United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 18

SEQ ID NO: 767942 - RNA, 20 nt, Human
accuggcuuccucuuggcau

SEQ ID NO: 767943 - RNA, 23 nt, Human
ucaucuguaaguaucuguggagu

SEQ ID NO: 767944 - RNA, 19 nt, Human
ccauggcaaugaucugaug

SEQ ID NO: 767945 - RNA, 22 nt, Human
agcugguguccuccuggagcug

SEQ ID NO: 767946 - RNA, 22 nt, Human
gaggucaggcuugcagcagggu

SEQ ID NO: 767947 - RNA, 22 nt, Human
agaaaccagacuuggcccauuu

SEQ ID NO: 767948 - RNA, 22 nt, Human
aaaguguaaggaauuuaaguaa

SEQ ID NO: 767949 - RNA, 22 nt, Human
gugggugauguacuggaggcca

SEQ ID NO: 767950 - RNA, 22 nt, Human
uccaggcauagaaggcacgcac

SEQ ID NO: 767951 - RNA, 22 nt, Human
cacuuuauauucuaagacggcc

SEQ ID NO: 767952 - RNA, 22 nt, Human
ugaacuuuugcacagaggauuu

SEQ ID NO: 767953 - RNA, 22 nt, Human
guuuucagccaggagcacauuu

SEQ ID NO: 767954 - RNA, 22 nt, Human
uuuaaacaaauaggauugccua

SEQ ID NO: 767955 - RNA, 22 nt, Human
gaugucuuggucaacuugggcu

SEQ ID NO: 767956 - RNA, 22 nt, Human
agacugggguucuggcaaggag

SEQ ID NO: 767957 - RNA, 19 nt, Human
ggagaggcuggagggaugc

SEQ ID NO: 767958 - RNA, 22 nt, Human
cuguccugugucagccugaaau

SEQ ID NO: 767959 - RNA, 22 nt, Human
uggugggggaggcugucuagca

SEQ ID NO: 767960 - RNA, 22 nt, Human
gggcuguguacuaugaggaggg

SEQ ID NO: 767961 - RNA, 22 nt, Human
gggaccugggccagaggacagu

SEQ ID NO: 767962 - RNA, 22 nt, Human
cucacagagcucauacugggag

SEQ ID NO: 767963 - RNA, 22 nt, Human
aggccacacaacucuuagagau

SEQ ID NO: 767964 - RNA, 22 nt, Human
auguauguaugcugugcuugca

SEQ ID NO: 767965 - RNA, 22 nt, Human
aaagugcacucucagugcugcu

SEQ ID NO: 767966 - RNA, 22 nt, Human
gagccauuguccaagccuguuu

SEQ ID NO: 767967 - RNA, 17 nt, Human
gucagcagcuugcuugu

SEQ ID NO: 767968 - RNA, 22 nt, Human
uaugcagcaccacucacugcag

SEQ ID NO: 767969 - RNA, 22 nt, Human
gaccacagaggugugggagaga

SEQ ID NO: 767970 - RNA, 22 nt, Human
acugauaaguugcuugcucuca

SEQ ID NO: 767971 - RNA, 22 nt, Human
aagaauaaguagaugggagaag

SEQ ID NO: 767972 - RNA, 22 nt, Human
ucuggcucaggagcuguguuca

SEQ ID NO: 767973 - RNA, 22 nt, Human
auucagaagcaaucacagugag

SEQ ID NO: 767974 - RNA, 22 nt, Human
uggccugggccugccggugcaa

SEQ ID NO: 767975 - RNA, 22 nt, Human
auguagaauuccuucuacuuug

SEQ ID NO: 767976 - RNA, 22 nt, Human
acuaguauaauugcccuaaccu

SEQ ID NO: 767977 - RNA, 22 nt, Human
uaaaaucagccgaccauggugg

SEQ ID NO: 767978 - RNA, 22 nt, Human
gccacccuuaucccaugcuucu

SEQ ID NO: 767979 - RNA, 21 nt, Human
ugcuccaggagggggcagucc

SEQ ID NO: 767980 - RNA, 22 nt, Human
auuguugggucucacuccuaga

SEQ ID NO: 767981 - RNA, 22 nt, Human
auguuuccuguuggauuggccc

SEQ ID NO: 767982 - RNA, 22 nt, Human
cacacagacagcucucugaaga

SEQ ID NO: 767983 - RNA, 22 nt, Human
augggcagagcuggugggaggc

SEQ ID NO: 767984 - RNA, 22 nt, Human
gcccugagaaugugugugucua

SEQ ID NO: 767985 - RNA, 22 nt, Human
ugucauuuaauagauaugaugg

SEQ ID NO: 767986 - RNA, 22 nt, Human
uauguguuauuugguauacauu

SEQ ID NO: 767987 - RNA, 22 nt, Human
ggcaucucggaacacgccuccg

SEQ ID NO: 767988 - RNA, 20 nt, Human
agaguagagguagauuuaug

SEQ ID NO: 767989 - RNA, 22 nt, Human
uuauuugugaaucauuuaucua

SEQ ID NO: 767990 - RNA, 22 nt, Human
cuccaguaucuguaggaaaagg

SEQ ID NO: 767991 - RNA, 22 nt, Human
gagacacuugcugugaggucgc

SEQ ID NO: 767992 - RNA, 22 nt, Human
cugggcuguaauguggcacuga

SEQ ID NO: 767993 - RNA, 22 nt, Human
ugcccauguuucucuguauccc

SEQ ID NO: 767994 - RNA, 23 nt, Human
ucaaacagguuucagagcaucuu

SEQ ID NO: 767995 - RNA, 22 nt, Human
aaguccaaggcugggugcagug

SEQ ID NO: 767996 - RNA, 22 nt, Human
guucaaauggcugcaguuacca

SEQ ID NO: 767997 - RNA, 22 nt, Human
ucuggccacuugcuucacacug

SEQ ID NO: 767998 - RNA, 22 nt, Human
auguuagaaucucugaaugugg

SEQ ID NO: 767999 - RNA, 22 nt, Human
uggcugagggggcucugcucag

SEQ ID NO: 768000 - RNA, 22 nt, Human
gcagggcuguggacacuuuggu

SEQ ID NO: 768001 - RNA, 20 nt, Human
aauaaacuacugagagaugu

SEQ ID NO: 768002 - RNA, 22 nt, Human
cacagcuggggaagcugaggcc

SEQ ID NO: 768003 - RNA, 22 nt, Human
ucuuugaucagccuuucacuga

SEQ ID NO: 768004 - RNA, 22 nt, Human
uaagaacaguguuucaucucua

SEQ ID NO: 768005 - RNA, 22 nt, Human
ucuuuguaaguuauauguagua

SEQ ID NO: 768006 - RNA, 22 nt, Human
uccuccaggauaaaauguguug

SEQ ID NO: 768007 - RNA, 22 nt, Human
aaggaagagaauccuucucaga

SEQ ID NO: 768008 - RNA, 22 nt, Human
ugcauauuguccuugauauuau

SEQ ID NO: 768009 - RNA, 22 nt, Human
uguggcccagaugagugugcua

SEQ ID NO: 768010 - RNA, 22 nt, Human
uucucugguaaacacaugcgua

SEQ ID NO: 768011 - RNA, 22 nt, Human
aauuaauauuuguggaauuaau

SEQ ID NO: 768012 - RNA, 22 nt, Human
uagcuaggguaagacuuggacc

SEQ ID NO: 768013 - RNA, 22 nt, Human
gugaauauucuuugugcaguau

SEQ ID NO: 768014 - RNA, 22 nt, Human
uuugacucaagccuuucuuuag

SEQ ID NO: 768015 - RNA, 22 nt, Human
agggcugaugcaccauguagcc

SEQ ID NO: 768016 - RNA, 22 nt, Human
gcuggccauggggagugaggag

SEQ ID NO: 768017 - RNA, 22 nt, Human
ugauguaagagauacacuugau

SEQ ID NO: 768018 - RNA, 23 nt, Human
uuuggacuugugacucuucuccu

SEQ ID NO: 768019 - RNA, 22 nt, Human
uuucuucagagagagcuuuccc

SEQ ID NO: 768020 - RNA, 22 nt, Human
cagagucccagaugccccuccu

SEQ ID NO: 768021 - RNA, 22 nt, Human
uuugacaaauaggggaauaagg

SEQ ID NO: 768022 - RNA, 22 nt, Human
ugugaggagggucaaacugagu

SEQ ID NO: 768023 - RNA, 23 nt, Human
caaaccuguuucucucaccuguc

SEQ ID NO: 768024 - RNA, 22 nt, Human
ggcaccaggaucagucugucau

SEQ ID NO: 768025 - RNA, 22 nt, Human
cagugucuacaguggcuggagg

SEQ ID NO: 768026 - RNA, 22 nt, Human
cuggagugaggucugggagccu

SEQ ID NO: 768027 - RNA, 22 nt, Human
aggccagcaugcaguucuaagg

SEQ ID NO: 768028 - RNA, 22 nt, Human
agggcccaguggagagcugagc

SEQ ID NO: 768029 - RNA, 22 nt, Human
uuguucuuuauccuggaagccu

SEQ ID NO: 768030 - RNA, 22 nt, Human
auccaaaauuuacuguagcauu

SEQ ID NO: 768031 - RNA, 22 nt, Human
ugagguucaguucuuggccaca

SEQ ID NO: 768032 - RNA, 22 nt, Human
uuucuguggauuuuccauucaa

SEQ ID NO: 768033 - RNA, 21 nt, Human
acucaaguggagaugccaggu

SEQ ID NO: 768034 - RNA, 22 nt, Human
uccucaucucggaaccugccac

SEQ ID NO: 768035 - RNA, 22 nt, Human
caggcuccacuguaggcagcuc

SEQ ID NO: 768036 - RNA, 22 nt, Human
aagauguaaaggcaauauaaag

SEQ ID NO: 768037 - RNA, 22 nt, Human
uggcucucuacaggucaagacc

SEQ ID NO: 768038 - RNA, 22 nt, Human
uagcaaagaccaaagcuaguug

SEQ ID NO: 768039 - RNA, 22 nt, Human
auacuucuuugauguucacagg

SEQ ID NO: 768040 - RNA, 22 nt, Human
agacaaauaacuuuuuaugucc

SEQ ID NO: 768041 - RNA, 22 nt, Human
gagaugcuuuguguauagacaa

SEQ ID NO: 768042 - RNA, 22 nt, Human
uagaaacuagauugauagcgga

SEQ ID NO: 768043 - RNA, 22 nt, Human
gcugcugggcacccccugagcu

SEQ ID NO: 768044 - RNA, 22 nt, Human
uuccugaagucaaagaucuaaa

SEQ ID NO: 768045 - RNA, 22 nt, Human
cguagguggcucagcaccuggg

SEQ ID NO: 768046 - RNA, 20 nt, Human
aauccugggacagaggcagg

SEQ ID NO: 768047 - RNA, 22 nt, Human
aggugggcacuccgcucgaggu

SEQ ID NO: 768048 - RNA, 22 nt, Human
agaguagccucauagacacuca

SEQ ID NO: 768049 - RNA, 22 nt, Human
uuuccugugcuuaacaaauauu

SEQ ID NO: 768050 - RNA, 22 nt, Human
ggcucuggagacauguggagag

SEQ ID NO: 768051 - RNA, 22 nt, Human
caaagucccagcugcuuagaga

SEQ ID NO: 768052 - RNA, 22 nt, Human
ugcugaagggaaggucuugaau

SEQ ID NO: 768053 - RNA, 22 nt, Human
acauccagaucucagcauggcu

SEQ ID NO: 768054 - RNA, 22 nt, Human
ggaaagagggacccagcuuggu

SEQ ID NO: 768055 - RNA, 19 nt, Human
gccacuccugaugcugccc

SEQ ID NO: 768056 - RNA, 22 nt, Human
auugaacagaaaaacucagaga

SEQ ID NO: 768057 - RNA, 18 nt, Human
uuuauuccugcccccagc

SEQ ID NO: 768058 - RNA, 18 nt, Human
uagagggggccugggcau

SEQ ID NO: 768059 - RNA, 22 nt, Human
cucugggcaaguuucuucauga

SEQ ID NO: 768060 - RNA, 22 nt, Human
caugucaacaggcccagaaaau

SEQ ID NO: 768061 - RNA, 22 nt, Human
ugcagaagcagagaguugccaa

SEQ ID NO: 768062 - RNA, 22 nt, Human
uauuccaaugucaguuauauca

SEQ ID NO: 768063 - RNA, 20 nt, Human
auccuuaaagagaauuucua

SEQ ID NO: 768064 - RNA, 17 nt, Human
acacagagauuaacaca

SEQ ID NO: 768065 - RNA, 22 nt, Human
uaggagaggugaauggcacacu

SEQ ID NO: 768066 - RNA, 22 nt, Human
caggcugcuccaggguaggaaa

SEQ ID NO: 768067 - RNA, 22 nt, Human
uugauucuggugacugauggaa

SEQ ID NO: 768068 - RNA, 22 nt, Human
caggaggaagaacucugcaaca

SEQ ID NO: 768069 - RNA, 22 nt, Human
ggaacuggagaaugcccucuuu

SEQ ID NO: 768070 - RNA, 22 nt, Human
aagcagcagccaucccccaagg

SEQ ID NO: 768071 - RNA, 22 nt, Human
cccagaaugauucagcgacagu

SEQ ID NO: 768072 - RNA, 22 nt, Human
gcuggccugucuagagccuuac

SEQ ID NO: 768073 - RNA, 22 nt, Human
ggccagcugccaccagcccuau

SEQ ID NO: 768074 - RNA, 22 nt, Human
agagcugugaaaaugagguuug

SEQ ID NO: 768075 - RNA, 22 nt, Human
aaaguguacuaugucaugaaca

SEQ ID NO: 768076 - RNA, 22 nt, Human
gggaaggagguggaccugcccc

SEQ ID NO: 768077 - RNA, 22 nt, Human
cucuuuccucgaugggcuccug

SEQ ID NO: 768078 - RNA, 22 nt, Human
uccagagcaggugucuacacag

SEQ ID NO: 768079 - RNA, 22 nt, Human
ugcagaagauggucugagcacc

SEQ ID NO: 768080 - RNA, 22 nt, Human
ccagcaucagcauugucuuagg

SEQ ID NO: 768081 - RNA, 22 nt, Human
ugggccugauuuaucaucuuca

SEQ ID NO: 768082 - RNA, 23 nt, Human
ucucugggugggcugugucuaua

SEQ ID NO: 768083 - RNA, 22 nt, Human
gcugucuggaggcucugaggga

SEQ ID NO: 768084 - RNA, 21 nt, Human
agacagcuuuaaagacacagg

SEQ ID NO: 768085 - RNA, 22 nt, Human
acauuaacaccgugaguuuggu

SEQ ID NO: 768086 - RNA, 22 nt, Human
ccuggcugucguuuugugaaau

SEQ ID NO: 768087 - RNA, 22 nt, Human
caggguggcacaucacagcauu

SEQ ID NO: 768088 - RNA, 22 nt, Human
aguuuaacuuuggaaaacuaua

SEQ ID NO: 768089 - RNA, 22 nt, Human
gggcugaccccaccccucacuc

SEQ ID NO: 768090 - RNA, 22 nt, Human
augcgugugugcaaaccauugc

SEQ ID NO: 768091 - RNA, 22 nt, Human
gcugccucuccugaguugacag

SEQ ID NO: 768092 - RNA, 22 nt, Human
augaugaagcaugguuacacug

SEQ ID NO: 768093 - RNA, 22 nt, Human
aagcagagaaaagcuuagguuc

SEQ ID NO: 768094 - RNA, 22 nt, Human
ccuggcacaagagcagcauugg

SEQ ID NO: 768095 - RNA, 22 nt, Human
aaaggcagaguuguuggaggca

SEQ ID NO: 768096 - RNA, 20 nt, Human
auucagaauaggcauguaaa

SEQ ID NO: 768097 - RNA, 22 nt, Human
aguucacugcuuaagccuuuga

SEQ ID NO: 768098 - RNA, 20 nt, Human
ucacagaaugccugaagaag

SEQ ID NO: 768099 - RNA, 22 nt, Human
uggcaucucaaacaggcagauu

SEQ ID NO: 768100 - RNA, 17 nt, Human
augugucuagugcaacc

SEQ ID NO: 768101 - RNA, 22 nt, Human
aaagcagcugcucuggccuuga

SEQ ID NO: 768102 - RNA, 22 nt, Human
aggcacuguacuagguacaggg

SEQ ID NO: 768103 - RNA, 22 nt, Human
ucagccucagguguucagauuu

SEQ ID NO: 768104 - RNA, 17 nt, Human
ggccauggugcaagguu

SEQ ID NO: 768105 - RNA, 22 nt, Human
uuucacagcauauagguguacu

SEQ ID NO: 768106 - RNA, 22 nt, Human
ccugccaggagcuggugcugca

SEQ ID NO: 768107 - RNA, 22 nt, Human
guggggaaaggaguggggcuca

SEQ ID NO: 768108 - RNA, 22 nt, Human
uaaggccaaguucauauacaac

SEQ ID NO: 768109 - RNA, 22 nt, Human
uauggcaagagaaucaacugaa

SEQ ID NO: 768110 - RNA, 22 nt, Human
uuucaaagguggaagagugaau

SEQ ID NO: 768111 - RNA, 22 nt, Human
agaagugccauacuguggucca

SEQ ID NO: 768112 - RNA, 22 nt, Human
ugagguuauuuauuaugcauga

SEQ ID NO: 768113 - RNA, 22 nt, Human
aaagaugcauaaaugccaaugg

SEQ ID NO: 768114 - RNA, 22 nt, Human
aguaugaauacagauuuucucu

SEQ ID NO: 768115 - RNA, 22 nt, Human
agauggcugauuaacuccaugg

SEQ ID NO: 768116 - RNA, 22 nt, Human
ccagugcgcaggcgccaccugu

SEQ ID NO: 768117 - RNA, 22 nt, Human
agucucagggccacccggggaa

SEQ ID NO: 768118 - RNA, 22 nt, Human
ccugcccacuccaggagcaacu

SEQ ID NO: 768119 - RNA, 18 nt, Human
gccugcaggcacgggggu

SEQ ID NO: 768120 - RNA, 21 nt, Human
uaggaacuguucugagugguc

SEQ ID NO: 768121 - RNA, 22 nt, Human
gacauuuguuccucuaagugac

SEQ ID NO: 768122 - RNA, 22 nt, Human
uggaggccaggaaggcagcgag

SEQ ID NO: 768123 - RNA, 22 nt, Human
aaugcucucugccauagcuaac

SEQ ID NO: 768124 - RNA, 22 nt, Human
cagaggauucccuagugaccug

SEQ ID NO: 768125 - RNA, 22 nt, Human
uugagcauuuguuuugaaagag

SEQ ID NO: 768126 - RNA, 22 nt, Human
uaucuguucuuagcuauagaug

SEQ ID NO: 768127 - RNA, 22 nt, Human
cgcuggucaccauggcguccug

SEQ ID NO: 768128 - RNA, 22 nt, Human
auguguauuuccaucgaucagc

SEQ ID NO: 768129 - RNA, 22 nt, Human
ucucugagcccaauguagcaau

SEQ ID NO: 768130 - RNA, 22 nt, Human
aaagcagcagcaccugcauuuc

SEQ ID NO: 768131 - RNA, 22 nt, Human
ugacaguagaagaugcuguuac

SEQ ID NO: 768132 - RNA, 22 nt, Human
gacagcaacacaugcuuagugc

SEQ ID NO: 768133 - RNA, 21 nt, Human
agcuauuucagauuugagagc

SEQ ID NO: 768134 - RNA, 22 nt, Human
gggucagggcuggcugucguca

SEQ ID NO: 768135 - RNA, 22 nt, Human
cugcacaguggguggggcguca

SEQ ID NO: 768136 - RNA, 22 nt, Human
cugucucucuaggacacugggg

SEQ ID NO: 768137 - RNA, 22 nt, Human
ccaggcuguaaacaccuucaaa

SEQ ID NO: 768138 - RNA, 22 nt, Human
aggagggagaugcccauccugg

SEQ ID NO: 768139 - RNA, 22 nt, Human
ccaggcugcuguugguguccgc

SEQ ID NO: 768140 - RNA, 22 nt, Human
gucaaacaaauuaacauaucca

SEQ ID NO: 768141 - RNA, 22 nt, Human
aacagaggcucccugcacuugu

SEQ ID NO: 768142 - RNA, 22 nt, Human
auuuguuuaucgucgauuguag

SEQ ID NO: 768143 - RNA, 22 nt, Human
uuuauauuaccuggaauagcuu

SEQ ID NO: 768144 - RNA, 22 nt, Human
ucagcaggcaggaggcaugcca

SEQ ID NO: 768145 - RNA, 22 nt, Human
caucuguuuuugucaauuacau

SEQ ID NO: 768146 - RNA, 22 nt, Human
cugggugauuccuguccaggca

SEQ ID NO: 768147 - RNA, 22 nt, Human
cugcuucauagcccuggucucu

SEQ ID NO: 768148 - RNA, 22 nt, Human
cacgaggccaucuccuucugga

SEQ ID NO: 768149 - RNA, 22 nt, Human
ugaguccugucuuugucacuua

SEQ ID NO: 768150 - RNA, 22 nt, Human
gucugucucucuccagagugca

SEQ ID NO: 768151 - RNA, 22 nt, Human
uacaugcuuccaacugccccau

SEQ ID NO: 768152 - RNA, 22 nt, Human
ucugugcuaauuuauccuuccu

SEQ ID NO: 768153 - RNA, 22 nt, Human
ucaaaguagggguaagccaggc

SEQ ID NO: 768154 - RNA, 22 nt, Human
uaagacaagccucgcauuugua

SEQ ID NO: 768155 - RNA, 22 nt, Human
uauucuccccggaucagggcaa

SEQ ID NO: 768156 - RNA, 22 nt, Human
aagagccaagcagucaucaaua

SEQ ID NO: 768157 - RNA, 22 nt, Human
uagagguacuccccucaaaguu

SEQ ID NO: 768158 - RNA, 22 nt, Human
uuuucuguuacaaaguacagcg

SEQ ID NO: 768159 - RNA, 22 nt, Human
aaaguugaguuuuauguguuac

SEQ ID NO: 768160 - RNA, 22 nt, Human
caguucucuuuccacuggaggc

SEQ ID NO: 768161 - RNA, 22 nt, Human
ggcagggcuugucucugugaug

SEQ ID NO: 768162 - RNA, 22 nt, Human
gcacacagaacauuuggauccu

SEQ ID NO: 768163 - RNA, 22 nt, Human
uagagguauaccaaaaaggcau

SEQ ID NO: 768164 - RNA, 22 nt, Human
cuggccaguuguccuggcuugg

SEQ ID NO: 768165 - RNA, 19 nt, Human
cgcucuggguuucguguca

SEQ ID NO: 768166 - RNA, 20 nt, Human
aaaugaugggaauaaucuau

SEQ ID NO: 768167 - RNA, 22 nt, Human
gucagcuccuagcaccccccaa

SEQ ID NO: 768168 - RNA, 22 nt, Human
cuuuggagaagaaugcauccuu

SEQ ID NO: 768169 - RNA, 22 nt, Human
uaaugagaauucuuuuugggua

SEQ ID NO: 768170 - RNA, 20 nt, Human
agcuccaugaaguagucacu

SEQ ID NO: 768171 - RNA, 23 nt, Human
aacagcaggaugauagaggaggu

SEQ ID NO: 768172 - RNA, 22 nt, Human
gcucugucuucagcacacagua

SEQ ID NO: 768173 - RNA, 22 nt, Human
ugagagugauugguucgaaugu

SEQ ID NO: 768174 - RNA, 22 nt, Human
caugccugccuggugggcgugg

SEQ ID NO: 768175 - RNA, 22 nt, Human
agccccucuguagcuaauagua

SEQ ID NO: 768176 - RNA, 22 nt, Human
cagcccugugcuaagcacccuc

SEQ ID NO: 768177 - RNA, 22 nt, Human
gaguaaaauaggugagaaucaa

SEQ ID NO: 768178 - RNA, 22 nt, Human
ggcacagagcuccagccuuggc

SEQ ID NO: 768179 - RNA, 18 nt, Human
acagugcugucacugcuu

SEQ ID NO: 768180 - RNA, 22 nt, Human
uuugguuugccugaguacccuc

SEQ ID NO: 768181 - RNA, 22 nt, Human
gaggccaugaauggauguuccu

SEQ ID NO: 768182 - RNA, 22 nt, Human
acccacugucaucucugaccac

SEQ ID NO: 768183 - RNA, 22 nt, Human
auccuuaaaggaauucugauuu

SEQ ID NO: 768184 - RNA, 19 nt, Human
cugaaacacagagagggcu

SEQ ID NO: 768185 - RNA, 22 nt, Human
uuuuagaaagaucccuggcagg

SEQ ID NO: 768186 - RNA, 22 nt, Human
ugugugaggugguucugagaag

SEQ ID NO: 768187 - RNA, 22 nt, Human
ugacauuuaucaaagaaauggu

SEQ ID NO: 768188 - RNA, 22 nt, Human
uuuugagauggagucuugcucu

SEQ ID NO: 768189 - RNA, 22 nt, Human
ucccugugccuauaugugcuga

SEQ ID NO: 768190 - RNA, 22 nt, Human
uacaagucauuggaugaggaau

SEQ ID NO: 768191 - RNA, 22 nt, Human
gcagaauacugagagcugauug

SEQ ID NO: 768192 - RNA, 22 nt, Human
agccuuaaaugcuagauucaua

SEQ ID NO: 768193 - RNA, 22 nt, Human
uaauuauuaugacaacaauugc

SEQ ID NO: 768194 - RNA, 22 nt, Human
cauugaaauauggaaacugaug

SEQ ID NO: 768195 - RNA, 22 nt, Human
ggcugccugcuccuccugcacg

SEQ ID NO: 768196 - RNA, 22 nt, Human
ugugcauguaccuuauucugga

SEQ ID NO: 768197 - RNA, 22 nt, Human
cuggcaggagcauucacagagg

SEQ ID NO: 768198 - RNA, 22 nt, Human
ccuggagaggagaaagggccca

SEQ ID NO: 768199 - RNA, 22 nt, Human
cuguguccaauggccuuagcag

SEQ ID NO: 768200 - RNA, 22 nt, Human
ggcuguggucauuaggagguug

SEQ ID NO: 768201 - RNA, 22 nt, Human
gggcaguggcucacgccuguaa

SEQ ID NO: 768202 - RNA, 22 nt, Human
caggaaauaucucaacacuuua

SEQ ID NO: 768203 - RNA, 22 nt, Human
cauaccuuucucaagcacaugu

SEQ ID NO: 768204 - RNA, 22 nt, Human
uuguuauuuacaacaauccuau

SEQ ID NO: 768205 - RNA, 22 nt, Human
ucauuauuuuggacuggagugu

SEQ ID NO: 768206 - RNA, 22 nt, Human
uaugccagggacuguuucacca

SEQ ID NO: 768207 - RNA, 22 nt, Human
cauaagaaauaaugaugaugac

SEQ ID NO: 768208 - RNA, 23 nt, Human
ugugccauugaggcugaggcuca

SEQ ID NO: 768209 - RNA, 22 nt, Human
aaagacacaugucucuuagauu

SEQ ID NO: 768210 - RNA, 22 nt, Human
augagguaauacuuucaguccu

SEQ ID NO: 768211 - RNA, 22 nt, Human
uccaggagguugagacugcagu

SEQ ID NO: 768212 - RNA, 22 nt, Human
cagacauggaaauuuaguguua

SEQ ID NO: 768213 - RNA, 22 nt, Human
augucuugauauuuuacuguuu

SEQ ID NO: 768214 - RNA, 22 nt, Human
ucccagcagggccgaccagccu

SEQ ID NO: 768215 - RNA, 22 nt, Human
cuucugggugccugugaguguu

SEQ ID NO: 768216 - RNA, 22 nt, Human
gauauucaacuaaagugaauua

SEQ ID NO: 768217 - RNA, 22 nt, Human
ccaguguggacucucuccuuug

SEQ ID NO: 768218 - RNA, 19 nt, Human
augucuguugaauuucaua

SEQ ID NO: 768219 - RNA, 17 nt, Human
ucugggcuucagugguc

SEQ ID NO: 768220 - RNA, 22 nt, Human
cugggccagcaacugcaaugga

SEQ ID NO: 768221 - RNA, 22 nt, Human
gugugcagggggccagcgcagc

SEQ ID NO: 768222 - RNA, 22 nt, Human
ucuguuauauagauaaugugug

SEQ ID NO: 768223 - RNA, 22 nt, Human
gugaggagucugaagcacauaa

SEQ ID NO: 768224 - RNA, 22 nt, Human
uaaguuacacuuaacuuacuag

SEQ ID NO: 768225 - RNA, 22 nt, Human
cugucuguuucugauucaaccu

SEQ ID NO: 768226 - RNA, 20 nt, Human
ucauggcugcugagagguuc

SEQ ID NO: 768227 - RNA, 22 nt, Human
guuaaacauugcuccacggguu

SEQ ID NO: 768228 - RNA, 22 nt, Human
cucugggcuccuucagcccuuu

SEQ ID NO: 768229 - RNA, 22 nt, Human
gccaggacuagagggaggugag

SEQ ID NO: 768230 - RNA, 22 nt, Human
gugagcaguugugagccccaaa

SEQ ID NO: 768231 - RNA, 22 nt, Human
ugguccugagaauccuguccuc

SEQ ID NO: 768232 - RNA, 22 nt, Human
ucaauuucuugguuugauaaua

SEQ ID NO: 768233 - RNA, 22 nt, Human
gacagcuucuugggccgggccu

SEQ ID NO: 768234 - RNA, 22 nt, Human
aagcugccagcugagcugaggc

SEQ ID NO: 768235 - RNA, 22 nt, Human
cugaaggcugaggcuguguugu

SEQ ID NO: 768236 - RNA, 22 nt, Human
cuggagccuagguugaccuggg

SEQ ID NO: 768237 - RNA, 15 nt, Human
uugcuuuaagacaug

SEQ ID NO: 768238 - RNA, 22 nt, Human
gaauuacaugacccugaguaga

SEQ ID NO: 768239 - RNA, 22 nt, Human
aggcuucuaggaaacuuucugg

SEQ ID NO: 768240 - RNA, 22 nt, Human
cagggccuccuaaggcaucuaa

SEQ ID NO: 768241 - RNA, 22 nt, Human
cggcuggguucggcugcaggcc

SEQ ID NO: 768242 - RNA, 22 nt, Human
agcaauguaaacccugaaguug

SEQ ID NO: 768243 - RNA, 22 nt, Human
ugggcaaguaucggacucugag

SEQ ID NO: 768244 - RNA, 22 nt, Human
cagcacagaguauuuuauugau

SEQ ID NO: 768245 - RNA, 22 nt, Human
uuagugcaaaccucagagacac

SEQ ID NO: 768246 - RNA, 18 nt, Human
ucugaaagcccuuuucca

SEQ ID NO: 768247 - RNA, 22 nt, Human
cccugccugugggcaucaacau

SEQ ID NO: 768248 - RNA, 22 nt, Human
gugcagguguuuuggcugccag

SEQ ID NO: 768249 - RNA, 22 nt, Human
ucugaacuccagcccugcucuc

SEQ ID NO: 768250 - RNA, 22 nt, Human
acuuucuucuacuacuuggaga

SEQ ID NO: 768251 - RNA, 22 nt, Human
uggaagcacuuggguuuuguug

SEQ ID NO: 768252 - RNA, 22 nt, Human
uguggaaaaaccacaaguuugg

SEQ ID NO: 768253 - RNA, 22 nt, Human
gaaguucucaaggaucacagaa

SEQ ID NO: 768254 - RNA, 22 nt, Human
uguggcuuuugcuagcuuugca

SEQ ID NO: 768255 - RNA, 22 nt, Human
caagcagaaaucuagaacucca

SEQ ID NO: 768256 - RNA, 22 nt, Human
agcucaggucucaggagguguc

SEQ ID NO: 768257 - RNA, 22 nt, Human
aagagcaggcugucaauggggc

SEQ ID NO: 768258 - RNA, 22 nt, Human
cagcaagccaaauguggcccga

SEQ ID NO: 768259 - RNA, 22 nt, Human
gcacacccucucaccagcacug

SEQ ID NO: 768260 - RNA, 21 nt, Human
ggauggauagggaagagauuu

SEQ ID NO: 768261 - RNA, 22 nt, Human
aaaagcacuacaauuucgcuuc

SEQ ID NO: 768262 - RNA, 22 nt, Human
cacauacaaugguguuauuugg

SEQ ID NO: 768263 - RNA, 22 nt, Human
ucuguaucuaauuuuacaguag

SEQ ID NO: 768264 - RNA, 22 nt, Human
accaggcuugaugauuugcuua

SEQ ID NO: 768265 - RNA, 22 nt, Human
cccugugguugcuagggcacag

SEQ ID NO: 768266 - RNA, 22 nt, Human
cuucuucugguuuauguggcaa

SEQ ID NO: 768267 - RNA, 22 nt, Human
ucagcaggugccucagauucuu

SEQ ID NO: 768268 - RNA, 22 nt, Human
gcuccaggagcucacagcucgc

SEQ ID NO: 768269 - RNA, 22 nt, Human
cagggcucgcucgcucgcucgc

SEQ ID NO: 768270 - RNA, 19 nt, Human
agggcugcucuggccuggg

SEQ ID NO: 768271 - RNA, 22 nt, Human
uaugucugaaucuuauuuaaau

SEQ ID NO: 768272 - RNA, 22 nt, Human
uucacauugugcagauuauggu

SEQ ID NO: 768273 - RNA, 22 nt, Human
ugcuggaauuuuucuaggauuu

SEQ ID NO: 768274 - RNA, 22 nt, Human
ggaggggccggcugccugccac

SEQ ID NO: 768275 - RNA, 22 nt, Human
aaacugcacaugaggcuggugc

SEQ ID NO: 768276 - RNA, 22 nt, Human
cugaugcuauaagccacagugg

SEQ ID NO: 768277 - RNA, 22 nt, Human
agagggcuggacgcagguugga

SEQ ID NO: 768278 - RNA, 22 nt, Human
accucucugggccugcuuccug

SEQ ID NO: 768279 - RNA, 22 nt, Human
aagaacaugguaggauaacaaa

SEQ ID NO: 768280 - RNA, 22 nt, Human
ggccaaggaugguggcucuggu

SEQ ID NO: 768281 - RNA, 22 nt, Human
ggaguggccucuccugugcagg

SEQ ID NO: 768282 - RNA, 22 nt, Human
cgcaggggaggaagguacaccu

SEQ ID NO: 768283 - RNA, 22 nt, Human
gcucuugauuuccaggagcuag

SEQ ID NO: 768284 - RNA, 22 nt, Human
uucauagcagucccuuucuggg

SEQ ID NO: 768285 - RNA, 22 nt, Human
uacauguuugguaaaugauggc

SEQ ID NO: 768286 - RNA, 22 nt, Human
agcaauuucccaucucuucugc

SEQ ID NO: 768287 - RNA, 22 nt, Human
ugcugagguuucgucugcuugc

SEQ ID NO: 768288 - RNA, 22 nt, Human
ggcuuccaugugaaauucuuug

SEQ ID NO: 768289 - RNA, 22 nt, Human
aauagcuuucucaugacuucac

SEQ ID NO: 768290 - RNA, 22 nt, Human
cagcucuuccauuuccuucagc

SEQ ID NO: 768291 - RNA, 22 nt, Human
auucuuugcaucucuggguggc

SEQ ID NO: 768292 - RNA, 22 nt, Human
gcaggagucagcccuaccuuga

SEQ ID NO: 768293 - RNA, 22 nt, Human
ucuucuuuaugucauaugccag

SEQ ID NO: 768294 - RNA, 22 nt, Human
caggaacccccacucucagcuc

SEQ ID NO: 768295 - RNA, 20 nt, Human
cagguccagcacgugcacgg

SEQ ID NO: 768296 - RNA, 22 nt, Human
cuuucucaaugccggaaggcac

SEQ ID NO: 768297 - RNA, 22 nt, Human
uuugccucucagagucuacaca

SEQ ID NO: 768298 - RNA, 19 nt, Human
caacaguacugguuugucc

SEQ ID NO: 768299 - RNA, 22 nt, Human
aucauccacuggagccggcagg

SEQ ID NO: 768300 - RNA, 22 nt, Human
cagugggcugugauggauucac

SEQ ID NO: 768301 - RNA, 22 nt, Human
agggcagcuuccauagucuggc

SEQ ID NO: 768302 - RNA, 22 nt, Human
aguuagaauagucagauuguag

SEQ ID NO: 768303 - RNA, 22 nt, Human
uucuuacaaguaugacguagca

SEQ ID NO: 768304 - RNA, 17 nt, Human
cugcuuggccucugggg

SEQ ID NO: 768305 - RNA, 19 nt, Human
ccuuugaaucaggacacuu

SEQ ID NO: 768306 - RNA, 22 nt, Human
gcaucuaaacuugcaucauugu

SEQ ID NO: 768307 - RNA, 22 nt, Human
aacaucagcacacaauagcaag

SEQ ID NO: 768308 - RNA, 22 nt, Human
uuuggaauuggcauucuauucu

SEQ ID NO: 768309 - RNA, 22 nt, Human
ccucauucuuuccugggccccu

SEQ ID NO: 768310 - RNA, 22 nt, Human
agugcuggagggaggcagguuc

SEQ ID NO: 768311 - RNA, 22 nt, Human
agucccagcucagaaccacuag

SEQ ID NO: 768312 - RNA, 22 nt, Human
ucagucaccuugacuauagcug

SEQ ID NO: 768313 - RNA, 21 nt, Human
uguggcugacacccuuuggga

SEQ ID NO: 768314 - RNA, 22 nt, Human
agggaagaagcugguaguaggu

SEQ ID NO: 768315 - RNA, 22 nt, Human
uaagaaugacaaccauaccauu

SEQ ID NO: 768316 - RNA, 22 nt, Human
auaucaaagcuaguggaaauuu

SEQ ID NO: 768317 - RNA, 22 nt, Human
uguacaaagccagaacucccaa

SEQ ID NO: 768318 - RNA, 22 nt, Human
auuaaaguugaaauugaacuga

SEQ ID NO: 768319 - RNA, 22 nt, Human
uggccucugcaauggauucacc

SEQ ID NO: 768320 - RNA, 22 nt, Human
aggcaggcagggcucacugucu

SEQ ID NO: 768321 - RNA, 22 nt, Human
acucagugaauuuucaucaaau

SEQ ID NO: 768322 - RNA, 22 nt, Human
ggagaaaauugaugaaguuggc

SEQ ID NO: 768323 - RNA, 22 nt, Human
gacccuggcagauaccgucaca

SEQ ID NO: 768324 - RNA, 22 nt, Human
aguacaauuuaaugaagauagc

SEQ ID NO: 768325 - RNA, 22 nt, Human
ccccaggccuguuggauggcgc

SEQ ID NO: 768326 - RNA, 22 nt, Human
ugggcagccaucccagccucuc

SEQ ID NO: 768327 - RNA, 22 nt, Human
aacuucaaaugugacuuugcau

SEQ ID NO: 768328 - RNA, 22 nt, Human
cccuuuaaguagaauauauuau

SEQ ID NO: 768329 - RNA, 22 nt, Human
cagaucugcuccucuguccaug

SEQ ID NO: 768330 - RNA, 22 nt, Human
cccagcacuuugaauaugucac

SEQ ID NO: 768331 - RNA, 22 nt, Human
cucuggggaaauggauauguac

SEQ ID NO: 768332 - RNA, 22 nt, Human
guauuuuaagugacuacuaggu

SEQ ID NO: 768333 - RNA, 22 nt, Human
agcaagauuuuccuugaauguu

SEQ ID NO: 768334 - RNA, 22 nt, Human
cugaagacugcugagaaguuac

SEQ ID NO: 768335 - RNA, 22 nt, Human
ccccauccuauucauguuucug

SEQ ID NO: 768336 - RNA, 22 nt, Human
acagugucucacugcugaaauc

SEQ ID NO: 768337 - RNA, 22 nt, Human
guccuucauggaguuacagccu

SEQ ID NO: 768338 - RNA, 22 nt, Human
uucaggagugucaggagugccu

SEQ ID NO: 768339 - RNA, 22 nt, Human
caguacaauuuuacaaaggacg

SEQ ID NO: 768340 - RNA, 22 nt, Human
aacaagcagaugcaaugcacuu

SEQ ID NO: 768341 - RNA, 22 nt, Human
uaugugcaugcugacuugagga

SEQ ID NO: 768342 - RNA, 22 nt, Human
auauaggcuaacaacuauugag

SEQ ID NO: 768343 - RNA, 22 nt, Human
uggcccagcaguucugccccag

SEQ ID NO: 768344 - RNA, 22 nt, Human
gggagucagugaaggagucaga

SEQ ID NO: 768345 - RNA, 22 nt, Human
auguguuuauaauuacucaauc

SEQ ID NO: 768346 - RNA, 22 nt, Human
ugaagacaagaaaacacugggg

SEQ ID NO: 768347 - RNA, 22 nt, Human
ucuacacugggggcuuugagca

SEQ ID NO: 768348 - RNA, 22 nt, Human
ccuguacaucugcucucauugc

SEQ ID NO: 768349 - RNA, 21 nt, Human
gcucagaguauugcacuguuu

SEQ ID NO: 768350 - RNA, 22 nt, Human
ucuggcaggaccaugaagcgua

SEQ ID NO: 768351 - RNA, 22 nt, Human
gcaggcacuccuaggaccauca

SEQ ID NO: 768352 - RNA, 22 nt, Human
ucucuuaauuuuggaauagugu

SEQ ID NO: 768353 - RNA, 22 nt, Human
gggguacuggcuggagccccac

SEQ ID NO: 768354 - RNA, 22 nt, Human
aggcugucaucuuugcaggcag

SEQ ID NO: 768355 - RNA, 18 nt, Human
acccuggcaugcucuucc

SEQ ID NO: 768356 - RNA, 22 nt, Human
aaggcacuugcccagagcugca

SEQ ID NO: 768357 - RNA, 23 nt, Human
uuguuuuuagagguggcaugaga

SEQ ID NO: 768358 - RNA, 22 nt, Human
ccugaacaaauggcauagccaa

SEQ ID NO: 768359 - RNA, 22 nt, Human
cagagacaguuucacagggucu

SEQ ID NO: 768360 - RNA, 22 nt, Human
uuggcucaaaacuuagauucca

SEQ ID NO: 768361 - RNA, 22 nt, Human
acuaaaugaacuauuaauacuu

SEQ ID NO: 768362 - RNA, 22 nt, Human
gguggaugcugacuguucugcu

SEQ ID NO: 768363 - RNA, 22 nt, Human
agggucaacacuuuaaacauau

SEQ ID NO: 768364 - RNA, 22 nt, Human
cauggaaugugaguuguuuagu

SEQ ID NO: 768365 - RNA, 22 nt, Human
gccucucucuacccaguaugau

SEQ ID NO: 768366 - RNA, 22 nt, Human
augcucauuuuauugagaauga

SEQ ID NO: 768367 - RNA, 21 nt, Human
ggcagugaugugaagugcauc

SEQ ID NO: 768368 - RNA, 19 nt, Human
ugccuguggcgagcaucuu

SEQ ID NO: 768369 - RNA, 22 nt, Human
aggaggucagagccccaugcug

SEQ ID NO: 768370 - RNA, 22 nt, Human
gcagggcagcucacugugguuc

SEQ ID NO: 768371 - RNA, 23 nt, Human
ccugggcauuggcugcagcuucu

SEQ ID NO: 768372 - RNA, 22 nt, Human
aagcccugggauguucagcagu

SEQ ID NO: 768373 - RNA, 22 nt, Human
uuuuaauucaaagugaauagug

SEQ ID NO: 768374 - RNA, 22 nt, Human
auagcaaagaugucaauucccc

SEQ ID NO: 768375 - RNA, 20 nt, Human
gaaaauaggccagccaggua

SEQ ID NO: 768376 - RNA, 22 nt, Human
gcuagagaccagaggccuugaa

SEQ ID NO: 768377 - RNA, 22 nt, Human
aaaguuuuuaagcaagacccuu

SEQ ID NO: 768378 - RNA, 19 nt, Human
ugacacagcuagguuugcu

SEQ ID NO: 768379 - RNA, 22 nt, Human
aucucccaaauuagccucuuga

SEQ ID NO: 768380 - RNA, 19 nt, Human
uggcaguguggcuuccaga

SEQ ID NO: 768381 - RNA, 19 nt, Human
aggguccaggcccugugga

SEQ ID NO: 768382 - RNA, 22 nt, Human
gccagcuggagacuggcagggg

SEQ ID NO: 768383 - RNA, 22 nt, Human
agggcaugcuggaggagagaca

SEQ ID NO: 768384 - RNA, 22 nt, Human
uucagcagcuuuuaguacauug

SEQ ID NO: 768385 - RNA, 22 nt, Human
uuuuuguugcagagaggccacu

SEQ ID NO: 768386 - RNA, 22 nt, Human
gaggucaggugaggaauuaaga

SEQ ID NO: 768387 - RNA, 22 nt, Human
aggcuccaaauuaccaagcucu

SEQ ID NO: 768388 - RNA, 22 nt, Human
uaaccuggggccugaagaccau

SEQ ID NO: 768389 - RNA, 22 nt, Human
aaacaauccaggaaccuguuua

SEQ ID NO: 768390 - RNA, 22 nt, Human
agggaagccccgaggaggcacc

SEQ ID NO: 768391 - RNA, 22 nt, Human
aagacuuucucccaaauccuca

SEQ ID NO: 768392 - RNA, 22 nt, Human
aucuauaucaugggguaaggua

SEQ ID NO: 768393 - RNA, 22 nt, Human
caaagcugacgaggucagcauc

SEQ ID NO: 768394 - RNA, 22 nt, Human
gacaugcauuaagacacacuga

SEQ ID NO: 768395 - RNA, 22 nt, Human
agggcucauaauuccugacuuc

SEQ ID NO: 768396 - RNA, 22 nt, Human
gugguuguuuaggucguggauc

SEQ ID NO: 768397 - RNA, 22 nt, Human
ucucuacagauccuauauagaa

SEQ ID NO: 768398 - RNA, 22 nt, Human
aaaaaagauugaugguggaugc

SEQ ID NO: 768399 - RNA, 22 nt, Human
acacacuucacccuugagcuaa

SEQ ID NO: 768400 - RNA, 22 nt, Human
cuuaggaacacuuacugguacu

SEQ ID NO: 768401 - RNA, 22 nt, Human
aaagccagugguaugagagaaa

SEQ ID NO: 768402 - RNA, 22 nt, Human
ucuuucccaguagcucucccag

SEQ ID NO: 768403 - RNA, 18 nt, Human
uucacaggaaaugucuuu

SEQ ID NO: 768404 - RNA, 22 nt, Human
aaagugcauagaguagugccua

SEQ ID NO: 768405 - RNA, 22 nt, Human
uguggcagcugcugcaggagcu

SEQ ID NO: 768406 - RNA, 22 nt, Human
accagagcuggcucugagcacc

SEQ ID NO: 768407 - RNA, 17 nt, Human
aggcuggcucacaggga

SEQ ID NO: 768408 - RNA, 19 nt, Human
gagcccucuccauggccac

SEQ ID NO: 768409 - RNA, 22 nt, Human
gacagacacuguguccucacuu

SEQ ID NO: 768410 - RNA, 22 nt, Human
uuucagagaugucuagccuauu

SEQ ID NO: 768411 - RNA, 22 nt, Human
cuugaaguugcaaaacauuaau

SEQ ID NO: 768412 - RNA, 17 nt, Human
aucuggcugcuucuaga

SEQ ID NO: 768413 - RNA, 22 nt, Human
agggagcuuuuucaugugucua

SEQ ID NO: 768414 - RNA, 22 nt, Human
ucagauuuuugagaugucuguu

SEQ ID NO: 768415 - RNA, 22 nt, Human
auucucuguuuccaagaugaaa

SEQ ID NO: 768416 - RNA, 22 nt, Human
uguacauagaucuugaaaauua

SEQ ID NO: 768417 - RNA, 17 nt, Human
ugucuuaucuguccugu

SEQ ID NO: 768418 - RNA, 22 nt, Human
acccaggacacagagaugaccc

SEQ ID NO: 768419 - RNA, 23 nt, Human
uuuauauuccuaaugucuugagc

SEQ ID NO: 768420 - RNA, 22 nt, Human
ucagauuuuauuuuccuguuac

SEQ ID NO: 768421 - RNA, 22 nt, Human
uuugaacucagcuucagacaac

SEQ ID NO: 768422 - RNA, 22 nt, Human
ucugggcucugcgaagcccuuc

SEQ ID NO: 768423 - RNA, 22 nt, Human
gucuggaaauucaauuuaaugc

SEQ ID NO: 768424 - RNA, 22 nt, Human
gcagcaguggcugcagguccca

SEQ ID NO: 768425 - RNA, 22 nt, Human
aaucucuucccaguaaaaaugg

SEQ ID NO: 768426 - RNA, 22 nt, Human
augauuuuucagcagaggaucu

SEQ ID NO: 768427 - RNA, 22 nt, Human
gagggggcuagcgcagugccca

SEQ ID NO: 768428 - RNA, 22 nt, Human
ucagcuuucucagaggccuaac

SEQ ID NO: 768429 - RNA, 22 nt, Human
ugagaucauuuauuuaccuuuc

SEQ ID NO: 768430 - RNA, 22 nt, Human
uggcuucuucauaugugaucuu

SEQ ID NO: 768431 - RNA, 22 nt, Human
uacaucaaggaacaccugguau

SEQ ID NO: 768432 - RNA, 23 nt, Human
uucugcauguuucagagcuggga

SEQ ID NO: 768433 - RNA, 22 nt, Human
ucauaaagauacuaagugaguu

SEQ ID NO: 768434 - RNA, 22 nt, Human
ggucucuguugccuccaucaag

SEQ ID NO: 768435 - RNA, 22 nt, Human
augaggcaguacacacaaagcc

SEQ ID NO: 768436 - RNA, 22 nt, Human
uauaaaguuucgaaagauguau

SEQ ID NO: 768437 - RNA, 22 nt, Human
ccaggcagaugggccggcuuca

SEQ ID NO: 768438 - RNA, 22 nt, Human
uugauguacagaauuguucaca

SEQ ID NO: 768439 - RNA, 22 nt, Human
ggcuccaggcuccuauuucacu

SEQ ID NO: 768440 - RNA, 22 nt, Human
auggccaccaucucuaaaacac

SEQ ID NO: 768441 - RNA, 22 nt, Human
ggggacucugcuucugggauca

SEQ ID NO: 768442 - RNA, 22 nt, Human
gcucagugagauauugacucca

SEQ ID NO: 768443 - RNA, 23 nt, Human
gcugccaaggaggcaggggugcc

SEQ ID NO: 768444 - RNA, 22 nt, Human
cagcacaggaagugggccuuca

SEQ ID NO: 768445 - RNA, 22 nt, Human
caggaaaaucugcccacacaag

SEQ ID NO: 768446 - RNA, 22 nt, Human
cgaggcagacaaaaguuggaag

SEQ ID NO: 768447 - RNA, 22 nt, Human
ccaggcuuuguaccaggcuuuc

SEQ ID NO: 768448 - RNA, 22 nt, Human
uguguauaagugagaaugcugu

SEQ ID NO: 768449 - RNA, 22 nt, Human
guucugcuccuguggcaaucua

SEQ ID NO: 768450 - RNA, 22 nt, Human
acaggcagcacuaaucucuggu

SEQ ID NO: 768451 - RNA, 22 nt, Human
aaagucaucuaggagcagauuu

SEQ ID NO: 768452 - RNA, 22 nt, Human
caagcuggagguuggagcuacu

SEQ ID NO: 768453 - RNA, 20 nt, Human
gcccaugaggacugcagcug

SEQ ID NO: 768454 - RNA, 22 nt, Human
auuguucuaaggguuuaauuaa

SEQ ID NO: 768455 - RNA, 20 nt, Human
aaacacagccucucuuuaca

SEQ ID NO: 768456 - RNA, 22 nt, Human
aguguuucaccguauguucuca

SEQ ID NO: 768457 - RNA, 22 nt, Human
cuccuggcuuucccagaccagg

SEQ ID NO: 768458 - RNA, 21 nt, Human
cacucaggguaugugccaggc

SEQ ID NO: 768459 - RNA, 22 nt, Human
cuucuguggauguuggaugcau

SEQ ID NO: 768460 - RNA, 22 nt, Human
agaacagguucaggguauaaaa

SEQ ID NO: 768461 - RNA, 22 nt, Human
aaguauauacuaaauguuaauc

SEQ ID NO: 768462 - RNA, 22 nt, Human
aguuauugaguaucuauaaugu

SEQ ID NO: 768463 - RNA, 22 nt, Human
agagcccucucauuggcuuauu

SEQ ID NO: 768464 - RNA, 22 nt, Human
agaagcguuccauuugaugggu

SEQ ID NO: 768465 - RNA, 22 nt, Human
gggucgggcaggcgcccucguc

SEQ ID NO: 768466 - RNA, 22 nt, Human
uuaaucucuuagcaaauuaaug

SEQ ID NO: 768467 - RNA, 22 nt, Human
cagaugcuucgugggugagcac

SEQ ID NO: 768468 - RNA, 22 nt, Human
aguuuucugcuaaaccagcuaa

SEQ ID NO: 768469 - RNA, 22 nt, Human
agauccaugugauuuggaguuc

SEQ ID NO: 768470 - RNA, 22 nt, Human
ucugcuggucaaggcugggucc

SEQ ID NO: 768471 - RNA, 22 nt, Human
aaugaggccaguagaaggaagu

SEQ ID NO: 768472 - RNA, 22 nt, Human
gguggagcuggaccaggagagg

SEQ ID NO: 768473 - RNA, 22 nt, Human
auguguaugucuuauucaaaga

SEQ ID NO: 768474 - RNA, 18 nt, Human
ucccuucucccuugccuc

SEQ ID NO: 768475 - RNA, 17 nt, Human
uuucuccuuccaucuca

SEQ ID NO: 768476 - RNA, 21 nt, Human
ggguggccgcaugggugcgug

SEQ ID NO: 768477 - RNA, 22 nt, Human
auccaaacuaugacuaguguuc

SEQ ID NO: 768478 - RNA, 22 nt, Human
caccagcaccagcucugugccu

SEQ ID NO: 768479 - RNA, 22 nt, Human
ccucucauagucuguauccuuu

SEQ ID NO: 768480 - RNA, 22 nt, Human
guggcagagccgugcagguagg

SEQ ID NO: 768481 - RNA, 22 nt, Human
uuucagagaaagcccaaagacu

SEQ ID NO: 768482 - RNA, 22 nt, Human
cagcuuuaggacucauaauaaa

SEQ ID NO: 768483 - RNA, 22 nt, Human
cucuucuuuaguccagaccauc

SEQ ID NO: 768484 - RNA, 22 nt, Human
uucucuggagggcugcccggcc

SEQ ID NO: 768485 - RNA, 22 nt, Human
gagggcaguagccucguacccu

SEQ ID NO: 768486 - RNA, 22 nt, Human
aaacugcuuuccacaguggcua

SEQ ID NO: 768487 - RNA, 22 nt, Human
uaguggauguucagagauuuga

SEQ ID NO: 768488 - RNA, 22 nt, Human
acauucacaagccuacaagguu

SEQ ID NO: 768489 - RNA, 22 nt, Human
cccagacugcagagcgggcaga

SEQ ID NO: 768490 - RNA, 22 nt, Human
agggcucugugacuaucacugc

SEQ ID NO: 768491 - RNA, 22 nt, Human
gccucugcggagcuguacauca

SEQ ID NO: 768492 - RNA, 22 nt, Human
uagggcucagaguccaguuucu

SEQ ID NO: 768493 - RNA, 22 nt, Human
ucuuucugcagcacaggggcag

SEQ ID NO: 768494 - RNA, 22 nt, Human
gguacaaugucuuacagaccca

SEQ ID NO: 768495 - RNA, 20 nt, Human
uauucaacuuuaaaaacuua

SEQ ID NO: 768496 - RNA, 22 nt, Human
gacagggacucccugguuagaa

SEQ ID NO: 768497 - RNA, 22 nt, Human
auuauaugugggauagaauuua

SEQ ID NO: 768498 - RNA, 22 nt, Human
ccaaggcugagguuuccaguug

SEQ ID NO: 768499 - RNA, 22 nt, Human
cugaggccucuuuccuuggcuu

SEQ ID NO: 768500 - RNA, 22 nt, Human
cuagagaauggcaaagauuaga

SEQ ID NO: 768501 - RNA, 22 nt, Human
ccugcuccaugcucaccaucag

SEQ ID NO: 768502 - RNA, 22 nt, Human
ugcauguuuauaacagaugagg

SEQ ID NO: 768503 - RNA, 22 nt, Human
gcaggucuggcauagagccugc

SEQ ID NO: 768504 - RNA, 22 nt, Human
ugccugcuaggcccugcugggu

SEQ ID NO: 768505 - RNA, 22 nt, Human
uagcuguucccagcucugugua

SEQ ID NO: 768506 - RNA, 22 nt, Human
cucuuccuuucccuugagggug

SEQ ID NO: 768507 - RNA, 22 nt, Human
ugccccucuugagaagcucagc

SEQ ID NO: 768508 - RNA, 22 nt, Human
ccagagucugugugugucaucc

SEQ ID NO: 768509 - RNA, 22 nt, Human
agcagcagugugguuuggggaa

SEQ ID NO: 768510 - RNA, 22 nt, Human
uuacagauuaaaaugcugaggu

SEQ ID NO: 768511 - RNA, 22 nt, Human
ugugaaggagaugaagggagug

SEQ ID NO: 768512 - RNA, 22 nt, Human
ccagcugauucgguggugguug

SEQ ID NO: 768513 - RNA, 22 nt, Human
ucucugcccauccucaguccac

SEQ ID NO: 768514 - RNA, 22 nt, Human
gagcaaggauggccggggccgu

SEQ ID NO: 768515 - RNA, 21 nt, Human
cucugguuugcauuggauuau

SEQ ID NO: 768516 - RNA, 22 nt, Human
aucuuuacaagaaauucuuuua

SEQ ID NO: 768517 - RNA, 22 nt, Human
ggagacuaccuagcaggcuguu

SEQ ID NO: 768518 - RNA, 23 nt, Human
ccauucaucucagucauugcuuu

SEQ ID NO: 768519 - RNA, 22 nt, Human
gccuuccugcagcucugagcgu

SEQ ID NO: 768520 - RNA, 22 nt, Human
gacuugggggaagauguggcug

SEQ ID NO: 768521 - RNA, 22 nt, Human
agcagggccucuggcacugguc

SEQ ID NO: 768522 - RNA, 22 nt, Human
gcccagaacagugucacauguc

SEQ ID NO: 768523 - RNA, 22 nt, Human
aaugcuuucuuauaaccacugc

SEQ ID NO: 768524 - RNA, 22 nt, Human
ugggagaagacguacuuuagac

SEQ ID NO: 768525 - RNA, 22 nt, Human
ugcugugagguugagaaggaag

SEQ ID NO: 768526 - RNA, 21 nt, Human
ccugagggugguugugaagau

SEQ ID NO: 768527 - RNA, 22 nt, Human
uuugacauugaaagcagaaucg

SEQ ID NO: 768528 - RNA, 22 nt, Human
agggccugggucuguacuccuc

SEQ ID NO: 768529 - RNA, 22 nt, Human
aagacugucuuuucugagugac

SEQ ID NO: 768530 - RNA, 22 nt, Human
auauggaaguuaccugacuuca

SEQ ID NO: 768531 - RNA, 22 nt, Human
gccuugcuuugcuucuggacag

SEQ ID NO: 768532 - RNA, 22 nt, Human
cuccuggaggauagugacuggg

SEQ ID NO: 768533 - RNA, 22 nt, Human
guuaugauggcaccacugcacu

SEQ ID NO: 768534 - RNA, 22 nt, Human
ccauccaugaacgaggaagugg

SEQ ID NO: 768535 - RNA, 22 nt, Human
aaggcuguccaggagaaaauag

SEQ ID NO: 768536 - RNA, 22 nt, Human
ugagagugguucagcucagaag

SEQ ID NO: 768537 - RNA, 23 nt, Human
uccugccagaugacuccuuucuu

SEQ ID NO: 768538 - RNA, 22 nt, Human
cacugggaaucugggaaagaga

SEQ ID NO: 768539 - RNA, 22 nt, Human
guuguuuugcaggauccuuaca

SEQ ID NO: 768540 - RNA, 22 nt, Human
cagcuccugccugggcagcugu

SEQ ID NO: 768541 - RNA, 22 nt, Human
gaaggacccucuggggucucag

SEQ ID NO: 768542 - RNA, 22 nt, Human
gcugcagcucgccuuccggccu

SEQ ID NO: 768543 - RNA, 22 nt, Human
agggcuuuacuucucaguucua

SEQ ID NO: 768544 - RNA, 22 nt, Human
agagauuuacacaugccuuuuc

SEQ ID NO: 768545 - RNA, 22 nt, Human
gcagggcugacucagccacccu

SEQ ID NO: 768546 - RNA, 22 nt, Human
agggguggagaguguugccagu

SEQ ID NO: 768547 - RNA, 22 nt, Human
ggcaggucagguccaugaccaa

SEQ ID NO: 768548 - RNA, 22 nt, Human
aaagacuaagaagaguauuauu

SEQ ID NO: 768549 - RNA, 22 nt, Human
cagacagacagccguggccacc

SEQ ID NO: 768550 - RNA, 22 nt, Human
guuauaaauaccuaauaggauu

SEQ ID NO: 768551 - RNA, 22 nt, Human
auguuacuuagaauaauucugg

SEQ ID NO: 768552 - RNA, 22 nt, Human
uccuccagucuuggugagguug

SEQ ID NO: 768553 - RNA, 22 nt, Human
caguagcaugcuuaucuuuuga

SEQ ID NO: 768554 - RNA, 22 nt, Human
gucuguccaucagcaaaggcuu

SEQ ID NO: 768555 - RNA, 19 nt, Human
cacagugcagccauuucuc

SEQ ID NO: 768556 - RNA, 22 nt, Human
cagcuccucuggccagcccugc

SEQ ID NO: 768557 - RNA, 22 nt, Human
acugaagcacauuugccaugaa

SEQ ID NO: 768558 - RNA, 18 nt, Human
ggagcugggccugguucc

SEQ ID NO: 768559 - RNA, 22 nt, Human
uuucauguauuucccaaagcuu

SEQ ID NO: 768560 - RNA, 19 nt, Human
aaauggcuuucuacuuaau

SEQ ID NO: 768561 - RNA, 22 nt, Human
accuccccacaugguagugagu

SEQ ID NO: 768562 - RNA, 22 nt, Human
uggggacacagagccaaacuau

SEQ ID NO: 768563 - RNA, 22 nt, Human
agacauggagaaggagccagug

SEQ ID NO: 768564 - RNA, 22 nt, Human
aacaguuucaguuacugaugag

SEQ ID NO: 768565 - RNA, 22 nt, Human
cuuggcugcuuuugugcacauu

SEQ ID NO: 768566 - RNA, 18 nt, Human
ucaguccuccauagagcu

SEQ ID NO: 768567 - RNA, 22 nt, Human
agggaaaggcugaugcuguggg

SEQ ID NO: 768568 - RNA, 22 nt, Human
aagcagaguccccuucccaugg

SEQ ID NO: 768569 - RNA, 22 nt, Human
gauugaaacauaggcagucgag

SEQ ID NO: 768570 - RNA, 22 nt, Human
augcaggauuagaaaguugccu

SEQ ID NO: 768571 - RNA, 22 nt, Human
cagagcaggaauaggguguuga

SEQ ID NO: 768572 - RNA, 22 nt, Human
uccaggcccugggaugggagca

SEQ ID NO: 768573 - RNA, 22 nt, Human
ggcaggcugcuugggucauguc

SEQ ID NO: 768574 - RNA, 22 nt, Human
gaggcagcaucuauggugggaa

SEQ ID NO: 768575 - RNA, 22 nt, Human
uucucucccaugaagcuucuau

SEQ ID NO: 768576 - RNA, 22 nt, Human
ucaggcugccuaucagacugug

SEQ ID NO: 768577 - RNA, 22 nt, Human
cacaagucauuuucagcaggcu

SEQ ID NO: 768578 - RNA, 22 nt, Human
uugcuuccuccuagccacuugc

SEQ ID NO: 768579 - RNA, 22 nt, Human
uggcuccaaaaacaaaugacau

SEQ ID NO: 768580 - RNA, 22 nt, Human
cacaggagcccugaggccuccc

SEQ ID NO: 768581 - RNA, 22 nt, Human
ccacugggcguuucuguccaau

SEQ ID NO: 768582 - RNA, 22 nt, Human
auggguaaggguguuugguuag

SEQ ID NO: 768583 - RNA, 22 nt, Human
cagcuguugaucucuuaagccu

SEQ ID NO: 768584 - RNA, 22 nt, Human
uuuauccagaaucaggauuuuu

SEQ ID NO: 768585 - RNA, 22 nt, Human
ccucccacuucuugcugagguc

SEQ ID NO: 768586 - RNA, 18 nt, Human
uagggcucuagggaguga

SEQ ID NO: 768587 - RNA, 22 nt, Human
acauucaaaauugugguuuaga

SEQ ID NO: 768588 - RNA, 22 nt, Human
ucuucaugaccucuguguuuua

SEQ ID NO: 768589 - RNA, 22 nt, Human
uuauuguuaggcuuuuggaauu

SEQ ID NO: 768590 - RNA, 22 nt, Human
ggaacagggauuuggccugguu

SEQ ID NO: 768591 - RNA, 22 nt, Human
aagaauuauugcaauacuagau

SEQ ID NO: 768592 - RNA, 22 nt, Human
ggcuuguugaaacacagauugu

SEQ ID NO: 768593 - RNA, 22 nt, Human
agccucugcuggcccuggcacu

SEQ ID NO: 768594 - RNA, 22 nt, Human
gcagcguggggcugagucagcu

SEQ ID NO: 768595 - RNA, 22 nt, Human
gugccuuugugucuaaaacagc

SEQ ID NO: 768596 - RNA, 22 nt, Human
gccaggcauuuguuaggugcug

SEQ ID NO: 768597 - RNA, 22 nt, Human
ggcuacaguggcacugggcuuu

SEQ ID NO: 768598 - RNA, 22 nt, Human
agcagagaccugguuuuguuga

SEQ ID NO: 768599 - RNA, 22 nt, Human
gcuguguuugacaguagcagac

SEQ ID NO: 768600 - RNA, 22 nt, Human
auggaaagggaagcaaggaaca

SEQ ID NO: 768601 - RNA, 22 nt, Human
uuuugcagaaugggaagguagu

SEQ ID NO: 768602 - RNA, 22 nt, Human
caugggcagaaguggcaucauu

SEQ ID NO: 768603 - RNA, 22 nt, Human
guuuucugccgguggugggcuc

SEQ ID NO: 768604 - RNA, 22 nt, Human
ugcugggcuguuccuguccaug

SEQ ID NO: 768605 - RNA, 22 nt, Human
uucugcugaaaacagccaugua

SEQ ID NO: 768606 - RNA, 22 nt, Human
guucacagcuuguguuuucucu

SEQ ID NO: 768607 - RNA, 22 nt, Human
gaacucuugcagugaaagcuua

SEQ ID NO: 768608 - RNA, 22 nt, Human
guuauucugccaaacuuccaca

SEQ ID NO: 768609 - RNA, 22 nt, Human
guccugggcggagggcugcugu

SEQ ID NO: 768610 - RNA, 22 nt, Human
ugauuuaugcauuauacuguug

SEQ ID NO: 768611 - RNA, 22 nt, Human
guuuuacacaccuaugaaagac

SEQ ID NO: 768612 - RNA, 22 nt, Human
ggcucugguugaccaugauggc

SEQ ID NO: 768613 - RNA, 22 nt, Human
cagugcugcaucuccaugccag

SEQ ID NO: 768614 - RNA, 22 nt, Human
agcccagguggagugugugggg

SEQ ID NO: 768615 - RNA, 22 nt, Human
guauacauacuucuagauuaaa

SEQ ID NO: 768616 - RNA, 22 nt, Human
uuucccucugugccagcuucuc

SEQ ID NO: 768617 - RNA, 22 nt, Human
cacagaauuuucucuuuacaau

SEQ ID NO: 768618 - RNA, 22 nt, Human
aaucagucauuagcucugaccu

SEQ ID NO: 768619 - RNA, 22 nt, Human
uuugucuucccccuuuaaucag

SEQ ID NO: 768620 - RNA, 22 nt, Human
aaggcagucugguuucaaagca

SEQ ID NO: 768621 - RNA, 17 nt, Human
ggccuguguggcugcag

SEQ ID NO: 768622 - RNA, 22 nt, Human
ugaaauauuuagagaguaaguu

SEQ ID NO: 768623 - RNA, 22 nt, Human
agagaaauucucaguggaagau

SEQ ID NO: 768624 - RNA, 22 nt, Human
ccaggaaugaaauguagauaaa

SEQ ID NO: 768625 - RNA, 22 nt, Human
ccagcugugccuaggagcaggg

SEQ ID NO: 768626 - RNA, 22 nt, Human
guuucauaggcaugugaccuau

SEQ ID NO: 768627 - RNA, 22 nt, Human
cuggugaccuugccccagguca

SEQ ID NO: 768628 - RNA, 22 nt, Human
ccacaugaaauugcuuauauuu

SEQ ID NO: 768629 - RNA, 23 nt, Human
aaaguguagccagguuaagaacc

SEQ ID NO: 768630 - RNA, 22 nt, Human
ggcaacaacuggacauagcugg

SEQ ID NO: 768631 - RNA, 22 nt, Human
gacugggguaaggugaggaggu

SEQ ID NO: 768632 - RNA, 22 nt, Human
uucuccccugacccugaugagg

SEQ ID NO: 768633 - RNA, 22 nt, Human
ggcccucuggcuuccgcauggg

SEQ ID NO: 768634 - RNA, 22 nt, Human
auguucuuugaaauauuuuaga

SEQ ID NO: 768635 - RNA, 22 nt, Human
auaaacaucuguuucucuucug

SEQ ID NO: 768636 - RNA, 22 nt, Human
augcacaggaaguguccccauu

SEQ ID NO: 768637 - RNA, 20 nt, Human
gcacuuggcugcugcuucuc

SEQ ID NO: 768638 - RNA, 22 nt, Human
ucugcucagguuaccuagcuag

SEQ ID NO: 768639 - RNA, 22 nt, Human
uucaguuuuauuguacugcuau

SEQ ID NO: 768640 - RNA, 22 nt, Human
gggcuccaaaaucuaugucuuc

SEQ ID NO: 768641 - RNA, 22 nt, Human
aaauuucuaagucaagaagaac

SEQ ID NO: 768642 - RNA, 22 nt, Human
ccucuggagucagaccagcuug

SEQ ID NO: 768643 - RNA, 22 nt, Human
cugauggagacuccacugugau

SEQ ID NO: 768644 - RNA, 22 nt, Human
agcgcugugggcgugcgaggag

SEQ ID NO: 768645 - RNA, 22 nt, Human
cagaaauguuuaugcuuuugaa

SEQ ID NO: 768646 - RNA, 22 nt, Human
aaauucuuucauggcuaauaag

SEQ ID NO: 768647 - RNA, 22 nt, Human
ggcaccuuggcuagugaucaac

SEQ ID NO: 768648 - RNA, 22 nt, Human
aguuauaccuuauacacauaug

SEQ ID NO: 768649 - RNA, 22 nt, Human
gacagugguuccaaggcagcuu

SEQ ID NO: 768650 - RNA, 22 nt, Human
acauuucucauaggagagccac

SEQ ID NO: 768651 - RNA, 22 nt, Human
cucgcaagucgcuccgguuacu

SEQ ID NO: 768652 - RNA, 22 nt, Human
agccagcugccuuucacaucug

SEQ ID NO: 768653 - RNA, 19 nt, Human
ucaacaguggugcugugga

SEQ ID NO: 768654 - RNA, 22 nt, Human
aggaaacugaagcccagagagg

SEQ ID NO: 768655 - RNA, 22 nt, Human
cugaaagaauaagauguuuaca

SEQ ID NO: 768656 - RNA, 22 nt, Human
aaugccaacuuggauauacauu

SEQ ID NO: 768657 - RNA, 20 nt, Human
uccugagauuuaagggguuc

SEQ ID NO: 768658 - RNA, 22 nt, Human
aacaugauaguauuuugaggug

SEQ ID NO: 768659 - RNA, 22 nt, Human
guauuuccuauagugagggccu

SEQ ID NO: 768660 - RNA, 22 nt, Human
auuccauuguguaaggauaucg

SEQ ID NO: 768661 - RNA, 22 nt, Human
gagagguagcaguaagaacagg

SEQ ID NO: 768662 - RNA, 22 nt, Human
cagguggggagaguguggagca

SEQ ID NO: 768663 - RNA, 21 nt, Human
agagcugguagguagguaggu

SEQ ID NO: 768664 - RNA, 18 nt, Human
gaccccgggaucugucga

SEQ ID NO: 768665 - RNA, 22 nt, Human
cugaggggauguuuuugacgga

SEQ ID NO: 768666 - RNA, 22 nt, Human
augcuuaaugaggguauauaug

SEQ ID NO: 768667 - RNA, 22 nt, Human
ggugugucugccaggaacugca

SEQ ID NO: 768668 - RNA, 22 nt, Human
cuggggcccugggucugcccuc

SEQ ID NO: 768669 - RNA, 22 nt, Human
gcugucacacaugggaucucag

SEQ ID NO: 768670 - RNA, 22 nt, Human
gaaacauuuguugaguacuugc

SEQ ID NO: 768671 - RNA, 22 nt, Human
uacaggguauucaaggguaguu

SEQ ID NO: 768672 - RNA, 22 nt, Human
ugaggagccacucuagcaguca

SEQ ID NO: 768673 - RNA, 22 nt, Human
cacacugacuggaaucaaggau

SEQ ID NO: 768674 - RNA, 22 nt, Human
aacacuaacauauagucagugg

SEQ ID NO: 768675 - RNA, 22 nt, Human
uaggucuguacccuguccuucu

SEQ ID NO: 768676 - RNA, 21 nt, Human
ugcacagggcccaggagagcc

SEQ ID NO: 768677 - RNA, 22 nt, Human
uaacagaaguuguucauugugg

SEQ ID NO: 768678 - RNA, 23 nt, Human
ugggcagcuucugcaugcccacc

SEQ ID NO: 768679 - RNA, 22 nt, Human
gggcuucaggagggucagccca

SEQ ID NO: 768680 - RNA, 22 nt, Human
ucaguguuuaccguauguuguu

SEQ ID NO: 768681 - RNA, 22 nt, Human
ugcaggugguuuggacacugcu

SEQ ID NO: 768682 - RNA, 22 nt, Human
cuuucauucuuagauauuagug

SEQ ID NO: 768683 - RNA, 22 nt, Human
caguagacacauuaauauggaa

SEQ ID NO: 768684 - RNA, 22 nt, Human
uccugagagcagcugcuuugga

SEQ ID NO: 768685 - RNA, 22 nt, Human
guccucaggcuugaguguuuau

SEQ ID NO: 768686 - RNA, 22 nt, Human
uagcaaugcuucauuauuuaaa

SEQ ID NO: 768687 - RNA, 22 nt, Human
cuggccugaggucggcuguagg

SEQ ID NO: 768688 - RNA, 22 nt, Human
aaggcagagucuaucuuggaag

SEQ ID NO: 768689 - RNA, 22 nt, Human
ucaucaguuuagaaaaaauaug

SEQ ID NO: 768690 - RNA, 22 nt, Human
cagcuucucgggagcgcaugug

SEQ ID NO: 768691 - RNA, 22 nt, Human
caucagcuuuucuaugugguga

SEQ ID NO: 768692 - RNA, 22 nt, Human
gucugggcuccuggcaggcagc

SEQ ID NO: 768693 - RNA, 22 nt, Human
guggagcauaacacacuagccu

SEQ ID NO: 768694 - RNA, 23 nt, Human
gaggagggucugacaaguguagc

SEQ ID NO: 768695 - RNA, 22 nt, Human
gugugugugcaucucuuuuauu

SEQ ID NO: 768696 - RNA, 22 nt, Human
uucacaaagcuggagcauuucc

SEQ ID NO: 768697 - RNA, 22 nt, Human
ugggccagagaguaagaaaggu

SEQ ID NO: 768698 - RNA, 22 nt, Human
ugugcuucucuuucucacuuaa

SEQ ID NO: 768699 - RNA, 22 nt, Human
augcaaaugcagccauugcaga

SEQ ID NO: 768700 - RNA, 22 nt, Human
uugggcuugucugggaaacugc

SEQ ID NO: 768701 - RNA, 22 nt, Human
ggcucuggggggaagucuguug

SEQ ID NO: 768702 - RNA, 22 nt, Human
caguccuugcucaaagucuaca

SEQ ID NO: 768703 - RNA, 22 nt, Human
acaggcaccuccagggguaugu

SEQ ID NO: 768704 - RNA, 22 nt, Human
gaggguggaucagccugauugg

SEQ ID NO: 768705 - RNA, 22 nt, Human
gcuuugcacagugcuguguuaa

SEQ ID NO: 768706 - RNA, 20 nt, Human
uacaaagaaugagguucagg

SEQ ID NO: 768707 - RNA, 22 nt, Human
caggaaauucuuuuuaacagaa

SEQ ID NO: 768708 - RNA, 22 nt, Human
ugacagagugacacucuugucu

SEQ ID NO: 768709 - RNA, 22 nt, Human
uuaaauguuuaaucuaacuuga

SEQ ID NO: 768710 - RNA, 22 nt, Human
gccaauuuauagccaaaaauca

SEQ ID NO: 768711 - RNA, 22 nt, Human
aggaaaaugauauucugcuguu

SEQ ID NO: 768712 - RNA, 22 nt, Human
cagacaggagacuggaucaugg

SEQ ID NO: 768713 - RNA, 22 nt, Human
aggauacauguuuuuuaucaau

SEQ ID NO: 768714 - RNA, 22 nt, Human
aaagaaaccuaucagccacaug

SEQ ID NO: 768715 - RNA, 22 nt, Human
ggccugagaauguaccagaucu

SEQ ID NO: 768716 - RNA, 22 nt, Human
cuagagaaucuuuuaagaagug

SEQ ID NO: 768717 - RNA, 22 nt, Human
ggaggccaaggaggagcuugcc

SEQ ID NO: 768718 - RNA, 22 nt, Human
auagggccuaaaaaguauugcu

SEQ ID NO: 768719 - RNA, 22 nt, Human
ugcaucuguucagagcugucga

SEQ ID NO: 768720 - RNA, 22 nt, Human
ucacauugaauggaagaauaga

SEQ ID NO: 768721 - RNA, 22 nt, Human
aaagacauggcaagagaugggg

SEQ ID NO: 768722 - RNA, 20 nt, Human
gggaggccccagaguccagg

SEQ ID NO: 768723 - RNA, 21 nt, Human
uuccacagugagaacugcaag

SEQ ID NO: 768724 - RNA, 22 nt, Human
uuugacuccuguguuucuggaa

SEQ ID NO: 768725 - RNA, 22 nt, Human
uaaccuacaugagaacuuuaaa

SEQ ID NO: 768726 - RNA, 20 nt, Human
caaugcacacagcugcuucu

SEQ ID NO: 768727 - RNA, 22 nt, Human
uacauaauaaggggcauggugu

SEQ ID NO: 768728 - RNA, 22 nt, Human
uccuugaauccuagcauccuau

SEQ ID NO: 768729 - RNA, 22 nt, Human
uuauucagugcauauauuaaaa

SEQ ID NO: 768730 - RNA, 18 nt, Human
uugcuucuuuucucuagg

SEQ ID NO: 768731 - RNA, 22 nt, Human
agagggugggcacgugauggau

SEQ ID NO: 768732 - RNA, 22 nt, Human
ugcuuauuaaacaugcauauuc

SEQ ID NO: 768733 - RNA, 22 nt, Human
agcaguuuuagggagacacauu

SEQ ID NO: 768734 - RNA, 22 nt, Human
augcuuggccccuuuauagccu

SEQ ID NO: 768735 - RNA, 22 nt, Human
ugaugagguggauucaaagcag

SEQ ID NO: 768736 - RNA, 22 nt, Human
ucauagcuaagcuccagagugc

SEQ ID NO: 768737 - RNA, 22 nt, Human
uucauuuaaucagaaucucuaa

SEQ ID NO: 768738 - RNA, 22 nt, Human
gcagggacgccagggacagcaa

SEQ ID NO: 768739 - RNA, 19 nt, Human
gcacacccugcaccaccau

SEQ ID NO: 768740 - RNA, 22 nt, Human
uuuacagucucuauagucaaaa

SEQ ID NO: 768741 - RNA, 22 nt, Human
ggcucuguggcuggccaugaug

SEQ ID NO: 768742 - RNA, 22 nt, Human
ugcuauacauguacauauuagu

SEQ ID NO: 768743 - RNA, 22 nt, Human
ucugagaaggugcaucagcugc

SEQ ID NO: 768744 - RNA, 23 nt, Human
caguggucagaacgugggagggu

SEQ ID NO: 768745 - RNA, 23 nt, Human
uggcucagcuaguuuuccauuuc

SEQ ID NO: 768746 - RNA, 22 nt, Human
uagaggcauaagagggaagcag

SEQ ID NO: 768747 - RNA, 22 nt, Human
ucagugccaugggcagacaggc

SEQ ID NO: 768748 - RNA, 22 nt, Human
acagcagcacuauugacauuuu

SEQ ID NO: 768749 - RNA, 22 nt, Human
ugagcaguggcaccaggucacc

SEQ ID NO: 768750 - RNA, 22 nt, Human
gcaggaauauaguauuucgagg

SEQ ID NO: 768751 - RNA, 22 nt, Human
cucugcaacuucuagcaguguc

SEQ ID NO: 768752 - RNA, 22 nt, Human
gggaguggggcuuaccuugaag

SEQ ID NO: 768753 - RNA, 22 nt, Human
cacuauaucuguucuuguuuau

SEQ ID NO: 768754 - RNA, 22 nt, Human
gcucugccuccccuaguguuac

SEQ ID NO: 768755 - RNA, 22 nt, Human
aucaggauggguuuggcuuagg

SEQ ID NO: 768756 - RNA, 22 nt, Human
agccugagugcuuaggacuguu

SEQ ID NO: 768757 - RNA, 22 nt, Human
uuacuugauuugaaaaucauag

SEQ ID NO: 768758 - RNA, 21 nt, Human
uaaaugugagcagggcugggc

SEQ ID NO: 768759 - RNA, 22 nt, Human
auccacccugugguggcuuucu

SEQ ID NO: 768760 - RNA, 22 nt, Human
uuuaauauucugcauucuccuu

SEQ ID NO: 768761 - RNA, 22 nt, Human
uccagcugacacuuaaggggag

SEQ ID NO: 768762 - RNA, 22 nt, Human
uaaauguguuguggaugaaguu

SEQ ID NO: 768763 - RNA, 22 nt, Human
cagucccagcugcucagaaggc

SEQ ID NO: 768764 - RNA, 19 nt, Human
aggcagcauucuggggcuu

SEQ ID NO: 768765 - RNA, 22 nt, Human
cacaggcugggaagccuaggcc

SEQ ID NO: 768766 - RNA, 22 nt, Human
uccuccucuaucagacagugcc

SEQ ID NO: 768767 - RNA, 23 nt, Human
uccugaggguuucccagccuugg

SEQ ID NO: 768768 - RNA, 18 nt, Human
acucugcggaggccccag

SEQ ID NO: 768769 - RNA, 22 nt, Human
uaaccuguuaagggcugaccca

SEQ ID NO: 768770 - RNA, 22 nt, Human
ugccuuggauugcagggaaccu

SEQ ID NO: 768771 - RNA, 22 nt, Human
ggaccugcucucccaguucucu

SEQ ID NO: 768772 - RNA, 17 nt, Human
ugugcauagaauaauga

SEQ ID NO: 768773 - RNA, 22 nt, Human
gaagcccaggcuuccuuggcuu

SEQ ID NO: 768774 - RNA, 22 nt, Human
ucauaggaguagcagugagagg

SEQ ID NO: 768775 - RNA, 22 nt, Human
ucacuggggccaugugagggac

SEQ ID NO: 768776 - RNA, 22 nt, Human
ugccugcccacgacuacagcag

SEQ ID NO: 768777 - RNA, 22 nt, Human
uuauuaagugccuacaauaaag

SEQ ID NO: 768778 - RNA, 22 nt, Human
gccagauguagauagcaaggua

SEQ ID NO: 768779 - RNA, 22 nt, Human
cagggucugaugguccucacuu

SEQ ID NO: 768780 - RNA, 22 nt, Human
gcucuguguucccuccaggcuc

SEQ ID NO: 768781 - RNA, 22 nt, Human
guucucucugcuuccaagaugg

SEQ ID NO: 768782 - RNA, 22 nt, Human
cagcccagugcacgcccguuuc

SEQ ID NO: 768783 - RNA, 22 nt, Human
cucaggauagauuguccucuca

SEQ ID NO: 768784 - RNA, 22 nt, Human
uacauguaagacaugagacucu

SEQ ID NO: 768785 - RNA, 22 nt, Human
caaagugcugagauuacaggua

SEQ ID NO: 768786 - RNA, 22 nt, Human
ugccacaguuguuugugcucua

SEQ ID NO: 768787 - RNA, 22 nt, Human
gcugaagguguguggagagagg

SEQ ID NO: 768788 - RNA, 22 nt, Human
agccaacagccagcaucaacca

SEQ ID NO: 768789 - RNA, 22 nt, Human
uucaagucaaggaaagaggucu

SEQ ID NO: 768790 - RNA, 21 nt, Human
uuuagcauuuacauauuucca

SEQ ID NO: 768791 - RNA, 22 nt, Human
uacagaauagaauagggacagg

SEQ ID NO: 768792 - RNA, 22 nt, Human
aaucgaaagcugagggagcauu

SEQ ID NO: 768793 - RNA, 22 nt, Human
ucacucuguuuuacucacuguu

SEQ ID NO: 768794 - RNA, 22 nt, Human
ugaggcaugguccugagggagc

SEQ ID NO: 768795 - RNA, 22 nt, Human
uagauucuucuuuugagucucu

SEQ ID NO: 768796 - RNA, 22 nt, Human
uuuuggaauuuauacaguaaug

SEQ ID NO: 768797 - RNA, 22 nt, Human
uuggagggacagauggcuaggc

SEQ ID NO: 768798 - RNA, 22 nt, Human
gugagguccuaauagacaucga

SEQ ID NO: 768799 - RNA, 22 nt, Human
gcccagcaggacagagugguuu

SEQ ID NO: 768800 - RNA, 20 nt, Human
aacacagauaccaaagguug

SEQ ID NO: 768801 - RNA, 22 nt, Human
caguggucccugagguugcugg

SEQ ID NO: 768802 - RNA, 15 nt, Human
aggcacugugggacc

SEQ ID NO: 768803 - RNA, 22 nt, Human
uugaaagggauauaucuuucug

SEQ ID NO: 768804 - RNA, 21 nt, Human
agauaguugggcaugcagcug

SEQ ID NO: 768805 - RNA, 22 nt, Human
uggucugauaccggauuccagu

SEQ ID NO: 768806 - RNA, 22 nt, Human
aaggcagccagauccuuugggu

SEQ ID NO: 768807 - RNA, 22 nt, Human
cugggcaccaggcaugacaggg

SEQ ID NO: 768808 - RNA, 22 nt, Human
gcucucagaugcuccagcagcc

SEQ ID NO: 768809 - RNA, 22 nt, Human
ugugugugcacaugcauauaca

SEQ ID NO: 768810 - RNA, 22 nt, Human
ucucugagggagauggccugcc

SEQ ID NO: 768811 - RNA, 22 nt, Human
cuucccacagaauucaaucagu

SEQ ID NO: 768812 - RNA, 18 nt, Human
ucagucuauuguauaaga

SEQ ID NO: 768813 - RNA, 22 nt, Human
uacugugucuuaggauguggaa

SEQ ID NO: 768814 - RNA, 22 nt, Human
aguaggaggcgggagcaugaag

SEQ ID NO: 768815 - RNA, 22 nt, Human
cucucuggauauuuguaugcug

SEQ ID NO: 768816 - RNA, 22 nt, Human
uauuaugaucgugacucaagga

SEQ ID NO: 768817 - RNA, 22 nt, Human
acuuaguggcuaugugaccuua

SEQ ID NO: 768818 - RNA, 22 nt, Human
uuauuagguuuacauaaagguu

SEQ ID NO: 768819 - RNA, 22 nt, Human
cucuccaguuauagcugauuug

SEQ ID NO: 768820 - RNA, 22 nt, Human
gcugcuuuuuggauuuggcaca

SEQ ID NO: 768821 - RNA, 22 nt, Human
uagggcaguuucauguuaucuu

SEQ ID NO: 768822 - RNA, 22 nt, Human
ugaagcagagugaaggugaauu

SEQ ID NO: 768823 - RNA, 22 nt, Human
ggcuccagcuaaugguuucuau

SEQ ID NO: 768824 - RNA, 22 nt, Human
augaaugacugucuacuuuggg

SEQ ID NO: 768825 - RNA, 20 nt, Human
aucuucuuggccagcuugcu

SEQ ID NO: 768826 - RNA, 22 nt, Human
ugccagagaggagaaagcauuu

SEQ ID NO: 768827 - RNA, 22 nt, Human
caggaagaaagaggugaggugu

SEQ ID NO: 768828 - RNA, 20 nt, Human
ucacaggagggaaggcaggu

SEQ ID NO: 768829 - RNA, 22 nt, Human
agagcaagugacagaaacaggg

SEQ ID NO: 768830 - RNA, 22 nt, Human
ugauggcuaucccuggaagggc

SEQ ID NO: 768831 - RNA, 17 nt, Human
gaguaguuacaacagac

SEQ ID NO: 768832 - RNA, 22 nt, Human
auugucuuaaacaaauguguuu

SEQ ID NO: 768833 - RNA, 22 nt, Human
uagggcugaggcaacaagggag

SEQ ID NO: 768834 - RNA, 22 nt, Human
auuacaguaacagcuacaaugc

SEQ ID NO: 768835 - RNA, 22 nt, Human
agaguguaauaagggcaagggc

SEQ ID NO: 768836 - RNA, 22 nt, Human
uauggcuucauugugcuccgca

SEQ ID NO: 768837 - RNA, 22 nt, Human
auucuuuacauuggcuucuucc

SEQ ID NO: 768838 - RNA, 22 nt, Human
uguuuuuccaugugcagaacaa

SEQ ID NO: 768839 - RNA, 22 nt, Human
agauuacagcaugggaauggga

SEQ ID NO: 768840 - RNA, 22 nt, Human
guccaugauucuguguaguaga

SEQ ID NO: 768841 - RNA, 22 nt, Human
cgcaggcuccggggugcccugg

SEQ ID NO: 768842 - RNA, 22 nt, Human
aaaaaugucauuauggaacuga

SEQ ID NO: 768843 - RNA, 22 nt, Human
ccagggaggguccuguggcuuc

SEQ ID NO: 768844 - RNA, 22 nt, Human
ggcuucuuccuggcuccuauua

SEQ ID NO: 768845 - RNA, 22 nt, Human
ucaguuuuucuauacuuuguag

SEQ ID NO: 768846 - RNA, 22 nt, Human
uaaaggccuaguaaguugagac

SEQ ID NO: 768847 - RNA, 23 nt, Human
aacugucuugcaagugugauacc

SEQ ID NO: 768848 - RNA, 22 nt, Human
cucucaaaugucauuccucuau

SEQ ID NO: 768849 - RNA, 22 nt, Human
cugccaggccuccgcugucccc

SEQ ID NO: 768850 - RNA, 22 nt, Human
ccugggcccucaccgccggugg

SEQ ID NO: 768851 - RNA, 22 nt, Human
aggcaguggagcuggaauaggc

SEQ ID NO: 768852 - RNA, 22 nt, Human
augacaagaguguucagggaga

SEQ ID NO: 768853 - RNA, 22 nt, Human
uuggcuucucuuaacccuaaag

SEQ ID NO: 768854 - RNA, 22 nt, Human
aaugcauugauugcuggaaaua

SEQ ID NO: 768855 - RNA, 22 nt, Human
ccacaguagcauccaaacagua

SEQ ID NO: 768856 - RNA, 22 nt, Human
ugauuguauagggguuauuaau

SEQ ID NO: 768857 - RNA, 20 nt, Human
ugcaggaauuugcauuccuu

SEQ ID NO: 768858 - RNA, 22 nt, Human
uauuugagcgaagcaguguuuu

SEQ ID NO: 768859 - RNA, 22 nt, Human
gcagaggcagggcccuccucca

SEQ ID NO: 768860 - RNA, 20 nt, Human
cucaguguggccugaguguu

SEQ ID NO: 768861 - RNA, 18 nt, Human
ccaguaccuccuccucuc

SEQ ID NO: 768862 - RNA, 22 nt, Human
gugcaggggaucagguugcagc

SEQ ID NO: 768863 - RNA, 22 nt, Human
gcagcauccugggccacagucc

SEQ ID NO: 768864 - RNA, 19 nt, Human
ggaaacaggggccagagga

SEQ ID NO: 768865 - RNA, 22 nt, Human
aacuuauugaacauucucgaau

SEQ ID NO: 768866 - RNA, 22 nt, Human
aggcucagagagcuguguccau

SEQ ID NO: 768867 - RNA, 22 nt, Human
ggacccagcucugagacccugc

SEQ ID NO: 768868 - RNA, 22 nt, Human
agcuguuuuccugguuagagac

SEQ ID NO: 768869 - RNA, 22 nt, Human
uuucuauaucuuaccuauugua

SEQ ID NO: 768870 - RNA, 22 nt, Human
auugaaagauauacuguucuca

SEQ ID NO: 768871 - RNA, 22 nt, Human
ucagcucucugggcucgaaccu

SEQ ID NO: 768872 - RNA, 18 nt, Human
aguaaauguuaaauauug

SEQ ID NO: 768873 - RNA, 22 nt, Human
cagcuggggagagacauggcag

SEQ ID NO: 768874 - RNA, 22 nt, Human
agcuuuaucacaauauuggcua

SEQ ID NO: 768875 - RNA, 22 nt, Human
caucuucugggacuucucaguu

SEQ ID NO: 768876 - RNA, 22 nt, Human
agaauugcuaacucuccuccug

SEQ ID NO: 768877 - RNA, 19 nt, Human
ucagggaguuuacagcaug

SEQ ID NO: 768878 - RNA, 22 nt, Human
uccugcagcauccgucgucugu

SEQ ID NO: 768879 - RNA, 22 nt, Human
ucucugugguacugagagucua

SEQ ID NO: 768880 - RNA, 22 nt, Human
ggaggccaugggcagaaucuuu

SEQ ID NO: 768881 - RNA, 22 nt, Human
uaauugaacuaacaugcaaaca

SEQ ID NO: 768882 - RNA, 22 nt, Human
agcucagagcucgggaggaugg

SEQ ID NO: 768883 - RNA, 22 nt, Human
aguacuuuacuucuuacaguuu

SEQ ID NO: 768884 - RNA, 22 nt, Human
gaggagcugggacccugucauc

SEQ ID NO: 768885 - RNA, 22 nt, Human
caggcacugugcuagauccuug

SEQ ID NO: 768886 - RNA, 22 nt, Human
cccaucacagacacuggguuau

SEQ ID NO: 768887 - RNA, 22 nt, Human
cugagguggggccugggcauca

SEQ ID NO: 768888 - RNA, 22 nt, Human
caucuuuguuuuggauauaauc

SEQ ID NO: 768889 - RNA, 22 nt, Human
agggucaccaguucauaggcac

SEQ ID NO: 768890 - RNA, 22 nt, Human
ccuggagugacagguguagccu

SEQ ID NO: 768891 - RNA, 22 nt, Human
ugucagcagcugguuugcuguu

SEQ ID NO: 768892 - RNA, 22 nt, Human
cacagggcagugauuguccaca

SEQ ID NO: 768893 - RNA, 22 nt, Human
cauuuagagaagauuacaagga

SEQ ID NO: 768894 - RNA, 22 nt, Human
acaaaggcaggauugacuuagu

SEQ ID NO: 768895 - RNA, 20 nt, Human
aggcucagagcaguaguaca

SEQ ID NO: 768896 - RNA, 22 nt, Human
cagcagauuugggaaacacugu

SEQ ID NO: 768897 - RNA, 22 nt, Human
aagccaagguuuuggucacagc

SEQ ID NO: 768898 - RNA, 22 nt, Human
ugugaaauguggauguuaauag

SEQ ID NO: 768899 - RNA, 22 nt, Human
aaacacaagaggcaggguacag

SEQ ID NO: 768900 - RNA, 22 nt, Human
gguggcagcauggucccagugu

SEQ ID NO: 768901 - RNA, 19 nt, Human
acacugaucagaucagcag

SEQ ID NO: 768902 - RNA, 19 nt, Human
uaacaagcacucugcauuc

SEQ ID NO: 768903 - RNA, 22 nt, Human
uugccaccgucauggccauuau

SEQ ID NO: 768904 - RNA, 22 nt, Human
agagcuuuuacuuacauucuau

SEQ ID NO: 768905 - RNA, 22 nt, Human
uccuuuaacuaguuaccauguu

SEQ ID NO: 768906 - RNA, 22 nt, Human
ucaggaagggcucagucugugc

SEQ ID NO: 768907 - RNA, 22 nt, Human
aucuauuucugcuaauaacaau

SEQ ID NO: 768908 - RNA, 22 nt, Human
cugugugcugaaaugcagugag

SEQ ID NO: 768909 - RNA, 22 nt, Human
auuucuagacuuagaacucuua

SEQ ID NO: 768910 - RNA, 22 nt, Human
uauagacuugaugguauuaagu

SEQ ID NO: 768911 - RNA, 22 nt, Human
aagucccuggugcuggcugcgc

SEQ ID NO: 768912 - RNA, 22 nt, Human
uguggcagaguaaggacccagu

SEQ ID NO: 768913 - RNA, 22 nt, Human
accacaggaauugcucuguggu

SEQ ID NO: 768914 - RNA, 22 nt, Human
gggacaggcaaagguaugcuuc

SEQ ID NO: 768915 - RNA, 22 nt, Human
ggaaggagcauuugccaguuua

SEQ ID NO: 768916 - RNA, 22 nt, Human
uuaagagauuuaggaacauuau

SEQ ID NO: 768917 - RNA, 22 nt, Human
gcuucuggaggagcugggcuga

SEQ ID NO: 768918 - RNA, 22 nt, Human
uuauaacaacaguuuacuuuaa

SEQ ID NO: 768919 - RNA, 22 nt, Human
augugcguguguacauauauau

SEQ ID NO: 768920 - RNA, 21 nt, Human
cccagggaagccgcagucacc

SEQ ID NO: 768921 - RNA, 22 nt, Human
acaaggcuucacacaguaugaa

SEQ ID NO: 768922 - RNA, 22 nt, Human
uuucuagucucgaucucuuaau

SEQ ID NO: 768923 - RNA, 22 nt, Human
uugggcagcauugcaguucccu

SEQ ID NO: 768924 - RNA, 22 nt, Human
ggcugccaggagggaggccagu

SEQ ID NO: 768925 - RNA, 22 nt, Human
auguuuccauguucaauuuacu

SEQ ID NO: 768926 - RNA, 18 nt, Human
ggguggugugcucuucgc

SEQ ID NO: 768927 - RNA, 22 nt, Human
gucagaggaggcugaguaggaa

SEQ ID NO: 768928 - RNA, 22 nt, Human
guggccagugggaaugggcuca

SEQ ID NO: 768929 - RNA, 22 nt, Human
ccugggagaacugcuggguugg

SEQ ID NO: 768930 - RNA, 22 nt, Human
gugcugccuccauauccgucag

SEQ ID NO: 768931 - RNA, 22 nt, Human
ggugggaggcaggcugcuccca

SEQ ID NO: 768932 - RNA, 22 nt, Human
ccucugcacuucaccuuagcuc

SEQ ID NO: 768933 - RNA, 22 nt, Human
uggcucuggagcuccugggccc

SEQ ID NO: 768934 - RNA, 22 nt, Human
acccagagcacagaugcaacgu

SEQ ID NO: 768935 - RNA, 22 nt, Human
aaugucuacaccguauguuguu

SEQ ID NO: 768936 - RNA, 22 nt, Human
ucaagauaccaccauuauaugu

SEQ ID NO: 768937 - RNA, 22 nt, Human
aggaagugggguucucucacug

SEQ ID NO: 768938 - RNA, 22 nt, Human
caggcagagacgucaguguagg

SEQ ID NO: 768939 - RNA, 21 nt, Human
gcccacagugaggaggauccc

SEQ ID NO: 768940 - RNA, 22 nt, Human
uaacuucacuggacucagcagc

SEQ ID NO: 768941 - RNA, 22 nt, Human
cagcuccuaugaguaugauucc

SEQ ID NO: 768942 - RNA, 22 nt, Human
acagggucuuagagaucaccug

SEQ ID NO: 768943 - RNA, 22 nt, Human
cagggcauaagaugaggcugua

SEQ ID NO: 768944 - RNA, 22 nt, Human
gguggcaguggucucugacaga

SEQ ID NO: 768945 - RNA, 22 nt, Human
ucucucaggaggcagguuccua

SEQ ID NO: 768946 - RNA, 20 nt, Human
cucugggcugcacccucgcc

SEQ ID NO: 768947 - RNA, 22 nt, Human
ggcaggcuagcacugauguccu

SEQ ID NO: 768948 - RNA, 22 nt, Human
ucuuagaaugucaacugauguu

SEQ ID NO: 768949 - RNA, 22 nt, Human
uuuaugauuaauccaauucugu

SEQ ID NO: 768950 - RNA, 22 nt, Human
agucauuuucugccuguaaucu

SEQ ID NO: 768951 - RNA, 22 nt, Human
uggcaaagacgcuagcuaagau

SEQ ID NO: 768952 - RNA, 22 nt, Human
acucucucacagcuuggcugau

SEQ ID NO: 768953 - RNA, 22 nt, Human
ucacaggagucauaauuacagu

SEQ ID NO: 768954 - RNA, 22 nt, Human
ucaugugucugcugcagcuguu

SEQ ID NO: 768955 - RNA, 22 nt, Human
agaaauguugaauacacaaaau

SEQ ID NO: 768956 - RNA, 22 nt, Human
ccucugcucccuggugucugag

SEQ ID NO: 768957 - RNA, 22 nt, Human
aagcauuuauagauaagaauuu

SEQ ID NO: 768958 - RNA, 22 nt, Human
uacuuacagaaggaagcaauug

SEQ ID NO: 768959 - RNA, 22 nt, Human
gccagcagggaagccuugggcu

SEQ ID NO: 768960 - RNA, 22 nt, Human
ccucuggggucuagcaauagca

SEQ ID NO: 768961 - RNA, 22 nt, Human
auagaagcaagaacagaaugga

SEQ ID NO: 768962 - RNA, 22 nt, Human
gccaaagcagucuugccucugc

SEQ ID NO: 768963 - RNA, 22 nt, Human
agcugugggagaaucucugggu

SEQ ID NO: 768964 - RNA, 22 nt, Human
ugaaggccagggauuugcagcc

SEQ ID NO: 768965 - RNA, 22 nt, Human
gagcccugauuugcagcauuug

SEQ ID NO: 768966 - RNA, 20 nt, Human
aguggcagggaaauggaaag

SEQ ID NO: 768967 - RNA, 22 nt, Human
acagauuuaggacuguagcgau

SEQ ID NO: 768968 - RNA, 22 nt, Human
cuggagcugucuucacaggccu

SEQ ID NO: 768969 - RNA, 22 nt, Human
agaagcugugguaugaaaugug

SEQ ID NO: 768970 - RNA, 22 nt, Human
gugcccugucucuugucuccag

SEQ ID NO: 768971 - RNA, 22 nt, Human
aucuguaacugcuaucaucucc

SEQ ID NO: 768972 - RNA, 22 nt, Human
gaaacauaguugagacacugcu

SEQ ID NO: 768973 - RNA, 22 nt, Human
ggcuccaugcugagcuuugaau

SEQ ID NO: 768974 - RNA, 22 nt, Human
uuuaucagaggcuauguuucau

SEQ ID NO: 768975 - RNA, 22 nt, Human
augccuggacuguaucccagau

SEQ ID NO: 768976 - RNA, 22 nt, Human
gcuagccugcaguggcuauggu

SEQ ID NO: 768977 - RNA, 20 nt, Human
gcugcucuccacggucugca

SEQ ID NO: 768978 - RNA, 22 nt, Human
caaaacauucagagagcucacu

SEQ ID NO: 768979 - RNA, 22 nt, Human
aggcaggggagcuggaagggua

SEQ ID NO: 768980 - RNA, 22 nt, Human
aaugagaagccuagguguacug

SEQ ID NO: 768981 - RNA, 22 nt, Human
ucuucauguugcuuauucuggg

SEQ ID NO: 768982 - RNA, 22 nt, Human
aaaugucuuucaauagagaaau

SEQ ID NO: 768983 - RNA, 22 nt, Human
aucuagauuagguauaagagcu

SEQ ID NO: 768984 - RNA, 22 nt, Human
uuacagaaggaacacuacucag

SEQ ID NO: 768985 - RNA, 22 nt, Human
caggagcuuucuucccaaacuu

SEQ ID NO: 768986 - RNA, 22 nt, Human
ugacucugcugugaaagcauuu

SEQ ID NO: 768987 - RNA, 22 nt, Human
cucaguacuuuauguauaugau

SEQ ID NO: 768988 - RNA, 22 nt, Human
cuggccagggugcgaucguggu

SEQ ID NO: 768989 - RNA, 22 nt, Human
uaggagccugcucugcagggac

SEQ ID NO: 768990 - RNA, 22 nt, Human
guacaggaccgcggcccccugg

SEQ ID NO: 768991 - RNA, 22 nt, Human
agugaccaucuaacgccuguga

SEQ ID NO: 768992 - RNA, 17 nt, Human
gaccaggagaaaccagg

SEQ ID NO: 768993 - RNA, 22 nt, Human
uucucccugccaaagcugccuc

SEQ ID NO: 768994 - RNA, 23 nt, Human
acugagcauuaguauuuuuauaa

SEQ ID NO: 768995 - RNA, 22 nt, Human
uucuaauuguguuugcauaucu

SEQ ID NO: 768996 - RNA, 22 nt, Human
gguacaaugguucauuuuaugu

SEQ ID NO: 768997 - RNA, 22 nt, Human
ucccagagauuuccucuccuuc

SEQ ID NO: 768998 - RNA, 21 nt, Human
cucucugcuuaugaauaguga

SEQ ID NO: 768999 - RNA, 22 nt, Human
ugaggugacaauucauucucca

SEQ ID NO: 769000 - RNA, 22 nt, Human
cagcugcaugucuguggugguc

SEQ ID NO: 769001 - RNA, 22 nt, Human
agcuggaggauaacucacuucu

SEQ ID NO: 769002 - RNA, 22 nt, Human
aagugcaucacuacucauuaca

SEQ ID NO: 769003 - RNA, 22 nt, Human
gaacaucaugaagaaaacauau

SEQ ID NO: 769004 - RNA, 22 nt, Human
cugcacacauauggcuucucuc

SEQ ID NO: 769005 - RNA, 22 nt, Human
ccuggcagguggcgcccucggc

SEQ ID NO: 769006 - RNA, 22 nt, Human
ccucuggccagagaaaggccag

SEQ ID NO: 769007 - RNA, 22 nt, Human
cuuguacaugauaaucucacuc

SEQ ID NO: 769008 - RNA, 22 nt, Human
aaucagaaauucuacaucacaa

SEQ ID NO: 769009 - RNA, 22 nt, Human
gugggugcggggagccgaggcg

SEQ ID NO: 769010 - RNA, 22 nt, Human
ugaaagucucuguuauagagaa

SEQ ID NO: 769011 - RNA, 22 nt, Human
uucucuauguguguuguaguuu

SEQ ID NO: 769012 - RNA, 22 nt, Human
uuauuuuaccuuccucugagcu

SEQ ID NO: 769013 - RNA, 22 nt, Human
caccugaagauuuagagauuga

SEQ ID NO: 769014 - RNA, 22 nt, Human
ucugcugcacaaauucaucucu

SEQ ID NO: 769015 - RNA, 22 nt, Human
ggucagcaucugguugagggca

SEQ ID NO: 769016 - RNA, 22 nt, Human
aaaugcucuggggauaagacug

SEQ ID NO: 769017 - RNA, 22 nt, Human
gguguggguccuugugcuugcu

SEQ ID NO: 769018 - RNA, 20 nt, Human
auucugcuuucugauagagc

SEQ ID NO: 769019 - RNA, 22 nt, Human
ugagaggagugauuguaaaauu

SEQ ID NO: 769020 - RNA, 18 nt, Human
cagcugugcccuguuugg

SEQ ID NO: 769021 - RNA, 22 nt, Human
ugcugagaugaauagagaccuc

SEQ ID NO: 769022 - RNA, 22 nt, Human
uggcuuccuccagagcaggagg

SEQ ID NO: 769023 - RNA, 22 nt, Human
guucacacuuuugauaugugaa

SEQ ID NO: 769024 - RNA, 22 nt, Human
ccugcaggcugcaggccaguuc

SEQ ID NO: 769025 - RNA, 22 nt, Human
guuaaacaagcuggacacugaa

SEQ ID NO: 769026 - RNA, 22 nt, Human
uccugaggcucacuuugaaugu

SEQ ID NO: 769027 - RNA, 22 nt, Human
uaagaugacuacuuaccacuga

SEQ ID NO: 769028 - RNA, 17 nt, Human
gcugaacaaggaaaaua

SEQ ID NO: 769029 - RNA, 22 nt, Human
ugcuggaaccaggaauuugaag

SEQ ID NO: 769030 - RNA, 22 nt, Human
uugggcagaggcugugcagagg

SEQ ID NO: 769031 - RNA, 22 nt, Human
caguaugucuacuggacaaagu

SEQ ID NO: 769032 - RNA, 22 nt, Human
ugucacuuuuuauagguguuga

SEQ ID NO: 769033 - RNA, 22 nt, Human
auguaggauugagugauagagg

SEQ ID NO: 769034 - RNA, 22 nt, Human
ugcauacacacauagguauggg

SEQ ID NO: 769035 - RNA, 22 nt, Human
uuccauuuuucuaacucucaga

SEQ ID NO: 769036 - RNA, 22 nt, Human
caaagauaaucacagaauaccc

SEQ ID NO: 769037 - RNA, 22 nt, Human
cucaggauauugggcuggagca

SEQ ID NO: 769038 - RNA, 22 nt, Human
acacauucaugagugcaugcac

SEQ ID NO: 769039 - RNA, 22 nt, Human
gacagucacuuccaggagagga

SEQ ID NO: 769040 - RNA, 22 nt, Human
ugcucuggguccugggccuccu

SEQ ID NO: 769041 - RNA, 22 nt, Human
uagaagauaagacaagugcugc

SEQ ID NO: 769042 - RNA, 22 nt, Human
uuccaauggaaucaugucuuga

SEQ ID NO: 769043 - RNA, 22 nt, Human
cucccuggcacagcgagagguu

SEQ ID NO: 769044 - RNA, 22 nt, Human
cuguccagcuuggcuccugggg

SEQ ID NO: 769045 - RNA, 22 nt, Human
cugggagagaagcgaagcuggg

SEQ ID NO: 769046 - RNA, 22 nt, Human
uccaugagcuagggauucauca

SEQ ID NO: 769047 - RNA, 22 nt, Human
ugcagaaauaaagauauuauca

SEQ ID NO: 769048 - RNA, 22 nt, Human
ucugggcccuaaaccagcucua

SEQ ID NO: 769049 - RNA, 22 nt, Human
agggcccuccccgcucagggca

SEQ ID NO: 769050 - RNA, 22 nt, Human
uuaugcaaagaaauagacuaau

SEQ ID NO: 769051 - RNA, 22 nt, Human
gaggaggcuguuucucugcauu

SEQ ID NO: 769052 - RNA, 22 nt, Human
gugugcauguggaagcauguau

SEQ ID NO: 769053 - RNA, 22 nt, Human
ggugcagaucuuucucuucagg

SEQ ID NO: 769054 - RNA, 22 nt, Human
gagugaaaaaggaagggccaua

SEQ ID NO: 769055 - RNA, 22 nt, Human
ggcugccuucagacuccagcuu

SEQ ID NO: 769056 - RNA, 22 nt, Human
ugaggugaccgcagaugggaag

SEQ ID NO: 769057 - RNA, 21 nt, Human
caagacauaugaguacucugg

SEQ ID NO: 769058 - RNA, 22 nt, Human
aggcuugguuaauucuguguga

SEQ ID NO: 769059 - RNA, 22 nt, Human
guggagacgggacagaagcuaa

SEQ ID NO: 769060 - RNA, 23 nt, Human
ucugagugauuagccucuggggu

SEQ ID NO: 769061 - RNA, 22 nt, Human
gacaagacaugugaugacauca

SEQ ID NO: 769062 - RNA, 22 nt, Human
acagagguguuccagaccuagg

SEQ ID NO: 769063 - RNA, 22 nt, Human
agugcauugcaucucugcuuca

SEQ ID NO: 769064 - RNA, 22 nt, Human
ggcucugccugcccagcagcac

SEQ ID NO: 769065 - RNA, 22 nt, Human
uaggaaaagucuagauugauga

SEQ ID NO: 769066 - RNA, 22 nt, Human
cuacagaauucaacaaaugguu

SEQ ID NO: 769067 - RNA, 18 nt, Human
uggcaggggcaguacgcc

SEQ ID NO: 769068 - RNA, 22 nt, Human
cccccauccaugucaggagagg

SEQ ID NO: 769069 - RNA, 22 nt, Human
acucccuuuccaggaaacacaa

SEQ ID NO: 769070 - RNA, 22 nt, Human
guuacaauguccuuacaugaaa

SEQ ID NO: 769071 - RNA, 18 nt, Human
cccucuugcacaaagcaa

SEQ ID NO: 769072 - RNA, 22 nt, Human
aaagcuauagggucaagcauuu

SEQ ID NO: 769073 - RNA, 22 nt, Human
uuugaaagccuggcuuuucucu

SEQ ID NO: 769074 - RNA, 22 nt, Human
uagcuugacuauucuaugaugu

SEQ ID NO: 769075 - RNA, 16 nt, Human
gggcaggaaucagggu

SEQ ID NO: 769076 - RNA, 22 nt, Human
gaaacacugguaaagacugccg

SEQ ID NO: 769077 - RNA, 22 nt, Human
ugggccucaucuucaaugaguc

SEQ ID NO: 769078 - RNA, 22 nt, Human
gagcuuccauccuuacugugug

SEQ ID NO: 769079 - RNA, 22 nt, Human
ucucagcagccagauccagagc

SEQ ID NO: 769080 - RNA, 23 nt, Human
ugcagcucaaagauggguaaaug

SEQ ID NO: 769081 - RNA, 22 nt, Human
gggaguggagagcaauggauga

SEQ ID NO: 769082 - RNA, 22 nt, Human
cugcagagcaaguucucuguug

SEQ ID NO: 769083 - RNA, 22 nt, Human
cccagacauaacagcagagagg

SEQ ID NO: 769084 - RNA, 22 nt, Human
cugggggucgcgccucugggca

SEQ ID NO: 769085 - RNA, 22 nt, Human
uggcugugaauggcaaauaauc

SEQ ID NO: 769086 - RNA, 22 nt, Human
uggccucuuaaggaugacacaa

SEQ ID NO: 769087 - RNA, 22 nt, Human
aacaguuugccugaaauguauu

SEQ ID NO: 769088 - RNA, 17 nt, Human
gcagcagagagacccuc

SEQ ID NO: 769089 - RNA, 22 nt, Human
acuggcuuugccucugccucuc

SEQ ID NO: 769090 - RNA, 20 nt, Human
uuucuuguacuuggagaagg

SEQ ID NO: 769091 - RNA, 22 nt, Human
cacagugaauuucaaguguugu

SEQ ID NO: 769092 - RNA, 22 nt, Human
gcucuccacugaccacggggca

SEQ ID NO: 769093 - RNA, 22 nt, Human
ugcccugugugugcaagcacug

SEQ ID NO: 769094 - RNA, 19 nt, Human
ggcugggucuggcagguuc

SEQ ID NO: 769095 - RNA, 22 nt, Human
acagaaguggcuucaaagagca

SEQ ID NO: 769096 - RNA, 22 nt, Human
auggcugccuuaauucuucagc

SEQ ID NO: 769097 - RNA, 22 nt, Human
agccagugcaacagcagugaag

SEQ ID NO: 769098 - RNA, 21 nt, Human
gccugggaagagaaagguaag

SEQ ID NO: 769099 - RNA, 22 nt, Human
ugcagcagguauggcaagcucc

SEQ ID NO: 769100 - RNA, 22 nt, Human
uccaguggguugcugagggagg

SEQ ID NO: 769101 - RNA, 22 nt, Human
uuggccuuguacaucauauuaa

SEQ ID NO: 769102 - RNA, 22 nt, Human
uggccuguggcuuaaggucugu

SEQ ID NO: 769103 - RNA, 22 nt, Human
uguguuucugagaaucccaccu

SEQ ID NO: 769104 - RNA, 19 nt, Human
ugcugacugagcugcaaaa

SEQ ID NO: 769105 - RNA, 22 nt, Human
auugguuuuguuaucuccauuc

SEQ ID NO: 769106 - RNA, 22 nt, Human
ugcuugcaagagaugcaaugac

SEQ ID NO: 769107 - RNA, 22 nt, Human
gaaugaacaaggauguucaucc

SEQ ID NO: 769108 - RNA, 22 nt, Human
uaagguuuguggggagcaaaag

SEQ ID NO: 769109 - RNA, 22 nt, Human
aauagacaauucuagccaacau

SEQ ID NO: 769110 - RNA, 22 nt, Human
ucucuggcugauauuccucugc

SEQ ID NO: 769111 - RNA, 22 nt, Human
guccuggguccccgcaggucag

SEQ ID NO: 769112 - RNA, 19 nt, Human
aggaaagguggccuuagca

SEQ ID NO: 769113 - RNA, 22 nt, Human
gaggcucuggaguagguacaca

SEQ ID NO: 769114 - RNA, 22 nt, Human
agauaaugauucugcauuucua

SEQ ID NO: 769115 - RNA, 22 nt, Human
ggagaagggccaauuccaugua

SEQ ID NO: 769116 - RNA, 17 nt, Human
cauuuguugaucaguug

SEQ ID NO: 769117 - RNA, 22 nt, Human
ggcugccagugagugcagaccg

SEQ ID NO: 769118 - RNA, 22 nt, Human
auuuauuccuuuauggcuggag

SEQ ID NO: 769119 - RNA, 22 nt, Human
aggccacagucagugggugcug

SEQ ID NO: 769120 - RNA, 22 nt, Human
agauuagguaugguuuaaguag

SEQ ID NO: 769121 - RNA, 22 nt, Human
uuauguaccugaauuaguaaag

SEQ ID NO: 769122 - RNA, 22 nt, Human
aaugaaugaaccacauauaaca

SEQ ID NO: 769123 - RNA, 22 nt, Human
uaagaauuccaucgcagaguau

SEQ ID NO: 769124 - RNA, 22 nt, Human
uacagauaggaggaaucugaaa

SEQ ID NO: 769125 - RNA, 22 nt, Human
cugcaaauaggggugugaauaa

SEQ ID NO: 769126 - RNA, 22 nt, Human
augguuaaauugguuauuuaug

SEQ ID NO: 769127 - RNA, 22 nt, Human
acauguggaggaggcgagggua

SEQ ID NO: 769128 - RNA, 22 nt, Human
uagcauaacagguaagagugag

SEQ ID NO: 769129 - RNA, 22 nt, Human
ggagcagacauaaccuuacaga

SEQ ID NO: 769130 - RNA, 22 nt, Human
agggcagccugagugcuggccc

SEQ ID NO: 769131 - RNA, 22 nt, Human
aggacuggcccugaggggaggc

SEQ ID NO: 769132 - RNA, 22 nt, Human
ugucugcuaaauuacuauuaca

SEQ ID NO: 769133 - RNA, 22 nt, Human
ugagacagccucugcacucaug

SEQ ID NO: 769134 - RNA, 22 nt, Human
gugcugauugggagcugggauu

SEQ ID NO: 769135 - RNA, 22 nt, Human
acugaugaaaacuaauaaauua

SEQ ID NO: 769136 - RNA, 22 nt, Human
ccaggcugugguuuagauagag

SEQ ID NO: 769137 - RNA, 23 nt, Human
aggcaagaacggguuguucaccc

SEQ ID NO: 769138 - RNA, 22 nt, Human
cagugcugacagggaggaaccu

SEQ ID NO: 769139 - RNA, 22 nt, Human
uucaugagcagaagggaggggu

SEQ ID NO: 769140 - RNA, 17 nt, Human
ucugucuugacugucac

SEQ ID NO: 769141 - RNA, 22 nt, Human
uuguuauuuaggucuggguuag

SEQ ID NO: 769142 - RNA, 22 nt, Human
ugccugugcccuucuuggcauu

SEQ ID NO: 769143 - RNA, 22 nt, Human
gaguccuggaacccugaaugcu

SEQ ID NO: 769144 - RNA, 22 nt, Human
ggccugaaugccugaguguggg

SEQ ID NO: 769145 - RNA, 22 nt, Human
cuccagggcagcauggcagugg

SEQ ID NO: 769146 - RNA, 22 nt, Human
uucaguuccuuaucauaggguu

SEQ ID NO: 769147 - RNA, 22 nt, Human
acacaucagaaauaugaaugag

SEQ ID NO: 769148 - RNA, 22 nt, Human
caguacuuauuucuauuuaggg

SEQ ID NO: 769149 - RNA, 22 nt, Human
aaccuuuugcaagugccuugac

SEQ ID NO: 769150 - RNA, 22 nt, Human
acaaugaauaucaugaaguacu

SEQ ID NO: 769151 - RNA, 22 nt, Human
gagucuucuacgcucacacaaa

SEQ ID NO: 769152 - RNA, 22 nt, Human
agguggcaguuguggaaccauc

SEQ ID NO: 769153 - RNA, 22 nt, Human
uugaagaugcugucucuuccag

SEQ ID NO: 769154 - RNA, 22 nt, Human
cagcagaggcacgucugugaau

SEQ ID NO: 769155 - RNA, 22 nt, Human
agcuggaaaauccaagaccuug

SEQ ID NO: 769156 - RNA, 22 nt, Human
cauguaaugcugggagcugggc

SEQ ID NO: 769157 - RNA, 22 nt, Human
ucagaauaugcuaaugacauuu

SEQ ID NO: 769158 - RNA, 22 nt, Human
aggugcaguggcucaugccugu

SEQ ID NO: 769159 - RNA, 22 nt, Human
acauucaaaauauuucugaugu

SEQ ID NO: 769160 - RNA, 21 nt, Human
caaccugagcugaacccgugc

SEQ ID NO: 769161 - RNA, 21 nt, Human
uccaaaccugucucuggcucu

SEQ ID NO: 769162 - RNA, 22 nt, Human
aucaggauagugguuaccuggg

SEQ ID NO: 769163 - RNA, 22 nt, Human
caucuuuguucuguaaacuuuu

SEQ ID NO: 769164 - RNA, 22 nt, Human
cuaguauuuaaaggcuaugauu

SEQ ID NO: 769165 - RNA, 18 nt, Human
uccagcucugccacuuac

SEQ ID NO: 769166 - RNA, 22 nt, Human
ugggcagggaucucuuuugcaa

SEQ ID NO: 769167 - RNA, 22 nt, Human
ggcuucugguaaagaccacacc

SEQ ID NO: 769168 - RNA, 22 nt, Human
cacauauaugggccccugaggg

SEQ ID NO: 769169 - RNA, 22 nt, Human
aaucuguuuuaucauuuguuac

SEQ ID NO: 769170 - RNA, 22 nt, Human
guguuaaccagcuaaacuuugc

SEQ ID NO: 769171 - RNA, 22 nt, Human
gcacagagucacuagcuaagca

SEQ ID NO: 769172 - RNA, 20 nt, Human
uauugugauagguguuaauc

SEQ ID NO: 769173 - RNA, 22 nt, Human
ugauuaaguucaaaauauagaa

SEQ ID NO: 769174 - RNA, 22 nt, Human
acagugauuauuaguugguggu

SEQ ID NO: 769175 - RNA, 22 nt, Human
uagacacauccguggaagcuuc

SEQ ID NO: 769176 - RNA, 22 nt, Human
uggcuccauucuuuaugaguug

SEQ ID NO: 769177 - RNA, 22 nt, Human
cagggacucccaggguagcucc

SEQ ID NO: 769178 - RNA, 22 nt, Human
aaagcaaacagaaccccaagcu

SEQ ID NO: 769179 - RNA, 21 nt, Human
acucaggagacuaacuauguc

SEQ ID NO: 769180 - RNA, 22 nt, Human
gcccugugugaucacaugaaca

SEQ ID NO: 769181 - RNA, 22 nt, Human
ggcucagaccucccagcuccag

SEQ ID NO: 769182 - RNA, 19 nt, Human
gagcacagcggcauuuggu

SEQ ID NO: 769183 - RNA, 22 nt, Human
ucagaaguauuaugcuaaagga

SEQ ID NO: 769184 - RNA, 22 nt, Human
aauguacagcugcugcugaagg

SEQ ID NO: 769185 - RNA, 19 nt, Human
uagcccuggccaucaugag

SEQ ID NO: 769186 - RNA, 22 nt, Human
ccagccuccauguagauagcug

SEQ ID NO: 769187 - RNA, 22 nt, Human
gugaacagauaauagaaaugaa

SEQ ID NO: 769188 - RNA, 20 nt, Human
acuuuaugaguucaauuuug

SEQ ID NO: 769189 - RNA, 19 nt, Human
uguuuucaagugggauuau

SEQ ID NO: 769190 - RNA, 22 nt, Human
cuuguugggucgugaauucugu

SEQ ID NO: 769191 - RNA, 22 nt, Human
cagcccugaaacaaccuccucu

SEQ ID NO: 769192 - RNA, 22 nt, Human
agcagucauuuuaggucaugca

SEQ ID NO: 769193 - RNA, 22 nt, Human
cuuccucuguggccagagugua

SEQ ID NO: 769194 - RNA, 21 nt, Human
acagccugucaucucaugguc

SEQ ID NO: 769195 - RNA, 22 nt, Human
gagcccagauuggaauuuccca

SEQ ID NO: 769196 - RNA, 22 nt, Human
aggaauuugggguuacaugaug

SEQ ID NO: 769197 - RNA, 20 nt, Human
cagaggcauuuucagacucu

SEQ ID NO: 769198 - RNA, 22 nt, Human
uggcucaccuucagaauauacc

SEQ ID NO: 769199 - RNA, 22 nt, Human
ugaccucuugucggagcuccag

SEQ ID NO: 769200 - RNA, 22 nt, Human
agaaauaagagcuuuccuuggg

SEQ ID NO: 769201 - RNA, 22 nt, Human
uacagaggaggggauuuuaaua

SEQ ID NO: 769202 - RNA, 22 nt, Human
agguuccucuuccucuggccug

SEQ ID NO: 769203 - RNA, 22 nt, Human
ugcagccauuuucugccaaugc

SEQ ID NO: 769204 - RNA, 22 nt, Human
ucaaaggagacacaaggagaaa

SEQ ID NO: 769205 - RNA, 23 nt, Human
uugcacaguuucggaaacugagg

SEQ ID NO: 769206 - RNA, 22 nt, Human
gccucaggacuggcauacucau

SEQ ID NO: 769207 - RNA, 22 nt, Human
gagcugggacuuggaauccaca

SEQ ID NO: 769208 - RNA, 22 nt, Human
ugaaaucuuagccauucugccu

SEQ ID NO: 769209 - RNA, 22 nt, Human
aagcaugggaaucccacagggu

SEQ ID NO: 769210 - RNA, 22 nt, Human
caaaggcaacauauacuuguuu

SEQ ID NO: 769211 - RNA, 22 nt, Human
ugcaugucaaggcacucaggau

SEQ ID NO: 769212 - RNA, 22 nt, Human
ugcaggcucaucucaagaguag

SEQ ID NO: 769213 - RNA, 22 nt, Human
cuuuggcaaggguuuuaauugu

SEQ ID NO: 769214 - RNA, 22 nt, Human
aacacugaagaccagguaauuu

SEQ ID NO: 769215 - RNA, 22 nt, Human
cuugccucugcuaaugguuucu

SEQ ID NO: 769216 - RNA, 20 nt, Human
ucuuuguuaauuuuaucucc

SEQ ID NO: 769217 - RNA, 22 nt, Human
cugaagagcaaaccaacuggac

SEQ ID NO: 769218 - RNA, 22 nt, Human
uguuuauugcugcaauugugcc

SEQ ID NO: 769219 - RNA, 22 nt, Human
acuggggaauggaacugggaau

SEQ ID NO: 769220 - RNA, 22 nt, Human
uguggccugggaaaugaguguu

SEQ ID NO: 769221 - RNA, 23 nt, Human
ggacacagagauaagugagacaa

SEQ ID NO: 769222 - RNA, 17 nt, Human
ggcagggugcuggguau

SEQ ID NO: 769223 - RNA, 22 nt, Human
acagugcaggucucaacaauua

SEQ ID NO: 769224 - RNA, 22 nt, Human
ccagagugacgugaagugugaa

SEQ ID NO: 769225 - RNA, 20 nt, Human
gcucugucuggccuacuuuu

SEQ ID NO: 769226 - RNA, 21 nt, Human
accaggcuugugggagggagc

SEQ ID NO: 769227 - RNA, 20 nt, Human
ggcaguuaaggcacagucau

SEQ ID NO: 769228 - RNA, 22 nt, Human
agugcauucuggcagaacaggu

SEQ ID NO: 769229 - RNA, 22 nt, Human
acugggcuuauuucuugugaac

SEQ ID NO: 769230 - RNA, 22 nt, Human
aacauugcagcuuaauugcagg

SEQ ID NO: 769231 - RNA, 21 nt, Human
ucacugcaaugcuaggagaaa

SEQ ID NO: 769232 - RNA, 22 nt, Human
ugguuccaguuuucaauagagc

SEQ ID NO: 769233 - RNA, 22 nt, Human
auggcccaggcaggcugguacu

SEQ ID NO: 769234 - RNA, 22 nt, Human
cgaggaaauauuuacaacugau

SEQ ID NO: 769235 - RNA, 22 nt, Human
uucaggaugcucagaguagucu

SEQ ID NO: 769236 - RNA, 22 nt, Human
ugcagaaacagucauuaaugua

SEQ ID NO: 769237 - RNA, 22 nt, Human
caguucuuaauaccaugugguu

SEQ ID NO: 769238 - RNA, 18 nt, Human
ucuuggcagcaucuggca

SEQ ID NO: 769239 - RNA, 21 nt, Human
acagggcaugcagcuggcugu

SEQ ID NO: 769240 - RNA, 22 nt, Human
gcagaggccuagguggaaggcc

SEQ ID NO: 769241 - RNA, 22 nt, Human
gugugcaggccacaggccaggg

SEQ ID NO: 769242 - RNA, 19 nt, Human
auccuggguccuccagcug

SEQ ID NO: 769243 - RNA, 22 nt, Human
aagcucauuaauuagaagcuaa

SEQ ID NO: 769244 - RNA, 16 nt, Human
ucccugggaguggugg

SEQ ID NO: 769245 - RNA, 22 nt, Human
ucuuuguaaaugccuagcauaa

SEQ ID NO: 769246 - RNA, 22 nt, Human
ugaguggagaacagaggcucuc

SEQ ID NO: 769247 - RNA, 22 nt, Human
gagagcugcaagguagggcggg

SEQ ID NO: 769248 - RNA, 22 nt, Human
ggcagaguggagugcggccucc

SEQ ID NO: 769249 - RNA, 22 nt, Human
agagccuguuuugugggagaug

SEQ ID NO: 769250 - RNA, 22 nt, Human
ucaaaggcuugugguucuggga

SEQ ID NO: 769251 - RNA, 22 nt, Human
auauuuauaagcaagcaggacu

SEQ ID NO: 769252 - RNA, 22 nt, Human
acuuccuguaaauagaauucca

SEQ ID NO: 769253 - RNA, 22 nt, Human
gcucccagguucuugggccuug

SEQ ID NO: 769254 - RNA, 22 nt, Human
ugaacaaauggaaauaaccagu

SEQ ID NO: 769255 - RNA, 22 nt, Human
accaagcuucguggaggaaguu

SEQ ID NO: 769256 - RNA, 22 nt, Human
acagggcagugucuugaaaaau

SEQ ID NO: 769257 - RNA, 22 nt, Human
cugggggcaagcagacagcugu

SEQ ID NO: 769258 - RNA, 22 nt, Human
aaggggaauagaguggguugug

SEQ ID NO: 769259 - RNA, 22 nt, Human
cuucugugaagagcagaaccau

SEQ ID NO: 769260 - RNA, 22 nt, Human
auuaauauccugcuggcuaaau

SEQ ID NO: 769261 - RNA, 22 nt, Human
cugcagcuggcucaugggauau

SEQ ID NO: 769262 - RNA, 22 nt, Human
gcacauuucucaaagaauuguc

SEQ ID NO: 769263 - RNA, 22 nt, Human
agaguguuauuugcucuguauu

SEQ ID NO: 769264 - RNA, 22 nt, Human
ugugacuguggacuuuuguggg

SEQ ID NO: 769265 - RNA, 22 nt, Human
uaguuuaauggucaacuaauga

SEQ ID NO: 769266 - RNA, 22 nt, Human
caugcagucuggagccuucugu

SEQ ID NO: 769267 - RNA, 22 nt, Human
uggcauguuuaaauggcaauaa

SEQ ID NO: 769268 - RNA, 22 nt, Human
guaaacauuacugugcuguaua

SEQ ID NO: 769269 - RNA, 22 nt, Human
gcucagagaaguugugccuggc

SEQ ID NO: 769270 - RNA, 22 nt, Human
gcacuaaaccaacauguaauaa

SEQ ID NO: 769271 - RNA, 22 nt, Human
uaaagacacugguuuuaaucau

SEQ ID NO: 769272 - RNA, 20 nt, Human
uggcaccaggugguggcccc

SEQ ID NO: 769273 - RNA, 22 nt, Human
aaacaaauuucaagcugugaca

SEQ ID NO: 769274 - RNA, 22 nt, Human
agguggucuuggcccacccagg

SEQ ID NO: 769275 - RNA, 22 nt, Human
uggucuggggaccgaggguuac

SEQ ID NO: 769276 - RNA, 22 nt, Human
gccuuuggcucugucugaccug

SEQ ID NO: 769277 - RNA, 22 nt, Human
auggcugcccacguuggugcuu

SEQ ID NO: 769278 - RNA, 17 nt, Human
gccagggagaggaagcc

SEQ ID NO: 769279 - RNA, 22 nt, Human
uuguaacacuuuucuauuaaua

SEQ ID NO: 769280 - RNA, 18 nt, Human
gguggcggggauggaggu

SEQ ID NO: 769281 - RNA, 22 nt, Human
ggucccaggcugcgggcuggug

SEQ ID NO: 769282 - RNA, 22 nt, Human
uuagugcuucuguccaaauaua

SEQ ID NO: 769283 - RNA, 20 nt, Human
ucacaacuccaucauuuccc

SEQ ID NO: 769284 - RNA, 22 nt, Human
aauguuauuucugcauaguagu

SEQ ID NO: 769285 - RNA, 22 nt, Human
gccuuuccugcucuggcauuca

SEQ ID NO: 769286 - RNA, 22 nt, Human
cugggcucuaagggagcaccgu

SEQ ID NO: 769287 - RNA, 22 nt, Human
gcauggagaagugggaacaggu

SEQ ID NO: 769288 - RNA, 22 nt, Human
auagucuuagucuauaguuuug

SEQ ID NO: 769289 - RNA, 22 nt, Human
ucuggccagcaugagaccuggu

SEQ ID NO: 769290 - RNA, 22 nt, Human
gaggcagagacuccaccuucag

SEQ ID NO: 769291 - RNA, 22 nt, Human
gaaaugugcagaauguguuaga

SEQ ID NO: 769292 - RNA, 22 nt, Human
acaaaaagggagaugagguaga

SEQ ID NO: 769293 - RNA, 22 nt, Human
ucugggaaguccucugucaugc

SEQ ID NO: 769294 - RNA, 22 nt, Human
cugagcucuaaugucagccuug

SEQ ID NO: 769295 - RNA, 22 nt, Human
guuacacagcuaagcuucuccu

SEQ ID NO: 769296 - RNA, 22 nt, Human
ucaguugcuguguaauguuuuc

SEQ ID NO: 769297 - RNA, 22 nt, Human
gaaagaccguuugggcucuaaa

SEQ ID NO: 769298 - RNA, 23 nt, Human
acuuggaagcagugaacaacuuu

SEQ ID NO: 769299 - RNA, 22 nt, Human
gauuugugcucauuuuccauua

SEQ ID NO: 769300 - RNA, 22 nt, Human
acuuagaacaggcagaauucca

SEQ ID NO: 769301 - RNA, 22 nt, Human
agcaccuugaucuuggacuucc

SEQ ID NO: 769302 - RNA, 22 nt, Human
cucagaagaacccaggguccca

SEQ ID NO: 769303 - RNA, 22 nt, Human
gaaauguaggcauaauuauuuu

SEQ ID NO: 769304 - RNA, 22 nt, Human
uggcagcacaagguggcccaug

SEQ ID NO: 769305 - RNA, 22 nt, Human
agggaaauaaucuauucugagg

SEQ ID NO: 769306 - RNA, 22 nt, Human
gaauacauuggaaaucagaaua

SEQ ID NO: 769307 - RNA, 22 nt, Human
gaaguuuuagucaaaauguaga

SEQ ID NO: 769308 - RNA, 22 nt, Human
ugauucugcuuugauccuugug

SEQ ID NO: 769309 - RNA, 22 nt, Human
gaacuggguccuugagucuaga

SEQ ID NO: 769310 - RNA, 22 nt, Human
ccucccugcuccucaacuggca

SEQ ID NO: 769311 - RNA, 22 nt, Human
aaacuguguaugcagagagcau

SEQ ID NO: 769312 - RNA, 22 nt, Human
ucucaggcuccugacauauaug

SEQ ID NO: 769313 - RNA, 22 nt, Human
ccagggugggaggcugaaggcg

SEQ ID NO: 769314 - RNA, 20 nt, Human
agagccuggaaaaagacauc

SEQ ID NO: 769315 - RNA, 22 nt, Human
gcugccuccgccggcuccacag

SEQ ID NO: 769316 - RNA, 22 nt, Human
cuggguggaucgcagccccagg

SEQ ID NO: 769317 - RNA, 22 nt, Human
auuuccaugaaggcagauuuua

SEQ ID NO: 769318 - RNA, 22 nt, Human
uguuccugaaugccuggcuggc

SEQ ID NO: 769319 - RNA, 22 nt, Human
gcauggcuccugucuuacuccc

SEQ ID NO: 769320 - RNA, 19 nt, Human
uagauaaggcauuuaaucu

SEQ ID NO: 769321 - RNA, 22 nt, Human
augacccuuacugcaucauaca

SEQ ID NO: 769322 - RNA, 21 nt, Human
cagcuccacuaaagcagcugu

SEQ ID NO: 769323 - RNA, 22 nt, Human
cuugaaagcacuuaguaaauua

SEQ ID NO: 769324 - RNA, 22 nt, Human
augaagauauucuuguuuucug

SEQ ID NO: 769325 - RNA, 23 nt, Human
uucuacagcuucuucaguuaagg

SEQ ID NO: 769326 - RNA, 22 nt, Human
uagcaacgguaugcaaucuguc

SEQ ID NO: 769327 - RNA, 22 nt, Human
caguaauuccaagugcuuauac

SEQ ID NO: 769328 - RNA, 18 nt, Human
uuauggcugugaaagagu

SEQ ID NO: 769329 - RNA, 22 nt, Human
ucaggccacggcucacugagac

SEQ ID NO: 769330 - RNA, 23 nt, Human
aaguaacagggauaauagcaguu

SEQ ID NO: 769331 - RNA, 22 nt, Human
aggccauguggccccagagucu

SEQ ID NO: 769332 - RNA, 22 nt, Human
aaggccaaaguuuucaggcuaa

SEQ ID NO: 769333 - RNA, 22 nt, Human
uccugggcagccucucuggaag

SEQ ID NO: 769334 - RNA, 22 nt, Human
acagcagaucuguggagcuuau

SEQ ID NO: 769335 - RNA, 22 nt, Human
gccaggcuggaaagaacagaca

SEQ ID NO: 769336 - RNA, 22 nt, Human
ugggccacggggguggagagcu

SEQ ID NO: 769337 - RNA, 21 nt, Human
aucagaaaauguaauggagca

SEQ ID NO: 769338 - RNA, 22 nt, Human
uguucaaguggauguggcuuuu

SEQ ID NO: 769339 - RNA, 22 nt, Human
ggaggggcuccuguucgccccc

SEQ ID NO: 769340 - RNA, 20 nt, Human
uucagaggugaaguuguggu

SEQ ID NO: 769341 - RNA, 22 nt, Human
uggcugccugaaugcaagacag

SEQ ID NO: 769342 - RNA, 22 nt, Human
aggggaaggccagccuguagag

SEQ ID NO: 769343 - RNA, 22 nt, Human
gccucagcuguugcaggggccc

SEQ ID NO: 769344 - RNA, 22 nt, Human
cugagucauugcagauguggag

SEQ ID NO: 769345 - RNA, 22 nt, Human
aaugaacagugggugagguacc

SEQ ID NO: 769346 - RNA, 22 nt, Human
aggcucucucugccccugggac

SEQ ID NO: 769347 - RNA, 22 nt, Human
cuggguggcagagccugcagug

SEQ ID NO: 769348 - RNA, 23 nt, Human
ucuuuuuaagagaucuagugacg

SEQ ID NO: 769349 - RNA, 22 nt, Human
gagcuuggugaugccuccuggu

SEQ ID NO: 769350 - RNA, 23 nt, Human
gggggcugguugacucucugcag

SEQ ID NO: 769351 - RNA, 22 nt, Human
cuucuucuggacaggcagcucc

SEQ ID NO: 769352 - RNA, 22 nt, Human
ggacuucuaagugccagacacu

SEQ ID NO: 769353 - RNA, 22 nt, Human
agacuguagggauagaggucuu

SEQ ID NO: 769354 - RNA, 22 nt, Human
uuacacaguauccaagguucuu

SEQ ID NO: 769355 - RNA, 22 nt, Human
cacaggaauauaaguuugaguu

SEQ ID NO: 769356 - RNA, 22 nt, Human
ggagaggagauuguggcauuuu

SEQ ID NO: 769357 - RNA, 22 nt, Human
aguuugaaaguauugacagaag

SEQ ID NO: 769358 - RNA, 22 nt, Human
cuucacuucacagaugccaaga

SEQ ID NO: 769359 - RNA, 22 nt, Human
gcugccacucugagcuugcuuc

SEQ ID NO: 769360 - RNA, 22 nt, Human
uggcaugggcaaaccagggaaa

SEQ ID NO: 769361 - RNA, 23 nt, Human
ucagucuucccugucaguaauag

SEQ ID NO: 769362 - RNA, 22 nt, Human
uugcuucacuacuucuaggcuc

SEQ ID NO: 769363 - RNA, 22 nt, Human
uuggcucuaggaaccaaaguga

SEQ ID NO: 769364 - RNA, 22 nt, Human
uaacuggcuuaaauuuuaucaa

SEQ ID NO: 769365 - RNA, 22 nt, Human
ucaagagacaggacguguuuca

SEQ ID NO: 769366 - RNA, 22 nt, Human
ucucugucccuaggagccuugc

SEQ ID NO: 769367 - RNA, 22 nt, Human
uugaguucuguguauccuuugu

SEQ ID NO: 769368 - RNA, 16 nt, Human
ucacacauuuguuggu

SEQ ID NO: 769369 - RNA, 22 nt, Human
auuucuguuugcuacuauaagu

SEQ ID NO: 769370 - RNA, 22 nt, Human
gaaagugcuaggaaguguuaga

SEQ ID NO: 769371 - RNA, 22 nt, Human
uguuuuguuagcacucugggaa

SEQ ID NO: 769372 - RNA, 22 nt, Human
aaaagacaucuauuucaggcag

SEQ ID NO: 769373 - RNA, 22 nt, Human
aggugcagcugacaccaugugg

SEQ ID NO: 769374 - RNA, 22 nt, Human
ucagggaaugaugcacacaguu

SEQ ID NO: 769375 - RNA, 22 nt, Human
cucacugcccugaaguuggguu

SEQ ID NO: 769376 - RNA, 22 nt, Human
uuucccucucaucucuauuauu

SEQ ID NO: 769377 - RNA, 22 nt, Human
uggcaaaguuuaucaggaauau

SEQ ID NO: 769378 - RNA, 22 nt, Human
aguguuucccaguaggaugaaa

SEQ ID NO: 769379 - RNA, 22 nt, Human
guccccucagccacccaugggg

SEQ ID NO: 769380 - RNA, 22 nt, Human
caagaaauucuguucagauagc

SEQ ID NO: 769381 - RNA, 22 nt, Human
gaaaucugucuuuguuugaaua

SEQ ID NO: 769382 - RNA, 17 nt, Human
gcuuccugugcugggga

SEQ ID NO: 769383 - RNA, 22 nt, Human
gucccacaccuugaggggucuu

SEQ ID NO: 769384 - RNA, 22 nt, Human
ugaggcuccagccaggccagca

SEQ ID NO: 769385 - RNA, 19 nt, Human
ucuggcuccgccucuuagu

SEQ ID NO: 769386 - RNA, 21 nt, Human
aggugggagaccauguagguc

SEQ ID NO: 769387 - RNA, 22 nt, Human
cugagaaauacccaagucuggu

SEQ ID NO: 769388 - RNA, 22 nt, Human
uuccagagcaguuuucagauca

SEQ ID NO: 769389 - RNA, 22 nt, Human
uaucuuuauuaugucuaucugc

SEQ ID NO: 769390 - RNA, 22 nt, Human
gucccuggggaaucagcuggag

SEQ ID NO: 769391 - RNA, 22 nt, Human
gcagugugaccgagcuugcuuc

SEQ ID NO: 769392 - RNA, 22 nt, Human
ugugccuuaugaauucuuucug

SEQ ID NO: 769393 - RNA, 23 nt, Human
guggccuccccggaaugccucgc

SEQ ID NO: 769394 - RNA, 20 nt, Human
ugcuguguggcccagcauga

SEQ ID NO: 769395 - RNA, 22 nt, Human
ucugugcugucucagagaaagc

SEQ ID NO: 769396 - RNA, 22 nt, Human
ccugagcucugcacuuuuuaga

SEQ ID NO: 769397 - RNA, 22 nt, Human
uauguauccguguguguacaga

SEQ ID NO: 769398 - RNA, 22 nt, Human
cacagcuuaugccacugauugg

SEQ ID NO: 769399 - RNA, 22 nt, Human
auucucugccauugcgguggau

SEQ ID NO: 769400 - RNA, 22 nt, Human
ucucugugguaugucauagcaa

SEQ ID NO: 769401 - RNA, 22 nt, Human
gacagcagaugaagccugcaga

SEQ ID NO: 769402 - RNA, 22 nt, Human
ugugugcacguacauacuguau

SEQ ID NO: 769403 - RNA, 22 nt, Human
gugcuuccuguauugauuccau

SEQ ID NO: 769404 - RNA, 22 nt, Human
aguguccccucugaggagugag

SEQ ID NO: 769405 - RNA, 22 nt, Human
gcuuagcagucacacauuguuc

SEQ ID NO: 769406 - RNA, 22 nt, Human
ugcguugcgcuccugcagcagg

SEQ ID NO: 769407 - RNA, 22 nt, Human
ggacucuguuuuccugaucacu

SEQ ID NO: 769408 - RNA, 22 nt, Human
agucugugugaaugugggcuuu

SEQ ID NO: 769409 - RNA, 22 nt, Human
ccaagggcuauuuacagaacag

SEQ ID NO: 769410 - RNA, 22 nt, Human
ugaacacagcauauuuuguuac

SEQ ID NO: 769411 - RNA, 22 nt, Human
gugcagggcagguguccuucca

SEQ ID NO: 769412 - RNA, 22 nt, Human
aguguaggguggucagagcaga

SEQ ID NO: 769413 - RNA, 22 nt, Human
uagaaagcaugcaaguuugaug

SEQ ID NO: 769414 - RNA, 22 nt, Human
augucuuucgcaucaguagcua

SEQ ID NO: 769415 - RNA, 22 nt, Human
agauguggcugcacccaccgcu

SEQ ID NO: 769416 - RNA, 22 nt, Human
ggccuugggauguggcugcagc

SEQ ID NO: 769417 - RNA, 22 nt, Human
cccauggcagucagagauaaga

SEQ ID NO: 769418 - RNA, 22 nt, Human
gugucccaggccucuggaauua

SEQ ID NO: 769419 - RNA, 22 nt, Human
gacccaggaagcuacuucuggu

SEQ ID NO: 769420 - RNA, 22 nt, Human
uauggcaguuacccuugaugau

SEQ ID NO: 769421 - RNA, 22 nt, Human
agggccacaguaaugcugagua

SEQ ID NO: 769422 - RNA, 22 nt, Human
ugguuugcccacucgagugauu

SEQ ID NO: 769423 - RNA, 22 nt, Human
agagccuguacuuuucugugaa

SEQ ID NO: 769424 - RNA, 22 nt, Human
cagagagggagcaguagucucu

SEQ ID NO: 769425 - RNA, 22 nt, Human
auucagucaaaccacuggucau

SEQ ID NO: 769426 - RNA, 22 nt, Human
augugaggcagcacggagauua

SEQ ID NO: 769427 - RNA, 22 nt, Human
ucugucaucaaauaugcuuucu

SEQ ID NO: 769428 - RNA, 22 nt, Human
aagcuggcucugaugucagaau

SEQ ID NO: 769429 - RNA, 22 nt, Human
ugucauaaaacacaagcuguug

SEQ ID NO: 769430 - RNA, 17 nt, Human
aggcaggcagagcggga

SEQ ID NO: 769431 - RNA, 22 nt, Human
cccagggcugcagauggaggcu

SEQ ID NO: 769432 - RNA, 22 nt, Human
auuauucuuaaugcagggauua

SEQ ID NO: 769433 - RNA, 15 nt, Human
uccaggcauucauuc

SEQ ID NO: 769434 - RNA, 22 nt, Human
cagcucucacacccuccuccca

SEQ ID NO: 769435 - RNA, 22 nt, Human
ugcccuggggagcccagccagg

SEQ ID NO: 769436 - RNA, 23 nt, Human
auagucugcgcaacugagagagg

SEQ ID NO: 769437 - RNA, 22 nt, Human
auuauccagcaccaaugucaga

SEQ ID NO: 769438 - RNA, 22 nt, Human
ggugcugacugaggauggcuug

SEQ ID NO: 769439 - RNA, 22 nt, Human
cuguuuauugagcaaucugcca

SEQ ID NO: 769440 - RNA, 22 nt, Human
uaucuguuguccaugcagaaag

SEQ ID NO: 769441 - RNA, 22 nt, Human
caccuuugaccuugcagcgcac

SEQ ID NO: 769442 - RNA, 22 nt, Human
cagcauggacagggguggcguu

SEQ ID NO: 769443 - RNA, 20 nt, Human
uccugguggauacugcuuaa

SEQ ID NO: 769444 - RNA, 22 nt, Human
agaaauuaggaaaguaacacuu

SEQ ID NO: 769445 - RNA, 22 nt, Human
gcagggcauagaggcacggagg

SEQ ID NO: 769446 - RNA, 22 nt, Human
agguuucuuuaugcugcuagaa

SEQ ID NO: 769447 - RNA, 22 nt, Human
auuucuguggcuucauucuccu

SEQ ID NO: 769448 - RNA, 22 nt, Human
aggugccugggagcucccugag

SEQ ID NO: 769449 - RNA, 22 nt, Human
cauuucaaugccuucaacauag

SEQ ID NO: 769450 - RNA, 22 nt, Human
guuaacacaggacucucugccu

SEQ ID NO: 769451 - RNA, 22 nt, Human
auucaagagcccauguuuccug

SEQ ID NO: 769452 - RNA, 22 nt, Human
ugccugcucuuaccacucuccc

SEQ ID NO: 769453 - RNA, 22 nt, Human
uguuuacuagccaacauggaga

SEQ ID NO: 769454 - RNA, 22 nt, Human
ucucuuuaaaaauagugaaaua

SEQ ID NO: 769455 - RNA, 22 nt, Human
aggcugagcugguagugaguac

SEQ ID NO: 769456 - RNA, 22 nt, Human
gcauggcuguugaagucagcuc

SEQ ID NO: 769457 - RNA, 22 nt, Human
agauacaaguuaagagaaagga

SEQ ID NO: 769458 - RNA, 22 nt, Human
ugcuuaaaaaguaacugcugau

SEQ ID NO: 769459 - RNA, 22 nt, Human
uagcaguacugggcauguguuu

SEQ ID NO: 769460 - RNA, 22 nt, Human
aagcugccagauucagucugcu

SEQ ID NO: 769461 - RNA, 22 nt, Human
ccaggaagcggugagggcugcc

SEQ ID NO: 769462 - RNA, 22 nt, Human
acugcuuccuggauggccagca

SEQ ID NO: 769463 - RNA, 22 nt, Human
agaacuguccccagagagcacu

SEQ ID NO: 769464 - RNA, 22 nt, Human
gcuccuggcuccaggcagccaa

SEQ ID NO: 769465 - RNA, 19 nt, Human
ugaguuuaaugcaaaacug

SEQ ID NO: 769466 - RNA, 22 nt, Human
ccagaggcauguucaaagcaau

SEQ ID NO: 769467 - RNA, 22 nt, Human
augagguuauauuuaauucacu

SEQ ID NO: 769468 - RNA, 22 nt, Human
cuggaucuguuugugcuugugg

SEQ ID NO: 769469 - RNA, 22 nt, Human
uuauagaaggagcauucacuua

SEQ ID NO: 769470 - RNA, 22 nt, Human
uucaaacuaguuaaaagucaga

SEQ ID NO: 769471 - RNA, 22 nt, Human
agccagugaugaagacucugga

SEQ ID NO: 769472 - RNA, 22 nt, Human
gagcaugguuccauagguuggu

SEQ ID NO: 769473 - RNA, 22 nt, Human
cuccugagaaauaagcaaguaa

SEQ ID NO: 769474 - RNA, 22 nt, Human
acccagggagugcuccuguucu

SEQ ID NO: 769475 - RNA, 22 nt, Human
caaauguauaaauguacuuucu

SEQ ID NO: 769476 - RNA, 22 nt, Human
guagaauauaugguuaguauug

SEQ ID NO: 769477 - RNA, 22 nt, Human
auaaaagucugcuuauuugggc

SEQ ID NO: 769478 - RNA, 22 nt, Human
ggccagcccuccucccuggguu

SEQ ID NO: 769479 - RNA, 22 nt, Human
ccuggcagcuaagugcuuugag

SEQ ID NO: 769480 - RNA, 22 nt, Human
agaggccaccacugucagggac

SEQ ID NO: 769481 - RNA, 22 nt, Human
uuugugcagauguauauuugug

SEQ ID NO: 769482 - RNA, 22 nt, Human
guccuucauuuccugaucucua

SEQ ID NO: 769483 - RNA, 22 nt, Human
gagcacauucccaggagcugcu

SEQ ID NO: 769484 - RNA, 22 nt, Human
uuuuaaacuauagcuggaugcu

SEQ ID NO: 769485 - RNA, 22 nt, Human
ggcuccaggguaccccuggaug

SEQ ID NO: 769486 - RNA, 22 nt, Human
agcucagaaccuccucauccca

SEQ ID NO: 769487 - RNA, 22 nt, Human
cacuucacuuggaugccuuuuc

SEQ ID NO: 769488 - RNA, 23 nt, Human
ucauucaaggcugguaucuuuca

SEQ ID NO: 769489 - RNA, 22 nt, Human
acauuugaaauucugaacagau

SEQ ID NO: 769490 - RNA, 22 nt, Human
aaaagagugacugauaaguaua

SEQ ID NO: 769491 - RNA, 22 nt, Human
ucacaugcugugggaucuguau

SEQ ID NO: 769492 - RNA, 22 nt, Human
ccuucuggaugugcuaaggaag

SEQ ID NO: 769493 - RNA, 22 nt, Human
ugaugaggcuucuuggugaaca

SEQ ID NO: 769494 - RNA, 22 nt, Human
uagcaacugccuuuacuauauu

SEQ ID NO: 769495 - RNA, 22 nt, Human
gagccaggaggcagagacugca

SEQ ID NO: 769496 - RNA, 22 nt, Human
gccaccuguuucgcuugcccag

SEQ ID NO: 769497 - RNA, 22 nt, Human
ucauucaagauuucaauagauu

SEQ ID NO: 769498 - RNA, 22 nt, Human
ucacagaaaagcugagcaucag

SEQ ID NO: 769499 - RNA, 22 nt, Human
gcuccuggcauccugcuuuuaa

SEQ ID NO: 769500 - RNA, 22 nt, Human
agaccugguuuaucaccagcau

SEQ ID NO: 769501 - RNA, 22 nt, Human
ccccagccagcuuguaguagaa

SEQ ID NO: 769502 - RNA, 22 nt, Human
ugugccuggcccagugguguca

SEQ ID NO: 769503 - RNA, 22 nt, Human
agugaaagguugagaauauucu

SEQ ID NO: 769504 - RNA, 16 nt, Human
ugcagagagcauggug

SEQ ID NO: 769505 - RNA, 22 nt, Human
gaaaugauuuuaguuuaucaug

SEQ ID NO: 769506 - RNA, 22 nt, Human
aggacaaaggaccagaucugga

SEQ ID NO: 769507 - RNA, 22 nt, Human
ugcaggaauagcuacagagcug

SEQ ID NO: 769508 - RNA, 23 nt, Human
uuagagaugauuaaaaaaucuug

SEQ ID NO: 769509 - RNA, 22 nt, Human
uccagcucaucugucuccauua

SEQ ID NO: 769510 - RNA, 21 nt, Human
uguucuaucagcucagguguc

SEQ ID NO: 769511 - RNA, 22 nt, Human
auacuucuagaaauacuaugca

SEQ ID NO: 769512 - RNA, 22 nt, Human
ggcaguuucucaggcaggggua

SEQ ID NO: 769513 - RNA, 17 nt, Human
uccugugggugcagcag

SEQ ID NO: 769514 - RNA, 22 nt, Human
uaaggcuuauauacuuagacau

SEQ ID NO: 769515 - RNA, 23 nt, Human
gaagcagaugucugaguaggcag

SEQ ID NO: 769516 - RNA, 23 nt, Human
acucguggaauucucugcgaucg

SEQ ID NO: 769517 - RNA, 20 nt, Human
uaggugagggcagauagagg

SEQ ID NO: 769518 - RNA, 22 nt, Human
acaaaauuaugaagaggccuug

SEQ ID NO: 769519 - RNA, 22 nt, Human
uaaucacaauucagaugucuua

SEQ ID NO: 769520 - RNA, 22 nt, Human
aaugcauaccaugucaucuuug

SEQ ID NO: 769521 - RNA, 22 nt, Human
auuucucauuuugcuucaaagg

SEQ ID NO: 769522 - RNA, 22 nt, Human
cccaggaguuagagguuguggu

SEQ ID NO: 769523 - RNA, 22 nt, Human
auuuuauccccacuggauuaca

SEQ ID NO: 769524 - RNA, 23 nt, Human
aagcaucuuuuccuagcuccauc

SEQ ID NO: 769525 - RNA, 22 nt, Human
uaacaaugcaaaaugaauuuag

SEQ ID NO: 769526 - RNA, 22 nt, Human
ccaggcugggcggggaaccugg

SEQ ID NO: 769527 - RNA, 22 nt, Human
caguauauucugcagagccuua

SEQ ID NO: 769528 - RNA, 22 nt, Human
gacaacagcauauggacuguca

SEQ ID NO: 769529 - RNA, 20 nt, Human
ccaagagcaugcaugaggaa

SEQ ID NO: 769530 - RNA, 22 nt, Human
gccuccccugcaauuguccuug

SEQ ID NO: 769531 - RNA, 22 nt, Human
agcagggaggcccagggcacug

SEQ ID NO: 769532 - RNA, 22 nt, Human
cccagcauccucagggagcggg

SEQ ID NO: 769533 - RNA, 22 nt, Human
uucacccaauauaacuagagga

SEQ ID NO: 769534 - RNA, 22 nt, Human
ucccacaggagccugaguccca

SEQ ID NO: 769535 - RNA, 20 nt, Human
gacaggagaguuagguaggu

SEQ ID NO: 769536 - RNA, 22 nt, Human
auauuguugacuauaagaguaa

SEQ ID NO: 769537 - RNA, 19 nt, Human
uggcuuccugacucucauc

SEQ ID NO: 769538 - RNA, 22 nt, Human
ggcugcucuccaucccaggccu

SEQ ID NO: 769539 - RNA, 22 nt, Human
auggcuguuuagcuucucugcu

SEQ ID NO: 769540 - RNA, 22 nt, Human
auagccaggagaugauggggga

SEQ ID NO: 769541 - RNA, 22 nt, Human
ccaggcccaccuuggccacuua

SEQ ID NO: 769542 - RNA, 23 nt, Human
acagaggcuuaaaugaguggcag

SEQ ID NO: 769543 - RNA, 22 nt, Human
ugugccauugagagguuucaga

SEQ ID NO: 769544 - RNA, 22 nt, Human
ucaaugucuucucaagucuuuu

SEQ ID NO: 769545 - RNA, 22 nt, Human
accugccucagugcagcuggau

SEQ ID NO: 769546 - RNA, 22 nt, Human
uccuagaaucuuuguaagauug

SEQ ID NO: 769547 - RNA, 22 nt, Human
uuauuacuguauuaauccagag

SEQ ID NO: 769548 - RNA, 22 nt, Human
uagaaacagcauauauuagccc

SEQ ID NO: 769549 - RNA, 22 nt, Human
ggucacuggucucugcuuccau

SEQ ID NO: 769550 - RNA, 22 nt, Human
aguagauucucauugaucuggu

SEQ ID NO: 769551 - RNA, 22 nt, Human
gcagcuuuguggagaggcccau

SEQ ID NO: 769552 - RNA, 22 nt, Human
cacacuugugaccgauauaaug

SEQ ID NO: 769553 - RNA, 22 nt, Human
uaaaggcucguauuguugugug

SEQ ID NO: 769554 - RNA, 22 nt, Human
agcaauaacagaaaacuuuccu

SEQ ID NO: 769555 - RNA, 22 nt, Human
ugaauuguacaguaugugaauu

SEQ ID NO: 769556 - RNA, 23 nt, Human
aaauggcuugcccucucguuugg

SEQ ID NO: 769557 - RNA, 22 nt, Human
aaguucaaggcagguccugagg

SEQ ID NO: 769558 - RNA, 22 nt, Human
uuuguacacugucuacuaugaa

SEQ ID NO: 769559 - RNA, 22 nt, Human
uuagguaaguaggaucaaaaaa

SEQ ID NO: 769560 - RNA, 22 nt, Human
ugcacacacucguguauaugag

SEQ ID NO: 769561 - RNA, 22 nt, Human
ugucaaacugugacuucuaaug

SEQ ID NO: 769562 - RNA, 19 nt, Human
guucaaacacugauucagc

SEQ ID NO: 769563 - RNA, 22 nt, Human
gcccagcuuuucacuuccacac

SEQ ID NO: 769564 - RNA, 22 nt, Human
ugcauacacaagcauacaugua

SEQ ID NO: 769565 - RNA, 22 nt, Human
uacagcuuaaaaaagccaacuu

SEQ ID NO: 769566 - RNA, 22 nt, Human
uuucauguuauuaauagugcug

SEQ ID NO: 769567 - RNA, 22 nt, Human
uaaugugaagacauaaaucaga

SEQ ID NO: 769568 - RNA, 21 nt, Human
ugaacucuggucaucuucauu

SEQ ID NO: 769569 - RNA, 22 nt, Human
uugagacugccuugucgucugc

SEQ ID NO: 769570 - RNA, 22 nt, Human
cugggcucaguggcucauggcu

SEQ ID NO: 769571 - RNA, 22 nt, Human
ucuggccagugaaaugcagaau

SEQ ID NO: 769572 - RNA, 22 nt, Human
gggagcuuaagacaguuccaau

SEQ ID NO: 769573 - RNA, 22 nt, Human
cuggagccggcgagccccagcc

SEQ ID NO: 769574 - RNA, 22 nt, Human
ggagugaguacuggaguagcug

SEQ ID NO: 769575 - RNA, 22 nt, Human
gcuggccacauugugccguccu

SEQ ID NO: 769576 - RNA, 22 nt, Human
ugcaugugucgggccugugcua

SEQ ID NO: 769577 - RNA, 22 nt, Human
uuggaaucugcaauuuaacaaa

SEQ ID NO: 769578 - RNA, 22 nt, Human
ugcccugguagacacagacugu

SEQ ID NO: 769579 - RNA, 22 nt, Human
accuggcacuacaggcaccugu

SEQ ID NO: 769580 - RNA, 22 nt, Human
uucugagguccaugcaguacug

SEQ ID NO: 769581 - RNA, 22 nt, Human
uggaaccuggccugagcuacca

SEQ ID NO: 769582 - RNA, 22 nt, Human
aaugcauuuuauuauaugugac

SEQ ID NO: 769583 - RNA, 22 nt, Human
caaucccaucaccaucugcucu

SEQ ID NO: 769584 - RNA, 22 nt, Human
uuggucacuugcuaugugccaa

SEQ ID NO: 769585 - RNA, 22 nt, Human
cccugagccgcugcuccaaccu

SEQ ID NO: 769586 - RNA, 22 nt, Human
uaagcaaaguuuauaaggcucu

SEQ ID NO: 769587 - RNA, 20 nt, Human
acagucgccuaucaaccagg

SEQ ID NO: 769588 - RNA, 22 nt, Human
ugcugagaugaauagggcuguc

SEQ ID NO: 769589 - RNA, 22 nt, Human
agagggcugccucagucagcua

SEQ ID NO: 769590 - RNA, 22 nt, Human
uccaggcucccucaggaugcac

SEQ ID NO: 769591 - RNA, 18 nt, Human
cagaaguccuucaaggcc

SEQ ID NO: 769592 - RNA, 22 nt, Human
ggcaugcaaaacaacucagaga

SEQ ID NO: 769593 - RNA, 22 nt, Human
cccaggaggcagagauagcagu

SEQ ID NO: 769594 - RNA, 22 nt, Human
agccauuggcugccuggugcgu

SEQ ID NO: 769595 - RNA, 22 nt, Human
ucacagugaggaguuacaguuu

SEQ ID NO: 769596 - RNA, 22 nt, Human
uggaaggaaagguagcagagaa

SEQ ID NO: 769597 - RNA, 22 nt, Human
uggggccugaaagguucucgcc

SEQ ID NO: 769598 - RNA, 22 nt, Human
ggcucagggaaugaggaagaau

SEQ ID NO: 769599 - RNA, 22 nt, Human
ucuuugaacucuguguauuaac

SEQ ID NO: 769600 - RNA, 22 nt, Human
ccagugugcauuaucauguguc

SEQ ID NO: 769601 - RNA, 22 nt, Human
ccuggcugaacaaagucccucc

SEQ ID NO: 769602 - RNA, 22 nt, Human
ucucuggguuuuuguccuguac

SEQ ID NO: 769603 - RNA, 22 nt, Human
cuuuuaaugagcauugcugucu

SEQ ID NO: 769604 - RNA, 22 nt, Human
cagacugaaaaucccugguagu

SEQ ID NO: 769605 - RNA, 20 nt, Human
aggucugauuccagaaucag

SEQ ID NO: 769606 - RNA, 22 nt, Human
aaggguccagcaccucggcucc

SEQ ID NO: 769607 - RNA, 22 nt, Human
uccaagcacuguuaauuaaacu

SEQ ID NO: 769608 - RNA, 23 nt, Human
ccucaugaaggucugcuuccugg

SEQ ID NO: 769609 - RNA, 22 nt, Human
auugucuguacuuuaaaaaugu

SEQ ID NO: 769610 - RNA, 22 nt, Human
gggaccaggucagggcucugac

SEQ ID NO: 769611 - RNA, 21 nt, Human
uguggcugccucuggcccugg

SEQ ID NO: 769612 - RNA, 22 nt, Human
uacaaagucagaauaacaggug

SEQ ID NO: 769613 - RNA, 22 nt, Human
ucuggcucccuggagcuccaca

SEQ ID NO: 769614 - RNA, 22 nt, Human
agagcacaaauuuuaaggaggc

SEQ ID NO: 769615 - RNA, 22 nt, Human
ucuuccagaaucucagagggcu

SEQ ID NO: 769616 - RNA, 22 nt, Human
uaaaugagggcugacaugauug

SEQ ID NO: 769617 - RNA, 22 nt, Human
ucacaugcucaccuaagccaca

SEQ ID NO: 769618 - RNA, 19 nt, Human
acaguucuaauuucugugg

SEQ ID NO: 769619 - RNA, 20 nt, Human
accagagcucucaguaugug

SEQ ID NO: 769620 - RNA, 22 nt, Human
ugggacagguuggagagaagca

SEQ ID NO: 769621 - RNA, 22 nt, Human
uuugcauuguaauauuuaguuc

SEQ ID NO: 769622 - RNA, 22 nt, Human
ggaaagggcauggccuuuucac

SEQ ID NO: 769623 - RNA, 22 nt, Human
ggagugggcagcacugcccugu

SEQ ID NO: 769624 - RNA, 22 nt, Human
cagcugcuuuaguuuuccaucc

SEQ ID NO: 769625 - RNA, 22 nt, Human
uacauuauccugucuuuguccu

SEQ ID NO: 769626 - RNA, 22 nt, Human
aauguuacgaucaacaacacau

SEQ ID NO: 769627 - RNA, 22 nt, Human
ugcuccaggagcacuuuccauu

SEQ ID NO: 769628 - RNA, 22 nt, Human
uuuacagcaacagugcagaggu

SEQ ID NO: 769629 - RNA, 22 nt, Human
uuuacacuccuggaaaugauau

SEQ ID NO: 769630 - RNA, 22 nt, Human
uuagcaaacucuguuagauucu

SEQ ID NO: 769631 - RNA, 20 nt, Human
uggcuucucuucacuccugu

SEQ ID NO: 769632 - RNA, 21 nt, Human
ucuugugugggaaacaauuug

SEQ ID NO: 769633 - RNA, 22 nt, Human
agccuggcugggaagagccucu

SEQ ID NO: 769634 - RNA, 22 nt, Human
cuuuccugagaaaggagaagga

SEQ ID NO: 769635 - RNA, 21 nt, Human
ccccucauacacucuccuugc

SEQ ID NO: 769636 - RNA, 22 nt, Human
gagacacaaacacauuuagagg

SEQ ID NO: 769637 - RNA, 23 nt, Human
uugggcucaguggcaggaagagu

SEQ ID NO: 769638 - RNA, 22 nt, Human
cucugcugcccaugaugguaua

SEQ ID NO: 769639 - RNA, 22 nt, Human
agaggcuccaccuucucugucc

SEQ ID NO: 769640 - RNA, 20 nt, Human
ucaaaauaggugugggcgga

SEQ ID NO: 769641 - RNA, 22 nt, Human
auucauggcagugguaacguuu

SEQ ID NO: 769642 - RNA, 18 nt, Human
ugcucuggucucacuugg

SEQ ID NO: 769643 - RNA, 17 nt, Human
aucuggaagcuagcuga

SEQ ID NO: 769644 - RNA, 22 nt, Human
uaaaugugcacuuuacuuuuca

SEQ ID NO: 769645 - RNA, 22 nt, Human
agagcucaagacgcucacagua

SEQ ID NO: 769646 - RNA, 22 nt, Human
guguggcugauugacaugguca

SEQ ID NO: 769647 - RNA, 22 nt, Human
aggagcagcccacuccuguccu

SEQ ID NO: 769648 - RNA, 22 nt, Human
uccagagccuuuccacccacuu

SEQ ID NO: 769649 - RNA, 19 nt, Human
uuacaugacacuccagccu

SEQ ID NO: 769650 - RNA, 22 nt, Human
ggcugcucggcagcuccugagc

SEQ ID NO: 769651 - RNA, 22 nt, Human
acccaggaaaacauggugcaga

SEQ ID NO: 769652 - RNA, 22 nt, Human
accagaaaggaauaauagaauu

SEQ ID NO: 769653 - RNA, 22 nt, Human
ucagucaacauaaauccaaggu

SEQ ID NO: 769654 - RNA, 19 nt, Human
uccccagcaccucugaguc

SEQ ID NO: 769655 - RNA, 22 nt, Human
aagcauuuuagauaaagcauca

SEQ ID NO: 769656 - RNA, 22 nt, Human
acacauuaaaacgucuacaaug

SEQ ID NO: 769657 - RNA, 22 nt, Human
ccucuacagggcauagcccaaa

SEQ ID NO: 769658 - RNA, 22 nt, Human
ggcaucaguauggccauagggu

SEQ ID NO: 769659 - RNA, 20 nt, Human
aggcagcuggccaggcaggu

SEQ ID NO: 769660 - RNA, 22 nt, Human
gcuccucuccucggagucgggg

SEQ ID NO: 769661 - RNA, 22 nt, Human
ccaguggguaggccauggugag

SEQ ID NO: 769662 - RNA, 22 nt, Human
ugacauuuuaucaauaucacag

SEQ ID NO: 769663 - RNA, 22 nt, Human
auucaucuguacuucaauaucu

SEQ ID NO: 769664 - RNA, 22 nt, Human
aggcaccuggccaguugucuug

SEQ ID NO: 769665 - RNA, 22 nt, Human
ggcucaggccagaccacgacuc

SEQ ID NO: 769666 - RNA, 22 nt, Human
uccagagcaaaguuugcuaaca

SEQ ID NO: 769667 - RNA, 20 nt, Human
ccaauaaagcucuauaggga

SEQ ID NO: 769668 - RNA, 23 nt, Human
ugagcccaggaggucaaggcugc

SEQ ID NO: 769669 - RNA, 22 nt, Human
uucuuuuuaaaguguguaugca

SEQ ID NO: 769670 - RNA, 22 nt, Human
uccaggucagacuucugugccc

SEQ ID NO: 769671 - RNA, 22 nt, Human
uaagacauccguugcuuauaau

SEQ ID NO: 769672 - RNA, 22 nt, Human
cuucuuuaccaagagauagagu

SEQ ID NO: 769673 - RNA, 22 nt, Human
uugcuugucuucccuuuaccuc

SEQ ID NO: 769674 - RNA, 22 nt, Human
uuuguugaguuacagagaugaa

SEQ ID NO: 769675 - RNA, 22 nt, Human
cuccauggcuuucgcaucugca

SEQ ID NO: 769676 - RNA, 22 nt, Human
uguagcagugucuaccacauua

SEQ ID NO: 769677 - RNA, 22 nt, Human
uuucacagcugggaagagauau

SEQ ID NO: 769678 - RNA, 22 nt, Human
aaggaaccauuugugugcaugg

SEQ ID NO: 769679 - RNA, 22 nt, Human
ugggcagggucucuguuaucag

SEQ ID NO: 769680 - RNA, 23 nt, Human
uggaauguuucuuguacugaaug

SEQ ID NO: 769681 - RNA, 22 nt, Human
auuuccuaggugcucgagugcu

SEQ ID NO: 769682 - RNA, 22 nt, Human
gccagggaacccaagggccuca

SEQ ID NO: 769683 - RNA, 22 nt, Human
cccagcuccuuggaugggcagg

SEQ ID NO: 769684 - RNA, 22 nt, Human
cugauacauaguagcaugucau

SEQ ID NO: 769685 - RNA, 22 nt, Human
acacacuucagauguaauuugu

SEQ ID NO: 769686 - RNA, 22 nt, Human
cagaaacagagaaauauuggcu

SEQ ID NO: 769687 - RNA, 22 nt, Human
ucaggagugccaguaccuuuug

SEQ ID NO: 769688 - RNA, 22 nt, Human
caggggcagucugugugcgugg

SEQ ID NO: 769689 - RNA, 22 nt, Human
aucucaggaggacccugaugcu

SEQ ID NO: 769690 - RNA, 22 nt, Human
uccuggcauugugcagggugug

SEQ ID NO: 769691 - RNA, 22 nt, Human
uugcuuuauuccuagcccuugu

SEQ ID NO: 769692 - RNA, 19 nt, Human
cuguugcuggggcucucuu

SEQ ID NO: 769693 - RNA, 22 nt, Human
aguccaauaaccucuuuccuuc

SEQ ID NO: 769694 - RNA, 22 nt, Human
agcuucuugacggauguucugg

SEQ ID NO: 769695 - RNA, 22 nt, Human
ggggcuuuugcacgugggaggc

SEQ ID NO: 769696 - RNA, 22 nt, Human
auacauaugaaugauuuggcuc

SEQ ID NO: 769697 - RNA, 22 nt, Human
agcuaaugauacaugcuccaca

SEQ ID NO: 769698 - RNA, 22 nt, Human
cucugaaaaugugguggggaaa

SEQ ID NO: 769699 - RNA, 22 nt, Human
ccugcauccgaaagugaucaua

SEQ ID NO: 769700 - RNA, 22 nt, Human
agggcugaaacauaauccuucu

SEQ ID NO: 769701 - RNA, 22 nt, Human
ucccacaggaaaguagacauug

SEQ ID NO: 769702 - RNA, 22 nt, Human
ucccagugggugacuggaggcu

SEQ ID NO: 769703 - RNA, 22 nt, Human
caaagcaggaagaauauugaaa

SEQ ID NO: 769704 - RNA, 22 nt, Human
uauuggugggggcagagagaga

SEQ ID NO: 769705 - RNA, 22 nt, Human
uagauucucccaccugccaggc

SEQ ID NO: 769706 - RNA, 22 nt, Human
uagcccagagagccaggggcuu

SEQ ID NO: 769707 - RNA, 20 nt, Human
uuggcaguuaagaaucuuac

SEQ ID NO: 769708 - RNA, 22 nt, Human
uugucaucaagaugcauugguc

SEQ ID NO: 769709 - RNA, 22 nt, Human
ucagaaaccagcucucucaauu

SEQ ID NO: 769710 - RNA, 22 nt, Human
cugacccauauaagaguggagg

SEQ ID NO: 769711 - RNA, 23 nt, Human
aaauugucguaagguggagaugu

SEQ ID NO: 769712 - RNA, 22 nt, Human
ugacuaaaauaggacauuaacu

SEQ ID NO: 769713 - RNA, 22 nt, Human
ugacacugcaaauauaaauauu

SEQ ID NO: 769714 - RNA, 22 nt, Human
ugugcucacucuaaauuaagau

SEQ ID NO: 769715 - RNA, 22 nt, Human
aucugggucugaagauaaugau

SEQ ID NO: 769716 - RNA, 22 nt, Human
cagcuuugaaacauggcucuag

SEQ ID NO: 769717 - RNA, 22 nt, Human
ugguuuuagaugccuuuacugc

SEQ ID NO: 769718 - RNA, 22 nt, Human
cuguaguugggcauuauaauag

SEQ ID NO: 769719 - RNA, 22 nt, Human
ucauccaguaugacuggugucu

SEQ ID NO: 769720 - RNA, 19 nt, Human
uccaggcugagagucagcu

SEQ ID NO: 769721 - RNA, 22 nt, Human
ccugagcugacucuccuuucag

SEQ ID NO: 769722 - RNA, 17 nt, Human
gguacaaacccauuuuu

SEQ ID NO: 769723 - RNA, 22 nt, Human
ccagucacuggaaaaugggaau

SEQ ID NO: 769724 - RNA, 22 nt, Human
caggaggacauacuggcucaca

SEQ ID NO: 769725 - RNA, 22 nt, Human
aauaacaggcucaucagaugcu

SEQ ID NO: 769726 - RNA, 22 nt, Human
ggucacugcucuaaacaaaagu

SEQ ID NO: 769727 - RNA, 22 nt, Human
uugccuguuugagagcuguguu

SEQ ID NO: 769728 - RNA, 22 nt, Human
aaugauauagcagacauagccu

SEQ ID NO: 769729 - RNA, 20 nt, Human
caugacacuguuccucugcc

SEQ ID NO: 769730 - RNA, 20 nt, Human
uggaaguucuguugcauugg

SEQ ID NO: 769731 - RNA, 22 nt, Human
uuucuuauacuauauugucauc

SEQ ID NO: 769732 - RNA, 22 nt, Human
ggcucccuggaaaucccgaggc

SEQ ID NO: 769733 - RNA, 22 nt, Human
cuggcugguccucggggacagc

SEQ ID NO: 769734 - RNA, 22 nt, Human
uccuuuuuaagucguuguggua

SEQ ID NO: 769735 - RNA, 22 nt, Human
caugcauauaugcuacaugcaa

SEQ ID NO: 769736 - RNA, 22 nt, Human
aagauucuuauuagguaauuuu

SEQ ID NO: 769737 - RNA, 17 nt, Human
ccagggaggggccgcgc

SEQ ID NO: 769738 - RNA, 22 nt, Human
ggcucugggaaauggucuuccu

SEQ ID NO: 769739 - RNA, 22 nt, Human
aaauuacagccuuggguagcuu

SEQ ID NO: 769740 - RNA, 22 nt, Human
uagggagaaacaccaauuuauu

SEQ ID NO: 769741 - RNA, 22 nt, Human
auggccagucuguuggacagca

SEQ ID NO: 769742 - RNA, 22 nt, Human
aucauaaagugcuaucugauug

SEQ ID NO: 769743 - RNA, 22 nt, Human
cuguucuaucauuaaaagcuau

SEQ ID NO: 769744 - RNA, 22 nt, Human
auguggcacagcacaguaagag

SEQ ID NO: 769745 - RNA, 22 nt, Human
acagaugaguuagaauaggcag

SEQ ID NO: 769746 - RNA, 22 nt, Human
caucuuuucagaagccauucug

SEQ ID NO: 769747 - RNA, 22 nt, Human
uuggaagcgagcacauggagga

SEQ ID NO: 769748 - RNA, 22 nt, Human
ccugcccuguguuuggggacua

SEQ ID NO: 769749 - RNA, 18 nt, Human
agcugcagaccaggaggu

SEQ ID NO: 769750 - RNA, 22 nt, Human
cugagaagguguggagaugggc

SEQ ID NO: 769751 - RNA, 22 nt, Human
aaagguuaguucuuagaagugc

SEQ ID NO: 769752 - RNA, 22 nt, Human
gcaggcucacucuguuuggcuc

SEQ ID NO: 769753 - RNA, 22 nt, Human
gggagagaugcugauugccaau

SEQ ID NO: 769754 - RNA, 22 nt, Human
aucaggaucaugcuggguggga

SEQ ID NO: 769755 - RNA, 17 nt, Human
guaaggcuugcagaugc

SEQ ID NO: 769756 - RNA, 22 nt, Human
cuagagaaaaagcuuagguacg

SEQ ID NO: 769757 - RNA, 22 nt, Human
uggggaucauaaauugauggag

SEQ ID NO: 769758 - RNA, 22 nt, Human
gaggaggaaacccuguuccucu

SEQ ID NO: 769759 - RNA, 22 nt, Human
auucugauaucuuauucuagcu

SEQ ID NO: 769760 - RNA, 22 nt, Human
augugcuuggacauucuaggaa

SEQ ID NO: 769761 - RNA, 22 nt, Human
ggccauggucaugggugagcuu

SEQ ID NO: 769762 - RNA, 22 nt, Human
gucccagaaacauauugcuggu

SEQ ID NO: 769763 - RNA, 22 nt, Human
ugcagcagacauaauguggauu

SEQ ID NO: 769764 - RNA, 22 nt, Human
ugggccagaggcauggagcuau

SEQ ID NO: 769765 - RNA, 22 nt, Human
cagaagugaaugugauaaacca

SEQ ID NO: 769766 - RNA, 22 nt, Human
agaguccauauauugauuuguu

SEQ ID NO: 769767 - RNA, 21 nt, Human
ugcuuuaugggaaaaauguca

SEQ ID NO: 769768 - RNA, 22 nt, Human
guuucucagcaacuauaugacu

SEQ ID NO: 769769 - RNA, 22 nt, Human
gacuauuuuuaucuaacugggu

SEQ ID NO: 769770 - RNA, 21 nt, Human
acaggcaauuucauaugguuc

SEQ ID NO: 769771 - RNA, 23 nt, Human
cagcccuuccugcauguuuuugu

SEQ ID NO: 769772 - RNA, 22 nt, Human
uugaaauggcagcagcugaccu

SEQ ID NO: 769773 - RNA, 22 nt, Human
uggcaaagaccgcaauuacuuu

SEQ ID NO: 769774 - RNA, 22 nt, Human
ugcagcugguuuagaacuagau

SEQ ID NO: 769775 - RNA, 22 nt, Human
ggaggaggcggcagaaguuccu

SEQ ID NO: 769776 - RNA, 22 nt, Human
gagcuuggugcacagugguuaa

SEQ ID NO: 769777 - RNA, 22 nt, Human
auguacaaaaugccacugaauu

SEQ ID NO: 769778 - RNA, 22 nt, Human
aaaaagagaaaugcucuagucc

SEQ ID NO: 769779 - RNA, 22 nt, Human
uucugcagaucaacuugacugc

SEQ ID NO: 769780 - RNA, 22 nt, Human
gacuuuauucguuaacuguuaa

SEQ ID NO: 769781 - RNA, 22 nt, Human
ugccccucuaggcccuguucua

SEQ ID NO: 769782 - RNA, 22 nt, Human
uccagagccuuucugcuugaca

SEQ ID NO: 769783 - RNA, 18 nt, Human
aggaagcaggaggaaggc

SEQ ID NO: 769784 - RNA, 22 nt, Human
ccucagaggugaacaucagugc

SEQ ID NO: 769785 - RNA, 22 nt, Human
ggguggaguagaaagaugaauu

SEQ ID NO: 769786 - RNA, 22 nt, Human
ucaguguuggcauucagaaaug

SEQ ID NO: 769787 - RNA, 22 nt, Human
acaguagugccaugaccuacag

SEQ ID NO: 769788 - RNA, 22 nt, Human
cagccagcugaauguaccauga

SEQ ID NO: 769789 - RNA, 22 nt, Human
ucagugauuucuggggugaggg

SEQ ID NO: 769790 - RNA, 22 nt, Human
gagggccagaucccaggaggaa

SEQ ID NO: 769791 - RNA, 22 nt, Human
acuccuggguugcaguccucaa

SEQ ID NO: 769792 - RNA, 22 nt, Human
ggcagccuugagggaggccugg

SEQ ID NO: 769793 - RNA, 18 nt, Human
gugcaaugaauagcagag

SEQ ID NO: 769794 - RNA, 19 nt, Human
agguccugaucagcaagga

SEQ ID NO: 769795 - RNA, 22 nt, Human
gcccucugcacagcucugagca

SEQ ID NO: 769796 - RNA, 22 nt, Human
ggcuccaguuugugccuucagc

SEQ ID NO: 769797 - RNA, 22 nt, Human
uuaaggaaagauuagcauuugu

SEQ ID NO: 769798 - RNA, 22 nt, Human
aggcuagucaagucaagcagug

SEQ ID NO: 769799 - RNA, 22 nt, Human
uuucaaaauuuugcagugguaa

SEQ ID NO: 769800 - RNA, 22 nt, Human
acauucauggguuuuacauuau

SEQ ID NO: 769801 - RNA, 22 nt, Human
uauuuuugccucucagauaaaa

SEQ ID NO: 769802 - RNA, 22 nt, Human
aaagcacauaguagaaggauuu

SEQ ID NO: 769803 - RNA, 22 nt, Human
ucacaggcucuccaccaugagg

SEQ ID NO: 769804 - RNA, 22 nt, Human
cagucucucuccuugcaggcgu

SEQ ID NO: 769805 - RNA, 22 nt, Human
gggagacccccaaugccagguc

SEQ ID NO: 769806 - RNA, 22 nt, Human
aggcucagugauguaaaauaua

SEQ ID NO: 769807 - RNA, 22 nt, Human
cuugaaaaauaugccuugcuuc

SEQ ID NO: 769808 - RNA, 22 nt, Human
agaugccuaaaucugggcaagg

SEQ ID NO: 769809 - RNA, 22 nt, Human
ccccaggagauuugggagcaca

SEQ ID NO: 769810 - RNA, 22 nt, Human
cuuguagaauugaaauggucuc

SEQ ID NO: 769811 - RNA, 22 nt, Human
gggagggacacaaagaguuccc

SEQ ID NO: 769812 - RNA, 21 nt, Human
uggcuggauagaugggaacug

SEQ ID NO: 769813 - RNA, 22 nt, Human
uagaucauaaauacuauggugc

SEQ ID NO: 769814 - RNA, 22 nt, Human
gcagcaagagguuucuguugac

SEQ ID NO: 769815 - RNA, 22 nt, Human
gcuuccugaguacacccucauc

SEQ ID NO: 769816 - RNA, 22 nt, Human
aggacaugaagaaagggcaagg

SEQ ID NO: 769817 - RNA, 22 nt, Human
agcugcccuguggggaggguug

SEQ ID NO: 769818 - RNA, 22 nt, Human
aagcacugggaggaggcugaga

SEQ ID NO: 769819 - RNA, 22 nt, Human
auucuuauuaaauagccagaag

SEQ ID NO: 769820 - RNA, 22 nt, Human
gaguccuucuggcuggcaggau

SEQ ID NO: 769821 - RNA, 22 nt, Human
agaauuguucuguagcuuggcu

SEQ ID NO: 769822 - RNA, 22 nt, Human
aucaguuuuuauuaauguagcu

SEQ ID NO: 769823 - RNA, 22 nt, Human
uacaaguauauucuagugauau

SEQ ID NO: 769824 - RNA, 22 nt, Human
cucagcucauuguggauccggu

SEQ ID NO: 769825 - RNA, 22 nt, Human
guuucucaaauuauuucagcuu

SEQ ID NO: 769826 - RNA, 22 nt, Human
gacugccagaaugugaggccug

SEQ ID NO: 769827 - RNA, 23 nt, Human
uugugggcagauuccauggggag

SEQ ID NO: 769828 - RNA, 22 nt, Human
ugaggccagccacagccacccu

SEQ ID NO: 769829 - RNA, 22 nt, Human
aggcacugguccauuuucugca

SEQ ID NO: 769830 - RNA, 22 nt, Human
gcgggcggggguucccaggucu

SEQ ID NO: 769831 - RNA, 22 nt, Human
ccagcuaguaagcaccugcauc

SEQ ID NO: 769832 - RNA, 19 nt, Human
ggcaccuuggcuaugccug

SEQ ID NO: 769833 - RNA, 22 nt, Human
cuaaacauggcuuagaacacuc

SEQ ID NO: 769834 - RNA, 22 nt, Human
aggaaacagugaacuuggcagg

SEQ ID NO: 769835 - RNA, 22 nt, Human
ucuuggcucugccacuaauuag

SEQ ID NO: 769836 - RNA, 22 nt, Human
gagcagggcuuguccuccucau

SEQ ID NO: 769837 - RNA, 22 nt, Human
auuuuucagcuucauugaggca

SEQ ID NO: 769838 - RNA, 22 nt, Human
ugguccugaggcuuguuuccac

SEQ ID NO: 769839 - RNA, 22 nt, Human
caaagauuuuagaauuugcaau

SEQ ID NO: 769840 - RNA, 22 nt, Human
aacacuaaaggucaguuagaag

SEQ ID NO: 769841 - RNA, 22 nt, Human
cacugcaggucugagauggggg

SEQ ID NO: 769842 - RNA, 22 nt, Human
agaugaauccacacauggcaaa

SEQ ID NO: 769843 - RNA, 22 nt, Human
gcgcucagaaaagauuuucuuc

SEQ ID NO: 769844 - RNA, 22 nt, Human
aggugcugugcuaugcacuugu

SEQ ID NO: 769845 - RNA, 22 nt, Human
cagagcuguauuuaucuuucca

SEQ ID NO: 769846 - RNA, 22 nt, Human
aaccccaguaccccaggauaug

SEQ ID NO: 769847 - RNA, 22 nt, Human
agggagcagggcuccuuugggu

SEQ ID NO: 769848 - RNA, 21 nt, Human
uccuguaagcuuggguggcuc

SEQ ID NO: 769849 - RNA, 22 nt, Human
gaacagaauuaccgaagaucug

SEQ ID NO: 769850 - RNA, 22 nt, Human
uagacuggugaauuagggggaa

SEQ ID NO: 769851 - RNA, 22 nt, Human
uucugacauauccagucucagu

SEQ ID NO: 769852 - RNA, 22 nt, Human
ugggggauuguuuuaaugaaua

SEQ ID NO: 769853 - RNA, 22 nt, Human
gaaucccuugcaaguuguugua

SEQ ID NO: 769854 - RNA, 22 nt, Human
auagacaugcaacacuuuuuac

SEQ ID NO: 769855 - RNA, 22 nt, Human
uccagaugcugcacauuccuga

SEQ ID NO: 769856 - RNA, 22 nt, Human
ccaggaaggaagcagggguuuc

SEQ ID NO: 769857 - RNA, 22 nt, Human
auccagagacuggggcugggau

SEQ ID NO: 769858 - RNA, 22 nt, Human
ggaaggguuuaagcaggagagu

SEQ ID NO: 769859 - RNA, 22 nt, Human
ugaccaggauacugcagggaug

SEQ ID NO: 769860 - RNA, 22 nt, Human
caggagcucaagaccacccugg

SEQ ID NO: 769861 - RNA, 22 nt, Human
uucaaucauuagaaucucaggc

SEQ ID NO: 769862 - RNA, 21 nt, Human
agcagguguaaaggaggaaau

SEQ ID NO: 769863 - RNA, 22 nt, Human
cagauuccggucaucucuccuu

SEQ ID NO: 769864 - RNA, 21 nt, Human
augcaucuaucuucuacucca

SEQ ID NO: 769865 - RNA, 22 nt, Human
ccuucagcguccccuuuacccg

SEQ ID NO: 769866 - RNA, 22 nt, Human
guggcccugagcccuuugacag

SEQ ID NO: 769867 - RNA, 22 nt, Human
gaggagcccuguuccccaggcc

SEQ ID NO: 769868 - RNA, 22 nt, Human
agcuuacugggcaguaaagauu

SEQ ID NO: 769869 - RNA, 22 nt, Human
gccuggagcuacuggacacuga

SEQ ID NO: 769870 - RNA, 22 nt, Human
cagcaagauuuuuaaagcaagg

SEQ ID NO: 769871 - RNA, 23 nt, Human
uuucugaaguugagauggacuuu

SEQ ID NO: 769872 - RNA, 22 nt, Human
guagcuuauuagggauaauagu

SEQ ID NO: 769873 - RNA, 22 nt, Human
gccuguucugcccugagagccu

SEQ ID NO: 769874 - RNA, 22 nt, Human
cauuucuaagaaggcugcacau

SEQ ID NO: 769875 - RNA, 23 nt, Human
cagugugacgaggugaggcaggc

SEQ ID NO: 769876 - RNA, 22 nt, Human
cagugccaaggauggccuggga

SEQ ID NO: 769877 - RNA, 22 nt, Human
ucucaggaagauuagggcuaag

SEQ ID NO: 769878 - RNA, 22 nt, Human
acuguagaggccuggauugagg

SEQ ID NO: 769879 - RNA, 17 nt, Human
agcugccucucccacca

SEQ ID NO: 769880 - RNA, 22 nt, Human
acucucucugauggaacuuuag

SEQ ID NO: 769881 - RNA, 22 nt, Human
auacacacugcuauccuuuuuu

SEQ ID NO: 769882 - RNA, 22 nt, Human
gcuguggcggcagcagcuggug

SEQ ID NO: 769883 - RNA, 22 nt, Human
agagaagugagcuuguucacuc

SEQ ID NO: 769884 - RNA, 22 nt, Human
ucaggaaauuaaacacuugaaa

SEQ ID NO: 769885 - RNA, 22 nt, Human
gaacaauacaggcuuuauuccu

SEQ ID NO: 769886 - RNA, 22 nt, Human
ucaguaacuucaugaccaagca

SEQ ID NO: 769887 - RNA, 22 nt, Human
uguggagaugugagcaagggga

SEQ ID NO: 769888 - RNA, 22 nt, Human
accaggcucugccaguguuuac

SEQ ID NO: 769889 - RNA, 22 nt, Human
auaauauuugcauuacugugau

SEQ ID NO: 769890 - RNA, 22 nt, Human
aauuagcauuucccauauaaau

SEQ ID NO: 769891 - RNA, 18 nt, Human
gcagggcugcacacgcau

SEQ ID NO: 769892 - RNA, 22 nt, Human
ucucagugguguuuugagucca

SEQ ID NO: 769893 - RNA, 22 nt, Human
agggccagcuagagcccucgcc

SEQ ID NO: 769894 - RNA, 22 nt, Human
ugcaguggcgccaucucagcuc

SEQ ID NO: 769895 - RNA, 22 nt, Human
ugcaucauauaaugucuaugga

SEQ ID NO: 769896 - RNA, 22 nt, Human
uagaagcagcaggacucauggu

SEQ ID NO: 769897 - RNA, 22 nt, Human
ggagagaacugaccugaaagga

SEQ ID NO: 769898 - RNA, 22 nt, Human
agaaugcaucuaaaagcagaga

SEQ ID NO: 769899 - RNA, 19 nt, Human
ccugggccuccaucacccc

SEQ ID NO: 769900 - RNA, 22 nt, Human
agugucauuccagggacccucg

SEQ ID NO: 769901 - RNA, 22 nt, Human
ugucaguuuccugugcccugcu

SEQ ID NO: 769902 - RNA, 22 nt, Human
ugcugcccguaccugugcacuu

SEQ ID NO: 769903 - RNA, 22 nt, Human
cugggccucaaucucagaguuu

SEQ ID NO: 769904 - RNA, 22 nt, Human
agagccacuccaggacucaggg

SEQ ID NO: 769905 - RNA, 22 nt, Human
gauauagguucauaguguuaca

SEQ ID NO: 769906 - RNA, 22 nt, Human
ucuggggguuaagugaggacaa

SEQ ID NO: 769907 - RNA, 23 nt, Human
uccuucaaguuaggaagugaaca

SEQ ID NO: 769908 - RNA, 22 nt, Human
aagggcuggagaggaaagguug

SEQ ID NO: 769909 - RNA, 22 nt, Human
cagauacagcuagcuccguggc

SEQ ID NO: 769910 - RNA, 22 nt, Human
gccuucagaguaccauguccuc

SEQ ID NO: 769911 - RNA, 22 nt, Human
uaucucuuuauugacaauaaaa

SEQ ID NO: 769912 - RNA, 22 nt, Human
gucccaggugcccagugggcag

SEQ ID NO: 769913 - RNA, 22 nt, Human
gacuuuaaguccuaucugugcg

SEQ ID NO: 769914 - RNA, 22 nt, Human
auuuaacuuucagccccucuuc

SEQ ID NO: 769915 - RNA, 22 nt, Human
ggcucuggucagugaggggccu

SEQ ID NO: 769916 - RNA, 22 nt, Human
gcugcccucugugacccggccc

SEQ ID NO: 769917 - RNA, 22 nt, Human
gagggugcaggaggaugguagu

SEQ ID NO: 769918 - RNA, 20 nt, Human
gcucugggagggaugugaug

SEQ ID NO: 769919 - RNA, 22 nt, Human
uuggagguuauuaacacuggcc

SEQ ID NO: 769920 - RNA, 22 nt, Human
gcugggcugcgucggggaagcc

SEQ ID NO: 769921 - RNA, 20 nt, Human
gcacaguuugggaaccaugg

SEQ ID NO: 769922 - RNA, 22 nt, Human
acuaagugauucuaagcaucuu

SEQ ID NO: 769923 - RNA, 22 nt, Human
cacagaauuaagggagaaauau

SEQ ID NO: 769924 - RNA, 22 nt, Human
caggguccggcugccuggcugu

SEQ ID NO: 769925 - RNA, 22 nt, Human
uuacacaaguucuuuaaccuau

SEQ ID NO: 769926 - RNA, 22 nt, Human
agcaccagagcuaugggccugc

SEQ ID NO: 769927 - RNA, 18 nt, Human
uaagucauuugaaaugcc

SEQ ID NO: 769928 - RNA, 22 nt, Human
ucugaaaugaccuuuccccacu

SEQ ID NO: 769929 - RNA, 22 nt, Human
agaaguauucugcauguacuga

SEQ ID NO: 769930 - RNA, 22 nt, Human
ccucagcugcuucccuggagcc

SEQ ID NO: 769931 - RNA, 22 nt, Human
uaagacauaccaaguuguguga

SEQ ID NO: 769932 - RNA, 22 nt, Human
agucaguuaaccucacagcauc

SEQ ID NO: 769933 - RNA, 22 nt, Human
aaggccaaggcugcagugagcc

SEQ ID NO: 769934 - RNA, 22 nt, Human
caggcugaucagggcugggaug

SEQ ID NO: 769935 - RNA, 22 nt, Human
uccaugcagaguccaggccuca

SEQ ID NO: 769936 - RNA, 22 nt, Human
agucucuggggaggaguggaaa

SEQ ID NO: 769937 - RNA, 22 nt, Human
ucuaccacuuugaccucucugu

SEQ ID NO: 769938 - RNA, 22 nt, Human
ucauuccauuuccagcucugaa

SEQ ID NO: 769939 - RNA, 22 nt, Human
ucucagaguuccucuggagucc

SEQ ID NO: 769940 - RNA, 22 nt, Human
cuauucugcuugaaauuauucu

SEQ ID NO: 769941 - RNA, 22 nt, Human
aaaagguagauucuccuucuau

SEQ ID NO: 769942 - RNA, 22 nt, Human
agcaauagauaaaacauuuacc

SEQ ID NO: 769943 - RNA, 22 nt, Human
caguccaggccuggaggagcca

SEQ ID NO: 769944 - RNA, 22 nt, Human
cugaaagcauuaacuccacuuc

SEQ ID NO: 769945 - RNA, 22 nt, Human
uccagggaccucccugagagcu

SEQ ID NO: 769946 - RNA, 22 nt, Human
accacuuugguauuucaauuuu

SEQ ID NO: 769947 - RNA, 22 nt, Human
ucugcuguucauucuuuuagcu

SEQ ID NO: 769948 - RNA, 22 nt, Human
uuagacagagcuccuugagggc

SEQ ID NO: 769949 - RNA, 20 nt, Human
caucaacaccuugucagccu

SEQ ID NO: 769950 - RNA, 22 nt, Human
uuacuuuagaaauagucaucaa

SEQ ID NO: 769951 - RNA, 17 nt, Human
uucauuaauaaaagcaa

SEQ ID NO: 769952 - RNA, 22 nt, Human
cucuccagccaggggcuuccug

SEQ ID NO: 769953 - RNA, 23 nt, Human
uccuggugacaugccugagcauc

SEQ ID NO: 769954 - RNA, 22 nt, Human
ccagcuugaagaugugcugguu

SEQ ID NO: 769955 - RNA, 22 nt, Human
cucuucuugaaagaggaauuca

SEQ ID NO: 769956 - RNA, 22 nt, Human
agggggcuccuuggugugcaga

SEQ ID NO: 769957 - RNA, 22 nt, Human
gccugagacagugugguccaau

SEQ ID NO: 769958 - RNA, 22 nt, Human
ugcuauuugggggcuacaugau

SEQ ID NO: 769959 - RNA, 22 nt, Human
ucacaggacccugaggguggcg

SEQ ID NO: 769960 - RNA, 22 nt, Human
cagcucugguccagggagggca

SEQ ID NO: 769961 - RNA, 23 nt, Human
aggcuccacucccugggaugugg

SEQ ID NO: 769962 - RNA, 22 nt, Human
uugugcaagaagccagcaccaa

SEQ ID NO: 769963 - RNA, 22 nt, Human
uguucuugggaaucuuacaguu

SEQ ID NO: 769964 - RNA, 22 nt, Human
ugaggccaggaucccaggcucu

SEQ ID NO: 769965 - RNA, 22 nt, Human
cagaacagacuuaacagggcug

SEQ ID NO: 769966 - RNA, 22 nt, Human
uccuggcaggguggcagcgggu

SEQ ID NO: 769967 - RNA, 22 nt, Human
ggggcccuuguggcugcaggcc

SEQ ID NO: 769968 - RNA, 22 nt, Human
cacagggaggcggucacuggcu

SEQ ID NO: 769969 - RNA, 22 nt, Human
ccugcugcuaugaaggugacag

SEQ ID NO: 769970 - RNA, 22 nt, Human
cuacuuguucacuguaggucgc

SEQ ID NO: 769971 - RNA, 22 nt, Human
gcucccaccuuugcuaucagua

SEQ ID NO: 769972 - RNA, 22 nt, Human
aagcaaaggcaggagcuuguga

SEQ ID NO: 769973 - RNA, 22 nt, Human
agggucaacauucuaaaaucug

SEQ ID NO: 769974 - RNA, 22 nt, Human
ucagaggagaugguuaccaggg

SEQ ID NO: 769975 - RNA, 22 nt, Human
cuggugcuuugcucauuugaua

SEQ ID NO: 769976 - RNA, 22 nt, Human
ugcacuggggucccagcgcacg

SEQ ID NO: 769977 - RNA, 22 nt, Human
cuggggccagugaggaggcuuu

SEQ ID NO: 769978 - RNA, 23 nt, Human
ugauucagcaaguccacuucugg

SEQ ID NO: 769979 - RNA, 22 nt, Human
acuggccaggcgaaccacacug

SEQ ID NO: 769980 - RNA, 22 nt, Human
agcugggaggcuccucugugac

SEQ ID NO: 769981 - RNA, 22 nt, Human
uuggcagaugaacacaacugga

SEQ ID NO: 769982 - RNA, 22 nt, Human
cucuggccugcuuccucaggua

SEQ ID NO: 769983 - RNA, 22 nt, Human
ggcuucugcucagccugcacgc

SEQ ID NO: 769984 - RNA, 22 nt, Human
gaagccaguguuugaagaauuu

SEQ ID NO: 769985 - RNA, 22 nt, Human
uuucucucuggcccugauuguc

SEQ ID NO: 769986 - RNA, 22 nt, Human
agaaagaacguugguuaucuua

SEQ ID NO: 769987 - RNA, 22 nt, Human
ugccaaggguaugggcaagaua

SEQ ID NO: 769988 - RNA, 22 nt, Human
ucaccuuagcuagaggaagaga

SEQ ID NO: 769989 - RNA, 22 nt, Human
uuccugggggcagcagucuuga

SEQ ID NO: 769990 - RNA, 22 nt, Human
augucaccaguuuccaaauuug

SEQ ID NO: 769991 - RNA, 22 nt, Human
auucagcauucauuaugcgcca

SEQ ID NO: 769992 - RNA, 22 nt, Human
cugcagcuuuggaaaccuguuu

SEQ ID NO: 769993 - RNA, 19 nt, Human
cugaaaaacauucucagga

SEQ ID NO: 769994 - RNA, 22 nt, Human
uagaaacaucagcuaaccaaaa

SEQ ID NO: 769995 - RNA, 18 nt, Human
cagaaaucacaccagcac

SEQ ID NO: 769996 - RNA, 22 nt, Human
agauguaacgguagguggcauu

SEQ ID NO: 769997 - RNA, 22 nt, Human
ugugaaaggggucacagggaaa

SEQ ID NO: 769998 - RNA, 22 nt, Human
gaggcagcagaacauggaagag

SEQ ID NO: 769999 - RNA, 22 nt, Human
ggaggccaucagggagggcauu

SEQ ID NO: 770000 - RNA, 21 nt, Human
uacugagaccucacagugugc

SEQ ID NO: 770001 - RNA, 22 nt, Human
auuguuaauguugcacuaaggu

SEQ ID NO: 770002 - RNA, 22 nt, Human
uaauguuugggaaggugcuuug

SEQ ID NO: 770003 - RNA, 22 nt, Human
acaucuuugcucuuauagagcu

SEQ ID NO: 770004 - RNA, 22 nt, Human
gggucuggcaugcugagaugga

SEQ ID NO: 770005 - RNA, 22 nt, Human
cuggcucugagugguaucuuga

SEQ ID NO: 770006 - RNA, 17 nt, Human
ucugcagaggcaaaccu

SEQ ID NO: 770007 - RNA, 22 nt, Human
aggcccugagcauccgagggca

SEQ ID NO: 770008 - RNA, 20 nt, Human
gcauccauauaugcaugugu

SEQ ID NO: 770009 - RNA, 22 nt, Human
agccagccgggggaccacagug

SEQ ID NO: 770010 - RNA, 22 nt, Human
uggcacagggcuuggucgcuca

SEQ ID NO: 770011 - RNA, 22 nt, Human
ugcugggggugucucaccaggc

SEQ ID NO: 770012 - RNA, 23 nt, Human
acugagguacugagguugugaca

SEQ ID NO: 770013 - RNA, 21 nt, Human
gcagccacugccuucaacaau

SEQ ID NO: 770014 - RNA, 22 nt, Human
gagaaagacguaggcugggagg

SEQ ID NO: 770015 - RNA, 22 nt, Human
uggcccuggguggaauguccca

SEQ ID NO: 770016 - RNA, 22 nt, Human
cugucauugagccugucagggc

SEQ ID NO: 770017 - RNA, 22 nt, Human
uggaaguggcagaaaaugaaca

SEQ ID NO: 770018 - RNA, 22 nt, Human
agaggaggaagagcuuuaaaau

SEQ ID NO: 770019 - RNA, 22 nt, Human
ugagcugcauuacagccucugu

SEQ ID NO: 770020 - RNA, 22 nt, Human
agcuccuggucuuuguccagag

SEQ ID NO: 770021 - RNA, 22 nt, Human
cuaauuguaagcuccuugaggg

SEQ ID NO: 770022 - RNA, 22 nt, Human
uacagguagggucuauguuaga

SEQ ID NO: 770023 - RNA, 22 nt, Human
gucaggaugggcagccaaacua

SEQ ID NO: 770024 - RNA, 22 nt, Human
uuuugccuaggguugacccguu

SEQ ID NO: 770025 - RNA, 21 nt, Human
acacaacaggcagucauuuuc

SEQ ID NO: 770026 - RNA, 22 nt, Human
guauucagaaggaugaucuagu

SEQ ID NO: 770027 - RNA, 22 nt, Human
aguucuuuugugaacauaugcu

SEQ ID NO: 770028 - RNA, 22 nt, Human
uauuucacucaguauaccauag

SEQ ID NO: 770029 - RNA, 22 nt, Human
caggacaguauaggcuuuagga

SEQ ID NO: 770030 - RNA, 22 nt, Human
cauuuauuaguuaguucgaugu

SEQ ID NO: 770031 - RNA, 22 nt, Human
agagcuaagaaacagaauugcu

SEQ ID NO: 770032 - RNA, 22 nt, Human
aaaauuuuacugguguuuccuu

SEQ ID NO: 770033 - RNA, 22 nt, Human
ucacagcucugucaauuuuaua

SEQ ID NO: 770034 - RNA, 22 nt, Human
cugggcugcuugcugaaggggu

SEQ ID NO: 770035 - RNA, 22 nt, Human
caggccugggcuggguaucagg

SEQ ID NO: 770036 - RNA, 22 nt, Human
uccuugaacagagggccugggu

SEQ ID NO: 770037 - RNA, 22 nt, Human
ucagccaguuaagucaagaaau

SEQ ID NO: 770038 - RNA, 22 nt, Human
gauccguuuauacugaguuuga

SEQ ID NO: 770039 - RNA, 22 nt, Human
augaaacucuaacuuaacaagu

SEQ ID NO: 770040 - RNA, 22 nt, Human
caccuggauauguuucagcuug

SEQ ID NO: 770041 - RNA, 22 nt, Human
ccacacuaaacugcucaaacca

SEQ ID NO: 770042 - RNA, 22 nt, Human
aggcgcagcacgugagaguugg

SEQ ID NO: 770043 - RNA, 22 nt, Human
gcucacaggcaguguugggaga

SEQ ID NO: 770044 - RNA, 22 nt, Human
agucuauuucagucuuacuagu

SEQ ID NO: 770045 - RNA, 22 nt, Human
ggacacuguucauggggagggg

SEQ ID NO: 770046 - RNA, 21 nt, Human
uuagcaaagcaaacacaugcu

SEQ ID NO: 770047 - RNA, 22 nt, Human
uuguuucagcuguaugcuaugu

SEQ ID NO: 770048 - RNA, 22 nt, Human
ugggcaaggcuggagccugcag

SEQ ID NO: 770049 - RNA, 22 nt, Human
gcucuugucaaaaauuaguuga

SEQ ID NO: 770050 - RNA, 22 nt, Human
aaaaacacaacugucuuucucu

SEQ ID NO: 770051 - RNA, 22 nt, Human
uuuaacaugugaauuuuggaag

SEQ ID NO: 770052 - RNA, 22 nt, Human
cccuggagaucgggagaggaag

SEQ ID NO: 770053 - RNA, 22 nt, Human
uuguuuaaaagaaaucauagaa

SEQ ID NO: 770054 - RNA, 21 nt, Human
cacucucccaauccuugcuga

SEQ ID NO: 770055 - RNA, 22 nt, Human
uuucaaggugcaggaggguuuu

SEQ ID NO: 770056 - RNA, 22 nt, Human
ugcugcagguguguucagugag

SEQ ID NO: 770057 - RNA, 22 nt, Human
gugugcagggaugagugcaggu

SEQ ID NO: 770058 - RNA, 22 nt, Human
ugugugcacaggaguguuugaa

SEQ ID NO: 770059 - RNA, 22 nt, Human
cguggccaguuucaagcuacca

SEQ ID NO: 770060 - RNA, 22 nt, Human
uguauuuugaguccaaucuccu

SEQ ID NO: 770061 - RNA, 22 nt, Human
ucccaggaagaucccagggacc

SEQ ID NO: 770062 - RNA, 22 nt, Human
agauacaaggcagagaugugca

SEQ ID NO: 770063 - RNA, 22 nt, Human
ggcuucuuuuuaguaaauguca

SEQ ID NO: 770064 - RNA, 22 nt, Human
ugggccucggagcacaggagac

SEQ ID NO: 770065 - RNA, 23 nt, Human
acaagauagggauaaaaagauaa

SEQ ID NO: 770066 - RNA, 16 nt, Human
ucagcuauagggauug

SEQ ID NO: 770067 - RNA, 22 nt, Human
gcucaaagaccagacagaggag

SEQ ID NO: 770068 - RNA, 22 nt, Human
uagaauugaguuucacuguucc

SEQ ID NO: 770069 - RNA, 22 nt, Human
uuugaaguguuauuucuaucac

SEQ ID NO: 770070 - RNA, 22 nt, Human
uaauugcuauuggaaugcuuug

SEQ ID NO: 770071 - RNA, 17 nt, Human
ugccaagaagagcagag

SEQ ID NO: 770072 - RNA, 22 nt, Human
aagcacagagagguaaaguaac

SEQ ID NO: 770073 - RNA, 22 nt, Human
aauggcuuugacauuuucaaau

SEQ ID NO: 770074 - RNA, 22 nt, Human
augcaauauguguuucuguuua

SEQ ID NO: 770075 - RNA, 22 nt, Human
cuggagaagcauucaaauaauu

SEQ ID NO: 770076 - RNA, 22 nt, Human
aggggccucagccuccugguca

SEQ ID NO: 770077 - RNA, 22 nt, Human
gaugaggggucauuggcuggga

SEQ ID NO: 770078 - RNA, 22 nt, Human
uugcuguaguguucugauguca

SEQ ID NO: 770079 - RNA, 21 nt, Human
aaaucacuguccaaucuuggu

SEQ ID NO: 770080 - RNA, 22 nt, Human
cacauucauggaguuugccugu

SEQ ID NO: 770081 - RNA, 22 nt, Human
gacagcaaagcagagccaaggc

SEQ ID NO: 770082 - RNA, 22 nt, Human
cagaggaaaugggaaggagaua

SEQ ID NO: 770083 - RNA, 22 nt, Human
cagggagaggcaucauagggaa

SEQ ID NO: 770084 - RNA, 22 nt, Human
uaguccuugcugggcacagagu

SEQ ID NO: 770085 - RNA, 22 nt, Human
gauggugucccaggcucaggcu

SEQ ID NO: 770086 - RNA, 22 nt, Human
aagacugauguccagucccaug

SEQ ID NO: 770087 - RNA, 22 nt, Human
uaagaggcauuagagacauagc

SEQ ID NO: 770088 - RNA, 22 nt, Human
cuacucugaauugaagugauau

SEQ ID NO: 770089 - RNA, 22 nt, Human
auccugaagcaugaaugucaaa

SEQ ID NO: 770090 - RNA, 22 nt, Human
ugucaaauaguagaaagauggc

SEQ ID NO: 770091 - RNA, 22 nt, Human
gugaaauauuuuguuuauguca

SEQ ID NO: 770092 - RNA, 22 nt, Human
cagggaggcugucuuaugccug

SEQ ID NO: 770093 - RNA, 21 nt, Human
cucuggaguuugaaggcuggg

SEQ ID NO: 770094 - RNA, 22 nt, Human
ugaggccagggauuccaucauu

SEQ ID NO: 770095 - RNA, 22 nt, Human
auauuguacuaggguuacaugu

SEQ ID NO: 770096 - RNA, 21 nt, Human
ggaacauuguuaauagucucu

SEQ ID NO: 770097 - RNA, 22 nt, Human
gggagggucugccaugcucccu

SEQ ID NO: 770098 - RNA, 22 nt, Human
aagaauacguaucaacaauggu

SEQ ID NO: 770099 - RNA, 22 nt, Human
uuuagacagcaucuggugacuu

SEQ ID NO: 770100 - RNA, 22 nt, Human
uccucaggcggugaggaggggc

SEQ ID NO: 770101 - RNA, 22 nt, Human
gagacaaaaguuggagugcaag

SEQ ID NO: 770102 - RNA, 22 nt, Human
cucugagcugaaacaugagcau

SEQ ID NO: 770103 - RNA, 22 nt, Human
agugcagggccugcccagcagg

SEQ ID NO: 770104 - RNA, 22 nt, Human
aguaaucugauuuuauagcuau

SEQ ID NO: 770105 - RNA, 22 nt, Human
uaguuuagacuucaacccuuug

SEQ ID NO: 770106 - RNA, 22 nt, Human
guacagaaugcuugguaaggca

SEQ ID NO: 770107 - RNA, 22 nt, Human
gacggagcugguugcugcggcu

SEQ ID NO: 770108 - RNA, 22 nt, Human
uccugggcgagguacuggggcu

SEQ ID NO: 770109 - RNA, 22 nt, Human
uagaaaauagggccuguggagc

SEQ ID NO: 770110 - RNA, 22 nt, Human
ggagucccagcaaagccuuccc

SEQ ID NO: 770111 - RNA, 22 nt, Human
cuggacucugcagagaaaagua

SEQ ID NO: 770112 - RNA, 22 nt, Human
gggcacaggaauuugggaugug

SEQ ID NO: 770113 - RNA, 21 nt, Human
uucuccagggggagcucucuc

SEQ ID NO: 770114 - RNA, 22 nt, Human
uggcacagaaaaaugcuccauu

SEQ ID NO: 770115 - RNA, 22 nt, Human
aguuccaugucuggguuuguga

SEQ ID NO: 770116 - RNA, 22 nt, Human
caggaacagaguggcauugucu

SEQ ID NO: 770117 - RNA, 22 nt, Human
ucaguguucuuauuuaauuagg

SEQ ID NO: 770118 - RNA, 22 nt, Human
cuucugugagucaguguuucug

SEQ ID NO: 770119 - RNA, 22 nt, Human
aggugcuuggcucgugcacaca

SEQ ID NO: 770120 - RNA, 22 nt, Human
uugauucaaccacuuaauaauc

SEQ ID NO: 770121 - RNA, 22 nt, Human
agagcuggagaugcagguuucg

SEQ ID NO: 770122 - RNA, 22 nt, Human
caggcccucgcccgcagcgacc

SEQ ID NO: 770123 - RNA, 22 nt, Human
uuugagaaacagacgaaagaca

SEQ ID NO: 770124 - RNA, 21 nt, Human
ccagcugccugcacuuuggac

SEQ ID NO: 770125 - RNA, 22 nt, Human
cucagugcaaccaaagugaucu

SEQ ID NO: 770126 - RNA, 22 nt, Human
cuggaagaguaauauaaauuag

SEQ ID NO: 770127 - RNA, 22 nt, Human
uuucagagaggcuucaaaucuu

SEQ ID NO: 770128 - RNA, 22 nt, Human
cuagggcacuaggacucaugug

SEQ ID NO: 770129 - RNA, 22 nt, Human
ggaacauuggcauuuuaaggcu

SEQ ID NO: 770130 - RNA, 22 nt, Human
ggcucgagcagcuguguaggau

SEQ ID NO: 770131 - RNA, 21 nt, Human
gucuuuuuaauugcgauuucc

SEQ ID NO: 770132 - RNA, 22 nt, Human
agggcuggcuaggugcguuccc

SEQ ID NO: 770133 - RNA, 22 nt, Human
uccugucugcucacagagcugg

SEQ ID NO: 770134 - RNA, 22 nt, Human
ccagaggaggggggucuuucug

SEQ ID NO: 770135 - RNA, 22 nt, Human
gaggaggccaguggaaggaagc

SEQ ID NO: 770136 - RNA, 22 nt, Human
accuuggaacugaaguguuuuu

SEQ ID NO: 770137 - RNA, 22 nt, Human
agaaaguuuauuccuaucuagc

SEQ ID NO: 770138 - RNA, 22 nt, Human
uaucuacauguagguauguaug

SEQ ID NO: 770139 - RNA, 22 nt, Human
cauuugugugggaacccaucag

SEQ ID NO: 770140 - RNA, 18 nt, Human
gagucuuuguuacugcug

SEQ ID NO: 770141 - RNA, 22 nt, Human
cucugaacucuugggcagcaug

SEQ ID NO: 770142 - RNA, 22 nt, Human
gguggggccugcuccagcggcc

SEQ ID NO: 770143 - RNA, 22 nt, Human
ggcagggguggccuuccuuugg

SEQ ID NO: 770144 - RNA, 22 nt, Human
cagugauuuuaaacuauggaug

SEQ ID NO: 770145 - RNA, 22 nt, Human
aaaugugagacugaguuuuccu

SEQ ID NO: 770146 - RNA, 22 nt, Human
acuucuguauguccugcauuca

SEQ ID NO: 770147 - RNA, 22 nt, Human
aaguccaaggucaccauucaca

SEQ ID NO: 770148 - RNA, 18 nt, Human
cugugcagcaaacugagc

SEQ ID NO: 770149 - RNA, 23 nt, Human
caaaccuguucuccccacaugca

SEQ ID NO: 770150 - RNA, 22 nt, Human
gccuucccuggcuaggcaagca

SEQ ID NO: 770151 - RNA, 22 nt, Human
aagccaauggauugguugcuuu

SEQ ID NO: 770152 - RNA, 22 nt, Human
cccugaggagagcgcuucccga

SEQ ID NO: 770153 - RNA, 22 nt, Human
ucacagacucuugauugucuaa

SEQ ID NO: 770154 - RNA, 22 nt, Human
uagaaguuucaaaagacuucau

SEQ ID NO: 770155 - RNA, 22 nt, Human
gcugauaaauaguugauguacc

SEQ ID NO: 770156 - RNA, 22 nt, Human
aagcuucaguucuggggcaaug

SEQ ID NO: 770157 - RNA, 22 nt, Human
gccccuucucugaggaaccugc

SEQ ID NO: 770158 - RNA, 22 nt, Human
uguacacacacguguguaucua

SEQ ID NO: 770159 - RNA, 22 nt, Human
ucaucacucauuggacaacaga

SEQ ID NO: 770160 - RNA, 22 nt, Human
ggacucaggcugguguucggac

SEQ ID NO: 770161 - RNA, 22 nt, Human
uugcuuuaaugagauuuugcca

SEQ ID NO: 770162 - RNA, 22 nt, Human
ugguuccucagggcagcuguac

SEQ ID NO: 770163 - RNA, 22 nt, Human
augguuuuauuucucuauagcu

SEQ ID NO: 770164 - RNA, 22 nt, Human
ugcuggagacauagcaggcagc

SEQ ID NO: 770165 - RNA, 22 nt, Human
gggagcgggacugcgcaggcuu

SEQ ID NO: 770166 - RNA, 22 nt, Human
gaugcgggcccgcuccacugcc

SEQ ID NO: 770167 - RNA, 22 nt, Human
acacaugcugauaagaauauaa

SEQ ID NO: 770168 - RNA, 22 nt, Human
gagcccagcccagagccauaug

SEQ ID NO: 770169 - RNA, 22 nt, Human
aucauuccacauguaccacuag

SEQ ID NO: 770170 - RNA, 22 nt, Human
aagcagaugccaagauuuacca

SEQ ID NO: 770171 - RNA, 22 nt, Human
caggaggcaucauggagcggac

SEQ ID NO: 770172 - RNA, 21 nt, Human
ugugcaguccaaugugcuagc

SEQ ID NO: 770173 - RNA, 22 nt, Human
uggcuucugggguggccugcau

SEQ ID NO: 770174 - RNA, 22 nt, Human
gaagcagcuggugagauggagc

SEQ ID NO: 770175 - RNA, 22 nt, Human
ccaccaagucccacuauaauuu

SEQ ID NO: 770176 - RNA, 17 nt, Human
ggugagaccucccacuc

SEQ ID NO: 770177 - RNA, 22 nt, Human
ucugggcagagggucuuaguca

SEQ ID NO: 770178 - RNA, 22 nt, Human
aaucaucuccgaaaaaagagua

SEQ ID NO: 770179 - RNA, 22 nt, Human
caguuuauauauaagcacauug

SEQ ID NO: 770180 - RNA, 23 nt, Human
ggugggagauuauccagaauuau

SEQ ID NO: 770181 - RNA, 22 nt, Human
uggcucugugaacagacgacug

SEQ ID NO: 770182 - RNA, 21 nt, Human
ugagcaaaauuuagagugaug

SEQ ID NO: 770183 - RNA, 22 nt, Human
ucaggccacuucacaggugauu

SEQ ID NO: 770184 - RNA, 22 nt, Human
auguuuacagaggaagugccuc

SEQ ID NO: 770185 - RNA, 22 nt, Human
cauuccagagcugccucugcua

SEQ ID NO: 770186 - RNA, 23 nt, Human
gaauaguuuuagaaauuggagaa

SEQ ID NO: 770187 - RNA, 22 nt, Human
uugagaaaagcuguguaaggau

SEQ ID NO: 770188 - RNA, 22 nt, Human
cuguggcugccucaccuacagg

SEQ ID NO: 770189 - RNA, 22 nt, Human
gggcuggaaaaacaacauacaa

SEQ ID NO: 770190 - RNA, 22 nt, Human
ccuccuggagcauuggugagga

SEQ ID NO: 770191 - RNA, 22 nt, Human
uaacacugguuaucccugugca

SEQ ID NO: 770192 - RNA, 22 nt, Human
cuggccuggucuggccucucca

SEQ ID NO: 770193 - RNA, 22 nt, Human
aauggcagaaugggccagaagc

SEQ ID NO: 770194 - RNA, 22 nt, Human
acacuuaagcaugaaguauaaa

SEQ ID NO: 770195 - RNA, 22 nt, Human
guggaccaagguggaagauaaa

SEQ ID NO: 770196 - RNA, 22 nt, Human
ugagcagagacgggggccucca

SEQ ID NO: 770197 - RNA, 22 nt, Human
ugggccugaaauucccauuuua

SEQ ID NO: 770198 - RNA, 22 nt, Human
uccuggcccuguggccugcagu

SEQ ID NO: 770199 - RNA, 22 nt, Human
aagccaguguuuuugagaguug

SEQ ID NO: 770200 - RNA, 22 nt, Human
aggggccucgcaggaccgcucc

SEQ ID NO: 770201 - RNA, 22 nt, Human
ggaggccauaguuugggaguca

SEQ ID NO: 770202 - RNA, 18 nt, Human
uuccauaauguauguaac

SEQ ID NO: 770203 - RNA, 22 nt, Human
ccaggucugcgggcggcaggca

SEQ ID NO: 770204 - RNA, 22 nt, Human
aaucuacaugcaauauuuuuag

SEQ ID NO: 770205 - RNA, 22 nt, Human
gucaaaacacuggggaauguug

SEQ ID NO: 770206 - RNA, 22 nt, Human
uagaucaggcugcuuagauaga

SEQ ID NO: 770207 - RNA, 22 nt, Human
uuccugguaaauuauguccagg

SEQ ID NO: 770208 - RNA, 22 nt, Human
uuucagaggugcuuggaaugcu

SEQ ID NO: 770209 - RNA, 22 nt, Human
uguacaaucuuggucccuuuau

SEQ ID NO: 770210 - RNA, 22 nt, Human
gccugggugaauuugauccuaa

SEQ ID NO: 770211 - RNA, 22 nt, Human
ucuccuuugaaaguuaggacug

SEQ ID NO: 770212 - RNA, 22 nt, Human
aaagacaguggauucaaaaucc

SEQ ID NO: 770213 - RNA, 22 nt, Human
ugaccugcagucaagaggggaa

SEQ ID NO: 770214 - RNA, 22 nt, Human
acauucuaugaagauaauuuua

SEQ ID NO: 770215 - RNA, 22 nt, Human
ucacuugaauucauucugcgaa

SEQ ID NO: 770216 - RNA, 22 nt, Human
accacaggguaaaguuagauau

SEQ ID NO: 770217 - RNA, 22 nt, Human
gcugagcagguguaaggaaggc

SEQ ID NO: 770218 - RNA, 22 nt, Human
guggcugcugguacucugggaa

SEQ ID NO: 770219 - RNA, 19 nt, Human
acuucuuuucaacacagga

SEQ ID NO: 770220 - RNA, 22 nt, Human
uuacugaaaauucuucaggauu

SEQ ID NO: 770221 - RNA, 22 nt, Human
gccuguggggcugaggcugccu

SEQ ID NO: 770222 - RNA, 22 nt, Human
uuucuaagaaaguaaugguuau

SEQ ID NO: 770223 - RNA, 22 nt, Human
auguguauguguauacacacag

SEQ ID NO: 770224 - RNA, 22 nt, Human
uuuacgagugcuaaugauauug

SEQ ID NO: 770225 - RNA, 22 nt, Human
auuugcauuuacauagcauaga

SEQ ID NO: 770226 - RNA, 22 nt, Human
uucaaaugauggcaguccuggc

SEQ ID NO: 770227 - RNA, 22 nt, Human
gcacagcccuggucggggcccc

SEQ ID NO: 770228 - RNA, 22 nt, Human
uccuggcuaguuuugcugaaau

SEQ ID NO: 770229 - RNA, 22 nt, Human
gauuucugggcuuuauuucaga

SEQ ID NO: 770230 - RNA, 22 nt, Human
ccuggcucagcagcucuuucuc

SEQ ID NO: 770231 - RNA, 22 nt, Human
acaaccuguucguuuccacaga

SEQ ID NO: 770232 - RNA, 22 nt, Human
gagcagcuccagccgcaugacu

SEQ ID NO: 770233 - RNA, 22 nt, Human
augaaacaaggguauuuucucu

SEQ ID NO: 770234 - RNA, 22 nt, Human
caguuucuucuauuuugaacua

SEQ ID NO: 770235 - RNA, 22 nt, Human
auacaguauaacuaauaaaccc

SEQ ID NO: 770236 - RNA, 19 nt, Human
ucugaggcuucuccccuug

SEQ ID NO: 770237 - RNA, 22 nt, Human
aaugucugaaaaucagacugca

SEQ ID NO: 770238 - RNA, 22 nt, Human
ucugaggucacagauuucaaga

SEQ ID NO: 770239 - RNA, 22 nt, Human
aucugccuccaaguccaugugu

SEQ ID NO: 770240 - RNA, 22 nt, Human
uccaaaggcccuaauaagcuug

SEQ ID NO: 770241 - RNA, 22 nt, Human
uuucccuacuuguaacuggaaa

SEQ ID NO: 770242 - RNA, 22 nt, Human
ccaagggcucuggacagagugg

SEQ ID NO: 770243 - RNA, 22 nt, Human
gagcagcuggaggccuuguugg

SEQ ID NO: 770244 - RNA, 22 nt, Human
cagaggaaaguauuucuggaag

SEQ ID NO: 770245 - RNA, 22 nt, Human
uucuucuucauuucugacgaug

SEQ ID NO: 770246 - RNA, 22 nt, Human
uaaggcacccauguucauacag

SEQ ID NO: 770247 - RNA, 22 nt, Human
ggcucaggacacagugguuuag

SEQ ID NO: 770248 - RNA, 22 nt, Human
acucugcuaaauguaaguuggu

SEQ ID NO: 770249 - RNA, 22 nt, Human
acuuccagcuagguucugcuaa

SEQ ID NO: 770250 - RNA, 22 nt, Human
aggcacaaagacagaaaagcac

SEQ ID NO: 770251 - RNA, 22 nt, Human
gucucaguuguaucaccugguu

SEQ ID NO: 770252 - RNA, 22 nt, Human
gucaaguuuauccgcucauuca

SEQ ID NO: 770253 - RNA, 22 nt, Human
acauugaacaguacaaaugauc

SEQ ID NO: 770254 - RNA, 22 nt, Human
gugaggcagggaaagaggauaa

SEQ ID NO: 770255 - RNA, 22 nt, Human
cauggcuuacuuucagggagua

SEQ ID NO: 770256 - RNA, 22 nt, Human
cuagagcagauugcagaguagg

SEQ ID NO: 770257 - RNA, 22 nt, Human
ggguuccaaugaugagcaagag

SEQ ID NO: 770258 - RNA, 22 nt, Human
ggcuggcaagugucugcucaug

SEQ ID NO: 770259 - RNA, 22 nt, Human
cuacuuccagggguggggcuca

SEQ ID NO: 770260 - RNA, 22 nt, Human
ucuguucaucaucuggacacau

SEQ ID NO: 770261 - RNA, 22 nt, Human
aagcagcauccugggcagaccu

SEQ ID NO: 770262 - RNA, 22 nt, Human
cuucuuguaaacgguuccccga

SEQ ID NO: 770263 - RNA, 22 nt, Human
agucacaugaguuucucuuuau

SEQ ID NO: 770264 - RNA, 22 nt, Human
uucuuucucagugggcagauac

SEQ ID NO: 770265 - RNA, 22 nt, Human
gagagugaugaaugguuaaaca

SEQ ID NO: 770266 - RNA, 22 nt, Human
gcuuucugauugcgaaaacaaa

SEQ ID NO: 770267 - RNA, 22 nt, Human
acaaaugccauauauaaauucu

SEQ ID NO: 770268 - RNA, 22 nt, Human
cugguuuuauguuauagaugga

SEQ ID NO: 770269 - RNA, 22 nt, Human
uagaaauggggaaguaguuagg

SEQ ID NO: 770270 - RNA, 22 nt, Human
gagauggggaauaggagcaagc

SEQ ID NO: 770271 - RNA, 22 nt, Human
uugauacacaauggaacaaugu

SEQ ID NO: 770272 - RNA, 22 nt, Human
cuggcuuuucaaacuguucagu

SEQ ID NO: 770273 - RNA, 22 nt, Human
gggaagagaggaggugguuucg

SEQ ID NO: 770274 - RNA, 22 nt, Human
ucagaaguugauaaaguaguug

SEQ ID NO: 770275 - RNA, 22 nt, Human
ucucagaauaaauuccuaacuu

SEQ ID NO: 770276 - RNA, 22 nt, Human
uaaauccuuaucuucuuugaau

SEQ ID NO: 770277 - RNA, 21 nt, Human
ccuugggaugcaagugagacu

SEQ ID NO: 770278 - RNA, 23 nt, Human
uuggaagggaagagcauuugaga

SEQ ID NO: 770279 - RNA, 22 nt, Human
uucaggaaaugucugccuacca

SEQ ID NO: 770280 - RNA, 22 nt, Human
uguggcaguauaagagcuagaa

SEQ ID NO: 770281 - RNA, 22 nt, Human
ucuuuggauauguauggauaga

SEQ ID NO: 770282 - RNA, 22 nt, Human
ucagcuggauguggaagugcua

SEQ ID NO: 770283 - RNA, 22 nt, Human
acuuuaaaaagagccuucuaac

SEQ ID NO: 770284 - RNA, 22 nt, Human
cauuaacaaugacugcuugacu

SEQ ID NO: 770285 - RNA, 22 nt, Human
gcccuggaaucucuccauggga

SEQ ID NO: 770286 - RNA, 22 nt, Human
caggaugggauguagugggccc

SEQ ID NO: 770287 - RNA, 21 nt, Human
ucccagggucuuaugggaugu

SEQ ID NO: 770288 - RNA, 22 nt, Human
ucacacagcugacagagccuuu

SEQ ID NO: 770289 - RNA, 22 nt, Human
uuccuuucccucacagccucgg

SEQ ID NO: 770290 - RNA, 22 nt, Human
ugcuggcugcagugcugucaaa

SEQ ID NO: 770291 - RNA, 22 nt, Human
cuggggcaugggccccuagagg

SEQ ID NO: 770292 - RNA, 17 nt, Human
agcagcuggcacaggag

SEQ ID NO: 770293 - RNA, 23 nt, Human
agggccacugggaaggauuacug

SEQ ID NO: 770294 - RNA, 22 nt, Human
ugguccagucguuccuuuccuu

SEQ ID NO: 770295 - RNA, 22 nt, Human
gggcagugucggggcccaggga

SEQ ID NO: 770296 - RNA, 22 nt, Human
ucugcagacuugauaaccacug

SEQ ID NO: 770297 - RNA, 22 nt, Human
acagagguguguguaggacagu

SEQ ID NO: 770298 - RNA, 22 nt, Human
ccuggcuucagcauugcccucu

SEQ ID NO: 770299 - RNA, 22 nt, Human
acaggaguuucugacagagaca

SEQ ID NO: 770300 - RNA, 22 nt, Human
cugcugcaacucuuuagagggu

SEQ ID NO: 770301 - RNA, 22 nt, Human
uuccaagucuaaguuauaaauc

SEQ ID NO: 770302 - RNA, 22 nt, Human
gccgugggugucauggcccaua

SEQ ID NO: 770303 - RNA, 22 nt, Human
cagcuuuccagagaccugcccc

SEQ ID NO: 770304 - RNA, 22 nt, Human
aggcagcaagauuauuuaaucc

SEQ ID NO: 770305 - RNA, 18 nt, Human
ucagcuuuugaaaaccaa

SEQ ID NO: 770306 - RNA, 20 nt, Human
uggcucucacccugugcgau

SEQ ID NO: 770307 - RNA, 19 nt, Human
auucauuuuugccuucuaa

SEQ ID NO: 770308 - RNA, 20 nt, Human
gccacaguuuucucacugca

SEQ ID NO: 770309 - RNA, 22 nt, Human
augcuuuuaugucacaugguca

SEQ ID NO: 770310 - RNA, 22 nt, Human
cccucaccaggcuccaggcaug

SEQ ID NO: 770311 - RNA, 22 nt, Human
uuucaaggcuaguuuuaauuag

SEQ ID NO: 770312 - RNA, 22 nt, Human
gcugaaaaauagugucguguuu

SEQ ID NO: 770313 - RNA, 19 nt, Human
gcugcuggcucuggcugga

SEQ ID NO: 770314 - RNA, 22 nt, Human
gcugacaguuacugcuguaaca

SEQ ID NO: 770315 - RNA, 19 nt, Human
cucuuuacucccuugccuu

SEQ ID NO: 770316 - RNA, 22 nt, Human
caggaaagagagcuauucacuu

SEQ ID NO: 770317 - RNA, 22 nt, Human
gagcccagucugcuccugcgcc

SEQ ID NO: 770318 - RNA, 22 nt, Human
ugccugucagggggagugggaa

SEQ ID NO: 770319 - RNA, 22 nt, Human
ugaggccagaguuuuuaauucc

SEQ ID NO: 770320 - RNA, 22 nt, Human
auguucuuugugauucugagcu

SEQ ID NO: 770321 - RNA, 22 nt, Human
uaaugcaguacugauauaaaca

SEQ ID NO: 770322 - RNA, 22 nt, Human
ugugcaugucugggccuguaag

SEQ ID NO: 770323 - RNA, 22 nt, Human
ugcaacuaggagguucuuagcu

SEQ ID NO: 770324 - RNA, 22 nt, Human
auguauauacuuacaugugugg

SEQ ID NO: 770325 - RNA, 22 nt, Human
auguaugaugcuaggcucucag

SEQ ID NO: 770326 - RNA, 21 nt, Human
gguggcuagaaagcagugaga

SEQ ID NO: 770327 - RNA, 16 nt, Human
gcuuagugagagcaac

SEQ ID NO: 770328 - RNA, 22 nt, Human
cuaaaaacucuacgaugcacag

SEQ ID NO: 770329 - RNA, 22 nt, Human
agagccagguguagucucggag

SEQ ID NO: 770330 - RNA, 22 nt, Human
uucacauucucacaagaggaaa

SEQ ID NO: 770331 - RNA, 22 nt, Human
auguauuucuauguagugaaga

SEQ ID NO: 770332 - RNA, 22 nt, Human
gagggcuccauuccccgugccc

SEQ ID NO: 770333 - RNA, 22 nt, Human
cuuccaguaguaucauucucau

SEQ ID NO: 770334 - RNA, 22 nt, Human
uucucuggaaggcucuacggga

SEQ ID NO: 770335 - RNA, 17 nt, Human
uugggagagaaagguau

SEQ ID NO: 770336 - RNA, 22 nt, Human
uggcccuuguccugggagaguu

SEQ ID NO: 770337 - RNA, 22 nt, Human
aggcugugagagguggcuccca

SEQ ID NO: 770338 - RNA, 22 nt, Human
uuuaaaaaacuagucugagucu

SEQ ID NO: 770339 - RNA, 22 nt, Human
ucaauacagaaaggauauuuug

SEQ ID NO: 770340 - RNA, 22 nt, Human
acuuuugaacaaacuccucugu

SEQ ID NO: 770341 - RNA, 22 nt, Human
aaggaugcagggacccaaggcu

SEQ ID NO: 770342 - RNA, 22 nt, Human
gacauuaauuucuuugguaauu

SEQ ID NO: 770343 - RNA, 22 nt, Human
cugagcuucagugcacugggag

SEQ ID NO: 770344 - RNA, 22 nt, Human
uaagcugugggagauuggcaua

SEQ ID NO: 770345 - RNA, 22 nt, Human
caccagccagagugacagcucc

SEQ ID NO: 770346 - RNA, 22 nt, Human
auguggcuagugcagaugaaua

SEQ ID NO: 770347 - RNA, 22 nt, Human
acccuccaggcugcagcuccug

SEQ ID NO: 770348 - RNA, 22 nt, Human
guucagggagggacagaugaag

SEQ ID NO: 770349 - RNA, 22 nt, Human
aagcagacagagaauggguuug

SEQ ID NO: 770350 - RNA, 22 nt, Human
uuucuugagugaugcuuagugu

SEQ ID NO: 770351 - RNA, 22 nt, Human
guguuaauuauuggugaauaga

SEQ ID NO: 770352 - RNA, 22 nt, Human
caggaaccugugcguagggaug

SEQ ID NO: 770353 - RNA, 22 nt, Human
aaacugaauucccaagggcaug

SEQ ID NO: 770354 - RNA, 22 nt, Human
ccaaggcagaagauggcucuug

SEQ ID NO: 770355 - RNA, 23 nt, Human
auuuccuaaaagauaaucauuac

SEQ ID NO: 770356 - RNA, 22 nt, Human
aagccuaaaugaugcuauuaug

SEQ ID NO: 770357 - RNA, 22 nt, Human
agcucccagcagagcuggccac

SEQ ID NO: 770358 - RNA, 22 nt, Human
aagccaguaaguuuuugucauu

SEQ ID NO: 770359 - RNA, 22 nt, Human
gugccuggggguaauguaggau

SEQ ID NO: 770360 - RNA, 22 nt, Human
ccacaggaggaacaauuagaug

SEQ ID NO: 770361 - RNA, 18 nt, Human
acagaggcagacauguau

SEQ ID NO: 770362 - RNA, 22 nt, Human
gaccuccagcggcccugcagag

SEQ ID NO: 770363 - RNA, 22 nt, Human
uuuaucugugggaguuguuugg

SEQ ID NO: 770364 - RNA, 22 nt, Human
uuauuaugguauuucuuugcag

SEQ ID NO: 770365 - RNA, 22 nt, Human
caggaauguagcagcgauggaa

SEQ ID NO: 770366 - RNA, 22 nt, Human
aggaaagaaguacauucucaug

SEQ ID NO: 770367 - RNA, 22 nt, Human
guagggacaugccauuaucuca

SEQ ID NO: 770368 - RNA, 22 nt, Human
aauuguacauauuuaugagcga

SEQ ID NO: 770369 - RNA, 19 nt, Human
uuucugcagcccagcagca

SEQ ID NO: 770370 - RNA, 22 nt, Human
auccuuggauccuguguuccug

SEQ ID NO: 770371 - RNA, 22 nt, Human
ugguggccgaagcccucucuca

SEQ ID NO: 770372 - RNA, 22 nt, Human
ggcuuccagugaugccucuuug

SEQ ID NO: 770373 - RNA, 22 nt, Human
cugggcuuagcagcuccugguc

SEQ ID NO: 770374 - RNA, 22 nt, Human
ggcuuaagaugguagcuuugag

SEQ ID NO: 770375 - RNA, 22 nt, Human
ugcagagguuuuuaauacauuu

SEQ ID NO: 770376 - RNA, 22 nt, Human
ugcugccuaggaaucuguauuu

SEQ ID NO: 770377 - RNA, 22 nt, Human
uuccuggggcgacuguaucuga

SEQ ID NO: 770378 - RNA, 22 nt, Human
gucaauaucuugguuguacuau

SEQ ID NO: 770379 - RNA, 22 nt, Human
ugacaaguacauaauuucaugu

SEQ ID NO: 770380 - RNA, 22 nt, Human
cccuuuaaaguuuuaccagcag

SEQ ID NO: 770381 - RNA, 22 nt, Human
gcuuggggagcucaguguccuu

SEQ ID NO: 770382 - RNA, 22 nt, Human
uaugagaaauuauaccuagguu

SEQ ID NO: 770383 - RNA, 22 nt, Human
accaggaggccuugguucugag

SEQ ID NO: 770384 - RNA, 22 nt, Human
uuagccaugcccuagaagagga

SEQ ID NO: 770385 - RNA, 22 nt, Human
uaggucugauuuccauucaguc

SEQ ID NO: 770386 - RNA, 22 nt, Human
auggguggagggugacacggau

SEQ ID NO: 770387 - RNA, 22 nt, Human
cagcaaaugaguggcagggcag

SEQ ID NO: 770388 - RNA, 22 nt, Human
auuugaauggcuuaacacaacg

SEQ ID NO: 770389 - RNA, 22 nt, Human
auugggcuggccuucuggagag

SEQ ID NO: 770390 - RNA, 21 nt, Human
ccucugcucgggcaugcguuu

SEQ ID NO: 770391 - RNA, 22 nt, Human
ucuggaaugauuuccuuccccu

SEQ ID NO: 770392 - RNA, 22 nt, Human
uuuacuuuugguaaggucauuu

SEQ ID NO: 770393 - RNA, 22 nt, Human
gcaaugcaaucuuuauuauauu

SEQ ID NO: 770394 - RNA, 22 nt, Human
ugcagcugugccugaaaaguac

SEQ ID NO: 770395 - RNA, 22 nt, Human
ggcagaggaggggugaauuugc

SEQ ID NO: 770396 - RNA, 23 nt, Human
uuccagaguccacaucugccacc

SEQ ID NO: 770397 - RNA, 22 nt, Human
gagugcugagcccacuuccuug

SEQ ID NO: 770398 - RNA, 22 nt, Human
gugcagaggacguggcggccuc

SEQ ID NO: 770399 - RNA, 22 nt, Human
ucaguucugcuagaaaaacagu

SEQ ID NO: 770400 - RNA, 22 nt, Human
aaaagccaugcauaccuaagag

SEQ ID NO: 770401 - RNA, 22 nt, Human
uaugaacauguucauugacuua

SEQ ID NO: 770402 - RNA, 22 nt, Human
cuacuucuaaguacauggugau

SEQ ID NO: 770403 - RNA, 22 nt, Human
aagccagccagugccagucuua

SEQ ID NO: 770404 - RNA, 22 nt, Human
aagggcagcugacagaugcuua

SEQ ID NO: 770405 - RNA, 22 nt, Human
cucagaaagugacaggggggug

SEQ ID NO: 770406 - RNA, 22 nt, Human
gucugcugacagagcauggacc

SEQ ID NO: 770407 - RNA, 18 nt, Human
gcagagugcgucucugug

SEQ ID NO: 770408 - RNA, 22 nt, Human
cagugaggaugauaauuaaggu

SEQ ID NO: 770409 - RNA, 22 nt, Human
gacauucauuaagccuuucugu

SEQ ID NO: 770410 - RNA, 22 nt, Human
uuauuucuugucuauguagcca

SEQ ID NO: 770411 - RNA, 23 nt, Human
ggggaaagaccaugcuugaggac

SEQ ID NO: 770412 - RNA, 22 nt, Human
auucucuggcuaaaaccugaag

SEQ ID NO: 770413 - RNA, 22 nt, Human
ucccaggaucugagggcagaga

SEQ ID NO: 770414 - RNA, 22 nt, Human
ucugggcuugguuagggcuguu

SEQ ID NO: 770415 - RNA, 22 nt, Human
gggcugagccacagcuuuuguu

SEQ ID NO: 770416 - RNA, 22 nt, Human
agcaggguuccaggaguugcag

SEQ ID NO: 770417 - RNA, 22 nt, Human
ugcugaggcuagaccuggaagu

SEQ ID NO: 770418 - RNA, 22 nt, Human
cacagagaacugugggagugug

SEQ ID NO: 770419 - RNA, 22 nt, Human
agaauaaacugcuuuagggcag

SEQ ID NO: 770420 - RNA, 22 nt, Human
cuguccuccggccaccuacagu

SEQ ID NO: 770421 - RNA, 22 nt, Human
ugccagcacuucuggcugucug

SEQ ID NO: 770422 - RNA, 22 nt, Human
aaggcagaaauucaacuacugg

SEQ ID NO: 770423 - RNA, 22 nt, Human
uuuccuuugugcaggccuuggg

SEQ ID NO: 770424 - RNA, 22 nt, Human
ugggauagggcuauugcucaca

SEQ ID NO: 770425 - RNA, 23 nt, Human
agaggccagccuuuggagacacc

SEQ ID NO: 770426 - RNA, 20 nt, Human
auugacagaaaguguucacc

SEQ ID NO: 770427 - RNA, 22 nt, Human
guauauaucggcacuauuuuaa

SEQ ID NO: 770428 - RNA, 22 nt, Human
ucuguggccugccuccucauuu

SEQ ID NO: 770429 - RNA, 22 nt, Human
uugucaaguaaggcugacauuu

SEQ ID NO: 770430 - RNA, 22 nt, Human
ugagcugugucuuggugagagu

SEQ ID NO: 770431 - RNA, 22 nt, Human
guuucuuagacauaugccauga

SEQ ID NO: 770432 - RNA, 22 nt, Human
gacacuuuuuuaaagcucauua

SEQ ID NO: 770433 - RNA, 22 nt, Human
gcagguggugggggagccguuc

SEQ ID NO: 770434 - RNA, 22 nt, Human
aaaguacaugcaauucuucuga

SEQ ID NO: 770435 - RNA, 22 nt, Human
uuucagaguuauguaagaaaau

SEQ ID NO: 770436 - RNA, 23 nt, Human
cagcucagaguguguccuguuuc

SEQ ID NO: 770437 - RNA, 17 nt, Human
auacaaagccauaaacc

SEQ ID NO: 770438 - RNA, 22 nt, Human
uaauccaaaacugaaucugugg

SEQ ID NO: 770439 - RNA, 22 nt, Human
auguaaguuuaagcacaacaag

SEQ ID NO: 770440 - RNA, 22 nt, Human
ugacugugcaagcagagagcau

SEQ ID NO: 770441 - RNA, 22 nt, Human
cugaacucaugauaugcuuuug

SEQ ID NO: 770442 - RNA, 22 nt, Human
ccuggcagcagcacaugccuuc

SEQ ID NO: 770443 - RNA, 22 nt, Human
caagcuggaguuccucagagug

SEQ ID NO: 770444 - RNA, 22 nt, Human
ggccuugguggcuuugcugaug

SEQ ID NO: 770445 - RNA, 22 nt, Human
ugccuacuaguacuauuuugug

SEQ ID NO: 770446 - RNA, 22 nt, Human
uuggccaaauaaucuugcagau

SEQ ID NO: 770447 - RNA, 22 nt, Human
auuucccagggccugggauuug

SEQ ID NO: 770448 - RNA, 22 nt, Human
gaguuggcuacucucugaggcu

SEQ ID NO: 770449 - RNA, 22 nt, Human
aggcugugacagggucauggag

SEQ ID NO: 770450 - RNA, 22 nt, Human
ucugaggucagugcugcaguua

SEQ ID NO: 770451 - RNA, 18 nt, Human
ggagacuaaacuguugac

SEQ ID NO: 770452 - RNA, 22 nt, Human
auguuuuccauugccauggaaa

SEQ ID NO: 770453 - RNA, 22 nt, Human
ucugcaggcuuggaguggcagc

SEQ ID NO: 770454 - RNA, 22 nt, Human
uccugggaguaauugagucaug

SEQ ID NO: 770455 - RNA, 22 nt, Human
ucucaggcucuuggaaccuguu

SEQ ID NO: 770456 - RNA, 22 nt, Human
gaccuuccaugccuucuuccaa

SEQ ID NO: 770457 - RNA, 18 nt, Human
cacaggagccacacucac

SEQ ID NO: 770458 - RNA, 22 nt, Human
guuuaaagucuuggaaggagga

SEQ ID NO: 770459 - RNA, 22 nt, Human
uucucagaggcugcuaagugca

SEQ ID NO: 770460 - RNA, 23 nt, Human
ccauggagcauggcucacuaggc

SEQ ID NO: 770461 - RNA, 21 nt, Human
ucaugcaggcagaguuuggua

SEQ ID NO: 770462 - RNA, 22 nt, Human
uaguuuccuaggcuguauuguu

SEQ ID NO: 770463 - RNA, 22 nt, Human
ccucuggccauucuuugaugga

SEQ ID NO: 770464 - RNA, 22 nt, Human
guucuucaucauuuuagauagg

SEQ ID NO: 770465 - RNA, 22 nt, Human
cuucacaaucaccuuuucggaa

SEQ ID NO: 770466 - RNA, 22 nt, Human
ugccuggcugggcugcucaugg

SEQ ID NO: 770467 - RNA, 22 nt, Human
aagugucugauggagcgaaaug

SEQ ID NO: 770468 - RNA, 22 nt, Human
guaaaucauggucagaauaaau

SEQ ID NO: 770469 - RNA, 22 nt, Human
uggucucugcaggccaggcuca

SEQ ID NO: 770470 - RNA, 22 nt, Human
ucuggcuucuaugaauguccuu

SEQ ID NO: 770471 - RNA, 22 nt, Human
uacagaaaaacuggcauugaag

SEQ ID NO: 770472 - RNA, 22 nt, Human
cuguggaagguuuagauaggua

SEQ ID NO: 770473 - RNA, 22 nt, Human
cccugaaaguacacugggacgg

SEQ ID NO: 770474 - RNA, 22 nt, Human
cccuccagugucccagugggga

SEQ ID NO: 770475 - RNA, 22 nt, Human
ggcagcacugcagcuuguuggg

SEQ ID NO: 770476 - RNA, 23 nt, Human
uuaaaauguggucucucccuagu

SEQ ID NO: 770477 - RNA, 21 nt, Human
uacagucuccccuguugucca

SEQ ID NO: 770478 - RNA, 22 nt, Human
uuacaguacagaaaauaacaga

SEQ ID NO: 770479 - RNA, 22 nt, Human
gugaggugguacaauauuaacu

SEQ ID NO: 770480 - RNA, 16 nt, Human
ucauugaagacaguac

SEQ ID NO: 770481 - RNA, 22 nt, Human
agcaggaaggggaugaugggca

SEQ ID NO: 770482 - RNA, 22 nt, Human
uuaauuuuuauguauagugugu

SEQ ID NO: 770483 - RNA, 23 nt, Human
uuucagcauucuaguucagguuc

SEQ ID NO: 770484 - RNA, 22 nt, Human
uaugguuauccucaaaagagga

SEQ ID NO: 770485 - RNA, 22 nt, Human
caccugcagggggagucaagag

SEQ ID NO: 770486 - RNA, 22 nt, Human
auggcuagcaccgcguugcugg

SEQ ID NO: 770487 - RNA, 22 nt, Human
ccaggaagauuuauuuuggcuu

SEQ ID NO: 770488 - RNA, 22 nt, Human
gggugguggccagcagugggca

SEQ ID NO: 770489 - RNA, 22 nt, Human
auauacacaucuuuuuaaauau

SEQ ID NO: 770490 - RNA, 22 nt, Human
ccacauuuacuggaugcucagg

SEQ ID NO: 770491 - RNA, 22 nt, Human
ugggccuccuuuccauucagag

SEQ ID NO: 770492 - RNA, 22 nt, Human
cccaaguauuccuccucugccc

SEQ ID NO: 770493 - RNA, 22 nt, Human
agacaauuguucuaaguaaaaa

SEQ ID NO: 770494 - RNA, 18 nt, Human
cccagaggaaugccugga

SEQ ID NO: 770495 - RNA, 22 nt, Human
ucuuauaaaaggacucccauuu

SEQ ID NO: 770496 - RNA, 22 nt, Human
gcucucuugguggcuguccugg

SEQ ID NO: 770497 - RNA, 22 nt, Human
caaggcaguuccccagagggcu

SEQ ID NO: 770498 - RNA, 22 nt, Human
acuuucauuugugaagacugua

SEQ ID NO: 770499 - RNA, 23 nt, Human
ucaaaggaggcaucguucugcag

SEQ ID NO: 770500 - RNA, 22 nt, Human
agcaacagcagguuugcacucc

SEQ ID NO: 770501 - RNA, 22 nt, Human
auggaaagcuaagccauuuacc

SEQ ID NO: 770502 - RNA, 22 nt, Human
guuauacaguuuugggucugcu

SEQ ID NO: 770503 - RNA, 18 nt, Human
uucaguuucuaguuccuu

SEQ ID NO: 770504 - RNA, 22 nt, Human
ucaggaauccagacagggcaca

SEQ ID NO: 770505 - RNA, 17 nt, Human
accaggcaacacgccca

SEQ ID NO: 770506 - RNA, 19 nt, Human
uguggccuggggacaggcc

SEQ ID NO: 770507 - RNA, 22 nt, Human
ugaagauuuuguagcuuucagc

SEQ ID NO: 770508 - RNA, 22 nt, Human
ccuggagcaggagcugcagagg

SEQ ID NO: 770509 - RNA, 19 nt, Human
agaggcagucuccaacagg

SEQ ID NO: 770510 - RNA, 22 nt, Human
augugcugaguguguauauaca

SEQ ID NO: 770511 - RNA, 22 nt, Human
cuucuuuaauguauacaaaaga

SEQ ID NO: 770512 - RNA, 22 nt, Human
cuacauacuguguguaaagaau

SEQ ID NO: 770513 - RNA, 22 nt, Human
ucuccaggaagcccucccugac

SEQ ID NO: 770514 - RNA, 22 nt, Human
agcuguuggcuggcugagcucu

SEQ ID NO: 770515 - RNA, 22 nt, Human
gcaaacauuccacagaaggaag

SEQ ID NO: 770516 - RNA, 23 nt, Human
cucccuggaguuucuggaagaug

SEQ ID NO: 770517 - RNA, 22 nt, Human
cuggguuccauguagccaagag

SEQ ID NO: 770518 - RNA, 22 nt, Human
ucucccaagugaccaggaaaga

SEQ ID NO: 770519 - RNA, 20 nt, Human
ccacaugagcucuuucugac

SEQ ID NO: 770520 - RNA, 22 nt, Human
uucucuccuccuagaggcuuuu

SEQ ID NO: 770521 - RNA, 22 nt, Human
ucuggccccgcaugcacuuuau

SEQ ID NO: 770522 - RNA, 22 nt, Human
acauuaaacuugcuuggcugua

SEQ ID NO: 770523 - RNA, 22 nt, Human
cugcagcugcucauguuacuug

SEQ ID NO: 770524 - RNA, 22 nt, Human
agcagcaaaagagaauaguuug

SEQ ID NO: 770525 - RNA, 22 nt, Human
ucugaaauggggcugaagcacu

SEQ ID NO: 770526 - RNA, 23 nt, Human
ugcugguucaaaaaggaaggagg

SEQ ID NO: 770527 - RNA, 22 nt, Human
caaagggcggcugucggagggu

SEQ ID NO: 770528 - RNA, 22 nt, Human
uagcagagcacaucuucauucu

SEQ ID NO: 770529 - RNA, 22 nt, Human
gacugagaaacaguacauuacc

SEQ ID NO: 770530 - RNA, 20 nt, Human
gacaucauguacacauugcc

SEQ ID NO: 770531 - RNA, 22 nt, Human
ugaaaucugcaugcaaaguccu

SEQ ID NO: 770532 - RNA, 22 nt, Human
uggaguccuuguuggaagugaa

SEQ ID NO: 770533 - RNA, 22 nt, Human
uggcagcaguggagguagaaag

SEQ ID NO: 770534 - RNA, 18 nt, Human
ugagagccugcuuguccc

SEQ ID NO: 770535 - RNA, 22 nt, Human
cccaguaccucuguucccugcu

SEQ ID NO: 770536 - RNA, 22 nt, Human
ugagugagcuggggagccggug

SEQ ID NO: 770537 - RNA, 22 nt, Human
acagugcuaaacacuucuugaa

SEQ ID NO: 770538 - RNA, 22 nt, Human
gcaauagacuguuuuuauuguu

SEQ ID NO: 770539 - RNA, 22 nt, Human
uuuaauuauaucugggcaguua

SEQ ID NO: 770540 - RNA, 22 nt, Human
acacacuggagguaaauggggu

SEQ ID NO: 770541 - RNA, 22 nt, Human
agcugccaucugaagaacugca

SEQ ID NO: 770542 - RNA, 18 nt, Human
ggguccugugggagacag

SEQ ID NO: 770543 - RNA, 20 nt, Human
ugacaguuucauaugguuca

SEQ ID NO: 770544 - RNA, 22 nt, Human
acaggugggcuuaagagucggc

SEQ ID NO: 770545 - RNA, 22 nt, Human
cugggcacaggggagcagaguc

SEQ ID NO: 770546 - RNA, 19 nt, Human
gagaggccugugcuugaag

SEQ ID NO: 770547 - RNA, 22 nt, Human
gacccugguguccagguccugc

SEQ ID NO: 770548 - RNA, 22 nt, Human
cggggcugcucguccuccugug

SEQ ID NO: 770549 - RNA, 22 nt, Human
uggcuggaggcaugcaagcucc

SEQ ID NO: 770550 - RNA, 22 nt, Human
cugccuggccacaacccagggu

SEQ ID NO: 770551 - RNA, 22 nt, Human
cagugucuuauuuguagcucag

SEQ ID NO: 770552 - RNA, 22 nt, Human
aggccugucuggggcucagcca

SEQ ID NO: 770553 - RNA, 22 nt, Human
caagcugguaucagcuagagcg

SEQ ID NO: 770554 - RNA, 22 nt, Human
augcuguguuuuaaauggaaau

SEQ ID NO: 770555 - RNA, 22 nt, Human
cgccuggaaccucuaggaccag

SEQ ID NO: 770556 - RNA, 20 nt, Human
gggcuuggaggacucgaggg

SEQ ID NO: 770557 - RNA, 22 nt, Human
cauccagaccgugccaugcugc

SEQ ID NO: 770558 - RNA, 22 nt, Human
ggagagaggagcccacugcugu

SEQ ID NO: 770559 - RNA, 22 nt, Human
uccuguuaguguuagacuuccc

SEQ ID NO: 770560 - RNA, 22 nt, Human
uacauuguuuuuucuugccauc

SEQ ID NO: 770561 - RNA, 22 nt, Human
uguccccagagccuguuccugc

SEQ ID NO: 770562 - RNA, 19 nt, Human
cugcucaggucagucuguc

SEQ ID NO: 770563 - RNA, 21 nt, Human
agagcaaguuaaggcauuaau

SEQ ID NO: 770564 - RNA, 18 nt, Human
ugugaacacauuuuucug

SEQ ID NO: 770565 - RNA, 22 nt, Human
ucugacauuuugagaaugacau

SEQ ID NO: 770566 - RNA, 22 nt, Human
ccuccagaggguuucccaugaa

SEQ ID NO: 770567 - RNA, 22 nt, Human
gagcaggaacagaucccuugga

SEQ ID NO: 770568 - RNA, 22 nt, Human
uaccaaagaauauuuuaaauag

SEQ ID NO: 770569 - RNA, 22 nt, Human
uuccacggggcuccccgcucuu

SEQ ID NO: 770570 - RNA, 22 nt, Human
uucugcaggagcccuaguguau

SEQ ID NO: 770571 - RNA, 22 nt, Human
cugagccauccauaccagcuua

SEQ ID NO: 770572 - RNA, 20 nt, Human
auagaucagugagacuaaag

SEQ ID NO: 770573 - RNA, 23 nt, Human
acaugcaaaaaucacagucuccu

SEQ ID NO: 770574 - RNA, 21 nt, Human
acagugugcuucucucccucc

SEQ ID NO: 770575 - RNA, 22 nt, Human
uaggaauugcccgugggguccu

SEQ ID NO: 770576 - RNA, 22 nt, Human
aaaugcaugugcuauagaugug

SEQ ID NO: 770577 - RNA, 22 nt, Human
acagucuuuagaguauuguccu

SEQ ID NO: 770578 - RNA, 22 nt, Human
aucuguaaagauaaucauaugu

SEQ ID NO: 770579 - RNA, 22 nt, Human
gacagacacaauugauccauga

SEQ ID NO: 770580 - RNA, 22 nt, Human
aaucagcuaaauaaacuaguca

SEQ ID NO: 770581 - RNA, 23 nt, Human
uggcaaagcauucuuauaacagu

SEQ ID NO: 770582 - RNA, 22 nt, Human
ucugucaggagauuggcagcug

SEQ ID NO: 770583 - RNA, 22 nt, Human
ugcagaggugugcauucuuaag

SEQ ID NO: 770584 - RNA, 22 nt, Human
guggcagggcuuugcuguucuu

SEQ ID NO: 770585 - RNA, 22 nt, Human
acuugaaacccugagaugauaa

SEQ ID NO: 770586 - RNA, 22 nt, Human
agagcuggggccagagucaagg

SEQ ID NO: 770587 - RNA, 22 nt, Human
aucugaaaaaucuccuuuguca

SEQ ID NO: 770588 - RNA, 22 nt, Human
uaugagaaaggagaaugacuuu

SEQ ID NO: 770589 - RNA, 22 nt, Human
cguggccuuugagugagcuccc

SEQ ID NO: 770590 - RNA, 22 nt, Human
guccugugaugaguaccaggug

SEQ ID NO: 770591 - RNA, 22 nt, Human
uccagccaagggagguuacuag

SEQ ID NO: 770592 - RNA, 22 nt, Human
agggaucaaaaaauguacaugc

SEQ ID NO: 770593 - RNA, 22 nt, Human
ccuggagagcucgggccaggca

SEQ ID NO: 770594 - RNA, 22 nt, Human
ugcuuaaacacauacauacaua

SEQ ID NO: 770595 - RNA, 20 nt, Human
gggcuggcgcauggggaaag

SEQ ID NO: 770596 - RNA, 22 nt, Human
uucugagaagggugggucuggc

SEQ ID NO: 770597 - RNA, 22 nt, Human
ugucuucagcagucaucugggg

SEQ ID NO: 770598 - RNA, 22 nt, Human
uaacaaaguaccauagacugga

SEQ ID NO: 770599 - RNA, 19 nt, Human
cucugccucuggcuguggc

SEQ ID NO: 770600 - RNA, 22 nt, Human
gagcuuggacaccuuggcaggu

SEQ ID NO: 770601 - RNA, 19 nt, Human
uaaggcagcagugacaggc

SEQ ID NO: 770602 - RNA, 22 nt, Human
aacuguggcauguugaauuugu

SEQ ID NO: 770603 - RNA, 22 nt, Human
gucuagaaaugccauacgugcc

SEQ ID NO: 770604 - RNA, 22 nt, Human
ucaggccccaucccagacuuau

SEQ ID NO: 770605 - RNA, 21 nt, Human
ucuuuccaauauucaugucuc

SEQ ID NO: 770606 - RNA, 22 nt, Human
gcccacugagugacucccucag

SEQ ID NO: 770607 - RNA, 22 nt, Human
ggauggcuguaaaaggugggaa

SEQ ID NO: 770608 - RNA, 22 nt, Human
aagagcugugggugguaguccu

SEQ ID NO: 770609 - RNA, 23 nt, Human
ugcuucucugcuugacaguucug

SEQ ID NO: 770610 - RNA, 22 nt, Human
agaaaagugcucuagugagagc

SEQ ID NO: 770611 - RNA, 19 nt, Human
ucccuucuauaguaauaaa

SEQ ID NO: 770612 - RNA, 23 nt, Human
cccaggcuacaaauuaugcucug

SEQ ID NO: 770613 - RNA, 22 nt, Human
cagccugcagggcugccuguug

SEQ ID NO: 770614 - RNA, 22 nt, Human
agaaaugaagagagucaagguu

SEQ ID NO: 770615 - RNA, 21 nt, Human
uccuccuucaaguccuggccu

SEQ ID NO: 770616 - RNA, 22 nt, Human
uuacaacagacacauauucuaa

SEQ ID NO: 770617 - RNA, 22 nt, Human
gcuuccccuccaagcacugccu

SEQ ID NO: 770618 - RNA, 22 nt, Human
agcucccagaguccucugccca

SEQ ID NO: 770619 - RNA, 22 nt, Human
uuccugggguacuggagaaaau

SEQ ID NO: 770620 - RNA, 21 nt, Human
acaauagacauaagcagagca

SEQ ID NO: 770621 - RNA, 22 nt, Human
ugcaggcuuuagccccauggcu

SEQ ID NO: 770622 - RNA, 22 nt, Human
ucugaaauggcgauggccguug

SEQ ID NO: 770623 - RNA, 22 nt, Human
uucauaguguuuccuuccagug

SEQ ID NO: 770624 - RNA, 22 nt, Human
ucuuuaauguacuuucuuucac

SEQ ID NO: 770625 - RNA, 22 nt, Human
gugggugucaguaucuuuaacg

SEQ ID NO: 770626 - RNA, 22 nt, Human
gagccugcagcuuucacagcau

SEQ ID NO: 770627 - RNA, 22 nt, Human
gagaggcucugaggacuggggu

SEQ ID NO: 770628 - RNA, 22 nt, Human
ugcagagggaaaaggugcuccu

SEQ ID NO: 770629 - RNA, 22 nt, Human
acuuuacagaugguuuccugac

SEQ ID NO: 770630 - RNA, 22 nt, Human
acagugugggacauuaggaaau

SEQ ID NO: 770631 - RNA, 22 nt, Human
aggaggcuguggagcacuccau

SEQ ID NO: 770632 - RNA, 22 nt, Human
uuucuuaggcucuaaaaugacu

SEQ ID NO: 770633 - RNA, 22 nt, Human
aggugggggcuguguccuugac

SEQ ID NO: 770634 - RNA, 22 nt, Human
gguacaaggagugaagguuugg

SEQ ID NO: 770635 - RNA, 22 nt, Human
gcucuguguccacagcuggaaa

SEQ ID NO: 770636 - RNA, 22 nt, Human
guuccaggcaagugggauagga

SEQ ID NO: 770637 - RNA, 22 nt, Human
gugguccucauaauucagugag

SEQ ID NO: 770638 - RNA, 22 nt, Human
gcugagugauugauauuuuagu

SEQ ID NO: 770639 - RNA, 17 nt, Human
ccaggagcgugggucuc

SEQ ID NO: 770640 - RNA, 22 nt, Human
cucuuuagucuguguggagaag

SEQ ID NO: 770641 - RNA, 22 nt, Human
ugcuuuguguuugaauagauaa

SEQ ID NO: 770642 - RNA, 22 nt, Human
ggucccaggcucccucuugucc

SEQ ID NO: 770643 - RNA, 22 nt, Human
aaacuuauuuuaucacaguuca

SEQ ID NO: 770644 - RNA, 22 nt, Human
gagcagcaagcacucaaaggcu

SEQ ID NO: 770645 - RNA, 22 nt, Human
aguccagugucaaggugccauu

SEQ ID NO: 770646 - RNA, 22 nt, Human
uccagagcuguaugauuuuuuu

SEQ ID NO: 770647 - RNA, 22 nt, Human
caugcuguguguuuuagcucca

SEQ ID NO: 770648 - RNA, 22 nt, Human
acagucugcagggugaacaugu

SEQ ID NO: 770649 - RNA, 22 nt, Human
auaaagccuuucuguuuucagg

SEQ ID NO: 770650 - RNA, 22 nt, Human
agacuucucaguuuuauuagua

SEQ ID NO: 770651 - RNA, 22 nt, Human
agcagccagagaaugaugcagu

SEQ ID NO: 770652 - RNA, 22 nt, Human
ccagcugcccacuauguguucu

SEQ ID NO: 770653 - RNA, 22 nt, Human
caggcgggcaggugcggccccu

SEQ ID NO: 770654 - RNA, 22 nt, Human
cugaauaauguucucuuguaug

SEQ ID NO: 770655 - RNA, 22 nt, Human
agcaaggccgagaggaugcuau

SEQ ID NO: 770656 - RNA, 22 nt, Human
ucugcuuuagugcaaagucuua

SEQ ID NO: 770657 - RNA, 22 nt, Human
ggcugcagaaguacuuccggau

SEQ ID NO: 770658 - RNA, 15 nt, Human
ggugucugcagugug

SEQ ID NO: 770659 - RNA, 22 nt, Human
aaggucauuuuuuccucuguug

SEQ ID NO: 770660 - RNA, 22 nt, Human
aucacagggugaggauuagacc

SEQ ID NO: 770661 - RNA, 22 nt, Human
gcugccagaagaggagggguua

SEQ ID NO: 770662 - RNA, 22 nt, Human
uucauagugacaugcauucugg

SEQ ID NO: 770663 - RNA, 22 nt, Human
ugcuggaguggcacuguguggc

SEQ ID NO: 770664 - RNA, 22 nt, Human
gcagggugccgacuucagggau

SEQ ID NO: 770665 - RNA, 22 nt, Human
auuccaaaaggauguuagaaug

SEQ ID NO: 770666 - RNA, 22 nt, Human
gggcuugguggagagaaugcug

SEQ ID NO: 770667 - RNA, 22 nt, Human
uacuuucaugucuauacauauu

SEQ ID NO: 770668 - RNA, 22 nt, Human
ggcagggaggaggugaaaguga

SEQ ID NO: 770669 - RNA, 22 nt, Human
caugaaaauaacauuguuguga

SEQ ID NO: 770670 - RNA, 22 nt, Human
uuagugguacucagggagggaa

SEQ ID NO: 770671 - RNA, 22 nt, Human
ugcugucugcaacaguacuaca

SEQ ID NO: 770672 - RNA, 22 nt, Human
cagucuuagaggugacugugga

SEQ ID NO: 770673 - RNA, 22 nt, Human
auucuuauuauaguaaaacagu

SEQ ID NO: 770674 - RNA, 22 nt, Human
ccucuucagcaaaguucggccc

SEQ ID NO: 770675 - RNA, 22 nt, Human
ggcucugcuggauugaggccag

SEQ ID NO: 770676 - RNA, 22 nt, Human
caugcaggaggaaaaagcagcu

SEQ ID NO: 770677 - RNA, 22 nt, Human
ugaauugugaccccucuguauu

SEQ ID NO: 770678 - RNA, 22 nt, Human
uaucuguuguaguacagaugau

SEQ ID NO: 770679 - RNA, 18 nt, Human
guuauucucucugcagua

SEQ ID NO: 770680 - RNA, 21 nt, Human
aaggcugagacaacucaggag

SEQ ID NO: 770681 - RNA, 22 nt, Human
agggaaggagguuagaacccac

SEQ ID NO: 770682 - RNA, 23 nt, Human
ugcaguaggauggggcugggccu

SEQ ID NO: 770683 - RNA, 22 nt, Human
ucugggaagcugguccuguucu

SEQ ID NO: 770684 - RNA, 22 nt, Human
uacauacauauucauacaggug

SEQ ID NO: 770685 - RNA, 22 nt, Human
uccccaggggcaucucucugcu

SEQ ID NO: 770686 - RNA, 22 nt, Human
agagaaaugggguaaucuuuca

SEQ ID NO: 770687 - RNA, 22 nt, Human
uuccaguuaaggaagcuauucu

SEQ ID NO: 770688 - RNA, 22 nt, Human
aaucuaaggacuuagcauugcu

SEQ ID NO: 770689 - RNA, 22 nt, Human
augucuguggcauuauauguuu

SEQ ID NO: 770690 - RNA, 22 nt, Human
acugcagccuugaacucugggc

SEQ ID NO: 770691 - RNA, 17 nt, Human
gaaggccugcacaggcc

SEQ ID NO: 770692 - RNA, 22 nt, Human
uggagguggcacaagggagguc

SEQ ID NO: 770693 - RNA, 21 nt, Human
ucagucauugccuccuucugg

SEQ ID NO: 770694 - RNA, 22 nt, Human
agaacaauguuaaauuauuaag

SEQ ID NO: 770695 - RNA, 22 nt, Human
uucauuuauucagcagguauuu

SEQ ID NO: 770696 - RNA, 22 nt, Human
aguaugaauugcuuugccugua

SEQ ID NO: 770697 - RNA, 22 nt, Human
augucuguccaacccugcaggg

SEQ ID NO: 770698 - RNA, 21 nt, Human
ucuccaguugacagugucucc

SEQ ID NO: 770699 - RNA, 22 nt, Human
agggcuuugauggcauucucau

SEQ ID NO: 770700 - RNA, 22 nt, Human
aacauucaaaacccaguucagu

SEQ ID NO: 770701 - RNA, 22 nt, Human
ggucagagaaaaguaggguguu

SEQ ID NO: 770702 - RNA, 22 nt, Human
ucugggccucaguuucuucauc

SEQ ID NO: 770703 - RNA, 19 nt, Human
acacaugcuccuggagccu

SEQ ID NO: 770704 - RNA, 22 nt, Human
caggaaaggugugucaugaugg

SEQ ID NO: 770705 - RNA, 22 nt, Human
cagucucuuuucagcuccaucc

SEQ ID NO: 770706 - RNA, 22 nt, Human
cagguccugccuugguuacccu

SEQ ID NO: 770707 - RNA, 19 nt, Human
cacaacuucgcuugauucc

SEQ ID NO: 770708 - RNA, 22 nt, Human
uggcccugaggggcugugcccc

SEQ ID NO: 770709 - RNA, 22 nt, Human
ccauccauauggugacaaggug

SEQ ID NO: 770710 - RNA, 22 nt, Human
ggagaauucuuuauuagcuuuu

SEQ ID NO: 770711 - RNA, 22 nt, Human
ugcagauggggaucaguggcuc

SEQ ID NO: 770712 - RNA, 22 nt, Human
ucaccccuggcccagucuugga

SEQ ID NO: 770713 - RNA, 22 nt, Human
ucacagugagccaugucagaga

SEQ ID NO: 770714 - RNA, 22 nt, Human
ccacucugcugugcuccaugau

SEQ ID NO: 770715 - RNA, 22 nt, Human
gggcaugagagggcagcuggca

SEQ ID NO: 770716 - RNA, 22 nt, Human
aaucuguuuaguucugcguaug

SEQ ID NO: 770717 - RNA, 22 nt, Human
gugcugagauuacaggugugag

SEQ ID NO: 770718 - RNA, 22 nt, Human
uuugcauaaaggagcauuucuc

SEQ ID NO: 770719 - RNA, 22 nt, Human
ccaggacuucgaggcuacagug

SEQ ID NO: 770720 - RNA, 22 nt, Human
gauggcuuugccugcugugagg

SEQ ID NO: 770721 - RNA, 22 nt, Human
ccagacagcaguuaaaggacau

SEQ ID NO: 770722 - RNA, 22 nt, Human
ucaagucauuugacuguguguu

SEQ ID NO: 770723 - RNA, 22 nt, Human
cagugaggcucugcugagcggu

SEQ ID NO: 770724 - RNA, 22 nt, Human
agagcugucacauagagccaga

SEQ ID NO: 770725 - RNA, 22 nt, Human
gggaacagaggaggguguugcu

SEQ ID NO: 770726 - RNA, 22 nt, Human
augucucucagguuuaacuuua

SEQ ID NO: 770727 - RNA, 22 nt, Human
aacaggcuuuuggaaaguuaca

SEQ ID NO: 770728 - RNA, 19 nt, Human
gcaggcagcugggguaucc

SEQ ID NO: 770729 - RNA, 22 nt, Human
ucuuugaauuucugacugucuu

SEQ ID NO: 770730 - RNA, 17 nt, Human
ucagucucuguccugga

SEQ ID NO: 770731 - RNA, 22 nt, Human
gaucauuuacuuguucuggacu

SEQ ID NO: 770732 - RNA, 22 nt, Human
ucaggaggcgucucgcuggggc

SEQ ID NO: 770733 - RNA, 22 nt, Human
acucugaggagugacuagaggu

SEQ ID NO: 770734 - RNA, 23 nt, Human
cucuggguccgauguccugacag

SEQ ID NO: 770735 - RNA, 22 nt, Human
uagcuuuaggaugguucucuug

SEQ ID NO: 770736 - RNA, 22 nt, Human
ucugugcaggaagucauuauga

SEQ ID NO: 770737 - RNA, 22 nt, Human
ucucugggaauuuuuuggacau

SEQ ID NO: 770738 - RNA, 22 nt, Human
ucauggaagaaagguuuguuuc

SEQ ID NO: 770739 - RNA, 22 nt, Human
auugugaauugagaguacuucu

SEQ ID NO: 770740 - RNA, 22 nt, Human
ccagguucaaauagcuguguga

SEQ ID NO: 770741 - RNA, 22 nt, Human
aggcucuccuccccaggaccau

SEQ ID NO: 770742 - RNA, 22 nt, Human
acaaaaguguaggaauuccuua

SEQ ID NO: 770743 - RNA, 22 nt, Human
aguucccaggugaugcugaugu

SEQ ID NO: 770744 - RNA, 22 nt, Human
uggccucuggcugaggacuaac

SEQ ID NO: 770745 - RNA, 22 nt, Human
augucugucuauagccaugaga

SEQ ID NO: 770746 - RNA, 22 nt, Human
uguuuaauuuuucaugagccaa

SEQ ID NO: 770747 - RNA, 22 nt, Human
gagggagagugauggaccauug

SEQ ID NO: 770748 - RNA, 22 nt, Human
ucugggcugugguuccacuccg

SEQ ID NO: 770749 - RNA, 22 nt, Human
gagguuggcgcccugccuggcc

SEQ ID NO: 770750 - RNA, 22 nt, Human
cucuguguucagccuagcagaa

SEQ ID NO: 770751 - RNA, 22 nt, Human
caggcuagauuggggccaguag

SEQ ID NO: 770752 - RNA, 22 nt, Human
gucaaacagccuccuguucuaa

SEQ ID NO: 770753 - RNA, 22 nt, Human
cccaggucugccagccuguggg

SEQ ID NO: 770754 - RNA, 22 nt, Human
guggggcugaguggagccagaa

SEQ ID NO: 770755 - RNA, 23 nt, Human
guaaaauacgcagugcaguguga

SEQ ID NO: 770756 - RNA, 22 nt, Human
uaugcacacaucgcagcaggaa

SEQ ID NO: 770757 - RNA, 21 nt, Human
aguuuuccauuagggagggag

SEQ ID NO: 770758 - RNA, 22 nt, Human
ugauugaagcuagaacaaccau

SEQ ID NO: 770759 - RNA, 22 nt, Human
uucuucagacucccucuuuaag

SEQ ID NO: 770760 - RNA, 22 nt, Human
uuccaggaggagguacuagagg

SEQ ID NO: 770761 - RNA, 22 nt, Human
uuuaucagagauauguguggac

SEQ ID NO: 770762 - RNA, 22 nt, Human
aaagcagugcaccuuaauugau

SEQ ID NO: 770763 - RNA, 22 nt, Human
agcuggaaagaagguggcagcc

SEQ ID NO: 770764 - RNA, 22 nt, Human
cuacaugaacucuuaagucaca

SEQ ID NO: 770765 - RNA, 22 nt, Human
uucuuuucaagaggggcaagga

SEQ ID NO: 770766 - RNA, 22 nt, Human
cuggcugggcagacagaaugcu

SEQ ID NO: 770767 - RNA, 22 nt, Human
aucuguuguuuuucaccaccca

SEQ ID NO: 770768 - RNA, 22 nt, Human
uuacaaucugauugucucaucu

SEQ ID NO: 770769 - RNA, 22 nt, Human
uacaaguauguuuuaaaauguu

SEQ ID NO: 770770 - RNA, 22 nt, Human
auuuauuaagcaucugcuaugu

SEQ ID NO: 770771 - RNA, 20 nt, Human
gcauggcauguagugaagug

SEQ ID NO: 770772 - RNA, 22 nt, Human
caaugucuucuauaguuacuca

SEQ ID NO: 770773 - RNA, 22 nt, Human
agagccugaggcccugagaggg

SEQ ID NO: 770774 - RNA, 22 nt, Human
acugagaacucaagagaaaagg

SEQ ID NO: 770775 - RNA, 22 nt, Human
uuuguuuagagaauugaagcag

SEQ ID NO: 770776 - RNA, 22 nt, Human
uguauguguggauagauguaua

SEQ ID NO: 770777 - RNA, 22 nt, Human
uaggauggucacagagauggac

SEQ ID NO: 770778 - RNA, 22 nt, Human
ugcacaugugccuguggcacau

SEQ ID NO: 770779 - RNA, 22 nt, Human
ggagacaguauggcuuguagcu

SEQ ID NO: 770780 - RNA, 19 nt, Human
ucugaggguccagaugcau

SEQ ID NO: 770781 - RNA, 22 nt, Human
agauaaucucuaggcuucaugu

SEQ ID NO: 770782 - RNA, 22 nt, Human
uaagcaaauagcuagaucagag

SEQ ID NO: 770783 - RNA, 22 nt, Human
aagcuggccucaaacuccuagc

SEQ ID NO: 770784 - RNA, 22 nt, Human
aagaaugucaagcagaaggucu

SEQ ID NO: 770785 - RNA, 22 nt, Human
cuggucuggcuacccagcgaau

SEQ ID NO: 770786 - RNA, 22 nt, Human
ggcugugcaccauccaccuccc

SEQ ID NO: 770787 - RNA, 22 nt, Human
ggugugggggcagcucugauau

SEQ ID NO: 770788 - RNA, 22 nt, Human
ugacagugacagccaaaggcuu

SEQ ID NO: 770789 - RNA, 22 nt, Human
acaugaaacccagccguggucc

SEQ ID NO: 770790 - RNA, 22 nt, Human
uuucuagucagccauaucuagu

SEQ ID NO: 770791 - RNA, 22 nt, Human
cugaagaggacuggguuggagg

SEQ ID NO: 770792 - RNA, 22 nt, Human
ggccaggccaagaggguuggaa

SEQ ID NO: 770793 - RNA, 22 nt, Human
gugcaugcaaauuacuguaaag

SEQ ID NO: 770794 - RNA, 22 nt, Human
auuaaaacuaaaaugccugauu

SEQ ID NO: 770795 - RNA, 22 nt, Human
gugaaggacuagcauggagggc

SEQ ID NO: 770796 - RNA, 22 nt, Human
uuggaaauugcaagugauuugc

SEQ ID NO: 770797 - RNA, 21 nt, Human
auaucacaaacauauggucug

SEQ ID NO: 770798 - RNA, 22 nt, Human
ucccagaggaaauggcagcuga

SEQ ID NO: 770799 - RNA, 22 nt, Human
ggcacugagcugccuuggggca

SEQ ID NO: 770800 - RNA, 22 nt, Human
acuggcaucuguggguagaggc

SEQ ID NO: 770801 - RNA, 18 nt, Human
uccaggccugaagugucc

SEQ ID NO: 770802 - RNA, 22 nt, Human
cgagcagagcagagacgucugg

SEQ ID NO: 770803 - RNA, 22 nt, Human
cagcaacggaaaauacacauag

SEQ ID NO: 770804 - RNA, 22 nt, Human
acaggaggagcuguuucaggga

SEQ ID NO: 770805 - RNA, 22 nt, Human
aguguguaauucagugcccagc

SEQ ID NO: 770806 - RNA, 22 nt, Human
ugagggggguaaucacuggguu

SEQ ID NO: 770807 - RNA, 22 nt, Human
ucuggaaggaacccuuagagga

SEQ ID NO: 770808 - RNA, 22 nt, Human
caguagcacucugucagugaag

SEQ ID NO: 770809 - RNA, 23 nt, Human
acuuaaaugguucuuuaucucag

SEQ ID NO: 770810 - RNA, 22 nt, Human
ucaguguuggcuacaucugccu

SEQ ID NO: 770811 - RNA, 22 nt, Human
uuucauaugggcauuggcaaua

SEQ ID NO: 770812 - RNA, 22 nt, Human
uucagaaguuuucaaaacuaag

SEQ ID NO: 770813 - RNA, 22 nt, Human
ccagacuggggcuccuugaggg

SEQ ID NO: 770814 - RNA, 22 nt, Human
cacaauguauauguauaucaaa

SEQ ID NO: 770815 - RNA, 20 nt, Human
ucuggacugucagacaggga

SEQ ID NO: 770816 - RNA, 22 nt, Human
agcaggaggguuuuguagaguc

SEQ ID NO: 770817 - RNA, 18 nt, Human
agcuggggccucuggucc

SEQ ID NO: 770818 - RNA, 22 nt, Human
gauucuuacuucuaagcaagcu

SEQ ID NO: 770819 - RNA, 22 nt, Human
ccucacagaggggcagccaucu

SEQ ID NO: 770820 - RNA, 22 nt, Human
acuuucaaauaucaugauucua

SEQ ID NO: 770821 - RNA, 22 nt, Human
aagucagagaucaaggugucua

SEQ ID NO: 770822 - RNA, 18 nt, Human
gcucugguuccuucaacc

SEQ ID NO: 770823 - RNA, 22 nt, Human
ggccuguggcaaggugagaaug

SEQ ID NO: 770824 - RNA, 22 nt, Human
uggaauuuuguauuagcuuuga

SEQ ID NO: 770825 - RNA, 23 nt, Human
gcucaggcaucauucuuccuggc

SEQ ID NO: 770826 - RNA, 22 nt, Human
caguaaaugguacguauauuuu

SEQ ID NO: 770827 - RNA, 22 nt, Human
aaugauauuuauugaauagaug

SEQ ID NO: 770828 - RNA, 22 nt, Human
gcacugcuuucugagucauugu

SEQ ID NO: 770829 - RNA, 22 nt, Human
auucuuugaacaguuuuccugu

SEQ ID NO: 770830 - RNA, 22 nt, Human
uguguguagaaagggcccuggu

SEQ ID NO: 770831 - RNA, 22 nt, Human
uggacaucuuagucaugucaau

SEQ ID NO: 770832 - RNA, 22 nt, Human
aaagugcagaacuguucucacu

SEQ ID NO: 770833 - RNA, 22 nt, Human
ugacauuuuuauaagagucaaa

SEQ ID NO: 770834 - RNA, 22 nt, Human
ucagaaucuuucuagagucuag

SEQ ID NO: 770835 - RNA, 20 nt, Human
uucaaaguguaugauaugca

SEQ ID NO: 770836 - RNA, 22 nt, Human
auuucuugauuccaccagugaa

SEQ ID NO: 770837 - RNA, 22 nt, Human
aagugucugacacaaaauaugu

SEQ ID NO: 770838 - RNA, 22 nt, Human
ggaaagagcuaaaagggugaga

SEQ ID NO: 770839 - RNA, 21 nt, Human
agaucccugaggagagcaucc

SEQ ID NO: 770840 - RNA, 22 nt, Human
gcagcuguacuggcagcauugu

SEQ ID NO: 770841 - RNA, 20 nt, Human
ucuucuguugccuuguucug

SEQ ID NO: 770842 - RNA, 22 nt, Human
aauguuugaccaaaaaacugca

SEQ ID NO: 770843 - RNA, 22 nt, Human
gacaggguccaaaggcagggga

SEQ ID NO: 770844 - RNA, 20 nt, Human
agucucuguagugccugaga

SEQ ID NO: 770845 - RNA, 22 nt, Human
cccuuccuggaguacccucugu

SEQ ID NO: 770846 - RNA, 22 nt, Human
uggauggguugaaaugugagcc

SEQ ID NO: 770847 - RNA, 22 nt, Human
agagaauuaacauuccauggcu

SEQ ID NO: 770848 - RNA, 22 nt, Human
uggagcauacuaacccacucug

SEQ ID NO: 770849 - RNA, 22 nt, Human
uagaaagcguuaaaucuacaga

SEQ ID NO: 770850 - RNA, 22 nt, Human
gauauauuuggaccagagcauu

SEQ ID NO: 770851 - RNA, 22 nt, Human
agugauggcauauauagaugug

SEQ ID NO: 770852 - RNA, 22 nt, Human
caaauguaaauucuuuugaagc

SEQ ID NO: 770853 - RNA, 22 nt, Human
gagugcuguaggacugagcccu

SEQ ID NO: 770854 - RNA, 22 nt, Human
ggcuggcuggcugguagacaag

SEQ ID NO: 770855 - RNA, 22 nt, Human
uagaucauuagcgggggugaga

SEQ ID NO: 770856 - RNA, 22 nt, Human
uauugcuuuuauuucuauggac

SEQ ID NO: 770857 - RNA, 22 nt, Human
ucacaugcacaucucuggaacc

SEQ ID NO: 770858 - RNA, 21 nt, Human
uuugagaauuggucagagugc

SEQ ID NO: 770859 - RNA, 22 nt, Human
ucagaggagccaaaguucugag

SEQ ID NO: 770860 - RNA, 22 nt, Human
uuauuuauggcacuguuggugg

SEQ ID NO: 770861 - RNA, 21 nt, Human
auguuauucuguuccuccagc

SEQ ID NO: 770862 - RNA, 22 nt, Human
cagccagcugucccaagugccu

SEQ ID NO: 770863 - RNA, 22 nt, Human
uucuuauuaugugcucugugaa

SEQ ID NO: 770864 - RNA, 22 nt, Human
gcuggcuggcugugcaaaggca

SEQ ID NO: 770865 - RNA, 22 nt, Human
gccucuccuggagaaggcaggg

SEQ ID NO: 770866 - RNA, 22 nt, Human
gaugggcguggcgcguuuggug

SEQ ID NO: 770867 - RNA, 22 nt, Human
uggaaaaacugagacuuagaca

SEQ ID NO: 770868 - RNA, 23 nt, Human
aacacauugcuaauuacauucaa

SEQ ID NO: 770869 - RNA, 22 nt, Human
cauauggacaagaacauuuaug

SEQ ID NO: 770870 - RNA, 22 nt, Human
aaugccuucaaguaucugagga

SEQ ID NO: 770871 - RNA, 22 nt, Human
uggggccugcacaggcugaaug

SEQ ID NO: 770872 - RNA, 22 nt, Human
ugcacagguaugcaaagcaugu

SEQ ID NO: 770873 - RNA, 22 nt, Human
agcagggggcauccuugcccuu

SEQ ID NO: 770874 - RNA, 22 nt, Human
uaccuggaaauggcuuuaguua

SEQ ID NO: 770875 - RNA, 22 nt, Human
agaaucaggaagacagccuggc

SEQ ID NO: 770876 - RNA, 22 nt, Human
uggcuucaaggugauaauuuac

SEQ ID NO: 770877 - RNA, 20 nt, Human
aaacugucugucaguaucua

SEQ ID NO: 770878 - RNA, 22 nt, Human
ucauuuuugucuccgguuugug

SEQ ID NO: 770879 - RNA, 22 nt, Human
ucuguuuagacucaguugaaac

SEQ ID NO: 770880 - RNA, 19 nt, Human
cagcccagggugcuaccaa

SEQ ID NO: 770881 - RNA, 22 nt, Human
acagucugcuugucuccauggu

SEQ ID NO: 770882 - RNA, 22 nt, Human
ugaacaugcuguugauggccug

SEQ ID NO: 770883 - RNA, 22 nt, Human
ugagguaguuuguuguacagua

SEQ ID NO: 770884 - RNA, 22 nt, Human
gcacaguguaccacagucccua

SEQ ID NO: 770885 - RNA, 22 nt, Human
acugggcugccugguucuucua

SEQ ID NO: 770886 - RNA, 15 nt, Human
cauaucacugggaau

SEQ ID NO: 770887 - RNA, 22 nt, Human
agguuucuggauuuauuauggc

SEQ ID NO: 770888 - RNA, 22 nt, Human
ucagcugcucaaauuuauguca

SEQ ID NO: 770889 - RNA, 22 nt, Human
aaugagaaccuugaaaggaacu

SEQ ID NO: 770890 - RNA, 22 nt, Human
ugcuggccaauggcagaggcgg

SEQ ID NO: 770891 - RNA, 23 nt, Human
ggcucugugcuaauugcugaaaa

SEQ ID NO: 770892 - RNA, 22 nt, Human
gcagccaggaagcccaggacac

SEQ ID NO: 770893 - RNA, 22 nt, Human
uucuggagagaaaccuuacaaa

SEQ ID NO: 770894 - RNA, 22 nt, Human
ucccugaugccuugauccgugg

SEQ ID NO: 770895 - RNA, 21 nt, Human
uaagccaccaugugaaaccag

SEQ ID NO: 770896 - RNA, 22 nt, Human
uagcuauuuggaaaauuccaau

SEQ ID NO: 770897 - RNA, 22 nt, Human
ucucauuauccaucacugcacu

SEQ ID NO: 770898 - RNA, 23 nt, Human
uuauugcuuucccugccuuccug

SEQ ID NO: 770899 - RNA, 22 nt, Human
gccaccuuccaaaauaaucaca

SEQ ID NO: 770900 - RNA, 22 nt, Human
cugcuuuauauugagcuugaaa

SEQ ID NO: 770901 - RNA, 18 nt, Human
uggauugaauugagaggu

SEQ ID NO: 770902 - RNA, 22 nt, Human
gcacaauuauuuaugcaguaug

SEQ ID NO: 770903 - RNA, 22 nt, Human
uuuuccuaguaggccuauuaga

SEQ ID NO: 770904 - RNA, 22 nt, Human
agcauuuaguuaguaaauguuu

SEQ ID NO: 770905 - RNA, 22 nt, Human
aacugagacacgaacuaugauu

SEQ ID NO: 770906 - RNA, 22 nt, Human
ucuucugagacuucucuuuggu

SEQ ID NO: 770907 - RNA, 22 nt, Human
ucuccaggcacuuggcugcuac

SEQ ID NO: 770908 - RNA, 22 nt, Human
cuuaauuacuguccaauaugca

SEQ ID NO: 770909 - RNA, 22 nt, Human
uacaugaacaaaauagcagaaa

SEQ ID NO: 770910 - RNA, 22 nt, Human
aaaguuguuguucacagguuau

SEQ ID NO: 770911 - RNA, 22 nt, Human
aauuaacagagggcuuauuacu

SEQ ID NO: 770912 - RNA, 22 nt, Human
ucauugaguugcacuuuuacua

SEQ ID NO: 770913 - RNA, 22 nt, Human
uucacagguugaagccuaaucc

SEQ ID NO: 770914 - RNA, 22 nt, Human
caggacacagaauaaggcaguu

SEQ ID NO: 770915 - RNA, 22 nt, Human
uaggcugggaagaaagauucuc

SEQ ID NO: 770916 - RNA, 22 nt, Human
uaaaugcuuucuaugaaagagg

SEQ ID NO: 770917 - RNA, 22 nt, Human
gggaacagggccugagcugggg

SEQ ID NO: 770918 - RNA, 22 nt, Human
aggcgcugaguaggcaaggagg

SEQ ID NO: 770919 - RNA, 22 nt, Human
auuguuuacacuaacuucauaa

SEQ ID NO: 770920 - RNA, 22 nt, Human
acaaaugauuaucacagaggag

SEQ ID NO: 770921 - RNA, 22 nt, Human
augauauuugcaaugugcuugc

SEQ ID NO: 770922 - RNA, 22 nt, Human
uagauucuccacauguagcaau

SEQ ID NO: 770923 - RNA, 17 nt, Human
gugagggcagaggaugg

SEQ ID NO: 770924 - RNA, 22 nt, Human
aaaccugaauguaugucagaag

SEQ ID NO: 770925 - RNA, 22 nt, Human
aagaggaguagaugugguuggu

SEQ ID NO: 770926 - RNA, 22 nt, Human
acauucuauucugcaggacaag

SEQ ID NO: 770927 - RNA, 22 nt, Human
ggcccagugcuguucacccagu

SEQ ID NO: 770928 - RNA, 22 nt, Human
cuggccacugcgggccucugcc

SEQ ID NO: 770929 - RNA, 22 nt, Human
ugguuacagagauuuuuaagau

SEQ ID NO: 770930 - RNA, 22 nt, Human
ggccagcuguggggccgagccu

SEQ ID NO: 770931 - RNA, 22 nt, Human
ugucccugauccacuggacccc

SEQ ID NO: 770932 - RNA, 22 nt, Human
gcugcugcuggucuggggccac

SEQ ID NO: 770933 - RNA, 22 nt, Human
acaaugcugcagggaaauuagg

SEQ ID NO: 770934 - RNA, 21 nt, Human
gcucuccagggccagcccagg

SEQ ID NO: 770935 - RNA, 22 nt, Human
gugcaaaaguaauuacaguuuu

SEQ ID NO: 770936 - RNA, 22 nt, Human
cuggaggaccacagaagcuggu

SEQ ID NO: 770937 - RNA, 22 nt, Human
uuuuccucaggaaugcuaagcu

SEQ ID NO: 770938 - RNA, 22 nt, Human
gcgaaucucagcuggugcugcg

SEQ ID NO: 770939 - RNA, 22 nt, Human
agcuucucccuuuccuauuggu

SEQ ID NO: 770940 - RNA, 22 nt, Human
cucagcucugacaggaggcauc

SEQ ID NO: 770941 - RNA, 22 nt, Human
ucugagguucccucaacuaccu

SEQ ID NO: 770942 - RNA, 21 nt, Human
uccaggaguucuaauaggugu

SEQ ID NO: 770943 - RNA, 22 nt, Human
cuuggagagugguuaucccugu

SEQ ID NO: 770944 - RNA, 22 nt, Human
aauccuggaaugaguuugcuga

SEQ ID NO: 770945 - RNA, 22 nt, Human
ccugauuauuguaaauauauuu

SEQ ID NO: 770946 - RNA, 22 nt, Human
ugaaaucuccucuuuauauauc

SEQ ID NO: 770947 - RNA, 22 nt, Human
ucucagagagaugaaacuucca

SEQ ID NO: 770948 - RNA, 22 nt, Human
aaggcuuggaccagcuacagug

SEQ ID NO: 770949 - RNA, 22 nt, Human
cauuagagcagauaauaugugu

SEQ ID NO: 770950 - RNA, 22 nt, Human
augcaguuagguaauagucuca

SEQ ID NO: 770951 - RNA, 22 nt, Human
caguuuagcauuuaccgugaug

SEQ ID NO: 770952 - RNA, 21 nt, Human
cccaggaguccuauuuaaaug

SEQ ID NO: 770953 - RNA, 22 nt, Human
caguuuaggucauccuugcuuu

SEQ ID NO: 770954 - RNA, 22 nt, Human
aagcacuaauauuuuggcaccu

SEQ ID NO: 770955 - RNA, 19 nt, Human
aaagcagaggagcaucuga

SEQ ID NO: 770956 - RNA, 22 nt, Human
cacagagcaacucaaaucagcu

SEQ ID NO: 770957 - RNA, 22 nt, Human
ugcaagggcuuagggggcugug

SEQ ID NO: 770958 - RNA, 22 nt, Human
gccaggaaauucaugccagauc

SEQ ID NO: 770959 - RNA, 22 nt, Human
ucagaaauagucuuuaaaauga

SEQ ID NO: 770960 - RNA, 22 nt, Human
agaaaacauuacauaggugugu

SEQ ID NO: 770961 - RNA, 22 nt, Human
gcugcugggucccucugugcca

SEQ ID NO: 770962 - RNA, 22 nt, Human
augacaguagguaaaugauagc

SEQ ID NO: 770963 - RNA, 22 nt, Human
aguggacaaccaugcugagauu

SEQ ID NO: 770964 - RNA, 22 nt, Human
aggcacugaagaacucuuuuug

SEQ ID NO: 770965 - RNA, 21 nt, Human
ucuaagccuugcagauggguu

SEQ ID NO: 770966 - RNA, 22 nt, Human
agccaccuucuccaaggccuag

SEQ ID NO: 770967 - RNA, 22 nt, Human
ucugcaggugggccccuagaau

SEQ ID NO: 770968 - RNA, 22 nt, Human
gacugggaggguucagcugggu

SEQ ID NO: 770969 - RNA, 22 nt, Human
ggugugugguccucucacuuag

SEQ ID NO: 770970 - RNA, 23 nt, Human
aauuggacuugcugucaaacuuc

SEQ ID NO: 770971 - RNA, 22 nt, Human
ugucugaaucgcuuccuagagg

SEQ ID NO: 770972 - RNA, 22 nt, Human
uucaaagauaauuaccaaacau

SEQ ID NO: 770973 - RNA, 22 nt, Human
ucagcaauaugauaggcuuugu

SEQ ID NO: 770974 - RNA, 23 nt, Human
uggggagggaagucauuucugua

SEQ ID NO: 770975 - RNA, 22 nt, Human
ucaggcuaacccuaggcagaag

SEQ ID NO: 770976 - RNA, 22 nt, Human
gggagggaaggaccuuaugaau

SEQ ID NO: 770977 - RNA, 22 nt, Human
acaagaauuuacauguagugga

SEQ ID NO: 770978 - RNA, 22 nt, Human
caccagcuugcagucuuaaccc

SEQ ID NO: 770979 - RNA, 22 nt, Human
aauggaauaccuagguggccca

SEQ ID NO: 770980 - RNA, 22 nt, Human
aggucagaugggagaugggaug

SEQ ID NO: 770981 - RNA, 22 nt, Human
cauuuggaaagagacuagagaa

SEQ ID NO: 770982 - RNA, 22 nt, Human
uggagcagaggcugagguuggg

SEQ ID NO: 770983 - RNA, 22 nt, Human
aaugucauugagcuccaauccu

SEQ ID NO: 770984 - RNA, 22 nt, Human
agacagcucuggguuccacacu

SEQ ID NO: 770985 - RNA, 18 nt, Human
gaagugaagugacucaau

SEQ ID NO: 770986 - RNA, 22 nt, Human
uuugcauugcauuaaguauucu

SEQ ID NO: 770987 - RNA, 22 nt, Human
acaguaauaaguguuggugagg

SEQ ID NO: 770988 - RNA, 22 nt, Human
gagauucucgagggcuuccagc

SEQ ID NO: 770989 - RNA, 22 nt, Human
uuauucagggauaacauccagg

SEQ ID NO: 770990 - RNA, 22 nt, Human
ucuggacuauaggcugccaagu

SEQ ID NO: 770991 - RNA, 22 nt, Human
aaguugagaugucauaggagac

SEQ ID NO: 770992 - RNA, 22 nt, Human
agaguaguucuuugcagagugg

SEQ ID NO: 770993 - RNA, 22 nt, Human
uuugaagcagaugguuaagcuu

SEQ ID NO: 770994 - RNA, 22 nt, Human
gaugucuuuuuccaggcucuuu

SEQ ID NO: 770995 - RNA, 22 nt, Human
aauugcuuagagaauccaggua

SEQ ID NO: 770996 - RNA, 22 nt, Human
uuugcaguguucaucaguauuu

SEQ ID NO: 770997 - RNA, 22 nt, Human
uuuauauccaucuuugaaguaa

SEQ ID NO: 770998 - RNA, 22 nt, Human
aaggcacugagccagccgucuc

SEQ ID NO: 770999 - RNA, 22 nt, Human
cacagagaaugaugagucacug

SEQ ID NO: 771000 - RNA, 22 nt, Human
uuauaauucuggcauaggcugu

SEQ ID NO: 771001 - RNA, 22 nt, Human
uuuaagaucauuuguauuaucc

SEQ ID NO: 771002 - RNA, 22 nt, Human
uggaaagagaaacucuugcuaa

SEQ ID NO: 771003 - RNA, 22 nt, Human
guauuuuucaguuaggagcuua

SEQ ID NO: 771004 - RNA, 22 nt, Human
agcauuuaagcuucugcaaagc

SEQ ID NO: 771005 - RNA, 22 nt, Human
ugcuucucccaaccagggccug

SEQ ID NO: 771006 - RNA, 22 nt, Human
auaaucuggcuuguuugcuuaa

SEQ ID NO: 771007 - RNA, 22 nt, Human
uuguggcucuugaggcucucgu

SEQ ID NO: 771008 - RNA, 22 nt, Human
uggaugugucgcccuggcucuc

SEQ ID NO: 771009 - RNA, 22 nt, Human
acaacacagcaaaaccccaucu

SEQ ID NO: 771010 - RNA, 22 nt, Human
aguggucugggcuaaaugaggu

SEQ ID NO: 771011 - RNA, 22 nt, Human
ucugggguggagcccuggaguc

SEQ ID NO: 771012 - RNA, 22 nt, Human
caguuauaagacuaagcuauuc

SEQ ID NO: 771013 - RNA, 22 nt, Human
gacaauaagaaaagaggaggca

SEQ ID NO: 771014 - RNA, 22 nt, Human
gcauguaaucacucuaggaagg

SEQ ID NO: 771015 - RNA, 22 nt, Human
agccagcuggugggucagcugg

SEQ ID NO: 771016 - RNA, 22 nt, Human
acccaggaggcaagguugcagu

SEQ ID NO: 771017 - RNA, 22 nt, Human
aggcagcagaaaacaaaugguu

SEQ ID NO: 771018 - RNA, 22 nt, Human
agacagggagggagcgcggcug

SEQ ID NO: 771019 - RNA, 22 nt, Human
auugaacugaauccuggauugc

SEQ ID NO: 771020 - RNA, 22 nt, Human
uucuggagccgggccugggcag

SEQ ID NO: 771021 - RNA, 22 nt, Human
ggaggccuugaggccaggagcu

SEQ ID NO: 771022 - RNA, 22 nt, Human
uuaaaccauaguuuaacauaag

SEQ ID NO: 771023 - RNA, 22 nt, Human
uucucugcagcuccuggcuggg

SEQ ID NO: 771024 - RNA, 22 nt, Human
uuggcagaaauguggcugggag

SEQ ID NO: 771025 - RNA, 22 nt, Human
uacaacauuuacguuaggcugu

SEQ ID NO: 771026 - RNA, 22 nt, Human
cuuagcagaagcuucagcuuca

SEQ ID NO: 771027 - RNA, 22 nt, Human
auuugcuuuaagguauaaaagg

SEQ ID NO: 771028 - RNA, 22 nt, Human
aggugccaagaugucacagaca

SEQ ID NO: 771029 - RNA, 22 nt, Human
cccaggagauggagguugcagu

SEQ ID NO: 771030 - RNA, 22 nt, Human
ucuaacagaaauucugacaaaa

SEQ ID NO: 771031 - RNA, 22 nt, Human
cuccaggccccuggccuucugc

SEQ ID NO: 771032 - RNA, 21 nt, Human
acaggcaaauuuuagacaaug

SEQ ID NO: 771033 - RNA, 22 nt, Human
ucugcugugaaaggugaauauu

SEQ ID NO: 771034 - RNA, 19 nt, Human
ucauucaggaccaguggau

SEQ ID NO: 771035 - RNA, 22 nt, Human
cuuucucaguguuaauuacuuu

SEQ ID NO: 771036 - RNA, 22 nt, Human
ucuauguagugccagcuaguau

SEQ ID NO: 771037 - RNA, 22 nt, Human
uucugaaaugagauauaaggua

SEQ ID NO: 771038 - RNA, 21 nt, Human
aggaagaaagguuggagguug

SEQ ID NO: 771039 - RNA, 21 nt, Human
aauucguuugcaacacugaua

SEQ ID NO: 771040 - RNA, 21 nt, Human
gcacagugccaggcacacagu

SEQ ID NO: 771041 - RNA, 22 nt, Human
gaauacaaagcagaacucauac

SEQ ID NO: 771042 - RNA, 22 nt, Human
acaucucacuucuuugaaggcu

SEQ ID NO: 771043 - RNA, 22 nt, Human
uggggguccuccucugcuuaag

SEQ ID NO: 771044 - RNA, 22 nt, Human
aucaaaguaauuaacacugaga

SEQ ID NO: 771045 - RNA, 22 nt, Human
gagaaggacuacacaucuggcc

SEQ ID NO: 771046 - RNA, 22 nt, Human
gcaguguugacuaugguaugag

SEQ ID NO: 771047 - RNA, 22 nt, Human
gcuccaggugaauccucucacc

SEQ ID NO: 771048 - RNA, 22 nt, Human
ugucccagacacaguaugcgcu

SEQ ID NO: 771049 - RNA, 22 nt, Human
cugcccuggccacugugcccag

SEQ ID NO: 771050 - RNA, 22 nt, Human
cauaguuauaaggcaacacugu

SEQ ID NO: 771051 - RNA, 22 nt, Human
cagccucuuuccacaucaggca

SEQ ID NO: 771052 - RNA, 22 nt, Human
ccagugcauaaucaauacagcc

SEQ ID NO: 771053 - RNA, 22 nt, Human
gccagccacguuagacuggccc

SEQ ID NO: 771054 - RNA, 22 nt, Human
cccuccccacaaagcuucacac

SEQ ID NO: 771055 - RNA, 22 nt, Human
aggcagcagacuguuaaucaga

SEQ ID NO: 771056 - RNA, 22 nt, Human
uuccuucuuugugguagaaagu

SEQ ID NO: 771057 - RNA, 19 nt, Human
gcauuucaggcauguuugc

SEQ ID NO: 771058 - RNA, 22 nt, Human
cagugguuuugagauucagggu

SEQ ID NO: 771059 - RNA, 22 nt, Human
cuggguuuagggucuccccuug

SEQ ID NO: 771060 - RNA, 22 nt, Human
cuccugagaauuuucaguugga

SEQ ID NO: 771061 - RNA, 22 nt, Human
gcucgguggccagccugaggcc

SEQ ID NO: 771062 - RNA, 22 nt, Human
ucugacuuuucucacuguugug

SEQ ID NO: 771063 - RNA, 22 nt, Human
uaaugcauguaaugggcugaua

SEQ ID NO: 771064 - RNA, 22 nt, Human
ugguuuuaaaaacaugcugcau

SEQ ID NO: 771065 - RNA, 22 nt, Human
ccaagaguaaauucaugaugcc

SEQ ID NO: 771066 - RNA, 22 nt, Human
aguccauaacuucagaguguca

SEQ ID NO: 771067 - RNA, 22 nt, Human
agcccugggucccaguccuggc

SEQ ID NO: 771068 - RNA, 22 nt, Human
ugucuucagauaggcauucuuc

SEQ ID NO: 771069 - RNA, 22 nt, Human
caacaaguguucguaaagugcc

SEQ ID NO: 771070 - RNA, 22 nt, Human
cagagacccuucucaguggcca

SEQ ID NO: 771071 - RNA, 22 nt, Human
aaugaagcaguccaucugcucu

SEQ ID NO: 771072 - RNA, 22 nt, Human
ucagaggcucacugucuacuuu

SEQ ID NO: 771073 - RNA, 22 nt, Human
uucauagagcagcucacugaau

SEQ ID NO: 771074 - RNA, 22 nt, Human
ugugacaggaacuauguggaug

SEQ ID NO: 771075 - RNA, 22 nt, Human
aaauucaauuaacuuucaugcu

SEQ ID NO: 771076 - RNA, 22 nt, Human
ggaccaggagcucagagcccuc

SEQ ID NO: 771077 - RNA, 22 nt, Human
ugcugccaaaugcgagcucugu

SEQ ID NO: 771078 - RNA, 22 nt, Human
cugugggagaaguugcuggagu

SEQ ID NO: 771079 - RNA, 22 nt, Human
cuauuauuuccucaucuauaaa

SEQ ID NO: 771080 - RNA, 22 nt, Human
aagacccuaccccuggagagga

SEQ ID NO: 771081 - RNA, 22 nt, Human
cauuggucuucuaacagagaga

SEQ ID NO: 771082 - RNA, 22 nt, Human
aguaagugagucacugugcugg

SEQ ID NO: 771083 - RNA, 22 nt, Human
uuccugagucccggguaaagau

SEQ ID NO: 771084 - RNA, 22 nt, Human
caguguauaaacuuuaacauag

SEQ ID NO: 771085 - RNA, 22 nt, Human
ugaaugaucuccgauuaguccu

SEQ ID NO: 771086 - RNA, 22 nt, Human
uagcuuuaccauagaagaguau

SEQ ID NO: 771087 - RNA, 22 nt, Human
ugugaaauauuuauauacucaa

SEQ ID NO: 771088 - RNA, 22 nt, Human
cucacugugccuuuucccaaac

SEQ ID NO: 771089 - RNA, 22 nt, Human
gcagggcugaaggucccaggcc

SEQ ID NO: 771090 - RNA, 22 nt, Human
ggccagagaagucagacccuug

SEQ ID NO: 771091 - RNA, 22 nt, Human
cagggcccagucccugcuguca

SEQ ID NO: 771092 - RNA, 22 nt, Human
aggcccugaccugggagaucua

SEQ ID NO: 771093 - RNA, 22 nt, Human
uugugaauagugcugcaauaaa

SEQ ID NO: 771094 - RNA, 22 nt, Human
gaagauuuauaggagccuauua

SEQ ID NO: 771095 - RNA, 22 nt, Human
ccugaccuauuuuucucagcug

SEQ ID NO: 771096 - RNA, 22 nt, Human
uccauguggcaauaggagacag

SEQ ID NO: 771097 - RNA, 23 nt, Human
uugauucuuucagggaccuagau

SEQ ID NO: 771098 - RNA, 22 nt, Human
gagacacaggcacagaagaggc

SEQ ID NO: 771099 - RNA, 22 nt, Human
uuaugucuuaaguaugcuaauu

SEQ ID NO: 771100 - RNA, 22 nt, Human
ggggcagauggaacagagcaca

SEQ ID NO: 771101 - RNA, 22 nt, Human
acaugucuguaauuauuuuagg

SEQ ID NO: 771102 - RNA, 22 nt, Human
auuuacauuccauggugguuac

SEQ ID NO: 771103 - RNA, 22 nt, Human
cagggacagggaucauuugcuu

SEQ ID NO: 771104 - RNA, 22 nt, Human
cugugcuuguguucauuguuaa

SEQ ID NO: 771105 - RNA, 22 nt, Human
ucccugggacggccuuuuggag

SEQ ID NO: 771106 - RNA, 22 nt, Human
ugggggagccuucacaguagcu

SEQ ID NO: 771107 - RNA, 22 nt, Human
gaggcuguucaguguccagcuu

SEQ ID NO: 771108 - RNA, 22 nt, Human
ggagacacagagcaacaaaaua

SEQ ID NO: 771109 - RNA, 22 nt, Human
uggcgagguuucagagagcggc

SEQ ID NO: 771110 - RNA, 22 nt, Human
auaaguucagguaaagaaauca

SEQ ID NO: 771111 - RNA, 22 nt, Human
uggcucaguggcagccgcagcu

SEQ ID NO: 771112 - RNA, 22 nt, Human
gcucuggcccaaacccuuucua

SEQ ID NO: 771113 - RNA, 21 nt, Human
ccagcccagccuccuucucuu

SEQ ID NO: 771114 - RNA, 19 nt, Human
caaggccaccauuucuccg

SEQ ID NO: 771115 - RNA, 22 nt, Human
uaaucuguuguuaauauugacu

SEQ ID NO: 771116 - RNA, 22 nt, Human
ugcacagaaucauuuucagcug

SEQ ID NO: 771117 - RNA, 22 nt, Human
gcaguguuuggauccauagcga

SEQ ID NO: 771118 - RNA, 22 nt, Human
agagccccucgguggagggguc

SEQ ID NO: 771119 - RNA, 22 nt, Human
ggccuuggggaggauggugucc

SEQ ID NO: 771120 - RNA, 22 nt, Human
cuccauggaaaaggcuguuguu

SEQ ID NO: 771121 - RNA, 22 nt, Human
aaggucugaguuuugccaggcc

SEQ ID NO: 771122 - RNA, 22 nt, Human
ucaggcuuauuacguuauuguc

SEQ ID NO: 771123 - RNA, 18 nt, Human
gugugcucagagagugag

SEQ ID NO: 771124 - RNA, 16 nt, Human
ggugggguaguuagaa

SEQ ID NO: 771125 - RNA, 22 nt, Human
agucaguuaaacuuuguaaagu

SEQ ID NO: 771126 - RNA, 22 nt, Human
uuuaaauguuuauagagaguac

SEQ ID NO: 771127 - RNA, 22 nt, Human
aaggcaguucacucacgcagcc

SEQ ID NO: 771128 - RNA, 22 nt, Human
uaaacagaaugcguaagaagug

SEQ ID NO: 771129 - RNA, 22 nt, Human
uagauuugccugggaaagcuca

SEQ ID NO: 771130 - RNA, 22 nt, Human
caaagguaguauauauauuguu

SEQ ID NO: 771131 - RNA, 20 nt, Human
agcccaggccugugugaguc

SEQ ID NO: 771132 - RNA, 20 nt, Human
agcccaucucccacagcuac

SEQ ID NO: 771133 - RNA, 22 nt, Human
acuugggucacaugaccuaccu

SEQ ID NO: 771134 - RNA, 22 nt, Human
aaauuaucaugggggagaaaca

SEQ ID NO: 771135 - RNA, 22 nt, Human
ccuggugcccccaagccagcug

SEQ ID NO: 771136 - RNA, 22 nt, Human
ccagcugguaagugauggagcc

SEQ ID NO: 771137 - RNA, 22 nt, Human
gacagugaguaccucaaaggcc

SEQ ID NO: 771138 - RNA, 22 nt, Human
ggcugggucccagcugggagga

SEQ ID NO: 771139 - RNA, 22 nt, Human
uagcuccuccccauccagguuc

SEQ ID NO: 771140 - RNA, 22 nt, Human
cuaagaggaaguacucuguuau

SEQ ID NO: 771141 - RNA, 20 nt, Human
cauuggcauucacagaagcu

SEQ ID NO: 771142 - RNA, 22 nt, Human
aacuccagguccuuugaaucug

SEQ ID NO: 771143 - RNA, 22 nt, Human
ggcaguuuggcaggauggaggg

SEQ ID NO: 771144 - RNA, 20 nt, Human
cuguggcaucugucauggug

SEQ ID NO: 771145 - RNA, 23 nt, Human
aaauggcuuuagacgugccuuau

SEQ ID NO: 771146 - RNA, 22 nt, Human
ucucaguguuuaaaaagauuuc

SEQ ID NO: 771147 - RNA, 22 nt, Human
uuccuaaucacgaacauuauuu

SEQ ID NO: 771148 - RNA, 22 nt, Human
ucagcacuuugaagcagaagga

SEQ ID NO: 771149 - RNA, 22 nt, Human
uggcuucuaguuugaggaaaaa

SEQ ID NO: 771150 - RNA, 22 nt, Human
cacaggaacaaagaagacaauu

SEQ ID NO: 771151 - RNA, 22 nt, Human
aaaaguguccagauuaugaaga

SEQ ID NO: 771152 - RNA, 22 nt, Human
guauuaggaaauaugaagaaag

SEQ ID NO: 771153 - RNA, 22 nt, Human
aaugucugcucuacucaggagg

SEQ ID NO: 771154 - RNA, 22 nt, Human
gggcacugggucuucuccacgc

SEQ ID NO: 771155 - RNA, 22 nt, Human
uagcaggguuuugaagaggguu

SEQ ID NO: 771156 - RNA, 17 nt, Human
uuccagcauguuacuaa

SEQ ID NO: 771157 - RNA, 22 nt, Human
cuauuuggccauagugcaguua

SEQ ID NO: 771158 - RNA, 22 nt, Human
uaauugcucgagaaauaaccuc

SEQ ID NO: 771159 - RNA, 22 nt, Human
ggagcaggcucugugguuucca

SEQ ID NO: 771160 - RNA, 22 nt, Human
ugucuuaaguagauuacagccu

SEQ ID NO: 771161 - RNA, 20 nt, Human
guccaggacccagcaggagg

SEQ ID NO: 771162 - RNA, 22 nt, Human
aagagaggacauggugaaccug

SEQ ID NO: 771163 - RNA, 22 nt, Human
augaaucaaacuguacacugag

SEQ ID NO: 771164 - RNA, 22 nt, Human
gaggaggguuggccuuagguag

SEQ ID NO: 771165 - RNA, 22 nt, Human
uacacugagaugacuuugguuu

SEQ ID NO: 771166 - RNA, 22 nt, Human
caggaguuucuauuguuccaaa

SEQ ID NO: 771167 - RNA, 22 nt, Human
agauuucuguggucauguaaug

SEQ ID NO: 771168 - RNA, 22 nt, Human
ugucccaguuggguauugaauu

SEQ ID NO: 771169 - RNA, 22 nt, Human
ggucacugucuucugggcucug

SEQ ID NO: 771170 - RNA, 22 nt, Human
caagcucugggauagcagagag

SEQ ID NO: 771171 - RNA, 22 nt, Human
aaggaagaugaaaguacugcua

SEQ ID NO: 771172 - RNA, 22 nt, Human
ggagagaauucagcuuaagauu

SEQ ID NO: 771173 - RNA, 22 nt, Human
gcuucaagcuguucagaacuau

SEQ ID NO: 771174 - RNA, 22 nt, Human
ccaggcuuucuccugacucaca

SEQ ID NO: 771175 - RNA, 22 nt, Human
aaaugcauugguuucuacuugu

SEQ ID NO: 771176 - RNA, 22 nt, Human
ucaugcaggaccaccccagcau

SEQ ID NO: 771177 - RNA, 22 nt, Human
auucugcugccuaguuuaugaa

SEQ ID NO: 771178 - RNA, 22 nt, Human
uuauuaauaaaguggcauagcc

SEQ ID NO: 771179 - RNA, 22 nt, Human
acagcaaaggacgaacacucug

SEQ ID NO: 771180 - RNA, 20 nt, Human
cacauuaaggaaaacaacug

SEQ ID NO: 771181 - RNA, 22 nt, Human
uuuucugugauucugagguugg

SEQ ID NO: 771182 - RNA, 22 nt, Human
uccagcugugcuccaggaggug

SEQ ID NO: 771183 - RNA, 22 nt, Human
uccucccaacuuuuccaucuca

SEQ ID NO: 771184 - RNA, 20 nt, Human
cuuuuucuccagcucugagc

SEQ ID NO: 771185 - RNA, 22 nt, Human
guucucauaguggaaaauaggu

SEQ ID NO: 771186 - RNA, 22 nt, Human
aacacagguugcugggccucac

SEQ ID NO: 771187 - RNA, 22 nt, Human
augucuguuuucauaucagaua

SEQ ID NO: 771188 - RNA, 22 nt, Human
ggugcccuguaaaagccaugca

SEQ ID NO: 771189 - RNA, 22 nt, Human
ugugacaugugucaucuuuucu

SEQ ID NO: 771190 - RNA, 22 nt, Human
cucugugugguagauuccauua

SEQ ID NO: 771191 - RNA, 22 nt, Human
ggcaggugccaguuggcuuggg

SEQ ID NO: 771192 - RNA, 21 nt, Human
guggcucugccaggacugaaa

SEQ ID NO: 771193 - RNA, 22 nt, Human
ugggggcugugcacaggcucac

SEQ ID NO: 771194 - RNA, 22 nt, Human
gaaucucauucuaacuaguagg

SEQ ID NO: 771195 - RNA, 22 nt, Human
cauuuguaguaucuguuuauau

SEQ ID NO: 771196 - RNA, 22 nt, Human
uggccucuuaggacauccucua

SEQ ID NO: 771197 - RNA, 22 nt, Human
uggccuggaaaaaugcagaugg

SEQ ID NO: 771198 - RNA, 22 nt, Human
uauuugaaggcauacauuuuga

SEQ ID NO: 771199 - RNA, 22 nt, Human
ggcaggugacggggaugaguau

SEQ ID NO: 771200 - RNA, 19 nt, Human
ugccucagggcuuugagga

SEQ ID NO: 771201 - RNA, 22 nt, Human
caugcagcggcguuugguuuaa

SEQ ID NO: 771202 - RNA, 22 nt, Human
gggcucuggaguucuagaaaga

SEQ ID NO: 771203 - RNA, 22 nt, Human
agcugucaccaggagccggacc

SEQ ID NO: 771204 - RNA, 22 nt, Human
ggcugaggggcccagaggaaca

SEQ ID NO: 771205 - RNA, 22 nt, Human
ccuggcucugcagccacuccag

SEQ ID NO: 771206 - RNA, 22 nt, Human
uuacagugagggugacauuuac

SEQ ID NO: 771207 - RNA, 22 nt, Human
uauuuccaagcugaauccaaug

SEQ ID NO: 771208 - RNA, 22 nt, Human
ucauugcauuuauucacuggca

SEQ ID NO: 771209 - RNA, 22 nt, Human
caaagcagugauccuuaaagga

SEQ ID NO: 771210 - RNA, 23 nt, Human
auggaagucacuguuuucuuguc

SEQ ID NO: 771211 - RNA, 22 nt, Human
ugucauuccuucaauguagaua

SEQ ID NO: 771212 - RNA, 22 nt, Human
uuuuauaaagagagucaguugg

SEQ ID NO: 771213 - RNA, 22 nt, Human
uucugcuaugaaaaaagugcug

SEQ ID NO: 771214 - RNA, 22 nt, Human
auggaaauacagccagagcaga

SEQ ID NO: 771215 - RNA, 22 nt, Human
uuuaauguauucuuuggaacca

SEQ ID NO: 771216 - RNA, 22 nt, Human
uucugcuuuuagcuaaacuaua

SEQ ID NO: 771217 - RNA, 22 nt, Human
uggcagauaaccugcugugccc

SEQ ID NO: 771218 - RNA, 22 nt, Human
uugggggcagagggagcaucug

SEQ ID NO: 771219 - RNA, 22 nt, Human
augugugcgggaaggaaaguga

SEQ ID NO: 771220 - RNA, 22 nt, Human
aaugaagauaaaaugggaugga

SEQ ID NO: 771221 - RNA, 22 nt, Human
agaaggaaggauaacugcauua

SEQ ID NO: 771222 - RNA, 22 nt, Human
uagaaacaagggagaggauucu

SEQ ID NO: 771223 - RNA, 22 nt, Human
ccuccuucuggggccuucugcu

SEQ ID NO: 771224 - RNA, 19 nt, Human
gcugcagcagagaaacugg

SEQ ID NO: 771225 - RNA, 22 nt, Human
auuguauaagucuauuuacaau

SEQ ID NO: 771226 - RNA, 22 nt, Human
uuggagggucuuccacagccau

SEQ ID NO: 771227 - RNA, 22 nt, Human
ccugagucuguguuuuccuaag

SEQ ID NO: 771228 - RNA, 22 nt, Human
uaauucagcugaacaacugugu

SEQ ID NO: 771229 - RNA, 22 nt, Human
gaguccagugauguuccugguc

SEQ ID NO: 771230 - RNA, 22 nt, Human
uucacagugagcuaugucuugu

SEQ ID NO: 771231 - RNA, 22 nt, Human
agcagagcugggauccuggguc

SEQ ID NO: 771232 - RNA, 22 nt, Human
gaauaagugaaguuggcagcuu

SEQ ID NO: 771233 - RNA, 22 nt, Human
ggggcaggagcccuucuucagc

SEQ ID NO: 771234 - RNA, 22 nt, Human
uuauuuaaugugaucugaagag

SEQ ID NO: 771235 - RNA, 22 nt, Human
ccuuucaaaacagaacacuagc

SEQ ID NO: 771236 - RNA, 22 nt, Human
augcuuuggccaaugagaagug

SEQ ID NO: 771237 - RNA, 22 nt, Human
agccacugugugaccagcuguc

SEQ ID NO: 771238 - RNA, 19 nt, Human
uccuguuauggagcuuagg

SEQ ID NO: 771239 - RNA, 22 nt, Human
ucagaggguggcugggagcauc

SEQ ID NO: 771240 - RNA, 22 nt, Human
uacaaguguaagcuugugagac

SEQ ID NO: 771241 - RNA, 22 nt, Human
gcuccaggccacggcuucuugg

SEQ ID NO: 771242 - RNA, 22 nt, Human
gcuaagaggcuauaucuuucuc

SEQ ID NO: 771243 - RNA, 22 nt, Human
agauggggcucaguguggaggc

SEQ ID NO: 771244 - RNA, 22 nt, Human
uccugaaugaguugaucacaau

SEQ ID NO: 771245 - RNA, 22 nt, Human
ugggccacauuccaaaccagcu

SEQ ID NO: 771246 - RNA, 22 nt, Human
agucuccuuaaauauuucccag

SEQ ID NO: 771247 - RNA, 22 nt, Human
caggccugugaguugaggcccc

SEQ ID NO: 771248 - RNA, 22 nt, Human
aucaguuuaaaugggcuguugg

SEQ ID NO: 771249 - RNA, 22 nt, Human
aagauuguuuuggaugcuaacu

SEQ ID NO: 771250 - RNA, 22 nt, Human
gauucuuaugagugaacuuuac

SEQ ID NO: 771251 - RNA, 22 nt, Human
uuguccaaggucccacaguuag

SEQ ID NO: 771252 - RNA, 20 nt, Human
cucucccagcacagcuuccu

SEQ ID NO: 771253 - RNA, 22 nt, Human
uguauuuauauuagaaugguug

SEQ ID NO: 771254 - RNA, 22 nt, Human
cugcugagcaucagggcugccc

SEQ ID NO: 771255 - RNA, 22 nt, Human
acuuuuaaggggccuugauuua

SEQ ID NO: 771256 - RNA, 22 nt, Human
ccacaggaccagaggagaucac

SEQ ID NO: 771257 - RNA, 22 nt, Human
ggacaggugacugcccagagug

SEQ ID NO: 771258 - RNA, 22 nt, Human
agcugagcucaggcugauguaa

SEQ ID NO: 771259 - RNA, 20 nt, Human
ugugugcaucuguauguauu

SEQ ID NO: 771260 - RNA, 22 nt, Human
gacccaggagagaggguugcau

SEQ ID NO: 771261 - RNA, 22 nt, Human
gcuugguuucuaacuuuucaua

SEQ ID NO: 771262 - RNA, 22 nt, Human
uggcagcaguagccaccccagc

SEQ ID NO: 771263 - RNA, 22 nt, Human
agacuguaauuuguggccuccu

SEQ ID NO: 771264 - RNA, 22 nt, Human
acagccaguaaucuaccccugu

SEQ ID NO: 771265 - RNA, 22 nt, Human
gucugccucagccgggggccgc

SEQ ID NO: 771266 - RNA, 22 nt, Human
ugaaaaugcacgcuggaaagca

SEQ ID NO: 771267 - RNA, 22 nt, Human
accucugcuucccggguucaag

SEQ ID NO: 771268 - RNA, 22 nt, Human
aaagcuguaaugcaugcuuucu

SEQ ID NO: 771269 - RNA, 22 nt, Human
ccccugccauagucaaaucuaa

SEQ ID NO: 771270 - RNA, 22 nt, Human
cuguagcagcugaccuggcuaa

SEQ ID NO: 771271 - RNA, 22 nt, Human
uucuuaguucaacuaaaauuua

SEQ ID NO: 771272 - RNA, 22 nt, Human
gcagagaggauauuauugucca

SEQ ID NO: 771273 - RNA, 22 nt, Human
caucuucaccagagacaagcaa

SEQ ID NO: 771274 - RNA, 22 nt, Human
ggaggccuggacuuccugaugg

SEQ ID NO: 771275 - RNA, 21 nt, Human
cucuuuguggcaauguauuuu

SEQ ID NO: 771276 - RNA, 22 nt, Human
gagauggaaucuguguggaggg

SEQ ID NO: 771277 - RNA, 22 nt, Human
augcccugugacucuccuggac

SEQ ID NO: 771278 - RNA, 22 nt, Human
uagcuguuggcuuacaucuguu

SEQ ID NO: 771279 - RNA, 17 nt, Human
gggaaguggagaaagcu

SEQ ID NO: 771280 - RNA, 22 nt, Human
uggaacacacuucaaggagaaa

SEQ ID NO: 771281 - RNA, 22 nt, Human
aggcuguagaucuagacaugua

SEQ ID NO: 771282 - RNA, 22 nt, Human
gcaguggaagccucuuuaagca

SEQ ID NO: 771283 - RNA, 22 nt, Human
uugcuuuauguguaugacuuga

SEQ ID NO: 771284 - RNA, 22 nt, Human
gugagacaauuccucaguagac

SEQ ID NO: 771285 - RNA, 22 nt, Human
ggcucugcccagaugaagagga

SEQ ID NO: 771286 - RNA, 22 nt, Human
ucagcugggaaguucucgcuug

SEQ ID NO: 771287 - RNA, 22 nt, Human
uucuauuuuuguggaacuguag

SEQ ID NO: 771288 - RNA, 22 nt, Human
ugucccagguccuagaugacca

SEQ ID NO: 771289 - RNA, 22 nt, Human
ucacaauucagaaaccaaguag

SEQ ID NO: 771290 - RNA, 22 nt, Human
gaaagugcuuagagugugguau

SEQ ID NO: 771291 - RNA, 22 nt, Human
uauguuuaguauccauuuucag

SEQ ID NO: 771292 - RNA, 22 nt, Human
uuccaagugucagaucagauuu

SEQ ID NO: 771293 - RNA, 22 nt, Human
uauguucuaggaaugguugaug

SEQ ID NO: 771294 - RNA, 22 nt, Human
uggcaucuuugucccagaagcu

SEQ ID NO: 771295 - RNA, 22 nt, Human
acucugccugaaccuccugcaa

SEQ ID NO: 771296 - RNA, 22 nt, Human
uucccucucuccagggcugccu

SEQ ID NO: 771297 - RNA, 22 nt, Human
ucagcuuucucuucuaucgaua

SEQ ID NO: 771298 - RNA, 22 nt, Human
uuugaacaugcugcaugauaau

SEQ ID NO: 771299 - RNA, 22 nt, Human
agguggcagacuaacagaagga

SEQ ID NO: 771300 - RNA, 22 nt, Human
uauuugcuccuuaggcauauuu

SEQ ID NO: 771301 - RNA, 22 nt, Human
guguccacggcugagaaugauu

SEQ ID NO: 771302 - RNA, 22 nt, Human
uggcagaguuauggguauuuau

SEQ ID NO: 771303 - RNA, 22 nt, Human
gaagagcuccaaaaacagugag

SEQ ID NO: 771304 - RNA, 22 nt, Human
gcagcugccuucagcuggaugg

SEQ ID NO: 771305 - RNA, 22 nt, Human
uagaugugagcccaggcugcuu

SEQ ID NO: 771306 - RNA, 22 nt, Human
agcuagcuuagccugugaggua

SEQ ID NO: 771307 - RNA, 22 nt, Human
ccagccaggcauugcaaacuga

SEQ ID NO: 771308 - RNA, 22 nt, Human
aguuuaaaucauguuuuguaac

SEQ ID NO: 771309 - RNA, 22 nt, Human
ggccacuguuuccugggcaguu

SEQ ID NO: 771310 - RNA, 22 nt, Human
aaacucagauguggugaagacc

SEQ ID NO: 771311 - RNA, 23 nt, Human
guuuucaacacaauaaauguaac

SEQ ID NO: 771312 - RNA, 22 nt, Human
ccuuggcuuaccuucugugugg

SEQ ID NO: 771313 - RNA, 22 nt, Human
aggccuggccugggcggcauug

SEQ ID NO: 771314 - RNA, 21 nt, Human
agcuggcagauauggugucug

SEQ ID NO: 771315 - RNA, 19 nt, Human
ucugagggagcacgaaggc

SEQ ID NO: 771316 - RNA, 22 nt, Human
guccucagucaguuuggugggg

SEQ ID NO: 771317 - RNA, 22 nt, Human
ugacauuuuuguacaaagucag

SEQ ID NO: 771318 - RNA, 23 nt, Human
ucugggcugagacuuggaagguc

SEQ ID NO: 771319 - RNA, 22 nt, Human
agggcucuuccuuugccucuca

SEQ ID NO: 771320 - RNA, 22 nt, Human
acucagagccucgagggacugc

SEQ ID NO: 771321 - RNA, 22 nt, Human
guucagcccacagagggggccg

SEQ ID NO: 771322 - RNA, 22 nt, Human
uacugucuggguucccaagcaa

SEQ ID NO: 771323 - RNA, 23 nt, Human
agagcaucaugaugcuaagucug

SEQ ID NO: 771324 - RNA, 22 nt, Human
ucuagcauuucuuuccugagga

SEQ ID NO: 771325 - RNA, 22 nt, Human
agacucaagacugcagaagacg

SEQ ID NO: 771326 - RNA, 22 nt, Human
gugaaauauuuaacguccaggu

SEQ ID NO: 771327 - RNA, 22 nt, Human
uugcuuccaguccaagucuguu

SEQ ID NO: 771328 - RNA, 22 nt, Human
uucuaugauucauuuagaaguu

SEQ ID NO: 771329 - RNA, 22 nt, Human
ccagcagaagcucccgcugggu

SEQ ID NO: 771330 - RNA, 22 nt, Human
acacaggggcucggcugggugc

SEQ ID NO: 771331 - RNA, 22 nt, Human
ucaucccuaaggacagcucugc

SEQ ID NO: 771332 - RNA, 22 nt, Human
caaauuuaagugaggucuuugu

SEQ ID NO: 771333 - RNA, 19 nt, Human
aggcaccuugauggcuucc

SEQ ID NO: 771334 - RNA, 22 nt, Human
ucucuccaacaugguggugcug

SEQ ID NO: 771335 - RNA, 23 nt, Human
gagcugggauacaggcuuacugc

SEQ ID NO: 771336 - RNA, 22 nt, Human
ccucagggccaucucugucccu

SEQ ID NO: 771337 - RNA, 22 nt, Human
cuccuggaucuuagccagauuc

SEQ ID NO: 771338 - RNA, 22 nt, Human
aauggccuguauggaaagugaa

SEQ ID NO: 771339 - RNA, 22 nt, Human
auuucagugucuucuucucccu

SEQ ID NO: 771340 - RNA, 22 nt, Human
uccuguggaagacaguguuggg

SEQ ID NO: 771341 - RNA, 23 nt, Human
uugugucuacuuccuaucuaggg

SEQ ID NO: 771342 - RNA, 22 nt, Human
ccuggccaggcucucagcacug

SEQ ID NO: 771343 - RNA, 22 nt, Human
uuucuccugcccagaugccugg

SEQ ID NO: 771344 - RNA, 22 nt, Human
aaguacauuuuuaacuuacagc

SEQ ID NO: 771345 - RNA, 22 nt, Human
ggccucagaaauagaguaaaau

SEQ ID NO: 771346 - RNA, 22 nt, Human
agcaguggcugaagauguuccu

SEQ ID NO: 771347 - RNA, 22 nt, Human
gagcuuggaugucuuuuguuca

SEQ ID NO: 771348 - RNA, 22 nt, Human
uaguauaugucuaugguuguag

SEQ ID NO: 771349 - RNA, 22 nt, Human
auuaauauugguucauuagcug

SEQ ID NO: 771350 - RNA, 22 nt, Human
auccuucaaaaggaauagcagg

SEQ ID NO: 771351 - RNA, 22 nt, Human
auucaaagcccaguaaacauug

SEQ ID NO: 771352 - RNA, 22 nt, Human
auaacauuuugacaacugguga

SEQ ID NO: 771353 - RNA, 22 nt, Human
gggugcagcagagcuccucugu

SEQ ID NO: 771354 - RNA, 22 nt, Human
uuuugugagcuccuuggaggua

SEQ ID NO: 771355 - RNA, 22 nt, Human
cugucuguuucaaaagugguua

SEQ ID NO: 771356 - RNA, 22 nt, Human
uuucaaagacagccauauuugu

SEQ ID NO: 771357 - RNA, 22 nt, Human
ccaucccugggccauguccccu

SEQ ID NO: 771358 - RNA, 22 nt, Human
cauuuguauagugcuuagacca

SEQ ID NO: 771359 - RNA, 22 nt, Human
ucuguggaguugaggaagguug

SEQ ID NO: 771360 - RNA, 22 nt, Human
aaaaagguugauccagauuagg

SEQ ID NO: 771361 - RNA, 22 nt, Human
cuugauucucagaaugcuugcu

SEQ ID NO: 771362 - RNA, 22 nt, Human
guccagaguauucaaguaacuu

SEQ ID NO: 771363 - RNA, 22 nt, Human
agcaccaggccauggggucccu

SEQ ID NO: 771364 - RNA, 19 nt, Human
ugcccaggccucccaaaag

SEQ ID NO: 771365 - RNA, 22 nt, Human
ugugaggauuaaaugcauagug

SEQ ID NO: 771366 - RNA, 22 nt, Human
uguauauauuucuuucauucua

SEQ ID NO: 771367 - RNA, 22 nt, Human
agaaagaacgcacuugugcugc

SEQ ID NO: 771368 - RNA, 22 nt, Human
cuccaggcuggauccaagucaa

SEQ ID NO: 771369 - RNA, 22 nt, Human
cgagaguggacagggcgcagcu

SEQ ID NO: 771370 - RNA, 22 nt, Human
gaggcugguucccuugaucuuu

SEQ ID NO: 771371 - RNA, 22 nt, Human
ccuggaaggcaggcauggauug

SEQ ID NO: 771372 - RNA, 22 nt, Human
ccaguguuggaggauggcuugc

SEQ ID NO: 771373 - RNA, 22 nt, Human
augucacaugguucuggggccu

SEQ ID NO: 771374 - RNA, 22 nt, Human
ucuucucaguuucucuaggaug

SEQ ID NO: 771375 - RNA, 22 nt, Human
uggcccgaccucugcucaugca

SEQ ID NO: 771376 - RNA, 22 nt, Human
caguuucagaaucaaaacauca

SEQ ID NO: 771377 - RNA, 22 nt, Human
gaagaugggaaugaugaguggg

SEQ ID NO: 771378 - RNA, 22 nt, Human
guucccauacaguaucagugcu

SEQ ID NO: 771379 - RNA, 22 nt, Human
gcugcagcccggcgcgccugag

SEQ ID NO: 771380 - RNA, 22 nt, Human
uggcccuuugggugcaggggca

SEQ ID NO: 771381 - RNA, 22 nt, Human
ugcauuguugaauauuucauag

SEQ ID NO: 771382 - RNA, 22 nt, Human
uuggcaucaguguaggaccugu

SEQ ID NO: 771383 - RNA, 22 nt, Human
ugcuccgggaaagagcagccgc

SEQ ID NO: 771384 - RNA, 22 nt, Human
uccugggguuuuggccgcagcu

SEQ ID NO: 771385 - RNA, 22 nt, Human
gauucaggccugcaucucagca

SEQ ID NO: 771386 - RNA, 22 nt, Human
gacagcaguccuggaguuccca

SEQ ID NO: 771387 - RNA, 22 nt, Human
aguguggagcaucgagggcaga

SEQ ID NO: 771388 - RNA, 22 nt, Human
ggugucuguugccuccugguua

SEQ ID NO: 771389 - RNA, 22 nt, Human
uggaguugcagcuaccagacau

SEQ ID NO: 771390 - RNA, 22 nt, Human
cucagcaacagcgacuuaaggg

SEQ ID NO: 771391 - RNA, 22 nt, Human
agcuccugcagacuccugcuca

SEQ ID NO: 771392 - RNA, 22 nt, Human
ugagcugugcuacgcccuggga

SEQ ID NO: 771393 - RNA, 22 nt, Human
aagacaugacugcacagccaaa

SEQ ID NO: 771394 - RNA, 21 nt, Human
gauuugcagaaacuagacagg

SEQ ID NO: 771395 - RNA, 23 nt, Human
uuucaaagacuuucccuuagagu

SEQ ID NO: 771396 - RNA, 22 nt, Human
guuauucuuuuauagcaauaca

SEQ ID NO: 771397 - RNA, 22 nt, Human
cugggacaugauagaaacagau

SEQ ID NO: 771398 - RNA, 22 nt, Human
acccugggcacaccauuucccc

SEQ ID NO: 771399 - RNA, 22 nt, Human
auggcuaaaccugaacuggucu

SEQ ID NO: 771400 - RNA, 22 nt, Human
gaugcucaucuguccuuugaug

SEQ ID NO: 771401 - RNA, 18 nt, Human
uuccaguagcuguaucac

SEQ ID NO: 771402 - RNA, 22 nt, Human
cugaggccagaacccgacccug

SEQ ID NO: 771403 - RNA, 22 nt, Human
gcagggcacagacagugccaag

SEQ ID NO: 771404 - RNA, 22 nt, Human
uggcugcguuuuccgauguauu

SEQ ID NO: 771405 - RNA, 22 nt, Human
cugaggcacuaacaaggacaag

SEQ ID NO: 771406 - RNA, 22 nt, Human
uaauaauuaguuauugaucgug

SEQ ID NO: 771407 - RNA, 22 nt, Human
agccccuguuuuuccagucaga

SEQ ID NO: 771408 - RNA, 22 nt, Human
gguggcugaaucaaaucaggcc

SEQ ID NO: 771409 - RNA, 22 nt, Human
cuuuaguguuguugugaggauu

SEQ ID NO: 771410 - RNA, 22 nt, Human
ggaggcacuucccgucucagcc

SEQ ID NO: 771411 - RNA, 21 nt, Human
cacuuuaaaaauaucuuuaua

SEQ ID NO: 771412 - RNA, 20 nt, Human
uauacuaacauauaucuguu

SEQ ID NO: 771413 - RNA, 22 nt, Human
uguuuuuuccuuaugcaaucug

SEQ ID NO: 771414 - RNA, 22 nt, Human
caugaaacuuccaaagcugacc

SEQ ID NO: 771415 - RNA, 22 nt, Human
caucucuccacggcagcucucg

SEQ ID NO: 771416 - RNA, 22 nt, Human
aaggugucggguuagcucagcc

SEQ ID NO: 771417 - RNA, 22 nt, Human
aggcagggcucauuucuuaggc

SEQ ID NO: 771418 - RNA, 22 nt, Human
cauucauuagaauagauaugua

SEQ ID NO: 771419 - RNA, 22 nt, Human
uggaggaugccuggggaggccu

SEQ ID NO: 771420 - RNA, 22 nt, Human
gcugggcagccccuacagagag

SEQ ID NO: 771421 - RNA, 22 nt, Human
guaggucagacauaagaggaca

SEQ ID NO: 771422 - RNA, 22 nt, Human
gggagcucucccugaggccugg

SEQ ID NO: 771423 - RNA, 22 nt, Human
acuucacaaagagaucaucuaa

SEQ ID NO: 771424 - RNA, 22 nt, Human
aucuguguaugaaaguauaacu

SEQ ID NO: 771425 - RNA, 22 nt, Human
caggcacagcuaagacuggcca

SEQ ID NO: 771426 - RNA, 22 nt, Human
acauaauaggugccugaauauu

SEQ ID NO: 771427 - RNA, 22 nt, Human
augaaaacggaccagagcuauu

SEQ ID NO: 771428 - RNA, 22 nt, Human
uaugcauaauuggauaaguaga

SEQ ID NO: 771429 - RNA, 22 nt, Human
ggaggccaagucacugaccugg

SEQ ID NO: 771430 - RNA, 22 nt, Human
ucagugcuucggcgagcaccua

SEQ ID NO: 771431 - RNA, 22 nt, Human
cugagaaaccaggugcucugau

SEQ ID NO: 771432 - RNA, 22 nt, Human
agcaggagcccuuaucaccagg

SEQ ID NO: 771433 - RNA, 17 nt, Human
aguggcaggcagauggg

SEQ ID NO: 771434 - RNA, 22 nt, Human
accaccccagaauuuuucaagg

SEQ ID NO: 771435 - RNA, 22 nt, Human
gcguuuaaagauagcuaauaag

SEQ ID NO: 771436 - RNA, 22 nt, Human
uaacacauagauauuuuaacuu

SEQ ID NO: 771437 - RNA, 22 nt, Human
cagggcagcuuccuuuguuagg

SEQ ID NO: 771438 - RNA, 22 nt, Human
gugaggagcucuuugacucacg

SEQ ID NO: 771439 - RNA, 22 nt, Human
agagcacaguaucugcacauca

SEQ ID NO: 771440 - RNA, 22 nt, Human
ugggcccaagagagucuccaac

SEQ ID NO: 771441 - RNA, 22 nt, Human
gagaacucagacgcaggucaug

SEQ ID NO: 771442 - RNA, 22 nt, Human
uuacaaggaggauagcauuucc

SEQ ID NO: 771443 - RNA, 22 nt, Human
aagacuguaugagacaauauaa

SEQ ID NO: 771444 - RNA, 23 nt, Human
cuucaucaaaaguuaacacuagu

SEQ ID NO: 771445 - RNA, 23 nt, Human
aggggcagcaaguuuugguguua

SEQ ID NO: 771446 - RNA, 22 nt, Human
cauguuuucuaggcuuucacaa

SEQ ID NO: 771447 - RNA, 22 nt, Human
ugcuccagaaaaacuugagacu

SEQ ID NO: 771448 - RNA, 22 nt, Human
aagauccugcuuuugcuucugu

SEQ ID NO: 771449 - RNA, 22 nt, Human
cucaggacccgguccagguggg

SEQ ID NO: 771450 - RNA, 22 nt, Human
gaauugucuuggccagugagaa

SEQ ID NO: 771451 - RNA, 22 nt, Human
uuuggguucagacaugauuaca

SEQ ID NO: 771452 - RNA, 22 nt, Human
gaggggucacaugggcuggcuu

SEQ ID NO: 771453 - RNA, 17 nt, Human
acacaagcaccuugagg

SEQ ID NO: 771454 - RNA, 22 nt, Human
ccagcugcucucuucuccgcca

SEQ ID NO: 771455 - RNA, 22 nt, Human
uagauauaagguccuuagaaca

SEQ ID NO: 771456 - RNA, 22 nt, Human
acugccuguuuggcauggcccc

SEQ ID NO: 771457 - RNA, 22 nt, Human
uggcagagaauaaaucuugacu

SEQ ID NO: 771458 - RNA, 21 nt, Human
aggcucagagagaaacucuug

SEQ ID NO: 771459 - RNA, 22 nt, Human
agcaguuuuuauaacacuggaa

SEQ ID NO: 771460 - RNA, 21 nt, Human
agcucuaugacuuggccaggu

SEQ ID NO: 771461 - RNA, 22 nt, Human
aaaucuguaagcaauugcucag

SEQ ID NO: 771462 - RNA, 22 nt, Human
cagggccuuguucaggagugaa

SEQ ID NO: 771463 - RNA, 22 nt, Human
cuuuggcuugcccuggcaguac

SEQ ID NO: 771464 - RNA, 16 nt, Human
cacauauauuuauaug

SEQ ID NO: 771465 - RNA, 22 nt, Human
ggucuuucuuugauaguggaga

SEQ ID NO: 771466 - RNA, 22 nt, Human
gaagaacacuucaugauucauu

SEQ ID NO: 771467 - RNA, 22 nt, Human
aaguucuaauuuugcauucagg

SEQ ID NO: 771468 - RNA, 22 nt, Human
agcaaagcaccauauggcaguu

SEQ ID NO: 771469 - RNA, 22 nt, Human
uuuaugugaugcaucccagaaa

SEQ ID NO: 771470 - RNA, 22 nt, Human
gcagaaagcuccuugcgaucug

SEQ ID NO: 771471 - RNA, 22 nt, Human
aagaaugugcuaaugaaaacuu

SEQ ID NO: 771472 - RNA, 22 nt, Human
gaccacagacuggaaagagggc

SEQ ID NO: 771473 - RNA, 22 nt, Human
gcugcugcaugaacagcgguca

SEQ ID NO: 771474 - RNA, 22 nt, Human
aaacugcaaugacagguaggag

SEQ ID NO: 771475 - RNA, 22 nt, Human
acugugcuaucuacugaauuau

SEQ ID NO: 771476 - RNA, 22 nt, Human
ugcuggaggccagaagucugag

SEQ ID NO: 771477 - RNA, 22 nt, Human
ugaggccaagccuccucugcca

SEQ ID NO: 771478 - RNA, 22 nt, Human
agggagcuaggauccugaaggu

SEQ ID NO: 771479 - RNA, 22 nt, Human
ucauuuuuuuccgguaggaaua

SEQ ID NO: 771480 - RNA, 22 nt, Human
gugccagcaguuauggugauuu

SEQ ID NO: 771481 - RNA, 22 nt, Human
uucagaaaggauaauuggaagg

SEQ ID NO: 771482 - RNA, 22 nt, Human
ugccacagacaggacagaacag

SEQ ID NO: 771483 - RNA, 22 nt, Human
uuuccucauuuaucugcuggga

SEQ ID NO: 771484 - RNA, 22 nt, Human
ucaacaauaggauauagcaggu

SEQ ID NO: 771485 - RNA, 22 nt, Human
aauuguacaagccuugugccau

SEQ ID NO: 771486 - RNA, 22 nt, Human
uauagcaagcuuugagcuuuca

SEQ ID NO: 771487 - RNA, 22 nt, Human
ugcugucaguuggcaggaugag

SEQ ID NO: 771488 - RNA, 22 nt, Human
gagcugaggcugaggccucacu

SEQ ID NO: 771489 - RNA, 22 nt, Human
aguaggcagaaguggcauucgg

SEQ ID NO: 771490 - RNA, 22 nt, Human
aaggugaaacuggaagcuggcc

SEQ ID NO: 771491 - RNA, 22 nt, Human
uccugcuucuucgagcuucugg

SEQ ID NO: 771492 - RNA, 22 nt, Human
ggauccaguccagggcugugug

SEQ ID NO: 771493 - RNA, 22 nt, Human
agaaaguacagaugagacacuu

SEQ ID NO: 771494 - RNA, 22 nt, Human
guaacauuuacaguuccuagag

SEQ ID NO: 771495 - RNA, 22 nt, Human
aaaccuagguuuccucauucag

SEQ ID NO: 771496 - RNA, 22 nt, Human
uggaagccaaggucagaaggag

SEQ ID NO: 771497 - RNA, 22 nt, Human
auagcaauggcaacaacuaagc

SEQ ID NO: 771498 - RNA, 18 nt, Human
ggcaggggugaaccacag

SEQ ID NO: 771499 - RNA, 22 nt, Human
gagcucugaaaaagcuugccuu

SEQ ID NO: 771500 - RNA, 22 nt, Human
agacucugggauuuugaaagca

SEQ ID NO: 771501 - RNA, 18 nt, Human
ggccucagccuggccgga

SEQ ID NO: 771502 - RNA, 22 nt, Human
cagucucuaaaucaaucugaau

SEQ ID NO: 771503 - RNA, 22 nt, Human
uccaggauugucagccagaagg

SEQ ID NO: 771504 - RNA, 22 nt, Human
gacuucaaaggucaaacaucgc

SEQ ID NO: 771505 - RNA, 22 nt, Human
gugcuguucuggcugccaccac

SEQ ID NO: 771506 - RNA, 22 nt, Human
uccagggcagccgcgggugcgc

SEQ ID NO: 771507 - RNA, 22 nt, Human
uuugagaacccuguauuuuaag

SEQ ID NO: 771508 - RNA, 21 nt, Human
acuucccaggaccuacucaga

SEQ ID NO: 771509 - RNA, 22 nt, Human
uauauaacuacuauuuugcuca

SEQ ID NO: 771510 - RNA, 22 nt, Human
uugaagcaaggcgaaucuugug

SEQ ID NO: 771511 - RNA, 22 nt, Human
aguacacaguagacuuucucau

SEQ ID NO: 771512 - RNA, 22 nt, Human
gcccaugcacuuucugugaugg

SEQ ID NO: 771513 - RNA, 22 nt, Human
ccugggcugaagucaagugugg

SEQ ID NO: 771514 - RNA, 22 nt, Human
cggcugugucuucacaggagcc

SEQ ID NO: 771515 - RNA, 22 nt, Human
uuucucuugcgauaugcuacac

SEQ ID NO: 771516 - RNA, 22 nt, Human
ugacccugagagcugaauggcu

SEQ ID NO: 771517 - RNA, 22 nt, Human
aauuauauugaaguugaauguc

SEQ ID NO: 771518 - RNA, 22 nt, Human
gugagagaaauuggagggaaug

SEQ ID NO: 771519 - RNA, 22 nt, Human
uggcaggcagugugggagcugg

SEQ ID NO: 771520 - RNA, 22 nt, Human
augcuuccaaggcuaagacaag

SEQ ID NO: 771521 - RNA, 21 nt, Human
ucccucagacagggugccuau

SEQ ID NO: 771522 - RNA, 22 nt, Human
cauagcaagaucacauucugua

SEQ ID NO: 771523 - RNA, 22 nt, Human
agagaaggcauagaacuugagu

SEQ ID NO: 771524 - RNA, 22 nt, Human
ccuucaaguuccuggucccugg

SEQ ID NO: 771525 - RNA, 22 nt, Human
ucacaucuugugauguuuucau

SEQ ID NO: 771526 - RNA, 22 nt, Human
cuuuccugaaaucucuucugca

SEQ ID NO: 771527 - RNA, 22 nt, Human
acugggccaggugugggugagu

SEQ ID NO: 771528 - RNA, 22 nt, Human
ccaggcugcagucaaggggcau

SEQ ID NO: 771529 - RNA, 22 nt, Human
aaucauguccaucuuaacuuuc

SEQ ID NO: 771530 - RNA, 22 nt, Human
ucuguggcuuccuauuucuugg

SEQ ID NO: 771531 - RNA, 22 nt, Human
cccaccaugugcccauuggcuu

SEQ ID NO: 771532 - RNA, 22 nt, Human
cggcuucaugagaaaugacaga

SEQ ID NO: 771533 - RNA, 22 nt, Human
uuaaaaugaauauugauuagca

SEQ ID NO: 771534 - RNA, 22 nt, Human
uuucuagugguuaagauuuaca

SEQ ID NO: 771535 - RNA, 22 nt, Human
uugcuucacugaguuaugccug

SEQ ID NO: 771536 - RNA, 22 nt, Human
auguuuuugagauacaaacaga

SEQ ID NO: 771537 - RNA, 22 nt, Human
aaacaucucaaagagguauuug

SEQ ID NO: 771538 - RNA, 22 nt, Human
acugucuucaaaugaauauauu

SEQ ID NO: 771539 - RNA, 22 nt, Human
agcugguggagaagcagaccuc

SEQ ID NO: 771540 - RNA, 22 nt, Human
ucacacgugagguucuauccug

SEQ ID NO: 771541 - RNA, 22 nt, Human
caacauuauauagccacaugcc

SEQ ID NO: 771542 - RNA, 22 nt, Human
ugcagccccugaaaauggcagc

SEQ ID NO: 771543 - RNA, 22 nt, Human
uguuagaaauuauuaguaauau

SEQ ID NO: 771544 - RNA, 22 nt, Human
gucuguguuuucaggccuuugu

SEQ ID NO: 771545 - RNA, 22 nt, Human
uucacauuguuuuaaugugaau

SEQ ID NO: 771546 - RNA, 22 nt, Human
aggcuaagugggugucagggcc

SEQ ID NO: 771547 - RNA, 22 nt, Human
uccuggcucggcuuggggacuu

SEQ ID NO: 771548 - RNA, 22 nt, Human
ccuccuuuccuguuuuccugag

SEQ ID NO: 771549 - RNA, 22 nt, Human
auuucauauguaucaccuagcc

SEQ ID NO: 771550 - RNA, 22 nt, Human
ugucaccaugcgaggcuaauuu

SEQ ID NO: 771551 - RNA, 22 nt, Human
agaugaaauuuguguugaguug

SEQ ID NO: 771552 - RNA, 22 nt, Human
guucccacuuggugcacuauga

SEQ ID NO: 771553 - RNA, 22 nt, Human
ggggcagccuccaggaaagcug

SEQ ID NO: 771554 - RNA, 22 nt, Human
augaauauguacacaucuguca

SEQ ID NO: 771555 - RNA, 22 nt, Human
acucacugcacuuugaaaugug

SEQ ID NO: 771556 - RNA, 22 nt, Human
agggggcaucagguccuggcuc

SEQ ID NO: 771557 - RNA, 22 nt, Human
ucagacagcuugcagggaggug

SEQ ID NO: 771558 - RNA, 22 nt, Human
cauuuguacagaacagcuuuau

SEQ ID NO: 771559 - RNA, 22 nt, Human
gcuuugaugaaucugugcuugg

SEQ ID NO: 771560 - RNA, 22 nt, Human
cauuaauaaacauuucagaaga

SEQ ID NO: 771561 - RNA, 22 nt, Human
ggucacaggggagaagagugau

SEQ ID NO: 771562 - RNA, 22 nt, Human
cagagaaagacuugcccuuagu

SEQ ID NO: 771563 - RNA, 22 nt, Human
aaacacuugcaaaaugguuccu

SEQ ID NO: 771564 - RNA, 22 nt, Human
ugcucaggucguucugccccuu

SEQ ID NO: 771565 - RNA, 22 nt, Human
uguuaugugccacacuugaggg

SEQ ID NO: 771566 - RNA, 22 nt, Human
agggaagcccuggcugagaccc

SEQ ID NO: 771567 - RNA, 22 nt, Human
uuuguucacugagcaaugauua

SEQ ID NO: 771568 - RNA, 22 nt, Human
cuggcuuuguucugauugcuuc

SEQ ID NO: 771569 - RNA, 22 nt, Human
caagaagccgagcuacaggcuc

SEQ ID NO: 771570 - RNA, 22 nt, Human
uucucucugagagcaucuggaa

SEQ ID NO: 771571 - RNA, 22 nt, Human
ugaagcaaugauagcagaauga

SEQ ID NO: 771572 - RNA, 18 nt, Human
auuaaggaauucuuuaga

SEQ ID NO: 771573 - RNA, 22 nt, Human
gagucuggacuauucuggucuu

SEQ ID NO: 771574 - RNA, 22 nt, Human
ggcaggagaauggcgugaacuc

SEQ ID NO: 771575 - RNA, 22 nt, Human
gucauauuggcuccacuuccuc

SEQ ID NO: 771576 - RNA, 22 nt, Human
ucacacauucuagguauguuga

SEQ ID NO: 771577 - RNA, 22 nt, Human
agaugauggccauguccucucc

SEQ ID NO: 771578 - RNA, 22 nt, Human
caaagggaaacgcagugucaag

SEQ ID NO: 771579 - RNA, 22 nt, Human
cacagcuucugagugaggauuu

SEQ ID NO: 771580 - RNA, 23 nt, Human
ggccauggagacuuagaaugggc

SEQ ID NO: 771581 - RNA, 22 nt, Human
auggaaggcuuuaugacucaaa

SEQ ID NO: 771582 - RNA, 22 nt, Human
ucccacagguggagcuugcagu

SEQ ID NO: 771583 - RNA, 22 nt, Human
cagauauaaauggaugugguag

SEQ ID NO: 771584 - RNA, 22 nt, Human
agucccagccuguaggauuggg

SEQ ID NO: 771585 - RNA, 22 nt, Human
ucagcuggagaugagaaccgaa

SEQ ID NO: 771586 - RNA, 22 nt, Human
caucccugcccucaugccuaua

SEQ ID NO: 771587 - RNA, 22 nt, Human
gcuugggagaggcuuccucuuu

SEQ ID NO: 771588 - RNA, 22 nt, Human
caugggcuacagaagcaugcug

SEQ ID NO: 771589 - RNA, 22 nt, Human
ucacugaagucuucaaguagga

SEQ ID NO: 771590 - RNA, 22 nt, Human
aaaucucugcaggcaaauguga

SEQ ID NO: 771591 - RNA, 22 nt, Human
acccagagauggaccuggcugc

SEQ ID NO: 771592 - RNA, 22 nt, Human
cauuuuacugacucuugaauua

SEQ ID NO: 771593 - RNA, 22 nt, Human
cagaccagcucuaugaacccaa

SEQ ID NO: 771594 - RNA, 22 nt, Human
gcaacaguuggauuccagagga

SEQ ID NO: 771595 - RNA, 22 nt, Human
uucaagucugaagaggacuaau

SEQ ID NO: 771596 - RNA, 22 nt, Human
agcugcuguccuaggcacugua

SEQ ID NO: 771597 - RNA, 23 nt, Human
uaucauuucagcucucugccugg

SEQ ID NO: 771598 - RNA, 22 nt, Human
uacagcuuuugcagcuguuuug

SEQ ID NO: 771599 - RNA, 19 nt, Human
agcugcagaccagaagugc

SEQ ID NO: 771600 - RNA, 22 nt, Human
cuucuuucccaggcauguuuua

SEQ ID NO: 771601 - RNA, 22 nt, Human
agagacuggagaugggcagugu

SEQ ID NO: 771602 - RNA, 22 nt, Human
gccugggagggcagcagugugg

SEQ ID NO: 771603 - RNA, 22 nt, Human
uagcagcagugguguauuuaga

SEQ ID NO: 771604 - RNA, 21 nt, Human
acaggcuuuagaaaaugacuc

SEQ ID NO: 771605 - RNA, 22 nt, Human
ugaggguggcacaggcacaaag

SEQ ID NO: 771606 - RNA, 22 nt, Human
uaugucuuuuccaaugcugucu

SEQ ID NO: 771607 - RNA, 18 nt, Human
ccuaagcuccagccccag

SEQ ID NO: 771608 - RNA, 22 nt, Human
ggcucuguucuaaauuaauaag

SEQ ID NO: 771609 - RNA, 22 nt, Human
cugcucugugcacuuguucagg

SEQ ID NO: 771610 - RNA, 22 nt, Human
uugcuuugccaccagaagucua

SEQ ID NO: 771611 - RNA, 22 nt, Human
ugagaucuucgcucuucacaga

SEQ ID NO: 771612 - RNA, 22 nt, Human
aucuguaauuuugaaugcaaau

SEQ ID NO: 771613 - RNA, 22 nt, Human
agagaagggaagggauucaccc

SEQ ID NO: 771614 - RNA, 22 nt, Human
auccuucaggaaaccauccuca

SEQ ID NO: 771615 - RNA, 22 nt, Human
uacacagggagagauuggaaac

SEQ ID NO: 771616 - RNA, 22 nt, Human
acucuggguucuuucacuugac

SEQ ID NO: 771617 - RNA, 22 nt, Human
acaacugucuucuucaugcucc

SEQ ID NO: 771618 - RNA, 22 nt, Human
ucugugaacaucacauugacag

SEQ ID NO: 771619 - RNA, 22 nt, Human
agcuccugcccaggaaggcucu

SEQ ID NO: 771620 - RNA, 22 nt, Human
cugcccugucugcagccuggcu

SEQ ID NO: 771621 - RNA, 22 nt, Human
cagggcuggauccuccagacuc

SEQ ID NO: 771622 - RNA, 22 nt, Human
agucucuuaaugggcagaaagu

SEQ ID NO: 771623 - RNA, 18 nt, Human
gcuagggcaugcauggug

SEQ ID NO: 771624 - RNA, 22 nt, Human
ggcugaggcggcgaugcccuug

SEQ ID NO: 771625 - RNA, 22 nt, Human
aauaagccagcccaugugaccc

SEQ ID NO: 771626 - RNA, 22 nt, Human
gcagagauuggugcacugauga

SEQ ID NO: 771627 - RNA, 22 nt, Human
gagcugguggugagaaagcucu

SEQ ID NO: 771628 - RNA, 22 nt, Human
aaaguguugauaugugacaucc

SEQ ID NO: 771629 - RNA, 22 nt, Human
uauggcuucugggccaaauuua

SEQ ID NO: 771630 - RNA, 22 nt, Human
ccaguguugcauaggaugggga

SEQ ID NO: 771631 - RNA, 22 nt, Human
cugccuguauugucugcuuggg

SEQ ID NO: 771632 - RNA, 22 nt, Human
gagaggcuggguuggagaucga

SEQ ID NO: 771633 - RNA, 22 nt, Human
aaaucacugauuaaaguuagaa

SEQ ID NO: 771634 - RNA, 22 nt, Human
ugguaaaguggcuucacagugu

SEQ ID NO: 771635 - RNA, 22 nt, Human
cagugcuguuguaagcucauug

SEQ ID NO: 771636 - RNA, 22 nt, Human
guucuguccucacugcaggccu

SEQ ID NO: 771637 - RNA, 22 nt, Human
cuuuacagugcugcuaauggcu

SEQ ID NO: 771638 - RNA, 22 nt, Human
gacacagaccaccaggcccugg

SEQ ID NO: 771639 - RNA, 23 nt, Human
agucagugcgggauggucagggg

SEQ ID NO: 771640 - RNA, 19 nt, Human
uucauucucuuauuguugu

SEQ ID NO: 771641 - RNA, 22 nt, Human
ugggggugugccagggaccucc

SEQ ID NO: 771642 - RNA, 22 nt, Human
ggacaggugcaaagggcacaug

SEQ ID NO: 771643 - RNA, 22 nt, Human
agguggggugagcugcagacua

SEQ ID NO: 771644 - RNA, 22 nt, Human
guccagagccggaagagugaca

SEQ ID NO: 771645 - RNA, 22 nt, Human
ggcucugcugcacccuuggcuc

SEQ ID NO: 771646 - RNA, 22 nt, Human
uugaaugagaaguuauugccau

SEQ ID NO: 771647 - RNA, 22 nt, Human
uagguagcuuuggcguuucuug

SEQ ID NO: 771648 - RNA, 22 nt, Human
gucuuuagagcuccuggcaucu

SEQ ID NO: 771649 - RNA, 22 nt, Human
acccaggcuggaaugcaguggu

SEQ ID NO: 771650 - RNA, 20 nt, Human
uggagguggucugcuguccu

SEQ ID NO: 771651 - RNA, 22 nt, Human
acugaacaccauuuauaacauu

SEQ ID NO: 771652 - RNA, 22 nt, Human
uguuaaauguuccuuuacugga

SEQ ID NO: 771653 - RNA, 22 nt, Human
uugcuuuuaauuaaucauugcu

SEQ ID NO: 771654 - RNA, 22 nt, Human
ucugcuuugcugccuccugauc

SEQ ID NO: 771655 - RNA, 22 nt, Human
uagauucuacugucacuuaguu

SEQ ID NO: 771656 - RNA, 22 nt, Human
caugaauauuuaguauuuacuu

SEQ ID NO: 771657 - RNA, 22 nt, Human
augaagacaggucucaucacca

SEQ ID NO: 771658 - RNA, 22 nt, Human
augcagaaggagccaugcuugc

SEQ ID NO: 771659 - RNA, 22 nt, Human
ucacagcugaguuuccauuucu

SEQ ID NO: 771660 - RNA, 22 nt, Human
uguguacauaucuauccuagau

SEQ ID NO: 771661 - RNA, 22 nt, Human
uggcucaguaaucgagucuccu

SEQ ID NO: 771662 - RNA, 21 nt, Human
auuuauguuugggguggaaug

SEQ ID NO: 771663 - RNA, 22 nt, Human
uaucaauugggccaaaugguac

SEQ ID NO: 771664 - RNA, 22 nt, Human
cuuuaugaaaaccagauugggg

SEQ ID NO: 771665 - RNA, 21 nt, Human
uacuacagucucuuuaucagu

SEQ ID NO: 771666 - RNA, 22 nt, Human
uucauugagugguuuauucuaa

SEQ ID NO: 771667 - RNA, 22 nt, Human
gaggccaaguuggagaccaggu

SEQ ID NO: 771668 - RNA, 22 nt, Human
gauaauccaagauugccucacu

SEQ ID NO: 771669 - RNA, 23 nt, Human
aggacaguggaauuuagggauug

SEQ ID NO: 771670 - RNA, 22 nt, Human
ugaaaaggguagaucccuaagu

SEQ ID NO: 771671 - RNA, 22 nt, Human
uguguucagaauuugcugcuuu

SEQ ID NO: 771672 - RNA, 21 nt, Human
ccugugugugucccuuuaaga

SEQ ID NO: 771673 - RNA, 22 nt, Human
uuugaaagggaaauaaacuccu

SEQ ID NO: 771674 - RNA, 20 nt, Human
uaugaagauaugugaacagc

SEQ ID NO: 771675 - RNA, 22 nt, Human
aguccuucuuuuaguugcuugg

SEQ ID NO: 771676 - RNA, 22 nt, Human
aggacaaucucuccuuuaucag

SEQ ID NO: 771677 - RNA, 22 nt, Human
acaaauuauagaaaauugagcu

SEQ ID NO: 771678 - RNA, 22 nt, Human
acacugaguauugaguagggua

SEQ ID NO: 771679 - RNA, 22 nt, Human
acugugugccaggcgcuggucu

SEQ ID NO: 771680 - RNA, 22 nt, Human
auguggcucagcaggcucccgu

SEQ ID NO: 771681 - RNA, 22 nt, Human
acucacauuucaucaggccaag

SEQ ID NO: 771682 - RNA, 22 nt, Human
aaguucuuggaggaugaagagu

SEQ ID NO: 771683 - RNA, 23 nt, Human
agaugaggcuucuccauguuggu

SEQ ID NO: 771684 - RNA, 22 nt, Human
agggauguggugggagagaaag

SEQ ID NO: 771685 - RNA, 22 nt, Human
aagugugugagccugucaggcu

SEQ ID NO: 771686 - RNA, 22 nt, Human
agugcuccaaagguuggucauu

SEQ ID NO: 771687 - RNA, 22 nt, Human
uauauuuuagacacccucacgc

SEQ ID NO: 771688 - RNA, 22 nt, Human
caggauggagaguuguugguug

SEQ ID NO: 771689 - RNA, 22 nt, Human
ucucuggaauuuugagagugac

SEQ ID NO: 771690 - RNA, 22 nt, Human
gggcagcacguuucaggaggau

SEQ ID NO: 771691 - RNA, 22 nt, Human
auggccaguguuucccucaguu

SEQ ID NO: 771692 - RNA, 22 nt, Human
gaaacuuuuaaaccucaugagu

SEQ ID NO: 771693 - RNA, 22 nt, Human
gcucccucugcucaggcacuug

SEQ ID NO: 771694 - RNA, 22 nt, Human
uugauucuaaaauaggaggaaa

SEQ ID NO: 771695 - RNA, 22 nt, Human
caucuguaaaguaggaauauug

SEQ ID NO: 771696 - RNA, 22 nt, Human
gugcaaaaugauauccugaagc

SEQ ID NO: 771697 - RNA, 22 nt, Human
agcaccuggagggcugggaccu

SEQ ID NO: 771698 - RNA, 22 nt, Human
ucauuuguucucauucucuacu

SEQ ID NO: 771699 - RNA, 22 nt, Human
caaggccacuccagagacuggu

SEQ ID NO: 771700 - RNA, 22 nt, Human
ggguaggcagugcguccugccu

SEQ ID NO: 771701 - RNA, 22 nt, Human
aagugugggacuagggcuccag

SEQ ID NO: 771702 - RNA, 22 nt, Human
cagucuaaucuguuacucauua

SEQ ID NO: 771703 - RNA, 22 nt, Human
agggaugacucuuggcugauuc

SEQ ID NO: 771704 - RNA, 22 nt, Human
uauagguaugucgagaaaugaa

SEQ ID NO: 771705 - RNA, 22 nt, Human
ugaaugugggagagcuggcaau

SEQ ID NO: 771706 - RNA, 22 nt, Human
uuccaagugcugaggacaguag

SEQ ID NO: 771707 - RNA, 22 nt, Human
auuccacagcucagccucucuu

SEQ ID NO: 771708 - RNA, 22 nt, Human
cagucuccaaaucagucugaau

SEQ ID NO: 771709 - RNA, 22 nt, Human
ucuuuucaggaauggcucuagu

SEQ ID NO: 771710 - RNA, 22 nt, Human
aggugggcggaucacaagguca

SEQ ID NO: 771711 - RNA, 23 nt, Human
cuguggccaccccuagcuggagg

SEQ ID NO: 771712 - RNA, 22 nt, Human
ugcagaggaccauuguccugga

SEQ ID NO: 771713 - RNA, 22 nt, Human
ucagggaaauagcagggcugaa

SEQ ID NO: 771714 - RNA, 22 nt, Human
auguccagcucaugauacuauc

SEQ ID NO: 771715 - RNA, 22 nt, Human
ccuggcucccccaucauagcug

SEQ ID NO: 771716 - RNA, 22 nt, Human
gcaccagcugccuucugugccc

SEQ ID NO: 771717 - RNA, 22 nt, Human
uagacacaucaaguauaguuaa

SEQ ID NO: 771718 - RNA, 22 nt, Human
agcccaggucuggcccagccug

SEQ ID NO: 771719 - RNA, 22 nt, Human
uugucagccagcucgcacucuu

SEQ ID NO: 771720 - RNA, 22 nt, Human
ccugucuggggacucccugggu

SEQ ID NO: 771721 - RNA, 22 nt, Human
ucugcccacugcucugcugccc

SEQ ID NO: 771722 - RNA, 18 nt, Human
cuccagggaacucaguca

SEQ ID NO: 771723 - RNA, 22 nt, Human
ugcagguguagaguugggcucc

SEQ ID NO: 771724 - RNA, 22 nt, Human
agcuggugauggccuaagaagg

SEQ ID NO: 771725 - RNA, 22 nt, Human
ccuaggcccucaaagagcauaa

SEQ ID NO: 771726 - RNA, 22 nt, Human
aagcaugcaaucugugauaagg

SEQ ID NO: 771727 - RNA, 22 nt, Human
acucuuguuuguagagcccacc

SEQ ID NO: 771728 - RNA, 22 nt, Human
augcauauuucuugggcuuacc

SEQ ID NO: 771729 - RNA, 22 nt, Human
ugagacaguuuuucuauuucca

SEQ ID NO: 771730 - RNA, 22 nt, Human
uacaacaugugguccuuuauga

SEQ ID NO: 771731 - RNA, 22 nt, Human
acagcuugcaugcagaggcacu

SEQ ID NO: 771732 - RNA, 22 nt, Human
ccagcagagcuggaagugugcu

SEQ ID NO: 771733 - RNA, 22 nt, Human
cuuauucagcaaguuuggguac

SEQ ID NO: 771734 - RNA, 22 nt, Human
gugugccuuucacacacuggga

SEQ ID NO: 771735 - RNA, 22 nt, Human
acagaggacaacuaggcgcuca

SEQ ID NO: 771736 - RNA, 20 nt, Human
uauuucugggcaaccauuua

SEQ ID NO: 771737 - RNA, 22 nt, Human
ucagggaggugucugccagaga

SEQ ID NO: 771738 - RNA, 22 nt, Human
agggacacacuccaguguuauu

SEQ ID NO: 771739 - RNA, 21 nt, Human
cucuuuauauaguaaagauau

SEQ ID NO: 771740 - RNA, 22 nt, Human
guguccugggcugguagagcug

SEQ ID NO: 771741 - RNA, 22 nt, Human
uuucauuucauagaauuguguu

SEQ ID NO: 771742 - RNA, 22 nt, Human
cagugccuggccggcuuccauu

SEQ ID NO: 771743 - RNA, 22 nt, Human
agaaacauccugcuuuccauuu

SEQ ID NO: 771744 - RNA, 22 nt, Human
uacugcaucgaaaugcuuuuau

SEQ ID NO: 771745 - RNA, 22 nt, Human
aagcuguucucuaaguuucaug

SEQ ID NO: 771746 - RNA, 22 nt, Human
ucucagucuuuuugguuacuca

SEQ ID NO: 771747 - RNA, 22 nt, Human
agucugugacucauuggaucuc

SEQ ID NO: 771748 - RNA, 22 nt, Human
uacaagaaacuacaugaaugca

SEQ ID NO: 771749 - RNA, 22 nt, Human
acuguaaagguuuguagcccag

SEQ ID NO: 771750 - RNA, 23 nt, Human
cuccccaguguccucaugcaucu

SEQ ID NO: 771751 - RNA, 22 nt, Human
agcuugggcaacacagcaagac

SEQ ID NO: 771752 - RNA, 22 nt, Human
gagucaggaguuaugcuccacc

SEQ ID NO: 771753 - RNA, 22 nt, Human
cucuguuucucagccuauuucc

SEQ ID NO: 771754 - RNA, 22 nt, Human
uggcuucucaguuucauaauga

SEQ ID NO: 771755 - RNA, 22 nt, Human
uauauuugugugugauuuauga

SEQ ID NO: 771756 - RNA, 22 nt, Human
acccaggacuuggcaaccucau

SEQ ID NO: 771757 - RNA, 22 nt, Human
ccaggacagggagacgggagcc

SEQ ID NO: 771758 - RNA, 22 nt, Human
uguggcuggucuccgagcgucg

SEQ ID NO: 771759 - RNA, 22 nt, Human
cugggucugggccuccuggagu

SEQ ID NO: 771760 - RNA, 23 nt, Human
agcaccaggaacagugugguccu

SEQ ID NO: 771761 - RNA, 19 nt, Human
ugcugcaggaugcugcugg

SEQ ID NO: 771762 - RNA, 22 nt, Human
gggcagugucugcaaaugaaca

SEQ ID NO: 771763 - RNA, 23 nt, Human
auuuaaugcugaguugaauguua

SEQ ID NO: 771764 - RNA, 22 nt, Human
agccacagucaaccuguccaua

SEQ ID NO: 771765 - RNA, 22 nt, Human
uauacaggaaauuuuggaacag

SEQ ID NO: 771766 - RNA, 22 nt, Human
aaguaaaagcuuuaccaugcgc

SEQ ID NO: 771767 - RNA, 22 nt, Human
ucauggaaacagcaaugcuaau

SEQ ID NO: 771768 - RNA, 22 nt, Human
cuguugugaauuuaguuaccaa

SEQ ID NO: 771769 - RNA, 22 nt, Human
uagugcuuuaaguuuacagaga

SEQ ID NO: 771770 - RNA, 22 nt, Human
ggcucuggcguccaauggagcg

SEQ ID NO: 771771 - RNA, 18 nt, Human
agaagcacaagaugucuu

SEQ ID NO: 771772 - RNA, 22 nt, Human
cuacagaguaucuaaagaggua

SEQ ID NO: 771773 - RNA, 22 nt, Human
ugguggccuugauggcaucugc

SEQ ID NO: 771774 - RNA, 22 nt, Human
ugagugugaggugggagcuugg

SEQ ID NO: 771775 - RNA, 22 nt, Human
uuguccuguuuagggauaagga

SEQ ID NO: 771776 - RNA, 22 nt, Human
uuccuucucuguggggaaggca

SEQ ID NO: 771777 - RNA, 22 nt, Human
acucuacuguaguaugggcacu

SEQ ID NO: 771778 - RNA, 22 nt, Human
cuucucucugcauaggcauggg

SEQ ID NO: 771779 - RNA, 22 nt, Human
cugauuccaaagccaaagcuau

SEQ ID NO: 771780 - RNA, 22 nt, Human
uaugcacacauguaugcaugug

SEQ ID NO: 771781 - RNA, 22 nt, Human
uagaggcuucuacugcucacuu

SEQ ID NO: 771782 - RNA, 22 nt, Human
uccaggagggauugggcugugg

SEQ ID NO: 771783 - RNA, 21 nt, Human
ucugggcagcccaguccugag

SEQ ID NO: 771784 - RNA, 22 nt, Human
caagcaaugcuauacucauuau

SEQ ID NO: 771785 - RNA, 22 nt, Human
aauauaaugcuguuuuaugcca

SEQ ID NO: 771786 - RNA, 22 nt, Human
aauuaggaauaaaugaguacuu

SEQ ID NO: 771787 - RNA, 22 nt, Human
aagcaggcaagguuguggggca

SEQ ID NO: 771788 - RNA, 22 nt, Human
cuuggagauacaagugguaccu

SEQ ID NO: 771789 - RNA, 22 nt, Human
gggaaguuugugggaggaauau

SEQ ID NO: 771790 - RNA, 22 nt, Human
uguuucuuuguagauauucuuu

SEQ ID NO: 771791 - RNA, 22 nt, Human
uaauuuuccacucuguuuaucu

SEQ ID NO: 771792 - RNA, 22 nt, Human
ugcccaaguccuccaccgaggu

SEQ ID NO: 771793 - RNA, 22 nt, Human
ugcagaguagcuauaccauuuu

SEQ ID NO: 771794 - RNA, 18 nt, Human
auuuuucccagauggaua

SEQ ID NO: 771795 - RNA, 22 nt, Human
uggucaacaggcagggaugaaa

SEQ ID NO: 771796 - RNA, 22 nt, Human
gcuucugcagccaaagaagccg

SEQ ID NO: 771797 - RNA, 22 nt, Human
cacugaaggcuaggauuagaug

SEQ ID NO: 771798 - RNA, 23 nt, Human
ugagaaauuuugauucaguagga

SEQ ID NO: 771799 - RNA, 22 nt, Human
guccauuuuauucagagacuuu

SEQ ID NO: 771800 - RNA, 22 nt, Human
aaccagugaaacaccaggcaag

SEQ ID NO: 771801 - RNA, 22 nt, Human
auuugauuuguagauaguguag

SEQ ID NO: 771802 - RNA, 22 nt, Human
cucagggaagcuauggugaggg

SEQ ID NO: 771803 - RNA, 22 nt, Human
agguaauaggguucagaauuau

SEQ ID NO: 771804 - RNA, 23 nt, Human
acagggcuuaucugucacucauc

SEQ ID NO: 771805 - RNA, 22 nt, Human
uggcuucaagucuagguucuac

SEQ ID NO: 771806 - RNA, 21 nt, Human
aucauuaauugcugagugaca

SEQ ID NO: 771807 - RNA, 22 nt, Human
uaccaaaaccaagccauuaucu

SEQ ID NO: 771808 - RNA, 22 nt, Human
uggugacagcauggaagaagug

SEQ ID NO: 771809 - RNA, 22 nt, Human
guucuuaagaccacaauaaaaa

SEQ ID NO: 771810 - RNA, 23 nt, Human
ucacugcuacucagccugagauu

SEQ ID NO: 771811 - RNA, 22 nt, Human
agcugggagcugaaggcugauu

SEQ ID NO: 771812 - RNA, 22 nt, Human
aaggccaugcuugaguugaagg

SEQ ID NO: 771813 - RNA, 22 nt, Human
cuagggagcacuagcugccuug

SEQ ID NO: 771814 - RNA, 22 nt, Human
cuggccuaggaaugguuuuccg

SEQ ID NO: 771815 - RNA, 22 nt, Human
ccugugcccugccaggcuggug

SEQ ID NO: 771816 - RNA, 22 nt, Human
cugcccugaccugccucagagu

SEQ ID NO: 771817 - RNA, 22 nt, Human
aguguuaagagaaaauucugcu

SEQ ID NO: 771818 - RNA, 22 nt, Human
uggcugagaaaaugguuuuagg

SEQ ID NO: 771819 - RNA, 22 nt, Human
uaagcauauuccagucaugucc

SEQ ID NO: 771820 - RNA, 22 nt, Human
ggucacagcuuuuucagcagca

SEQ ID NO: 771821 - RNA, 22 nt, Human
cugcugcauuccucuuuaugag

SEQ ID NO: 771822 - RNA, 22 nt, Human
ucuccagguucagucgauggaa

SEQ ID NO: 771823 - RNA, 22 nt, Human
aaaaguuuaagacucauucuag

SEQ ID NO: 771824 - RNA, 22 nt, Human
acagagucucaaaccuacaaag

SEQ ID NO: 771825 - RNA, 22 nt, Human
ggcugaggguuaagaucagaca

SEQ ID NO: 771826 - RNA, 22 nt, Human
aagcccugauaggaaaaugcug

SEQ ID NO: 771827 - RNA, 22 nt, Human
caggcagaaugaccgaccucgc

SEQ ID NO: 771828 - RNA, 22 nt, Human
uugggagguaauggagccaagu

SEQ ID NO: 771829 - RNA, 22 nt, Human
ugggggagauugugcaucucua

SEQ ID NO: 771830 - RNA, 22 nt, Human
uugaaggacauccuauuucuag

SEQ ID NO: 771831 - RNA, 21 nt, Human
acagaugugauaugcagucuu

SEQ ID NO: 771832 - RNA, 22 nt, Human
gcugauuauuacaugucugugg

SEQ ID NO: 771833 - RNA, 22 nt, Human
cauguacauucuguagauggag

SEQ ID NO: 771834 - RNA, 22 nt, Human
aaacauuguuaugauaaauuac

SEQ ID NO: 771835 - RNA, 19 nt, Human
uggcucuguuucucuggag

SEQ ID NO: 771836 - RNA, 22 nt, Human
agcuaggauaagcagagacugg

SEQ ID NO: 771837 - RNA, 22 nt, Human
uacaguuuaacacuuuggagaa

SEQ ID NO: 771838 - RNA, 22 nt, Human
gccagcucagugccaggccccu

SEQ ID NO: 771839 - RNA, 22 nt, Human
cugggagacaagagagggcuga

SEQ ID NO: 771840 - RNA, 22 nt, Human
uuucuucucaucccugaaauca

SEQ ID NO: 771841 - RNA, 22 nt, Human
ccuguugcucugcaugaguuua

SEQ ID NO: 771842 - RNA, 22 nt, Human
caugagaaguggccuucaaaaa

SEQ ID NO: 771843 - RNA, 22 nt, Human
caacagaccuggauucaaaaac

SEQ ID NO: 771844 - RNA, 22 nt, Human
cagugcagaggccagggaggau

SEQ ID NO: 771845 - RNA, 22 nt, Human
cuccaacgaggcugggguacaa

SEQ ID NO: 771846 - RNA, 22 nt, Human
uggcugagaaguucugguggga

SEQ ID NO: 771847 - RNA, 22 nt, Human
aaauggguuugauucucagcca

SEQ ID NO: 771848 - RNA, 21 nt, Human
uauuuaucucaggcuaucuuu

SEQ ID NO: 771849 - RNA, 22 nt, Human
ucaccacucacucaggcaaguc

SEQ ID NO: 771850 - RNA, 22 nt, Human
aagggggcccagcacuaaguug

SEQ ID NO: 771851 - RNA, 22 nt, Human
ggcugcugggaauaugccagcu

SEQ ID NO: 771852 - RNA, 22 nt, Human
ucagccagguaauguggagaug

SEQ ID NO: 771853 - RNA, 22 nt, Human
ggcugagcguggcugccguggg

SEQ ID NO: 771854 - RNA, 22 nt, Human
cuggcugugcugacugagaggg

SEQ ID NO: 771855 - RNA, 22 nt, Human
gcacaagaauaaccauauuuaa

SEQ ID NO: 771856 - RNA, 22 nt, Human
gcccuccccucuggguggugag

SEQ ID NO: 771857 - RNA, 22 nt, Human
aaaaugaggucaauauccuuuu

SEQ ID NO: 771858 - RNA, 22 nt, Human
cccuggccagcucaugucugag

SEQ ID NO: 771859 - RNA, 22 nt, Human
gguuauauaauucagugcuuuc

SEQ ID NO: 771860 - RNA, 22 nt, Human
gcugugcaguaguagguacagu

SEQ ID NO: 771861 - RNA, 22 nt, Human
gugucccagcagcacauuggcu

SEQ ID NO: 771862 - RNA, 22 nt, Human
cuggcugcgcuaguccagaaga

SEQ ID NO: 771863 - RNA, 22 nt, Human
ucuaucagaguagaaggcaacg

SEQ ID NO: 771864 - RNA, 22 nt, Human
ucccagagacagagccuccucc

SEQ ID NO: 771865 - RNA, 18 nt, Human
cagcugcaggcucaggac

SEQ ID NO: 771866 - RNA, 22 nt, Human
acugaggacagugaggagggcu

SEQ ID NO: 771867 - RNA, 22 nt, Human
uauuuaacuggaaacacaauga

SEQ ID NO: 771868 - RNA, 22 nt, Human
uggcucagucauggaugaguaa

SEQ ID NO: 771869 - RNA, 22 nt, Human
ugaugagggaacugguucauac

SEQ ID NO: 771870 - RNA, 22 nt, Human
ggcaggguuuacaauagcaaua

SEQ ID NO: 771871 - RNA, 22 nt, Human
aaagguaaaguaucugcccaag

SEQ ID NO: 771872 - RNA, 22 nt, Human
ucuuuccuacuuuauugugaac

SEQ ID NO: 771873 - RNA, 22 nt, Human
ugcaggcagcuaaaccauguaa

SEQ ID NO: 771874 - RNA, 22 nt, Human
uggagcaagcuggagagaacau

SEQ ID NO: 771875 - RNA, 22 nt, Human
caggcugugaaacugagaugcg

SEQ ID NO: 771876 - RNA, 22 nt, Human
ugaguggacaccugcuucuuua

SEQ ID NO: 771877 - RNA, 22 nt, Human
gguggguggaaacagcauguac

SEQ ID NO: 771878 - RNA, 22 nt, Human
ggcgggugcacagacccuuccc

SEQ ID NO: 771879 - RNA, 22 nt, Human
caauugcuuuguggaagccuuu

SEQ ID NO: 771880 - RNA, 22 nt, Human
gggcagguguuuccaaggugag

SEQ ID NO: 771881 - RNA, 22 nt, Human
ugaggcagucacccccuccugc

SEQ ID NO: 771882 - RNA, 22 nt, Human
uggguucuagagggaccagaac

SEQ ID NO: 771883 - RNA, 23 nt, Human
cagaaaguuugagaagauacauc

SEQ ID NO: 771884 - RNA, 22 nt, Human
cagcaucucacuucccagaagg

SEQ ID NO: 771885 - RNA, 22 nt, Human
uuaagauuuucuucaguauuau

SEQ ID NO: 771886 - RNA, 22 nt, Human
auagcaacaccccaauuuucua

SEQ ID NO: 771887 - RNA, 21 nt, Human
gucauccaccucucgggcucu

SEQ ID NO: 771888 - RNA, 22 nt, Human
acauguaagacuagcuuaaagu

SEQ ID NO: 771889 - RNA, 22 nt, Human
aggagccaggaaaccugcucug

SEQ ID NO: 771890 - RNA, 22 nt, Human
acucucugucuaaaugcaguuu

SEQ ID NO: 771891 - RNA, 22 nt, Human
uaggccauugauuuuuauaagu

SEQ ID NO: 771892 - RNA, 22 nt, Human
aagucaaagcuuucagaggaaa

SEQ ID NO: 771893 - RNA, 22 nt, Human
uagcuuuuauccacugcuuuug

SEQ ID NO: 771894 - RNA, 22 nt, Human
cagccacguagcccuuggccgu

SEQ ID NO: 771895 - RNA, 22 nt, Human
agcccagggacagggcggaugu

SEQ ID NO: 771896 - RNA, 22 nt, Human
auacacaggugcuaggucaaua

SEQ ID NO: 771897 - RNA, 22 nt, Human
gccugcagggccugggccuacc

SEQ ID NO: 771898 - RNA, 22 nt, Human
caaaaguaauugcaguuuuugc

SEQ ID NO: 771899 - RNA, 22 nt, Human
caugcucuagauucucucuaau

SEQ ID NO: 771900 - RNA, 22 nt, Human
aggaagugaaagggaaggaguu

SEQ ID NO: 771901 - RNA, 22 nt, Human
ugguccagaugccuuggcuuua

SEQ ID NO: 771902 - RNA, 22 nt, Human
cagguccugcagggagaguaaa

SEQ ID NO: 771903 - RNA, 22 nt, Human
uuacuuuggauggucaagaaag

SEQ ID NO: 771904 - RNA, 22 nt, Human
ggcauccucuagaagcuggaaa

SEQ ID NO: 771905 - RNA, 22 nt, Human
ugcaggcuguaaucugaggcua

SEQ ID NO: 771906 - RNA, 21 nt, Human
aacauugguucaaauaaaacu

SEQ ID NO: 771907 - RNA, 22 nt, Human
ccugggcugcucauggggauga

SEQ ID NO: 771908 - RNA, 19 nt, Human
uggggcuguguuuugaccc

SEQ ID NO: 771909 - RNA, 22 nt, Human
gcccucccuacagccuauuucu

SEQ ID NO: 771910 - RNA, 22 nt, Human
cuguuguauuauucaauauuau

SEQ ID NO: 771911 - RNA, 22 nt, Human
gagcugaguguccuaggcaugg

SEQ ID NO: 771912 - RNA, 22 nt, Human
cacaguuuugucuugguuucca

SEQ ID NO: 771913 - RNA, 22 nt, Human
cuucccaguucugcuugagggg

SEQ ID NO: 771914 - RNA, 22 nt, Human
uuccaggaauucagcucucagu

SEQ ID NO: 771915 - RNA, 22 nt, Human
caaauaguaugagcaaugauuc

SEQ ID NO: 771916 - RNA, 22 nt, Human
agcccagccacuauuaaauguu

SEQ ID NO: 771917 - RNA, 22 nt, Human
aauuuacaggugcacucgccau

SEQ ID NO: 771918 - RNA, 22 nt, Human
ccuggcugcccauggacccucu

SEQ ID NO: 771919 - RNA, 22 nt, Human
uagagaaauaagcuuugccuug

SEQ ID NO: 771920 - RNA, 22 nt, Human
ccugugggagcccaggcagaua

SEQ ID NO: 771921 - RNA, 22 nt, Human
acuaagugggacauuuacuagg

SEQ ID NO: 771922 - RNA, 22 nt, Human
aaacucuucauauacauaugcu

SEQ ID NO: 771923 - RNA, 22 nt, Human
ugcacaggugagacucaggaag

SEQ ID NO: 771924 - RNA, 22 nt, Human
cccugcagagccagcccugacc

SEQ ID NO: 771925 - RNA, 22 nt, Human
uuacaaguacugaauaugauuu

SEQ ID NO: 771926 - RNA, 18 nt, Human
uggugaaggguggaggag

SEQ ID NO: 771927 - RNA, 22 nt, Human
aguucacuauagaagacagugu

SEQ ID NO: 771928 - RNA, 22 nt, Human
ugggcugaggggccuugaugac

SEQ ID NO: 771929 - RNA, 22 nt, Human
uguuuuaagagcgcacuuuaua

SEQ ID NO: 771930 - RNA, 22 nt, Human
gugcuuuaaaccacugugcugu

SEQ ID NO: 771931 - RNA, 22 nt, Human
aguuacugcuuucaggaaguuu

SEQ ID NO: 771932 - RNA, 22 nt, Human
gacaaaacacauuaguuuaaaa

SEQ ID NO: 771933 - RNA, 22 nt, Human
aaccuaagugcuguugaacguu

SEQ ID NO: 771934 - RNA, 22 nt, Human
uggucgaccaguuggaaaguaa

SEQ ID NO: 771935 - RNA, 22 nt, Human
acaguggugagugacugauagg

SEQ ID NO: 771936 - RNA, 22 nt, Human
ucuccuggagcaggaagguggg

SEQ ID NO: 771937 - RNA, 22 nt, Human
gaggcagaaguugcagugagca

SEQ ID NO: 771938 - RNA, 22 nt, Human
agcagcagcucauucuuccugu

SEQ ID NO: 771939 - RNA, 20 nt, Human
cguguguggcuauuuugggu

SEQ ID NO: 771940 - RNA, 22 nt, Human
gggcugggaauggcuaaguaug

SEQ ID NO: 771941 - RNA, 22 nt, Human
aagagcuggaugaagaaaucaa

SEQ ID NO: 771942 - RNA, 19 nt, Human
acacaugaggagggacccc

SEQ ID NO: 771943 - RNA, 17 nt, Human
agguuuaugguauuuga

SEQ ID NO: 771944 - RNA, 22 nt, Human
uuauuuacuggauggccuuggg

SEQ ID NO: 771945 - RNA, 22 nt, Human
gaaugcaguggugagaucuugg

SEQ ID NO: 771946 - RNA, 23 nt, Human
aagcugccagucugaagccuggg

SEQ ID NO: 771947 - RNA, 22 nt, Human
aaacaccaagagcuagcuauua

SEQ ID NO: 771948 - RNA, 22 nt, Human
aucccagauagugacccucagg

SEQ ID NO: 771949 - RNA, 22 nt, Human
ggaauaaagaaucugguucccc

SEQ ID NO: 771950 - RNA, 22 nt, Human
acuggcagagacccugauggcc

SEQ ID NO: 771951 - RNA, 22 nt, Human
uguagaaauuaguaagaucaac

SEQ ID NO: 771952 - RNA, 22 nt, Human
cccugaggccucagguucauug

SEQ ID NO: 771953 - RNA, 22 nt, Human
ugacaauggggcacauggaaag

SEQ ID NO: 771954 - RNA, 22 nt, Human
ccccaggacacauggaccaagu

SEQ ID NO: 771955 - RNA, 22 nt, Human
cagcccuggccccagguggucu

SEQ ID NO: 771956 - RNA, 22 nt, Human
uucauuuguccaaauacuaugu

SEQ ID NO: 771957 - RNA, 22 nt, Human
ggguacaguucuuccaguguca

SEQ ID NO: 771958 - RNA, 22 nt, Human
uugaaucucaucccaauguugu

SEQ ID NO: 771959 - RNA, 22 nt, Human
gugucuuaggguugcacagagu

SEQ ID NO: 771960 - RNA, 22 nt, Human
augaggaacagacuugcuggau

SEQ ID NO: 771961 - RNA, 22 nt, Human
aggucugggaguucauucccug

SEQ ID NO: 771962 - RNA, 22 nt, Human
cugaggacauugaugaggcaau

SEQ ID NO: 771963 - RNA, 19 nt, Human
agucccaggcccgaaagag

SEQ ID NO: 771964 - RNA, 22 nt, Human
gccugccuagaauugcagcuuu

SEQ ID NO: 771965 - RNA, 22 nt, Human
cagcaauaacucaaagccauuu

SEQ ID NO: 771966 - RNA, 22 nt, Human
guuccucacguggacagaugau

SEQ ID NO: 771967 - RNA, 22 nt, Human
uaucauuguguuugccagucac

SEQ ID NO: 771968 - RNA, 22 nt, Human
cugcauuucacauuuaaacuuu

SEQ ID NO: 771969 - RNA, 23 nt, Human
cugcaauugccugaucucauugg

SEQ ID NO: 771970 - RNA, 22 nt, Human
cuugcagaugugacuaaauuaa

SEQ ID NO: 771971 - RNA, 22 nt, Human
aaacagaguuugguaaauagcc

SEQ ID NO: 771972 - RNA, 22 nt, Human
aacagcagaggagcgauggcug

SEQ ID NO: 771973 - RNA, 22 nt, Human
cagagcuucugacagcugcugc

SEQ ID NO: 771974 - RNA, 22 nt, Human
ccauucauagcaagcuacaucu

SEQ ID NO: 771975 - RNA, 22 nt, Human
ugcugagggcagaugaauuaga

SEQ ID NO: 771976 - RNA, 22 nt, Human
ucuccagggagguagcccagug

SEQ ID NO: 771977 - RNA, 22 nt, Human
uuuaggcagcagugaggaugaa

SEQ ID NO: 771978 - RNA, 22 nt, Human
gcagaguucucuuccagcuaac

SEQ ID NO: 771979 - RNA, 20 nt, Human
cacuguggcacauugguuua

SEQ ID NO: 771980 - RNA, 17 nt, Human
acaguaacuauguuaug

SEQ ID NO: 771981 - RNA, 22 nt, Human
aaugugcugguaacugcuuugc

SEQ ID NO: 771982 - RNA, 22 nt, Human
gacagcugcucccguuucugcu

SEQ ID NO: 771983 - RNA, 22 nt, Human
ucgaauggcaaggaaagaggcu

SEQ ID NO: 771984 - RNA, 22 nt, Human
guggccuagaggugcaaggaac

SEQ ID NO: 771985 - RNA, 20 nt, Human
ccccuucaucuacagccuga

SEQ ID NO: 771986 - RNA, 22 nt, Human
agagccugucaauuguaaagag

SEQ ID NO: 771987 - RNA, 22 nt, Human
ugucugaugauagugucucucc

SEQ ID NO: 771988 - RNA, 23 nt, Human
ugcuggagacaagugugagaagg

SEQ ID NO: 771989 - RNA, 22 nt, Human
cucugccucagugauuucuuua

SEQ ID NO: 771990 - RNA, 22 nt, Human
caggaugcagugggacccaggg

SEQ ID NO: 771991 - RNA, 20 nt, Human
uucaggauucuagaccacac

SEQ ID NO: 771992 - RNA, 22 nt, Human
uacagauagaauuagugaguua

SEQ ID NO: 771993 - RNA, 22 nt, Human
gggaccagaggcugugcacaau

SEQ ID NO: 771994 - RNA, 22 nt, Human
caucagucagucucuucaguau

SEQ ID NO: 771995 - RNA, 23 nt, Human
gagggcucugagugcuugggcca

SEQ ID NO: 771996 - RNA, 22 nt, Human
gccagcugagcaaauuccagcu

SEQ ID NO: 771997 - RNA, 22 nt, Human
gguuuucaguuugugagcucug

SEQ ID NO: 771998 - RNA, 22 nt, Human
uuccuucuuguaaugaucugcc

SEQ ID NO: 771999 - RNA, 22 nt, Human
ucuacaguagaaagaucccagu

SEQ ID NO: 772000 - RNA, 22 nt, Human
augugucuaauuccaggagcac

SEQ ID NO: 772001 - RNA, 22 nt, Human
gccuggagcagacgugucccgg

SEQ ID NO: 772002 - RNA, 22 nt, Human
uaagagcuccaauauuuguggc

SEQ ID NO: 772003 - RNA, 22 nt, Human
uacccugcuagcuagcaucucu

SEQ ID NO: 772004 - RNA, 22 nt, Human
aaacagcaggaacaucuugcca

SEQ ID NO: 772005 - RNA, 22 nt, Human
uauugugaguucagacuaaaaa

SEQ ID NO: 772006 - RNA, 22 nt, Human
uuuaugucacuuugaaagagag

SEQ ID NO: 772007 - RNA, 22 nt, Human
uccauuuucuaaguaucacuua

SEQ ID NO: 772008 - RNA, 22 nt, Human
gucaggacucugacccgucccg

SEQ ID NO: 772009 - RNA, 22 nt, Human
cccucagggaccacugacuuca

SEQ ID NO: 772010 - RNA, 22 nt, Human
gauuaugguaacaaugauuaaa

SEQ ID NO: 772011 - RNA, 22 nt, Human
ugcuuuggaucuauuugcugag

SEQ ID NO: 772012 - RNA, 22 nt, Human
caggauauaucucuaguguugg

SEQ ID NO: 772013 - RNA, 22 nt, Human
cagcuguuacucugaguaaaug

SEQ ID NO: 772014 - RNA, 22 nt, Human
acugucaucagaagaugaaaau

SEQ ID NO: 772015 - RNA, 22 nt, Human
caaggccagagccagcgauaag

SEQ ID NO: 772016 - RNA, 22 nt, Human
uuauauguaugcuuauaaacca

SEQ ID NO: 772017 - RNA, 22 nt, Human
uggcuucccaggaaaggagaag

SEQ ID NO: 772018 - RNA, 22 nt, Human
aaugauaagacaugaguagagg

SEQ ID NO: 772019 - RNA, 22 nt, Human
uuuuucagccaugaauuacacu

SEQ ID NO: 772020 - RNA, 22 nt, Human
aauuuauucccgucucugggcu

SEQ ID NO: 772021 - RNA, 22 nt, Human
cugggccaguuaugucucaucu

SEQ ID NO: 772022 - RNA, 22 nt, Human
ugaaaguuauuacugaugaugu

SEQ ID NO: 772023 - RNA, 22 nt, Human
uaacacagacagccacuaguaa

SEQ ID NO: 772024 - RNA, 22 nt, Human
ugcacacaaguuggagaaugaa

SEQ ID NO: 772025 - RNA, 22 nt, Human
acacuacagggccgggauggaa

SEQ ID NO: 772026 - RNA, 22 nt, Human
aguagaaagaaggcacugggcc

SEQ ID NO: 772027 - RNA, 22 nt, Human
gcagcuccuucaaucucaccau

SEQ ID NO: 772028 - RNA, 22 nt, Human
cagcccugcucuuagugucucc

SEQ ID NO: 772029 - RNA, 22 nt, Human
auacaugugccauguuggugua

SEQ ID NO: 772030 - RNA, 22 nt, Human
cuguggagcagggcagggucac

SEQ ID NO: 772031 - RNA, 23 nt, Human
uucugaaaauagauaguggcucc

SEQ ID NO: 772032 - RNA, 22 nt, Human
cucaaauaccucuccaugugac

SEQ ID NO: 772033 - RNA, 22 nt, Human
cacacacuggagcaaggagaug

SEQ ID NO: 772034 - RNA, 22 nt, Human
aaaccacacuuagcaguuucgu

SEQ ID NO: 772035 - RNA, 23 nt, Human
acugggcuuaugaggaggcuugu

SEQ ID NO: 772036 - RNA, 22 nt, Human
agucuugcauuuucugaagaug

SEQ ID NO: 772037 - RNA, 20 nt, Human
ucaucugauuaaccucgaag

SEQ ID NO: 772038 - RNA, 22 nt, Human
cccacuucaugggcaggaagga

SEQ ID NO: 772039 - RNA, 22 nt, Human
ucuggagcuuccucauuuacag

SEQ ID NO: 772040 - RNA, 22 nt, Human
gaggaaaucauuccagaaaagg

SEQ ID NO: 772041 - RNA, 22 nt, Human
ucugcccacaguccaauaguug

SEQ ID NO: 772042 - RNA, 22 nt, Human
uuuuccugggcuuucuguguaa

SEQ ID NO: 772043 - RNA, 23 nt, Human
ugcagaggcaugaucacugcuca

SEQ ID NO: 772044 - RNA, 22 nt, Human
uagggacaaagagcugaggccu

SEQ ID NO: 772045 - RNA, 22 nt, Human
gcagggggucauucacgcuggc

SEQ ID NO: 772046 - RNA, 22 nt, Human
uccagcuguugauauucuaggu

SEQ ID NO: 772047 - RNA, 22 nt, Human
gugguccaaggaguuuccagca

SEQ ID NO: 772048 - RNA, 23 nt, Human
cuggcucuguagguggcauccuu

SEQ ID NO: 772049 - RNA, 22 nt, Human
ugucuuaauaugugcauucugu

SEQ ID NO: 772050 - RNA, 22 nt, Human
ugagcaggacugaccggccuua

SEQ ID NO: 772051 - RNA, 22 nt, Human
uuucaggaaggugaggcacaug

SEQ ID NO: 772052 - RNA, 22 nt, Human
gcaggguggauggcagggccag

SEQ ID NO: 772053 - RNA, 22 nt, Human
ucuggcaguugccgcuucaguc

SEQ ID NO: 772054 - RNA, 22 nt, Human
guccucaggaaagcagauaaca

SEQ ID NO: 772055 - RNA, 22 nt, Human
gaggugucaugagggccugcuc

SEQ ID NO: 772056 - RNA, 22 nt, Human
cugggccuccagcucugccagc

SEQ ID NO: 772057 - RNA, 22 nt, Human
uaggugucugcucuuauuuaac

SEQ ID NO: 772058 - RNA, 21 nt, Human
cccaggugggaugguugccuc

SEQ ID NO: 772059 - RNA, 22 nt, Human
agcuccuugcagguugccuugg

SEQ ID NO: 772060 - RNA, 23 nt, Human
ugaaacauuuaggguagaauuuc

SEQ ID NO: 772061 - RNA, 22 nt, Human
ccugggcaucaacaagcagaga

SEQ ID NO: 772062 - RNA, 22 nt, Human
ggucccaggagaauaggugcaa

SEQ ID NO: 772063 - RNA, 22 nt, Human
aauuaaaugacaggggaagaug

SEQ ID NO: 772064 - RNA, 22 nt, Human
ugaaaugauuauaugguguuug

SEQ ID NO: 772065 - RNA, 22 nt, Human
agugguccugcaaacccgugug

SEQ ID NO: 772066 - RNA, 22 nt, Human
ucaggugguccuaagugccauc

SEQ ID NO: 772067 - RNA, 22 nt, Human
cuguuacugcuggagccauuga

SEQ ID NO: 772068 - RNA, 22 nt, Human
guuugcauaucugugaaaugga

SEQ ID NO: 772069 - RNA, 22 nt, Human
aguagacauuuugcaacaucug

SEQ ID NO: 772070 - RNA, 22 nt, Human
uaucauuuuacugugacauuuu

SEQ ID NO: 772071 - RNA, 22 nt, Human
uaugaaagaaucucagagcaca

SEQ ID NO: 772072 - RNA, 22 nt, Human
uacuucuagccugccccuugug

SEQ ID NO: 772073 - RNA, 22 nt, Human
aagcuucagugugagcauguaa

SEQ ID NO: 772074 - RNA, 22 nt, Human
augugcuucauaaucuucucau

SEQ ID NO: 772075 - RNA, 22 nt, Human
acucaggcuacaacgcguggcu

SEQ ID NO: 772076 - RNA, 22 nt, Human
gagcucuguucucguccugcug

SEQ ID NO: 772077 - RNA, 16 nt, Human
auucacaaggcaucgg

SEQ ID NO: 772078 - RNA, 22 nt, Human
gaaggagagagacaucgucccu

SEQ ID NO: 772079 - RNA, 22 nt, Human
caccuggaguagcaagguaauu

SEQ ID NO: 772080 - RNA, 23 nt, Human
acagaaaucauuuguaagguacc

SEQ ID NO: 772081 - RNA, 22 nt, Human
uuuugugagcccauaaaugcca

SEQ ID NO: 772082 - RNA, 22 nt, Human
aagaccucugaaguaccuggug

SEQ ID NO: 772083 - RNA, 22 nt, Human
gccugcagccucaagggcugag

SEQ ID NO: 772084 - RNA, 22 nt, Human
gcagggguagugucuuccugag

SEQ ID NO: 772085 - RNA, 21 nt, Human
ugcauggaggaaaguuauaga

SEQ ID NO: 772086 - RNA, 22 nt, Human
agccuggauccauguggcuacc

SEQ ID NO: 772087 - RNA, 22 nt, Human
cccuuccucccaggcuucugug

SEQ ID NO: 772088 - RNA, 22 nt, Human
aucuacauaaaacgaauacaua

SEQ ID NO: 772089 - RNA, 20 nt, Human
uaaugucaaagucacaaggu

SEQ ID NO: 772090 - RNA, 22 nt, Human
uguuugaguucuagcgcauuua

SEQ ID NO: 772091 - RNA, 22 nt, Human
aaagucauggaaaaucuuggaa

SEQ ID NO: 772092 - RNA, 22 nt, Human
uuuggagaaguugcuaaagugu

SEQ ID NO: 772093 - RNA, 22 nt, Human
acaggcuggugguccuggccau

SEQ ID NO: 772094 - RNA, 22 nt, Human
uucccucuuucacugugauuuu

SEQ ID NO: 772095 - RNA, 22 nt, Human
acagcaggaauuaacauauaag

SEQ ID NO: 772096 - RNA, 22 nt, Human
aaaauuuccaccaucuuugugu

SEQ ID NO: 772097 - RNA, 21 nt, Human
gcagagcuggaaccaggaccc

SEQ ID NO: 772098 - RNA, 20 nt, Human
uacuugaauguugcagcagu

SEQ ID NO: 772099 - RNA, 22 nt, Human
aaauacaauuucaggcuguaau

SEQ ID NO: 772100 - RNA, 22 nt, Human
auccauuugacauaauuucagc

SEQ ID NO: 772101 - RNA, 22 nt, Human
uuccuucuuccuuuaguaacca

SEQ ID NO: 772102 - RNA, 20 nt, Human
uugaaugaaugucuggcuca

SEQ ID NO: 772103 - RNA, 19 nt, Human
agcuggggcgguguguguu

SEQ ID NO: 772104 - RNA, 22 nt, Human
uaacuugauaaguauucucugc

SEQ ID NO: 772105 - RNA, 22 nt, Human
auauuuguaguggguaagaagu

SEQ ID NO: 772106 - RNA, 22 nt, Human
cuggcugcaggaugaggcugcc

SEQ ID NO: 772107 - RNA, 22 nt, Human
aggagguguagauuuccuguca

SEQ ID NO: 772108 - RNA, 22 nt, Human
ggcauugaugggagauggugga

SEQ ID NO: 772109 - RNA, 22 nt, Human
aggaugacuggaacccaaguga

SEQ ID NO: 772110 - RNA, 22 nt, Human
ucuagcaccacauuaaauagca

SEQ ID NO: 772111 - RNA, 22 nt, Human
cucaggaguuggaggcuacagu

SEQ ID NO: 772112 - RNA, 22 nt, Human
ugagaagcucugaaacaguauc

SEQ ID NO: 772113 - RNA, 22 nt, Human
auaaaacuuggguaugaucccu

SEQ ID NO: 772114 - RNA, 20 nt, Human
gaggaaaagcugccaggccu

SEQ ID NO: 772115 - RNA, 22 nt, Human
uagcagggucucaggagucagg

SEQ ID NO: 772116 - RNA, 22 nt, Human
accucucaggucuuccucauau

SEQ ID NO: 772117 - RNA, 22 nt, Human
cagguccaagagauccuccuac

SEQ ID NO: 772118 - RNA, 22 nt, Human
cagcugcuguuacugcuuauua

SEQ ID NO: 772119 - RNA, 22 nt, Human
aagcagcuuccccaaagugccu

SEQ ID NO: 772120 - RNA, 23 nt, Human
ccuguggcaaguagaugagauga

SEQ ID NO: 772121 - RNA, 22 nt, Human
agagaugagaacaugcuuggau

SEQ ID NO: 772122 - RNA, 22 nt, Human
cauccagaguccaaggcugggc

SEQ ID NO: 772123 - RNA, 20 nt, Human
aagguccaaacucuguguuc

SEQ ID NO: 772124 - RNA, 22 nt, Human
uaucuucuugccaggcuggugu

SEQ ID NO: 772125 - RNA, 22 nt, Human
ugcuggcuuuuugguccuugcu

SEQ ID NO: 772126 - RNA, 22 nt, Human
cagcucugguuccugggcccag

SEQ ID NO: 772127 - RNA, 22 nt, Human
ccugucuacauaacugugugaa

SEQ ID NO: 772128 - RNA, 22 nt, Human
cacuguuuuauuccaacauagg

SEQ ID NO: 772129 - RNA, 22 nt, Human
agcucugggggaaagucugcuc

SEQ ID NO: 772130 - RNA, 22 nt, Human
uaggaagcucuuuguuuuguga

SEQ ID NO: 772131 - RNA, 22 nt, Human
agucauauauuuuguuugugca

SEQ ID NO: 772132 - RNA, 19 nt, Human
gaggcaaggaguuuaagcc

SEQ ID NO: 772133 - RNA, 22 nt, Human
auaauauaauccuacuucccau

SEQ ID NO: 772134 - RNA, 22 nt, Human
cuugcugugugguguucucaga

SEQ ID NO: 772135 - RNA, 22 nt, Human
ugcugcuguaucaugccuucau

SEQ ID NO: 772136 - RNA, 22 nt, Human
ccuggcuccgugucacgugccc

SEQ ID NO: 772137 - RNA, 22 nt, Human
aaacaucugacuugcuuuuuca

SEQ ID NO: 772138 - RNA, 22 nt, Human
ugaaaugaaacagaacauauca

SEQ ID NO: 772139 - RNA, 22 nt, Human
ugcuaaggacugggaggcaggg

SEQ ID NO: 772140 - RNA, 22 nt, Human
ggcuauguguguccaguguauu

SEQ ID NO: 772141 - RNA, 22 nt, Human
uccaggcuaauuuugcauuguu

SEQ ID NO: 772142 - RNA, 22 nt, Human
ucccacauaugcaauccugaau

SEQ ID NO: 772143 - RNA, 20 nt, Human
aggcagagcgcacuuuuaga

SEQ ID NO: 772144 - RNA, 22 nt, Human
uccaccagccaggcccaggcug

SEQ ID NO: 772145 - RNA, 22 nt, Human
cacccuuugcugcucuuccucc

SEQ ID NO: 772146 - RNA, 22 nt, Human
uuuuaucaaucauuaagacauu

SEQ ID NO: 772147 - RNA, 18 nt, Human
agauuuugagaaauacaa

SEQ ID NO: 772148 - RNA, 22 nt, Human
guaaauauucccucgguuccua

SEQ ID NO: 772149 - RNA, 22 nt, Human
gcuuccuacaugugucugcgag

SEQ ID NO: 772150 - RNA, 22 nt, Human
cccaggaaugaggggcggaggc

SEQ ID NO: 772151 - RNA, 22 nt, Human
aaagcugcccuacacggaagca

SEQ ID NO: 772152 - RNA, 22 nt, Human
gcaagcagaucuccggagggaa

SEQ ID NO: 772153 - RNA, 22 nt, Human
guguggggucuucucuuggccu

SEQ ID NO: 772154 - RNA, 22 nt, Human
uugagcucccgcuucuucuuug

SEQ ID NO: 772155 - RNA, 22 nt, Human
agcuggguguguaucagauaaa

SEQ ID NO: 772156 - RNA, 22 nt, Human
uguguccugcagacagacucag

SEQ ID NO: 772157 - RNA, 22 nt, Human
ucuccugaagaccaugugcacu

SEQ ID NO: 772158 - RNA, 22 nt, Human
acauugaauguaugugaugaaa

SEQ ID NO: 772159 - RNA, 22 nt, Human
aacauaucauaggaugucauug

SEQ ID NO: 772160 - RNA, 22 nt, Human
gggcacuguguucagagugcag

SEQ ID NO: 772161 - RNA, 22 nt, Human
uaaugaacucuuuacuuuggga

SEQ ID NO: 772162 - RNA, 22 nt, Human
ugaaggcauaaaucuugggaac

SEQ ID NO: 772163 - RNA, 22 nt, Human
cugugccacugggggccggcaa

SEQ ID NO: 772164 - RNA, 22 nt, Human
cugagaguuaagagauggggcu

SEQ ID NO: 772165 - RNA, 22 nt, Human
aacccgggagguggagguuaug

SEQ ID NO: 772166 - RNA, 22 nt, Human
accccaggucuccaggcucugg

SEQ ID NO: 772167 - RNA, 22 nt, Human
uuccugguaguaagacaucugg

SEQ ID NO: 772168 - RNA, 22 nt, Human
uacauuccugggcuccacccua

SEQ ID NO: 772169 - RNA, 22 nt, Human
gcucugugggugaguagaaucu

SEQ ID NO: 772170 - RNA, 22 nt, Human
ugcagcagggcccaggcacaga

SEQ ID NO: 772171 - RNA, 22 nt, Human
auggauaaauacuuggugguau

SEQ ID NO: 772172 - RNA, 22 nt, Human
agucucagaaaagaagcaugga

SEQ ID NO: 772173 - RNA, 22 nt, Human
ugaggccaggcaaaggcgaucu

SEQ ID NO: 772174 - RNA, 22 nt, Human
uaacuucaaaauugccacaugu

SEQ ID NO: 772175 - RNA, 22 nt, Human
ugaaaagacugcaagagagcau

SEQ ID NO: 772176 - RNA, 22 nt, Human
agcucagaagggaggaaaugag

SEQ ID NO: 772177 - RNA, 22 nt, Human
acugugugggccgcucacuggg

SEQ ID NO: 772178 - RNA, 22 nt, Human
auuagcaacauggugaauaugu

SEQ ID NO: 772179 - RNA, 22 nt, Human
agggucuucccaccauuccugc

SEQ ID NO: 772180 - RNA, 22 nt, Human
caggauggagggagggcuguua

SEQ ID NO: 772181 - RNA, 22 nt, Human
uugcuacaugguuucaaagcug

SEQ ID NO: 772182 - RNA, 22 nt, Human
agcuguuuucuucuaggaagac

SEQ ID NO: 772183 - RNA, 22 nt, Human
caggaaauuggcuauuugggau

SEQ ID NO: 772184 - RNA, 22 nt, Human
aagaacugugcuccaggcucca

SEQ ID NO: 772185 - RNA, 22 nt, Human
aagucuaguauccuucuugacu

SEQ ID NO: 772186 - RNA, 22 nt, Human
agaugcugugucuguucccuug

SEQ ID NO: 772187 - RNA, 22 nt, Human
ugcaggccuaugguggggcccc

SEQ ID NO: 772188 - RNA, 15 nt, Human
ggugagaguaggauu

SEQ ID NO: 772189 - RNA, 22 nt, Human
cccugcagaaccacagacaaac

SEQ ID NO: 772190 - RNA, 22 nt, Human
gguuugguuuuggccaucuucc

SEQ ID NO: 772191 - RNA, 22 nt, Human
ugagagcuugaguaucacuggc

SEQ ID NO: 772192 - RNA, 23 nt, Human
uaaagcaaagucaagugcacucc

SEQ ID NO: 772193 - RNA, 22 nt, Human
agcccagaggguagcagaagaa

SEQ ID NO: 772194 - RNA, 22 nt, Human
agguaaauucagcagugacauu

SEQ ID NO: 772195 - RNA, 22 nt, Human
gcccugucggaacugcgaccuc

SEQ ID NO: 772196 - RNA, 22 nt, Human
cucaggucuuaguucugucauc

SEQ ID NO: 772197 - RNA, 22 nt, Human
uggagcaggugccaggugugug

SEQ ID NO: 772198 - RNA, 22 nt, Human
aacagucuacugaauaucugcg

SEQ ID NO: 772199 - RNA, 22 nt, Human
caaccucuguaauguucuagga

SEQ ID NO: 772200 - RNA, 22 nt, Human
cauugcccaguaggaucaccag

SEQ ID NO: 772201 - RNA, 22 nt, Human
ucugagccagacaagacagcca

SEQ ID NO: 772202 - RNA, 22 nt, Human
cucagaagaacaaaggcucuac

SEQ ID NO: 772203 - RNA, 22 nt, Human
ccccuggggaucagcuggaauu

SEQ ID NO: 772204 - RNA, 22 nt, Human
cacagagauggccagggcacau

SEQ ID NO: 772205 - RNA, 22 nt, Human
uggcgagccccgacugaguguu

SEQ ID NO: 772206 - RNA, 22 nt, Human
acauacuuuguccuuaacguac

SEQ ID NO: 772207 - RNA, 22 nt, Human
gguccuucaguagguuccagac

SEQ ID NO: 772208 - RNA, 22 nt, Human
aauugaaauucuuuguggucca

SEQ ID NO: 772209 - RNA, 21 nt, Human
uagcaaauggagaguaagaga

SEQ ID NO: 772210 - RNA, 22 nt, Human
gucugccugucuggaugacaga

SEQ ID NO: 772211 - RNA, 22 nt, Human
cgugaguggguagcuuauucuu

SEQ ID NO: 772212 - RNA, 22 nt, Human
uuggcucugugucuccacucaa

SEQ ID NO: 772213 - RNA, 22 nt, Human
cugcccaggcugaaggaacauc

SEQ ID NO: 772214 - RNA, 22 nt, Human
gagaggcaggaauccuggguga

SEQ ID NO: 772215 - RNA, 22 nt, Human
gaggggugggcuggaaguuaua

SEQ ID NO: 772216 - RNA, 22 nt, Human
uggaggucucugucugggcagg

SEQ ID NO: 772217 - RNA, 22 nt, Human
agugacagccaaauccauccau

SEQ ID NO: 772218 - RNA, 21 nt, Human
agggccagaucaccaaggagc

SEQ ID NO: 772219 - RNA, 22 nt, Human
auugucagugggauuugucaac

SEQ ID NO: 772220 - RNA, 22 nt, Human
gucucuggcuuuaugcugguuu

SEQ ID NO: 772221 - RNA, 22 nt, Human
aacucuuaauuuucaugaaaug

SEQ ID NO: 772222 - RNA, 22 nt, Human
ucucaguggacgugucugucuu

SEQ ID NO: 772223 - RNA, 22 nt, Human
ccggucccaggugccccgguga

SEQ ID NO: 772224 - RNA, 19 nt, Human
ccaggagugguggggugag

SEQ ID NO: 772225 - RNA, 22 nt, Human
acaaguguugcauuuugccauu

SEQ ID NO: 772226 - RNA, 22 nt, Human
caaaccugacuggggaugggcg

SEQ ID NO: 772227 - RNA, 20 nt, Human
uccaggcccacucagcugaa

SEQ ID NO: 772228 - RNA, 19 nt, Human
uccaaagaaguucacauuu

SEQ ID NO: 772229 - RNA, 22 nt, Human
cuuggcacuugggcagugagca

SEQ ID NO: 772230 - RNA, 22 nt, Human
aguggcaucccuuuaacagggu

SEQ ID NO: 772231 - RNA, 22 nt, Human
acugaaagauaaaucaguuagc

SEQ ID NO: 772232 - RNA, 22 nt, Human
agaguuuguauuuuucagugaa

SEQ ID NO: 772233 - RNA, 21 nt, Human
caaaaggauaggaaauuaggg

SEQ ID NO: 772234 - RNA, 22 nt, Human
auauguauguacgcacauauuc

SEQ ID NO: 772235 - RNA, 22 nt, Human
gaggcuagagcaggggcucaau

SEQ ID NO: 772236 - RNA, 22 nt, Human
uauuaaauguuauuuggguugu

SEQ ID NO: 772237 - RNA, 22 nt, Human
acacuguaaauugagugcguga

SEQ ID NO: 772238 - RNA, 22 nt, Human
uauguguauaccuauacaugug

SEQ ID NO: 772239 - RNA, 22 nt, Human
ugcugggcugcacccccagagu

SEQ ID NO: 772240 - RNA, 21 nt, Human
aggaguugcuguggccugguu

SEQ ID NO: 772241 - RNA, 22 nt, Human
uugaggcacagauuuuaguggc

SEQ ID NO: 772242 - RNA, 22 nt, Human
aggagcaaaugaugagacagca

SEQ ID NO: 772243 - RNA, 22 nt, Human
ucuggcuccaccuccuuuacua

SEQ ID NO: 772244 - RNA, 22 nt, Human
ucaugcucugguuuagcuguuu

SEQ ID NO: 772245 - RNA, 22 nt, Human
aaauacacguacauguguaaaa

SEQ ID NO: 772246 - RNA, 22 nt, Human
acaggaguuaaggcugaguuga

SEQ ID NO: 772247 - RNA, 22 nt, Human
gagcugcuggauauguggccug

SEQ ID NO: 772248 - RNA, 22 nt, Human
uucucuuugacauuauucaggu

SEQ ID NO: 772249 - RNA, 22 nt, Human
cacugcccucacugugguucuc

SEQ ID NO: 772250 - RNA, 22 nt, Human
uacauaguauucacauuguuuu

SEQ ID NO: 772251 - RNA, 22 nt, Human
uguguguauaugcauuuaucua

SEQ ID NO: 772252 - RNA, 20 nt, Human
guuuuucucucuugccacua

SEQ ID NO: 772253 - RNA, 22 nt, Human
acacaguaccccaaggcugggc

SEQ ID NO: 772254 - RNA, 22 nt, Human
cagugucugccuuucuguuugg

SEQ ID NO: 772255 - RNA, 22 nt, Human
ugaaugcacugcucuccuagga

SEQ ID NO: 772256 - RNA, 22 nt, Human
aaagguaguacuucuagaaggg

SEQ ID NO: 772257 - RNA, 19 nt, Human
uccaggcuccauuggcaga

SEQ ID NO: 772258 - RNA, 22 nt, Human
uggucugacuugcuuuggacag

SEQ ID NO: 772259 - RNA, 22 nt, Human
uuucuaaguguguuucauagga

SEQ ID NO: 772260 - RNA, 22 nt, Human
uuccaugaaagugaaauggagc

SEQ ID NO: 772261 - RNA, 22 nt, Human
guaggcagugcuugauuuucca

SEQ ID NO: 772262 - RNA, 22 nt, Human
ucugaaagggcuaaauaauuug

SEQ ID NO: 772263 - RNA, 22 nt, Human
gacaagacagcuugcagacaac

SEQ ID NO: 772264 - RNA, 22 nt, Human
uauaggaaauaggucuucugug

SEQ ID NO: 772265 - RNA, 22 nt, Human
cuaggaaugguaccucuuacaa

SEQ ID NO: 772266 - RNA, 22 nt, Human
gcagcccaagagacucuguuga

SEQ ID NO: 772267 - RNA, 22 nt, Human
aaacagucaaaggccuaagcua

SEQ ID NO: 772268 - RNA, 22 nt, Human
uuuucugccugcguguuuagga

SEQ ID NO: 772269 - RNA, 22 nt, Human
caucuuaaauuaaagcuuaagg

SEQ ID NO: 772270 - RNA, 22 nt, Human
ugaaucaauugucuuaagacau

SEQ ID NO: 772271 - RNA, 22 nt, Human
gguccaguccugcucaccacuu

SEQ ID NO: 772272 - RNA, 22 nt, Human
ucugaggggcuggaagggcugc

SEQ ID NO: 772273 - RNA, 22 nt, Human
uagacacaucuucauccacaau

SEQ ID NO: 772274 - RNA, 22 nt, Human
cauuuauucauuugcuagggcu

SEQ ID NO: 772275 - RNA, 22 nt, Human
auuacaacuaugugcucugcaa

SEQ ID NO: 772276 - RNA, 22 nt, Human
gaguccuggagaaacgcaggug

SEQ ID NO: 772277 - RNA, 22 nt, Human
cugaggucaccccacuggcugu

SEQ ID NO: 772278 - RNA, 22 nt, Human
gauucagugggcuuugggacag

SEQ ID NO: 772279 - RNA, 22 nt, Human
uccuccagcuguauccugccug

SEQ ID NO: 772280 - RNA, 22 nt, Human
ucuuuaauuguggaagagcagc

SEQ ID NO: 772281 - RNA, 22 nt, Human
cccaggagaucuggaucucguc

SEQ ID NO: 772282 - RNA, 22 nt, Human
agccuggaauuaaggaaaugca

SEQ ID NO: 772283 - RNA, 22 nt, Human
uuaugcaaaggggccucuuccu

SEQ ID NO: 772284 - RNA, 22 nt, Human
gcagggcaggauuugaacccag

SEQ ID NO: 772285 - RNA, 20 nt, Human
caggccucugggggcccugg

SEQ ID NO: 772286 - RNA, 22 nt, Human
ggaauucucuaugcucuguucc

SEQ ID NO: 772287 - RNA, 22 nt, Human
gacuggaaucccaggcucugug

SEQ ID NO: 772288 - RNA, 22 nt, Human
uggugcaggaguuggcagggac

SEQ ID NO: 772289 - RNA, 22 nt, Human
uucauacuguguuuccaaguuu

SEQ ID NO: 772290 - RNA, 22 nt, Human
caaguuuguguucuaucauucu

SEQ ID NO: 772291 - RNA, 23 nt, Human
aagcuuccuucacgucuccuggg

SEQ ID NO: 772292 - RNA, 22 nt, Human
uagaaguggcaacacucagaaa

SEQ ID NO: 772293 - RNA, 22 nt, Human
uaaacauguugacaucuuaccu

SEQ ID NO: 772294 - RNA, 22 nt, Human
ggccaggcugcccugggagcag

SEQ ID NO: 772295 - RNA, 22 nt, Human
auugucuucugucuuaggugau

SEQ ID NO: 772296 - RNA, 22 nt, Human
gauuucuaaguuuuaccacaaa

SEQ ID NO: 772297 - RNA, 22 nt, Human
uuugaagugggcauuagaaccu

SEQ ID NO: 772298 - RNA, 22 nt, Human
acaugaaaacugguuccuucag

SEQ ID NO: 772299 - RNA, 22 nt, Human
uacaguaaagcugcuaugaauu

SEQ ID NO: 772300 - RNA, 22 nt, Human
cacaugaggugacuuccaagcu

SEQ ID NO: 772301 - RNA, 22 nt, Human
uauuuaaaauagugcuccagca

SEQ ID NO: 772302 - RNA, 22 nt, Human
cauucuuauauuuacucauuca

SEQ ID NO: 772303 - RNA, 22 nt, Human
ugccucagucagcuucccuggg

SEQ ID NO: 772304 - RNA, 23 nt, Human
uacuauaacgcugugucagcucc

SEQ ID NO: 772305 - RNA, 22 nt, Human
cuaaggcaccgaggcaggagcg

SEQ ID NO: 772306 - RNA, 23 nt, Human
ugccacccuucucuucccagcuu

SEQ ID NO: 772307 - RNA, 22 nt, Human
cugugagacugauagggaagag

SEQ ID NO: 772308 - RNA, 23 nt, Human
agagagaguuugugucagguacc

SEQ ID NO: 772309 - RNA, 22 nt, Human
ucugaggucauuccaaggacau

SEQ ID NO: 772310 - RNA, 22 nt, Human
aagaaaugcacacaacugcugg

SEQ ID NO: 772311 - RNA, 20 nt, Human
uucaggaauaagauagcagc

SEQ ID NO: 772312 - RNA, 22 nt, Human
aaggcaccauugucaacgguaa

SEQ ID NO: 772313 - RNA, 22 nt, Human
ucacauuuucuacuacuguacg

SEQ ID NO: 772314 - RNA, 22 nt, Human
cccaggcuggaauuccaggccu

SEQ ID NO: 772315 - RNA, 21 nt, Human
ucaguccuguuagccuuuggg

SEQ ID NO: 772316 - RNA, 20 nt, Human
ggcuuggcugccuggggagg

SEQ ID NO: 772317 - RNA, 17 nt, Human
uaucucuucaaguuuca

SEQ ID NO: 772318 - RNA, 22 nt, Human
gagggaauggugugcaagaggu

SEQ ID NO: 772319 - RNA, 18 nt, Human
auauggaaugccuggcua

SEQ ID NO: 772320 - RNA, 17 nt, Human
ggcagcugugugcaugc

SEQ ID NO: 772321 - RNA, 22 nt, Human
acccaggguuugagcucugcag

SEQ ID NO: 772322 - RNA, 22 nt, Human
agaaacucuggaagaacuuuua

SEQ ID NO: 772323 - RNA, 22 nt, Human
gucugccugggacgcugggagu

SEQ ID NO: 772324 - RNA, 22 nt, Human
cugggucaguggcaagcugggu

SEQ ID NO: 772325 - RNA, 22 nt, Human
ucuggcuuuauuccuucacuga

SEQ ID NO: 772326 - RNA, 22 nt, Human
ggcacagcaccuuuucacauug

SEQ ID NO: 772327 - RNA, 22 nt, Human
ucagggcauggcugcacuuggc

SEQ ID NO: 772328 - RNA, 19 nt, Human
aagggucacaagcagcaga

SEQ ID NO: 772329 - RNA, 22 nt, Human
gggcucuggaaggugcaccaug

SEQ ID NO: 772330 - RNA, 22 nt, Human
gagaggcugcauaugcacacug

SEQ ID NO: 772331 - RNA, 22 nt, Human
gugcugaggagagggggugguc

SEQ ID NO: 772332 - RNA, 22 nt, Human
aaugaaauguagcuuauccaua

SEQ ID NO: 772333 - RNA, 22 nt, Human
ccugggccucacccagcucuug

SEQ ID NO: 772334 - RNA, 21 nt, Human
uaugagaaaacugaggugcau

SEQ ID NO: 772335 - RNA, 22 nt, Human
uucucaggacuccugccugcuu

SEQ ID NO: 772336 - RNA, 22 nt, Human
agugagacaguauacugagcag

SEQ ID NO: 772337 - RNA, 22 nt, Human
cugcagggcagggccuccuggc

SEQ ID NO: 772338 - RNA, 22 nt, Human
uccucacauggugagccacaca

SEQ ID NO: 772339 - RNA, 22 nt, Human
acugaaguagucauugucauua

SEQ ID NO: 772340 - RNA, 22 nt, Human
gggucuccauguuaacaucacu

SEQ ID NO: 772341 - RNA, 22 nt, Human
ucauccagccucaucaggagcu

SEQ ID NO: 772342 - RNA, 18 nt, Human
cugaaggauccaggugua

SEQ ID NO: 772343 - RNA, 22 nt, Human
aggaggguucucuggacagagg

SEQ ID NO: 772344 - RNA, 20 nt, Human
uccugcagucgcuagcgccc

SEQ ID NO: 772345 - RNA, 22 nt, Human
aguuuucugccucuggaugcgu

SEQ ID NO: 772346 - RNA, 22 nt, Human
ugaggccaaaaugacucaaaug

SEQ ID NO: 772347 - RNA, 22 nt, Human
cauaugaaauaugaguugaaca

SEQ ID NO: 772348 - RNA, 22 nt, Human
gcacaaagguggaaggaggaag

SEQ ID NO: 772349 - RNA, 22 nt, Human
gcacccagauauugccuugacc

SEQ ID NO: 772350 - RNA, 22 nt, Human
cccaggacucugacacccccaa

SEQ ID NO: 772351 - RNA, 22 nt, Human
ucaaaugcuucuacuccuaaga

SEQ ID NO: 772352 - RNA, 22 nt, Human
ucuuucuugguauucugagcua

SEQ ID NO: 772353 - RNA, 22 nt, Human
agcugggcugaugacucauguu

SEQ ID NO: 772354 - RNA, 22 nt, Human
caauaugcaagcuauuaaguau

SEQ ID NO: 772355 - RNA, 22 nt, Human
cuucagaagccugcagccuuug

SEQ ID NO: 772356 - RNA, 22 nt, Human
agaggccccaggugagcaugcc

SEQ ID NO: 772357 - RNA, 22 nt, Human
guucuaauuuggggcuccuuag

SEQ ID NO: 772358 - RNA, 22 nt, Human
uuccaaagcugcuuuauuuagu

SEQ ID NO: 772359 - RNA, 22 nt, Human
guuucacagguuggagccagca

SEQ ID NO: 772360 - RNA, 22 nt, Human
agccucccuaugcaccuucagg

SEQ ID NO: 772361 - RNA, 22 nt, Human
agaagcagacucugaggcaagg

SEQ ID NO: 772362 - RNA, 22 nt, Human
gguccuggaaauugacggaaag

SEQ ID NO: 772363 - RNA, 22 nt, Human
uggagagaaaguugaauggagg

SEQ ID NO: 772364 - RNA, 22 nt, Human
cuggaguacaggaaucuuccca

SEQ ID NO: 772365 - RNA, 22 nt, Human
uuggcugugcagaucuugccua

SEQ ID NO: 772366 - RNA, 22 nt, Human
gaaacacauaugaacaguugau

SEQ ID NO: 772367 - RNA, 22 nt, Human
uucucagagcacugcugacaaa

SEQ ID NO: 772368 - RNA, 22 nt, Human
ugagcagaugugccaaacugua

SEQ ID NO: 772369 - RNA, 22 nt, Human
agauucaaagugaagaacuuaa

SEQ ID NO: 772370 - RNA, 18 nt, Human
ugaggaaggggaaguauu

SEQ ID NO: 772371 - RNA, 22 nt, Human
agaggaggcagcuuaacucagu

SEQ ID NO: 772372 - RNA, 22 nt, Human
guucaaaauucaaaugguauac

SEQ ID NO: 772373 - RNA, 22 nt, Human
caggcucccacaagcucccagc

SEQ ID NO: 772374 - RNA, 22 nt, Human
aucacuuugguaccaauucagc

SEQ ID NO: 772375 - RNA, 22 nt, Human
ggcuucucccuucuucugauug

SEQ ID NO: 772376 - RNA, 22 nt, Human
uuugagcuuguagcauugcuau

SEQ ID NO: 772377 - RNA, 22 nt, Human
ucccuuccucauaggcagaagg

SEQ ID NO: 772378 - RNA, 23 nt, Human
ugacaacagcucucagccauguc

SEQ ID NO: 772379 - RNA, 22 nt, Human
ugcugagagauuuaaagggcca

SEQ ID NO: 772380 - RNA, 22 nt, Human
agcuaaggacaguugauuuaga

SEQ ID NO: 772381 - RNA, 22 nt, Human
agcucucaagauaagaaagaac

SEQ ID NO: 772382 - RNA, 22 nt, Human
cuuaagaugaggucaugcuaua

SEQ ID NO: 772383 - RNA, 22 nt, Human
caggaaauucccagaaggacug

SEQ ID NO: 772384 - RNA, 22 nt, Human
gaagugugcacaucuuacaagu

SEQ ID NO: 772385 - RNA, 22 nt, Human
ucccuggccauuccucuaggcc

SEQ ID NO: 772386 - RNA, 22 nt, Human
aggucgaguuucggggcuacuu

SEQ ID NO: 772387 - RNA, 22 nt, Human
agagcagcuggggcagagacca

SEQ ID NO: 772388 - RNA, 22 nt, Human
aggcuguguuuaagugguaaug

SEQ ID NO: 772389 - RNA, 22 nt, Human
uccauuuucuugcucuagguaa

SEQ ID NO: 772390 - RNA, 22 nt, Human
cccagccucuggauucugcccu

SEQ ID NO: 772391 - RNA, 22 nt, Human
agauccaggguuggauuugcau

SEQ ID NO: 772392 - RNA, 22 nt, Human
aaguacaucaaauguuuggcua

SEQ ID NO: 772393 - RNA, 22 nt, Human
gaucugggagccucauggagac

SEQ ID NO: 772394 - RNA, 22 nt, Human
guacaguuuucaguguucacug

SEQ ID NO: 772395 - RNA, 22 nt, Human
guacauguaugagauaugugua

SEQ ID NO: 772396 - RNA, 22 nt, Human
ggacuuggggaaggcacaguua

SEQ ID NO: 772397 - RNA, 22 nt, Human
aggggaaaugccuuggugguac

SEQ ID NO: 772398 - RNA, 22 nt, Human
cucuggacccagacaaaccugg

SEQ ID NO: 772399 - RNA, 22 nt, Human
cacugucugggacauguggucu

SEQ ID NO: 772400 - RNA, 22 nt, Human
cuauucugauuaccagauauug

SEQ ID NO: 772401 - RNA, 22 nt, Human
uguggccaggccccugauggug

SEQ ID NO: 772402 - RNA, 22 nt, Human
gggggcuagagagaugaaauau

SEQ ID NO: 772403 - RNA, 22 nt, Human
gaauaauugugaugcuugaagu

SEQ ID NO: 772404 - RNA, 22 nt, Human
cugagccagagggagucggguc

SEQ ID NO: 772405 - RNA, 22 nt, Human
aagaagaaguguuauuuuuaga

SEQ ID NO: 772406 - RNA, 22 nt, Human
ucacauuugcuaucccacuccu

SEQ ID NO: 772407 - RNA, 22 nt, Human
gguuccccaggcggcccuugga

SEQ ID NO: 772408 - RNA, 22 nt, Human
uagggggcuguccugugcauua

SEQ ID NO: 772409 - RNA, 22 nt, Human
agugcugucuccuucccccggg

SEQ ID NO: 772410 - RNA, 22 nt, Human
ucccagcugagauugagcaagg

SEQ ID NO: 772411 - RNA, 22 nt, Human
gacuucucggcacccuuuggca

SEQ ID NO: 772412 - RNA, 22 nt, Human
ucuuccugcuuuggugaggcuu

SEQ ID NO: 772413 - RNA, 23 nt, Human
agcuucugguucaggucaagcag

SEQ ID NO: 772414 - RNA, 20 nt, Human
agugugguuuucaggaauau

SEQ ID NO: 772415 - RNA, 22 nt, Human
agaucgauuucauauccucuua

SEQ ID NO: 772416 - RNA, 22 nt, Human
gcaggacuugaauccaggcagu

SEQ ID NO: 772417 - RNA, 22 nt, Human
caggcccagggagggagaccaa

SEQ ID NO: 772418 - RNA, 17 nt, Human
cccagcuggcagugccg

SEQ ID NO: 772419 - RNA, 22 nt, Human
ucagaaguuaauacgaggagaa

SEQ ID NO: 772420 - RNA, 22 nt, Human
caggaugcuucuggggccaggc

SEQ ID NO: 772421 - RNA, 21 nt, Human
ugcaggaaagugcugcgaccc

SEQ ID NO: 772422 - RNA, 22 nt, Human
ucagaggaacacuguuucaugc

SEQ ID NO: 772423 - RNA, 22 nt, Human
cacauugaaaugacccaauaau

SEQ ID NO: 772424 - RNA, 22 nt, Human
gcagagcuguuaauggagcuga

SEQ ID NO: 772425 - RNA, 22 nt, Human
uagccaggccuuugaucccggc

SEQ ID NO: 772426 - RNA, 22 nt, Human
ucagcagaauguggcaugucac

SEQ ID NO: 772427 - RNA, 22 nt, Human
augucacagcaggaguauucuu

SEQ ID NO: 772428 - RNA, 22 nt, Human
ccuugcugaccaucaccuuuga

SEQ ID NO: 772429 - RNA, 22 nt, Human
uucuacacaccucugaggacau

SEQ ID NO: 772430 - RNA, 22 nt, Human
auugcuuuguacaugccuagca

SEQ ID NO: 772431 - RNA, 22 nt, Human
ugugccuuuaaggggagcugag

SEQ ID NO: 772432 - RNA, 22 nt, Human
auuguuuccccggaauuauuca

SEQ ID NO: 772433 - RNA, 22 nt, Human
gaagucucacagacagaucaga

SEQ ID NO: 772434 - RNA, 22 nt, Human
aacagucuaaauuauacccuuu

SEQ ID NO: 772435 - RNA, 22 nt, Human
cagcagccucaaguuuauuuuc

SEQ ID NO: 772436 - RNA, 22 nt, Human
cacacauuagagccaaugucag

SEQ ID NO: 772437 - RNA, 22 nt, Human
auaaggcagaaauagggaaagu

SEQ ID NO: 772438 - RNA, 22 nt, Human
cagcuuggcuuccgcuuuacug

SEQ ID NO: 772439 - RNA, 22 nt, Human
acagcaguuaacgaucagacuc

SEQ ID NO: 772440 - RNA, 22 nt, Human
caugucuugcccugauuaguag

SEQ ID NO: 772441 - RNA, 19 nt, Human
agacacacuugauaugugu

SEQ ID NO: 772442 - RNA, 22 nt, Human
ucaaacuggcagacuucuacuu

SEQ ID NO: 772443 - RNA, 22 nt, Human
uacagcauguccuuagcaaggc

SEQ ID NO: 772444 - RNA, 20 nt, Human
cucuuuucacucucaguggu

SEQ ID NO: 772445 - RNA, 22 nt, Human
gggcuggcaucgguugcugaga

SEQ ID NO: 772446 - RNA, 22 nt, Human
auucgcgggccuggaggguggg

SEQ ID NO: 772447 - RNA, 22 nt, Human
uccuguuuaggcuguggucugg

SEQ ID NO: 772448 - RNA, 22 nt, Human
uaucuagauggauuuuagugaa

SEQ ID NO: 772449 - RNA, 22 nt, Human
agaacaauugccccaaagcuug

SEQ ID NO: 772450 - RNA, 22 nt, Human
uagagcagaacuuguuaacacc

SEQ ID NO: 772451 - RNA, 22 nt, Human
agagccugggcagcuccucugg

SEQ ID NO: 772452 - RNA, 22 nt, Human
uaacagcucuguguggcuguaa

SEQ ID NO: 772453 - RNA, 22 nt, Human
agcagcuguacuuucaucuguu

SEQ ID NO: 772454 - RNA, 22 nt, Human
cacagugaauuacauagacgug

SEQ ID NO: 772455 - RNA, 17 nt, Human
cuggagccaagagggcc

SEQ ID NO: 772456 - RNA, 22 nt, Human
cagaauguagaucaucaucaag

SEQ ID NO: 772457 - RNA, 22 nt, Human
cauuggaagacauaucaugcua

SEQ ID NO: 772458 - RNA, 18 nt, Human
gcucagcuaugggagguu

SEQ ID NO: 772459 - RNA, 22 nt, Human
aacaggcaaacugugggauccc

SEQ ID NO: 772460 - RNA, 22 nt, Human
ggacauggagcauguagagaaa

SEQ ID NO: 772461 - RNA, 22 nt, Human
agaggagaauccguuuccuugc

SEQ ID NO: 772462 - RNA, 22 nt, Human
uucugucaugcucauguaauug

SEQ ID NO: 772463 - RNA, 22 nt, Human
caaaaacugcaauuacuuuuac

SEQ ID NO: 772464 - RNA, 22 nt, Human
cuccuggggccauggaaggaac

SEQ ID NO: 772465 - RNA, 22 nt, Human
acacaugaguucucaucuugug

SEQ ID NO: 772466 - RNA, 22 nt, Human
caucuuuaacaauuuacaaugu

SEQ ID NO: 772467 - RNA, 22 nt, Human
gcaccugggacccagaggcacc

SEQ ID NO: 772468 - RNA, 22 nt, Human
caggcagaaugagauuacuuca

SEQ ID NO: 772469 - RNA, 23 nt, Human
uggcagugcccagggagaugauc

SEQ ID NO: 772470 - RNA, 22 nt, Human
ugaguuauauauacuggcucug

SEQ ID NO: 772471 - RNA, 22 nt, Human
aauuagggaaguauuuaguagu

SEQ ID NO: 772472 - RNA, 22 nt, Human
aaauaugagaguaggaguuugg

SEQ ID NO: 772473 - RNA, 22 nt, Human
auuuauuccugauuccuggcuu

SEQ ID NO: 772474 - RNA, 22 nt, Human
gaaaguuucucacacaugcaga

SEQ ID NO: 772475 - RNA, 22 nt, Human
uaauaauuaacagugauggguc

SEQ ID NO: 772476 - RNA, 22 nt, Human
gcagugcagugggacagggcgc

SEQ ID NO: 772477 - RNA, 22 nt, Human
guggugcaggccagcaggggcg

SEQ ID NO: 772478 - RNA, 22 nt, Human
augcuuuauuguuaggucaugu

SEQ ID NO: 772479 - RNA, 23 nt, Human
caucagccucagucuguggaccc

SEQ ID NO: 772480 - RNA, 22 nt, Human
auuacagauuauaaauuugagc

SEQ ID NO: 772481 - RNA, 22 nt, Human
ggcugccugguuuagugcugac

SEQ ID NO: 772482 - RNA, 22 nt, Human
uucugauuguuggaggaugcuu

SEQ ID NO: 772483 - RNA, 22 nt, Human
aaagccaggcagccaagccagu

SEQ ID NO: 772484 - RNA, 22 nt, Human
gccuggcaggggccugggagug

SEQ ID NO: 772485 - RNA, 22 nt, Human
uuucucaacuguauuaugcaga

SEQ ID NO: 772486 - RNA, 22 nt, Human
cugucugggucuacauccucug

SEQ ID NO: 772487 - RNA, 22 nt, Human
caggugggcguggcgagaaggc

SEQ ID NO: 772488 - RNA, 22 nt, Human
auucacaaauaacaggugcaga

SEQ ID NO: 772489 - RNA, 22 nt, Human
ggaugcaggggcagcagagccu

SEQ ID NO: 772490 - RNA, 22 nt, Human
uccaccagagccuucccaugcu

SEQ ID NO: 772491 - RNA, 22 nt, Human
uaagaugagguagguaagacuu

SEQ ID NO: 772492 - RNA, 22 nt, Human
cuguggagugcuuggcucagug

SEQ ID NO: 772493 - RNA, 22 nt, Human
aaagacauugaagaaggacuua

SEQ ID NO: 772494 - RNA, 22 nt, Human
cagguuuagguggacgugcagg

SEQ ID NO: 772495 - RNA, 20 nt, Human
cccaguguccagccuugcca

SEQ ID NO: 772496 - RNA, 22 nt, Human
agcugagagguggcaagcugua

SEQ ID NO: 772497 - RNA, 22 nt, Human
ucccugugagucaacuaaacaa

SEQ ID NO: 772498 - RNA, 22 nt, Human
acauuuggcaagaaagagaaac

SEQ ID NO: 772499 - RNA, 22 nt, Human
ccaaaugugccuguuucaacaa

SEQ ID NO: 772500 - RNA, 22 nt, Human
guuucaaagcacagcucacauu

SEQ ID NO: 772501 - RNA, 22 nt, Human
cuuggagauacagaggacauuu

SEQ ID NO: 772502 - RNA, 18 nt, Human
ccgggcuuuggugacaca

SEQ ID NO: 772503 - RNA, 22 nt, Human
aggucucugaguacugcuggac

SEQ ID NO: 772504 - RNA, 22 nt, Human
uggcacuguggauuucacaagu

SEQ ID NO: 772505 - RNA, 22 nt, Human
caggcagagccaaucguggggu

SEQ ID NO: 772506 - RNA, 22 nt, Human
ucuuuuuuuccugugcagagcu

SEQ ID NO: 772507 - RNA, 23 nt, Human
uaucuguauuuguucacugcugu

SEQ ID NO: 772508 - RNA, 22 nt, Human
acauagaagugaugcuuaucca

SEQ ID NO: 772509 - RNA, 22 nt, Human
ccuggcccuggaauagggcagg

SEQ ID NO: 772510 - RNA, 22 nt, Human
uaguuuagcauacaucuucagg

SEQ ID NO: 772511 - RNA, 22 nt, Human
gcagggcuguucaggagggugg

SEQ ID NO: 772512 - RNA, 22 nt, Human
gcugugcaaaucgauuuguugg

SEQ ID NO: 772513 - RNA, 22 nt, Human
auguuucuaguuguaugucacu

SEQ ID NO: 772514 - RNA, 22 nt, Human
uacaaccagauccucuaaguca

SEQ ID NO: 772515 - RNA, 22 nt, Human
auauucugcuuuugaugcauuc

SEQ ID NO: 772516 - RNA, 22 nt, Human
cagaagugauguugagcuaguc

SEQ ID NO: 772517 - RNA, 22 nt, Human
uugaaguucugcauuucuaaua

SEQ ID NO: 772518 - RNA, 22 nt, Human
aggggccuggacauggacgcgc

SEQ ID NO: 772519 - RNA, 22 nt, Human
uuuacaguuccaugugauaggc

SEQ ID NO: 772520 - RNA, 22 nt, Human
ccauuugaaaugaauguuuuua

SEQ ID NO: 772521 - RNA, 21 nt, Human
uuugaauagaaauagugcuua

SEQ ID NO: 772522 - RNA, 22 nt, Human
uuguuuaaagaacuucugacuu

SEQ ID NO: 772523 - RNA, 22 nt, Human
uuuauuagauuaucaaagaggu

SEQ ID NO: 772524 - RNA, 22 nt, Human
caaagccauagaguagauaaga

SEQ ID NO: 772525 - RNA, 22 nt, Human
ucuauauuccagauacagauua

SEQ ID NO: 772526 - RNA, 22 nt, Human
ugagcccuaccugcucaucucc

SEQ ID NO: 772527 - RNA, 22 nt, Human
acucaucuucccuccuggaggg

SEQ ID NO: 772528 - RNA, 22 nt, Human
gaggaugugucuggucugggca

SEQ ID NO: 772529 - RNA, 21 nt, Human
auaugaacuguggacuuugga

SEQ ID NO: 772530 - RNA, 19 nt, Human
aaguugaucauuuugacag

SEQ ID NO: 772531 - RNA, 22 nt, Human
cucaguuucuuacucuguauaa

SEQ ID NO: 772532 - RNA, 22 nt, Human
ucucagugcagagaggcuaucu

SEQ ID NO: 772533 - RNA, 22 nt, Human
ggaagggcaauaaaaucucagg

SEQ ID NO: 772534 - RNA, 22 nt, Human
agaaaauuacuccagagacaag

SEQ ID NO: 772535 - RNA, 22 nt, Human
gcugcugucagcaggccuuguu

SEQ ID NO: 772536 - RNA, 22 nt, Human
auucuucauacagacaaguccu

SEQ ID NO: 772537 - RNA, 22 nt, Human
auucagggaggaaaggggccuc

SEQ ID NO: 772538 - RNA, 22 nt, Human
aggacuucuuagaugccuuccg

SEQ ID NO: 772539 - RNA, 22 nt, Human
cccagcagugguucucaaacuu

SEQ ID NO: 772540 - RNA, 22 nt, Human
ggcaguggugggaggcucgcuc

SEQ ID NO: 772541 - RNA, 22 nt, Human
uuuagcauccaagguuaugacu

SEQ ID NO: 772542 - RNA, 22 nt, Human
ugcuuucuuuagcuccugaguc

SEQ ID NO: 772543 - RNA, 18 nt, Human
caguuuuuauaucuggca

SEQ ID NO: 772544 - RNA, 22 nt, Human
agcagagcggggccuccggaag

SEQ ID NO: 772545 - RNA, 22 nt, Human
caggagcccagaguccucagcu

SEQ ID NO: 772546 - RNA, 22 nt, Human
uaaguccacuauauccuucucu

SEQ ID NO: 772547 - RNA, 22 nt, Human
aaaaagucauauucuuguuccu

SEQ ID NO: 772548 - RNA, 22 nt, Human
uacaggaggauuaucaaaggau

SEQ ID NO: 772549 - RNA, 22 nt, Human
acuguuuaggaggcuuauaugc

SEQ ID NO: 772550 - RNA, 22 nt, Human
aagagaaggauucugagccugg

SEQ ID NO: 772551 - RNA, 22 nt, Human
agaggaugguugaggaagaccu

SEQ ID NO: 772552 - RNA, 22 nt, Human
gcugucacaucaaggcacuaaa

SEQ ID NO: 772553 - RNA, 22 nt, Human
guggucagcagcagugggagug

SEQ ID NO: 772554 - RNA, 22 nt, Human
augucauuaaaauugugcugca

SEQ ID NO: 772555 - RNA, 22 nt, Human
ucccaggaauugaagccagugu

SEQ ID NO: 772556 - RNA, 22 nt, Human
acaugcaugcuuuggugggugu

SEQ ID NO: 772557 - RNA, 22 nt, Human
ugaucaaauucaggagucugga

SEQ ID NO: 772558 - RNA, 20 nt, Human
auguuguuuacucauagcau

SEQ ID NO: 772559 - RNA, 22 nt, Human
ucaguaauuaccuaugacucga

SEQ ID NO: 772560 - RNA, 22 nt, Human
uucccucccuggcugccauuuc

SEQ ID NO: 772561 - RNA, 22 nt, Human
uaggcagcugcaaacuucgguc

SEQ ID NO: 772562 - RNA, 22 nt, Human
uagacuauagcucacagugcuu

SEQ ID NO: 772563 - RNA, 22 nt, Human
auccugggcaagucaauguccc

SEQ ID NO: 772564 - RNA, 22 nt, Human
uccaauuugaaaugguauaugu

SEQ ID NO: 772565 - RNA, 22 nt, Human
gugaaggaccaauaugacucau

SEQ ID NO: 772566 - RNA, 22 nt, Human
aauggccauaucauugcagagc

SEQ ID NO: 772567 - RNA, 22 nt, Human
ucacagaaggaccuuguuucau

SEQ ID NO: 772568 - RNA, 22 nt, Human
agcugucugucuccugaggaga

SEQ ID NO: 772569 - RNA, 22 nt, Human
cuauuagguuggugcaaaagua

SEQ ID NO: 772570 - RNA, 22 nt, Human
aagggggccacaccugguguga

SEQ ID NO: 772571 - RNA, 22 nt, Human
auuuaaauuuucugauggagag

SEQ ID NO: 772572 - RNA, 22 nt, Human
auacaguaaccacauucuauag

SEQ ID NO: 772573 - RNA, 22 nt, Human
uuacauuagacccacuuucaug

SEQ ID NO: 772574 - RNA, 22 nt, Human
ccagagagauugcuucuaaaga

SEQ ID NO: 772575 - RNA, 22 nt, Human
cugccucuauaggaguccacca

SEQ ID NO: 772576 - RNA, 22 nt, Human
gcuggaguccaguggcaugauc

SEQ ID NO: 772577 - RNA, 22 nt, Human
uggcuuccuaaacugauuucca

SEQ ID NO: 772578 - RNA, 22 nt, Human
cucagcccggugcucgugccac

SEQ ID NO: 772579 - RNA, 22 nt, Human
uuaguguuagggccuguuaccu

SEQ ID NO: 772580 - RNA, 22 nt, Human
ccagugugaaccucaccacccu

SEQ ID NO: 772581 - RNA, 22 nt, Human
aggaucagugaauacucagggu

SEQ ID NO: 772582 - RNA, 22 nt, Human
uggaacacugaucauugccuuu

SEQ ID NO: 772583 - RNA, 22 nt, Human
ucucugggaaugggccugggua

SEQ ID NO: 772584 - RNA, 22 nt, Human
acauacuuaugcuaaaaauaua

SEQ ID NO: 772585 - RNA, 22 nt, Human
ggucauuguucuuuucugugau

SEQ ID NO: 772586 - RNA, 22 nt, Human
uguggagguuuaaguaauggga

SEQ ID NO: 772587 - RNA, 22 nt, Human
acagcccaggacuccagugggc

SEQ ID NO: 772588 - RNA, 22 nt, Human
cucugagagagcuggugagcac

SEQ ID NO: 772589 - RNA, 22 nt, Human
auucauuuagagggauuaagca

SEQ ID NO: 772590 - RNA, 19 nt, Human
aaacuaaggggaaauguuu

SEQ ID NO: 772591 - RNA, 22 nt, Human
cuuguagaccccuggacucacg

SEQ ID NO: 772592 - RNA, 22 nt, Human
cuuuccagauuuguccaguuau

SEQ ID NO: 772593 - RNA, 22 nt, Human
uagcaaggcguggcacucaaau

SEQ ID NO: 772594 - RNA, 22 nt, Human
aacacugaccucuacccucagu

SEQ ID NO: 772595 - RNA, 22 nt, Human
uccacuccuuaugccagacggu

SEQ ID NO: 772596 - RNA, 22 nt, Human
aggcgcugcgcuggggccagaa

SEQ ID NO: 772597 - RNA, 22 nt, Human
uuauucaguuuguguagaggug

SEQ ID NO: 772598 - RNA, 22 nt, Human
agacaucaaugaucagagguag

SEQ ID NO: 772599 - RNA, 22 nt, Human
uguuacugauuugauauacagu

SEQ ID NO: 772600 - RNA, 22 nt, Human
uugcuuuagggcaaauauuuca

SEQ ID NO: 772601 - RNA, 22 nt, Human
gagguuggagggcuggccugca

SEQ ID NO: 772602 - RNA, 22 nt, Human
gugaccagcccauagagaggcg

SEQ ID NO: 772603 - RNA, 22 nt, Human
ugagcuugcuacauagaucaga

SEQ ID NO: 772604 - RNA, 20 nt, Human
gcauggcuaaucuguacuga

SEQ ID NO: 772605 - RNA, 22 nt, Human
ugucuuuacuuaauaaauauac

SEQ ID NO: 772606 - RNA, 19 nt, Human
ggccugaggccacagaucc

SEQ ID NO: 772607 - RNA, 22 nt, Human
gaaggccauugcguccugggau

SEQ ID NO: 772608 - RNA, 22 nt, Human
uaugaagugucuguuguaucug

SEQ ID NO: 772609 - RNA, 22 nt, Human
gaggcuccucauucaguaugcu

SEQ ID NO: 772610 - RNA, 22 nt, Human
ccaggaggcucugacuggaccc

SEQ ID NO: 772611 - RNA, 22 nt, Human
auuugucaauaagaugaacaua

SEQ ID NO: 772612 - RNA, 22 nt, Human
ugggcugcugucugcacaugcu

SEQ ID NO: 772613 - RNA, 22 nt, Human
ucagccaggccaggcauucaca

SEQ ID NO: 772614 - RNA, 22 nt, Human
accugcccuggaggaagauauu

SEQ ID NO: 772615 - RNA, 23 nt, Human
gccucugcucugcguuggggacu

SEQ ID NO: 772616 - RNA, 22 nt, Human
augcuacaggaagacgucaggc

SEQ ID NO: 772617 - RNA, 22 nt, Human
ugugagaauuccugaucacagg

SEQ ID NO: 772618 - RNA, 22 nt, Human
agcaacuagccaggaugcagag

SEQ ID NO: 772619 - RNA, 22 nt, Human
cacuguggugccaaaccuggag

SEQ ID NO: 772620 - RNA, 22 nt, Human
auggauuggauuuuuauggacc

SEQ ID NO: 772621 - RNA, 22 nt, Human
gagcuaaguuucuggaggcaga

SEQ ID NO: 772622 - RNA, 22 nt, Human
uuugccugggaauucuagugua

SEQ ID NO: 772623 - RNA, 22 nt, Human
gucuucaauugcauuugauggg

SEQ ID NO: 772624 - RNA, 22 nt, Human
agggcacaggcuggcaggaucu

SEQ ID NO: 772625 - RNA, 22 nt, Human
gcucucagguacaaagcugugu

SEQ ID NO: 772626 - RNA, 22 nt, Human
gcagagcacccugcagugguau

SEQ ID NO: 772627 - RNA, 22 nt, Human
uaggccaguggcagguugugug

SEQ ID NO: 772628 - RNA, 22 nt, Human
cacugagguaucugucucuccu

SEQ ID NO: 772629 - RNA, 22 nt, Human
acccuggguucccgcagcacca

SEQ ID NO: 772630 - RNA, 22 nt, Human
gggcugacgaaggccaugugug

SEQ ID NO: 772631 - RNA, 22 nt, Human
ugcgcaggagcucugccaggag

SEQ ID NO: 772632 - RNA, 20 nt, Human
auacacauauucuugcaacu

SEQ ID NO: 772633 - RNA, 22 nt, Human
ucucagcugacugcuuuccucg

SEQ ID NO: 772634 - RNA, 22 nt, Human
gguggcucagggcuccaagcau

SEQ ID NO: 772635 - RNA, 22 nt, Human
cauucacagagggggaagcauc

SEQ ID NO: 772636 - RNA, 22 nt, Human
uaucacuacaccuggcuaauua

SEQ ID NO: 772637 - RNA, 22 nt, Human
ccaggggcucucagggugugug

SEQ ID NO: 772638 - RNA, 22 nt, Human
uugagaagaggcuuuguaggaa

SEQ ID NO: 772639 - RNA, 22 nt, Human
auguuucuguccuacgagauaa

SEQ ID NO: 772640 - RNA, 22 nt, Human
guuauugagacauagaguuaug

SEQ ID NO: 772641 - RNA, 22 nt, Human
guucauuuaugauguaacaugu

SEQ ID NO: 772642 - RNA, 22 nt, Human
gcucccuggcuuuuacagugua

SEQ ID NO: 772643 - RNA, 22 nt, Human
uugcuucagagggagacacuuu

SEQ ID NO: 772644 - RNA, 22 nt, Human
uuguuacauggacaacuguaug

SEQ ID NO: 772645 - RNA, 22 nt, Human
ccacauuuuugauacucucacu

SEQ ID NO: 772646 - RNA, 22 nt, Human
ccagaggugccacagaaagagc

SEQ ID NO: 772647 - RNA, 22 nt, Human
ugcauuuguaacauucaagaau

SEQ ID NO: 772648 - RNA, 22 nt, Human
ucuguccaguggcucucaggga

SEQ ID NO: 772649 - RNA, 23 nt, Human
acucagcuuugggagaugacuca

SEQ ID NO: 772650 - RNA, 22 nt, Human
uguuuaugcaucguuaauacca

SEQ ID NO: 772651 - RNA, 22 nt, Human
ugagcagcaggaucuucuggua

SEQ ID NO: 772652 - RNA, 22 nt, Human
agcucagaacugcagacaugug

SEQ ID NO: 772653 - RNA, 22 nt, Human
ucuguucagacacuuuacaugu

SEQ ID NO: 772654 - RNA, 22 nt, Human
uaggucucucuucuugauggga

SEQ ID NO: 772655 - RNA, 22 nt, Human
cacuguaauggaauuuucuuua

SEQ ID NO: 772656 - RNA, 23 nt, Human
agaauuguuguuagggaaaagua

SEQ ID NO: 772657 - RNA, 22 nt, Human
cagccagggucaggcagcuucu

SEQ ID NO: 772658 - RNA, 22 nt, Human
uuuaugacauuacaauaucaag

SEQ ID NO: 772659 - RNA, 22 nt, Human
ugcugcagcuuugucacaugca

SEQ ID NO: 772660 - RNA, 20 nt, Human
uccaggagguuaguguggcu

SEQ ID NO: 772661 - RNA, 22 nt, Human
cuuccuguugucacagucugcg

SEQ ID NO: 772662 - RNA, 22 nt, Human
cuggaggagagucugaaugaca

SEQ ID NO: 772663 - RNA, 22 nt, Human
uccuggagccucauucaaacac

SEQ ID NO: 772664 - RNA, 22 nt, Human
guauacaugugguaaaaugcac

SEQ ID NO: 772665 - RNA, 22 nt, Human
uugaggucuucauucuugggca

SEQ ID NO: 772666 - RNA, 22 nt, Human
ugaugaauuaguaacaaaugag

SEQ ID NO: 772667 - RNA, 22 nt, Human
uugccugugucagcagguggaa

SEQ ID NO: 772668 - RNA, 22 nt, Human
guggccaaaaggaagaagguua

SEQ ID NO: 772669 - RNA, 22 nt, Human
uuccugggagcuagccacaucu

SEQ ID NO: 772670 - RNA, 20 nt, Human
cugaagagacuggaggggca

SEQ ID NO: 772671 - RNA, 22 nt, Human
cugugugcucggauggacucgu

SEQ ID NO: 772672 - RNA, 22 nt, Human
aaauaagaggacagauguuugg

SEQ ID NO: 772673 - RNA, 22 nt, Human
caggccagugggaaauagggau

SEQ ID NO: 772674 - RNA, 22 nt, Human
auuccagauguuacugaaaggc

SEQ ID NO: 772675 - RNA, 22 nt, Human
ggagaaugauauauagcucagu

SEQ ID NO: 772676 - RNA, 22 nt, Human
uuuuguaagaaacugccaagcc

SEQ ID NO: 772677 - RNA, 22 nt, Human
auuccacauaggccuucaugac

SEQ ID NO: 772678 - RNA, 22 nt, Human
ucuacagucaaguuauauugcu

SEQ ID NO: 772679 - RNA, 22 nt, Human
ccuuggguguuuaauagauaua

SEQ ID NO: 772680 - RNA, 22 nt, Human
agcuggugugcucuggaauccu

SEQ ID NO: 772681 - RNA, 22 nt, Human
uguacaguguagucaugagguu

SEQ ID NO: 772682 - RNA, 22 nt, Human
ccucuuccugcacugacauuuu

SEQ ID NO: 772683 - RNA, 22 nt, Human
ucugucacuuauuaagauggau

SEQ ID NO: 772684 - RNA, 22 nt, Human
agagcuguguuuaguaguuacg

SEQ ID NO: 772685 - RNA, 22 nt, Human
aggaaggguucuuucuguuuau

SEQ ID NO: 772686 - RNA, 22 nt, Human
cagaaaccugucuggaguggga

SEQ ID NO: 772687 - RNA, 22 nt, Human
cuccucuuuggggauuuacaca

SEQ ID NO: 772688 - RNA, 22 nt, Human
uaguggggaaggaggacaagaa

SEQ ID NO: 772689 - RNA, 22 nt, Human
cugggagcgcagcaggcacaac

SEQ ID NO: 772690 - RNA, 22 nt, Human
gucaccuugaacaggcuacuca

SEQ ID NO: 772691 - RNA, 22 nt, Human
uugccaucccuuaccucaguca

SEQ ID NO: 772692 - RNA, 22 nt, Human
uauucugcuaagugauuucuac

SEQ ID NO: 772693 - RNA, 22 nt, Human
gcccagcacauugcugaggacc

SEQ ID NO: 772694 - RNA, 19 nt, Human
agccagugagccucugggu

SEQ ID NO: 772695 - RNA, 19 nt, Human
aggcaaccaaugaggcaaa

SEQ ID NO: 772696 - RNA, 18 nt, Human
cugaggcuuagagagguu

SEQ ID NO: 772697 - RNA, 22 nt, Human
gcgacgcucgggcuccgaugcc

SEQ ID NO: 772698 - RNA, 22 nt, Human
gagagguagaggcucugcuuaa

SEQ ID NO: 772699 - RNA, 22 nt, Human
agcaccaggauauuguuggaga

SEQ ID NO: 772700 - RNA, 17 nt, Human
aagagaggcugagcugg

SEQ ID NO: 772701 - RNA, 22 nt, Human
uccaguaugacugauguccuuc

SEQ ID NO: 772702 - RNA, 22 nt, Human
uaaugccaauuuaaugauccau

SEQ ID NO: 772703 - RNA, 22 nt, Human
uccagcccucagccaaguggaa

SEQ ID NO: 772704 - RNA, 22 nt, Human
uccagugguuugaaaggggugu

SEQ ID NO: 772705 - RNA, 22 nt, Human
ucugaagguugagaagggcuga

SEQ ID NO: 772706 - RNA, 22 nt, Human
ucaaccucuggagaaaucagga

SEQ ID NO: 772707 - RNA, 22 nt, Human
ucuaaacacuaagucuugaugc

SEQ ID NO: 772708 - RNA, 22 nt, Human
cuggaagacguuugaagccaug

SEQ ID NO: 772709 - RNA, 22 nt, Human
ccagcuuuucagaaucugccug

SEQ ID NO: 772710 - RNA, 21 nt, Human
ugucuucauaugagauggugu

SEQ ID NO: 772711 - RNA, 22 nt, Human
uauugacaauuugugaaacuau

SEQ ID NO: 772712 - RNA, 22 nt, Human
acuccgacucugagucuacauu

SEQ ID NO: 772713 - RNA, 22 nt, Human
cccuggguucuggcugggcugc

SEQ ID NO: 772714 - RNA, 22 nt, Human
uuccagggaagagcaaggcagu

SEQ ID NO: 772715 - RNA, 22 nt, Human
uuugaaagcaggugugggaggg

SEQ ID NO: 772716 - RNA, 22 nt, Human
gggccuccgugugcuggugcuc

SEQ ID NO: 772717 - RNA, 22 nt, Human
auuguuaauaacuauuacauug

SEQ ID NO: 772718 - RNA, 22 nt, Human
cuguuaaguguagauaaugugg

SEQ ID NO: 772719 - RNA, 22 nt, Human
ggcagugaugucaaacagugaa

SEQ ID NO: 772720 - RNA, 22 nt, Human
aaguacauguugcucaacagcc

SEQ ID NO: 772721 - RNA, 22 nt, Human
gugauuccuauuaguacaugca

SEQ ID NO: 772722 - RNA, 23 nt, Human
ugcauuauccucucugaagacca

SEQ ID NO: 772723 - RNA, 22 nt, Human
ugugcagagaagccacuggggg

SEQ ID NO: 772724 - RNA, 22 nt, Human
uacagcacggugcauuuacuac

SEQ ID NO: 772725 - RNA, 22 nt, Human
uuggaacucaauaauucuucuu

SEQ ID NO: 772726 - RNA, 21 nt, Human
gcauuaaaagcaguuguuggu

SEQ ID NO: 772727 - RNA, 22 nt, Human
gcuggcucuuuuugccgggcuc

SEQ ID NO: 772728 - RNA, 22 nt, Human
aaguggagagcccuggaggucu

SEQ ID NO: 772729 - RNA, 23 nt, Human
uauguguaaggagaaggagugag

SEQ ID NO: 772730 - RNA, 22 nt, Human
cuggggucucaauucuagcggg

SEQ ID NO: 772731 - RNA, 22 nt, Human
gccaguggcuugccaggcagga

SEQ ID NO: 772732 - RNA, 21 nt, Human
aaaggccauaaucacggagca

SEQ ID NO: 772733 - RNA, 22 nt, Human
uuggccagagguuucucucaug

SEQ ID NO: 772734 - RNA, 22 nt, Human
guagaggacauuugacaugaug

SEQ ID NO: 772735 - RNA, 22 nt, Human
cccaggagaugcacuccauugg

SEQ ID NO: 772736 - RNA, 22 nt, Human
ggggggugacaaguagagguug

SEQ ID NO: 772737 - RNA, 22 nt, Human
gugcagugaaaaaagaaugucc

SEQ ID NO: 772738 - RNA, 22 nt, Human
cucucagugccacacagccauu

SEQ ID NO: 772739 - RNA, 22 nt, Human
cuggucaccagguagcauugua

SEQ ID NO: 772740 - RNA, 22 nt, Human
auugcucugcaauccuccccaa

SEQ ID NO: 772741 - RNA, 22 nt, Human
acagucuuuaauuucuuugugg

SEQ ID NO: 772742 - RNA, 22 nt, Human
augcucagggcacacucuggac

SEQ ID NO: 772743 - RNA, 22 nt, Human
gggcacaguacuccaaucaacu

SEQ ID NO: 772744 - RNA, 22 nt, Human
cuccaggagggcuuccugugau

SEQ ID NO: 772745 - RNA, 22 nt, Human
agcagaaaauuggaaaugacaa

SEQ ID NO: 772746 - RNA, 22 nt, Human
uccccuccaacuccaacuaugg

SEQ ID NO: 772747 - RNA, 22 nt, Human
uaagguuuugagaccagaacgu

SEQ ID NO: 772748 - RNA, 22 nt, Human
uuuucuccuuucaagauagcau

SEQ ID NO: 772749 - RNA, 22 nt, Human
ccucugagccugugugcggcac

SEQ ID NO: 772750 - RNA, 22 nt, Human
auggcugugguaucagacgcag

SEQ ID NO: 772751 - RNA, 22 nt, Human
aagauccaugagggcagagauu

SEQ ID NO: 772752 - RNA, 22 nt, Human
gccugggaaagaguagggaaau

SEQ ID NO: 772753 - RNA, 22 nt, Human
ccacaaguuucagcacccagag

SEQ ID NO: 772754 - RNA, 22 nt, Human
ucugucacccgagcaggcgaga

SEQ ID NO: 772755 - RNA, 22 nt, Human
auuugagaugguaaauaacuuu

SEQ ID NO: 772756 - RNA, 22 nt, Human
guuuggcaguguuauguagguu

SEQ ID NO: 772757 - RNA, 22 nt, Human
aaaucccacucagaaacugcca

SEQ ID NO: 772758 - RNA, 22 nt, Human
augaagauaauagcauugguug

SEQ ID NO: 772759 - RNA, 22 nt, Human
uggccagcuuugacuguaaacc

SEQ ID NO: 772760 - RNA, 21 nt, Human
aaaguucaugcuuuaauauuc

SEQ ID NO: 772761 - RNA, 21 nt, Human
uuucugucucugccacuaguu

SEQ ID NO: 772762 - RNA, 22 nt, Human
agccauugaauuuagugccuuu

SEQ ID NO: 772763 - RNA, 22 nt, Human
ugaguacucggagugcuuugga

SEQ ID NO: 772764 - RNA, 22 nt, Human
gcuuccaaugcuucuaucacau

SEQ ID NO: 772765 - RNA, 22 nt, Human
cagagguauuuugauaaacgcc

SEQ ID NO: 772766 - RNA, 22 nt, Human
cugcccacuauguugucauggg

SEQ ID NO: 772767 - RNA, 22 nt, Human
aaagaagagcuggaaggagucu

SEQ ID NO: 772768 - RNA, 22 nt, Human
ggaauucugcauguucaguugg

SEQ ID NO: 772769 - RNA, 22 nt, Human
aaaugcucuccaaaaugaaagu

SEQ ID NO: 772770 - RNA, 22 nt, Human
ucucuguguugcaggaaaaucu

SEQ ID NO: 772771 - RNA, 22 nt, Human
gaggcucagagagguccacaua

SEQ ID NO: 772772 - RNA, 22 nt, Human
ucacuuugacagagaaaugaau

SEQ ID NO: 772773 - RNA, 16 nt, Human
ggagagugucugcaaa

SEQ ID NO: 772774 - RNA, 22 nt, Human
uauuucuuguucccuccaaguu

SEQ ID NO: 772775 - RNA, 22 nt, Human
augcugaagaguucaugauuau

SEQ ID NO: 772776 - RNA, 22 nt, Human
cuggagccggaccagggacggu

SEQ ID NO: 772777 - RNA, 22 nt, Human
uuagcaaauaucuugaaacagg

SEQ ID NO: 772778 - RNA, 22 nt, Human
ugcagaggcgccgugggugggg

SEQ ID NO: 772779 - RNA, 22 nt, Human
agcugcuacugcucugccagag

SEQ ID NO: 772780 - RNA, 22 nt, Human
uggagauggguuaauggagaga

SEQ ID NO: 772781 - RNA, 22 nt, Human
gacuuugugccaaacgccagaa

SEQ ID NO: 772782 - RNA, 22 nt, Human
cagacagaggcuguaugagggc

SEQ ID NO: 772783 - RNA, 22 nt, Human
ucagcacuuuuacucucuuugc

SEQ ID NO: 772784 - RNA, 22 nt, Human
uauuuucuguggaggaccagau

SEQ ID NO: 772785 - RNA, 22 nt, Human
uaugcacauugguuuccucauu

SEQ ID NO: 772786 - RNA, 22 nt, Human
guaacuuuggauuuaggguacc

SEQ ID NO: 772787 - RNA, 22 nt, Human
cacuaagucaacagccucucuu

SEQ ID NO: 772788 - RNA, 22 nt, Human
uuucaguuuuugcucgauguau

SEQ ID NO: 772789 - RNA, 22 nt, Human
caaagguuggaaauguuuacca

SEQ ID NO: 772790 - RNA, 22 nt, Human
acagucuggaagcagggggcaa

SEQ ID NO: 772791 - RNA, 19 nt, Human
cagcacaugcuucucugag

SEQ ID NO: 772792 - RNA, 22 nt, Human
ugcagaaccaguccucagaccc

SEQ ID NO: 772793 - RNA, 22 nt, Human
aaguccuuaggaagcagucguu

SEQ ID NO: 772794 - RNA, 22 nt, Human
gugacauguuauggacuggcua

SEQ ID NO: 772795 - RNA, 22 nt, Human
cugcaguagcagagcugaguag

SEQ ID NO: 772796 - RNA, 22 nt, Human
accaguaugugccuucaguguc

SEQ ID NO: 772797 - RNA, 22 nt, Human
acuugccauaaaugaaaauacu

SEQ ID NO: 772798 - RNA, 19 nt, Human
uguagcaguuuaaaacaac

SEQ ID NO: 772799 - RNA, 22 nt, Human
gcuggagcugaguucccugggc

SEQ ID NO: 772800 - RNA, 23 nt, Human
agccucuuuucuccugcccugca

SEQ ID NO: 772801 - RNA, 22 nt, Human
agaauaaaugcuaccuaucaca

SEQ ID NO: 772802 - RNA, 22 nt, Human
ggacaaaauccaaacuucuuag

SEQ ID NO: 772803 - RNA, 22 nt, Human
aggcaggugggagugauuccuu

SEQ ID NO: 772804 - RNA, 20 nt, Human
cugaaagacguaacagugca

SEQ ID NO: 772805 - RNA, 18 nt, Human
cucagggcaucagucugg

SEQ ID NO: 772806 - RNA, 22 nt, Human
ucagaagcuaaauuugauauuu

SEQ ID NO: 772807 - RNA, 19 nt, Human
aauacaguguuauagaauu

SEQ ID NO: 772808 - RNA, 21 nt, Human
uucuguuuuuuguaccagggc

SEQ ID NO: 772809 - RNA, 22 nt, Human
acaggccuggaaaggaaggagu

SEQ ID NO: 772810 - RNA, 22 nt, Human
gugcuggcccuguccucgagcu

SEQ ID NO: 772811 - RNA, 22 nt, Human
ggccacugccuccgccauggcu

SEQ ID NO: 772812 - RNA, 22 nt, Human
uaauuauacaaaaaggcaugca

SEQ ID NO: 772813 - RNA, 22 nt, Human
uccuugaagcuuguaucuaaua

SEQ ID NO: 772814 - RNA, 20 nt, Human
gugggcagcaggcauacugg

SEQ ID NO: 772815 - RNA, 22 nt, Human
uuuuauacacaugaacaugcag

SEQ ID NO: 772816 - RNA, 22 nt, Human
cccucugccugggaccaagucc

SEQ ID NO: 772817 - RNA, 22 nt, Human
acaauacaggcuucuggacuua

SEQ ID NO: 772818 - RNA, 22 nt, Human
aagaagugguccuuuucuuucu

SEQ ID NO: 772819 - RNA, 22 nt, Human
uaagaaacauuuuuaugacagu

SEQ ID NO: 772820 - RNA, 22 nt, Human
ucaaagaauguuaugaggguag

SEQ ID NO: 772821 - RNA, 20 nt, Human
gcugccuguuucuguaagua

SEQ ID NO: 772822 - RNA, 22 nt, Human
aaugucugccagaacugaucau

SEQ ID NO: 772823 - RNA, 19 nt, Human
ucagcuggcaggccuccuc

SEQ ID NO: 772824 - RNA, 22 nt, Human
agcagcuccccucaugcuccac

SEQ ID NO: 772825 - RNA, 22 nt, Human
ucaugcuuaaaagacacuugag

SEQ ID NO: 772826 - RNA, 22 nt, Human
uguggguccuccugugugcccg

SEQ ID NO: 772827 - RNA, 18 nt, Human
gggugcaggcacugacug

SEQ ID NO: 772828 - RNA, 22 nt, Human
agggguagagauugcuggugua

SEQ ID NO: 772829 - RNA, 22 nt, Human
gaagcaguucgaaagcaguugg

SEQ ID NO: 772830 - RNA, 22 nt, Human
caaaagggaguucucuggaagg

SEQ ID NO: 772831 - RNA, 22 nt, Human
ugcaggugagugcaggggcuca

SEQ ID NO: 772832 - RNA, 22 nt, Human
uagauucugacccucuuuuuac

SEQ ID NO: 772833 - RNA, 22 nt, Human
uuagcauuucauuucaagagga

SEQ ID NO: 772834 - RNA, 22 nt, Human
ucccuggaacagagagacaacg

SEQ ID NO: 772835 - RNA, 22 nt, Human
uugaaauuuuaggccuugcaau

SEQ ID NO: 772836 - RNA, 22 nt, Human
ugaacuguacaucccuaaccua

SEQ ID NO: 772837 - RNA, 22 nt, Human
ugagcuggaggacaggagggua

SEQ ID NO: 772838 - RNA, 22 nt, Human
cauuagaaccuauaaaaagcau

SEQ ID NO: 772839 - RNA, 22 nt, Human
aaaugugcuaaaguauuaacau

SEQ ID NO: 772840 - RNA, 22 nt, Human
ucaggucugaugccucauccau

SEQ ID NO: 772841 - RNA, 22 nt, Human
cagggccucauggccggggugc

SEQ ID NO: 772842 - RNA, 18 nt, Human
ugggauggagaguaacug

SEQ ID NO: 772843 - RNA, 22 nt, Human
aaggguuggggaagagcaaauu

SEQ ID NO: 772844 - RNA, 22 nt, Human
uggaggcaguuuaagucugaga

SEQ ID NO: 772845 - RNA, 22 nt, Human
cagggcuguggcuuugugcugu

SEQ ID NO: 772846 - RNA, 22 nt, Human
aaucagaacgcucgaucuucgg

SEQ ID NO: 772847 - RNA, 22 nt, Human
cggcccugcugagcuugucugg

SEQ ID NO: 772848 - RNA, 22 nt, Human
uagcuucuugagaaagggugcc

SEQ ID NO: 772849 - RNA, 18 nt, Human
gcugggguugagcucucc

SEQ ID NO: 772850 - RNA, 22 nt, Human
ugggacagugaccccagagguc

SEQ ID NO: 772851 - RNA, 22 nt, Human
auaaaaucuuuaugugcucugc

SEQ ID NO: 772852 - RNA, 21 nt, Human
ucuccaguauccuucucugag

SEQ ID NO: 772853 - RNA, 22 nt, Human
aacugcauucagaaagcucacu

SEQ ID NO: 772854 - RNA, 22 nt, Human
caagaggagcaggcaggugugc

SEQ ID NO: 772855 - RNA, 22 nt, Human
cauaggaagccaucucagucac

SEQ ID NO: 772856 - RNA, 22 nt, Human
augaggauguuaguggacugga

SEQ ID NO: 772857 - RNA, 22 nt, Human
agugugagauuaaaccgaauca

SEQ ID NO: 772858 - RNA, 22 nt, Human
aaggguggauuucugagcucua

SEQ ID NO: 772859 - RNA, 22 nt, Human
accagcagaguugaggaggaca

SEQ ID NO: 772860 - RNA, 19 nt, Human
gcaggcacagcccugggug

SEQ ID NO: 772861 - RNA, 22 nt, Human
gguuguaguuggagguuguaua

SEQ ID NO: 772862 - RNA, 22 nt, Human
agggggcccuugcaggugagcg

SEQ ID NO: 772863 - RNA, 22 nt, Human
uaagauaugguaggaaguuugg

SEQ ID NO: 772864 - RNA, 22 nt, Human
gcuccagggaguacauuuauca

SEQ ID NO: 772865 - RNA, 22 nt, Human
gcccaggaagccaccgggaagu

SEQ ID NO: 772866 - RNA, 22 nt, Human
guggccaggucagggacuugug

SEQ ID NO: 772867 - RNA, 22 nt, Human
ucucaaauuuauacagaguuca

SEQ ID NO: 772868 - RNA, 22 nt, Human
aaaauugugaagguuucugaaa

SEQ ID NO: 772869 - RNA, 22 nt, Human
cacauucaucaguguuguacug

SEQ ID NO: 772870 - RNA, 21 nt, Human
agcugcuuucagcuccuagag

SEQ ID NO: 772871 - RNA, 23 nt, Human
uucuuucaagaaguucacagugc

SEQ ID NO: 772872 - RNA, 22 nt, Human
cacaggccaauacccucucucu

SEQ ID NO: 772873 - RNA, 22 nt, Human
uuggccagcgacgaccuucuua

SEQ ID NO: 772874 - RNA, 22 nt, Human
gacauuuaugaaggagauaugc

SEQ ID NO: 772875 - RNA, 20 nt, Human
gcaagcaugaagaguagaga

SEQ ID NO: 772876 - RNA, 20 nt, Human
aaggcagaguggguuggagc

SEQ ID NO: 772877 - RNA, 22 nt, Human
ugugugcucuaaugccuaguac

SEQ ID NO: 772878 - RNA, 22 nt, Human
gcaccugcuggggcugaugaga

SEQ ID NO: 772879 - RNA, 22 nt, Human
uaaaaagcagcugagauuuucu

SEQ ID NO: 772880 - RNA, 22 nt, Human
caacacugacaauggacugauu

SEQ ID NO: 772881 - RNA, 20 nt, Human
acaucaacuagucacagaca

SEQ ID NO: 772882 - RNA, 22 nt, Human
ccuuucucuaucgacccaucgc

SEQ ID NO: 772883 - RNA, 22 nt, Human
augucuucucuguagguaaauu

SEQ ID NO: 772884 - RNA, 21 nt, Human
ucuucccucaggauguccugc

SEQ ID NO: 772885 - RNA, 22 nt, Human
aaguccuuguauacagaaucaa

SEQ ID NO: 772886 - RNA, 22 nt, Human
aaugacaaauauggaagccuga

SEQ ID NO: 772887 - RNA, 17 nt, Human
ccauacugacauauuga

SEQ ID NO: 772888 - RNA, 22 nt, Human
cggcugaggaucuccaggccug

SEQ ID NO: 772889 - RNA, 22 nt, Human
uggaagggaacagguggguguu

SEQ ID NO: 772890 - RNA, 22 nt, Human
aagcacuaggucacacaaguua

SEQ ID NO: 772891 - RNA, 22 nt, Human
aagcacagcagagccuugcuug

SEQ ID NO: 772892 - RNA, 20 nt, Human
ggagggcagcugagaguugg

SEQ ID NO: 772893 - RNA, 22 nt, Human
agccucucauguucucccccag

SEQ ID NO: 772894 - RNA, 20 nt, Human
cagggccacgcuccaaggca

SEQ ID NO: 772895 - RNA, 22 nt, Human
ugcaggaagcaaccagguccaa

SEQ ID NO: 772896 - RNA, 22 nt, Human
aagccauucaucuaauguccug

SEQ ID NO: 772897 - RNA, 22 nt, Human
cggcuucaucuuuacuucaaga

SEQ ID NO: 772898 - RNA, 19 nt, Human
auaacuacauuggcucagu

SEQ ID NO: 772899 - RNA, 22 nt, Human
ccuuacaaugcaguuuacuuag

SEQ ID NO: 772900 - RNA, 22 nt, Human
cuguguccugucuccuaaggug

SEQ ID NO: 772901 - RNA, 18 nt, Human
gcccguguggagaccaug

SEQ ID NO: 772902 - RNA, 22 nt, Human
cuccagggaugagacagaguag

SEQ ID NO: 772903 - RNA, 22 nt, Human
agcaugcugguguucauggcag

SEQ ID NO: 772904 - RNA, 22 nt, Human
auuuacagaugaugcuauuuga

SEQ ID NO: 772905 - RNA, 22 nt, Human
aggccucacauugggcuucaag

SEQ ID NO: 772906 - RNA, 22 nt, Human
aggcggcugguguccugcaggu

SEQ ID NO: 772907 - RNA, 22 nt, Human
uaaauuacucaaugcacauaaa

SEQ ID NO: 772908 - RNA, 22 nt, Human
gaaaguauuagccuagaaguca

SEQ ID NO: 772909 - RNA, 22 nt, Human
ugguuucccauuaucugcagga

SEQ ID NO: 772910 - RNA, 22 nt, Human
cagcucuuccuacccuaguugg

SEQ ID NO: 772911 - RNA, 22 nt, Human
gaucuucuauguaaugaagugu

SEQ ID NO: 772912 - RNA, 22 nt, Human
uucuggaagaauaaugggcaaa

SEQ ID NO: 772913 - RNA, 22 nt, Human
ucuuuaagaguaauuauuuugg

SEQ ID NO: 772914 - RNA, 22 nt, Human
agccagggaagaggccuaccuc

SEQ ID NO: 772915 - RNA, 22 nt, Human
acauccaucuucugccugugaa

SEQ ID NO: 772916 - RNA, 22 nt, Human
uuuaagaucuaucccauuuugu

SEQ ID NO: 772917 - RNA, 22 nt, Human
gcaggaguggagaccaugggga

SEQ ID NO: 772918 - RNA, 22 nt, Human
aguggcuguacuauuuuuucau

SEQ ID NO: 772919 - RNA, 22 nt, Human
uuggcuuucucuguaucugaau

SEQ ID NO: 772920 - RNA, 22 nt, Human
aaugaacccuucaagcucugau

SEQ ID NO: 772921 - RNA, 22 nt, Human
uuacagauguaggaacugaagu

SEQ ID NO: 772922 - RNA, 22 nt, Human
cccugacccaaaacugucagaa

SEQ ID NO: 772923 - RNA, 23 nt, Human
gcccauggagucuggaucuggcc

SEQ ID NO: 772924 - RNA, 22 nt, Human
uuaaucuucagggacucuugcu

SEQ ID NO: 772925 - RNA, 22 nt, Human
uggagaauucuauguugagggg

SEQ ID NO: 772926 - RNA, 22 nt, Human
gcugucccaugguugcaagaug

SEQ ID NO: 772927 - RNA, 22 nt, Human
cagggcuucgcuccuggugcac

SEQ ID NO: 772928 - RNA, 22 nt, Human
ucccagcucacauaugguaacu

SEQ ID NO: 772929 - RNA, 22 nt, Human
cuacccaggcuggagugcagua

SEQ ID NO: 772930 - RNA, 22 nt, Human
ucaggaguuuggccuacagagg

SEQ ID NO: 772931 - RNA, 22 nt, Human
cuccucuuuacccgcauggucu

SEQ ID NO: 772932 - RNA, 22 nt, Human
gaggaaaauauucagggagguu

SEQ ID NO: 772933 - RNA, 22 nt, Human
uuucacaaguaaaguccuaagu

SEQ ID NO: 772934 - RNA, 22 nt, Human
ucccagccacagguguagcccu

SEQ ID NO: 772935 - RNA, 22 nt, Human
aaggcugagggcuguaccuggc

SEQ ID NO: 772936 - RNA, 22 nt, Human
uucuuucuuagcaaucuauggu

SEQ ID NO: 772937 - RNA, 22 nt, Human
uugacaauguccuuugaauuuc

SEQ ID NO: 772938 - RNA, 19 nt, Human
cacagggagaccacauguc

SEQ ID NO: 772939 - RNA, 22 nt, Human
gaggccuguagucauggaugua

SEQ ID NO: 772940 - RNA, 22 nt, Human
agcaaauacuuuucacugagcc

SEQ ID NO: 772941 - RNA, 22 nt, Human
ggaaggaaauuggggcaguugu

SEQ ID NO: 772942 - RNA, 22 nt, Human
caggcagaggaagucugggucu

SEQ ID NO: 772943 - RNA, 22 nt, Human
uggagccaugccuggccuuucc

SEQ ID NO: 772944 - RNA, 22 nt, Human
agcugcagagguuugugcaaca

SEQ ID NO: 772945 - RNA, 22 nt, Human
uuccagcuaacucacaucccuu

SEQ ID NO: 772946 - RNA, 18 nt, Human
ggaaggugcuggagugca

SEQ ID NO: 772947 - RNA, 22 nt, Human
cauaauuuuccaugguuugcua

SEQ ID NO: 772948 - RNA, 22 nt, Human
ucccagggacccagccugauac

SEQ ID NO: 772949 - RNA, 22 nt, Human
acauucauugccaggguggaag

SEQ ID NO: 772950 - RNA, 22 nt, Human
agggacuggcucucugagcagg

SEQ ID NO: 772951 - RNA, 22 nt, Human
agucuccacaacagcccugaua

SEQ ID NO: 772952 - RNA, 22 nt, Human
ugcugccuuagaaauggcuaua

SEQ ID NO: 772953 - RNA, 22 nt, Human
ucuagaaugacaugcaagagua

SEQ ID NO: 772954 - RNA, 23 nt, Human
agcuggguggccugcgugaagcu

SEQ ID NO: 772955 - RNA, 22 nt, Human
ccuggagcaucaggaggaaggg

SEQ ID NO: 772956 - RNA, 18 nt, Human
ucccucccugcuguggcc

SEQ ID NO: 772957 - RNA, 22 nt, Human
ccugggagguggagguugcagc

SEQ ID NO: 772958 - RNA, 22 nt, Human
auacaucuagagucauaaaaac

SEQ ID NO: 772959 - RNA, 22 nt, Human
gagauuuaauuggauuaacuua

SEQ ID NO: 772960 - RNA, 22 nt, Human
uaugacauugcuuuuuagaacu

SEQ ID NO: 772961 - RNA, 22 nt, Human
aagggcucugugugccucccca

SEQ ID NO: 772962 - RNA, 22 nt, Human
uggccaggcauucagauaagac

SEQ ID NO: 772963 - RNA, 22 nt, Human
acagaggucauggagaguucuc

SEQ ID NO: 772964 - RNA, 22 nt, Human
cacccuggccucgcucucugca

SEQ ID NO: 772965 - RNA, 22 nt, Human
ugcagugugaccuguagcgagc

SEQ ID NO: 772966 - RNA, 22 nt, Human
aaaauccuuagccgagugaggu

SEQ ID NO: 772967 - RNA, 22 nt, Human
aauacuauguugugacacauga

SEQ ID NO: 772968 - RNA, 22 nt, Human
guugggaaggcaagaaguagaa

SEQ ID NO: 772969 - RNA, 22 nt, Human
aucacaggugguaggaaaagaa

SEQ ID NO: 772970 - RNA, 22 nt, Human
gcuccagggacccaagagaaaa

SEQ ID NO: 772971 - RNA, 22 nt, Human
aggaagggagcaguuuguuguu

SEQ ID NO: 772972 - RNA, 22 nt, Human
uuccaggaagcucucggccucu

SEQ ID NO: 772973 - RNA, 22 nt, Human
aaaguuugagugauuugacaca

SEQ ID NO: 772974 - RNA, 22 nt, Human
uggcagccaucagagcaggggu

SEQ ID NO: 772975 - RNA, 22 nt, Human
aggagcuaauucauaagccacu

SEQ ID NO: 772976 - RNA, 22 nt, Human
aaaggaagauugagcuuuucca

SEQ ID NO: 772977 - RNA, 22 nt, Human
ugugugcacaugauuugaaaug

SEQ ID NO: 772978 - RNA, 22 nt, Human
uccugagcucccaugaacaggc

SEQ ID NO: 772979 - RNA, 22 nt, Human
aaggcuggggugcagacggccu

SEQ ID NO: 772980 - RNA, 22 nt, Human
cuuucccuuagccccauucuau

SEQ ID NO: 772981 - RNA, 18 nt, Human
ccacccagggggagagga

SEQ ID NO: 772982 - RNA, 22 nt, Human
cuggaucuaaagguggauguag

SEQ ID NO: 772983 - RNA, 22 nt, Human
uauugauuccugcuuucugcuc

SEQ ID NO: 772984 - RNA, 22 nt, Human
cucugagagcggucuguggcuu

SEQ ID NO: 772985 - RNA, 19 nt, Human
ugcaagugucuuggacaag

SEQ ID NO: 772986 - RNA, 22 nt, Human
uuucuccugcuagaacaaggag

SEQ ID NO: 772987 - RNA, 22 nt, Human
aggagggucauguugaagugua

SEQ ID NO: 772988 - RNA, 22 nt, Human
auuuggaacuuauaauaaguuu

SEQ ID NO: 772989 - RNA, 22 nt, Human
accuggcaugaagcaugccuua

SEQ ID NO: 772990 - RNA, 22 nt, Human
agcagcaguacauauaagacua

SEQ ID NO: 772991 - RNA, 22 nt, Human
ccccaggagcuuguuuuagaga

SEQ ID NO: 772992 - RNA, 22 nt, Human
uagaugauagggccagaauuug

SEQ ID NO: 772993 - RNA, 22 nt, Human
auggccaagcuuacucuguugu

SEQ ID NO: 772994 - RNA, 22 nt, Human
ugaguauauacccagaagugga

SEQ ID NO: 772995 - RNA, 22 nt, Human
gccuggaagugugucgugggaa

SEQ ID NO: 772996 - RNA, 22 nt, Human
gagaugaauguaaacaaaggca

SEQ ID NO: 772997 - RNA, 17 nt, Human
uccaggcagcaacugag

SEQ ID NO: 772998 - RNA, 22 nt, Human
ugacugagagagaacucagcuu

SEQ ID NO: 772999 - RNA, 22 nt, Human
ugaacgcagguccacauggcuc

SEQ ID NO: 773000 - RNA, 22 nt, Human
cuuucucuggaggggagugguu

SEQ ID NO: 773001 - RNA, 22 nt, Human
guuauauaauuccugugguagu

SEQ ID NO: 773002 - RNA, 19 nt, Human
cuuggcaucugugaaguga

SEQ ID NO: 773003 - RNA, 22 nt, Human
uaaggaaaauggacaucaaaca

SEQ ID NO: 773004 - RNA, 22 nt, Human
uuucugcuucucagacccugaa

SEQ ID NO: 773005 - RNA, 22 nt, Human
uuuuauugguaaugauaaaagu

SEQ ID NO: 773006 - RNA, 22 nt, Human
uuacaauuacuugaucucagcu

SEQ ID NO: 773007 - RNA, 22 nt, Human
agugcuccugccagcuuucugg

SEQ ID NO: 773008 - RNA, 22 nt, Human
uguaagaagggccagagcucca

SEQ ID NO: 773009 - RNA, 22 nt, Human
uccugauuagguuuccauagcu

SEQ ID NO: 773010 - RNA, 23 nt, Human
aaagacugaggaaagucucuguc

SEQ ID NO: 773011 - RNA, 22 nt, Human
aaaguguugaagaaaauguuca

SEQ ID NO: 773012 - RNA, 22 nt, Human
auguccugguccuccaccaugg

SEQ ID NO: 773013 - RNA, 22 nt, Human
ugaggggguuaauuaggagagu

SEQ ID NO: 773014 - RNA, 22 nt, Human
uggggccagagcugcagggagc

SEQ ID NO: 773015 - RNA, 22 nt, Human
augcuuuuaacuccuuuauccc

SEQ ID NO: 773016 - RNA, 22 nt, Human
cagagacaaccugguagagaaa

SEQ ID NO: 773017 - RNA, 22 nt, Human
aacagcuuuuuuggucagcauu

SEQ ID NO: 773018 - RNA, 22 nt, Human
ggugucugauuccaaggccaca

SEQ ID NO: 773019 - RNA, 22 nt, Human
ugaggugguuuguaucacuggg

SEQ ID NO: 773020 - RNA, 22 nt, Human
aacaauaggagugaugcaguau

SEQ ID NO: 773021 - RNA, 22 nt, Human
accaaggaguuugguauuuuag

SEQ ID NO: 773022 - RNA, 22 nt, Human
acuguuaaaguaauuaauuguc

SEQ ID NO: 773023 - RNA, 22 nt, Human
uuauucagugccuuugaaagaa

SEQ ID NO: 773024 - RNA, 22 nt, Human
ugggccacgucaucucccacaa

SEQ ID NO: 773025 - RNA, 22 nt, Human
gcuucagaaguugggcucugac

SEQ ID NO: 773026 - RNA, 22 nt, Human
uguaaccugacugcuuugcucu

SEQ ID NO: 773027 - RNA, 22 nt, Human
aacagcagcaugacagcugggu

SEQ ID NO: 773028 - RNA, 20 nt, Human
uuuccuuucauuuuaguacc

SEQ ID NO: 773029 - RNA, 22 nt, Human
aguaaacauguaauuguucauu

SEQ ID NO: 773030 - RNA, 22 nt, Human
uuccagcaggcagacaggagau

SEQ ID NO: 773031 - RNA, 22 nt, Human
guguguggacgucugagcccag

SEQ ID NO: 773032 - RNA, 22 nt, Human
acagcugauaguuaccucuguc

SEQ ID NO: 773033 - RNA, 22 nt, Human
uguuauucucugccuacaaguc

SEQ ID NO: 773034 - RNA, 20 nt, Human
ucucuggcaagaagcugcag

SEQ ID NO: 773035 - RNA, 22 nt, Human
gauuuucuugggaaacaaugag

SEQ ID NO: 773036 - RNA, 22 nt, Human
cagcaggcuggacuucaguccc

SEQ ID NO: 773037 - RNA, 22 nt, Human
gaugugggugucuucagcuggu

SEQ ID NO: 773038 - RNA, 22 nt, Human
ugaggccugggcacauaaccuc

SEQ ID NO: 773039 - RNA, 22 nt, Human
uuguuacacauaauaacauuuu

SEQ ID NO: 773040 - RNA, 20 nt, Human
accugggguugccugugcuc

SEQ ID NO: 773041 - RNA, 22 nt, Human
gcagaggugugggaggggccac

SEQ ID NO: 773042 - RNA, 22 nt, Human
gcgugggguagguagacaugga

SEQ ID NO: 773043 - RNA, 22 nt, Human
uauauugacuuuaaagaagcaa

SEQ ID NO: 773044 - RNA, 22 nt, Human
caauaacugcuaaauucccugu

SEQ ID NO: 773045 - RNA, 22 nt, Human
agcugcagcacuccaguagccg

SEQ ID NO: 773046 - RNA, 22 nt, Human
accuuuggaggacuagggucau

SEQ ID NO: 773047 - RNA, 22 nt, Human
agucacugguucuguaauuaau

SEQ ID NO: 773048 - RNA, 22 nt, Human
gcuguguuggugaagcuguagc

SEQ ID NO: 773049 - RNA, 22 nt, Human
caugggcucuucuggacugcac

SEQ ID NO: 773050 - RNA, 22 nt, Human
ggaagugaggaaauauuuuguu

SEQ ID NO: 773051 - RNA, 23 nt, Human
aaagccaagucagucuacuggaa

SEQ ID NO: 773052 - RNA, 22 nt, Human
uucucagauauuuguauggaac

SEQ ID NO: 773053 - RNA, 22 nt, Human
ccuggaaggacaauagauagug

SEQ ID NO: 773054 - RNA, 22 nt, Human
acugagaaauuuccagacuugc

SEQ ID NO: 773055 - RNA, 22 nt, Human
uuugcauuaucucacuuauaua

SEQ ID NO: 773056 - RNA, 22 nt, Human
caggccucagagaguggcgggg

SEQ ID NO: 773057 - RNA, 22 nt, Human
ugguggcuaccagguccugggg

SEQ ID NO: 773058 - RNA, 22 nt, Human
uugcaaauucauggaucugaau

SEQ ID NO: 773059 - RNA, 22 nt, Human
gcacauacccacugucaagcac

SEQ ID NO: 773060 - RNA, 22 nt, Human
uguucaauccccagguccugaa

SEQ ID NO: 773061 - RNA, 20 nt, Human
ugccugcccagguccugcac

SEQ ID NO: 773062 - RNA, 22 nt, Human
auuugcauuuagaaagaucacu

SEQ ID NO: 773063 - RNA, 22 nt, Human
gugcccugaugcaauugucuca

SEQ ID NO: 773064 - RNA, 22 nt, Human
cugcuucacccaacuuugggau

SEQ ID NO: 773065 - RNA, 22 nt, Human
gcacacacaugugaguacaugc

SEQ ID NO: 773066 - RNA, 22 nt, Human
agaaagcacagcggguccauuu

SEQ ID NO: 773067 - RNA, 22 nt, Human
cuguccuggugcuggggauccc

SEQ ID NO: 773068 - RNA, 22 nt, Human
agguucaggcugcacaccugag

SEQ ID NO: 773069 - RNA, 22 nt, Human
gggagcugaacugcugaaguug

SEQ ID NO: 773070 - RNA, 22 nt, Human
gaugaaaaucuugagaugucga

SEQ ID NO: 773071 - RNA, 22 nt, Human
gacagguggggaaacuaaggua

SEQ ID NO: 773072 - RNA, 22 nt, Human
agcaaggcucuuaaugcccaaa

SEQ ID NO: 773073 - RNA, 22 nt, Human
uccuggcuccugaucugucacu

SEQ ID NO: 773074 - RNA, 23 nt, Human
ucaguuuguauaauccauaugca

SEQ ID NO: 773075 - RNA, 22 nt, Human
aacaguaaaaaucauuuaguug

SEQ ID NO: 773076 - RNA, 22 nt, Human
cuugcuuuguccagaaauucag

SEQ ID NO: 773077 - RNA, 22 nt, Human
uccugggcagcgggacgcucag

SEQ ID NO: 773078 - RNA, 22 nt, Human
cuuacacagucuggcacuucuu

SEQ ID NO: 773079 - RNA, 22 nt, Human
ccacuacuuuguuuuuggugcu

SEQ ID NO: 773080 - RNA, 22 nt, Human
gcucucuggaggccauggacag

SEQ ID NO: 773081 - RNA, 22 nt, Human
ucggagagcucacagcuguggc

SEQ ID NO: 773082 - RNA, 22 nt, Human
acugaguguaggacuuugaguu

SEQ ID NO: 773083 - RNA, 23 nt, Human
uaagaacagacaagcauuuacau

SEQ ID NO: 773084 - RNA, 22 nt, Human
aggcuccugagaggcagaggcu

SEQ ID NO: 773085 - RNA, 22 nt, Human
ucauccaguaccauggaaggca

SEQ ID NO: 773086 - RNA, 22 nt, Human
gcuggaagggaggcccagccgg

SEQ ID NO: 773087 - RNA, 22 nt, Human
cuccagugggggugagccuaga

SEQ ID NO: 773088 - RNA, 22 nt, Human
ccugcaguuuguugugaccccg

SEQ ID NO: 773089 - RNA, 22 nt, Human
caugccagggcuugcugccugg

SEQ ID NO: 773090 - RNA, 22 nt, Human
caaagggcauuuuagugaacug

SEQ ID NO: 773091 - RNA, 22 nt, Human
ggcaaagcccugccugguucaa

SEQ ID NO: 773092 - RNA, 22 nt, Human
uuucaaacauagaucugaauau

SEQ ID NO: 773093 - RNA, 19 nt, Human
agcuguggaugugggauuu

SEQ ID NO: 773094 - RNA, 22 nt, Human
cuucaggaaaaucucuaaggau

SEQ ID NO: 773095 - RNA, 20 nt, Human
uccagcugucuuucagagac

SEQ ID NO: 773096 - RNA, 22 nt, Human
ucaugcuuuguuaauguggcac

SEQ ID NO: 773097 - RNA, 22 nt, Human
aggaccugccaggugcaaagca

SEQ ID NO: 773098 - RNA, 22 nt, Human
uggcagaguggaccauacucaa

SEQ ID NO: 773099 - RNA, 18 nt, Human
uggcucagauggcuuuaa

SEQ ID NO: 773100 - RNA, 22 nt, Human
ucaaucauaaugaagugaagaa

SEQ ID NO: 773101 - RNA, 22 nt, Human
uaacaguguggacuugagaucu

SEQ ID NO: 773102 - RNA, 22 nt, Human
uggaaugacaaguuguucagag

SEQ ID NO: 773103 - RNA, 19 nt, Human
ugccugucaguagaucuca

SEQ ID NO: 773104 - RNA, 22 nt, Human
ggccagcucaggguccuugggc

SEQ ID NO: 773105 - RNA, 22 nt, Human
agacaaggcuggaguuuaggca

SEQ ID NO: 773106 - RNA, 22 nt, Human
uugccuugauucuucucaugug

SEQ ID NO: 773107 - RNA, 22 nt, Human
agaggcucugccgccucaggua

SEQ ID NO: 773108 - RNA, 22 nt, Human
uugaggucucuacagaagagug

SEQ ID NO: 773109 - RNA, 22 nt, Human
aauuucaauuacuuuugcacca

SEQ ID NO: 773110 - RNA, 22 nt, Human
ggcugcagaggcgaucugaggu

SEQ ID NO: 773111 - RNA, 22 nt, Human
ugcaguguuccuguggguuuau

SEQ ID NO: 773112 - RNA, 19 nt, Human
uguggucucuguucucagg

SEQ ID NO: 773113 - RNA, 22 nt, Human
cagagggcucuuggcugccugc

SEQ ID NO: 773114 - RNA, 22 nt, Human
uguacaaucugaugauguaugg

SEQ ID NO: 773115 - RNA, 22 nt, Human
ucaggaaauacaagugacauca

SEQ ID NO: 773116 - RNA, 22 nt, Human
augcauauuuucuacuauaucg

SEQ ID NO: 773117 - RNA, 22 nt, Human
uuggccaagggcucuuuaggcu

SEQ ID NO: 773118 - RNA, 22 nt, Human
acugaauagugcugcauuguac

SEQ ID NO: 773119 - RNA, 20 nt, Human
auguccugcuucuccucacc

SEQ ID NO: 773120 - RNA, 22 nt, Human
ccagggcaauaggaacacuuuu

SEQ ID NO: 773121 - RNA, 22 nt, Human
gacacuugugcuguuucugagc

SEQ ID NO: 773122 - RNA, 22 nt, Human
uguacaaagguacuuugauguu

SEQ ID NO: 773123 - RNA, 22 nt, Human
ucucaguguggugcuuaggaua

SEQ ID NO: 773124 - RNA, 22 nt, Human
auacuugagguuguauaaauau

SEQ ID NO: 773125 - RNA, 22 nt, Human
gcaggagaacaaagcaagcugc

SEQ ID NO: 773126 - RNA, 22 nt, Human
ggaggcaggaaagacagguuca

SEQ ID NO: 773127 - RNA, 22 nt, Human
aaugaaaauuggacccuagaac

SEQ ID NO: 773128 - RNA, 22 nt, Human
aguaaaaauugaggugcaaaau

SEQ ID NO: 773129 - RNA, 22 nt, Human
gauuucccagcaaaagcugguu

SEQ ID NO: 773130 - RNA, 22 nt, Human
cauuuagaaacuguuuuuaaca

SEQ ID NO: 773131 - RNA, 22 nt, Human
auucuagcccuggaacggcgac

SEQ ID NO: 773132 - RNA, 22 nt, Human
ugcccagcagggagcuaccugg

SEQ ID NO: 773133 - RNA, 21 nt, Human
cacuauuuauauaugccagcu

SEQ ID NO: 773134 - RNA, 22 nt, Human
gacagcaaugacggggcagcug

SEQ ID NO: 773135 - RNA, 22 nt, Human
ucaggcuguuagccaccuccuc

SEQ ID NO: 773136 - RNA, 22 nt, Human
acauaacaugucaaucacccga

SEQ ID NO: 773137 - RNA, 22 nt, Human
uuucuguagggauuucacaguu

SEQ ID NO: 773138 - RNA, 18 nt, Human
aaacccacucagcgcuga

SEQ ID NO: 773139 - RNA, 22 nt, Human
cacugaaaucgaaaaauguagg

SEQ ID NO: 773140 - RNA, 22 nt, Human
uuaacaguaaagaauugugcaa

SEQ ID NO: 773141 - RNA, 22 nt, Human
acacuuuuguuugaagucucca

SEQ ID NO: 773142 - RNA, 22 nt, Human
acuguccuuuuaaugcagccgu

SEQ ID NO: 773143 - RNA, 22 nt, Human
acugggauuacaggugggaguc

SEQ ID NO: 773144 - RNA, 22 nt, Human
cacccaguugacuacaaagggg

SEQ ID NO: 773145 - RNA, 22 nt, Human
aaaauggucucagcuggcacca

SEQ ID NO: 773146 - RNA, 22 nt, Human
auugcuguggaaauauaagaug

SEQ ID NO: 773147 - RNA, 19 nt, Human
acaguccagcuguuuguac

SEQ ID NO: 773148 - RNA, 22 nt, Human
uucuguacucuuugagaagaau

SEQ ID NO: 773149 - RNA, 22 nt, Human
agaggcacccgcgcgcggccau

SEQ ID NO: 773150 - RNA, 22 nt, Human
ggggcccagcaccccuccucgc

SEQ ID NO: 773151 - RNA, 22 nt, Human
uccuggcuuuucuuggcucauc

SEQ ID NO: 773152 - RNA, 22 nt, Human
uguggcugacuccuggucccca

SEQ ID NO: 773153 - RNA, 19 nt, Human
acauucccaucagcaaugu

SEQ ID NO: 773154 - RNA, 17 nt, Human
gagagcccucagauguc

SEQ ID NO: 773155 - RNA, 22 nt, Human
caguguggcugagacagaggcu

SEQ ID NO: 773156 - RNA, 22 nt, Human
agauggauuucuuccagugaga

SEQ ID NO: 773157 - RNA, 22 nt, Human
uucaauguuucuuaucaaguug

SEQ ID NO: 773158 - RNA, 22 nt, Human
gugggguguccagcagcgagcu

SEQ ID NO: 773159 - RNA, 22 nt, Human
auagagauggguuuaguuauaa

SEQ ID NO: 773160 - RNA, 22 nt, Human
gcagcaucagguucacugcgug

SEQ ID NO: 773161 - RNA, 22 nt, Human
gacccagccugguuuuuauagg

SEQ ID NO: 773162 - RNA, 22 nt, Human
gacauaaaguucuugcuugaau

SEQ ID NO: 773163 - RNA, 22 nt, Human
ugcacaggugguccaucugcac

SEQ ID NO: 773164 - RNA, 22 nt, Human
aagcuugggaaccacgguaauc

SEQ ID NO: 773165 - RNA, 22 nt, Human
aaguugauuuaaacuacuaguc

SEQ ID NO: 773166 - RNA, 22 nt, Human
gacuuugaacaguguaucagua

SEQ ID NO: 773167 - RNA, 22 nt, Human
acugaaggucucagcaaggaug

SEQ ID NO: 773168 - RNA, 22 nt, Human
aacagcagcugaggagcugggc

SEQ ID NO: 773169 - RNA, 22 nt, Human
agguggcuaugaggaugcaguc

SEQ ID NO: 773170 - RNA, 22 nt, Human
uaaaguuuggcagacaauaaca

SEQ ID NO: 773171 - RNA, 23 nt, Human
gggggccguccuggggauuauag

SEQ ID NO: 773172 - RNA, 22 nt, Human
aagggaaacuuucacaaugucc

SEQ ID NO: 773173 - RNA, 22 nt, Human
uggagaggaaagugcaguuuug

SEQ ID NO: 773174 - RNA, 22 nt, Human
aaauuuaaaaagcagcauugca

SEQ ID NO: 773175 - RNA, 22 nt, Human
gcccucaggacaagguuacgcu

SEQ ID NO: 773176 - RNA, 22 nt, Human
aagagcugcccaaggugaacag

SEQ ID NO: 773177 - RNA, 22 nt, Human
agcauggggcaaugcaugugcu

SEQ ID NO: 773178 - RNA, 23 nt, Human
aggucaaccacaagcugacaaac

SEQ ID NO: 773179 - RNA, 22 nt, Human
aggagugaguguccucagcaga

SEQ ID NO: 773180 - RNA, 22 nt, Human
gagcugucuggggacucugggu

SEQ ID NO: 773181 - RNA, 22 nt, Human
ucuucuccagugcuucugcaca

SEQ ID NO: 773182 - RNA, 22 nt, Human
gggucccaggucuggaaaagca

SEQ ID NO: 773183 - RNA, 22 nt, Human
ucacagcaacccugaggcgagu

SEQ ID NO: 773184 - RNA, 22 nt, Human
guacaaauguacacuuguauaa

SEQ ID NO: 773185 - RNA, 22 nt, Human
aggguagguguaagauagcccu

SEQ ID NO: 773186 - RNA, 22 nt, Human
aggcagcaaugaaugaaaugga

SEQ ID NO: 773187 - RNA, 17 nt, Human
uuucuggaaugggcaaa

SEQ ID NO: 773188 - RNA, 22 nt, Human
cagagcugcuucccaguuugug

SEQ ID NO: 773189 - RNA, 22 nt, Human
caggagccacauuccaccuuga

SEQ ID NO: 773190 - RNA, 22 nt, Human
cagguccaguaaaaagaguccu

SEQ ID NO: 773191 - RNA, 22 nt, Human
uuuauagaugucuguauuauaa

SEQ ID NO: 773192 - RNA, 22 nt, Human
uuucauaaacaguagaagacua

SEQ ID NO: 773193 - RNA, 22 nt, Human
ucagaagccgggcagguuuugg

SEQ ID NO: 773194 - RNA, 22 nt, Human
agggcagacuaggauggaagug

SEQ ID NO: 773195 - RNA, 22 nt, Human
uaugaagacaaugauagcauga

SEQ ID NO: 773196 - RNA, 22 nt, Human
gcuggaggauggacuggaagaa

SEQ ID NO: 773197 - RNA, 20 nt, Human
cuguuuauuagaaguggauu

SEQ ID NO: 773198 - RNA, 22 nt, Human
agucccagaucuccauucgguc

SEQ ID NO: 773199 - RNA, 22 nt, Human
cuguggcuggaauaauaaaugu

SEQ ID NO: 773200 - RNA, 22 nt, Human
uagcagagcgggugcgaggcgg

SEQ ID NO: 773201 - RNA, 22 nt, Human
ggaggcucugcuccguguguuc

SEQ ID NO: 773202 - RNA, 22 nt, Human
accuagaaacugacagaauauu

SEQ ID NO: 773203 - RNA, 19 nt, Human
ugguggcaaugucagcuaa

SEQ ID NO: 773204 - RNA, 22 nt, Human
ggcucaggacugcagcguagag

SEQ ID NO: 773205 - RNA, 19 nt, Human
ugcauaaauuauauacuuu

SEQ ID NO: 773206 - RNA, 22 nt, Human
cugaagcaaaggaucgagcuaa

SEQ ID NO: 773207 - RNA, 22 nt, Human
augaggcauucacagaaggcac

SEQ ID NO: 773208 - RNA, 22 nt, Human
ugcaagaggaauucuagaagca

SEQ ID NO: 773209 - RNA, 22 nt, Human
cacuguuuggcuccuguacuua

SEQ ID NO: 773210 - RNA, 22 nt, Human
uccaccugaguuucaguuauuu

SEQ ID NO: 773211 - RNA, 22 nt, Human
aucuuuuacuacaaaucaggug

SEQ ID NO: 773212 - RNA, 22 nt, Human
uucauggaucaugccuuuugug

SEQ ID NO: 773213 - RNA, 22 nt, Human
gacagccaugcacuucugcugu

SEQ ID NO: 773214 - RNA, 22 nt, Human
cguccccucguucccacuuugg

SEQ ID NO: 773215 - RNA, 22 nt, Human
aaaguuuuauucaagcauuagu

SEQ ID NO: 773216 - RNA, 22 nt, Human
cuugccuucuuuuccuauagaa

SEQ ID NO: 773217 - RNA, 20 nt, Human
uuguuuaaaggugaagaggc

SEQ ID NO: 773218 - RNA, 23 nt, Human
ugcccagugggugcaggggguau

SEQ ID NO: 773219 - RNA, 22 nt, Human
uuacagugacaguugcuaugau

SEQ ID NO: 773220 - RNA, 22 nt, Human
agcugugccuauucguggcaag

SEQ ID NO: 773221 - RNA, 22 nt, Human
uuauguuugaguauaugacuca

SEQ ID NO: 773222 - RNA, 22 nt, Human
uggcuacaucacagagaauucc

SEQ ID NO: 773223 - RNA, 22 nt, Human
uucuccucugcaaugacuggca

SEQ ID NO: 773224 - RNA, 22 nt, Human
uagcuuuagugaaaaauaucag

SEQ ID NO: 773225 - RNA, 22 nt, Human
cacaguguagacuaauaauaga

SEQ ID NO: 773226 - RNA, 22 nt, Human
cuauacaucccaauuucagaga

SEQ ID NO: 773227 - RNA, 19 nt, Human
ucugucacuggggguauuc

SEQ ID NO: 773228 - RNA, 22 nt, Human
ccagggcacuuaggcccagccc

SEQ ID NO: 773229 - RNA, 23 nt, Human
uccucagcauguuuugucaugua

SEQ ID NO: 773230 - RNA, 22 nt, Human
ccaggaagcauaauguaguggg

SEQ ID NO: 773231 - RNA, 21 nt, Human
caggaaaucagugugaauuag

SEQ ID NO: 773232 - RNA, 22 nt, Human
aaagcagggaugaggcuagagg

SEQ ID NO: 773233 - RNA, 23 nt, Human
cuagggcaguauuucacagacac

SEQ ID NO: 773234 - RNA, 18 nt, Human
cuggucucccuucgcuuu

SEQ ID NO: 773235 - RNA, 22 nt, Human
cugcaguacaagaagcaucucu

SEQ ID NO: 773236 - RNA, 22 nt, Human
acaauaaggauuuuuaggggca

SEQ ID NO: 773237 - RNA, 22 nt, Human
gccucugcucucagguagccuc

SEQ ID NO: 773238 - RNA, 22 nt, Human
aagcaucuauagguucuaggag

SEQ ID NO: 773239 - RNA, 22 nt, Human
ucugggaaguuggcagccagcu

SEQ ID NO: 773240 - RNA, 22 nt, Human
ugcuuuauuaagagagaaauuu

SEQ ID NO: 773241 - RNA, 22 nt, Human
gccuuuauauuuuucugguguu

SEQ ID NO: 773242 - RNA, 22 nt, Human
gccacccugagcugggccaggg

SEQ ID NO: 773243 - RNA, 22 nt, Human
gccuucugauugcuggacugac

SEQ ID NO: 773244 - RNA, 22 nt, Human
ugcuucuguuucauugaucuua

SEQ ID NO: 773245 - RNA, 22 nt, Human
uugcugaaaucuaugacauccu

SEQ ID NO: 773246 - RNA, 17 nt, Human
agauggccucuaagauu

SEQ ID NO: 773247 - RNA, 22 nt, Human
ugcaguccuggugaggggacau

SEQ ID NO: 773248 - RNA, 22 nt, Human
uugcauuuacugcaccgugagu

SEQ ID NO: 773249 - RNA, 22 nt, Human
ugcaggcaggggaugagcagcc

SEQ ID NO: 773250 - RNA, 22 nt, Human
uagauucuucuaggucuuuagc

SEQ ID NO: 773251 - RNA, 22 nt, Human
uucccugaucacgugucaggag

SEQ ID NO: 773252 - RNA, 22 nt, Human
ugccaagagggcagagggcagu

SEQ ID NO: 773253 - RNA, 22 nt, Human
agaaggcuggccauggugcccu

SEQ ID NO: 773254 - RNA, 22 nt, Human
aguuuuaagaugcgcuucuguu

SEQ ID NO: 773255 - RNA, 23 nt, Human
uauacacauguggcaguauagug

SEQ ID NO: 773256 - RNA, 22 nt, Human
ucucaaauaggccuugguccug

SEQ ID NO: 773257 - RNA, 22 nt, Human
aaggcacugacugugcagggga

SEQ ID NO: 773258 - RNA, 22 nt, Human
agcacauuaguaucuaagaaca

SEQ ID NO: 773259 - RNA, 22 nt, Human
auagauacauuguuauauuugu

SEQ ID NO: 773260 - RNA, 22 nt, Human
gcacugugcuaaacauguauca

SEQ ID NO: 773261 - RNA, 22 nt, Human
caaagcuauaaauucagacaga

SEQ ID NO: 773262 - RNA, 22 nt, Human
ugagcccuggcucuuucacuua

SEQ ID NO: 773263 - RNA, 18 nt, Human
aacaguuuccagauucuc

SEQ ID NO: 773264 - RNA, 22 nt, Human
uguccugugcacuguagcaugu

SEQ ID NO: 773265 - RNA, 18 nt, Human
aaacuggcuuggccugug

SEQ ID NO: 773266 - RNA, 22 nt, Human
cucagagguggaugccuugugg

SEQ ID NO: 773267 - RNA, 17 nt, Human
gcaucacagauaacacg

SEQ ID NO: 773268 - RNA, 21 nt, Human
agacacugguuuagcauucau

SEQ ID NO: 773269 - RNA, 22 nt, Human
cucacaauuuuucagugacuau

SEQ ID NO: 773270 - RNA, 22 nt, Human
ugaguuauaaugaauauuugaa

SEQ ID NO: 773271 - RNA, 22 nt, Human
ggcuggcaggcacaguaugcaa

SEQ ID NO: 773272 - RNA, 22 nt, Human
guauuuccauuagugugugcac

SEQ ID NO: 773273 - RNA, 23 nt, Human
uccauacucuaaacauguuauuu

SEQ ID NO: 773274 - RNA, 17 nt, Human
aaggcacagggcacugg

SEQ ID NO: 773275 - RNA, 22 nt, Human
gagcucagaggauucuggggag

SEQ ID NO: 773276 - RNA, 22 nt, Human
uccuuaauauggaagaguucuc

SEQ ID NO: 773277 - RNA, 22 nt, Human
agcagggcagugaucagaaagg

SEQ ID NO: 773278 - RNA, 22 nt, Human
gcuggcuuuguggucucuccuc

SEQ ID NO: 773279 - RNA, 22 nt, Human
auggcuccuucugugcaguuuu

SEQ ID NO: 773280 - RNA, 22 nt, Human
ucugggccagaucuagggaucu

SEQ ID NO: 773281 - RNA, 22 nt, Human
acauucaaccaauguuugcuau

SEQ ID NO: 773282 - RNA, 22 nt, Human
agagaaggguagcccauucucc

SEQ ID NO: 773283 - RNA, 22 nt, Human
cccagccugugacagccguccu

SEQ ID NO: 773284 - RNA, 20 nt, Human
uggcaggaggcagcagugga

SEQ ID NO: 773285 - RNA, 22 nt, Human
cuccccacacacuaggccugau

SEQ ID NO: 773286 - RNA, 22 nt, Human
ucaucuuuguaucccuaacaca

SEQ ID NO: 773287 - RNA, 22 nt, Human
acagaugagacuccaggaccuu

SEQ ID NO: 773288 - RNA, 22 nt, Human
ggcuauggaaauggcaggacau

SEQ ID NO: 773289 - RNA, 23 nt, Human
agugagcagcuguagggcaagga

SEQ ID NO: 773290 - RNA, 22 nt, Human
gguguugcaguugaagacuggu

SEQ ID NO: 773291 - RNA, 22 nt, Human
uugauucugauccuuugcuagc

SEQ ID NO: 773292 - RNA, 22 nt, Human
gaggggagacagggaaaucagu

SEQ ID NO: 773293 - RNA, 22 nt, Human
cuggagaacuaguuaaacacgu

SEQ ID NO: 773294 - RNA, 22 nt, Human
ucaguauagcuucuaaacuaac

SEQ ID NO: 773295 - RNA, 22 nt, Human
cuuguguuguacauucuauggg

SEQ ID NO: 773296 - RNA, 22 nt, Human
acauaugauauugaggaucuca

SEQ ID NO: 773297 - RNA, 22 nt, Human
auuauagggaauucuagaaguc

SEQ ID NO: 773298 - RNA, 20 nt, Human
agggccuguugcaagcguuu

SEQ ID NO: 773299 - RNA, 22 nt, Human
gcaugcauuucacuagguaugu

SEQ ID NO: 773300 - RNA, 22 nt, Human
uaguguguaugguaaugaugaa

SEQ ID NO: 773301 - RNA, 22 nt, Human
agcacagagagcucuagguaaa

SEQ ID NO: 773302 - RNA, 22 nt, Human
gggggagagacgagcggcucug

SEQ ID NO: 773303 - RNA, 22 nt, Human
aguguuuagcaugaaguucauu

SEQ ID NO: 773304 - RNA, 22 nt, Human
agucaaagaagaugguuccaaa

SEQ ID NO: 773305 - RNA, 22 nt, Human
aaaauugguuccuuucugaggc

SEQ ID NO: 773306 - RNA, 22 nt, Human
gggguggcccuacccucuggaa

SEQ ID NO: 773307 - RNA, 22 nt, Human
acagggagccccagcauuucca

SEQ ID NO: 773308 - RNA, 22 nt, Human
agcauucauugcuagaauguaa

SEQ ID NO: 773309 - RNA, 22 nt, Human
auuucauagauuguaaaucccu

SEQ ID NO: 773310 - RNA, 19 nt, Human
acauuggacauggaucuug

SEQ ID NO: 773311 - RNA, 22 nt, Human
auguagauuugcuucuccugcc

SEQ ID NO: 773312 - RNA, 22 nt, Human
uggcugugucaucauagcugug

SEQ ID NO: 773313 - RNA, 22 nt, Human
auaucauaaaucggugcaugaa

SEQ ID NO: 773314 - RNA, 22 nt, Human
ggcuccagggucucuccuugug

SEQ ID NO: 773315 - RNA, 22 nt, Human
aacugauuucaaguucaguuuc

SEQ ID NO: 773316 - RNA, 22 nt, Human
acagaauuuaaagcucuagacu

SEQ ID NO: 773317 - RNA, 22 nt, Human
aaucuuucaaauuucuuugggu

SEQ ID NO: 773318 - RNA, 22 nt, Human
gcacagcucgagcucaggaggg

SEQ ID NO: 773319 - RNA, 22 nt, Human
uauuggcagcaugagcuccugg

SEQ ID NO: 773320 - RNA, 22 nt, Human
cuccaggguuccccgauccacu

SEQ ID NO: 773321 - RNA, 22 nt, Human
agaagugucagugcaggcagcu

SEQ ID NO: 773322 - RNA, 22 nt, Human
uucagccuguucaugcuguugc

SEQ ID NO: 773323 - RNA, 22 nt, Human
auauuaaugagcaaguaaguga

SEQ ID NO: 773324 - RNA, 22 nt, Human
uggagaaggggcagggucucca

SEQ ID NO: 773325 - RNA, 22 nt, Human
cucagagaagauggaugaggua

SEQ ID NO: 773326 - RNA, 22 nt, Human
ccugcuguagggccccuggggc

SEQ ID NO: 773327 - RNA, 22 nt, Human
ucugacugaaccaauuauuuac

SEQ ID NO: 773328 - RNA, 22 nt, Human
augaaauuuuaauuauaccucu

SEQ ID NO: 773329 - RNA, 22 nt, Human
auucaacauauucugaguaaaa

SEQ ID NO: 773330 - RNA, 22 nt, Human
aggucaaaaucaggcagggaag

SEQ ID NO: 773331 - RNA, 22 nt, Human
uggaccugcuggaugggcaggu

SEQ ID NO: 773332 - RNA, 22 nt, Human
cagcuuuauugagguauaauug

SEQ ID NO: 773333 - RNA, 22 nt, Human
uguacacugcaggaugcauugc

SEQ ID NO: 773334 - RNA, 22 nt, Human
uucagagaguccaguaugcagu

SEQ ID NO: 773335 - RNA, 22 nt, Human
uuaaaagaauccuguuauccuc

SEQ ID NO: 773336 - RNA, 22 nt, Human
agcaaagcacuuugcauacaua

SEQ ID NO: 773337 - RNA, 22 nt, Human
cuccagucuaguagagccugcu

SEQ ID NO: 773338 - RNA, 22 nt, Human
cagagaagagucuggccucucu

SEQ ID NO: 773339 - RNA, 22 nt, Human
ccaucccugccauuauagccca

SEQ ID NO: 773340 - RNA, 22 nt, Human
acuguauaaggcauagguaagc

SEQ ID NO: 773341 - RNA, 22 nt, Human
gacauucagguguucaaugcca

SEQ ID NO: 773342 - RNA, 22 nt, Human
uucugggcuugaaaguuuaaua

SEQ ID NO: 773343 - RNA, 22 nt, Human
ucugugccuuuaagaagcucau

SEQ ID NO: 773344 - RNA, 22 nt, Human
auugagaaauauaaucuggaaa

SEQ ID NO: 773345 - RNA, 22 nt, Human
aaucauguacugcuguggcuuu

SEQ ID NO: 773346 - RNA, 22 nt, Human
ucauggaauagagcaguggcaa

SEQ ID NO: 773347 - RNA, 22 nt, Human
cccaggacucggcacucuccuu

SEQ ID NO: 773348 - RNA, 22 nt, Human
uuccacagcccaagcugguggc

SEQ ID NO: 773349 - RNA, 22 nt, Human
cugggcagagcuaacaccugag

SEQ ID NO: 773350 - RNA, 21 nt, Human
auacacauacacauaaaugug

SEQ ID NO: 773351 - RNA, 22 nt, Human
cauugcuuaucuaguucacaua

SEQ ID NO: 773352 - RNA, 22 nt, Human
gucugcugcuucuguugaagca

SEQ ID NO: 773353 - RNA, 22 nt, Human
uccagcccaucccuagccuggg

SEQ ID NO: 773354 - RNA, 22 nt, Human
cuugccaaugguacaaacgauu

SEQ ID NO: 773355 - RNA, 22 nt, Human
uagagcuggaauuugcagcaag

SEQ ID NO: 773356 - RNA, 22 nt, Human
auguuuaaaggagucagagacu

SEQ ID NO: 773357 - RNA, 22 nt, Human
aaggcuuuuguuccuauuuagu

SEQ ID NO: 773358 - RNA, 22 nt, Human
cccaggcagcggggucuccuug

SEQ ID NO: 773359 - RNA, 19 nt, Human
ucucaauguucagaaagcu

SEQ ID NO: 773360 - RNA, 22 nt, Human
uugcauaaagauuuuauugcau

SEQ ID NO: 773361 - RNA, 17 nt, Human
cucuggggacaguucua

SEQ ID NO: 773362 - RNA, 21 nt, Human
aguaguuuagcacaggguuug

SEQ ID NO: 773363 - RNA, 22 nt, Human
ggagggugggucauucuuacau

SEQ ID NO: 773364 - RNA, 18 nt, Human
agaggcuggacaggggau

SEQ ID NO: 773365 - RNA, 22 nt, Human
aaucaaagaaugggcuaguugg

SEQ ID NO: 773366 - RNA, 22 nt, Human
gagcucugggaaacaaagugua

SEQ ID NO: 773367 - RNA, 22 nt, Human
cuuccgugucaguuccaggugg

SEQ ID NO: 773368 - RNA, 22 nt, Human
gugagaauaccagcagugagaa

SEQ ID NO: 773369 - RNA, 22 nt, Human
acauucucuuccuaaauauacu

SEQ ID NO: 773370 - RNA, 22 nt, Human
cacagggaaccaaggcugggcc

SEQ ID NO: 773371 - RNA, 22 nt, Human
gucagcaccucuuuggggagcu

SEQ ID NO: 773372 - RNA, 18 nt, Human
uucagcagcagacacacu

SEQ ID NO: 773373 - RNA, 22 nt, Human
gaaauuuauuaucuacaucauu

SEQ ID NO: 773374 - RNA, 22 nt, Human
aauucauauggauaugcuagua

SEQ ID NO: 773375 - RNA, 22 nt, Human
guggcauugacauguaaacagu

SEQ ID NO: 773376 - RNA, 22 nt, Human
uggcuuuacuuaaacugaauca

SEQ ID NO: 773377 - RNA, 22 nt, Human
aggcuggaguacaguggcuauu

SEQ ID NO: 773378 - RNA, 22 nt, Human
ggaggaccugcuggcccugcaa

SEQ ID NO: 773379 - RNA, 22 nt, Human
gccaccucuuugucucugccgc

SEQ ID NO: 773380 - RNA, 22 nt, Human
aaucacauugaaucugcuaccu

SEQ ID NO: 773381 - RNA, 22 nt, Human
ggagccagugcccucuggugga

SEQ ID NO: 773382 - RNA, 22 nt, Human
uugcaggguugacacugccugc

SEQ ID NO: 773383 - RNA, 22 nt, Human
agaaggcuaaagaaacagauug

SEQ ID NO: 773384 - RNA, 22 nt, Human
uuucuuuugcccuguggguuag

SEQ ID NO: 773385 - RNA, 22 nt, Human
guugcagacggggugcacugaa

SEQ ID NO: 773386 - RNA, 22 nt, Human
ccucugacuccuggacuugggg

SEQ ID NO: 773387 - RNA, 22 nt, Human
gagguggaggggaaaaauagau

SEQ ID NO: 773388 - RNA, 22 nt, Human
aucauugaaauguaguuucauc

SEQ ID NO: 773389 - RNA, 22 nt, Human
ucacaucuauacccaauaauuu

SEQ ID NO: 773390 - RNA, 22 nt, Human
gcagaggcuccauuuuacagau

SEQ ID NO: 773391 - RNA, 22 nt, Human
aggcgcugugcuuggggcugga

SEQ ID NO: 773392 - RNA, 22 nt, Human
auacagagaagggaggcaaaau

SEQ ID NO: 773393 - RNA, 22 nt, Human
uuggaacucguguuacuuguau

SEQ ID NO: 773394 - RNA, 22 nt, Human
gggugggccugucuggccaugu

SEQ ID NO: 773395 - RNA, 22 nt, Human
uaagaaacuaaugcaauaagag

SEQ ID NO: 773396 - RNA, 21 nt, Human
gagcucucaggcaagaagcag

SEQ ID NO: 773397 - RNA, 22 nt, Human
uaguuaauucuuuaagaacaag

SEQ ID NO: 773398 - RNA, 19 nt, Human
uguaccugggucauggugc

SEQ ID NO: 773399 - RNA, 22 nt, Human
agcucucugauaaauugauaaa

SEQ ID NO: 773400 - RNA, 22 nt, Human
aggaaauugucuuuuuccuugu

SEQ ID NO: 773401 - RNA, 22 nt, Human
gacuguuaccuauauuuaugug

SEQ ID NO: 773402 - RNA, 22 nt, Human
agcuaacauggaggaaaaaguu

SEQ ID NO: 773403 - RNA, 22 nt, Human
ggaaauauuuugucuaauuugu

SEQ ID NO: 773404 - RNA, 22 nt, Human
aaauuagaccagggcuccugga

SEQ ID NO: 773405 - RNA, 21 nt, Human
ugaaugaggaggauggcauuu

SEQ ID NO: 773406 - RNA, 23 nt, Human
aacuuuacuauuuugaauaaugc

SEQ ID NO: 773407 - RNA, 22 nt, Human
ucagcagaggggaaggcaucug

SEQ ID NO: 773408 - RNA, 22 nt, Human
cugccagugaaauugugucagu

SEQ ID NO: 773409 - RNA, 23 nt, Human
acaaugcacuuuaaaugguuccc

SEQ ID NO: 773410 - RNA, 22 nt, Human
auacuuuggggguuaguguaga

SEQ ID NO: 773411 - RNA, 22 nt, Human
gccuggcacucacugaagaggc

SEQ ID NO: 773412 - RNA, 23 nt, Human
cuccuggaggguccggcccugcc

SEQ ID NO: 773413 - RNA, 22 nt, Human
acuccaguucucuuguuuauaa

SEQ ID NO: 773414 - RNA, 22 nt, Human
agcauucaugaugacaacagga

SEQ ID NO: 773415 - RNA, 22 nt, Human
ugggagcuccuggagggcagga

SEQ ID NO: 773416 - RNA, 19 nt, Human
cuguccacacacucgcuuc

SEQ ID NO: 773417 - RNA, 22 nt, Human
uuggcugugaaagcuucucaaa

SEQ ID NO: 773418 - RNA, 22 nt, Human
agaguuuguguccuuuaucagg

SEQ ID NO: 773419 - RNA, 22 nt, Human
uccaagaagagccuuucuccuc

SEQ ID NO: 773420 - RNA, 22 nt, Human
caaggcugucuccagcuuccaa

SEQ ID NO: 773421 - RNA, 22 nt, Human
cucaggacagauuccagagaaa

SEQ ID NO: 773422 - RNA, 22 nt, Human
uguaugaaguuacugagccucu

SEQ ID NO: 773423 - RNA, 22 nt, Human
cuguaugucuugugaauuguag

SEQ ID NO: 773424 - RNA, 22 nt, Human
uuucugcaaguguagauaccca

SEQ ID NO: 773425 - RNA, 22 nt, Human
ccugggcagccugcucaaggac

SEQ ID NO: 773426 - RNA, 22 nt, Human
ucugaggugucacaaggccagg

SEQ ID NO: 773427 - RNA, 23 nt, Human
ucagagaggcccccugcagagau

SEQ ID NO: 773428 - RNA, 21 nt, Human
aaacaucucugcuuuuguguc

SEQ ID NO: 773429 - RNA, 22 nt, Human
cauucucaauaguagaugagua

SEQ ID NO: 773430 - RNA, 21 nt, Human
agugacagaggaaggugcaua

SEQ ID NO: 773431 - RNA, 22 nt, Human
ucccaaggugcucggcaacagg

SEQ ID NO: 773432 - RNA, 22 nt, Human
guuuacuuagaugcucaugcag

SEQ ID NO: 773433 - RNA, 22 nt, Human
uagcaacaugguuaucacauua

SEQ ID NO: 773434 - RNA, 22 nt, Human
aagcacagggacuuuaggaaua

SEQ ID NO: 773435 - RNA, 22 nt, Human
uuuauguaguuacggacuauca

SEQ ID NO: 773436 - RNA, 20 nt, Human
augucugaaguaauccauuu

SEQ ID NO: 773437 - RNA, 22 nt, Human
aaaacuguaggaauugggugcc

SEQ ID NO: 773438 - RNA, 22 nt, Human
cacucccucuaguugcauucug

SEQ ID NO: 773439 - RNA, 22 nt, Human
ucugcacauggcgcugguccug

SEQ ID NO: 773440 - RNA, 22 nt, Human
cagcuucuccagaugacccuca

SEQ ID NO: 773441 - RNA, 22 nt, Human
gguccaccuccaagcuggggac

SEQ ID NO: 773442 - RNA, 22 nt, Human
caggguccaucuuucaucacug

SEQ ID NO: 773443 - RNA, 22 nt, Human
uugguuuacuaggauucaaauu

SEQ ID NO: 773444 - RNA, 22 nt, Human
ucauagaaauggaaaguauauu

SEQ ID NO: 773445 - RNA, 22 nt, Human
auugagaaaauaaguauggaua

SEQ ID NO: 773446 - RNA, 17 nt, Human
agccugcugaucucaca

SEQ ID NO: 773447 - RNA, 22 nt, Human
ggucucugagugaggaccuggg

SEQ ID NO: 773448 - RNA, 22 nt, Human
cagcagcagauucagcgucugg

SEQ ID NO: 773449 - RNA, 22 nt, Human
cucuggagggaggcugagcugg

SEQ ID NO: 773450 - RNA, 22 nt, Human
gaagcagcuuucuggugaggag

SEQ ID NO: 773451 - RNA, 22 nt, Human
ugagguggccgaggagcaggac

SEQ ID NO: 773452 - RNA, 22 nt, Human
gcaggcugaugacuggaguugg

SEQ ID NO: 773453 - RNA, 22 nt, Human
agaggaaucugucuagacacaa

SEQ ID NO: 773454 - RNA, 22 nt, Human
guguaaaaacauacuauuucua

SEQ ID NO: 773455 - RNA, 22 nt, Human
ccaggcuguuuucaaacuuggg

SEQ ID NO: 773456 - RNA, 22 nt, Human
guaggcugugugaggcuagaga

SEQ ID NO: 773457 - RNA, 22 nt, Human
uggaggcauuuuagguugucac

SEQ ID NO: 773458 - RNA, 22 nt, Human
cuaagaaauguugugaaugcca

SEQ ID NO: 773459 - RNA, 20 nt, Human
cagauggcacgucagggcau

SEQ ID NO: 773460 - RNA, 22 nt, Human
uuagagagaaccaucaggaucu

SEQ ID NO: 773461 - RNA, 22 nt, Human
cacauaaauggugccauguuuu

SEQ ID NO: 773462 - RNA, 22 nt, Human
cugcagggagaggggacagccu

SEQ ID NO: 773463 - RNA, 22 nt, Human
gccaaccauuggcuucuuguca

SEQ ID NO: 773464 - RNA, 22 nt, Human
ccagguggcccugcccuacucu

SEQ ID NO: 773465 - RNA, 19 nt, Human
ugugagaggcuagcugccc

SEQ ID NO: 773466 - RNA, 22 nt, Human
gcuggagauacugcucaguauc

SEQ ID NO: 773467 - RNA, 22 nt, Human
aagcgccaugguuccugcgcag

SEQ ID NO: 773468 - RNA, 22 nt, Human
caggaacaggggagugaaccug

SEQ ID NO: 773469 - RNA, 22 nt, Human
gcaauagugccuauucucuuga

SEQ ID NO: 773470 - RNA, 22 nt, Human
ucauaaagcuugccugcagugu

SEQ ID NO: 773471 - RNA, 22 nt, Human
gcaagcuggcuguuagaggaug

SEQ ID NO: 773472 - RNA, 22 nt, Human
acugccuugucucuugccuguu

SEQ ID NO: 773473 - RNA, 22 nt, Human
agccuggggcacuucuccaaac

SEQ ID NO: 773474 - RNA, 22 nt, Human
ccauggccaggaaagccaaggu

SEQ ID NO: 773475 - RNA, 22 nt, Human
guguaaggugaaaucaacaaau

SEQ ID NO: 773476 - RNA, 22 nt, Human
aaaggcaugauuaauucugugu

SEQ ID NO: 773477 - RNA, 22 nt, Human
uuuaucugaaaaaacucuugga

SEQ ID NO: 773478 - RNA, 22 nt, Human
guucugggaagguggaccuguu

SEQ ID NO: 773479 - RNA, 17 nt, Human
cuucucuggcagaagau

SEQ ID NO: 773480 - RNA, 22 nt, Human
aggcuggaucucuguugccuuc

SEQ ID NO: 773481 - RNA, 22 nt, Human
cacaucccuggaguuacccagu

SEQ ID NO: 773482 - RNA, 22 nt, Human
auguaacaggugaagcucugag

SEQ ID NO: 773483 - RNA, 22 nt, Human
gccuuucagugccuucuguuca

SEQ ID NO: 773484 - RNA, 22 nt, Human
caggcuugauuauucagacaau

SEQ ID NO: 773485 - RNA, 22 nt, Human
aacacauagacguuugauauca

SEQ ID NO: 773486 - RNA, 20 nt, Human
cuuagcuucuaagguucugg

SEQ ID NO: 773487 - RNA, 22 nt, Human
acaagcaucagguucagcaaua

SEQ ID NO: 773488 - RNA, 22 nt, Human
ugacauaaaccagugagcaaaa

SEQ ID NO: 773489 - RNA, 22 nt, Human
uacugaauggggcaguaagaaa

SEQ ID NO: 773490 - RNA, 22 nt, Human
agaaagcaucuccauuguaggu

SEQ ID NO: 773491 - RNA, 18 nt, Human
uuauucagacgcauauga

SEQ ID NO: 773492 - RNA, 22 nt, Human
acuguucuccuuuggcuauauc

SEQ ID NO: 773493 - RNA, 22 nt, Human
aaccugcaguuuuuauucugag

SEQ ID NO: 773494 - RNA, 22 nt, Human
auucugggucugggugugauca

SEQ ID NO: 773495 - RNA, 22 nt, Human
aaggugucggcagagccgcuuc

SEQ ID NO: 773496 - RNA, 22 nt, Human
uacauuccauguguguguauuc

SEQ ID NO: 773497 - RNA, 22 nt, Human
gcacuuaggguauguacugggc

SEQ ID NO: 773498 - RNA, 22 nt, Human
ucuggcagugaagucaugaggu

SEQ ID NO: 773499 - RNA, 22 nt, Human
auggaucuaccuucaggcucug

SEQ ID NO: 773500 - RNA, 22 nt, Human
aaagcaaugucucugccugguu

SEQ ID NO: 773501 - RNA, 22 nt, Human
caccagaacaagacaggagaau

SEQ ID NO: 773502 - RNA, 15 nt, Human
cugaacucuaaacca

SEQ ID NO: 773503 - RNA, 22 nt, Human
ucagcuucacccagaguuguag

SEQ ID NO: 773504 - RNA, 22 nt, Human
ugcaauaacccaugagauagaa

SEQ ID NO: 773505 - RNA, 22 nt, Human
ggacaugauauuucaggaagac

SEQ ID NO: 773506 - RNA, 22 nt, Human
uugacacaauguauauuuucaa

SEQ ID NO: 773507 - RNA, 22 nt, Human
gcagagccugacgggauuuuuc

SEQ ID NO: 773508 - RNA, 22 nt, Human
agcucccagaagccagagucgg

SEQ ID NO: 773509 - RNA, 22 nt, Human
uuguuuccauugcagacugugu

SEQ ID NO: 773510 - RNA, 22 nt, Human
caucaucaaaacaaauggaguc

SEQ ID NO: 773511 - RNA, 22 nt, Human
agccccuccaguggcauaaaau

SEQ ID NO: 773512 - RNA, 22 nt, Human
cucagggaguagcacaugugga

SEQ ID NO: 773513 - RNA, 22 nt, Human
uggcccagucagcaggagaggg

SEQ ID NO: 773514 - RNA, 21 nt, Human
ugcuuucagacucuuacagaa

SEQ ID NO: 773515 - RNA, 20 nt, Human
cuaagaggaggacuagguuu

SEQ ID NO: 773516 - RNA, 22 nt, Human
guccucagggaauguggcgggu

SEQ ID NO: 773517 - RNA, 22 nt, Human
aggcagguagaaggaucuuuau

SEQ ID NO: 773518 - RNA, 20 nt, Human
caucagugccugacaggucc

SEQ ID NO: 773519 - RNA, 22 nt, Human
cucugagaugauaccuucugga

SEQ ID NO: 773520 - RNA, 22 nt, Human
ucauuacaguguuuauaugucu

SEQ ID NO: 773521 - RNA, 22 nt, Human
acaguguggugauggcacuugc

SEQ ID NO: 773522 - RNA, 18 nt, Human
cauucuuggcagcuuuug

SEQ ID NO: 773523 - RNA, 22 nt, Human
uacaguuacugcauuucuaaua

SEQ ID NO: 773524 - RNA, 22 nt, Human
guuccucauccagucaugacua

SEQ ID NO: 773525 - RNA, 22 nt, Human
uuucaugcucauggaacacagc

SEQ ID NO: 773526 - RNA, 22 nt, Human
cuggcugaauccuagucucaua

SEQ ID NO: 773527 - RNA, 22 nt, Human
cccccagccagcagugcucagc

SEQ ID NO: 773528 - RNA, 23 nt, Human
ugggauagaauuucauggcugcu

SEQ ID NO: 773529 - RNA, 22 nt, Human
cuguuuuugugcugugucuccc

SEQ ID NO: 773530 - RNA, 22 nt, Human
acagggagaugggugaaagcgg

SEQ ID NO: 773531 - RNA, 19 nt, Human
ugggccugcaucugggucu

SEQ ID NO: 773532 - RNA, 22 nt, Human
ucacugugcacauaugauaggu

SEQ ID NO: 773533 - RNA, 22 nt, Human
cacaguaaccccaggacuggga

SEQ ID NO: 773534 - RNA, 22 nt, Human
uccugcuugaaacucugccuuc

SEQ ID NO: 773535 - RNA, 20 nt, Human
gcccugugaugucuugaccu

SEQ ID NO: 773536 - RNA, 20 nt, Human
uucugccuaggguuagccug

SEQ ID NO: 773537 - RNA, 22 nt, Human
aggcucauucuugccucugagc

SEQ ID NO: 773538 - RNA, 22 nt, Human
uacuuuuccuggaaccacugcu

SEQ ID NO: 773539 - RNA, 22 nt, Human
auacacagccauuaugaauuag

SEQ ID NO: 773540 - RNA, 22 nt, Human
gcaucuaaauaaacgugggagu

SEQ ID NO: 773541 - RNA, 21 nt, Human
agggaaauccagucacuuuuc

SEQ ID NO: 773542 - RNA, 22 nt, Human
agcuagggcuuucguagacagu

SEQ ID NO: 773543 - RNA, 22 nt, Human
uggggagcccacucaccucccc

SEQ ID NO: 773544 - RNA, 22 nt, Human
gccuggaggcgagaacccaaug

SEQ ID NO: 773545 - RNA, 22 nt, Human
gcagaugcaacugcaggugagu

SEQ ID NO: 773546 - RNA, 22 nt, Human
cuccugaggaaaagcuugguca

SEQ ID NO: 773547 - RNA, 22 nt, Human
guguggccuugggagaggucug

SEQ ID NO: 773548 - RNA, 22 nt, Human
agugucucagccccaacuagag

SEQ ID NO: 773549 - RNA, 22 nt, Human
gucugccauguggagaaagcca

SEQ ID NO: 773550 - RNA, 22 nt, Human
auauuuucacagaacuugcaaa

SEQ ID NO: 773551 - RNA, 22 nt, Human
acauuucucagguaagucauuu

SEQ ID NO: 773552 - RNA, 21 nt, Human
uccuuauauuugaauacuuua

SEQ ID NO: 773553 - RNA, 22 nt, Human
cuuuaauucagauuugaaggga

SEQ ID NO: 773554 - RNA, 22 nt, Human
ugcugcuuuaaaaagugcugau

SEQ ID NO: 773555 - RNA, 22 nt, Human
uagugcuuaacacaaagugauu

SEQ ID NO: 773556 - RNA, 18 nt, Human
gucacagcagagaacugc

SEQ ID NO: 773557 - RNA, 22 nt, Human
uagaaacucacguuaucauugc

SEQ ID NO: 773558 - RNA, 22 nt, Human
auugaguaccuccagauucaua

SEQ ID NO: 773559 - RNA, 22 nt, Human
ugcuccuauccuccugcugaca

SEQ ID NO: 773560 - RNA, 22 nt, Human
ugugcaaucuugagcaauuuau

SEQ ID NO: 773561 - RNA, 22 nt, Human
acugaggucaugcauaguuucu

SEQ ID NO: 773562 - RNA, 22 nt, Human
ggucuggaguagaugagucaug

SEQ ID NO: 773563 - RNA, 22 nt, Human
agcauagaguccugagggcagg

SEQ ID NO: 773564 - RNA, 22 nt, Human
guagacagcaaccaaaccaggu

SEQ ID NO: 773565 - RNA, 22 nt, Human
aauguauguguauaucaaauca

SEQ ID NO: 773566 - RNA, 22 nt, Human
aggcucagagaugaguaagcac

SEQ ID NO: 773567 - RNA, 19 nt, Human
cagcaauaaugccagaugg

SEQ ID NO: 773568 - RNA, 22 nt, Human
caucugcuguuccuuggacuca

SEQ ID NO: 773569 - RNA, 22 nt, Human
agggcucagggucaccaucugu

SEQ ID NO: 773570 - RNA, 22 nt, Human
gccucucugggcugccgaggcu

SEQ ID NO: 773571 - RNA, 22 nt, Human
aacuggcauaugaacuuguucu

SEQ ID NO: 773572 - RNA, 21 nt, Human
ucaggaagagccaguucaugc

SEQ ID NO: 773573 - RNA, 22 nt, Human
ucuguucuuuccaacaagacag

SEQ ID NO: 773574 - RNA, 22 nt, Human
acuaaauacacacauuuguuca

SEQ ID NO: 773575 - RNA, 22 nt, Human
uguuugaaacuuugaucacuaa

SEQ ID NO: 773576 - RNA, 22 nt, Human
gcugagggcuguaacagcagag

SEQ ID NO: 773577 - RNA, 22 nt, Human
uugcauuacauuugcucagucu

SEQ ID NO: 773578 - RNA, 22 nt, Human
uggcagcagcuaacuuaggcag

SEQ ID NO: 773579 - RNA, 19 nt, Human
gcaucauuugucucuucuu

SEQ ID NO: 773580 - RNA, 22 nt, Human
uugauucagaaaaagauggaga

SEQ ID NO: 773581 - RNA, 22 nt, Human
auugucuuuggugcuuccagga

SEQ ID NO: 773582 - RNA, 22 nt, Human
cagggcugcuggccgugcccuc

SEQ ID NO: 773583 - RNA, 22 nt, Human
acagccagugcuccgugaggac

SEQ ID NO: 773584 - RNA, 22 nt, Human
ccacaggacaguuaaugugcag

SEQ ID NO: 773585 - RNA, 22 nt, Human
ucaccagggcuccagccagccu

SEQ ID NO: 773586 - RNA, 22 nt, Human
cauguguaaggcucacaggcag

SEQ ID NO: 773587 - RNA, 22 nt, Human
aguguguagcauuuggcaggca

SEQ ID NO: 773588 - RNA, 22 nt, Human
uucagagacagcaaccaggaca

SEQ ID NO: 773589 - RNA, 19 nt, Human
cugagucaaagguuguggg

SEQ ID NO: 773590 - RNA, 22 nt, Human
cagggaagagccgaugcugcag

SEQ ID NO: 773591 - RNA, 22 nt, Human
cugaauaauuuucuguuguaug

SEQ ID NO: 773592 - RNA, 22 nt, Human
gcauugaauccuaucaggcaaa

SEQ ID NO: 773593 - RNA, 22 nt, Human
caccaggggcagagaccaaagu

SEQ ID NO: 773594 - RNA, 22 nt, Human
uucaagacugcgacuaaugccc

SEQ ID NO: 773595 - RNA, 22 nt, Human
agcuccccucguuucucuccau

SEQ ID NO: 773596 - RNA, 22 nt, Human
acagcagauuucccugggcucc

SEQ ID NO: 773597 - RNA, 22 nt, Human
auccagcuuugucuggucuucg

SEQ ID NO: 773598 - RNA, 22 nt, Human
gggcaugccugagccugccacu

SEQ ID NO: 773599 - RNA, 22 nt, Human
ucuccuggccuuuagguuaagg

SEQ ID NO: 773600 - RNA, 22 nt, Human
ccaggccuggacggguggccug

SEQ ID NO: 773601 - RNA, 22 nt, Human
aagacauuggcauugacuguaa

SEQ ID NO: 773602 - RNA, 22 nt, Human
cuauuuguaaagugccuggugu

SEQ ID NO: 773603 - RNA, 22 nt, Human
gaggaagaauugguuauuggag

SEQ ID NO: 773604 - RNA, 22 nt, Human
uggaagaccagacuucccgaac

SEQ ID NO: 773605 - RNA, 22 nt, Human
ucaaagaacaucaucugaaaug

SEQ ID NO: 773606 - RNA, 22 nt, Human
ugcagggccaugguggcggcug

SEQ ID NO: 773607 - RNA, 21 nt, Human
cuuugguuuccuccugccuuc

SEQ ID NO: 773608 - RNA, 22 nt, Human
uuucuaagacauuugucaucuu

SEQ ID NO: 773609 - RNA, 22 nt, Human
uuuccaggagaaagagagccuu

SEQ ID NO: 773610 - RNA, 22 nt, Human
ugcuuggagaaucagucccagc

SEQ ID NO: 773611 - RNA, 22 nt, Human
cucugugauuuugugagccaga

SEQ ID NO: 773612 - RNA, 22 nt, Human
cucaucaccacauauaacaaag

SEQ ID NO: 773613 - RNA, 22 nt, Human
uagagaugugauauagcagagu

SEQ ID NO: 773614 - RNA, 22 nt, Human
ccaggccuucugaggacacucu

SEQ ID NO: 773615 - RNA, 22 nt, Human
agccagaaaaacaccaagagga

SEQ ID NO: 773616 - RNA, 22 nt, Human
gaggccacggaagggagcugug

SEQ ID NO: 773617 - RNA, 22 nt, Human
gcucugggccgggcaccagccu

SEQ ID NO: 773618 - RNA, 22 nt, Human
ucaugacaucuguuuaucucaa

SEQ ID NO: 773619 - RNA, 22 nt, Human
gaaagguuuggcuuuucaguag

SEQ ID NO: 773620 - RNA, 22 nt, Human
ggacaaaucucauuauuucuga

SEQ ID NO: 773621 - RNA, 22 nt, Human
aggaugugagccagccuggccu

SEQ ID NO: 773622 - RNA, 22 nt, Human
agguacauggggugugugcacg

SEQ ID NO: 773623 - RNA, 22 nt, Human
ggcaucuguccaucucuccagc

SEQ ID NO: 773624 - RNA, 22 nt, Human
aagauuucugcuccugagagaa

SEQ ID NO: 773625 - RNA, 22 nt, Human
ccucuggccacaugggacauag

SEQ ID NO: 773626 - RNA, 22 nt, Human
aguaacagaaggccugacuuaa

SEQ ID NO: 773627 - RNA, 22 nt, Human
gcuggcuggaggugaggaagaa

SEQ ID NO: 773628 - RNA, 22 nt, Human
cugcccagaagcuuagagcuua

SEQ ID NO: 773629 - RNA, 22 nt, Human
gacaggcuagguugcuguccuc

SEQ ID NO: 773630 - RNA, 22 nt, Human
caggaaauucuuuuguuugugc

SEQ ID NO: 773631 - RNA, 22 nt, Human
ggcagugccugaugcugcagga

SEQ ID NO: 773632 - RNA, 22 nt, Human
gcuguccugggaacaggcacua

SEQ ID NO: 773633 - RNA, 22 nt, Human
auucuaaagcuuguggagcuua

SEQ ID NO: 773634 - RNA, 22 nt, Human
ugcuggccuguccacgggcugu

SEQ ID NO: 773635 - RNA, 22 nt, Human
ucaaaugaggcugaugaaugug

SEQ ID NO: 773636 - RNA, 22 nt, Human
agaagcagcuuucaaggugauu

SEQ ID NO: 773637 - RNA, 22 nt, Human
agcagcugccagagagaguucc

SEQ ID NO: 773638 - RNA, 22 nt, Human
gccugggauucccagaggggca

SEQ ID NO: 773639 - RNA, 22 nt, Human
agaccagcugccucccagggcc

SEQ ID NO: 773640 - RNA, 22 nt, Human
caggggacauuaaagcuccaua

SEQ ID NO: 773641 - RNA, 22 nt, Human
ggccuggaguuuggggaauaga

SEQ ID NO: 773642 - RNA, 22 nt, Human
ucugcaaauauuagcuuagaca

SEQ ID NO: 773643 - RNA, 22 nt, Human
agagcuccgugccuggcugcca

SEQ ID NO: 773644 - RNA, 22 nt, Human
cugucccucaucaccucugggu

SEQ ID NO: 773645 - RNA, 22 nt, Human
caggccugcaggaaaggcuccc

SEQ ID NO: 773646 - RNA, 22 nt, Human
aauguuugagcaucuacaugcu

SEQ ID NO: 773647 - RNA, 22 nt, Human
gcuguguaccuacuaacugcuu

SEQ ID NO: 773648 - RNA, 22 nt, Human
acagguguagcaggagcaucaa

SEQ ID NO: 773649 - RNA, 22 nt, Human
aggggugaaggcccgauaggag

SEQ ID NO: 773650 - RNA, 22 nt, Human
ccuucaaaacacuaguuuuuga

SEQ ID NO: 773651 - RNA, 20 nt, Human
acugggccuaggggaggcau

SEQ ID NO: 773652 - RNA, 22 nt, Human
ucucccucuuugucugcuuugg

SEQ ID NO: 773653 - RNA, 22 nt, Human
acauucuaacauuguacagaua

SEQ ID NO: 773654 - RNA, 22 nt, Human
agcauuuaggagaauuugagaa

SEQ ID NO: 773655 - RNA, 22 nt, Human
ccagggaaacagcccaguguga

SEQ ID NO: 773656 - RNA, 22 nt, Human
agaaaacuugucacagcucuca

SEQ ID NO: 773657 - RNA, 22 nt, Human
cucugggugagacagaccuggu

SEQ ID NO: 773658 - RNA, 22 nt, Human
agaaucuaaguacacagacaga

SEQ ID NO: 773659 - RNA, 22 nt, Human
ggcugugagcaggcagaaugcu

SEQ ID NO: 773660 - RNA, 22 nt, Human
cagugcuggagauggguggaac

SEQ ID NO: 773661 - RNA, 22 nt, Human
ucuuuaaugugauuguaauuau

SEQ ID NO: 773662 - RNA, 22 nt, Human
uggacugauuuucauuuuaaau

SEQ ID NO: 773663 - RNA, 22 nt, Human
agaugcugccaggccccucagu

SEQ ID NO: 773664 - RNA, 22 nt, Human
ugggcagacgcuguuggaaggc

SEQ ID NO: 773665 - RNA, 22 nt, Human
gggagcaggacauaauagcaau

SEQ ID NO: 773666 - RNA, 22 nt, Human
gugucaugggguuuguuauaca

SEQ ID NO: 773667 - RNA, 22 nt, Human
augcuucuuguauuuggcugac

SEQ ID NO: 773668 - RNA, 22 nt, Human
augcuaaauccagaagcaguca

SEQ ID NO: 773669 - RNA, 18 nt, Human
ugccagccgacuggccug

SEQ ID NO: 773670 - RNA, 22 nt, Human
aaacacuuuagaaagggacuug

SEQ ID NO: 773671 - RNA, 22 nt, Human
ccugggugaaaucucuccugca

SEQ ID NO: 773672 - RNA, 22 nt, Human
cucacuggcaagacuacaggug

SEQ ID NO: 773673 - RNA, 22 nt, Human
ugaggacauugagacuggagac

SEQ ID NO: 773674 - RNA, 22 nt, Human
ggaagauuucccguagcugugc

SEQ ID NO: 773675 - RNA, 22 nt, Human
caggagguggagcucaaguggu

SEQ ID NO: 773676 - RNA, 22 nt, Human
acacacacaagcagguugugga

SEQ ID NO: 773677 - RNA, 22 nt, Human
ccaaggugggcagaucacgagg

SEQ ID NO: 773678 - RNA, 22 nt, Human
cagugcuuuuaaaacaacauca

SEQ ID NO: 773679 - RNA, 20 nt, Human
aucuugggauugagauugcc

SEQ ID NO: 773680 - RNA, 22 nt, Human
caugugugguuaccuacuugac

SEQ ID NO: 773681 - RNA, 22 nt, Human
acaaggcuuuggaggguucuua

SEQ ID NO: 773682 - RNA, 22 nt, Human
aauucagugguuucugcaacaa

SEQ ID NO: 773683 - RNA, 22 nt, Human
cuugcuggugguguuuucuaug

SEQ ID NO: 773684 - RNA, 22 nt, Human
ccugucaguugcugucagggau

SEQ ID NO: 773685 - RNA, 22 nt, Human
aaaguucagugccuucuauaca

SEQ ID NO: 773686 - RNA, 22 nt, Human
ucacccccuguauuaguagcua

SEQ ID NO: 773687 - RNA, 22 nt, Human
gacugaggugaccuaggacuac

SEQ ID NO: 773688 - RNA, 19 nt, Human
aagagggaaagugcuaugc

SEQ ID NO: 773689 - RNA, 22 nt, Human
ucuggcucaaaauacguacucu

SEQ ID NO: 773690 - RNA, 22 nt, Human
uuccaagugcccauauuucauc

SEQ ID NO: 773691 - RNA, 22 nt, Human
agcagaugcgucugagugggag

SEQ ID NO: 773692 - RNA, 22 nt, Human
uaggagaagagucagggccuaa

SEQ ID NO: 773693 - RNA, 22 nt, Human
gucaggggccaugggccaagga

SEQ ID NO: 773694 - RNA, 17 nt, Human
caauuucauagguuuug

SEQ ID NO: 773695 - RNA, 22 nt, Human
uggcuucucauuugcauuaaac

SEQ ID NO: 773696 - RNA, 22 nt, Human
gucauuuaaagaccauuguggg

SEQ ID NO: 773697 - RNA, 22 nt, Human
gcuguggguacaaauacacaau

SEQ ID NO: 773698 - RNA, 22 nt, Human
cuccuggcacucaguguggaag

SEQ ID NO: 773699 - RNA, 22 nt, Human
acugagagcguguacaaacuua

SEQ ID NO: 773700 - RNA, 22 nt, Human
ccucagugaccuauugcauuca

SEQ ID NO: 773701 - RNA, 22 nt, Human
uccagggcuugacagggugccu

SEQ ID NO: 773702 - RNA, 22 nt, Human
agggccuggugaccuggguccu

SEQ ID NO: 773703 - RNA, 22 nt, Human
auagaacagaaacagaugcaca

SEQ ID NO: 773704 - RNA, 22 nt, Human
cauggcuuuugcuuuugcccau

SEQ ID NO: 773705 - RNA, 22 nt, Human
cauuuguaggaugcuucuuguu

SEQ ID NO: 773706 - RNA, 22 nt, Human
gagguggcuccuucagggaaua

SEQ ID NO: 773707 - RNA, 22 nt, Human
cagagaugugauccagcugucu

SEQ ID NO: 773708 - RNA, 22 nt, Human
uucaacaucuuggagcuggaac

SEQ ID NO: 773709 - RNA, 22 nt, Human
cuugcugugugccaucagggcu

SEQ ID NO: 773710 - RNA, 22 nt, Human
agggagugguuaagaaggugca

SEQ ID NO: 773711 - RNA, 22 nt, Human
aggccuccuggcuccaggccuu

SEQ ID NO: 773712 - RNA, 22 nt, Human
gagaauuacuguuuuuauaaca

SEQ ID NO: 773713 - RNA, 22 nt, Human
cagagcagggguuucccagguu

SEQ ID NO: 773714 - RNA, 18 nt, Human
uggagagcagcagugggg

SEQ ID NO: 773715 - RNA, 20 nt, Human
gaugggaaucggagcuggua

SEQ ID NO: 773716 - RNA, 22 nt, Human
ggcucuugcccgcccaggcugg

SEQ ID NO: 773717 - RNA, 21 nt, Human
ucugggcuuucuuauaaggca

SEQ ID NO: 773718 - RNA, 22 nt, Human
ccagcuuuuccucucauugcuu

SEQ ID NO: 773719 - RNA, 22 nt, Human
aacaggaccccgcguggugucu

SEQ ID NO: 773720 - RNA, 22 nt, Human
ggcccagcccgagucagccuuc

SEQ ID NO: 773721 - RNA, 22 nt, Human
ucccaggagcaccuuuugagcc

SEQ ID NO: 773722 - RNA, 22 nt, Human
cccuccugugccugaggccagc

SEQ ID NO: 773723 - RNA, 22 nt, Human
agguaauuacuagaguuauuua

SEQ ID NO: 773724 - RNA, 22 nt, Human
aagacuugaccagguugaaggc

SEQ ID NO: 773725 - RNA, 22 nt, Human
ggacagugaaucuggagguaua

SEQ ID NO: 773726 - RNA, 22 nt, Human
gcaaggauguacugcaauagga

SEQ ID NO: 773727 - RNA, 22 nt, Human
agcuuacaccccccaagauucu

SEQ ID NO: 773728 - RNA, 22 nt, Human
cuucaccuccuccucugugggc

SEQ ID NO: 773729 - RNA, 22 nt, Human
cucauucuuucacagucugugg

SEQ ID NO: 773730 - RNA, 22 nt, Human
ugcuggggcucugaccacucca

SEQ ID NO: 773731 - RNA, 22 nt, Human
auguggccuuagguucuagugg

SEQ ID NO: 773732 - RNA, 22 nt, Human
agagggcauaaaauagagcacg

SEQ ID NO: 773733 - RNA, 22 nt, Human
uuaaacaccugucuaguguagc

SEQ ID NO: 773734 - RNA, 20 nt, Human
ugacacaaauugcuuucuca

SEQ ID NO: 773735 - RNA, 22 nt, Human
agcagcuggugcaacucuaaga

SEQ ID NO: 773736 - RNA, 22 nt, Human
agauguggccggcuagggagag

SEQ ID NO: 773737 - RNA, 22 nt, Human
acacaugauaagaaaguuuaaa

SEQ ID NO: 773738 - RNA, 22 nt, Human
ucagcaucacgugguccgagaa

SEQ ID NO: 773739 - RNA, 22 nt, Human
uuuacagugagagcuuagugag

SEQ ID NO: 773740 - RNA, 22 nt, Human
ccagggagccuggugugucagc

SEQ ID NO: 773741 - RNA, 21 nt, Human
gauugaaaccauggcagugag

SEQ ID NO: 773742 - RNA, 22 nt, Human
ccagcucucuuugaagcauaaa

SEQ ID NO: 773743 - RNA, 22 nt, Human
cuggugccuccucccugugcuu

SEQ ID NO: 773744 - RNA, 22 nt, Human
aagagaaggcccugacccaccc

SEQ ID NO: 773745 - RNA, 22 nt, Human
ugcaggaggcuuuauucaggau

SEQ ID NO: 773746 - RNA, 22 nt, Human
ccucaaauagcccccagucuag

SEQ ID NO: 773747 - RNA, 22 nt, Human
ucucugucugcacccaaucaau

SEQ ID NO: 773748 - RNA, 19 nt, Human
ccuccccuuggaccagcaa

SEQ ID NO: 773749 - RNA, 22 nt, Human
uuuugguucugggauacagaga

SEQ ID NO: 773750 - RNA, 22 nt, Human
aacacugagaggggaguggcac

SEQ ID NO: 773751 - RNA, 22 nt, Human
cacaagggcuuuguaggcuuug

SEQ ID NO: 773752 - RNA, 22 nt, Human
uccaggcaugucugaguccuuc

SEQ ID NO: 773753 - RNA, 22 nt, Human
uucuuauuuuccugaggaagaa

SEQ ID NO: 773754 - RNA, 22 nt, Human
cuuggccugcccagccagaagg

SEQ ID NO: 773755 - RNA, 22 nt, Human
aaaauuauagaucuagugccug

SEQ ID NO: 773756 - RNA, 22 nt, Human
agccaggcggggcagguuuccu

SEQ ID NO: 773757 - RNA, 22 nt, Human
aggcauugcugguauuggaagu

SEQ ID NO: 773758 - RNA, 22 nt, Human
uguacacauuuuuauguuaaca

SEQ ID NO: 773759 - RNA, 18 nt, Human
gcuucauggaaggguugu

SEQ ID NO: 773760 - RNA, 22 nt, Human
aagcugaagacacagcuccagu

SEQ ID NO: 773761 - RNA, 22 nt, Human
gaaccucuauauuugugacauc

SEQ ID NO: 773762 - RNA, 22 nt, Human
aaacugcagccuugaguucagg

SEQ ID NO: 773763 - RNA, 22 nt, Human
auguuuuauauuuugcagcagu

SEQ ID NO: 773764 - RNA, 22 nt, Human
acugagguggggucugcuugga

SEQ ID NO: 773765 - RNA, 22 nt, Human
auuuccucaugaucauaaugca

SEQ ID NO: 773766 - RNA, 22 nt, Human
agucacaugcauuuucuucaau

SEQ ID NO: 773767 - RNA, 22 nt, Human
uggacagguugaguaggaggag

SEQ ID NO: 773768 - RNA, 21 nt, Human
cucagggcuugguguccucau

SEQ ID NO: 773769 - RNA, 21 nt, Human
uccacaaguuagaaggaaauu

SEQ ID NO: 773770 - RNA, 22 nt, Human
uuaugaaggaucagguacuugg

SEQ ID NO: 773771 - RNA, 19 nt, Human
ccuggcugugaagccugca

SEQ ID NO: 773772 - RNA, 22 nt, Human
ugaauggauauaacaacagugu

SEQ ID NO: 773773 - RNA, 22 nt, Human
aacccaggaggcagaggcugca

SEQ ID NO: 773774 - RNA, 22 nt, Human
agagcaggcauaaagcuuugaa

SEQ ID NO: 773775 - RNA, 22 nt, Human
gcuggcagguaaagccccgggg

SEQ ID NO: 773776 - RNA, 22 nt, Human
ugugggcacuaaugacaugcag

SEQ ID NO: 773777 - RNA, 22 nt, Human
cucugagacucaagugaguggg

SEQ ID NO: 773778 - RNA, 22 nt, Human
uccuucagcucucuauuuagau

SEQ ID NO: 773779 - RNA, 22 nt, Human
ccucuucucaacuccagccaga

SEQ ID NO: 773780 - RNA, 22 nt, Human
gucugggguacuuucaucugau

SEQ ID NO: 773781 - RNA, 19 nt, Human
uccuucacuucuuaccagg

SEQ ID NO: 773782 - RNA, 22 nt, Human
ugcccucagcagcagcuccugc

SEQ ID NO: 773783 - RNA, 22 nt, Human
ccccaggagaaaucuuaaacua

SEQ ID NO: 773784 - RNA, 22 nt, Human
acacaggacagggauguguuuu

SEQ ID NO: 773785 - RNA, 22 nt, Human
agcucccagucuccucuccaug

SEQ ID NO: 773786 - RNA, 22 nt, Human
ccaggagcaacuugaaggcaag

SEQ ID NO: 773787 - RNA, 22 nt, Human
ucucugugaauggcgucaccug

SEQ ID NO: 773788 - RNA, 18 nt, Human
ccagagcuggcuccucgc

SEQ ID NO: 773789 - RNA, 19 nt, Human
cuccaaguuaagagggagg

SEQ ID NO: 773790 - RNA, 22 nt, Human
cugcuucuagcaccaagucccu

SEQ ID NO: 773791 - RNA, 22 nt, Human
augugugccugagugauggacu

SEQ ID NO: 773792 - RNA, 22 nt, Human
cagaagccugccucagaugcac

SEQ ID NO: 773793 - RNA, 22 nt, Human
agaauacaguaugcaaaaagau

SEQ ID NO: 773794 - RNA, 20 nt, Human
uuucacuguggugcuggaga

SEQ ID NO: 773795 - RNA, 22 nt, Human
gagggcugugaaggagcggguu

SEQ ID NO: 773796 - RNA, 17 nt, Human
caguggucugagguaug

SEQ ID NO: 773797 - RNA, 22 nt, Human
augcuguguccuagugaaagaa

SEQ ID NO: 773798 - RNA, 18 nt, Human
gucuguguggcuugggga

SEQ ID NO: 773799 - RNA, 22 nt, Human
agaacaggaggaagccagcucc

SEQ ID NO: 773800 - RNA, 22 nt, Human
ccagaagacaagaauguucuua

SEQ ID NO: 773801 - RNA, 22 nt, Human
cuuguccuuuacuugagacuca

SEQ ID NO: 773802 - RNA, 23 nt, Human
agcagguagguugaaauuuuccu

SEQ ID NO: 773803 - RNA, 22 nt, Human
uagcagcauuuuuguagaguau

SEQ ID NO: 773804 - RNA, 22 nt, Human
aggaugccuucauugcauggcc

SEQ ID NO: 773805 - RNA, 22 nt, Human
agcccugguagccugcugccau

SEQ ID NO: 773806 - RNA, 22 nt, Human
ucacugggagagcugacaagga

SEQ ID NO: 773807 - RNA, 22 nt, Human
ccuauugacaauucucuucucc

SEQ ID NO: 773808 - RNA, 22 nt, Human
uauuuggaauagcuugcuaaug

SEQ ID NO: 773809 - RNA, 22 nt, Human
auucagacucuugagcaguccc

SEQ ID NO: 773810 - RNA, 22 nt, Human
aggcuggagugcaauggcguga

SEQ ID NO: 773811 - RNA, 20 nt, Human
gagacagcaaaagccucucc

SEQ ID NO: 773812 - RNA, 22 nt, Human
auaaccugguaguauuaaaugu

SEQ ID NO: 773813 - RNA, 22 nt, Human
auucugaugcuucacaaaggua

SEQ ID NO: 773814 - RNA, 22 nt, Human
ccugugugauuggaagcugaga

SEQ ID NO: 773815 - RNA, 22 nt, Human
acaauauacacauccuaauggg

SEQ ID NO: 773816 - RNA, 22 nt, Human
aggcucugugcauccuccccaa

SEQ ID NO: 773817 - RNA, 22 nt, Human
ucagaacauugacauucuuauu

SEQ ID NO: 773818 - RNA, 23 nt, Human
ccucuccagacacugggccuugu

SEQ ID NO: 773819 - RNA, 22 nt, Human
acaggguuguggccuuaaaggc

SEQ ID NO: 773820 - RNA, 22 nt, Human
cgaagacagaccaucugaguag

SEQ ID NO: 773821 - RNA, 21 nt, Human
aguuaaaccuuuagagaacua

SEQ ID NO: 773822 - RNA, 22 nt, Human
uaagguuugcuuaucuucgccu

SEQ ID NO: 773823 - RNA, 22 nt, Human
aauguguuaguauugauuuguc

SEQ ID NO: 773824 - RNA, 22 nt, Human
agccuaggagguuggggcugca

SEQ ID NO: 773825 - RNA, 22 nt, Human
cuguauuuguccucuauuuauu

SEQ ID NO: 773826 - RNA, 21 nt, Human
auugcucuguugugucuagaa

SEQ ID NO: 773827 - RNA, 22 nt, Human
ucugcuguauuagguugaacug

SEQ ID NO: 773828 - RNA, 22 nt, Human
gcuacagacugagcauggcucu

SEQ ID NO: 773829 - RNA, 22 nt, Human
aaagcaaugcuuguggaaugua

SEQ ID NO: 773830 - RNA, 22 nt, Human
gaugcaaagauaaaacagacgc

SEQ ID NO: 773831 - RNA, 22 nt, Human
gggcugcuacgagaacugaaua

SEQ ID NO: 773832 - RNA, 22 nt, Human
aggugggcacaccucccuucuc

SEQ ID NO: 773833 - RNA, 22 nt, Human
ugcccuccacaguggcuccacc

SEQ ID NO: 773834 - RNA, 22 nt, Human
gaaaaucugcuuauauuauuuu

SEQ ID NO: 773835 - RNA, 22 nt, Human
uuacaugacaaagcuuuggcuc

SEQ ID NO: 773836 - RNA, 21 nt, Human
gccagggaagagaguuggcug

SEQ ID NO: 773837 - RNA, 22 nt, Human
guucaaauuuucuaggugggug

SEQ ID NO: 773838 - RNA, 22 nt, Human
uucaaaucccugcuccacuauu

SEQ ID NO: 773839 - RNA, 22 nt, Human
caaauagugucacauugugagg

SEQ ID NO: 773840 - RNA, 22 nt, Human
gccugcuggaggagccucaggg

SEQ ID NO: 773841 - RNA, 22 nt, Human
uugucugcuccucccagccuca

SEQ ID NO: 773842 - RNA, 22 nt, Human
cugcugugcauauuuaucuagg

SEQ ID NO: 773843 - RNA, 22 nt, Human
cuuuagauuucuauguaucacu

SEQ ID NO: 773844 - RNA, 22 nt, Human
gcucccugccuacacggaccuu

SEQ ID NO: 773845 - RNA, 22 nt, Human
guguuuaugagugaccuugucu

SEQ ID NO: 773846 - RNA, 22 nt, Human
augaaauucaucugagaaugcu

SEQ ID NO: 773847 - RNA, 22 nt, Human
aaucuuuuaggggauccugagg

SEQ ID NO: 773848 - RNA, 19 nt, Human
ggcagcucuugucuucugc

SEQ ID NO: 773849 - RNA, 22 nt, Human
uaggcaggugugcacugcccac

SEQ ID NO: 773850 - RNA, 22 nt, Human
auggaaauguuaagucaguccg

SEQ ID NO: 773851 - RNA, 19 nt, Human
uuccuuagaggaggcggug

SEQ ID NO: 773852 - RNA, 22 nt, Human
auauuuguuagagucuaugugu

SEQ ID NO: 773853 - RNA, 22 nt, Human
accgaaggaaacuggaaccguu

SEQ ID NO: 773854 - RNA, 22 nt, Human
uguucuuucaguuagacacagu

SEQ ID NO: 773855 - RNA, 22 nt, Human
uggucccugccugccaagugcu

SEQ ID NO: 773856 - RNA, 22 nt, Human
gccuggaguuguggugaagcca

SEQ ID NO: 773857 - RNA, 22 nt, Human
ugaagcuugagugucaguuccu

SEQ ID NO: 773858 - RNA, 23 nt, Human
ucacagagcauacugcauuuugc

SEQ ID NO: 773859 - RNA, 22 nt, Human
uccagagcuguccuacugugag

SEQ ID NO: 773860 - RNA, 22 nt, Human
ugcuuuauuuauaaaauagcaa

SEQ ID NO: 773861 - RNA, 22 nt, Human
agcugcagcuguuuucugagug

SEQ ID NO: 773862 - RNA, 22 nt, Human
cagagguagaacuggcccucac

SEQ ID NO: 773863 - RNA, 22 nt, Human
guggccagaaccaggagaauga

SEQ ID NO: 773864 - RNA, 22 nt, Human
gagcaucucuauagugacugug

SEQ ID NO: 773865 - RNA, 22 nt, Human
uugaguucuggucuuuuaaaag

SEQ ID NO: 773866 - RNA, 22 nt, Human
cugcugggcagaggcugcauga

SEQ ID NO: 773867 - RNA, 22 nt, Human
guguauggacacaugucauguu

SEQ ID NO: 773868 - RNA, 19 nt, Human
agggaguuuauauuugcac

SEQ ID NO: 773869 - RNA, 22 nt, Human
uggaaaggacaguugcugauag

SEQ ID NO: 773870 - RNA, 22 nt, Human
ccugucugaaggcagggggaug

SEQ ID NO: 773871 - RNA, 22 nt, Human
acaggacaauuuauaaugggca

SEQ ID NO: 773872 - RNA, 22 nt, Human
ugaagccacagagcaucugccu

SEQ ID NO: 773873 - RNA, 20 nt, Human
aucaaaggcugauucagucc

SEQ ID NO: 773874 - RNA, 22 nt, Human
ccuugcucaucccccagugccu

SEQ ID NO: 773875 - RNA, 22 nt, Human
gccucaggccuauagcugcugu

SEQ ID NO: 773876 - RNA, 22 nt, Human
ugguagcaacaucucaguggcu

SEQ ID NO: 773877 - RNA, 22 nt, Human
cugggagauugcuagagaugca

SEQ ID NO: 773878 - RNA, 22 nt, Human
cccuucccuucugggagaucca

SEQ ID NO: 773879 - RNA, 22 nt, Human
gcacuugucaaauauuauagua

SEQ ID NO: 773880 - RNA, 22 nt, Human
agagaaggucacuaaggaccca

SEQ ID NO: 773881 - RNA, 22 nt, Human
caauaagauguauugagcagag

SEQ ID NO: 773882 - RNA, 22 nt, Human
cuucagcaccauagcuccuucu

SEQ ID NO: 773883 - RNA, 21 nt, Human
auuuucugugauagcugucuc

SEQ ID NO: 773884 - RNA, 22 nt, Human
ucagagcagacuuugaaggagg

SEQ ID NO: 773885 - RNA, 22 nt, Human
ucccagcugcugagauagugcu

SEQ ID NO: 773886 - RNA, 22 nt, Human
ggacugaaaucuuuccauguca

SEQ ID NO: 773887 - RNA, 22 nt, Human
aagccacuuggggaaagaugga

SEQ ID NO: 773888 - RNA, 20 nt, Human
gggagcuggaauugucuuag

SEQ ID NO: 773889 - RNA, 22 nt, Human
auggcagagaaagcgagccaca

SEQ ID NO: 773890 - RNA, 22 nt, Human
acaggaugggcgcacagagcua

SEQ ID NO: 773891 - RNA, 22 nt, Human
acaacacauguguauaugugug

SEQ ID NO: 773892 - RNA, 22 nt, Human
ggcagguggaaggucuccauuc

SEQ ID NO: 773893 - RNA, 20 nt, Human
cucuuaaauguaaaguaggc

SEQ ID NO: 773894 - RNA, 22 nt, Human
auugaguaguaggaaaauaacu

SEQ ID NO: 773895 - RNA, 22 nt, Human
agucuacaaagggaagcccuuu

SEQ ID NO: 773896 - RNA, 22 nt, Human
aggacccagaggcagaggacgu

SEQ ID NO: 773897 - RNA, 22 nt, Human
uucagcagguggugaguucugc

SEQ ID NO: 773898 - RNA, 22 nt, Human
uuacauguggagucugauugca

SEQ ID NO: 773899 - RNA, 22 nt, Human
cuguaugugaaaaugucaagug

SEQ ID NO: 773900 - RNA, 22 nt, Human
aucaggaagaauuggaugcuac

SEQ ID NO: 773901 - RNA, 21 nt, Human
uggcuucagccauuuucucug

SEQ ID NO: 773902 - RNA, 22 nt, Human
guuaaugccuacauauuaagca

SEQ ID NO: 773903 - RNA, 22 nt, Human
gugcagagugucuguggacuga

SEQ ID NO: 773904 - RNA, 22 nt, Human
aucugaagaggucauggcugac

SEQ ID NO: 773905 - RNA, 22 nt, Human
aguauuguaaacuuccuaagga

SEQ ID NO: 773906 - RNA, 22 nt, Human
uucuugauuagucucaugccaa

SEQ ID NO: 773907 - RNA, 22 nt, Human
gagagaggccuccauguacuga

SEQ ID NO: 773908 - RNA, 22 nt, Human
gggcacugaaugccaagcuagg

SEQ ID NO: 773909 - RNA, 22 nt, Human
ggagggcucgucauccaccacu

SEQ ID NO: 773910 - RNA, 22 nt, Human
auguuuuucauaccaguguugg

SEQ ID NO: 773911 - RNA, 22 nt, Human
cuggagaaguacugagacauuu

SEQ ID NO: 773912 - RNA, 22 nt, Human
cagagcuuucugucacauuagu

SEQ ID NO: 773913 - RNA, 22 nt, Human
aaaaggcucuucaaaauggaag

SEQ ID NO: 773914 - RNA, 22 nt, Human
gccugccugaaggcuguaccag

SEQ ID NO: 773915 - RNA, 22 nt, Human
ucugagaagcuagaggacaaag

SEQ ID NO: 773916 - RNA, 22 nt, Human
aguauguugacuuauucuugga

SEQ ID NO: 773917 - RNA, 22 nt, Human
gugguuuucuccaacccagaac

SEQ ID NO: 773918 - RNA, 22 nt, Human
guuuaauucccacaccugcccu

SEQ ID NO: 773919 - RNA, 22 nt, Human
uuucauuggcucccugaugaau

SEQ ID NO: 773920 - RNA, 22 nt, Human
gagguccucuguguccgcgggc

SEQ ID NO: 773921 - RNA, 22 nt, Human
aaaguucagauuagacucaaga

SEQ ID NO: 773922 - RNA, 22 nt, Human
uccagggccacagaggaugcua

SEQ ID NO: 773923 - RNA, 22 nt, Human
cuucugcaauaaguuuuggucc

SEQ ID NO: 773924 - RNA, 22 nt, Human
auuuaugacagaagauaugcug

SEQ ID NO: 773925 - RNA, 22 nt, Human
ccacaggggucucuguagcuga

SEQ ID NO: 773926 - RNA, 22 nt, Human
augcauaugugugcacacgugu

SEQ ID NO: 773927 - RNA, 22 nt, Human
acauggugugcugagaaugaca

SEQ ID NO: 773928 - RNA, 22 nt, Human
uccaugccaggcagucgaugca

SEQ ID NO: 773929 - RNA, 21 nt, Human
cacacaguggagugcccuugc

SEQ ID NO: 773930 - RNA, 23 nt, Human
agcuuugugaaagcagacauggg

SEQ ID NO: 773931 - RNA, 22 nt, Human
guucuccauucagcuuccugug

SEQ ID NO: 773932 - RNA, 22 nt, Human
gaggagacugacagcagauucu

SEQ ID NO: 773933 - RNA, 22 nt, Human
uugugagcaggcugcacaaacc

SEQ ID NO: 773934 - RNA, 22 nt, Human
ucucucuggagcuggggcauga

SEQ ID NO: 773935 - RNA, 22 nt, Human
ugcacagggagggggccagcuc

SEQ ID NO: 773936 - RNA, 22 nt, Human
ugaugagggcaguucuuguugc

SEQ ID NO: 773937 - RNA, 22 nt, Human
aaucuucacucauucagaguug

SEQ ID NO: 773938 - RNA, 22 nt, Human
aagcagcugcagguucaaagga

SEQ ID NO: 773939 - RNA, 22 nt, Human
ugcagauucaaaugaaaugcaa

SEQ ID NO: 773940 - RNA, 22 nt, Human
gaaucuuaccucucuauuguug

SEQ ID NO: 773941 - RNA, 22 nt, Human
uuguggcugucgagaauugagg

SEQ ID NO: 773942 - RNA, 23 nt, Human
ucagaauuccaguuucuuugaag

SEQ ID NO: 773943 - RNA, 22 nt, Human
cacagaacaccaaagaaccuuc

SEQ ID NO: 773944 - RNA, 20 nt, Human
auagaaguauuauguaaugu

SEQ ID NO: 773945 - RNA, 22 nt, Human
aaaugcucucuaauguaauaca

SEQ ID NO: 773946 - RNA, 22 nt, Human
uauuugucaccuauggcugucc

SEQ ID NO: 773947 - RNA, 22 nt, Human
ggaggaagcccucggugcccca

SEQ ID NO: 773948 - RNA, 16 nt, Human
augcugcuauuagagg

SEQ ID NO: 773949 - RNA, 22 nt, Human
ugcaauuuuuaucaauucagca

SEQ ID NO: 773950 - RNA, 22 nt, Human
aagcagcagaccugauuuugaa

SEQ ID NO: 773951 - RNA, 22 nt, Human
cuggggacugaaggauguugcu

SEQ ID NO: 773952 - RNA, 22 nt, Human
uucuacagacuauaacugugau

SEQ ID NO: 773953 - RNA, 22 nt, Human
auaguguguuagugacauaggc

SEQ ID NO: 773954 - RNA, 22 nt, Human
uccugaacagcuccugagcaug

SEQ ID NO: 773955 - RNA, 19 nt, Human
ugcagcugucucuauauua

SEQ ID NO: 773956 - RNA, 22 nt, Human
gccaggcaugggcuucugggcg

SEQ ID NO: 773957 - RNA, 22 nt, Human
ugcauguuauagaauuuuaacu

SEQ ID NO: 773958 - RNA, 21 nt, Human
augcauguuacaguauaugcc

SEQ ID NO: 773959 - RNA, 19 nt, Human
uguuggugcggauguggag

SEQ ID NO: 773960 - RNA, 22 nt, Human
acaugcauaagccuagccauca

SEQ ID NO: 773961 - RNA, 22 nt, Human
ggggccaguaggagugauguac

SEQ ID NO: 773962 - RNA, 22 nt, Human
cuuggagacauugaucuuuugc

SEQ ID NO: 773963 - RNA, 22 nt, Human
uuuauuuaccuuauguccucca

SEQ ID NO: 773964 - RNA, 22 nt, Human
aagcaggcgagggccuggagca

SEQ ID NO: 773965 - RNA, 22 nt, Human
acugcuucacugcgucuuaucu

SEQ ID NO: 773966 - RNA, 22 nt, Human
ucaggagaaggcaauguggaaa

SEQ ID NO: 773967 - RNA, 22 nt, Human
gcccaggaguucaagucuagug

SEQ ID NO: 773968 - RNA, 22 nt, Human
auauggaaauagcaauaugguu

SEQ ID NO: 773969 - RNA, 22 nt, Human
aucagaagaaauggaugugacu

SEQ ID NO: 773970 - RNA, 22 nt, Human
cccuggagcuagucugagcaga

SEQ ID NO: 773971 - RNA, 22 nt, Human
ucagcccuagccucaguccagg

SEQ ID NO: 773972 - RNA, 22 nt, Human
augaacaguaugcaacaugauu

SEQ ID NO: 773973 - RNA, 22 nt, Human
ucacacuuagagcgaauuguuu

SEQ ID NO: 773974 - RNA, 22 nt, Human
agcaggaaguagucuguaagca

SEQ ID NO: 773975 - RNA, 22 nt, Human
uguacaaugcugagguuugggg

SEQ ID NO: 773976 - RNA, 22 nt, Human
gguuaaaacugauauuaugggu

SEQ ID NO: 773977 - RNA, 22 nt, Human
agaugcugccucuccucacaag

SEQ ID NO: 773978 - RNA, 22 nt, Human
aaccagcuaacauguggaauga

SEQ ID NO: 773979 - RNA, 22 nt, Human
uuucugacacaucaguuguaaa

SEQ ID NO: 773980 - RNA, 22 nt, Human
ucugugauagguggcauaguga

SEQ ID NO: 773981 - RNA, 22 nt, Human
augaaaguguuuaaguuuaugu

SEQ ID NO: 773982 - RNA, 20 nt, Human
acuguguaaacaugauucau

SEQ ID NO: 773983 - RNA, 23 nt, Human
caacacugccuucaggugaagaa

SEQ ID NO: 773984 - RNA, 22 nt, Human
auuagaaugaaguauaggauuu

SEQ ID NO: 773985 - RNA, 22 nt, Human
uugaaaguuaucuagauucuga

SEQ ID NO: 773986 - RNA, 22 nt, Human
cacuguaauagcauuauaagug

SEQ ID NO: 773987 - RNA, 22 nt, Human
gccaccagcagaaaaggggcca

SEQ ID NO: 773988 - RNA, 22 nt, Human
ccagcucugauuuugaccucca

SEQ ID NO: 773989 - RNA, 22 nt, Human
acucuggccaggugcgguaugu

SEQ ID NO: 773990 - RNA, 22 nt, Human
auuuguguuguauuaagcugcu

SEQ ID NO: 773991 - RNA, 22 nt, Human
agugcaaagaaaucagcuuugu

SEQ ID NO: 773992 - RNA, 22 nt, Human
uuugaugcuaagauuuaauaaa

SEQ ID NO: 773993 - RNA, 22 nt, Human
cauuucuguacauguuuuggug

SEQ ID NO: 773994 - RNA, 22 nt, Human
ugucugcucgggguucccaccu

SEQ ID NO: 773995 - RNA, 22 nt, Human
ugcuuuuaggagauuaaaauua

SEQ ID NO: 773996 - RNA, 19 nt, Human
augaaugagcugugagguu

SEQ ID NO: 773997 - RNA, 22 nt, Human
aggcaggugcuuaugacuugcu

SEQ ID NO: 773998 - RNA, 23 nt, Human
ucugccagugugugccaggagcc

SEQ ID NO: 773999 - RNA, 22 nt, Human
uugccugugaacgcugaguccu

SEQ ID NO: 774000 - RNA, 22 nt, Human
aguguccccuccaagggccugg

SEQ ID NO: 774001 - RNA, 22 nt, Human
ccugcagagccacgugccagcg

SEQ ID NO: 774002 - RNA, 22 nt, Human
cugaacaguacuuggccaguuu

SEQ ID NO: 774003 - RNA, 22 nt, Human
ugucucuuacuuugauucuugg

SEQ ID NO: 774004 - RNA, 22 nt, Human
aaauauuguuuugguaagcuuc

SEQ ID NO: 774005 - RNA, 22 nt, Human
uuagaaccaggaacucuaauau

SEQ ID NO: 774006 - RNA, 22 nt, Human
uuguuacagcagcaauagaaaa

SEQ ID NO: 774007 - RNA, 22 nt, Human
auguacaaaauguuuugaaaug

SEQ ID NO: 774008 - RNA, 19 nt, Human
ugagacagagaccaguucu

SEQ ID NO: 774009 - RNA, 22 nt, Human
acauuuuuacugggcaucugca

SEQ ID NO: 774010 - RNA, 22 nt, Human
ggaaagagcccagcagugcuug

SEQ ID NO: 774011 - RNA, 22 nt, Human
ggcacucagagauucaggcugu

SEQ ID NO: 774012 - RNA, 22 nt, Human
aaccugagucuuuugauuugcu

SEQ ID NO: 774013 - RNA, 22 nt, Human
ggcugagggccagggcuagucu

SEQ ID NO: 774014 - RNA, 21 nt, Human
ucccacagaaacugcgaaauu

SEQ ID NO: 774015 - RNA, 22 nt, Human
uggaugugagaaggaucaggcu

SEQ ID NO: 774016 - RNA, 22 nt, Human
ggcugagggucccagacccuaa

SEQ ID NO: 774017 - RNA, 22 nt, Human
agugccuggcacauggaaggug

SEQ ID NO: 774018 - RNA, 22 nt, Human
uguccauggauagagcugcucg

SEQ ID NO: 774019 - RNA, 22 nt, Human
gagguagccacagauagagacu

SEQ ID NO: 774020 - RNA, 22 nt, Human
aaggaagacuugagaagguucc

SEQ ID NO: 774021 - RNA, 22 nt, Human
agcugcuuccucuuugauguca

SEQ ID NO: 774022 - RNA, 17 nt, Human
agggucaggugaaguuc

SEQ ID NO: 774023 - RNA, 22 nt, Human
aggaggcugggcacaguggccu

SEQ ID NO: 774024 - RNA, 22 nt, Human
aggcugaggugugcugugaucg

SEQ ID NO: 774025 - RNA, 22 nt, Human
gagaauuuucuaguaguuucau

SEQ ID NO: 774026 - RNA, 18 nt, Human
ugagcccuuaucuuuggc

SEQ ID NO: 774027 - RNA, 22 nt, Human
cccaugaacugucuugcuguag

SEQ ID NO: 774028 - RNA, 22 nt, Human
ggagcaucugaacagggagaag

SEQ ID NO: 774029 - RNA, 20 nt, Human
ggcugccuccuuccuuuccu

SEQ ID NO: 774030 - RNA, 22 nt, Human
uucugucuucccacugaggagc

SEQ ID NO: 774031 - RNA, 22 nt, Human
cagcuggcgccuggggaccaga

SEQ ID NO: 774032 - RNA, 22 nt, Human
gcuggccucuacaggccggcca

SEQ ID NO: 774033 - RNA, 22 nt, Human
aaacucuguauuugcugugggu

SEQ ID NO: 774034 - RNA, 22 nt, Human
aggcuggcgucaggggcuguac

SEQ ID NO: 774035 - RNA, 22 nt, Human
gggaguggauuauguggaccca

SEQ ID NO: 774036 - RNA, 22 nt, Human
agaaaggagaccagcucugccc

SEQ ID NO: 774037 - RNA, 22 nt, Human
ucauugauaaaguacugcuuuu

SEQ ID NO: 774038 - RNA, 22 nt, Human
gaaucuuuuuucuugccaggca

SEQ ID NO: 774039 - RNA, 22 nt, Human
caauuucaugccauguauugcu

SEQ ID NO: 774040 - RNA, 22 nt, Human
auggcauugcaagggcaggagg

SEQ ID NO: 774041 - RNA, 22 nt, Human
aagacaaugaguccugauggga

SEQ ID NO: 774042 - RNA, 22 nt, Human
aaaugacauuaggauccugcau

SEQ ID NO: 774043 - RNA, 22 nt, Human
uggcccugaggacccagugugg

SEQ ID NO: 774044 - RNA, 22 nt, Human
gcugcacuugagccugggagaa

SEQ ID NO: 774045 - RNA, 22 nt, Human
aacuacagcaucuauacaaaua

SEQ ID NO: 774046 - RNA, 22 nt, Human
ucaggcuuccaggcucugcuga

SEQ ID NO: 774047 - RNA, 22 nt, Human
guuugucuuaauuaggcaucga

SEQ ID NO: 774048 - RNA, 22 nt, Human
ggcuauggaagauaaggcugaa

SEQ ID NO: 774049 - RNA, 22 nt, Human
gcccagugcugagggugcugcu

SEQ ID NO: 774050 - RNA, 22 nt, Human
ucacugcaaucucugccuucca

SEQ ID NO: 774051 - RNA, 20 nt, Human
aagcagugaggugaggagug

SEQ ID NO: 774052 - RNA, 20 nt, Human
agcggcagcuuccugcuucg

SEQ ID NO: 774053 - RNA, 22 nt, Human
ggugaggguaaacuaaaacauc

SEQ ID NO: 774054 - RNA, 22 nt, Human
gucugcuggugccuggccugcg

SEQ ID NO: 774055 - RNA, 22 nt, Human
aacuugcuuauauuauuacauu

SEQ ID NO: 774056 - RNA, 22 nt, Human
uccaugcaaacaguggcuagcu

SEQ ID NO: 774057 - RNA, 22 nt, Human
uugugugcauaaauucugaugu

SEQ ID NO: 774058 - RNA, 22 nt, Human
aggcacuuuuugcauuuuagaa

SEQ ID NO: 774059 - RNA, 22 nt, Human
gcagcccaggaggcgggagccc

SEQ ID NO: 774060 - RNA, 22 nt, Human
cugguucugauuuugcugcauu

SEQ ID NO: 774061 - RNA, 22 nt, Human
ugguuccacuaaccugagagcc

SEQ ID NO: 774062 - RNA, 19 nt, Human
cugaagucuuuucagcugg

SEQ ID NO: 774063 - RNA, 21 nt, Human
ucucuuugggaacauuaauca

SEQ ID NO: 774064 - RNA, 22 nt, Human
acagggcuuuuaaucaguaguu

SEQ ID NO: 774065 - RNA, 22 nt, Human
acaggauaguuuuuaaucuucc

SEQ ID NO: 774066 - RNA, 22 nt, Human
gcagagaugggccagugacgca

SEQ ID NO: 774067 - RNA, 19 nt, Human
aguuauuucuaaauuuacc

SEQ ID NO: 774068 - RNA, 22 nt, Human
uuacuucuugucucaugccuau

SEQ ID NO: 774069 - RNA, 21 nt, Human
ucugcauuuuagcaagaucuc

SEQ ID NO: 774070 - RNA, 22 nt, Human
auucuuuuguccuagcuugaua

SEQ ID NO: 774071 - RNA, 22 nt, Human
gaaacaacuacuauugauuucu

SEQ ID NO: 774072 - RNA, 23 nt, Human
uucauuugucuacuucacuuguu

SEQ ID NO: 774073 - RNA, 22 nt, Human
cugcugugacagcugccguguu

SEQ ID NO: 774074 - RNA, 22 nt, Human
auuucuuacauaacaaauuguu

SEQ ID NO: 774075 - RNA, 22 nt, Human
gacagcaggagaucaugauaga

SEQ ID NO: 774076 - RNA, 22 nt, Human
ugccuacccaugguuagacaua

SEQ ID NO: 774077 - RNA, 22 nt, Human
gaagagcuuagacagaaucaaa

SEQ ID NO: 774078 - RNA, 22 nt, Human
caggccucuauggucagcugag

SEQ ID NO: 774079 - RNA, 22 nt, Human
acuucauucauuuucacgaaug

SEQ ID NO: 774080 - RNA, 22 nt, Human
aacuucauguaauuuaaaacag

SEQ ID NO: 774081 - RNA, 22 nt, Human
acacuucauuuacauuauaggc

SEQ ID NO: 774082 - RNA, 22 nt, Human
acaaagauucauuugcauuauu

SEQ ID NO: 774083 - RNA, 22 nt, Human
uuacauuuggcuauguccucua

SEQ ID NO: 774084 - RNA, 22 nt, Human
ucucaucugcgagcucugccag

SEQ ID NO: 774085 - RNA, 22 nt, Human
aaccuggccccagauuccccau

SEQ ID NO: 774086 - RNA, 22 nt, Human
cauuaucucuucuauaugcuag

SEQ ID NO: 774087 - RNA, 22 nt, Human
ccagccauaaacccagaugacu

SEQ ID NO: 774088 - RNA, 23 nt, Human
ucuuuucaaugguucuuuaugug

SEQ ID NO: 774089 - RNA, 22 nt, Human
cacccccaccugugggcuccug

SEQ ID NO: 774090 - RNA, 22 nt, Human
cugcagucuuccuuccuuaggc

SEQ ID NO: 774091 - RNA, 22 nt, Human
ggcugccugccuccaagccggg

SEQ ID NO: 774092 - RNA, 22 nt, Human
gaguagggaugcuggugacucc

SEQ ID NO: 774093 - RNA, 22 nt, Human
aggagucagauuguuugaaugu

SEQ ID NO: 774094 - RNA, 22 nt, Human
uugauugaauuuugaaaaucua

SEQ ID NO: 774095 - RNA, 22 nt, Human
uuacaagacacugcugacacag

SEQ ID NO: 774096 - RNA, 22 nt, Human
ggccuucugccuuucagcaaug

SEQ ID NO: 774097 - RNA, 22 nt, Human
cauuuacacacagaggugugcu

SEQ ID NO: 774098 - RNA, 22 nt, Human
uguuuacuggaccagggagggg

SEQ ID NO: 774099 - RNA, 22 nt, Human
aaaccuguagcaguuuguuaca

SEQ ID NO: 774100 - RNA, 22 nt, Human
acuccaggcaucugcuucugcu

SEQ ID NO: 774101 - RNA, 22 nt, Human
cuagggugugcagauuuugccu

SEQ ID NO: 774102 - RNA, 22 nt, Human
gcuuuucuagcuagaacauccg

SEQ ID NO: 774103 - RNA, 22 nt, Human
acuuccugacuucuggguugga

SEQ ID NO: 774104 - RNA, 22 nt, Human
cagcugcccaagccccagaugu

SEQ ID NO: 774105 - RNA, 22 nt, Human
uuacaguaugaucaacuuuuca

SEQ ID NO: 774106 - RNA, 20 nt, Human
gcugaggagcagugugguug

SEQ ID NO: 774107 - RNA, 22 nt, Human
ucugccuccugcuugucccgac

SEQ ID NO: 774108 - RNA, 22 nt, Human
gcagggugauagugaggcucag

SEQ ID NO: 774109 - RNA, 22 nt, Human
uuuauaguagcaugauuuauaa

SEQ ID NO: 774110 - RNA, 22 nt, Human
gaaggcagguuuuucaaaacug

SEQ ID NO: 774111 - RNA, 22 nt, Human
aacuguuuuucacgugucucau

SEQ ID NO: 774112 - RNA, 22 nt, Human
ggugaaauauuuuugauauguu

SEQ ID NO: 774113 - RNA, 20 nt, Human
ggacagugagacauaucuca

SEQ ID NO: 774114 - RNA, 21 nt, Human
cacuccacuuagaacaggguu

SEQ ID NO: 774115 - RNA, 22 nt, Human
gcucagugugguccucagaugu

SEQ ID NO: 774116 - RNA, 22 nt, Human
gcucaggcuucuucuauaaaga

SEQ ID NO: 774117 - RNA, 22 nt, Human
ggcagagcugcaugagcacuca

SEQ ID NO: 774118 - RNA, 22 nt, Human
uuccaaaugaguuccaucgaau

SEQ ID NO: 774119 - RNA, 20 nt, Human
uagcaagcaggaggugcaga

SEQ ID NO: 774120 - RNA, 22 nt, Human
ucuagaaauuuugccuuguauu

SEQ ID NO: 774121 - RNA, 21 nt, Human
gcucaaagggcuugccaugcu

SEQ ID NO: 774122 - RNA, 19 nt, Human
ucaguuuuagucaucaguu

SEQ ID NO: 774123 - RNA, 22 nt, Human
auccuugagccuuaucuuuugu

SEQ ID NO: 774124 - RNA, 22 nt, Human
acuuggcuuuaguaguaacuga

SEQ ID NO: 774125 - RNA, 22 nt, Human
ggcagcuguuggcucucuagga

SEQ ID NO: 774126 - RNA, 22 nt, Human
caagaugacaaggcuggaggcu

SEQ ID NO: 774127 - RNA, 22 nt, Human
gugacucugcauuuuauggauc

SEQ ID NO: 774128 - RNA, 22 nt, Human
ccaugcugacccugugcaggca

SEQ ID NO: 774129 - RNA, 22 nt, Human
uucaacuuuaggcaaagaaaac

SEQ ID NO: 774130 - RNA, 22 nt, Human
uugauaaaaugauaucuucuuu

SEQ ID NO: 774131 - RNA, 22 nt, Human
agggcuuuguuuaggugaccac

SEQ ID NO: 774132 - RNA, 22 nt, Human
aaggacuccaauucuuucaucu

SEQ ID NO: 774133 - RNA, 22 nt, Human
ugagcccuccaaacccaggauu

SEQ ID NO: 774134 - RNA, 22 nt, Human
ucugagguggacgauggagccu

SEQ ID NO: 774135 - RNA, 22 nt, Human
gcuuugggggcugcagugcgug

SEQ ID NO: 774136 - RNA, 22 nt, Human
ucugagcuauguaagacuugga

SEQ ID NO: 774137 - RNA, 22 nt, Human
uagacacuagggauuuaguacu

SEQ ID NO: 774138 - RNA, 16 nt, Human
aggcagcauguuagug

SEQ ID NO: 774139 - RNA, 22 nt, Human
gcagaugguggggcaggaaaau

SEQ ID NO: 774140 - RNA, 22 nt, Human
uuggcauaaaacucuucaaaau

SEQ ID NO: 774141 - RNA, 22 nt, Human
aauguuugucaucacacagaua

SEQ ID NO: 774142 - RNA, 22 nt, Human
cgaugguucuggcugcuuguau

SEQ ID NO: 774143 - RNA, 22 nt, Human
cuggagaacagagcuguuuaga

SEQ ID NO: 774144 - RNA, 22 nt, Human
uuuucacauugucccagcacua

SEQ ID NO: 774145 - RNA, 22 nt, Human
ugaguucugacugugaugccag

SEQ ID NO: 774146 - RNA, 22 nt, Human
aucugccuguauuuaccaucau

SEQ ID NO: 774147 - RNA, 22 nt, Human
gcuggggagcaagaguagugag

SEQ ID NO: 774148 - RNA, 18 nt, Human
gccuucagacugcaugcu

SEQ ID NO: 774149 - RNA, 18 nt, Human
gacuuuaaaacacugcuc

SEQ ID NO: 774150 - RNA, 22 nt, Human
ucugagcagcuuuguuuugugu

SEQ ID NO: 774151 - RNA, 23 nt, Human
gccaauuuaguaaaggcaguggg

SEQ ID NO: 774152 - RNA, 22 nt, Human
gggucuaggagacaugggcaag

SEQ ID NO: 774153 - RNA, 18 nt, Human
cugagggcagccccuggg

SEQ ID NO: 774154 - RNA, 22 nt, Human
ugguccauguccuccaucucuc

SEQ ID NO: 774155 - RNA, 22 nt, Human
uguguuggaaauagggucuuug

SEQ ID NO: 774156 - RNA, 23 nt, Human
agauuuggaaagcugaguggcgu

SEQ ID NO: 774157 - RNA, 22 nt, Human
gugcccagugcaggcccgcagg

SEQ ID NO: 774158 - RNA, 22 nt, Human
gcuguauuccugcacuguauag

SEQ ID NO: 774159 - RNA, 22 nt, Human
agcugcugagagucugccgggc

SEQ ID NO: 774160 - RNA, 22 nt, Human
ugagcugugaucuaugauaaau

SEQ ID NO: 774161 - RNA, 22 nt, Human
gcccuccaugagacacagugua

SEQ ID NO: 774162 - RNA, 22 nt, Human
ucagcacuggcgcugggcaggu

SEQ ID NO: 774163 - RNA, 22 nt, Human
gcuguggguaaacgcugagggu

SEQ ID NO: 774164 - RNA, 22 nt, Human
caggcuggagugcaguugugca

SEQ ID NO: 774165 - RNA, 22 nt, Human
auaaagucauggcagcuagaau

SEQ ID NO: 774166 - RNA, 22 nt, Human
aagagcauggaauggagaucca

SEQ ID NO: 774167 - RNA, 18 nt, Human
cuuccucuucuggagaaa

SEQ ID NO: 774168 - RNA, 22 nt, Human
ucuggaaauuucaguuuuagag

SEQ ID NO: 774169 - RNA, 23 nt, Human
gcacucaucugaagcuauggugc

SEQ ID NO: 774170 - RNA, 22 nt, Human
aaauauacuagaugaugaccca

SEQ ID NO: 774171 - RNA, 18 nt, Human
ggacccagggccucaccc

SEQ ID NO: 774172 - RNA, 20 nt, Human
guuuauacagaagaccccaa

SEQ ID NO: 774173 - RNA, 22 nt, Human
ccuuuugcucucccauccagaa

SEQ ID NO: 774174 - RNA, 22 nt, Human
cuguguuugacaggcggucucc

SEQ ID NO: 774175 - RNA, 22 nt, Human
uggaaguggcagaggaaguggu

SEQ ID NO: 774176 - RNA, 22 nt, Human
auggccaagaauauuucucaac

SEQ ID NO: 774177 - RNA, 22 nt, Human
ggccuuccugcugcuccgggcc

SEQ ID NO: 774178 - RNA, 22 nt, Human
ucacaugcuguguguggagauc

SEQ ID NO: 774179 - RNA, 22 nt, Human
uccuggccuugcuccugaugcc

SEQ ID NO: 774180 - RNA, 22 nt, Human
gaugggguccuugaccuggcca

SEQ ID NO: 774181 - RNA, 19 nt, Human
cccagaggaaugccuggaa

SEQ ID NO: 774182 - RNA, 19 nt, Human
ugcagagagaggcaaagaa

SEQ ID NO: 774183 - RNA, 22 nt, Human
aaggcagcuucaccacagcauu

SEQ ID NO: 774184 - RNA, 22 nt, Human
ucucccuggagcccugaagcau

SEQ ID NO: 774185 - RNA, 22 nt, Human
aaauugugcucacacugauauu

SEQ ID NO: 774186 - RNA, 22 nt, Human
augggcuguccuaguccagccc

SEQ ID NO: 774187 - RNA, 22 nt, Human
gggccugccauugcugccccag

SEQ ID NO: 774188 - RNA, 22 nt, Human
cgcuuuggauuucgcuuuccaa

SEQ ID NO: 774189 - RNA, 22 nt, Human
caaagucagcugccagucccaa

SEQ ID NO: 774190 - RNA, 22 nt, Human
agcuggcuucucugcagacauu

SEQ ID NO: 774191 - RNA, 22 nt, Human
ggucacauucugaggaaucagg

SEQ ID NO: 774192 - RNA, 22 nt, Human
acuacagaagucuuauuagaga

SEQ ID NO: 774193 - RNA, 22 nt, Human
ugaaccacaugcaaagugaaua

SEQ ID NO: 774194 - RNA, 20 nt, Human
ugaacacugggguguuucag

SEQ ID NO: 774195 - RNA, 22 nt, Human
uucuggaacauagcaagaaguu

SEQ ID NO: 774196 - RNA, 22 nt, Human
ucucuuugucugcucuuaguug

SEQ ID NO: 774197 - RNA, 22 nt, Human
ucagaaauuuaggcuggacuug

SEQ ID NO: 774198 - RNA, 22 nt, Human
gccacuggcgcugugcagagug

SEQ ID NO: 774199 - RNA, 22 nt, Human
augcacauguggcuuuauguau

SEQ ID NO: 774200 - RNA, 22 nt, Human
acagaaauucugggacagaaaa

SEQ ID NO: 774201 - RNA, 22 nt, Human
cucuuccuuaagacuauaaaga

SEQ ID NO: 774202 - RNA, 22 nt, Human
aauauaaauuccugggcccagc

SEQ ID NO: 774203 - RNA, 22 nt, Human
caaugcaagcaagauggucaca

SEQ ID NO: 774204 - RNA, 19 nt, Human
ucaaaacacaaaugguuga

SEQ ID NO: 774205 - RNA, 22 nt, Human
ugguaaaguguacugaauauga

SEQ ID NO: 774206 - RNA, 22 nt, Human
ucugccaccaacugucacuaca

SEQ ID NO: 774207 - RNA, 22 nt, Human
ugggcccugacuucaagcaucc

SEQ ID NO: 774208 - RNA, 22 nt, Human
aguccaguguguucuggcagca

SEQ ID NO: 774209 - RNA, 22 nt, Human
aggucugucuggccccaugaau

SEQ ID NO: 774210 - RNA, 22 nt, Human
ugcuuccuugaucauucccaaa

SEQ ID NO: 774211 - RNA, 22 nt, Human
ucugaagauaugagcuuuauga

SEQ ID NO: 774212 - RNA, 22 nt, Human
agcaucucuaaauccaguaagu

SEQ ID NO: 774213 - RNA, 23 nt, Human
ucuaaaauucaucauuuacguuc

SEQ ID NO: 774214 - RNA, 18 nt, Human
gcagcugacacuggaguu

SEQ ID NO: 774215 - RNA, 22 nt, Human
ucuggagucuaaagaaccaaaa

SEQ ID NO: 774216 - RNA, 22 nt, Human
guauggaaguauaaguuuugaa

SEQ ID NO: 774217 - RNA, 22 nt, Human
cccagggacucgggauucuagg

SEQ ID NO: 774218 - RNA, 22 nt, Human
uagccagugaauguuuccagug

SEQ ID NO: 774219 - RNA, 21 nt, Human
ucuguggcagcaugaugaggu

SEQ ID NO: 774220 - RNA, 22 nt, Human
guucagcagcagugauuuugug

SEQ ID NO: 774221 - RNA, 22 nt, Human
gccagguccccucauggcuccu

SEQ ID NO: 774222 - RNA, 22 nt, Human
ggcugcagaggcccccaguggg

SEQ ID NO: 774223 - RNA, 22 nt, Human
ugugcucuggaguugccuucac

SEQ ID NO: 774224 - RNA, 22 nt, Human
ucagaaaaugaaauggacucuc

SEQ ID NO: 774225 - RNA, 22 nt, Human
aguccagaacuucagcuaguuu

SEQ ID NO: 774226 - RNA, 22 nt, Human
uucuccaggccgcgcagggggc

SEQ ID NO: 774227 - RNA, 22 nt, Human
uggagggcgcuuagauggaggg

SEQ ID NO: 774228 - RNA, 22 nt, Human
cuagggucaggggccugcgucg

SEQ ID NO: 774229 - RNA, 22 nt, Human
ugcugggcggugggcucauccc

SEQ ID NO: 774230 - RNA, 22 nt, Human
cccaugagugcugcucagaggc

SEQ ID NO: 774231 - RNA, 22 nt, Human
uggcagaaagaaccaugugcaa

SEQ ID NO: 774232 - RNA, 22 nt, Human
gggagcuggaucgcgcgcccgg

SEQ ID NO: 774233 - RNA, 22 nt, Human
uggcuucaucacucgggcugcc

SEQ ID NO: 774234 - RNA, 22 nt, Human
cagacaggcuagccagacucac

SEQ ID NO: 774235 - RNA, 22 nt, Human
uacuuucuagcucuccccaguu

SEQ ID NO: 774236 - RNA, 22 nt, Human
cuuuacacaugagaccugcaau

SEQ ID NO: 774237 - RNA, 22 nt, Human
uaaaaugccagaccaguucacg

SEQ ID NO: 774238 - RNA, 22 nt, Human
uaaugcaggugcccuuggguuu

SEQ ID NO: 774239 - RNA, 22 nt, Human
acugcagccuuugggcucauaa

SEQ ID NO: 774240 - RNA, 22 nt, Human
acagauuuggcccagccaaugc

SEQ ID NO: 774241 - RNA, 22 nt, Human
cuucaaauccuguguagggcua

SEQ ID NO: 774242 - RNA, 22 nt, Human
ugccucuuggagccuuuccucu

SEQ ID NO: 774243 - RNA, 22 nt, Human
ugguccagacuuugaccucuca

SEQ ID NO: 774244 - RNA, 22 nt, Human
uugaggucuggcaguagcguug

SEQ ID NO: 774245 - RNA, 19 nt, Human
gguguccuagagauaagag

SEQ ID NO: 774246 - RNA, 22 nt, Human
uaaagugcucauaaaaauggau

SEQ ID NO: 774247 - RNA, 22 nt, Human
aggcagcugaggucuggcgccc

SEQ ID NO: 774248 - RNA, 22 nt, Human
ugaggugccacccaagagccuu

SEQ ID NO: 774249 - RNA, 22 nt, Human
caggcugcagugcaguggcuau

SEQ ID NO: 774250 - RNA, 22 nt, Human
ugguuuugcuaaaauagaaaga

SEQ ID NO: 774251 - RNA, 20 nt, Human
agugaauagagacauugccc

SEQ ID NO: 774252 - RNA, 20 nt, Human
uggaccugucucuuuaggga

SEQ ID NO: 774253 - RNA, 22 nt, Human
ucuggccuuaucuguccaagcc

SEQ ID NO: 774254 - RNA, 22 nt, Human
gucaccucgcugucuuccugag

SEQ ID NO: 774255 - RNA, 22 nt, Human
cuggccagaagcaccuuuggcg

SEQ ID NO: 774256 - RNA, 22 nt, Human
ucuggagaaucugucagugugg

SEQ ID NO: 774257 - RNA, 22 nt, Human
aguaucaucuccauuucacuga

SEQ ID NO: 774258 - RNA, 22 nt, Human
gagguggcugggaguagggaau

SEQ ID NO: 774259 - RNA, 22 nt, Human
cagcucugugggagcguaugug

SEQ ID NO: 774260 - RNA, 22 nt, Human
ucagagaaaugcugagcucaug

SEQ ID NO: 774261 - RNA, 22 nt, Human
aagggagcaaauggacagacgg

SEQ ID NO: 774262 - RNA, 22 nt, Human
gauggcacacagacauccccgc

SEQ ID NO: 774263 - RNA, 22 nt, Human
uguggcugccacccugaagccg

SEQ ID NO: 774264 - RNA, 22 nt, Human
cagcuguucagcaacucgcaga

SEQ ID NO: 774265 - RNA, 22 nt, Human
ccaucccuccuccaccagcuag

SEQ ID NO: 774266 - RNA, 22 nt, Human
cacgacuuguggaggagcgcgg

SEQ ID NO: 774267 - RNA, 22 nt, Human
auucaguuagaucauccuaauu

SEQ ID NO: 774268 - RNA, 22 nt, Human
cagguggcagaggucucuggaa

SEQ ID NO: 774269 - RNA, 22 nt, Human
uguccugugauuccagcucuuc

SEQ ID NO: 774270 - RNA, 22 nt, Human
uuguugggcaugcaguggcugu

SEQ ID NO: 774271 - RNA, 22 nt, Human
uuucuagaguucaucaugguaa

SEQ ID NO: 774272 - RNA, 21 nt, Human
augugaaauaucaucagagca

SEQ ID NO: 774273 - RNA, 23 nt, Human
augcccuguagaggcugcugacc

SEQ ID NO: 774274 - RNA, 22 nt, Human
agcccuggcagagccagguagu

SEQ ID NO: 774275 - RNA, 22 nt, Human
caaguucacuugucuacaaggg

SEQ ID NO: 774276 - RNA, 22 nt, Human
agaagcauuggaccaggggccc

SEQ ID NO: 774277 - RNA, 22 nt, Human
aguuaaagucugaaauagagaa

SEQ ID NO: 774278 - RNA, 22 nt, Human
cagcuuucugucucaugacuga

SEQ ID NO: 774279 - RNA, 22 nt, Human
uauguuucuuccuuuucauaca

SEQ ID NO: 774280 - RNA, 22 nt, Human
acaacuagcagguauuaauuuu

SEQ ID NO: 774281 - RNA, 22 nt, Human
acaaucauuccguucacaacag

SEQ ID NO: 774282 - RNA, 22 nt, Human
ugaggaugguuaaagaacauug

SEQ ID NO: 774283 - RNA, 22 nt, Human
ugcuucugggucccagccuggc

SEQ ID NO: 774284 - RNA, 20 nt, Human
ucuuaaauccccagggccau

SEQ ID NO: 774285 - RNA, 22 nt, Human
auguaauuugcccucaaguuaa

SEQ ID NO: 774286 - RNA, 22 nt, Human
uggcuaagcuggggaggccugg

SEQ ID NO: 774287 - RNA, 22 nt, Human
ugggcaggagagaagcuaaaga

SEQ ID NO: 774288 - RNA, 22 nt, Human
uuauuugaaugauggcacaauu

SEQ ID NO: 774289 - RNA, 22 nt, Human
ucuuuggaaugcuagcauucua

SEQ ID NO: 774290 - RNA, 20 nt, Human
acagguucauucugugugac

SEQ ID NO: 774291 - RNA, 22 nt, Human
ucucugagcgcauuccuccggc

SEQ ID NO: 774292 - RNA, 19 nt, Human
cugcuuccuucccucacug

SEQ ID NO: 774293 - RNA, 19 nt, Human
agugggcaaggaagaugac

SEQ ID NO: 774294 - RNA, 22 nt, Human
aggcuucaggaaauauacauuu

SEQ ID NO: 774295 - RNA, 22 nt, Human
cggcuucagcucaggccccucg

SEQ ID NO: 774296 - RNA, 22 nt, Human
ucuacagugucaaugugucuug

SEQ ID NO: 774297 - RNA, 22 nt, Human
aacaugaaguuuucuauaguga

SEQ ID NO: 774298 - RNA, 22 nt, Human
uggcagugaaagacaauugggc

SEQ ID NO: 774299 - RNA, 22 nt, Human
aaauauuugucugaggcgguug

SEQ ID NO: 774300 - RNA, 22 nt, Human
agaguggcagcaagucagguag

SEQ ID NO: 774301 - RNA, 22 nt, Human
ccccagaaguuugcacaagaga

SEQ ID NO: 774302 - RNA, 22 nt, Human
ugugagcacuggcugggaaagu

SEQ ID NO: 774303 - RNA, 22 nt, Human
aggaaggcaugagguguucaca

SEQ ID NO: 774304 - RNA, 22 nt, Human
aguguuuauauuauggaaauau

SEQ ID NO: 774305 - RNA, 22 nt, Human
gcuguguaucagaugccacggg

SEQ ID NO: 774306 - RNA, 22 nt, Human
uccuucuuucccccuagucauu

SEQ ID NO: 774307 - RNA, 22 nt, Human
ugcagaaauaacucauauugca

SEQ ID NO: 774308 - RNA, 22 nt, Human
ugagguagguggugaaaaauga

SEQ ID NO: 774309 - RNA, 22 nt, Human
uucuagcacugccuggaagaca

SEQ ID NO: 774310 - RNA, 20 nt, Human
uuucaaacugcaccuuugcu

SEQ ID NO: 774311 - RNA, 22 nt, Human
uuucuccuaacucaaauuuaag

SEQ ID NO: 774312 - RNA, 22 nt, Human
ucccagcuacucuagaggcuga

SEQ ID NO: 774313 - RNA, 22 nt, Human
auauacaugggaauauguggag

SEQ ID NO: 774314 - RNA, 22 nt, Human
acugaaauacugcucuuggauu

SEQ ID NO: 774315 - RNA, 22 nt, Human
guggccuuucuugggcuacaga

SEQ ID NO: 774316 - RNA, 22 nt, Human
uaguucaggaagagaaacaaca

SEQ ID NO: 774317 - RNA, 22 nt, Human
augcaauaccuucugaaaauaa

SEQ ID NO: 774318 - RNA, 22 nt, Human
aucuccaggauuuucacacuca

SEQ ID NO: 774319 - RNA, 19 nt, Human
aggcuaaagagucuugcgu

SEQ ID NO: 774320 - RNA, 22 nt, Human
ugagauaacauggaagaguagc

SEQ ID NO: 774321 - RNA, 22 nt, Human
acucuugucucaacuuuuguau

SEQ ID NO: 774322 - RNA, 22 nt, Human
cugacucccaagcuagugcucu

SEQ ID NO: 774323 - RNA, 22 nt, Human
cugugcccuggccaggccucuc

SEQ ID NO: 774324 - RNA, 22 nt, Human
uuuuacaaaugaggagcuggag

SEQ ID NO: 774325 - RNA, 22 nt, Human
agcaguuuuccugagcuccuca

SEQ ID NO: 774326 - RNA, 22 nt, Human
ucuagaaagccaaauuaggaau

SEQ ID NO: 774327 - RNA, 22 nt, Human
auccaaagcccuaaguuaacug

SEQ ID NO: 774328 - RNA, 22 nt, Human
uggcugccaugacgccugggga

SEQ ID NO: 774329 - RNA, 22 nt, Human
ggaggcucuugagaggggagua

SEQ ID NO: 774330 - RNA, 22 nt, Human
aaugaacaggugaaugucagau

SEQ ID NO: 774331 - RNA, 22 nt, Human
caguaacaggcucugugguaua

SEQ ID NO: 774332 - RNA, 22 nt, Human
gccuggagcucaugugggcauu

SEQ ID NO: 774333 - RNA, 22 nt, Human
aggaaacuguccccucauccua

SEQ ID NO: 774334 - RNA, 22 nt, Human
accgggcuaauuuuuguaucuu

SEQ ID NO: 774335 - RNA, 22 nt, Human
uacagccuggcacuacccuggg

SEQ ID NO: 774336 - RNA, 22 nt, Human
ggcugcuggaagacugaacaag

SEQ ID NO: 774337 - RNA, 22 nt, Human
uucugcuugguucuugguauga

SEQ ID NO: 774338 - RNA, 22 nt, Human
aggccagcuuccagaggggcag

SEQ ID NO: 774339 - RNA, 19 nt, Human
agcaguggagccaugccug

SEQ ID NO: 774340 - RNA, 22 nt, Human
acauuuuaauaugcuuagugug

SEQ ID NO: 774341 - RNA, 22 nt, Human
gucagagagggcacgugcacac

SEQ ID NO: 774342 - RNA, 22 nt, Human
agacgagggccuggcacacagu

SEQ ID NO: 774343 - RNA, 22 nt, Human
gugagaguguuuggaaauagaa

SEQ ID NO: 774344 - RNA, 22 nt, Human
uagccaugagcagaucacuaua

SEQ ID NO: 774345 - RNA, 22 nt, Human
acacucuugcauuaccugaaua

SEQ ID NO: 774346 - RNA, 22 nt, Human
agugcuuaauagauguccagca

SEQ ID NO: 774347 - RNA, 22 nt, Human
ucuuggccagguguggugccuc

SEQ ID NO: 774348 - RNA, 22 nt, Human
gggacuucauagcuaggcacuu

SEQ ID NO: 774349 - RNA, 22 nt, Human
ggggcuggcucacuaagagacu

SEQ ID NO: 774350 - RNA, 22 nt, Human
agggaagcaaugauuauuauuc

SEQ ID NO: 774351 - RNA, 22 nt, Human
caguccugugucccuugguggg

SEQ ID NO: 774352 - RNA, 22 nt, Human
cuauucagccucuaagacaagu

SEQ ID NO: 774353 - RNA, 22 nt, Human
uggggaaaggagagcauuauuu

SEQ ID NO: 774354 - RNA, 22 nt, Human
auagaauaugacuuuuagaucc

SEQ ID NO: 774355 - RNA, 22 nt, Human
cuggagagagaaaaagccuuaa

SEQ ID NO: 774356 - RNA, 22 nt, Human
auagauguucaaucagauauuu

SEQ ID NO: 774357 - RNA, 22 nt, Human
caugaucugguccuacuguggg

SEQ ID NO: 774358 - RNA, 22 nt, Human
aucugcuugaaugagcaacagg

SEQ ID NO: 774359 - RNA, 22 nt, Human
cucuuuccucagccacagucua

SEQ ID NO: 774360 - RNA, 22 nt, Human
cagcugccacuugcucucggcu

SEQ ID NO: 774361 - RNA, 22 nt, Human
cucacagagccucugugucuuc

SEQ ID NO: 774362 - RNA, 22 nt, Human
aagugaagaaauacaugagaau

SEQ ID NO: 774363 - RNA, 19 nt, Human
uuagggacaugaauucuag

SEQ ID NO: 774364 - RNA, 22 nt, Human
ucccagggggaugaacacugcc

SEQ ID NO: 774365 - RNA, 22 nt, Human
cccucagcuucucccugcagcu

SEQ ID NO: 774366 - RNA, 22 nt, Human
augaaacugggauaacuauagc

SEQ ID NO: 774367 - RNA, 22 nt, Human
cagggcuuacuggaggcugcuu

SEQ ID NO: 774368 - RNA, 22 nt, Human
ggcuccuucaagccugucacug

SEQ ID NO: 774369 - RNA, 22 nt, Human
ucauaacaaccuggaaggccag

SEQ ID NO: 774370 - RNA, 22 nt, Human
agaggagcugggaggcccucgu

SEQ ID NO: 774371 - RNA, 22 nt, Human
cugcuuuaaguauucaacaaag

SEQ ID NO: 774372 - RNA, 22 nt, Human
uggccacaucugaaaugagugu

SEQ ID NO: 774373 - RNA, 22 nt, Human
acuuauuucauggaucauaaug

SEQ ID NO: 774374 - RNA, 22 nt, Human
ccugggcauaaaucacuccaag

SEQ ID NO: 774375 - RNA, 22 nt, Human
acuuuacuacauccacagaugg

SEQ ID NO: 774376 - RNA, 22 nt, Human
auuugaaaucuggguuacucug

SEQ ID NO: 774377 - RNA, 22 nt, Human
cuugccaaauuaacauacagaa

SEQ ID NO: 774378 - RNA, 22 nt, Human
aaaccucugugcuaugacaccc

SEQ ID NO: 774379 - RNA, 22 nt, Human
gcugugugccaggggaaggcug

SEQ ID NO: 774380 - RNA, 22 nt, Human
caaguucauuguagcauuauug

SEQ ID NO: 774381 - RNA, 22 nt, Human
cuaaagugccaggaauacaggu

SEQ ID NO: 774382 - RNA, 22 nt, Human
accacauuucugaauagcauaa

SEQ ID NO: 774383 - RNA, 22 nt, Human
uacaugcuccacuuucuccugu

SEQ ID NO: 774384 - RNA, 22 nt, Human
gcauuucauguagauugagaac

SEQ ID NO: 774385 - RNA, 22 nt, Human
uuaaaaucacagucacccagua

SEQ ID NO: 774386 - RNA, 22 nt, Human
cacaguaugaucuaaaguaagu

SEQ ID NO: 774387 - RNA, 22 nt, Human
agcccagcugccugccugcugu

SEQ ID NO: 774388 - RNA, 22 nt, Human
aaggugcucguuauggccagug

SEQ ID NO: 774389 - RNA, 22 nt, Human
ucaaaaucaaagauacuugaaa

SEQ ID NO: 774390 - RNA, 22 nt, Human
accugccucuaagcagcaggug

SEQ ID NO: 774391 - RNA, 22 nt, Human
gggcaugacuuuuggaguggga

SEQ ID NO: 774392 - RNA, 22 nt, Human
uuauuacaaugcagaaaauaga

SEQ ID NO: 774393 - RNA, 22 nt, Human
cuuccaggacaccaggguagua

SEQ ID NO: 774394 - RNA, 22 nt, Human
uccugggcuuaagugauccucc

SEQ ID NO: 774395 - RNA, 22 nt, Human
uaggaaacaaaguggaugaaau

SEQ ID NO: 774396 - RNA, 22 nt, Human
aagcugccaaugguaagcugcu

SEQ ID NO: 774397 - RNA, 22 nt, Human
uggcugggugcuauccaguacu

SEQ ID NO: 774398 - RNA, 22 nt, Human
uccagcuuugagauuuuaugga

SEQ ID NO: 774399 - RNA, 22 nt, Human
uuucccaguucccugcucuaua

SEQ ID NO: 774400 - RNA, 22 nt, Human
uugcauuugagaaaguucuccu

SEQ ID NO: 774401 - RNA, 22 nt, Human
acagcuguggggacucuugccc

SEQ ID NO: 774402 - RNA, 22 nt, Human
cagcucugggagucccaccccu

SEQ ID NO: 774403 - RNA, 22 nt, Human
aguuagugaagcucaucacagc

SEQ ID NO: 774404 - RNA, 22 nt, Human
aggaagcucaaagccaugaugu

SEQ ID NO: 774405 - RNA, 20 nt, Human
uauggcuugcagccacccuu

SEQ ID NO: 774406 - RNA, 22 nt, Human
aggugccuaucuggucucugca

SEQ ID NO: 774407 - RNA, 22 nt, Human
cuggcucaggaaaguugcugcu

SEQ ID NO: 774408 - RNA, 22 nt, Human
cugaggcaggagaauugcugga

SEQ ID NO: 774409 - RNA, 22 nt, Human
ugugucugcacugaguccucac

SEQ ID NO: 774410 - RNA, 22 nt, Human
uauguagcaauagcaucauacu

SEQ ID NO: 774411 - RNA, 22 nt, Human
aaagacuggaaggugaggcugu

SEQ ID NO: 774412 - RNA, 22 nt, Human
cagcauuuucuuaauguaggug

SEQ ID NO: 774413 - RNA, 22 nt, Human
auucugggaguguaggaugguu

SEQ ID NO: 774414 - RNA, 22 nt, Human
aagugaugcuacgacuuugaca

SEQ ID NO: 774415 - RNA, 22 nt, Human
uaaaaguggauaagcuguagga

SEQ ID NO: 774416 - RNA, 22 nt, Human
uaucucuagcgcacagaagaaa

SEQ ID NO: 774417 - RNA, 22 nt, Human
cucuggcuugguaaaaacuucu

SEQ ID NO: 774418 - RNA, 22 nt, Human
cagucaccuagacagaacuuac

SEQ ID NO: 774419 - RNA, 22 nt, Human
ucauugcagcuucagguguuca

SEQ ID NO: 774420 - RNA, 22 nt, Human
cuccuguugcacuaguuccuga

SEQ ID NO: 774421 - RNA, 20 nt, Human
gcucugaccauaucaagaca

SEQ ID NO: 774422 - RNA, 22 nt, Human
cagugccaugucugagccccua

SEQ ID NO: 774423 - RNA, 22 nt, Human
ugucccauggacacaacuucuu

SEQ ID NO: 774424 - RNA, 22 nt, Human
agugcuuugaauguucugggca

SEQ ID NO: 774425 - RNA, 22 nt, Human
aggaaccagagguugagcaacu

SEQ ID NO: 774426 - RNA, 22 nt, Human
auauguguacgugcaguauaua

SEQ ID NO: 774427 - RNA, 22 nt, Human
ucaguguccggagccugagugc

SEQ ID NO: 774428 - RNA, 22 nt, Human
cagagccuuaguucuccuagaa

SEQ ID NO: 774429 - RNA, 22 nt, Human
caguccucucugugucugcacc

SEQ ID NO: 774430 - RNA, 23 nt, Human
uugcugccugagccuuccucugg

SEQ ID NO: 774431 - RNA, 21 nt, Human
agcagcagcaguggggcuucu

SEQ ID NO: 774432 - RNA, 22 nt, Human
auccuucaguggaagacaguag

SEQ ID NO: 774433 - RNA, 22 nt, Human
augaacaaguauuugcaugagc

SEQ ID NO: 774434 - RNA, 22 nt, Human
gggcauggaggucugucugcag

SEQ ID NO: 774435 - RNA, 22 nt, Human
ugaguuaucuaaaauagucaaa

SEQ ID NO: 774436 - RNA, 22 nt, Human
aggcacugggggaugagcaagg

SEQ ID NO: 774437 - RNA, 22 nt, Human
uagaucauggaguaaaauggaa

SEQ ID NO: 774438 - RNA, 22 nt, Human
ucaggaguaaagaagacuugac

SEQ ID NO: 774439 - RNA, 22 nt, Human
aggcaagggggcgccaccuucc

SEQ ID NO: 774440 - RNA, 20 nt, Human
agcaccuguguagaagcauc

SEQ ID NO: 774441 - RNA, 22 nt, Human
uuauggaaaauacaauuauaag

SEQ ID NO: 774442 - RNA, 22 nt, Human
ucagugcuuauauucugagccu

SEQ ID NO: 774443 - RNA, 20 nt, Human
cuuugccuauucucugccug

SEQ ID NO: 774444 - RNA, 22 nt, Human
aacucacagcuguuuggauuag

SEQ ID NO: 774445 - RNA, 22 nt, Human
cugggucuucagcagcaggcgg

SEQ ID NO: 774446 - RNA, 22 nt, Human
cauauuagccuccacugggaca

SEQ ID NO: 774447 - RNA, 18 nt, Human
ggcuccgacgggccgugc

SEQ ID NO: 774448 - RNA, 22 nt, Human
uguguuccuucgucuucccuuc

SEQ ID NO: 774449 - RNA, 22 nt, Human
gaaguucuuugcuccccaguac

SEQ ID NO: 774450 - RNA, 22 nt, Human
cuggagugaagcuuauuuuuca

SEQ ID NO: 774451 - RNA, 22 nt, Human
uuucaaacuaugugucaggcag

SEQ ID NO: 774452 - RNA, 22 nt, Human
gugaggacugguaaggacugca

SEQ ID NO: 774453 - RNA, 22 nt, Human
aaagcacauuacaagcucaguc

SEQ ID NO: 774454 - RNA, 22 nt, Human
augucuuucaaauucugccuag

SEQ ID NO: 774455 - RNA, 22 nt, Human
caggaagcucuuagcagucacc

SEQ ID NO: 774456 - RNA, 22 nt, Human
agaccacagucaggcuccuggu

SEQ ID NO: 774457 - RNA, 22 nt, Human
aggcuggagcaagggggcauau

SEQ ID NO: 774458 - RNA, 22 nt, Human
auuaagagccuacuaugugccg

SEQ ID NO: 774459 - RNA, 22 nt, Human
caugaggauccaggugacaggc

SEQ ID NO: 774460 - RNA, 23 nt, Human
auguauuuaaauuucagugauga

SEQ ID NO: 774461 - RNA, 19 nt, Human
uuucuuuuccccucagcac

SEQ ID NO: 774462 - RNA, 22 nt, Human
auuucuuccuucuccuagaaga

SEQ ID NO: 774463 - RNA, 22 nt, Human
caagagcucagaaacccuugcu

SEQ ID NO: 774464 - RNA, 22 nt, Human
uccucccuguaccauuccucug

SEQ ID NO: 774465 - RNA, 22 nt, Human
aauuugauucccugcaccuguu

SEQ ID NO: 774466 - RNA, 22 nt, Human
uaaacaucuguagccuucaguc

SEQ ID NO: 774467 - RNA, 22 nt, Human
uggcagugccccuugaccagug

SEQ ID NO: 774468 - RNA, 22 nt, Human
ucccagcuuagauuugcucauu

SEQ ID NO: 774469 - RNA, 17 nt, Human
cgugugcuugugugcac

SEQ ID NO: 774470 - RNA, 22 nt, Human
cagauaugauaggauuagcaca

SEQ ID NO: 774471 - RNA, 22 nt, Human
cacuagaaagguacagauuaug

SEQ ID NO: 774472 - RNA, 22 nt, Human
agccacugguaaacugguagga

SEQ ID NO: 774473 - RNA, 22 nt, Human
cacuguucuuuuuguaguccaa

SEQ ID NO: 774474 - RNA, 22 nt, Human
uagcugccagaccauucuuacu

SEQ ID NO: 774475 - RNA, 22 nt, Human
auuuccugguugcauuggcuuu

SEQ ID NO: 774476 - RNA, 22 nt, Human
gagguccaacacaauggguguu

SEQ ID NO: 774477 - RNA, 22 nt, Human
ccaggagcaggagcugcagcug

SEQ ID NO: 774478 - RNA, 22 nt, Human
cagaggcacagugcgggccacu

SEQ ID NO: 774479 - RNA, 22 nt, Human
cugaggcuggggaagggaagug

SEQ ID NO: 774480 - RNA, 22 nt, Human
cauggcugaacacucagugacu

SEQ ID NO: 774481 - RNA, 22 nt, Human
cuggccuggcagggagggcaug

SEQ ID NO: 774482 - RNA, 22 nt, Human
uagcaguuaaucugagccaaga

SEQ ID NO: 774483 - RNA, 22 nt, Human
cugccagaucauuggauucaca

SEQ ID NO: 774484 - RNA, 22 nt, Human
agaccaagaaaggaugaggauc

SEQ ID NO: 774485 - RNA, 22 nt, Human
ugaaggaaaugacggcagaaga

SEQ ID NO: 774486 - RNA, 22 nt, Human
gggaucugauuuaggaugggag

SEQ ID NO: 774487 - RNA, 22 nt, Human
uccaauuuuacgucuguauaaa

SEQ ID NO: 774488 - RNA, 22 nt, Human
caguaaauuuuauuugugggug

SEQ ID NO: 774489 - RNA, 20 nt, Human
auguaaaauuauaaggcuga

SEQ ID NO: 774490 - RNA, 22 nt, Human
agcccugcacaggucuguggcu

SEQ ID NO: 774491 - RNA, 22 nt, Human
uaaaacuagaccgugagucuaa

SEQ ID NO: 774492 - RNA, 22 nt, Human
cugggcugcaucaaagaggcau

SEQ ID NO: 774493 - RNA, 22 nt, Human
cauacugugaagcuuacuauuu

SEQ ID NO: 774494 - RNA, 22 nt, Human
uacaaagcaaaucaucuaagag

SEQ ID NO: 774495 - RNA, 22 nt, Human
ucagaagaaagauguuauuacu

SEQ ID NO: 774496 - RNA, 22 nt, Human
ucucuacauaaccucaauacuc

SEQ ID NO: 774497 - RNA, 22 nt, Human
aucaccaggcaaaaugucagag

SEQ ID NO: 774498 - RNA, 22 nt, Human
agugcuuugagcguuugaaaag

SEQ ID NO: 774499 - RNA, 22 nt, Human
aucugagucucugacagcaugu

SEQ ID NO: 774500 - RNA, 22 nt, Human
ggcaucaggguaggaagguauc

SEQ ID NO: 774501 - RNA, 19 nt, Human
ccccaaaguuuagauguug

SEQ ID NO: 774502 - RNA, 22 nt, Human
cccucaggaugcaguggaagug

SEQ ID NO: 774503 - RNA, 22 nt, Human
gcugaggaaaccaaugcucaga

SEQ ID NO: 774504 - RNA, 20 nt, Human
uaucaaucagaaagaagacu

SEQ ID NO: 774505 - RNA, 22 nt, Human
ucugcagagcauuauagcaaaa

SEQ ID NO: 774506 - RNA, 22 nt, Human
aaagacuuggcuuaugauuugc

SEQ ID NO: 774507 - RNA, 22 nt, Human
ggcagcucacugauuagcaauu

SEQ ID NO: 774508 - RNA, 19 nt, Human
cugaggcccauguaccaug

SEQ ID NO: 774509 - RNA, 22 nt, Human
ccugcucuccauacacuuucua

SEQ ID NO: 774510 - RNA, 22 nt, Human
gacuguggauagaacacugcag

SEQ ID NO: 774511 - RNA, 22 nt, Human
aauugauggacagagaugaaga

SEQ ID NO: 774512 - RNA, 22 nt, Human
cagggccucgaagccucugggc

SEQ ID NO: 774513 - RNA, 22 nt, Human
ggcucugcuucucaccuguucc

SEQ ID NO: 774514 - RNA, 22 nt, Human
ccuccccucagacagagacugg

SEQ ID NO: 774515 - RNA, 22 nt, Human
uaaauugcugauuuuagaugcu

SEQ ID NO: 774516 - RNA, 22 nt, Human
aaauaggaaugugguccuggga

SEQ ID NO: 774517 - RNA, 22 nt, Human
ugcuggagaucauuaauguuca

SEQ ID NO: 774518 - RNA, 22 nt, Human
gcugccaggcccuggggcuaug

SEQ ID NO: 774519 - RNA, 21 nt, Human
uggcucugagccucauggcug

SEQ ID NO: 774520 - RNA, 22 nt, Human
uguuugugagaugugagguacg

SEQ ID NO: 774521 - RNA, 23 nt, Human
cuggaacauaguagauggucaga

SEQ ID NO: 774522 - RNA, 22 nt, Human
auuuugaaaagcauuugaguaa

SEQ ID NO: 774523 - RNA, 22 nt, Human
gcauuuuucaucccucuugggu

SEQ ID NO: 774524 - RNA, 21 nt, Human
caggccgggugagcaggcagc

SEQ ID NO: 774525 - RNA, 22 nt, Human
aaccuggaggcuguguagucuu

SEQ ID NO: 774526 - RNA, 22 nt, Human
aggguccaucaaggacugcaca

SEQ ID NO: 774527 - RNA, 22 nt, Human
cuggagcucuucugagugugcu

SEQ ID NO: 774528 - RNA, 22 nt, Human
ugagcuguggugggguagagga

SEQ ID NO: 774529 - RNA, 22 nt, Human
gccuggaucccagggagucagg

SEQ ID NO: 774530 - RNA, 22 nt, Human
aaaguggucaccuucucauuuc

SEQ ID NO: 774531 - RNA, 22 nt, Human
ucuuagcaaauuuucuuugccu

SEQ ID NO: 774532 - RNA, 22 nt, Human
auucauuugcuauuguguaugg

SEQ ID NO: 774533 - RNA, 19 nt, Human
ccaggccugcgggcguugg

SEQ ID NO: 774534 - RNA, 22 nt, Human
gugcuggcuggggcaucaggca

SEQ ID NO: 774535 - RNA, 22 nt, Human
aggucugagucuauauacauug

SEQ ID NO: 774536 - RNA, 22 nt, Human
gugucugugucauuacuaauag

SEQ ID NO: 774537 - RNA, 22 nt, Human
gaggcuucccgcccaugcugga

SEQ ID NO: 774538 - RNA, 22 nt, Human
auacaucauuucccaucaaucg

SEQ ID NO: 774539 - RNA, 22 nt, Human
agaucacagcccccagaugcca

SEQ ID NO: 774540 - RNA, 22 nt, Human
ugcauuucagaagaaaauucgg

SEQ ID NO: 774541 - RNA, 22 nt, Human
gaagagcugcucagaacaugau

SEQ ID NO: 774542 - RNA, 22 nt, Human
cagggccagcgucucgggcuau

SEQ ID NO: 774543 - RNA, 22 nt, Human
ucuucucucauguaggagggaa

SEQ ID NO: 774544 - RNA, 22 nt, Human
gagggcugcaaugagacagaga

SEQ ID NO: 774545 - RNA, 19 nt, Human
agggccaggauucuggaac

SEQ ID NO: 774546 - RNA, 22 nt, Human
acacugcagauguaauuugagu

SEQ ID NO: 774547 - RNA, 22 nt, Human
agaggcaaguucagagcuagga

SEQ ID NO: 774548 - RNA, 22 nt, Human
accuuauuuggaaauauaauua

SEQ ID NO: 774549 - RNA, 21 nt, Human
acucugcugcgggcuuggccu

SEQ ID NO: 774550 - RNA, 20 nt, Human
gucaagucccuggggcagcu

SEQ ID NO: 774551 - RNA, 22 nt, Human
uccugcuguuuaccuacaaugg

SEQ ID NO: 774552 - RNA, 22 nt, Human
cucuggagcgcugcuucccgcg

SEQ ID NO: 774553 - RNA, 22 nt, Human
cacaguuugggucuccggggca

SEQ ID NO: 774554 - RNA, 22 nt, Human
aguuuuuccugauuuuacagaa

SEQ ID NO: 774555 - RNA, 20 nt, Human
gccuggaggcaaugggaaga

SEQ ID NO: 774556 - RNA, 22 nt, Human
aggccagggccagauuagccac

SEQ ID NO: 774557 - RNA, 22 nt, Human
cucauuagacagguauacuuua

SEQ ID NO: 774558 - RNA, 22 nt, Human
agcuaggggaccaagguggccc

SEQ ID NO: 774559 - RNA, 21 nt, Human
accagcauuccacacuguccc

SEQ ID NO: 774560 - RNA, 22 nt, Human
ugauucaacuuucauaacaaaa

SEQ ID NO: 774561 - RNA, 22 nt, Human
ggcuccaagucucagagugaag

SEQ ID NO: 774562 - RNA, 22 nt, Human
cucugugucagcugggugugca

SEQ ID NO: 774563 - RNA, 22 nt, Human
gucuaaacuuuggcccagauuu

SEQ ID NO: 774564 - RNA, 22 nt, Human
ugagauaauuaaaucaaaaccu

SEQ ID NO: 774565 - RNA, 22 nt, Human
cagcaggaaaaucaauucugug

SEQ ID NO: 774566 - RNA, 22 nt, Human
cuaaaccuuugugcuugcaauu

SEQ ID NO: 774567 - RNA, 22 nt, Human
uuccugcccugccugugccacu

SEQ ID NO: 774568 - RNA, 22 nt, Human
auuccacaggacuaccaaugug

SEQ ID NO: 774569 - RNA, 22 nt, Human
caagucugaccucugggugaag

SEQ ID NO: 774570 - RNA, 22 nt, Human
cugcgugucuccuuggggcaga

SEQ ID NO: 774571 - RNA, 23 nt, Human
agacacauaggagcagcuauugg

SEQ ID NO: 774572 - RNA, 22 nt, Human
ugccugggacuguacuaaauuu

SEQ ID NO: 774573 - RNA, 22 nt, Human
aaauugcauuuuaaagguagau

SEQ ID NO: 774574 - RNA, 22 nt, Human
acaagauagguugagucuagcc

SEQ ID NO: 774575 - RNA, 22 nt, Human
guucuuccucauugcuuugaag

SEQ ID NO: 774576 - RNA, 22 nt, Human
acacaagauuguguauugaauu

SEQ ID NO: 774577 - RNA, 21 nt, Human
ggagucauuagucauuuccuu

SEQ ID NO: 774578 - RNA, 22 nt, Human
aaugacagagcacugaacuugg

SEQ ID NO: 774579 - RNA, 22 nt, Human
aaaguuuccugcuaagugcuau

SEQ ID NO: 774580 - RNA, 22 nt, Human
gcaugguggccuuaggguagcc

SEQ ID NO: 774581 - RNA, 22 nt, Human
cauuaugugagugauuaauuca

SEQ ID NO: 774582 - RNA, 22 nt, Human
uugucgggcuuacgcagggcca

SEQ ID NO: 774583 - RNA, 22 nt, Human
auuacaucaguugacaugugag

SEQ ID NO: 774584 - RNA, 18 nt, Human
acaaaggucugcaagacc

SEQ ID NO: 774585 - RNA, 22 nt, Human
cauguacaaaaggcaaaugccu

SEQ ID NO: 774586 - RNA, 22 nt, Human
ugaguucaaauuuuggcucugc

SEQ ID NO: 774587 - RNA, 22 nt, Human
agggaucaguagggacggcagc

SEQ ID NO: 774588 - RNA, 22 nt, Human
cguuggagacacuugaggacuu

SEQ ID NO: 774589 - RNA, 16 nt, Human
gcccaggacgggaggc

SEQ ID NO: 774590 - RNA, 22 nt, Human
cacaaggagguccugaggaagc

SEQ ID NO: 774591 - RNA, 22 nt, Human
uccagguauuacuaaguguuaa

SEQ ID NO: 774592 - RNA, 22 nt, Human
cucccugggccucaguuucucu

SEQ ID NO: 774593 - RNA, 22 nt, Human
uccagcagggaauuaguagucu

SEQ ID NO: 774594 - RNA, 22 nt, Human
cuccacucaccgaggcagagca

SEQ ID NO: 774595 - RNA, 17 nt, Human
aggagucucagaugagc

SEQ ID NO: 774596 - RNA, 22 nt, Human
ugggggagauuagagcuucuua

SEQ ID NO: 774597 - RNA, 18 nt, Human
ggugaggcggcggccagc

SEQ ID NO: 774598 - RNA, 22 nt, Human
aacacugucuuauacuucaaug

SEQ ID NO: 774599 - RNA, 20 nt, Human
uauuuguauuugggaaaguu

SEQ ID NO: 774600 - RNA, 22 nt, Human
uucaaacucuugcucugcuagu

SEQ ID NO: 774601 - RNA, 22 nt, Human
uauauugaccaguacaauuggu

SEQ ID NO: 774602 - RNA, 21 nt, Human
aaagugguaaggauuauuuug

SEQ ID NO: 774603 - RNA, 22 nt, Human
auuaaauuggaucugcauaguu

SEQ ID NO: 774604 - RNA, 22 nt, Human
aagucaagauaaaggugcuggc

SEQ ID NO: 774605 - RNA, 22 nt, Human
aaauuucuugaggcucucuagc

SEQ ID NO: 774606 - RNA, 22 nt, Human
ugccucaguuucaucugcagaa

SEQ ID NO: 774607 - RNA, 22 nt, Human
acagauuuauugaagcugcugc

SEQ ID NO: 774608 - RNA, 22 nt, Human
uaaugcaacgugagauaauuaa

SEQ ID NO: 774609 - RNA, 19 nt, Human
auguuuuaugcugauggga

SEQ ID NO: 774610 - RNA, 22 nt, Human
uucaagucuggagaucuggaac

SEQ ID NO: 774611 - RNA, 22 nt, Human
gugggaagaacuucaaguggcu

SEQ ID NO: 774612 - RNA, 22 nt, Human
acagccagguaaaggcauggca

SEQ ID NO: 774613 - RNA, 20 nt, Human
agagugagacuccaucucag

SEQ ID NO: 774614 - RNA, 22 nt, Human
uauugucaagaaguuuauagug

SEQ ID NO: 774615 - RNA, 18 nt, Human
cacaggcaggugauaggu

SEQ ID NO: 774616 - RNA, 20 nt, Human
cuccaggggaagagccuucc

SEQ ID NO: 774617 - RNA, 22 nt, Human
ccugauucugaugccucaugga

SEQ ID NO: 774618 - RNA, 22 nt, Human
aguggcucuccaagaagucaca

SEQ ID NO: 774619 - RNA, 22 nt, Human
aguggcaguuuuauauuucaug

SEQ ID NO: 774620 - RNA, 22 nt, Human
gggagagagaaaacguggcgca

SEQ ID NO: 774621 - RNA, 22 nt, Human
ucugagaaggguaggcuccauu

SEQ ID NO: 774622 - RNA, 22 nt, Human
uaugccugauaacugugucucu

SEQ ID NO: 774623 - RNA, 23 nt, Human
cauaaaauauuaguaugguagca

SEQ ID NO: 774624 - RNA, 22 nt, Human
gugggaugcaguggugaguggc

SEQ ID NO: 774625 - RNA, 22 nt, Human
auaacccucuggauaggacagg

SEQ ID NO: 774626 - RNA, 22 nt, Human
caucucaucagugagagucagc

SEQ ID NO: 774627 - RNA, 22 nt, Human
augucaaacacaacaccagugg

SEQ ID NO: 774628 - RNA, 22 nt, Human
aaggucugugaggcuguuuguc

SEQ ID NO: 774629 - RNA, 22 nt, Human
gaaaugaaauagcaccaagguu

SEQ ID NO: 774630 - RNA, 22 nt, Human
uuucucaaauacuguuccagga

SEQ ID NO: 774631 - RNA, 23 nt, Human
ugaaagcaaugggucuauaguau

SEQ ID NO: 774632 - RNA, 22 nt, Human
gggcuggaucucacgugagacc

SEQ ID NO: 774633 - RNA, 22 nt, Human
ugaggaagcaaaggcuugugug

SEQ ID NO: 774634 - RNA, 22 nt, Human
ugcguggcgcagcgugugggau

SEQ ID NO: 774635 - RNA, 22 nt, Human
gucaggagauagggcaagcuuc

SEQ ID NO: 774636 - RNA, 22 nt, Human
guggauggauuuugaggaaugg

SEQ ID NO: 774637 - RNA, 22 nt, Human
cugagaggaugcugcaguggag

SEQ ID NO: 774638 - RNA, 22 nt, Human
uuucucuauuaggggcuagcuu

SEQ ID NO: 774639 - RNA, 22 nt, Human
uuacacagaaacacuguucaga

SEQ ID NO: 774640 - RNA, 22 nt, Human
cugggugaauuugaaggaaagg

SEQ ID NO: 774641 - RNA, 22 nt, Human
ggacugugaggucugggugagg

SEQ ID NO: 774642 - RNA, 22 nt, Human
gaugaaauuguuuugauacuuu

SEQ ID NO: 774643 - RNA, 22 nt, Human
uuugacaacacguuauuugccu

SEQ ID NO: 774644 - RNA, 22 nt, Human
ugcucuggaccaugacuaugug

SEQ ID NO: 774645 - RNA, 22 nt, Human
ucuaauaaauaaaugcucuagg

SEQ ID NO: 774646 - RNA, 22 nt, Human
gcagaggcaaucagguaugugg

SEQ ID NO: 774647 - RNA, 21 nt, Human
uggagcugccacuuguccucc

SEQ ID NO: 774648 - RNA, 22 nt, Human
guugaaagagcauggacuugaa

SEQ ID NO: 774649 - RNA, 22 nt, Human
cucuccuuugaagcaacuguau

SEQ ID NO: 774650 - RNA, 22 nt, Human
uggaaggcaugggaacuguucu

SEQ ID NO: 774651 - RNA, 19 nt, Human
augauacaggugaaaauug

SEQ ID NO: 774652 - RNA, 22 nt, Human
gcuguuauaauauucuguuugu

SEQ ID NO: 774653 - RNA, 22 nt, Human
uccacaggaaagcaccucccau

SEQ ID NO: 774654 - RNA, 22 nt, Human
uauuuaauuagugauuguagag

SEQ ID NO: 774655 - RNA, 22 nt, Human
uggagucaguggcuauugggca

SEQ ID NO: 774656 - RNA, 22 nt, Human
accaggccaaaaucauauuuac

SEQ ID NO: 774657 - RNA, 22 nt, Human
gugcccuccugaagccaucaca

SEQ ID NO: 774658 - RNA, 22 nt, Human
acagucuaggccuaggucaaaa

SEQ ID NO: 774659 - RNA, 22 nt, Human
guaaagcagguaguugggacac

SEQ ID NO: 774660 - RNA, 22 nt, Human
uuuagagagaauuuucaaagug

SEQ ID NO: 774661 - RNA, 22 nt, Human
aggcaccuggaucuuggaauuc

SEQ ID NO: 774662 - RNA, 22 nt, Human
gguugguaacucccugugcagu

SEQ ID NO: 774663 - RNA, 22 nt, Human
caggucuggugagagaacaguu

SEQ ID NO: 774664 - RNA, 22 nt, Human
gcucagagaauuuacugcugcc

SEQ ID NO: 774665 - RNA, 22 nt, Human
uuucuaguucucugccaaaaaa

SEQ ID NO: 774666 - RNA, 22 nt, Human
auuaaaccccaguucucuuacu

SEQ ID NO: 774667 - RNA, 22 nt, Human
cagcucuuauuuucucuccuaa

SEQ ID NO: 774668 - RNA, 22 nt, Human
caaacuguucucugugggauuc

SEQ ID NO: 774669 - RNA, 20 nt, Human
ugcucuggaaauggucugag

SEQ ID NO: 774670 - RNA, 22 nt, Human
agcuggccuguuagagcugagu

SEQ ID NO: 774671 - RNA, 19 nt, Human
cuuuucaucaacagccaau

SEQ ID NO: 774672 - RNA, 22 nt, Human
uuggccaaccagaacggagguc

SEQ ID NO: 774673 - RNA, 22 nt, Human
uuugcauuaguuuagauuucaa

SEQ ID NO: 774674 - RNA, 21 nt, Human
cccaccccauaaggcagaacc

SEQ ID NO: 774675 - RNA, 20 nt, Human
acacuucauuugcagcagcu

SEQ ID NO: 774676 - RNA, 22 nt, Human
cacaggaaguggucagugccag

SEQ ID NO: 774677 - RNA, 22 nt, Human
gucagauuaauagcaauaauaa

SEQ ID NO: 774678 - RNA, 22 nt, Human
gaucuuuucagguuucucuagu

SEQ ID NO: 774679 - RNA, 22 nt, Human
ccaggguguagggauuccagau

SEQ ID NO: 774680 - RNA, 22 nt, Human
ggaccuggcaauuugcaucucu

SEQ ID NO: 774681 - RNA, 22 nt, Human
auggaauaauuguuucacagaa

SEQ ID NO: 774682 - RNA, 17 nt, Human
ggcuggaggggacccgg

SEQ ID NO: 774683 - RNA, 21 nt, Human
uggcucaguugcugggcacag

SEQ ID NO: 774684 - RNA, 18 nt, Human
ucagauuuaacuguaucc

SEQ ID NO: 774685 - RNA, 22 nt, Human
augcuuccucuacggccucuga

SEQ ID NO: 774686 - RNA, 22 nt, Human
uaaccaaagggccuaaggaaug

SEQ ID NO: 774687 - RNA, 22 nt, Human
gugaaggauuggagggcaucuu

SEQ ID NO: 774688 - RNA, 22 nt, Human
uugaaaggugacauuguuagag

SEQ ID NO: 774689 - RNA, 22 nt, Human
uacagcuucagugugccccagu

SEQ ID NO: 774690 - RNA, 22 nt, Human
uuucugcucgcucucaaucagg

SEQ ID NO: 774691 - RNA, 22 nt, Human
uccugucagugaggcagaugaa

SEQ ID NO: 774692 - RNA, 20 nt, Human
guuuuucuugggcgagcuau

SEQ ID NO: 774693 - RNA, 22 nt, Human
ccuugggauuucucaugccaau

SEQ ID NO: 774694 - RNA, 19 nt, Human
ccuuccuccccagggccau

SEQ ID NO: 774695 - RNA, 22 nt, Human
uccucagaaaccccugugaggu

SEQ ID NO: 774696 - RNA, 23 nt, Human
ugcuggaauuuguacccuggcag

SEQ ID NO: 774697 - RNA, 22 nt, Human
uuggaaaagcguucucuguagc

SEQ ID NO: 774698 - RNA, 22 nt, Human
aggcccagcuggacaaacugcu

SEQ ID NO: 774699 - RNA, 22 nt, Human
ugucuuaugcugcauagacuau

SEQ ID NO: 774700 - RNA, 22 nt, Human
ccuggcugcucugaugagcgcc

SEQ ID NO: 774701 - RNA, 22 nt, Human
gaugugggguugagggaccagc

SEQ ID NO: 774702 - RNA, 18 nt, Human
gucaccuggaucagauua

SEQ ID NO: 774703 - RNA, 21 nt, Human
uccaggaguggcugggcaggg

SEQ ID NO: 774704 - RNA, 22 nt, Human
uguuccuucacagcaguggaca

SEQ ID NO: 774705 - RNA, 22 nt, Human
cuauacagcagcuuacuaguua

SEQ ID NO: 774706 - RNA, 22 nt, Human
aguccaugguuguaguucucuc

SEQ ID NO: 774707 - RNA, 22 nt, Human
uggauuuaguucuucacaggcc

SEQ ID NO: 774708 - RNA, 19 nt, Human
ugguccagcuucuucuccu

SEQ ID NO: 774709 - RNA, 22 nt, Human
acauuuuuggguugaugucuga

SEQ ID NO: 774710 - RNA, 22 nt, Human
agggaugggaacuccuccagca

SEQ ID NO: 774711 - RNA, 22 nt, Human
guggaggguuugcaaugugcag

SEQ ID NO: 774712 - RNA, 22 nt, Human
cuuccuagugucuacuuuggag

SEQ ID NO: 774713 - RNA, 22 nt, Human
uacauugaaaucaauggaugug

SEQ ID NO: 774714 - RNA, 22 nt, Human
ggagccugagcggcccagggcc

SEQ ID NO: 774715 - RNA, 22 nt, Human
cuguauuucccacauucucuau

SEQ ID NO: 774716 - RNA, 22 nt, Human
ucuuacauauagcaugaguaca

SEQ ID NO: 774717 - RNA, 22 nt, Human
ccuaauuugauuuuaaauagcc

SEQ ID NO: 774718 - RNA, 22 nt, Human
agcagcagauucagcaggaaug

SEQ ID NO: 774719 - RNA, 22 nt, Human
uucacccuggaccagaaauugg

SEQ ID NO: 774720 - RNA, 22 nt, Human
uaaggcagugaaacuauucugu

SEQ ID NO: 774721 - RNA, 22 nt, Human
guggaagggacugccuagagga

SEQ ID NO: 774722 - RNA, 22 nt, Human
uacucugccccagccaauaaug

SEQ ID NO: 774723 - RNA, 22 nt, Human
acuguauucuagucauguuugu

SEQ ID NO: 774724 - RNA, 18 nt, Human
uccugccugcgggcuccc

SEQ ID NO: 774725 - RNA, 22 nt, Human
cggggcugacagcaggugugcu

SEQ ID NO: 774726 - RNA, 22 nt, Human
gcucugggugaauggcagauug

SEQ ID NO: 774727 - RNA, 22 nt, Human
cauacuuugggauaagagugga

SEQ ID NO: 774728 - RNA, 22 nt, Human
acacccagauuaugcacacaaa

SEQ ID NO: 774729 - RNA, 22 nt, Human
ugcuggcccaguauggacugca

SEQ ID NO: 774730 - RNA, 22 nt, Human
agcugccugccaugccgcuggu

SEQ ID NO: 774731 - RNA, 23 nt, Human
aaacuacauuuauaguuuuucuc

SEQ ID NO: 774732 - RNA, 22 nt, Human
auggcugccccaaauuguugcu

SEQ ID NO: 774733 - RNA, 22 nt, Human
aucaagucugccugucuggagg

SEQ ID NO: 774734 - RNA, 22 nt, Human
aucugagucaaauauuucauuu

SEQ ID NO: 774735 - RNA, 22 nt, Human
agagcaauggcauccagcugau

SEQ ID NO: 774736 - RNA, 22 nt, Human
auccagggauaaaaguaagguu

SEQ ID NO: 774737 - RNA, 22 nt, Human
ugcuuccacuaaugagcugugu

SEQ ID NO: 774738 - RNA, 22 nt, Human
ggcuggagguagaagaacacuu

SEQ ID NO: 774739 - RNA, 22 nt, Human
cagaagugcaauuuaaauuagg

SEQ ID NO: 774740 - RNA, 22 nt, Human
ugcaggagcugcuguccugcuc

SEQ ID NO: 774741 - RNA, 22 nt, Human
ugaagaggccgugugcagguga

SEQ ID NO: 774742 - RNA, 22 nt, Human
aaagcaggcagcaggcuggauu

SEQ ID NO: 774743 - RNA, 19 nt, Human
ggcuucaguuuagcaggcu

SEQ ID NO: 774744 - RNA, 22 nt, Human
uucuuuugggaauuacguaugc

SEQ ID NO: 774745 - RNA, 22 nt, Human
cauaaaguagcagagcaugacu

SEQ ID NO: 774746 - RNA, 22 nt, Human
auuuuuuagccaagacucugca

SEQ ID NO: 774747 - RNA, 22 nt, Human
gccccaggugguaaaccuaaga

SEQ ID NO: 774748 - RNA, 22 nt, Human
cacuguaagaugagcuuuuuua

SEQ ID NO: 774749 - RNA, 22 nt, Human
gggaggcacgaggcgcgcagug

SEQ ID NO: 774750 - RNA, 22 nt, Human
uaagaucaguucaaacaugugu

SEQ ID NO: 774751 - RNA, 22 nt, Human
cuacagguaugugcaugacauc

SEQ ID NO: 774752 - RNA, 22 nt, Human
uuguaugaggauagcaagaagc

SEQ ID NO: 774753 - RNA, 22 nt, Human
uaaagugcaggcuacucagaag

SEQ ID NO: 774754 - RNA, 22 nt, Human
cagcugcuuacuagcuguguga

SEQ ID NO: 774755 - RNA, 22 nt, Human
ucugcauuacaugccauagaca

SEQ ID NO: 774756 - RNA, 22 nt, Human
uucauuuguggugaaugaagug

SEQ ID NO: 774757 - RNA, 22 nt, Human
cucaggagguuuccugucuagg

SEQ ID NO: 774758 - RNA, 22 nt, Human
gagcacagccaaaguaagaagg

SEQ ID NO: 774759 - RNA, 22 nt, Human
uuucuccugugaggucagaagu

SEQ ID NO: 774760 - RNA, 22 nt, Human
uuucacacccacuaggacuguu

SEQ ID NO: 774761 - RNA, 22 nt, Human
gaaaaugugucaucccuacugu

SEQ ID NO: 774762 - RNA, 22 nt, Human
cagcauggggcuuggagucagc

SEQ ID NO: 774763 - RNA, 22 nt, Human
ugaaauaauaucuggaucaauc

SEQ ID NO: 774764 - RNA, 22 nt, Human
ugcuuccuauccacacaaugcc

SEQ ID NO: 774765 - RNA, 23 nt, Human
ggcacagaugcugagcaugugca

SEQ ID NO: 774766 - RNA, 22 nt, Human
auacaguagggaccaugucuga

SEQ ID NO: 774767 - RNA, 22 nt, Human
uggggcagccacauagacaaca

SEQ ID NO: 774768 - RNA, 22 nt, Human
cccucacagucuaggagcagcu

SEQ ID NO: 774769 - RNA, 22 nt, Human
caguguuuagaucaagaaggcc

SEQ ID NO: 774770 - RNA, 22 nt, Human
cccaaaggaaggacaaggcaga

SEQ ID NO: 774771 - RNA, 22 nt, Human
uucagagauggaaggcagaaug

SEQ ID NO: 774772 - RNA, 22 nt, Human
ucucagggcucagagcucaggc

SEQ ID NO: 774773 - RNA, 22 nt, Human
gcaccccuggacgguagggcca

SEQ ID NO: 774774 - RNA, 22 nt, Human
auuuaauuguucuucuggcuau

SEQ ID NO: 774775 - RNA, 22 nt, Human
uaaauguauaggcacuaaaccu

SEQ ID NO: 774776 - RNA, 20 nt, Human
uuauguguaccugugcuccc

SEQ ID NO: 774777 - RNA, 20 nt, Human
aguguuucucaacauggggc

SEQ ID NO: 774778 - RNA, 22 nt, Human
uuuauuggaacacagccaugac

SEQ ID NO: 774779 - RNA, 22 nt, Human
uaccucaugcuguacagcacgu

SEQ ID NO: 774780 - RNA, 23 nt, Human
auggggcucaacacuuaguagcu

SEQ ID NO: 774781 - RNA, 22 nt, Human
gagcugaagcgcuacagcaucc

SEQ ID NO: 774782 - RNA, 22 nt, Human
agggagcauugugacauaucac

SEQ ID NO: 774783 - RNA, 22 nt, Human
uuugaagauaaauauggagaaa

SEQ ID NO: 774784 - RNA, 22 nt, Human
ggcaggcaggucuucauggccc

SEQ ID NO: 774785 - RNA, 22 nt, Human
guggaaggugcuagaacaagga

SEQ ID NO: 774786 - RNA, 22 nt, Human
ucaggugaccugagccacuaug

SEQ ID NO: 774787 - RNA, 22 nt, Human
ccuaacuuucauuaggccccag

SEQ ID NO: 774788 - RNA, 22 nt, Human
ucaaugauaguacaaucagccu

SEQ ID NO: 774789 - RNA, 22 nt, Human
ucacagcacauggaccgagucc

SEQ ID NO: 774790 - RNA, 20 nt, Human
gcuguguagcagugugcagu

SEQ ID NO: 774791 - RNA, 22 nt, Human
cuggcacaacuccaccucagcg

SEQ ID NO: 774792 - RNA, 22 nt, Human
ucaagugcuugugagguauuug

SEQ ID NO: 774793 - RNA, 22 nt, Human
ugacagggcuagaggcaaugca

SEQ ID NO: 774794 - RNA, 22 nt, Human
aggaagagguagcugucaaggg

SEQ ID NO: 774795 - RNA, 22 nt, Human
ccaggagggaggaguuccugag

SEQ ID NO: 774796 - RNA, 22 nt, Human
gaauuucagagguaacaucauc

SEQ ID NO: 774797 - RNA, 22 nt, Human
auacacaucuauuuaagagaca

SEQ ID NO: 774798 - RNA, 22 nt, Human
auuauguagguuaggugguugu

SEQ ID NO: 774799 - RNA, 22 nt, Human
aagaaguuagguguaacaauau

SEQ ID NO: 774800 - RNA, 22 nt, Human
aacucauucuaaguauaccaaa

SEQ ID NO: 774801 - RNA, 20 nt, Human
acacauauagcagcauaaac

SEQ ID NO: 774802 - RNA, 22 nt, Human
caguccuugcuaugacccugag

SEQ ID NO: 774803 - RNA, 22 nt, Human
auuuacacuaaaggaaggagga

SEQ ID NO: 774804 - RNA, 22 nt, Human
gcuuucugaagcaguguuucuc

SEQ ID NO: 774805 - RNA, 22 nt, Human
augugugguacagucccguuua

SEQ ID NO: 774806 - RNA, 23 nt, Human
ugugggcgcauuguaaggguagc

SEQ ID NO: 774807 - RNA, 22 nt, Human
gcagcugccgugagcucacgcc

SEQ ID NO: 774808 - RNA, 22 nt, Human
aguaacuaugcuugagaaucag

SEQ ID NO: 774809 - RNA, 22 nt, Human
accaggaacaagccauggagga

SEQ ID NO: 774810 - RNA, 22 nt, Human
ugacucaguacaucuggaguug

SEQ ID NO: 774811 - RNA, 18 nt, Human
cauaauuuucuuucuuua

SEQ ID NO: 774812 - RNA, 22 nt, Human
gcugcugcuugaaggcucggag

SEQ ID NO: 774813 - RNA, 22 nt, Human
uaggccaaggacaguaaggaca

SEQ ID NO: 774814 - RNA, 22 nt, Human
ccucagagguguggcaucucug

SEQ ID NO: 774815 - RNA, 22 nt, Human
guggggcucccaucuccuggcu

SEQ ID NO: 774816 - RNA, 22 nt, Human
gagcuccuggauugcuccuagg

SEQ ID NO: 774817 - RNA, 22 nt, Human
ccucucggcagcccaucuuguc

SEQ ID NO: 774818 - RNA, 22 nt, Human
agaagcagaaggaagcagggcc

SEQ ID NO: 774819 - RNA, 22 nt, Human
auguguccacaggugugagaga

SEQ ID NO: 774820 - RNA, 22 nt, Human
gaagccagcaguggagaaagga

SEQ ID NO: 774821 - RNA, 22 nt, Human
agcacauguauucuccuugaau

SEQ ID NO: 774822 - RNA, 22 nt, Human
ucaaaaguuucacauagagaua

SEQ ID NO: 774823 - RNA, 21 nt, Human
aggauuucugucauuucagau

SEQ ID NO: 774824 - RNA, 22 nt, Human
acauaucuuucccucuccugaa

SEQ ID NO: 774825 - RNA, 22 nt, Human
gagcuuggaagcagauccucac

SEQ ID NO: 774826 - RNA, 22 nt, Human
ggcagugcaaggcuggcacagu

SEQ ID NO: 774827 - RNA, 22 nt, Human
uccacagguaugaggccccacc

SEQ ID NO: 774828 - RNA, 22 nt, Human
agcugaaacccaggccucagcu

SEQ ID NO: 774829 - RNA, 22 nt, Human
agccaccaccacugaaagguua

SEQ ID NO: 774830 - RNA, 22 nt, Human
gcuggccugcugggcaccaccg

SEQ ID NO: 774831 - RNA, 22 nt, Human
ugcagauagcgucauucuugcu

SEQ ID NO: 774832 - RNA, 22 nt, Human
aguggcaguaacauuccacaau

SEQ ID NO: 774833 - RNA, 22 nt, Human
cagugugugacucuggggguac

SEQ ID NO: 774834 - RNA, 22 nt, Human
guuauugacauguauuaagcac

SEQ ID NO: 774835 - RNA, 22 nt, Human
cuucugggagagcuuuugcuuc

SEQ ID NO: 774836 - RNA, 22 nt, Human
aguggcagagcugugucuugaa

SEQ ID NO: 774837 - RNA, 23 nt, Human
ugucccagagggagggauaggcu

SEQ ID NO: 774838 - RNA, 22 nt, Human
ugagcccuaauuuacaacaucu

SEQ ID NO: 774839 - RNA, 22 nt, Human
ugcuguggauucagagaugaaa

SEQ ID NO: 774840 - RNA, 22 nt, Human
gugggaagucucucggaggaag

SEQ ID NO: 774841 - RNA, 22 nt, Human
cggggaagcgguucuggcggua

SEQ ID NO: 774842 - RNA, 22 nt, Human
ucacacuuuccauggcuguuaa

SEQ ID NO: 774843 - RNA, 21 nt, Human
acagcagcaaucugucuuucc

SEQ ID NO: 774844 - RNA, 22 nt, Human
aggcaggcuagucgcuugagcc

SEQ ID NO: 774845 - RNA, 22 nt, Human
uacauugauucaggauauaggc

SEQ ID NO: 774846 - RNA, 22 nt, Human
uaagauuuuuaaaauguccuca

SEQ ID NO: 774847 - RNA, 22 nt, Human
gugugagccaugauguguccag

SEQ ID NO: 774848 - RNA, 22 nt, Human
cacucugaugguuucuguucaa

SEQ ID NO: 774849 - RNA, 22 nt, Human
ucccacacagcccgcucaccgg

SEQ ID NO: 774850 - RNA, 22 nt, Human
ugcuugucacccugccugagug

SEQ ID NO: 774851 - RNA, 22 nt, Human
auugggaagauuuagauccacu

SEQ ID NO: 774852 - RNA, 21 nt, Human
aggaggagagcuuggccuacc

SEQ ID NO: 774853 - RNA, 22 nt, Human
uacuuuauucaggaaggcuggu

SEQ ID NO: 774854 - RNA, 22 nt, Human
ucuuauuugcaacuggcucaga

SEQ ID NO: 774855 - RNA, 19 nt, Human
gcauaaauacacuauuguc

SEQ ID NO: 774856 - RNA, 22 nt, Human
acccggagucggagguugcagu

SEQ ID NO: 774857 - RNA, 22 nt, Human
guggucagaaaucucaguggca

SEQ ID NO: 774858 - RNA, 22 nt, Human
aucacagcacaccugacaugua

SEQ ID NO: 774859 - RNA, 22 nt, Human
guggccuggaguuugauguagg

SEQ ID NO: 774860 - RNA, 22 nt, Human
auaacuuaaugggucaugcucu

SEQ ID NO: 774861 - RNA, 22 nt, Human
uaguuuuacaucagccauuguu

SEQ ID NO: 774862 - RNA, 22 nt, Human
agggcuguaccaucagguuccu

SEQ ID NO: 774863 - RNA, 22 nt, Human
aggaaggugcaguagggugugc

SEQ ID NO: 774864 - RNA, 20 nt, Human
caguccaggcuagaaaacaa

SEQ ID NO: 774865 - RNA, 22 nt, Human
acagaguagcucaagaagauug

SEQ ID NO: 774866 - RNA, 22 nt, Human
gccaggcagcugggagggugcc

SEQ ID NO: 774867 - RNA, 22 nt, Human
gccagagcacaggcugguagua

SEQ ID NO: 774868 - RNA, 22 nt, Human
ggcccugggacacaacaccgaa

SEQ ID NO: 774869 - RNA, 22 nt, Human
gauuuucauuauagcuaguuuc

SEQ ID NO: 774870 - RNA, 22 nt, Human
ugcuugaugagugugccaagca

SEQ ID NO: 774871 - RNA, 22 nt, Human
gucaaaaaguagucauuucugu

SEQ ID NO: 774872 - RNA, 22 nt, Human
ggcaucaggaucugucuugcuu

SEQ ID NO: 774873 - RNA, 22 nt, Human
uuuggcucggcugcugauggug

SEQ ID NO: 774874 - RNA, 22 nt, Human
acagaucacuugacuaaaauga

SEQ ID NO: 774875 - RNA, 22 nt, Human
cugggagcuagcucugagcuga

SEQ ID NO: 774876 - RNA, 22 nt, Human
uuuuaauugcaauuaugguccc

SEQ ID NO: 774877 - RNA, 22 nt, Human
ggucugagagccacugaauccc

SEQ ID NO: 774878 - RNA, 22 nt, Human
aagcaauaaucccaaagugcug

SEQ ID NO: 774879 - RNA, 22 nt, Human
ggcugucagggugagcuggcuu

SEQ ID NO: 774880 - RNA, 22 nt, Human
ucccacuggacgucugugcugg

SEQ ID NO: 774881 - RNA, 23 nt, Human
ugcaauaugucagugcaaagugg

SEQ ID NO: 774882 - RNA, 23 nt, Human
ucagaauaauaaccuaguaacug

SEQ ID NO: 774883 - RNA, 22 nt, Human
uccuugaaugaagagaggugac

SEQ ID NO: 774884 - RNA, 22 nt, Human
uaggaaacaaaccugccucuuc

SEQ ID NO: 774885 - RNA, 22 nt, Human
aacucucauuuuagguguaagg

SEQ ID NO: 774886 - RNA, 22 nt, Human
uccauaagcagguucuuccuga

SEQ ID NO: 774887 - RNA, 22 nt, Human
gcuggcuuugcacugggugcau

SEQ ID NO: 774888 - RNA, 22 nt, Human
ggggcuguugaaguuaguugag

SEQ ID NO: 774889 - RNA, 19 nt, Human
ucugugcugggaggcagca

SEQ ID NO: 774890 - RNA, 22 nt, Human
gcuggaguaucuggggaaggag

SEQ ID NO: 774891 - RNA, 22 nt, Human
caaguccuuuucuuggcucagg

SEQ ID NO: 774892 - RNA, 22 nt, Human
gaaggccuagggaugcucugcg

SEQ ID NO: 774893 - RNA, 22 nt, Human
gugcugcucacaucuggaggua

SEQ ID NO: 774894 - RNA, 19 nt, Human
gggcccagcauggaggguu

SEQ ID NO: 774895 - RNA, 22 nt, Human
gugugugugccugcacacacac

SEQ ID NO: 774896 - RNA, 22 nt, Human
agccugguuuaagcauuuuaua

SEQ ID NO: 774897 - RNA, 22 nt, Human
uaaaggcaaauguguguuugug

SEQ ID NO: 774898 - RNA, 22 nt, Human
acagcuguguuuuauaaucagc

SEQ ID NO: 774899 - RNA, 22 nt, Human
acaacugucaguaaagaauauu

SEQ ID NO: 774900 - RNA, 22 nt, Human
cugggcuacguguugacagcau

SEQ ID NO: 774901 - RNA, 22 nt, Human
cacuugaacccgggaggcugag

SEQ ID NO: 774902 - RNA, 22 nt, Human
aaaggcacuggauagcugggga

SEQ ID NO: 774903 - RNA, 22 nt, Human
gggcugcuuauacugaugauaa

SEQ ID NO: 774904 - RNA, 22 nt, Human
uucuugauuucaugcaguuaag

SEQ ID NO: 774905 - RNA, 22 nt, Human
aucuccgccaucgcgaacgccu

SEQ ID NO: 774906 - RNA, 22 nt, Human
agucaaaggguauuuggauuga

SEQ ID NO: 774907 - RNA, 22 nt, Human
aauaauguugacgauagucuua

SEQ ID NO: 774908 - RNA, 22 nt, Human
aauccagguggcggagguugug

SEQ ID NO: 774909 - RNA, 22 nt, Human
uccugggcagaaugggauggcu

SEQ ID NO: 774910 - RNA, 21 nt, Human
ggagauggguaucgccugggc

SEQ ID NO: 774911 - RNA, 22 nt, Human
agcuggcuauacuugaaaaguc

SEQ ID NO: 774912 - RNA, 22 nt, Human
ucuuugcaguggugaauaaaga

SEQ ID NO: 774913 - RNA, 22 nt, Human
gccacuguccugugccugugcu

SEQ ID NO: 774914 - RNA, 22 nt, Human
gcugucugcugugcacugagca

SEQ ID NO: 774915 - RNA, 22 nt, Human
gcucuauguugaccuucagugg

SEQ ID NO: 774916 - RNA, 22 nt, Human
ucccaggaugaagacaguguug

SEQ ID NO: 774917 - RNA, 22 nt, Human
aggcccagcccguccucgugcu

SEQ ID NO: 774918 - RNA, 22 nt, Human
uguggcuguguccaccugcugc

SEQ ID NO: 774919 - RNA, 22 nt, Human
gagcagcucagaggacuagugu

SEQ ID NO: 774920 - RNA, 22 nt, Human
ugcugguccuggagcuggguuc

SEQ ID NO: 774921 - RNA, 22 nt, Human
ugauucaagcuacuguuacugg

SEQ ID NO: 774922 - RNA, 22 nt, Human
uaggaagggcucagggcucggu

SEQ ID NO: 774923 - RNA, 22 nt, Human
acauagauuuaagagcaauuag

SEQ ID NO: 774924 - RNA, 22 nt, Human
guuugaaaugucugcaagggaa

SEQ ID NO: 774925 - RNA, 22 nt, Human
uucuaagucacucagauuuugg

SEQ ID NO: 774926 - RNA, 22 nt, Human
auuuccauagagcgucucacag

SEQ ID NO: 774927 - RNA, 22 nt, Human
ggaggcgcggcucggcugugcc

SEQ ID NO: 774928 - RNA, 22 nt, Human
gcuggcucuacauuugagguca

SEQ ID NO: 774929 - RNA, 22 nt, Human
ggccagcaggcccugugauccu

SEQ ID NO: 774930 - RNA, 21 nt, Human
uuucaauguguucuuuguagu

SEQ ID NO: 774931 - RNA, 22 nt, Human
ccagucugaggccuggugaggg

SEQ ID NO: 774932 - RNA, 22 nt, Human
guacaugucaaaaaaugcauaa

SEQ ID NO: 774933 - RNA, 22 nt, Human
auauaggcuucaugacagaggg

SEQ ID NO: 774934 - RNA, 22 nt, Human
aggcagcaugggcccagagucc

SEQ ID NO: 774935 - RNA, 22 nt, Human
cugccagcucucuggaggcucu

SEQ ID NO: 774936 - RNA, 22 nt, Human
uggcaccugaacuuagaggugu

SEQ ID NO: 774937 - RNA, 22 nt, Human
cagguccccaggguaccuaccu

SEQ ID NO: 774938 - RNA, 22 nt, Human
gcucagcugggaccaauguguu

SEQ ID NO: 774939 - RNA, 22 nt, Human
caggcagagcugaagauagaug

SEQ ID NO: 774940 - RNA, 22 nt, Human
uaagcauaacuaaaaaugauuu

SEQ ID NO: 774941 - RNA, 19 nt, Human
caaaugggacaggaaggca

SEQ ID NO: 774942 - RNA, 22 nt, Human
uguggggcugugguguucuucu

SEQ ID NO: 774943 - RNA, 22 nt, Human
uugaauaauauguucaggagga

SEQ ID NO: 774944 - RNA, 22 nt, Human
uaaauguaaauggcgucuugcg

SEQ ID NO: 774945 - RNA, 22 nt, Human
gucccagggagguucagggcuu

SEQ ID NO: 774946 - RNA, 22 nt, Human
uuggaaggagccuaaaagagac

SEQ ID NO: 774947 - RNA, 22 nt, Human
ucuugcuaaagaccaacacauu

SEQ ID NO: 774948 - RNA, 22 nt, Human
gagugcaucguggccauuuuaa

SEQ ID NO: 774949 - RNA, 22 nt, Human
cuuucuggaguggaaagguauu

SEQ ID NO: 774950 - RNA, 22 nt, Human
caugaucaccacuugacagccc

SEQ ID NO: 774951 - RNA, 22 nt, Human
cagaaugagauaacccagauug

SEQ ID NO: 774952 - RNA, 19 nt, Human
cugugggcggaggaggggc

SEQ ID NO: 774953 - RNA, 22 nt, Human
uuucugcuaaucuuuuacugag

SEQ ID NO: 774954 - RNA, 22 nt, Human
caguuuauuuccaagaugacaa

SEQ ID NO: 774955 - RNA, 22 nt, Human
augcuuuauguucuggcauuuu

SEQ ID NO: 774956 - RNA, 22 nt, Human
cagccaugagucuaagcaguuu

SEQ ID NO: 774957 - RNA, 22 nt, Human
gccugaaguuucaugccucuau

SEQ ID NO: 774958 - RNA, 22 nt, Human
gaagaacuuauaggaaugucau

SEQ ID NO: 774959 - RNA, 22 nt, Human
aauucagaagcacaaaaccuag

SEQ ID NO: 774960 - RNA, 21 nt, Human
uggcucugaaagagugcugca

SEQ ID NO: 774961 - RNA, 22 nt, Human
ccaggccuagccccugagggua

SEQ ID NO: 774962 - RNA, 22 nt, Human
ugaggccuuuucugucuggcua

SEQ ID NO: 774963 - RNA, 22 nt, Human
uuacacaauuuuauugaccuaa

SEQ ID NO: 774964 - RNA, 22 nt, Human
cuguacaaauggcaguugaguu

SEQ ID NO: 774965 - RNA, 22 nt, Human
uuuuccucugcaauaaaagcag

SEQ ID NO: 774966 - RNA, 22 nt, Human
ucagauggcacacagagccugc

SEQ ID NO: 774967 - RNA, 22 nt, Human
caggccaggguugagaagagaa

SEQ ID NO: 774968 - RNA, 22 nt, Human
aauugcuuuaguuaccauagug

SEQ ID NO: 774969 - RNA, 22 nt, Human
acaugaaaguuauucugaguug

SEQ ID NO: 774970 - RNA, 22 nt, Human
agcugugaccuucaagagcuac

SEQ ID NO: 774971 - RNA, 22 nt, Human
cuggaaagugucuccauccugg

SEQ ID NO: 774972 - RNA, 22 nt, Human
aaauucauuuuucuuagugugc

SEQ ID NO: 774973 - RNA, 22 nt, Human
uugauucaaaggggacaagugg

SEQ ID NO: 774974 - RNA, 22 nt, Human
cccuucagugcuaggcugccug

SEQ ID NO: 774975 - RNA, 22 nt, Human
aguggucaaagacuagauuuca

SEQ ID NO: 774976 - RNA, 22 nt, Human
cucuguggguauuuauauguau

SEQ ID NO: 774977 - RNA, 22 nt, Human
ccccaccauguagaaacugaga

SEQ ID NO: 774978 - RNA, 22 nt, Human
cacauccuucauacucagcucu

SEQ ID NO: 774979 - RNA, 22 nt, Human
ucugaguuuaggaccaggcuga

SEQ ID NO: 774980 - RNA, 22 nt, Human
agagucaguaacauauauggua

SEQ ID NO: 774981 - RNA, 22 nt, Human
ucuggcagagugauaggauaag

SEQ ID NO: 774982 - RNA, 22 nt, Human
ggcugcccucggggucgcaggc

SEQ ID NO: 774983 - RNA, 22 nt, Human
uagcaagcagauuagaagaucc

SEQ ID NO: 774984 - RNA, 22 nt, Human
cugugucuuuccuacuuugugg

SEQ ID NO: 774985 - RNA, 22 nt, Human
auacugauuaguugagaaagca

SEQ ID NO: 774986 - RNA, 22 nt, Human
cauaauaucuccgauuacuugc

SEQ ID NO: 774987 - RNA, 22 nt, Human
cagaaauauuccaaguacugca

SEQ ID NO: 774988 - RNA, 18 nt, Human
cagagcaguaugaauguu

SEQ ID NO: 774989 - RNA, 23 nt, Human
auguaucucauccaaggaagcuc

SEQ ID NO: 774990 - RNA, 22 nt, Human
agucaauuaucucuaggucauc

SEQ ID NO: 774991 - RNA, 22 nt, Human
gguucugaaguggucccauucc

SEQ ID NO: 774992 - RNA, 22 nt, Human
ucuuccagauacuuccugacuu

SEQ ID NO: 774993 - RNA, 22 nt, Human
aaaugucuuugaguuuuuauaa

SEQ ID NO: 774994 - RNA, 22 nt, Human
cuggcccucggaguccagcugc

SEQ ID NO: 774995 - RNA, 22 nt, Human
ccugcccccgucagaggugaug

SEQ ID NO: 774996 - RNA, 22 nt, Human
uguccuugaugaauaugaaauu

SEQ ID NO: 774997 - RNA, 22 nt, Human
auagauauuagcaaaauuuuau

SEQ ID NO: 774998 - RNA, 22 nt, Human
uccuggugggacagaaaaccuc

SEQ ID NO: 774999 - RNA, 19 nt, Human
uccagccccucugugugug

SEQ ID NO: 775000 - RNA, 22 nt, Human
ucugcugagaugcccaugguua

SEQ ID NO: 775001 - RNA, 20 nt, Human
ccucucugcaugcucccuga

SEQ ID NO: 775002 - RNA, 22 nt, Human
guccucuggaagaugaguucuu

SEQ ID NO: 775003 - RNA, 22 nt, Human
uggaacaccuugcuccagaaag

SEQ ID NO: 775004 - RNA, 22 nt, Human
gcagguggauauugcuacuuga

SEQ ID NO: 775005 - RNA, 22 nt, Human
gcgcacauguucagauguguga

SEQ ID NO: 775006 - RNA, 22 nt, Human
gggcugagagugacuguucugu

SEQ ID NO: 775007 - RNA, 22 nt, Human
auucccaccaagcaggccaugc

SEQ ID NO: 775008 - RNA, 22 nt, Human
uuucuaagugugauuuuagauu

SEQ ID NO: 775009 - RNA, 22 nt, Human
ucugagaauggagcuaaaaauc

SEQ ID NO: 775010 - RNA, 22 nt, Human
ccagaaaacucuacaugcuugu

SEQ ID NO: 775011 - RNA, 22 nt, Human
uuguuucaggaugguuuguuac

SEQ ID NO: 775012 - RNA, 20 nt, Human
ugauauuucuggaaguggag

SEQ ID NO: 775013 - RNA, 22 nt, Human
gggcuuuaugagauugagaucu

SEQ ID NO: 775014 - RNA, 22 nt, Human
guuacaaagcacuucaagugaa

SEQ ID NO: 775015 - RNA, 22 nt, Human
cuucagagaguccagggacugc

SEQ ID NO: 775016 - RNA, 22 nt, Human
aaagauuuaugaaguucaauua

SEQ ID NO: 775017 - RNA, 22 nt, Human
ccacaguaagagauaguuuaug

SEQ ID NO: 775018 - RNA, 22 nt, Human
ucucaucucggaucagaaguga

SEQ ID NO: 775019 - RNA, 22 nt, Human
gccugagcagcuauacacacag

SEQ ID NO: 775020 - RNA, 22 nt, Human
uggagcagccuuuucuaagcaa

SEQ ID NO: 775021 - RNA, 22 nt, Human
uauacacauauacguuugugug

SEQ ID NO: 775022 - RNA, 22 nt, Human
uaaucacugugagucuguuuuc

SEQ ID NO: 775023 - RNA, 22 nt, Human
aaguucaagcucugccuaaaau

SEQ ID NO: 775024 - RNA, 22 nt, Human
agguggugaugacagaagacag

SEQ ID NO: 775025 - RNA, 21 nt, Human
uggaaggcugcucugccaggg

SEQ ID NO: 775026 - RNA, 22 nt, Human
ccagucuguacuuugcucuguu

SEQ ID NO: 775027 - RNA, 22 nt, Human
ucugggcugggagcguguggac

SEQ ID NO: 775028 - RNA, 22 nt, Human
ucuccacacuuucucucccagg

SEQ ID NO: 775029 - RNA, 22 nt, Human
uggcagaaguucacuaguagcu

SEQ ID NO: 775030 - RNA, 20 nt, Human
ugcugcugccuccgccucug

SEQ ID NO: 775031 - RNA, 22 nt, Human
uuuuauguugcuauaauaggua

SEQ ID NO: 775032 - RNA, 21 nt, Human
ggugggguaccuaagguagcu

SEQ ID NO: 775033 - RNA, 22 nt, Human
agcacuagccuguuuugcugug

SEQ ID NO: 775034 - RNA, 22 nt, Human
gauguucuuauaccauuguggg

SEQ ID NO: 775035 - RNA, 22 nt, Human
uaaaggcacggaguuguuaugg

SEQ ID NO: 775036 - RNA, 22 nt, Human
aaucacaugaaaacuguguguu

SEQ ID NO: 775037 - RNA, 22 nt, Human
cucaggaggaggaaguucauug

SEQ ID NO: 775038 - RNA, 22 nt, Human
uucucuggggacuugguuggag

SEQ ID NO: 775039 - RNA, 21 nt, Human
ugaauuucgguauggcuauaa

SEQ ID NO: 775040 - RNA, 22 nt, Human
acagcugugauuucuaucauga

SEQ ID NO: 775041 - RNA, 22 nt, Human
gcugagaacagagcucugagcu

SEQ ID NO: 775042 - RNA, 22 nt, Human
uuauucaccaguguaaaacacu

SEQ ID NO: 775043 - RNA, 22 nt, Human
agcccugggcuguagauaagca

SEQ ID NO: 775044 - RNA, 22 nt, Human
ggagcaggagucucuugaauuu

SEQ ID NO: 775045 - RNA, 22 nt, Human
cuguccagcugaccagagcagc

SEQ ID NO: 775046 - RNA, 22 nt, Human
uacauguaguucacugguggca

SEQ ID NO: 775047 - RNA, 22 nt, Human
cucuggcggccaugcucguggu

SEQ ID NO: 775048 - RNA, 22 nt, Human
agucauaaagccagugggaggc

SEQ ID NO: 775049 - RNA, 22 nt, Human
gacaguggaaugacccuuugag

SEQ ID NO: 775050 - RNA, 22 nt, Human
auccuaaaauuguucaauuucu

SEQ ID NO: 775051 - RNA, 22 nt, Human
uuuaucuuuaggacuuugcaga

SEQ ID NO: 775052 - RNA, 22 nt, Human
cagauucugcagucaacuugcu

SEQ ID NO: 775053 - RNA, 22 nt, Human
gcauccagagguagccacugug

SEQ ID NO: 775054 - RNA, 22 nt, Human
gucucucugcuaggccuccagu

SEQ ID NO: 775055 - RNA, 22 nt, Human
cagacacagcaauucuguguug

SEQ ID NO: 775056 - RNA, 22 nt, Human
cccagcucuuccugggagcuaa

SEQ ID NO: 775057 - RNA, 22 nt, Human
gacacuuuaggauuuaaaaguc

SEQ ID NO: 775058 - RNA, 22 nt, Human
auagacaaacacgaagaugaca

SEQ ID NO: 775059 - RNA, 21 nt, Human
augggcagaggcagagaggcu

SEQ ID NO: 775060 - RNA, 22 nt, Human
ucugggcuauauggucucugcu

SEQ ID NO: 775061 - RNA, 22 nt, Human
cagaggcugacaaaauauugcu

SEQ ID NO: 775062 - RNA, 22 nt, Human
aaauguucuaaauuacauguga

SEQ ID NO: 775063 - RNA, 22 nt, Human
acaguccuuguguggaacauua

SEQ ID NO: 775064 - RNA, 22 nt, Human
ugaucaaagccaaaguugagau

SEQ ID NO: 775065 - RNA, 22 nt, Human
acauggaauguguacuaaguua

SEQ ID NO: 775066 - RNA, 22 nt, Human
gcugaggcucaauccccuucug

SEQ ID NO: 775067 - RNA, 22 nt, Human
ggaacacugccuuuuauuuucc

SEQ ID NO: 775068 - RNA, 22 nt, Human
acacagagccagggaauacagu

SEQ ID NO: 775069 - RNA, 22 nt, Human
caguucugacuuucauaauguc

SEQ ID NO: 775070 - RNA, 22 nt, Human
auucugccucacaggcagcugg

SEQ ID NO: 775071 - RNA, 22 nt, Human
ugcuggaguaacaagacacuca

SEQ ID NO: 775072 - RNA, 22 nt, Human
augcuuccagauugguaggggu

SEQ ID NO: 775073 - RNA, 22 nt, Human
ugaaaaggagccuuagguaggu

SEQ ID NO: 775074 - RNA, 22 nt, Human
ucuggagauaagacagacagau

SEQ ID NO: 775075 - RNA, 22 nt, Human
ugggugggagcgcccugucugg

SEQ ID NO: 775076 - RNA, 22 nt, Human
acaaaaaccguggauucagcau

SEQ ID NO: 775077 - RNA, 22 nt, Human
gcccugugagauuagaacagca

SEQ ID NO: 775078 - RNA, 22 nt, Human
gucaggauuaaugggaguaugc

SEQ ID NO: 775079 - RNA, 22 nt, Human
acagcuaacuuaaacuaaccua

SEQ ID NO: 775080 - RNA, 22 nt, Human
aaucacaucucauucaacagcc

SEQ ID NO: 775081 - RNA, 22 nt, Human
gcugucccgcugacuuccagcu

SEQ ID NO: 775082 - RNA, 22 nt, Human
uuuggagagaguuaaauauguu

SEQ ID NO: 775083 - RNA, 22 nt, Human
gagcuggggcggauacucagcu

SEQ ID NO: 775084 - RNA, 22 nt, Human
caguccuugcucugggaugaug

SEQ ID NO: 775085 - RNA, 22 nt, Human
augagcagaugcuccugccucu

SEQ ID NO: 775086 - RNA, 22 nt, Human
aaacagucuugugggcuuggag

SEQ ID NO: 775087 - RNA, 22 nt, Human
uaauaccuggccuugauacagu

SEQ ID NO: 775088 - RNA, 22 nt, Human
gucuccuuguggaucucaagga

SEQ ID NO: 775089 - RNA, 20 nt, Human
cagaaggucuaagcuuuaga

SEQ ID NO: 775090 - RNA, 22 nt, Human
aaguuugagagccuuuaguaua

SEQ ID NO: 775091 - RNA, 22 nt, Human
ugggcccugcccuugucugucc

SEQ ID NO: 775092 - RNA, 22 nt, Human
uuaguuagggcuccugaggacc

SEQ ID NO: 775093 - RNA, 22 nt, Human
auuaggauuuuguccaaguagc

SEQ ID NO: 775094 - RNA, 22 nt, Human
uuucucuucacugugugccuca

SEQ ID NO: 775095 - RNA, 22 nt, Human
ugcucccugcucagagaggcca

SEQ ID NO: 775096 - RNA, 22 nt, Human
ucacauuucucagcacugauga

SEQ ID NO: 775097 - RNA, 22 nt, Human
acugucuuccaggucuggaggu

SEQ ID NO: 775098 - RNA, 22 nt, Human
ucuccugucuucucagcacccc

SEQ ID NO: 775099 - RNA, 22 nt, Human
gcaugauuaauaugcuuacugu

SEQ ID NO: 775100 - RNA, 22 nt, Human
ucaggcugaccagguuuugcuc

SEQ ID NO: 775101 - RNA, 22 nt, Human
aauuuccaaauuucugucacac

SEQ ID NO: 775102 - RNA, 19 nt, Human
ugugauaagcagaauucca

SEQ ID NO: 775103 - RNA, 22 nt, Human
uucucacuauguauguagauug

SEQ ID NO: 775104 - RNA, 22 nt, Human
gcaaggcucccgcagcccaggg

SEQ ID NO: 775105 - RNA, 22 nt, Human
ugauguucuguauaucauauag

SEQ ID NO: 775106 - RNA, 18 nt, Human
ucuccuuccaaaucuuca

SEQ ID NO: 775107 - RNA, 22 nt, Human
acugagcagaagagaucuguga

SEQ ID NO: 775108 - RNA, 22 nt, Human
ccaggggcugcagauccauggu

SEQ ID NO: 775109 - RNA, 22 nt, Human
acagguggcauaggcaguuuga

SEQ ID NO: 775110 - RNA, 22 nt, Human
auaaucaaaguccuaugacauc

SEQ ID NO: 775111 - RNA, 21 nt, Human
ucauuucucuauguauuucac

SEQ ID NO: 775112 - RNA, 22 nt, Human
cugcaguuugcuaagagacaaa

SEQ ID NO: 775113 - RNA, 22 nt, Human
gauuuccaggacgggagguggg

SEQ ID NO: 775114 - RNA, 22 nt, Human
uuuuaacacucagcacuaucuc

SEQ ID NO: 775115 - RNA, 22 nt, Human
auauagguuaucauauuugccc

SEQ ID NO: 775116 - RNA, 22 nt, Human
acauucugucaacagugagcag

SEQ ID NO: 775117 - RNA, 22 nt, Human
agagccugaggaugucccagcu

SEQ ID NO: 775118 - RNA, 23 nt, Human
gcucagaugcccuaggagguggc

SEQ ID NO: 775119 - RNA, 22 nt, Human
gauauuuuugcagacaccuggg

SEQ ID NO: 775120 - RNA, 22 nt, Human
gugcucugggcugccugacaug

SEQ ID NO: 775121 - RNA, 22 nt, Human
aggucauuacaauuaucauuuu

SEQ ID NO: 775122 - RNA, 22 nt, Human
gcacuugaagaauugaacugga

SEQ ID NO: 775123 - RNA, 22 nt, Human
uagucagagucuucucuguugu

SEQ ID NO: 775124 - RNA, 22 nt, Human
aaauaaucaauuuuuguagaua

SEQ ID NO: 775125 - RNA, 18 nt, Human
ccugaagccugugucuuu

SEQ ID NO: 775126 - RNA, 22 nt, Human
ucccaggcgccugguggggagc

SEQ ID NO: 775127 - RNA, 22 nt, Human
agaggggaggcgaaccagaguc

SEQ ID NO: 775128 - RNA, 22 nt, Human
guacagaaaguacccauagaag

SEQ ID NO: 775129 - RNA, 18 nt, Human
cagugucuugguaaaaua

SEQ ID NO: 775130 - RNA, 20 nt, Human
cccugcagccaugggagugg

SEQ ID NO: 775131 - RNA, 22 nt, Human
uuuaacuuaaucugcuugauga

SEQ ID NO: 775132 - RNA, 22 nt, Human
uauguccugcuacucucucaug

SEQ ID NO: 775133 - RNA, 22 nt, Human
aggaccuuuggcaaggcugcuc

SEQ ID NO: 775134 - RNA, 22 nt, Human
ucagagucauugcaaguagaag

SEQ ID NO: 775135 - RNA, 22 nt, Human
ucugcccuaauucagugcuuag

SEQ ID NO: 775136 - RNA, 22 nt, Human
ugcagcugaugauacccccaug

SEQ ID NO: 775137 - RNA, 22 nt, Human
aguccuggguccagcagguccu

SEQ ID NO: 775138 - RNA, 22 nt, Human
gggagggucugagagcugcacc

SEQ ID NO: 775139 - RNA, 22 nt, Human
gaaacauacgauuuaggagaaa

SEQ ID NO: 775140 - RNA, 22 nt, Human
aggugagugugacugcaagaga

SEQ ID NO: 775141 - RNA, 22 nt, Human
gaggcacagucccgaggcaagg

SEQ ID NO: 775142 - RNA, 22 nt, Human
gagcuuuaagggcacuggucuu

SEQ ID NO: 775143 - RNA, 23 nt, Human
ccagccucugggucuucauccag

SEQ ID NO: 775144 - RNA, 22 nt, Human
cugucuguugaccauaguuugc

SEQ ID NO: 775145 - RNA, 22 nt, Human
ucuugggauugcccugcaguuc

SEQ ID NO: 775146 - RNA, 22 nt, Human
acugugggccuuuccuuugacc

SEQ ID NO: 775147 - RNA, 22 nt, Human
ccaagagguugugaggcaggca

SEQ ID NO: 775148 - RNA, 22 nt, Human
cuguggcuggccuuauugcugc

SEQ ID NO: 775149 - RNA, 22 nt, Human
gugcagggagcccagaaggucc

SEQ ID NO: 775150 - RNA, 22 nt, Human
cacagguguuuguuauacucag

SEQ ID NO: 775151 - RNA, 22 nt, Human
auacuuugcuaguaucagugug

SEQ ID NO: 775152 - RNA, 22 nt, Human
aggcaguguguagcuggaagag

SEQ ID NO: 775153 - RNA, 22 nt, Human
cugcuucaaggaaaugaaucgg

SEQ ID NO: 775154 - RNA, 19 nt, Human
aggaggccaugccacuaga

SEQ ID NO: 775155 - RNA, 22 nt, Human
gacagcagacagaacuaccugc

SEQ ID NO: 775156 - RNA, 22 nt, Human
gggggugacgauggcagcuggu

SEQ ID NO: 775157 - RNA, 23 nt, Human
ugcagagggacugaagccagcuu

SEQ ID NO: 775158 - RNA, 22 nt, Human
ugcaggccggcccuaggccuca

SEQ ID NO: 775159 - RNA, 22 nt, Human
ucugucuuagccaucucaggcu

SEQ ID NO: 775160 - RNA, 22 nt, Human
ugggcuccuugggagcaaguga

SEQ ID NO: 775161 - RNA, 22 nt, Human
gugcagcugggcgcugaccuuc

SEQ ID NO: 775162 - RNA, 22 nt, Human
ccuagaggcugcaaggagaggc

SEQ ID NO: 775163 - RNA, 22 nt, Human
ucaauucuaguggagagaguuu

SEQ ID NO: 775164 - RNA, 23 nt, Human
ccaaagucgaagucuaguccaga

SEQ ID NO: 775165 - RNA, 20 nt, Human
cugacagaaaauauuucauc

SEQ ID NO: 775166 - RNA, 22 nt, Human
gcaggaagaugagcucagguaa

SEQ ID NO: 775167 - RNA, 22 nt, Human
uauaugcuugugcaugucuuug

SEQ ID NO: 775168 - RNA, 22 nt, Human
cagcacaucugauuauaugacu

SEQ ID NO: 775169 - RNA, 19 nt, Human
auucuucucaaauauccau

SEQ ID NO: 775170 - RNA, 22 nt, Human
ccagcuuuugcacuggacuggg

SEQ ID NO: 775171 - RNA, 22 nt, Human
ucugauuucucuuguggaugcu

SEQ ID NO: 775172 - RNA, 22 nt, Human
uuggaaagaccgaauuccuguu

SEQ ID NO: 775173 - RNA, 22 nt, Human
ucacuucccucuucagcuccca

SEQ ID NO: 775174 - RNA, 22 nt, Human
cuaaagauaaggaaaguauccu

SEQ ID NO: 775175 - RNA, 21 nt, Human
ccuggcagaagccugauaugc

SEQ ID NO: 775176 - RNA, 19 nt, Human
aggcagucauuggaauaua

SEQ ID NO: 775177 - RNA, 22 nt, Human
uauugaaauucuucauguccuc

SEQ ID NO: 775178 - RNA, 22 nt, Human
cuguggcuuugcagggcuuguu

SEQ ID NO: 775179 - RNA, 22 nt, Human
ccuuuucuagaaagggaggcaa

SEQ ID NO: 775180 - RNA, 22 nt, Human
cacugcaguuccccagugcgca

SEQ ID NO: 775181 - RNA, 22 nt, Human
ggccaccuggcugugggggcag

SEQ ID NO: 775182 - RNA, 21 nt, Human
aguuacauguauagauaaagu

SEQ ID NO: 775183 - RNA, 22 nt, Human
gucaugccuggcuucuuagaca

SEQ ID NO: 775184 - RNA, 22 nt, Human
aauugagaugacagaggaauag

SEQ ID NO: 775185 - RNA, 22 nt, Human
uuuauucuaacuugcugcucua

SEQ ID NO: 775186 - RNA, 22 nt, Human
cuggcucuguggcuuccuucau

SEQ ID NO: 775187 - RNA, 22 nt, Human
gucugcuuuucugcccuuucau

SEQ ID NO: 775188 - RNA, 22 nt, Human
aucagcaaucucguguauuagg

SEQ ID NO: 775189 - RNA, 22 nt, Human
uucugugugccagaguugugcu

SEQ ID NO: 775190 - RNA, 22 nt, Human
uggagcaggacggggaguggua

SEQ ID NO: 775191 - RNA, 22 nt, Human
auguaugcuuugauuuuagaug

SEQ ID NO: 775192 - RNA, 20 nt, Human
ucacauccucucccaacaug

SEQ ID NO: 775193 - RNA, 22 nt, Human
uauuuuaaagugaagggucuug

SEQ ID NO: 775194 - RNA, 22 nt, Human
guccagcccucugccuccaggu

SEQ ID NO: 775195 - RNA, 22 nt, Human
accagcuguuaggcuuggugcu

SEQ ID NO: 775196 - RNA, 22 nt, Human
ugggccugcuggggcauuuuca

SEQ ID NO: 775197 - RNA, 19 nt, Human
acuagauacaacaugcaga

SEQ ID NO: 775198 - RNA, 21 nt, Human
cucuacauucccagcaacucu

SEQ ID NO: 775199 - RNA, 22 nt, Human
ugugugaaucuauugaauauau

SEQ ID NO: 775200 - RNA, 22 nt, Human
uggaggauuaaucuggaaagau

SEQ ID NO: 775201 - RNA, 22 nt, Human
agacauaagcgagcaucacagg

SEQ ID NO: 775202 - RNA, 22 nt, Human
ggucauugaaaucagaaggguu

SEQ ID NO: 775203 - RNA, 22 nt, Human
aauugcuuuugggggcaguuac

SEQ ID NO: 775204 - RNA, 22 nt, Human
aauaguguuguucacucaggag

SEQ ID NO: 775205 - RNA, 20 nt, Human
uggcugcacaccaggacagg

SEQ ID NO: 775206 - RNA, 22 nt, Human
cuguggcucaggccuguaagcc

SEQ ID NO: 775207 - RNA, 22 nt, Human
uugggguggaagugaggaucau

SEQ ID NO: 775208 - RNA, 22 nt, Human
uccaggcucagucaagcacuuc

SEQ ID NO: 775209 - RNA, 22 nt, Human
agacagacagagaauuuaaaua

SEQ ID NO: 775210 - RNA, 21 nt, Human
cuacagaagcucuccuaucca

SEQ ID NO: 775211 - RNA, 22 nt, Human
acagcacaaucugagucccaga

SEQ ID NO: 775212 - RNA, 22 nt, Human
ucuggggagucaaagagaccug

SEQ ID NO: 775213 - RNA, 22 nt, Human
ucugauguggcagcugcaucua

SEQ ID NO: 775214 - RNA, 22 nt, Human
ggcuucagauuucucaguuguu

SEQ ID NO: 775215 - RNA, 22 nt, Human
acuugaaacaucuuuaaaugua

SEQ ID NO: 775216 - RNA, 22 nt, Human
cacuugaaugagaauuuccugg

SEQ ID NO: 775217 - RNA, 21 nt, Human
ugaacaaaguucuuaucguga

SEQ ID NO: 775218 - RNA, 22 nt, Human
cuccuucaugucauguguccgg

SEQ ID NO: 775219 - RNA, 22 nt, Human
uugagacacaaggcacaguaag

SEQ ID NO: 775220 - RNA, 20 nt, Human
ugaauaugaccuuauuugga

SEQ ID NO: 775221 - RNA, 22 nt, Human
ugcagguggauucaauguggga

SEQ ID NO: 775222 - RNA, 22 nt, Human
ucugggcugcuucagccuucgc

SEQ ID NO: 775223 - RNA, 22 nt, Human
gccagcugugcuuuuccuaaaa

SEQ ID NO: 775224 - RNA, 22 nt, Human
cacacaugacccacuuuuaccg

SEQ ID NO: 775225 - RNA, 22 nt, Human
auggguaggauuuacucagaug

SEQ ID NO: 775226 - RNA, 22 nt, Human
caaguaauucugcaagaaacca

SEQ ID NO: 775227 - RNA, 22 nt, Human
uggucucugagccuuccugugg

SEQ ID NO: 775228 - RNA, 22 nt, Human
gcacagaggaugaggcagcucu

SEQ ID NO: 775229 - RNA, 22 nt, Human
gaucagaaucuucauuuucagu

SEQ ID NO: 775230 - RNA, 22 nt, Human
ucagagugaggcgucaacauga

SEQ ID NO: 775231 - RNA, 22 nt, Human
uccagggagcaagucaggccgg

SEQ ID NO: 775232 - RNA, 22 nt, Human
cagguaggauggaagggcucaa

SEQ ID NO: 775233 - RNA, 22 nt, Human
agguaaaugaauguuuagucuu

SEQ ID NO: 775234 - RNA, 22 nt, Human
ccuggagcaaaaaucuaaggag

SEQ ID NO: 775235 - RNA, 22 nt, Human
gcacugugcuagguaucaggga

SEQ ID NO: 775236 - RNA, 22 nt, Human
agaaugcagcuugccaguaucu

SEQ ID NO: 775237 - RNA, 22 nt, Human
uugauucauauagauaugcgug

SEQ ID NO: 775238 - RNA, 22 nt, Human
uuccucagcuguuugggcucau

SEQ ID NO: 775239 - RNA, 22 nt, Human
aaagcucuuggauuuuagacuc

SEQ ID NO: 775240 - RNA, 22 nt, Human
uuuccuggcucuguggccuugu

SEQ ID NO: 775241 - RNA, 22 nt, Human
uacagcacaaagggccuuuacc

SEQ ID NO: 775242 - RNA, 22 nt, Human
aacaauaacuagacaugccaug

SEQ ID NO: 775243 - RNA, 22 nt, Human
uauuugcaggcuuuugucaugg

SEQ ID NO: 775244 - RNA, 22 nt, Human
aaggaucugacagacuauagaa

SEQ ID NO: 775245 - RNA, 22 nt, Human
gaggcaccucgcgggaggaggc

SEQ ID NO: 775246 - RNA, 22 nt, Human
uauugucacgucuuaauucuag

SEQ ID NO: 775247 - RNA, 22 nt, Human
caggcaagcacggugaaccugg

SEQ ID NO: 775248 - RNA, 22 nt, Human
ccagcugcuaucaugccauuuc

SEQ ID NO: 775249 - RNA, 22 nt, Human
augcacaggcugugggcugguu

SEQ ID NO: 775250 - RNA, 23 nt, Human
aaguagauaacacuguucugaga

SEQ ID NO: 775251 - RNA, 22 nt, Human
uaggcaggcugaauguagauuu

SEQ ID NO: 775252 - RNA, 22 nt, Human
caaggccaguuucuccuaguca

SEQ ID NO: 775253 - RNA, 22 nt, Human
aucaagcagugaaaaaugcuag

SEQ ID NO: 775254 - RNA, 22 nt, Human
ugggauaucugucagcagcuuc

SEQ ID NO: 775255 - RNA, 22 nt, Human
caggugcugcagggcuggcguc

SEQ ID NO: 775256 - RNA, 22 nt, Human
cuuuagauguugcuuuaacuau

SEQ ID NO: 775257 - RNA, 23 nt, Human
ggucccugacagcgggcaaguug

SEQ ID NO: 775258 - RNA, 23 nt, Human
ggacacauuuauuucagaauuca

SEQ ID NO: 775259 - RNA, 18 nt, Human
ggcagccuggacaugcuc

SEQ ID NO: 775260 - RNA, 22 nt, Human
uccaguuuauuuuuggcagggu

SEQ ID NO: 775261 - RNA, 20 nt, Human
auuugcuuaccuuguuucua

SEQ ID NO: 775262 - RNA, 22 nt, Human
aggagacauggaauagugaggc

SEQ ID NO: 775263 - RNA, 22 nt, Human
gugauuucuaaucaucugaaug

SEQ ID NO: 775264 - RNA, 22 nt, Human
uuaaugaccuagagcaguaauu

SEQ ID NO: 775265 - RNA, 22 nt, Human
gagauuucuuuugaugccuguc

SEQ ID NO: 775266 - RNA, 22 nt, Human
uccaggcauuccagccauucca

SEQ ID NO: 775267 - RNA, 22 nt, Human
gaguuuaaauaacacauuucca

SEQ ID NO: 775268 - RNA, 22 nt, Human
uaguuuaggaauuaugagggug

SEQ ID NO: 775269 - RNA, 22 nt, Human
ucauacaucuguccuggagcuc

SEQ ID NO: 775270 - RNA, 22 nt, Human
gcugagugauucauacgcugcu

SEQ ID NO: 775271 - RNA, 23 nt, Human
ccagcugugccuggcccaggagc

SEQ ID NO: 775272 - RNA, 22 nt, Human
cagagcugacccaaggauugaa

SEQ ID NO: 775273 - RNA, 21 nt, Human
aauggcuuauacagaaguaag

SEQ ID NO: 775274 - RNA, 22 nt, Human
ugaguagagaauucagcuaagg

SEQ ID NO: 775275 - RNA, 22 nt, Human
gcugcuggccccacaugcucca

SEQ ID NO: 775276 - RNA, 22 nt, Human
ucaguggauuguagaaggcuua

SEQ ID NO: 775277 - RNA, 22 nt, Human
aauaguuugaauuuaucagaug

SEQ ID NO: 775278 - RNA, 22 nt, Human
cagaggaaguuccuugaugaga

SEQ ID NO: 775279 - RNA, 22 nt, Human
ccugggagggcaagugcugaug

SEQ ID NO: 775280 - RNA, 23 nt, Human
uagggcagcugggagggacaugc

SEQ ID NO: 775281 - RNA, 22 nt, Human
aggggcuuauguuucuccaggc

SEQ ID NO: 775282 - RNA, 22 nt, Human
ugccugccaaugaugcuugugu

SEQ ID NO: 775283 - RNA, 22 nt, Human
caguuucuguuuuaaauagcag

SEQ ID NO: 775284 - RNA, 22 nt, Human
caaucagauaugugacauauuu

SEQ ID NO: 775285 - RNA, 22 nt, Human
cuguauuuuuuaagaauaucuc

SEQ ID NO: 775286 - RNA, 21 nt, Human
ccagagagagggaaguggguu

SEQ ID NO: 775287 - RNA, 22 nt, Human
ucaguguugugcacauacaaaa

SEQ ID NO: 775288 - RNA, 23 nt, Human
augcccugugcagaaauguggaa

SEQ ID NO: 775289 - RNA, 19 nt, Human
acacuguagauauagcuau

SEQ ID NO: 775290 - RNA, 22 nt, Human
uacagagaggugacccuugggc

SEQ ID NO: 775291 - RNA, 22 nt, Human
gaaggaaaucugugauuuaugc

SEQ ID NO: 775292 - RNA, 21 nt, Human
aguaucauaaugaauaguucu

SEQ ID NO: 775293 - RNA, 22 nt, Human
cugaagcacagcauauaaauaa

SEQ ID NO: 775294 - RNA, 22 nt, Human
acuaguauucuuggucuuguau

SEQ ID NO: 775295 - RNA, 22 nt, Human
ggucacaugcggggcuguagcc

SEQ ID NO: 775296 - RNA, 22 nt, Human
cugcaucuguuagauuaucacc

SEQ ID NO: 775297 - RNA, 22 nt, Human
aggacccugaggucuccuguga

SEQ ID NO: 775298 - RNA, 22 nt, Human
uuccaaggcccagcagagagga

SEQ ID NO: 775299 - RNA, 22 nt, Human
ccugggagagcugcccggguga

SEQ ID NO: 775300 - RNA, 22 nt, Human
acaggauggccagcugauauug

SEQ ID NO: 775301 - RNA, 22 nt, Human
gucuacaaagcuucaagucucu

SEQ ID NO: 775302 - RNA, 22 nt, Human
agcauauaggaaauguugaauc

SEQ ID NO: 775303 - RNA, 22 nt, Human
gccuccggaguugcagugucuu

SEQ ID NO: 775304 - RNA, 20 nt, Human
cagagcugggauuugaacac

SEQ ID NO: 775305 - RNA, 21 nt, Human
ucaccuggcuucugaccuggc

SEQ ID NO: 775306 - RNA, 22 nt, Human
ugagaagcugcugacuuagccu

SEQ ID NO: 775307 - RNA, 22 nt, Human
ucauggcuaaccaaggccugau

SEQ ID NO: 775308 - RNA, 22 nt, Human
uccuggcugucacucggguuga

SEQ ID NO: 775309 - RNA, 22 nt, Human
aggcuggagugugcaguggcgc

SEQ ID NO: 775310 - RNA, 22 nt, Human
uuccagcccgcgacuuguucag

SEQ ID NO: 775311 - RNA, 22 nt, Human
cuuuaccacaaggacagaacuu

SEQ ID NO: 775312 - RNA, 22 nt, Human
acgaauaagagauaaagcaagg

SEQ ID NO: 775313 - RNA, 22 nt, Human
aggcugagggcuccugagggca

SEQ ID NO: 775314 - RNA, 18 nt, Human
agagaugggaguuggaaa

SEQ ID NO: 775315 - RNA, 22 nt, Human
auuucacaaaccauccugauuu

SEQ ID NO: 775316 - RNA, 22 nt, Human
uuuacagcuacuguccuauuuc

SEQ ID NO: 775317 - RNA, 22 nt, Human
agaguggccuggccuggggcau

SEQ ID NO: 775318 - RNA, 22 nt, Human
ugagggcuaaauuguggcaggu

SEQ ID NO: 775319 - RNA, 22 nt, Human
agagaaaagaguucaggcuuug

SEQ ID NO: 775320 - RNA, 22 nt, Human
agugauguugacuagcuauaag

SEQ ID NO: 775321 - RNA, 22 nt, Human
auaaugugauauuucauuuaca

SEQ ID NO: 775322 - RNA, 22 nt, Human
ugcagggccuugggucuuucuu

SEQ ID NO: 775323 - RNA, 22 nt, Human
cauaauuucuguaucagcacca

SEQ ID NO: 775324 - RNA, 22 nt, Human
uucuggaaacccucagccagug

SEQ ID NO: 775325 - RNA, 22 nt, Human
cugccuugaggagguuguggga

SEQ ID NO: 775326 - RNA, 22 nt, Human
aggccuuuguggagcucauggc

SEQ ID NO: 775327 - RNA, 19 nt, Human
uggagggguuugaaugugg

SEQ ID NO: 775328 - RNA, 22 nt, Human
uacaagaaaguccaguggguuu

SEQ ID NO: 775329 - RNA, 22 nt, Human
aaaggcuucuuugcuccauguc

SEQ ID NO: 775330 - RNA, 23 nt, Human
agacagaggcugaggcuggccgc

SEQ ID NO: 775331 - RNA, 22 nt, Human
ugugugauuccacuuauauggg

SEQ ID NO: 775332 - RNA, 22 nt, Human
uccagccuaggggaacagcugc

SEQ ID NO: 775333 - RNA, 22 nt, Human
agugcuuugguauagaacuauu

SEQ ID NO: 775334 - RNA, 22 nt, Human
agaagccauugaagcagaccuc

SEQ ID NO: 775335 - RNA, 18 nt, Human
ugaacacaguacaauucc

SEQ ID NO: 775336 - RNA, 22 nt, Human
auuugcuuucagguauaaaagg

SEQ ID NO: 775337 - RNA, 22 nt, Human
ugcagugggccggaggccaggg

SEQ ID NO: 775338 - RNA, 21 nt, Human
agacagacugccugacccacg

SEQ ID NO: 775339 - RNA, 22 nt, Human
ggagugagagaguuuaagguca

SEQ ID NO: 775340 - RNA, 21 nt, Human
agggccugugcucuccagguc

SEQ ID NO: 775341 - RNA, 22 nt, Human
aggucaagggcaagagugaggu

SEQ ID NO: 775342 - RNA, 22 nt, Human
ggccccugcggacugccuagag

SEQ ID NO: 775343 - RNA, 22 nt, Human
caagggcugaacacagguuuca

SEQ ID NO: 775344 - RNA, 22 nt, Human
auccuugagaaaauaaaugacc

SEQ ID NO: 775345 - RNA, 19 nt, Human
ccuuccccuucagccucug

SEQ ID NO: 775346 - RNA, 22 nt, Human
guucaucucacagauaggcagu

SEQ ID NO: 775347 - RNA, 21 nt, Human
accuuuggaaagacccuggga

SEQ ID NO: 775348 - RNA, 22 nt, Human
agagauccuucaaucuaguuuu

SEQ ID NO: 775349 - RNA, 22 nt, Human
ugggagaacccagggucaggcu

SEQ ID NO: 775350 - RNA, 22 nt, Human
ucuggcuccuggcuccacugcc

SEQ ID NO: 775351 - RNA, 22 nt, Human
aagggccuccuggggagccugg

SEQ ID NO: 775352 - RNA, 22 nt, Human
cagagggaucaucuuccugaag

SEQ ID NO: 775353 - RNA, 22 nt, Human
ccaggggaaacagggagcacuc

SEQ ID NO: 775354 - RNA, 22 nt, Human
uggcuaggaauccaugacucuc

SEQ ID NO: 775355 - RNA, 22 nt, Human
gaagcccuguaggugcaaaggu

SEQ ID NO: 775356 - RNA, 22 nt, Human
ucuaaacuacgucaaaacuagu

SEQ ID NO: 775357 - RNA, 22 nt, Human
cccagcuccuuacagggccgaa

SEQ ID NO: 775358 - RNA, 22 nt, Human
agcacugauuuuguugcacuua

SEQ ID NO: 775359 - RNA, 22 nt, Human
guuuugugaggcacccacaggu

SEQ ID NO: 775360 - RNA, 22 nt, Human
uguauaaauuuaaauuccugcu

SEQ ID NO: 775361 - RNA, 22 nt, Human
agauuuuaguuuggggaggugc

SEQ ID NO: 775362 - RNA, 21 nt, Human
acagagcauaaugguguggca

SEQ ID NO: 775363 - RNA, 22 nt, Human
ugugggcuguacugagggcagg

SEQ ID NO: 775364 - RNA, 22 nt, Human
gggcuggagagucccacguggg

SEQ ID NO: 775365 - RNA, 22 nt, Human
gccuggcugucuggcaagguuc

SEQ ID NO: 775366 - RNA, 22 nt, Human
ucaucugaccccaucuauucuc

SEQ ID NO: 775367 - RNA, 22 nt, Human
uagaggggaaucugccuccucu

SEQ ID NO: 775368 - RNA, 22 nt, Human
uugcuuuaccauuugaucucua

SEQ ID NO: 775369 - RNA, 22 nt, Human
agcagcaggcuguguggacuga

SEQ ID NO: 775370 - RNA, 22 nt, Human
accugguuccuccucacugcug

SEQ ID NO: 775371 - RNA, 19 nt, Human
ucaaggcucccugagggau

SEQ ID NO: 775372 - RNA, 22 nt, Human
cagcccuggugccaagguuccc

SEQ ID NO: 775373 - RNA, 22 nt, Human
acucugacauuuaaaaagcaau

SEQ ID NO: 775374 - RNA, 22 nt, Human
gccaggaguguguggcuauguu

SEQ ID NO: 775375 - RNA, 22 nt, Human
aaaaguaauugcgguuuuugcu

SEQ ID NO: 775376 - RNA, 22 nt, Human
uucacauuucucugcuguuuga

SEQ ID NO: 775377 - RNA, 22 nt, Human
gcagcugauggaaguccuauug

SEQ ID NO: 775378 - RNA, 22 nt, Human
auuauuuccuugcuuugaggaa

SEQ ID NO: 775379 - RNA, 19 nt, Human
cagcucaguuugauucucu

SEQ ID NO: 775380 - RNA, 18 nt, Human
ugacucacccugucagug

SEQ ID NO: 775381 - RNA, 22 nt, Human
ucacuuuggaagauagcacauc

SEQ ID NO: 775382 - RNA, 22 nt, Human
aagucagcacuccaggaagcca

SEQ ID NO: 775383 - RNA, 22 nt, Human
acuuuucugcagaugaucucuu

SEQ ID NO: 775384 - RNA, 22 nt, Human
ugccugccaggcaaccugggag

SEQ ID NO: 775385 - RNA, 22 nt, Human
gagggcugauaacaggaauaca

SEQ ID NO: 775386 - RNA, 22 nt, Human
ucuggggagcagcccuggugag

SEQ ID NO: 775387 - RNA, 22 nt, Human
gcugggcuucacagagccuuua

SEQ ID NO: 775388 - RNA, 22 nt, Human
caggcuucgcucugugggcagg

SEQ ID NO: 775389 - RNA, 22 nt, Human
gcauggcaagaucaggagacca

SEQ ID NO: 775390 - RNA, 22 nt, Human
aggcccagacucagcggggcgg

SEQ ID NO: 775391 - RNA, 22 nt, Human
caggcugcuguccacaaagcau

SEQ ID NO: 775392 - RNA, 22 nt, Human
uggaggccgcguagucugagca

SEQ ID NO: 775393 - RNA, 22 nt, Human
aaggagagagcuuugcuggaac

SEQ ID NO: 775394 - RNA, 22 nt, Human
caucaagauggaagagcaaaua

SEQ ID NO: 775395 - RNA, 22 nt, Human
uacacugucuuagaaaggggca

SEQ ID NO: 775396 - RNA, 22 nt, Human
caugcacauuauucaaagccca

SEQ ID NO: 775397 - RNA, 22 nt, Human
cuggaaagacagagggcauggg

SEQ ID NO: 775398 - RNA, 22 nt, Human
auccuguggcuccagggagccg

SEQ ID NO: 775399 - RNA, 22 nt, Human
ucugggagagggaaagaagacu

SEQ ID NO: 775400 - RNA, 22 nt, Human
ucagaggacgcacuaggguugu

SEQ ID NO: 775401 - RNA, 22 nt, Human
gagguagcgaguggacagugca

SEQ ID NO: 775402 - RNA, 22 nt, Human
ugugaagaguagacauguggug

SEQ ID NO: 775403 - RNA, 22 nt, Human
ggugaggggcgccucugcccag

SEQ ID NO: 775404 - RNA, 22 nt, Human
gcagggacaccuuugugaagcu

SEQ ID NO: 775405 - RNA, 22 nt, Human
acugucgauuaugaugagucag

SEQ ID NO: 775406 - RNA, 22 nt, Human
ugaggcagcuuuuucugugugu

SEQ ID NO: 775407 - RNA, 22 nt, Human
gauuaguugauuaagagucaga

SEQ ID NO: 775408 - RNA, 22 nt, Human
acaguguuuggcaaugcaugca

SEQ ID NO: 775409 - RNA, 20 nt, Human
uauuugaaauggccaagugu

SEQ ID NO: 775410 - RNA, 22 nt, Human
ugcaaggguagaagugauggca

SEQ ID NO: 775411 - RNA, 22 nt, Human
agcagagccugggcuaggggug

SEQ ID NO: 775412 - RNA, 22 nt, Human
cagguaguccacagugagggag

SEQ ID NO: 775413 - RNA, 22 nt, Human
agggacacuugcuuucaggccc

SEQ ID NO: 775414 - RNA, 19 nt, Human
ccuggaggugaagguucuc

SEQ ID NO: 775415 - RNA, 22 nt, Human
auuguuuuccaaagaugcugcu

SEQ ID NO: 775416 - RNA, 22 nt, Human
guucuuugacuccaagaaagua

SEQ ID NO: 775417 - RNA, 18 nt, Human
gaucucugcagugccuac

SEQ ID NO: 775418 - RNA, 22 nt, Human
gguuaaaaauaauuuacuuggc

SEQ ID NO: 775419 - RNA, 22 nt, Human
aaguuaggaugaaugccuuagc

SEQ ID NO: 775420 - RNA, 22 nt, Human
aguguccucuauuaugacuuua

SEQ ID NO: 775421 - RNA, 22 nt, Human
uucuuccuugguuuccuggaua

SEQ ID NO: 775422 - RNA, 22 nt, Human
agugggguccucaguaugguuc

SEQ ID NO: 775423 - RNA, 22 nt, Human
ggcagagcagccccaggguuug

SEQ ID NO: 775424 - RNA, 20 nt, Human
ucucaggguucagcaaagua

SEQ ID NO: 775425 - RNA, 19 nt, Human
agggcacagggacagaagg

SEQ ID NO: 775426 - RNA, 22 nt, Human
augcauaucacagucuccaugu

SEQ ID NO: 775427 - RNA, 22 nt, Human
ggguagggugacuuaggcuggc

SEQ ID NO: 775428 - RNA, 22 nt, Human
auugcuguacacuucuagaucu

SEQ ID NO: 775429 - RNA, 22 nt, Human
cugauggagagugugauuuggg

SEQ ID NO: 775430 - RNA, 22 nt, Human
ggcuggcuacauuggaggaagg

SEQ ID NO: 775431 - RNA, 22 nt, Human
uacaugcuucuauaugugaagu

SEQ ID NO: 775432 - RNA, 22 nt, Human
gcucccugcagcugagaguucc

SEQ ID NO: 775433 - RNA, 18 nt, Human
ccagcugugcagcaucug

SEQ ID NO: 775434 - RNA, 22 nt, Human
ggccucucagggcagagacccu

SEQ ID NO: 775435 - RNA, 19 nt, Human
acacugggagaagacugcu

SEQ ID NO: 775436 - RNA, 22 nt, Human
uucagacaguuuucagauucau

SEQ ID NO: 775437 - RNA, 22 nt, Human
aauggcuuuaggaauccagugc

SEQ ID NO: 775438 - RNA, 22 nt, Human
ugucucucugcccccauugcuc

SEQ ID NO: 775439 - RNA, 22 nt, Human
agagcagauggagcuggaagag

SEQ ID NO: 775440 - RNA, 22 nt, Human
uuuggccucaugaauuucuugc

SEQ ID NO: 775441 - RNA, 22 nt, Human
uucugcugaagucacugggagc

SEQ ID NO: 775442 - RNA, 22 nt, Human
ucugcaggaggcuggcugcagg

SEQ ID NO: 775443 - RNA, 22 nt, Human
ucagggcagaauccaaagaauu

SEQ ID NO: 775444 - RNA, 22 nt, Human
agaccauggccauccuaggaaa

SEQ ID NO: 775445 - RNA, 22 nt, Human
aauggcuuaaguauaagugaga

SEQ ID NO: 775446 - RNA, 22 nt, Human
ggacaggcugcaucugagcaug

SEQ ID NO: 775447 - RNA, 22 nt, Human
guccagaguagucgaguauucu

SEQ ID NO: 775448 - RNA, 22 nt, Human
uccuguggggaaaagccuaucu

SEQ ID NO: 775449 - RNA, 19 nt, Human
cagaggccagaagcacagg

SEQ ID NO: 775450 - RNA, 19 nt, Human
uacauuccacacaaucucu

SEQ ID NO: 775451 - RNA, 22 nt, Human
uuauauuucugguagccuucag

SEQ ID NO: 775452 - RNA, 22 nt, Human
uccugggcuucacagacucugu

SEQ ID NO: 775453 - RNA, 22 nt, Human
aauauaguguuagcucauuuga

SEQ ID NO: 775454 - RNA, 22 nt, Human
uuugagugcccauguuucccag

SEQ ID NO: 775455 - RNA, 22 nt, Human
ugauuuucaugggugaucuuug

SEQ ID NO: 775456 - RNA, 22 nt, Human
acagacauuuuaagacacuuua

SEQ ID NO: 775457 - RNA, 22 nt, Human
uauuuguugaguuguuaugucu

SEQ ID NO: 775458 - RNA, 20 nt, Human
uacaaaccuccacacuggug

SEQ ID NO: 775459 - RNA, 22 nt, Human
cuagaaaucucuguuuacauca

SEQ ID NO: 775460 - RNA, 22 nt, Human
agcccugaagcuggccaugucc

SEQ ID NO: 775461 - RNA, 22 nt, Human
caucaaagcuuuuuucuguguu

SEQ ID NO: 775462 - RNA, 22 nt, Human
ucaaaugcaccucucauuuguu

SEQ ID NO: 775463 - RNA, 22 nt, Human
aagguacaaaguauuauuuaaa

SEQ ID NO: 775464 - RNA, 19 nt, Human
cuucagcaucuccggagcu

SEQ ID NO: 775465 - RNA, 22 nt, Human
ggccaccuuaaguuaaggauau

SEQ ID NO: 775466 - RNA, 23 nt, Human
cagcuucuuugggauucuuuaua

SEQ ID NO: 775467 - RNA, 22 nt, Human
gcagaggcugggugucccaguc

SEQ ID NO: 775468 - RNA, 22 nt, Human
ccaggagcagaguagguguuca

SEQ ID NO: 775469 - RNA, 22 nt, Human
uagcacaguguucacaacagug

SEQ ID NO: 775470 - RNA, 22 nt, Human
cugcacugagcucucccagccc

SEQ ID NO: 775471 - RNA, 22 nt, Human
uuauguuuuauggcuauaucau

SEQ ID NO: 775472 - RNA, 22 nt, Human
uacuuugguaucaaacuaaaac

SEQ ID NO: 775473 - RNA, 22 nt, Human
uggagucacagugaccugaguc

SEQ ID NO: 775474 - RNA, 22 nt, Human
accauccugaaaccuucaugcu

SEQ ID NO: 775475 - RNA, 22 nt, Human
ucucagaguuuacggggcugaa

SEQ ID NO: 775476 - RNA, 22 nt, Human
ugaaacaagggaccguccuuuc

SEQ ID NO: 775477 - RNA, 22 nt, Human
gccagguggcugagcagcugca

SEQ ID NO: 775478 - RNA, 22 nt, Human
uucacauaaauagaucacauca

SEQ ID NO: 775479 - RNA, 22 nt, Human
uucuccuuccugguuuucaggc

SEQ ID NO: 775480 - RNA, 19 nt, Human
uggcugggcgugccuccgu

SEQ ID NO: 775481 - RNA, 22 nt, Human
uuuucuucuaccugcuguccaa

SEQ ID NO: 775482 - RNA, 22 nt, Human
augaaacuaaacuacauaaguu

SEQ ID NO: 775483 - RNA, 22 nt, Human
cagaaacuuucuuuacugagca

SEQ ID NO: 775484 - RNA, 18 nt, Human
gcucaguguguuaacacu

SEQ ID NO: 775485 - RNA, 22 nt, Human
ccaggcguggcuucagcagccc

SEQ ID NO: 775486 - RNA, 22 nt, Human
gagcccagcuaaauuuauauaa

SEQ ID NO: 775487 - RNA, 22 nt, Human
aaagaccauguuuacagcuagg

SEQ ID NO: 775488 - RNA, 22 nt, Human
ugucauuuccugaaugcugagu

SEQ ID NO: 775489 - RNA, 22 nt, Human
aucgaauaauugcauucuauaa

SEQ ID NO: 775490 - RNA, 22 nt, Human
guccaggaaucaaaagauggaa

SEQ ID NO: 775491 - RNA, 22 nt, Human
gauuuagagaauguuuuguaag

SEQ ID NO: 775492 - RNA, 22 nt, Human
agaagccauucucaguuccuga

SEQ ID NO: 775493 - RNA, 21 nt, Human
guucaaauccugacacuacac

SEQ ID NO: 775494 - RNA, 22 nt, Human
agagaauucuggugcuaacaag

SEQ ID NO: 775495 - RNA, 22 nt, Human
gucacaggaaaggguguaaggg

SEQ ID NO: 775496 - RNA, 22 nt, Human
guuguacauaugaggauaaguu

SEQ ID NO: 775497 - RNA, 22 nt, Human
uaacuacauuucacugcaauua

SEQ ID NO: 775498 - RNA, 22 nt, Human
ggggagcugggaggugaguuac

SEQ ID NO: 775499 - RNA, 22 nt, Human
aguucaaacucuauaagaacuu

SEQ ID NO: 775500 - RNA, 22 nt, Human
acaauauuguacccagaaguuu

SEQ ID NO: 775501 - RNA, 22 nt, Human
aggcagcagugauaagauagga

SEQ ID NO: 775502 - RNA, 22 nt, Human
aaauaagcacuuaacuguauca

SEQ ID NO: 775503 - RNA, 22 nt, Human
ugggaggaaugucacugagcca

SEQ ID NO: 775504 - RNA, 22 nt, Human
uagaaguuaggaaauaggaaua

SEQ ID NO: 775505 - RNA, 22 nt, Human
cuggagcccaggccuggugucu

SEQ ID NO: 775506 - RNA, 22 nt, Human
aauuccagcugauugacuuucc

SEQ ID NO: 775507 - RNA, 22 nt, Human
gcagcccaggagcaggcgaccc

SEQ ID NO: 775508 - RNA, 22 nt, Human
cuaguugcucuccuuuaaaccu

SEQ ID NO: 775509 - RNA, 22 nt, Human
ggcacuggaaggaucaugugag

SEQ ID NO: 775510 - RNA, 22 nt, Human
ucuuggcuguaccauugacuag

SEQ ID NO: 775511 - RNA, 22 nt, Human
ugggguacuuguaucaaagcac

SEQ ID NO: 775512 - RNA, 22 nt, Human
caggucuuuguugcagcaugga

SEQ ID NO: 775513 - RNA, 22 nt, Human
ggguaugagauauaggugaaua

SEQ ID NO: 775514 - RNA, 22 nt, Human
ugucucagauacgccaucaagg

SEQ ID NO: 775515 - RNA, 22 nt, Human
uggcauccacaaaugcuuagau

SEQ ID NO: 775516 - RNA, 22 nt, Human
auguggggacucugagagaauu

SEQ ID NO: 775517 - RNA, 22 nt, Human
gaaagcacgauaguagcaaaag

SEQ ID NO: 775518 - RNA, 22 nt, Human
acagucauuagauacaaugucu

SEQ ID NO: 775519 - RNA, 22 nt, Human
uauaauuuuucuguggccaguu

SEQ ID NO: 775520 - RNA, 20 nt, Human
cuaucuccuggcgugccuuc

SEQ ID NO: 775521 - RNA, 22 nt, Human
uguuguagcuugacagcagcca

SEQ ID NO: 775522 - RNA, 22 nt, Human
gaaggcuggggccuucucaucu

SEQ ID NO: 775523 - RNA, 22 nt, Human
cggaagcguucucagcaggggc

SEQ ID NO: 775524 - RNA, 22 nt, Human
guggcacagagauggggcauga

SEQ ID NO: 775525 - RNA, 21 nt, Human
uuugaaagcccuauguuuuca

SEQ ID NO: 775526 - RNA, 22 nt, Human
uguguguauguuuacuuuuccu

SEQ ID NO: 775527 - RNA, 20 nt, Human
aggcaugggaugcccagauu

SEQ ID NO: 775528 - RNA, 22 nt, Human
ccacuucaucagugcuccauuu

SEQ ID NO: 775529 - RNA, 22 nt, Human
uaugcauucagagguugggugu

SEQ ID NO: 775530 - RNA, 22 nt, Human
gaggcuguaaguguggagccua

SEQ ID NO: 775531 - RNA, 22 nt, Human
gcuuucugaugagcuuaagaaa

SEQ ID NO: 775532 - RNA, 22 nt, Human
gauggcuuguuuucuggcugaa

SEQ ID NO: 775533 - RNA, 23 nt, Human
cauggcagcaagagcucauggcc

SEQ ID NO: 775534 - RNA, 22 nt, Human
acucaaguagauauuaacaaaa

SEQ ID NO: 775535 - RNA, 22 nt, Human
acuauucaagugcucauucaga

SEQ ID NO: 775536 - RNA, 22 nt, Human
augugucuuugagacucugcua

SEQ ID NO: 775537 - RNA, 22 nt, Human
cauuccuauuaugucccuagug

SEQ ID NO: 775538 - RNA, 22 nt, Human
gaguaaggcugcugauggagug

SEQ ID NO: 775539 - RNA, 22 nt, Human
uaaucuuagcaaccuccagugu

SEQ ID NO: 775540 - RNA, 22 nt, Human
guacaauagucccuguuuggau

SEQ ID NO: 775541 - RNA, 22 nt, Human
aagagcugcaucuaagccauga

SEQ ID NO: 775542 - RNA, 20 nt, Human
gaaccucucccagccccugg

SEQ ID NO: 775543 - RNA, 22 nt, Human
gaggccacgguuuuccuugggg

SEQ ID NO: 775544 - RNA, 21 nt, Human
uccagaccucccucuccuagc

SEQ ID NO: 775545 - RNA, 22 nt, Human
gagggccaggcagcaagaaggc

SEQ ID NO: 775546 - RNA, 22 nt, Human
cugggcccuauggaagaaaggg

SEQ ID NO: 775547 - RNA, 22 nt, Human
uucauucucuuagcauaguccu

SEQ ID NO: 775548 - RNA, 22 nt, Human
ucacugcuuugagccacugagc

SEQ ID NO: 775549 - RNA, 22 nt, Human
uuaacagguuauauuguacagg

SEQ ID NO: 775550 - RNA, 22 nt, Human
acugggcuggggcucauucucc

SEQ ID NO: 775551 - RNA, 20 nt, Human
agaaaugugaaaggcugagu

SEQ ID NO: 775552 - RNA, 23 nt, Human
uuuauagcagcaugauuuauagu

SEQ ID NO: 775553 - RNA, 22 nt, Human
uggugugggcguggcaggcaag

SEQ ID NO: 775554 - RNA, 19 nt, Human
uaaaaacugaaggaagcag

SEQ ID NO: 775555 - RNA, 22 nt, Human
auacaguaagugucccugaaac

SEQ ID NO: 775556 - RNA, 22 nt, Human
uugacaaaggcugagaggaaaa

SEQ ID NO: 775557 - RNA, 22 nt, Human
gcuguucucuguaacaugcauu

SEQ ID NO: 775558 - RNA, 22 nt, Human
uacaugcuggugacuguagaca

SEQ ID NO: 775559 - RNA, 22 nt, Human
ucauguauuugugauagaugac

SEQ ID NO: 775560 - RNA, 22 nt, Human
acauuucacuguucacagcagg

SEQ ID NO: 775561 - RNA, 22 nt, Human
ucaggaguuucagguguaagug

SEQ ID NO: 775562 - RNA, 22 nt, Human
gucccucaagguccagucaugg

SEQ ID NO: 775563 - RNA, 22 nt, Human
gcccugcccugagccguagacc

SEQ ID NO: 775564 - RNA, 22 nt, Human
cuaggaaaugaauacaguacac

SEQ ID NO: 775565 - RNA, 21 nt, Human
uuaaugcuaugcagaaaaucu

SEQ ID NO: 775566 - RNA, 22 nt, Human
cccaggaccauccuucugugcc

SEQ ID NO: 775567 - RNA, 23 nt, Human
cugcauugucuccugggagcaug

SEQ ID NO: 775568 - RNA, 22 nt, Human
aaguuugguccuucuaagaaga

SEQ ID NO: 775569 - RNA, 22 nt, Human
uccuguuucuccugcaaaaucc

SEQ ID NO: 775570 - RNA, 23 nt, Human
cuuuucauugccuuagcgcagag

SEQ ID NO: 775571 - RNA, 22 nt, Human
ucagagcuaaggggagagcaaa

SEQ ID NO: 775572 - RNA, 22 nt, Human
cugagauggccacugggucuca

SEQ ID NO: 775573 - RNA, 22 nt, Human
agcuucuuaguucacuuuuaau

SEQ ID NO: 775574 - RNA, 22 nt, Human
uuuuauucucaagacaauggga

SEQ ID NO: 775575 - RNA, 22 nt, Human
cagagacuggagugcaguggcg

SEQ ID NO: 775576 - RNA, 21 nt, Human
acugagagauguuggaucaua

SEQ ID NO: 775577 - RNA, 22 nt, Human
uuuauucuauaggcauuaagca

SEQ ID NO: 775578 - RNA, 19 nt, Human
agacaugagacacaggaug

SEQ ID NO: 775579 - RNA, 20 nt, Human
uuguuuauuauguucugauc

SEQ ID NO: 775580 - RNA, 22 nt, Human
agcaggaguguccccuggcugu

SEQ ID NO: 775581 - RNA, 22 nt, Human
ugagggccgaggagcugugggu

SEQ ID NO: 775582 - RNA, 22 nt, Human
aagauuauggcagauaacaauu

SEQ ID NO: 775583 - RNA, 22 nt, Human
caaaaugugagucccaccucaa

SEQ ID NO: 775584 - RNA, 22 nt, Human
uaaccugcugugcuggucaguc

SEQ ID NO: 775585 - RNA, 20 nt, Human
ccagacagcaccugccuggu

SEQ ID NO: 775586 - RNA, 22 nt, Human
gacaggcuucaugauggcagga

SEQ ID NO: 775587 - RNA, 22 nt, Human
uuuccuucccuggaugagaagu

SEQ ID NO: 775588 - RNA, 21 nt, Human
ccagcuccaggaccuuggauc

SEQ ID NO: 775589 - RNA, 22 nt, Human
gcugccugucuguuucuuuuau

SEQ ID NO: 775590 - RNA, 22 nt, Human
gcccuugggagguuccacuggg

SEQ ID NO: 775591 - RNA, 22 nt, Human
gucuggaagaacuagggauguu

SEQ ID NO: 775592 - RNA, 22 nt, Human
agaccuggagugaagaguuccc

SEQ ID NO: 775593 - RNA, 22 nt, Human
cagaggccaggcugccugacug

SEQ ID NO: 775594 - RNA, 22 nt, Human
ucauucuggaugacuuucuaga

SEQ ID NO: 775595 - RNA, 22 nt, Human
auccuugguaagagaguuggau

SEQ ID NO: 775596 - RNA, 22 nt, Human
uggcugagaccuucccaaauuc

SEQ ID NO: 775597 - RNA, 22 nt, Human
cauuuagagaguaaaaauuagc

SEQ ID NO: 775598 - RNA, 22 nt, Human
ggguuucaugguucucacaaug

SEQ ID NO: 775599 - RNA, 22 nt, Human
ccugaggcucuccugaauaaug

SEQ ID NO: 775600 - RNA, 22 nt, Human
gucagcugucuccccagagugg

SEQ ID NO: 775601 - RNA, 18 nt, Human
aagaggaggaaacccagg

SEQ ID NO: 775602 - RNA, 22 nt, Human
ucuuuucauugagaacacacug

SEQ ID NO: 775603 - RNA, 20 nt, Human
uuuauuggccuuucaggaac

SEQ ID NO: 775604 - RNA, 22 nt, Human
uaugugauagaguuacuuuaua

SEQ ID NO: 775605 - RNA, 22 nt, Human
aguggugcugcgcgcggagcuc

SEQ ID NO: 775606 - RNA, 22 nt, Human
uuugcuuuguuuaaaaguggua

SEQ ID NO: 775607 - RNA, 22 nt, Human
acagcuggaggucugugagcac

SEQ ID NO: 775608 - RNA, 22 nt, Human
cauuucuaagaagaucugggua

SEQ ID NO: 775609 - RNA, 22 nt, Human
aauuugugaaucugucucuuga

SEQ ID NO: 775610 - RNA, 22 nt, Human
aguuaguggcaaagugguuuga

SEQ ID NO: 775611 - RNA, 22 nt, Human
uuuguacauuucacuccauugu

SEQ ID NO: 775612 - RNA, 22 nt, Human
gagcuuggugcugccuguuguc

SEQ ID NO: 775613 - RNA, 22 nt, Human
cugcagcuguagaggacagugg

SEQ ID NO: 775614 - RNA, 22 nt, Human
caggagaagucucuagggggug

SEQ ID NO: 775615 - RNA, 22 nt, Human
acucuuuacuuaaacucuaagu

SEQ ID NO: 775616 - RNA, 22 nt, Human
cuguuuccccaugcccugacuc

SEQ ID NO: 775617 - RNA, 22 nt, Human
auggauaagucaaagaguaucc

SEQ ID NO: 775618 - RNA, 22 nt, Human
ggcaaaguuuucaucucauaac

SEQ ID NO: 775619 - RNA, 22 nt, Human
uagccaggcgaggucagugucg

SEQ ID NO: 775620 - RNA, 22 nt, Human
cagccaggcccagaucaugcug

SEQ ID NO: 775621 - RNA, 22 nt, Human
gacagcaacacucaauucugca

SEQ ID NO: 775622 - RNA, 22 nt, Human
ucacuccauagcuuaacucuuu

SEQ ID NO: 775623 - RNA, 22 nt, Human
gggcccugaucugugagcgcag

SEQ ID NO: 775624 - RNA, 22 nt, Human
caagaggcaaauugucuagaag

SEQ ID NO: 775625 - RNA, 22 nt, Human
cagcaaucgggugauaugcaau

SEQ ID NO: 775626 - RNA, 22 nt, Human
aacacuuuggaauagagauagg

SEQ ID NO: 775627 - RNA, 22 nt, Human
acucuggagauggaugucagga

SEQ ID NO: 775628 - RNA, 21 nt, Human
ucauuguugcaugguaggggg

SEQ ID NO: 775629 - RNA, 22 nt, Human
guggcagaguucaggcguuugg

SEQ ID NO: 775630 - RNA, 22 nt, Human
agaagggcuacacgggcucucc

SEQ ID NO: 775631 - RNA, 22 nt, Human
aauacuauguagccaaaauaau

SEQ ID NO: 775632 - RNA, 22 nt, Human
cagcuccaucuugcuuauacca

SEQ ID NO: 775633 - RNA, 22 nt, Human
agagccacggcaggccuaggaa

SEQ ID NO: 775634 - RNA, 22 nt, Human
cuggcugcauuggcaagucaau

SEQ ID NO: 775635 - RNA, 22 nt, Human
auuugugauaauuuguuacagc

SEQ ID NO: 775636 - RNA, 22 nt, Human
ugggucuccugugccugggagg

SEQ ID NO: 775637 - RNA, 23 nt, Human
agcaaauaaucugcuugcuuuuu

SEQ ID NO: 775638 - RNA, 19 nt, Human
acaggggccuuuccagggu

SEQ ID NO: 775639 - RNA, 22 nt, Human
uccugggguguguuuugcugcu

SEQ ID NO: 775640 - RNA, 22 nt, Human
gcuggggccucugugagguuaa

SEQ ID NO: 775641 - RNA, 22 nt, Human
gccacugauuauucagcagaca

SEQ ID NO: 775642 - RNA, 21 nt, Human
caugggguugcuauagcaaaa

SEQ ID NO: 775643 - RNA, 22 nt, Human
ucuguauuuuaagaugcuguuu

SEQ ID NO: 775644 - RNA, 22 nt, Human
ucugguccucucugugaugcua

SEQ ID NO: 775645 - RNA, 22 nt, Human
ugugcgcuccggcgagucagcg

SEQ ID NO: 775646 - RNA, 22 nt, Human
uagcuucccuagcuaaagaggu

SEQ ID NO: 775647 - RNA, 22 nt, Human
ggggacccucaggacugcgucu

SEQ ID NO: 775648 - RNA, 22 nt, Human
agacaaggcaaggcggccagau

SEQ ID NO: 775649 - RNA, 22 nt, Human
auccagagagguuaggugacau

SEQ ID NO: 775650 - RNA, 22 nt, Human
uucauucuugggaucagagagu

SEQ ID NO: 775651 - RNA, 22 nt, Human
ggggcagagagaaggaagcuug

SEQ ID NO: 775652 - RNA, 22 nt, Human
ugaggggagacagaguggacuc

SEQ ID NO: 775653 - RNA, 22 nt, Human
aauuauacaauugucaaguucu

SEQ ID NO: 775654 - RNA, 21 nt, Human
cagggcacacagaggauggua

SEQ ID NO: 775655 - RNA, 22 nt, Human
gugcauuuggugacucucaccc

SEQ ID NO: 775656 - RNA, 22 nt, Human
gugucaugcacacucaguguug

SEQ ID NO: 775657 - RNA, 22 nt, Human
ccagcauccaugcucccucggg

SEQ ID NO: 775658 - RNA, 22 nt, Human
ucuguucuugcuuuucuccaac

SEQ ID NO: 775659 - RNA, 22 nt, Human
cagcuuuaccuuuaggaguaac

SEQ ID NO: 775660 - RNA, 22 nt, Human
guuucuguaagacugaauugac

SEQ ID NO: 775661 - RNA, 22 nt, Human
gugccuggaaugcgccucggcg

SEQ ID NO: 775662 - RNA, 22 nt, Human
gcuccagcucguggcucccagc

SEQ ID NO: 775663 - RNA, 22 nt, Human
cggcacagccgggcaaggcugg

SEQ ID NO: 775664 - RNA, 22 nt, Human
cagccagggagggcaaaugaga

SEQ ID NO: 775665 - RNA, 22 nt, Human
gaaggaagggcuggcugucuug

SEQ ID NO: 775666 - RNA, 22 nt, Human
cugugcugaggaugcaguuucu

SEQ ID NO: 775667 - RNA, 18 nt, Human
ugcugggcauuaggcuua

SEQ ID NO: 775668 - RNA, 22 nt, Human
cagcagagcugggaauaaaauu

SEQ ID NO: 775669 - RNA, 22 nt, Human
aggcuagaggcuucuggcuuca

SEQ ID NO: 775670 - RNA, 22 nt, Human
uuagacaucaagaagccaaugu

SEQ ID NO: 775671 - RNA, 21 nt, Human
aaugucuuuguccaugcucug

SEQ ID NO: 775672 - RNA, 22 nt, Human
uucaguuuucuuuagaauguag

SEQ ID NO: 775673 - RNA, 22 nt, Human
cuucuuucuuuugaucacaggu

SEQ ID NO: 775674 - RNA, 22 nt, Human
guggcagguggagccuccugca

SEQ ID NO: 775675 - RNA, 22 nt, Human
uuucuaguaaucaauauaaagu

SEQ ID NO: 775676 - RNA, 22 nt, Human
guccagggccccgagcaccagg

SEQ ID NO: 775677 - RNA, 22 nt, Human
cugugugccuagaggguggccg

SEQ ID NO: 775678 - RNA, 22 nt, Human
acagggucaagggugcuacaag

SEQ ID NO: 775679 - RNA, 22 nt, Human
cacacaguggaguauuacucag

SEQ ID NO: 775680 - RNA, 22 nt, Human
ccaguguuuccgucaguacacg

SEQ ID NO: 775681 - RNA, 22 nt, Human
accaggggugucaacagcauuu

SEQ ID NO: 775682 - RNA, 22 nt, Human
gcucugcugucuucuugcaggc

SEQ ID NO: 775683 - RNA, 22 nt, Human
aagcaacagaaacauucuaaua

SEQ ID NO: 775684 - RNA, 22 nt, Human
caggcaccuuugugcaugggca

SEQ ID NO: 775685 - RNA, 22 nt, Human
gcuggaggaggaagugugaggg

SEQ ID NO: 775686 - RNA, 19 nt, Human
gcauuucucuuuacagcca

SEQ ID NO: 775687 - RNA, 22 nt, Human
ugcauaaacuucucugguguga

SEQ ID NO: 775688 - RNA, 22 nt, Human
cuucaaacccagauuaaaugca

SEQ ID NO: 775689 - RNA, 22 nt, Human
uuuuuagauuacucagccacca

SEQ ID NO: 775690 - RNA, 22 nt, Human
auggccuggggagcaugggaag

SEQ ID NO: 775691 - RNA, 22 nt, Human
gggcugacaccacccaggcgca

SEQ ID NO: 775692 - RNA, 22 nt, Human
gguggcagaggugcaucagccc

SEQ ID NO: 775693 - RNA, 22 nt, Human
cugcagagcaugaggaggucug

SEQ ID NO: 775694 - RNA, 22 nt, Human
gugcauuuauauuugccuuugg

SEQ ID NO: 775695 - RNA, 22 nt, Human
uugaaacuuagaaauugagcug

SEQ ID NO: 775696 - RNA, 22 nt, Human
ugagaacuugugcuauugcaca

SEQ ID NO: 775697 - RNA, 22 nt, Human
uucaaagcagagggucaauaca

SEQ ID NO: 775698 - RNA, 22 nt, Human
cuccugggaauuuaguugugag

SEQ ID NO: 775699 - RNA, 22 nt, Human
ugagagaugaaguuaguuguuc

SEQ ID NO: 775700 - RNA, 22 nt, Human
auaaauucucugauguauagua

SEQ ID NO: 775701 - RNA, 22 nt, Human
cauuccuuaacguggggagucu

SEQ ID NO: 775702 - RNA, 23 nt, Human
ccagggagugcuacuaucaagcc

SEQ ID NO: 775703 - RNA, 22 nt, Human
caggacuauguucaacagauag

SEQ ID NO: 775704 - RNA, 22 nt, Human
uuuugcaucuggugaagaccag

SEQ ID NO: 775705 - RNA, 20 nt, Human
aaaaugaugggcagggcagg

SEQ ID NO: 775706 - RNA, 22 nt, Human
gugccuggagcuaauguguaua

SEQ ID NO: 775707 - RNA, 22 nt, Human
gucuuuuuuacaccuuacauca

SEQ ID NO: 775708 - RNA, 22 nt, Human
ugggaggaagugcuaaugggag

SEQ ID NO: 775709 - RNA, 22 nt, Human
ugggagaaagaacccugaguga

SEQ ID NO: 775710 - RNA, 23 nt, Human
ccagggccccuacaccacugucc

SEQ ID NO: 775711 - RNA, 22 nt, Human
uugugcuugcccuggaggugcg

SEQ ID NO: 775712 - RNA, 22 nt, Human
guuucccaaauuguucacaggg

SEQ ID NO: 775713 - RNA, 22 nt, Human
uauuucuuuucgugacuuauug

SEQ ID NO: 775714 - RNA, 22 nt, Human
ggugucucagcugcuggcaggg

SEQ ID NO: 775715 - RNA, 22 nt, Human
uggagagcaaugaggggcaggc

SEQ ID NO: 775716 - RNA, 22 nt, Human
ugagcuuacgugggaacagacu

SEQ ID NO: 775717 - RNA, 22 nt, Human
uggcucuggugcgggcuccugc

SEQ ID NO: 775718 - RNA, 22 nt, Human
aucuucuacuuugccaaucagg

SEQ ID NO: 775719 - RNA, 22 nt, Human
gguggcugcuuccucaagagga

SEQ ID NO: 775720 - RNA, 22 nt, Human
guccaaaagagccagccgggcg

SEQ ID NO: 775721 - RNA, 22 nt, Human
aggcggugcuguggacagugac

SEQ ID NO: 775722 - RNA, 22 nt, Human
accagcucauaauuuucaaaac

SEQ ID NO: 775723 - RNA, 22 nt, Human
uuuuauaagcaagaaagggaaa

SEQ ID NO: 775724 - RNA, 22 nt, Human
acugcaggagacacagcugcug

SEQ ID NO: 775725 - RNA, 22 nt, Human
cuucuaggcuucucagggggca

SEQ ID NO: 775726 - RNA, 22 nt, Human
uuuacagauguggaaagugagc

SEQ ID NO: 775727 - RNA, 22 nt, Human
ugucaguggucauaguagaaaa

SEQ ID NO: 775728 - RNA, 22 nt, Human
gcuuacaagccagcuguaccac

SEQ ID NO: 775729 - RNA, 22 nt, Human
gccacagcucacguuccccauu

SEQ ID NO: 775730 - RNA, 22 nt, Human
cucugagaagaguucaaguaaa

SEQ ID NO: 775731 - RNA, 22 nt, Human
cucccagaaaauucucagacaa

SEQ ID NO: 775732 - RNA, 22 nt, Human
auucugcacuuccuuugcuucc

SEQ ID NO: 775733 - RNA, 22 nt, Human
uccugccaggagugcuggcccu

SEQ ID NO: 775734 - RNA, 22 nt, Human
ccugccagacgcaccagggggc

SEQ ID NO: 775735 - RNA, 22 nt, Human
cuuucucuguggugaggagggu

SEQ ID NO: 775736 - RNA, 22 nt, Human
auaaauguuuguugaaugaaua

SEQ ID NO: 775737 - RNA, 22 nt, Human
gagggccagaguccugggguca

SEQ ID NO: 775738 - RNA, 22 nt, Human
ggguaggccgugggucaccagg

SEQ ID NO: 775739 - RNA, 22 nt, Human
auauuuguaaaauucugugucu

SEQ ID NO: 775740 - RNA, 22 nt, Human
cuaaggaaauaugucacuugcu

SEQ ID NO: 775741 - RNA, 19 nt, Human
cagaaauagcgaaguguaa

SEQ ID NO: 775742 - RNA, 22 nt, Human
cagcaacuccuguagcuuaugc

SEQ ID NO: 775743 - RNA, 21 nt, Human
uuagaaagcucacuacaguua

SEQ ID NO: 775744 - RNA, 22 nt, Human
caucagagugguggccuggugu

SEQ ID NO: 775745 - RNA, 22 nt, Human
ucugagaaggaagcucugugua

SEQ ID NO: 775746 - RNA, 22 nt, Human
gccugcagggcccuuguggguc

SEQ ID NO: 775747 - RNA, 22 nt, Human
ccuagacuagaggcagggagcc

SEQ ID NO: 775748 - RNA, 22 nt, Human
ucuuagaaaugaaguucuuucu

SEQ ID NO: 775749 - RNA, 23 nt, Human
aagcaauaccaggugugggcccu

SEQ ID NO: 775750 - RNA, 22 nt, Human
cuggccagccugucgaugcccu

SEQ ID NO: 775751 - RNA, 22 nt, Human
cuaaccuguugaaggaauugcu

SEQ ID NO: 775752 - RNA, 22 nt, Human
gcaaagaaugcagauuugccuc

SEQ ID NO: 775753 - RNA, 22 nt, Human
aagcaucaacacuauauugaug

SEQ ID NO: 775754 - RNA, 22 nt, Human
acuauagcucggguuauaaugu

SEQ ID NO: 775755 - RNA, 19 nt, Human
ggaaggcagaggggcugug

SEQ ID NO: 775756 - RNA, 22 nt, Human
gcagugcaggaacauagcuucu

SEQ ID NO: 775757 - RNA, 22 nt, Human
guuuccagucaacuugugugug

SEQ ID NO: 775758 - RNA, 22 nt, Human
auacaguguacuauuuagcagu

SEQ ID NO: 775759 - RNA, 22 nt, Human
ccuuucucuuggauaccgauug

SEQ ID NO: 775760 - RNA, 22 nt, Human
uucuagcagagggcaucugcug

SEQ ID NO: 775761 - RNA, 21 nt, Human
ucccagagugcuugggacugc

SEQ ID NO: 775762 - RNA, 22 nt, Human
uccuggcagagagcaugaggcc

SEQ ID NO: 775763 - RNA, 22 nt, Human
ucaggcucucagaccaacagca

SEQ ID NO: 775764 - RNA, 22 nt, Human
aucauugaauugcuuuguucuu

SEQ ID NO: 775765 - RNA, 23 nt, Human
ugggcggggcuuuucacucugcc

SEQ ID NO: 775766 - RNA, 22 nt, Human
caggcacaauuauuucccuuuc

SEQ ID NO: 775767 - RNA, 22 nt, Human
ucuccaggcuuuuugugaauug

SEQ ID NO: 775768 - RNA, 23 nt, Human
auaaacugucaaaagccagcccu

SEQ ID NO: 775769 - RNA, 22 nt, Human
cuuccucuauguucagguagaa

SEQ ID NO: 775770 - RNA, 22 nt, Human
aaguguuuggggaucauuuuaa

SEQ ID NO: 775771 - RNA, 22 nt, Human
gcaggccugguuuacaugguag

SEQ ID NO: 775772 - RNA, 22 nt, Human
ucucuguggagcaguguguuca

SEQ ID NO: 775773 - RNA, 22 nt, Human
uuucuguuaggcaucauuuuaa

SEQ ID NO: 775774 - RNA, 22 nt, Human
uucuggaagaguaaaauaagcc

SEQ ID NO: 775775 - RNA, 22 nt, Human
ugaggcccuagggcaugggaga

SEQ ID NO: 775776 - RNA, 22 nt, Human
ugcaagagcagaaagaacugag

SEQ ID NO: 775777 - RNA, 22 nt, Human
aagagcuccaggcaaugcgguc

SEQ ID NO: 775778 - RNA, 22 nt, Human
uaaggccaauuaacaaccaggg

SEQ ID NO: 775779 - RNA, 22 nt, Human
gcaaucaaugauuuauauuugu

SEQ ID NO: 775780 - RNA, 22 nt, Human
cucaucagaaauaccugacaaa

SEQ ID NO: 775781 - RNA, 22 nt, Human
ugucugugugagcaaaugacuu

SEQ ID NO: 775782 - RNA, 22 nt, Human
cagucucugugccagauccugg

SEQ ID NO: 775783 - RNA, 22 nt, Human
aaacaacuucugcacuaugggu

SEQ ID NO: 775784 - RNA, 22 nt, Human
gaaauucaaauaagauauguag

SEQ ID NO: 775785 - RNA, 22 nt, Human
gaggggccuggcacugagcugg

SEQ ID NO: 775786 - RNA, 19 nt, Human
accuucugggaaacauucc

SEQ ID NO: 775787 - RNA, 22 nt, Human
aguaacaguaacaucuuccuag

SEQ ID NO: 775788 - RNA, 22 nt, Human
ucauuucaguccucugugugag

SEQ ID NO: 775789 - RNA, 22 nt, Human
gggaagcaggugcagcucgccu

SEQ ID NO: 775790 - RNA, 22 nt, Human
guaucuuucccaccaaucacaa

SEQ ID NO: 775791 - RNA, 22 nt, Human
agaaggguguauacauuuccug

SEQ ID NO: 775792 - RNA, 22 nt, Human
acugcaacaccuccuggguuca

SEQ ID NO: 775793 - RNA, 22 nt, Human
ugucaugggcauuuauugaggg

SEQ ID NO: 775794 - RNA, 22 nt, Human
gaggcaggguguugauuacaga

SEQ ID NO: 775795 - RNA, 22 nt, Human
cucaagaaggaugagcuauugc

SEQ ID NO: 775796 - RNA, 22 nt, Human
ugguuauaaaaguccucucauu

SEQ ID NO: 775797 - RNA, 20 nt, Human
caccaggcgcucugagaaca

SEQ ID NO: 775798 - RNA, 19 nt, Human
acacagggaucagaggguu

SEQ ID NO: 775799 - RNA, 22 nt, Human
ggggaacaccgggcagaggcgc

SEQ ID NO: 775800 - RNA, 22 nt, Human
guuacaaaugccaaagcugaga

SEQ ID NO: 775801 - RNA, 22 nt, Human
guauuuauaggggaaugagagu

SEQ ID NO: 775802 - RNA, 22 nt, Human
uauucagaguauuccaugaggu

SEQ ID NO: 775803 - RNA, 22 nt, Human
aggugauaaguguuaaauaaag

SEQ ID NO: 775804 - RNA, 22 nt, Human
gacccauauaggacccuccaaa

SEQ ID NO: 775805 - RNA, 20 nt, Human
ucaugcagguguucuagguu

SEQ ID NO: 775806 - RNA, 22 nt, Human
agaccaugaccugccacuaagc

SEQ ID NO: 775807 - RNA, 22 nt, Human
auuauagaggguuacaguuaau

SEQ ID NO: 775808 - RNA, 22 nt, Human
aaacuugaacccagcucaggcu

SEQ ID NO: 775809 - RNA, 19 nt, Human
uguuuuguuaaagcagucc

SEQ ID NO: 775810 - RNA, 22 nt, Human
agugacuucuccuaaugucaua

SEQ ID NO: 775811 - RNA, 22 nt, Human
cucugggucucccugaggcuaa

SEQ ID NO: 775812 - RNA, 22 nt, Human
ccaguguugaacaguauuugga

SEQ ID NO: 775813 - RNA, 19 nt, Human
gcaggacucccagcuccuc

SEQ ID NO: 775814 - RNA, 22 nt, Human
uccagcuggggacaugggcuuc

SEQ ID NO: 775815 - RNA, 22 nt, Human
gcucacagucugcugagugcag

SEQ ID NO: 775816 - RNA, 22 nt, Human
auuguugagugcuucagcugua

SEQ ID NO: 775817 - RNA, 22 nt, Human
cucugauuuccuuauucuguca

SEQ ID NO: 775818 - RNA, 22 nt, Human
aaugucaaacagagcagagcua

SEQ ID NO: 775819 - RNA, 22 nt, Human
guggcagccgcaggcccugugu

SEQ ID NO: 775820 - RNA, 22 nt, Human
cagacagaccugcaagggcaca

SEQ ID NO: 775821 - RNA, 22 nt, Human
gcaaggcagcgcggaguagcua

SEQ ID NO: 775822 - RNA, 22 nt, Human
gacugggggcagccgcaccagu

SEQ ID NO: 775823 - RNA, 22 nt, Human
ucuaauuuuaggcauuuguuca

SEQ ID NO: 775824 - RNA, 22 nt, Human
gcucuggacccuggaguggcug

SEQ ID NO: 775825 - RNA, 22 nt, Human
uugggacagaaaaggagaagau

SEQ ID NO: 775826 - RNA, 22 nt, Human
aaaucaaggagggauuauauuu

SEQ ID NO: 775827 - RNA, 22 nt, Human
ucuucagaagaucacaucagug

SEQ ID NO: 775828 - RNA, 22 nt, Human
auggcagaauuaggauuucaag

SEQ ID NO: 775829 - RNA, 22 nt, Human
cagcagcuucuguugaucagaa

SEQ ID NO: 775830 - RNA, 17 nt, Human
aaccagcuguccccucc

SEQ ID NO: 775831 - RNA, 22 nt, Human
cuuugcagaaauaaacuugaug

SEQ ID NO: 775832 - RNA, 22 nt, Human
agguagaaggaccagaauuuau

SEQ ID NO: 775833 - RNA, 22 nt, Human
uuuacacugcuugaacaaucuc

SEQ ID NO: 775834 - RNA, 17 nt, Human
cugggccuccccugucc

SEQ ID NO: 775835 - RNA, 22 nt, Human
auagcacugguuuuucuugguu

SEQ ID NO: 775836 - RNA, 22 nt, Human
ucacauuucugauuauaccaaa

SEQ ID NO: 775837 - RNA, 22 nt, Human
cccaugcugugccuagagagca

SEQ ID NO: 775838 - RNA, 22 nt, Human
uggccugcuuucauuugaugcu

SEQ ID NO: 775839 - RNA, 22 nt, Human
aagauguaucaguuaagucuuc

SEQ ID NO: 775840 - RNA, 22 nt, Human
guggcacacaggagagagcuca

SEQ ID NO: 775841 - RNA, 22 nt, Human
ugcagcucauugguguccuggu

SEQ ID NO: 775842 - RNA, 22 nt, Human
uacagggguaacaguggggaau

SEQ ID NO: 775843 - RNA, 22 nt, Human
guauguguugaauucagggguc

SEQ ID NO: 775844 - RNA, 22 nt, Human
ugugggaaugcugaugggaucu

SEQ ID NO: 775845 - RNA, 21 nt, Human
aggcagcgugagggccacuca

SEQ ID NO: 775846 - RNA, 22 nt, Human
agaggcccugggcuggugugcu

SEQ ID NO: 775847 - RNA, 22 nt, Human
ugcuuuauucaggguuuacccc

SEQ ID NO: 775848 - RNA, 23 nt, Human
aggaauggcuagaagugugaccc

SEQ ID NO: 775849 - RNA, 22 nt, Human
ggaccaggcugagcaccugccu

SEQ ID NO: 775850 - RNA, 22 nt, Human
cagugucaccaggcgagucucc

SEQ ID NO: 775851 - RNA, 22 nt, Human
agggacagaugaaugacugagu

SEQ ID NO: 775852 - RNA, 22 nt, Human
ugcacagacaacucuuucuaga

SEQ ID NO: 775853 - RNA, 22 nt, Human
uuucacauaucaacucuauccu

SEQ ID NO: 775854 - RNA, 22 nt, Human
aaguucugccaggcuguggcag

SEQ ID NO: 775855 - RNA, 22 nt, Human
auuacaguaggauuggaaagga

SEQ ID NO: 775856 - RNA, 22 nt, Human
cccucucuuagaagaaacacag

SEQ ID NO: 775857 - RNA, 22 nt, Human
gcugccugggcuggcauuccca

SEQ ID NO: 775858 - RNA, 22 nt, Human
cacuggcugagcuucucuaggg

SEQ ID NO: 775859 - RNA, 22 nt, Human
agcugcaacaucugcuuguccc

SEQ ID NO: 775860 - RNA, 22 nt, Human
uuucaggauuuuaugagauagu

SEQ ID NO: 775861 - RNA, 22 nt, Human
uccugugccuccaccugcuccg

SEQ ID NO: 775862 - RNA, 22 nt, Human
aagauacacguuguauugaaua

SEQ ID NO: 775863 - RNA, 22 nt, Human
aaggggugagcagaggcuucgc

SEQ ID NO: 775864 - RNA, 22 nt, Human
agagacaggaguucuguuucca

SEQ ID NO: 775865 - RNA, 22 nt, Human
uccuuuggaacugacuccguua

SEQ ID NO: 775866 - RNA, 21 nt, Human
ugcaggagucugugagucagg

SEQ ID NO: 775867 - RNA, 22 nt, Human
uccaaagggaagcgcuuucugu

SEQ ID NO: 775868 - RNA, 22 nt, Human
aucagcugaaaaacaggcagca

SEQ ID NO: 775869 - RNA, 22 nt, Human
acucuuacucccucaggcacug

SEQ ID NO: 775870 - RNA, 22 nt, Human
ugucuuuaauucuacauaucuc

SEQ ID NO: 775871 - RNA, 19 nt, Human
caggacagacuucaaagcc

SEQ ID NO: 775872 - RNA, 21 nt, Human
ugggaugggucugggaccagc

SEQ ID NO: 775873 - RNA, 22 nt, Human
cagccagcuggcacugugagua

SEQ ID NO: 775874 - RNA, 23 nt, Human
gccaggcacaugguggacacgca

SEQ ID NO: 775875 - RNA, 21 nt, Human
uuucuucacuuugccccaugu

SEQ ID NO: 775876 - RNA, 23 nt, Human
ucccagggaaggugagcgaggcu

SEQ ID NO: 775877 - RNA, 22 nt, Human
agagaacagcauugcagcuuug

SEQ ID NO: 775878 - RNA, 22 nt, Human
uucccacaaucugcguguguau

SEQ ID NO: 775879 - RNA, 22 nt, Human
agagacuggaguuacgaguuca

SEQ ID NO: 775880 - RNA, 22 nt, Human
acagaugagagacaaugugcua

SEQ ID NO: 775881 - RNA, 22 nt, Human
uuaguguacuuagugcucuaag

SEQ ID NO: 775882 - RNA, 22 nt, Human
gaggcugauucggggaacagca

SEQ ID NO: 775883 - RNA, 22 nt, Human
ucugaccacagacaaccugcua

SEQ ID NO: 775884 - RNA, 22 nt, Human
gauauacauagguuucuaugca

SEQ ID NO: 775885 - RNA, 22 nt, Human
uuucuucuuaauacuggcugcu

SEQ ID NO: 775886 - RNA, 22 nt, Human
uaggccagcccuuaguccuguc

SEQ ID NO: 775887 - RNA, 22 nt, Human
gagguccugucugagaauggag

SEQ ID NO: 775888 - RNA, 22 nt, Human
ggagcucagaagugagugaguu

SEQ ID NO: 775889 - RNA, 22 nt, Human
uacaugcauuggauggcaauag

SEQ ID NO: 775890 - RNA, 22 nt, Human
uuggucccucauggacacauga

SEQ ID NO: 775891 - RNA, 22 nt, Human
gucugaggaagaugcaggggga

SEQ ID NO: 775892 - RNA, 17 nt, Human
cccaugagcccacuccc

SEQ ID NO: 775893 - RNA, 22 nt, Human
ccagcuccaaguuugggcauca

SEQ ID NO: 775894 - RNA, 22 nt, Human
cuugaaugaaaccaacugauga

SEQ ID NO: 775895 - RNA, 22 nt, Human
cuugaggcugcacuccagggcc

SEQ ID NO: 775896 - RNA, 22 nt, Human
ucuggaagacagugagcccgcu

SEQ ID NO: 775897 - RNA, 22 nt, Human
guauuucaucuugaaaaccagu

SEQ ID NO: 775898 - RNA, 22 nt, Human
ggcagcuggguuggccagaaac

SEQ ID NO: 775899 - RNA, 22 nt, Human
aagcagccacuggccaguuaua

SEQ ID NO: 775900 - RNA, 22 nt, Human
ucagacugaucaucuaucagau

SEQ ID NO: 775901 - RNA, 22 nt, Human
cuaggcucagucucuggucugu

SEQ ID NO: 775902 - RNA, 22 nt, Human
ucacuucacacccacuaucaug

SEQ ID NO: 775903 - RNA, 22 nt, Human
gcagaggugagaagggccuccc

SEQ ID NO: 775904 - RNA, 22 nt, Human
acuguauagauggaguugauuu

SEQ ID NO: 775905 - RNA, 22 nt, Human
uugauucuauggcuccgggagu

SEQ ID NO: 775906 - RNA, 22 nt, Human
gcacuucaugacuuugucaaau

SEQ ID NO: 775907 - RNA, 22 nt, Human
uaccugagguaaggaugaugag

SEQ ID NO: 775908 - RNA, 22 nt, Human
gaaucucaguggaagcaggaag

SEQ ID NO: 775909 - RNA, 22 nt, Human
acuguucuucccauuuauauug

SEQ ID NO: 775910 - RNA, 22 nt, Human
gagguggcgcgccaucccugcc

SEQ ID NO: 775911 - RNA, 22 nt, Human
agcagcaucuucuaaguaaggc

SEQ ID NO: 775912 - RNA, 22 nt, Human
agcucugguauuucuuuaaucc

SEQ ID NO: 775913 - RNA, 22 nt, Human
ucacacacauaaucuaagauua

SEQ ID NO: 775914 - RNA, 22 nt, Human
ugucugaaggcagguggagaac

SEQ ID NO: 775915 - RNA, 22 nt, Human
aaagguaugauacugugacaug

SEQ ID NO: 775916 - RNA, 22 nt, Human
aggcaaggugcuacagacagug

SEQ ID NO: 775917 - RNA, 22 nt, Human
aagacacaaagcuucccuuuuc

SEQ ID NO: 775918 - RNA, 20 nt, Human
caccagucaugagucaauac

SEQ ID NO: 775919 - RNA, 22 nt, Human
cgcaacagcguggcgcccagcu

SEQ ID NO: 775920 - RNA, 22 nt, Human
cugggcuguuuguucuggucuc

SEQ ID NO: 775921 - RNA, 22 nt, Human
auggcucuugaauugauacucu

SEQ ID NO: 775922 - RNA, 22 nt, Human
ugagccagucucucagaacccu

SEQ ID NO: 775923 - RNA, 22 nt, Human
cagggugguaccagcaucuagu

SEQ ID NO: 775924 - RNA, 22 nt, Human
uacuucaaacaaugguacaaac

SEQ ID NO: 775925 - RNA, 22 nt, Human
aaguucuuucuggaaggucugc

SEQ ID NO: 775926 - RNA, 22 nt, Human
augcaguagauaggcacuuuua

SEQ ID NO: 775927 - RNA, 22 nt, Human
uuuguguuuuagcuggugaggc

SEQ ID NO: 775928 - RNA, 22 nt, Human
uuuaguuuuaacugaaagcuau

SEQ ID NO: 775929 - RNA, 17 nt, Human
gcauccaguaacaugcc

SEQ ID NO: 775930 - RNA, 22 nt, Human
gggcucugggucgugucuccau

SEQ ID NO: 775931 - RNA, 17 nt, Human
cugaagauaauggcaac

SEQ ID NO: 775932 - RNA, 22 nt, Human
gcgccugccaccaugccaggcu

SEQ ID NO: 775933 - RNA, 22 nt, Human
auggggugagacuaggauuaaa

SEQ ID NO: 775934 - RNA, 22 nt, Human
ugucuuuagagucacaaaacca

SEQ ID NO: 775935 - RNA, 20 nt, Human
ugggagaagaacacuggaac

SEQ ID NO: 775936 - RNA, 19 nt, Human
cuagggcuuggcagcaggc

SEQ ID NO: 775937 - RNA, 21 nt, Human
uucugccuuccccuagcuggg

SEQ ID NO: 775938 - RNA, 23 nt, Human
uguaacuuugggcauguugcuuc

SEQ ID NO: 775939 - RNA, 22 nt, Human
uuauuaaugaguacaaguuauu

SEQ ID NO: 775940 - RNA, 19 nt, Human
auagagacagaguuuaauc

SEQ ID NO: 775941 - RNA, 22 nt, Human
ugcuugacuuaguuucucauuu

SEQ ID NO: 775942 - RNA, 22 nt, Human
uaucacacucggaaaucuagga

SEQ ID NO: 775943 - RNA, 22 nt, Human
aaagaucaugcuguuuugugau

SEQ ID NO: 775944 - RNA, 22 nt, Human
ucucugagcucaggagcugcag

SEQ ID NO: 775945 - RNA, 22 nt, Human
cagcugguguccagggaagugg

SEQ ID NO: 775946 - RNA, 22 nt, Human
ugcagggccgcuggaggucaug

SEQ ID NO: 775947 - RNA, 22 nt, Human
caccaggagccaucaggagucc

SEQ ID NO: 775948 - RNA, 23 nt, Human
ucagggcucacacguuuucuggc

SEQ ID NO: 775949 - RNA, 22 nt, Human
uuaucagaguccccaaaagaaa

SEQ ID NO: 775950 - RNA, 22 nt, Human
ggaucugggcucugccaaucag

SEQ ID NO: 775951 - RNA, 22 nt, Human
cccauucccuuuacuguugcau

SEQ ID NO: 775952 - RNA, 22 nt, Human
cauuuaaagguuguggguaaaa

SEQ ID NO: 775953 - RNA, 22 nt, Human
ccacuugaauuuuagugguuuu

SEQ ID NO: 775954 - RNA, 22 nt, Human
gagccagugaucagacagggag

SEQ ID NO: 775955 - RNA, 22 nt, Human
acuggaaaugagaugauaucag

SEQ ID NO: 775956 - RNA, 22 nt, Human
uccagcucugauucucacuagc

SEQ ID NO: 775957 - RNA, 22 nt, Human
uggggcuggcuauugucucccu

SEQ ID NO: 775958 - RNA, 22 nt, Human
uguacaugaauaaaagaucuug

SEQ ID NO: 775959 - RNA, 22 nt, Human
aaggagagguuguccguguugu

SEQ ID NO: 775960 - RNA, 22 nt, Human
acaugcuuuucccacaauuaua

SEQ ID NO: 775961 - RNA, 22 nt, Human
gcagagguuggauuggugacuu

SEQ ID NO: 775962 - RNA, 22 nt, Human
gcuuuagaaauguaggagauac

SEQ ID NO: 775963 - RNA, 19 nt, Human
aggcuggaugcccaucuua

SEQ ID NO: 775964 - RNA, 22 nt, Human
gccaggcuggugucacaacucu

SEQ ID NO: 775965 - RNA, 22 nt, Human
acaugaacauuauaucagcaag

SEQ ID NO: 775966 - RNA, 22 nt, Human
uaccugagccccugcuggugua

SEQ ID NO: 775967 - RNA, 18 nt, Human
guguuacaggagugcagc

SEQ ID NO: 775968 - RNA, 22 nt, Human
cacugcaguaacucuaggacug

SEQ ID NO: 775969 - RNA, 22 nt, Human
uaucaacauuaauauuuucugg

SEQ ID NO: 775970 - RNA, 22 nt, Human
ugcagggauuauguagggguug

SEQ ID NO: 775971 - RNA, 22 nt, Human
uggagccaguguugcccaacac

SEQ ID NO: 775972 - RNA, 22 nt, Human
ccuccacaggagcugcagugcu

SEQ ID NO: 775973 - RNA, 22 nt, Human
agguaguuuugacuucauggcu

SEQ ID NO: 775974 - RNA, 22 nt, Human
ccagggcaggagaaagacucac

SEQ ID NO: 775975 - RNA, 22 nt, Human
gcaggacaggcguugguccagu

SEQ ID NO: 775976 - RNA, 22 nt, Human
ccagagaggccuuggcaagaca

SEQ ID NO: 775977 - RNA, 22 nt, Human
cagcaugaaaaguguugcuauc

SEQ ID NO: 775978 - RNA, 22 nt, Human
uguacaaaacaagaugggggua

SEQ ID NO: 775979 - RNA, 22 nt, Human
guacauuuuacuuuguuugaau

SEQ ID NO: 775980 - RNA, 22 nt, Human
auuuccuauagauauggugagu

SEQ ID NO: 775981 - RNA, 22 nt, Human
acagcuuugggcaaugcuauga

SEQ ID NO: 775982 - RNA, 22 nt, Human
uaguuucuagucaaucuucuuu

SEQ ID NO: 775983 - RNA, 22 nt, Human
cacccagcuuuugcauccuccg

SEQ ID NO: 775984 - RNA, 22 nt, Human
ucaaugcauaggagguggcaga

SEQ ID NO: 775985 - RNA, 22 nt, Human
agaagucaaugaugagagugcu

SEQ ID NO: 775986 - RNA, 22 nt, Human
ucuggaauugcugugugaguuc

SEQ ID NO: 775987 - RNA, 22 nt, Human
gaggaaggaaugcaguguaugc

SEQ ID NO: 775988 - RNA, 22 nt, Human
ugggccucuguuuccucaucug

SEQ ID NO: 775989 - RNA, 22 nt, Human
aaagucauacauggugcuuacu

SEQ ID NO: 775990 - RNA, 22 nt, Human
agggaggcauuagcuacugcga

SEQ ID NO: 775991 - RNA, 18 nt, Human
aguggucuguuauaucau

SEQ ID NO: 775992 - RNA, 22 nt, Human
agcuccuugaaggcaguagcug

SEQ ID NO: 775993 - RNA, 22 nt, Human
ccuguccuccaagagcacaucu

SEQ ID NO: 775994 - RNA, 22 nt, Human
cccaggacccuucaauggcucc

SEQ ID NO: 775995 - RNA, 23 nt, Human
aguuccagaaaaaugcucaagca

SEQ ID NO: 775996 - RNA, 22 nt, Human
cccuggacuguucagggccuga

SEQ ID NO: 775997 - RNA, 23 nt, Human
cagcaggagggugccugggcugc

SEQ ID NO: 775998 - RNA, 22 nt, Human
uuugucuuggccucaguuuucu

SEQ ID NO: 775999 - RNA, 22 nt, Human
cugggaagauggugacagaauu

SEQ ID NO: 776000 - RNA, 22 nt, Human
ccugaguuaguugcugugucuc

SEQ ID NO: 776001 - RNA, 22 nt, Human
ggcccaguguaccccaggcagu

SEQ ID NO: 776002 - RNA, 22 nt, Human
ucuccaggugaaacuugcaggg

SEQ ID NO: 776003 - RNA, 19 nt, Human
gacuccaacuuuaagcaug

SEQ ID NO: 776004 - RNA, 22 nt, Human
agauugaagacugguggagcug

SEQ ID NO: 776005 - RNA, 22 nt, Human
ugagauaagcaaggauaaaggu

SEQ ID NO: 776006 - RNA, 22 nt, Human
aagcagugcgcucaucuaaggg

SEQ ID NO: 776007 - RNA, 22 nt, Human
gaggcacagaguaggugcacac

SEQ ID NO: 776008 - RNA, 22 nt, Human
agaaguuugguccuuuucaagg

SEQ ID NO: 776009 - RNA, 20 nt, Human
uuucugugagaaacacuguu

SEQ ID NO: 776010 - RNA, 22 nt, Human
ucacaguguggcaacucacaga

SEQ ID NO: 776011 - RNA, 19 nt, Human
gcacacauacacccuuugg

SEQ ID NO: 776012 - RNA, 23 nt, Human
ucuccuccuagauacagucaugg

SEQ ID NO: 776013 - RNA, 22 nt, Human
auucacaaguugauggauauuu

SEQ ID NO: 776014 - RNA, 22 nt, Human
ucccagcagcauagcucagaau

SEQ ID NO: 776015 - RNA, 22 nt, Human
aaaaugaacagaacaaugggga

SEQ ID NO: 776016 - RNA, 22 nt, Human
ccucccugguggcucuggucua

SEQ ID NO: 776017 - RNA, 22 nt, Human
aaccucucccuuugugucccug

SEQ ID NO: 776018 - RNA, 22 nt, Human
agaaaaggauugauggaucaga

SEQ ID NO: 776019 - RNA, 22 nt, Human
uacagaggaggugguugggagu

SEQ ID NO: 776020 - RNA, 22 nt, Human
auccaggguguggagagagcuc

SEQ ID NO: 776021 - RNA, 22 nt, Human
cuguggcucucugcaggguccc

SEQ ID NO: 776022 - RNA, 22 nt, Human
cuuggcuuuugcucccagauca

SEQ ID NO: 776023 - RNA, 19 nt, Human
caggagagcaugcacuuug

SEQ ID NO: 776024 - RNA, 22 nt, Human
auuaguugaacaaguuaaguaa

SEQ ID NO: 776025 - RNA, 22 nt, Human
agaucauuuggcagaagcaacg

SEQ ID NO: 776026 - RNA, 22 nt, Human
uggggguguccuggugcacaca

SEQ ID NO: 776027 - RNA, 22 nt, Human
caauuuuacucuuccucuucca

SEQ ID NO: 776028 - RNA, 22 nt, Human
cacuguacuggguugaaggacg

SEQ ID NO: 776029 - RNA, 22 nt, Human
aucugacaucuacuagaacaga

SEQ ID NO: 776030 - RNA, 18 nt, Human
uggcuuccugcgggcugc

SEQ ID NO: 776031 - RNA, 22 nt, Human
ugcugagguaaccauauccugc

SEQ ID NO: 776032 - RNA, 22 nt, Human
agcuccagaagccugcaaggua

SEQ ID NO: 776033 - RNA, 22 nt, Human
caugaaggaccauuucacgguc

SEQ ID NO: 776034 - RNA, 22 nt, Human
uguaucaaggguuuauguaagc

SEQ ID NO: 776035 - RNA, 22 nt, Human
ucucagggaccaugaugaugac

SEQ ID NO: 776036 - RNA, 22 nt, Human
gaagcacaaaguguaguuccga

SEQ ID NO: 776037 - RNA, 21 nt, Human
aaaaucaccuuaggucacugg

SEQ ID NO: 776038 - RNA, 23 nt, Human
gccuggauuaaggcagugacuuc

SEQ ID NO: 776039 - RNA, 19 nt, Human
uuagccauccacagugaaa

SEQ ID NO: 776040 - RNA, 21 nt, Human
uuuucccacugaaagcuccca

SEQ ID NO: 776041 - RNA, 22 nt, Human
ugaagacaagugugcugguguu

SEQ ID NO: 776042 - RNA, 22 nt, Human
aggggcuguggaaaccaacucu

SEQ ID NO: 776043 - RNA, 22 nt, Human
cugaaggaagcagaagcgaggu

SEQ ID NO: 776044 - RNA, 21 nt, Human
uggaaagauucaaagaccagg

SEQ ID NO: 776045 - RNA, 23 nt, Human
gcugcagcuguggauguucucag

SEQ ID NO: 776046 - RNA, 21 nt, Human
auuucagaaauauugguggga

SEQ ID NO: 776047 - RNA, 22 nt, Human
ugugcacauucuaggacuagua

SEQ ID NO: 776048 - RNA, 22 nt, Human
ucuucuacuauaauaauuuucu

SEQ ID NO: 776049 - RNA, 20 nt, Human
ucugaagaaagacagggacu

SEQ ID NO: 776050 - RNA, 22 nt, Human
ugcauugaggggcucucuuccu

SEQ ID NO: 776051 - RNA, 21 nt, Human
gggggaagaggaguugcuagu

SEQ ID NO: 776052 - RNA, 22 nt, Human
acacagaguaucuuuugccuag

SEQ ID NO: 776053 - RNA, 22 nt, Human
acagccccccgcucaguuucca

SEQ ID NO: 776054 - RNA, 22 nt, Human
aacagcagggaaauuccaaguc

SEQ ID NO: 776055 - RNA, 16 nt, Human
aauugcuucuugcugc

SEQ ID NO: 776056 - RNA, 22 nt, Human
gccuucugauaucucuuggcau

SEQ ID NO: 776057 - RNA, 22 nt, Human
ggagugaaucacuagaugcaga

SEQ ID NO: 776058 - RNA, 22 nt, Human
ugaucuuuccucuuguuugucu

SEQ ID NO: 776059 - RNA, 22 nt, Human
aaagguucucuuguucauuauu

SEQ ID NO: 776060 - RNA, 22 nt, Human
agaggccccaugggauggcggu

SEQ ID NO: 776061 - RNA, 22 nt, Human
uugcuguguaacuccuggccug

SEQ ID NO: 776062 - RNA, 22 nt, Human
accugcccaugaaaauggggag

SEQ ID NO: 776063 - RNA, 22 nt, Human
aguggaagagccauguuccaac

SEQ ID NO: 776064 - RNA, 22 nt, Human
gaugagcugugauuaauaagua

SEQ ID NO: 776065 - RNA, 22 nt, Human
uggccaggcuggucuggaacgc

SEQ ID NO: 776066 - RNA, 22 nt, Human
gcgcaagccacacagccugggg

SEQ ID NO: 776067 - RNA, 22 nt, Human
accaggcacucuuguggcagug

SEQ ID NO: 776068 - RNA, 22 nt, Human
gucuggaggcccgucagcccua

SEQ ID NO: 776069 - RNA, 22 nt, Human
ccaggacacgauuuuuagucug

SEQ ID NO: 776070 - RNA, 22 nt, Human
caggcagggagccacuguauaa

SEQ ID NO: 776071 - RNA, 22 nt, Human
uagguucauauucuagaaucau

SEQ ID NO: 776072 - RNA, 22 nt, Human
uggcucacuguagccuugaccu

SEQ ID NO: 776073 - RNA, 21 nt, Human
uagagccagugguguucugac

SEQ ID NO: 776074 - RNA, 22 nt, Human
ucucuuaaaagaguaauagaga

SEQ ID NO: 776075 - RNA, 22 nt, Human
guggccuuaagaaacaaacaac

SEQ ID NO: 776076 - RNA, 22 nt, Human
ugcugccacaaauucagcugcc

SEQ ID NO: 776077 - RNA, 22 nt, Human
uaaccugaacacacaauaggga

SEQ ID NO: 776078 - RNA, 22 nt, Human
ggggccuguagagcuucaggga

SEQ ID NO: 776079 - RNA, 22 nt, Human
cauauuuaguguuuggagaucg

SEQ ID NO: 776080 - RNA, 22 nt, Human
gccagagcagaauagaguggcc

SEQ ID NO: 776081 - RNA, 21 nt, Human
uccaggagcacgggacuagga

SEQ ID NO: 776082 - RNA, 22 nt, Human
ugcaggagcccuugggcucugg

SEQ ID NO: 776083 - RNA, 22 nt, Human
ggccuggaagaggacagagaaa

SEQ ID NO: 776084 - RNA, 22 nt, Human
gcaggcuggaggcuguucuggg

SEQ ID NO: 776085 - RNA, 22 nt, Human
aggaggcugaacuagggucugg

SEQ ID NO: 776086 - RNA, 22 nt, Human
ugaagccaucaggaagccagca

SEQ ID NO: 776087 - RNA, 22 nt, Human
gccugagagaacugaccaagag

SEQ ID NO: 776088 - RNA, 22 nt, Human
accagagggagacuuccucuuc

SEQ ID NO: 776089 - RNA, 22 nt, Human
agagcagauggccagggggccu

SEQ ID NO: 776090 - RNA, 22 nt, Human
guuacauggagcaaugaugcau

SEQ ID NO: 776091 - RNA, 22 nt, Human
ugccaggcauuugacagacacu

SEQ ID NO: 776092 - RNA, 22 nt, Human
uaaaugugaccuucauuuuaua

SEQ ID NO: 776093 - RNA, 22 nt, Human
ugcuuuuuaguacugucuuauu

SEQ ID NO: 776094 - RNA, 22 nt, Human
ggguggcugacuguuuugugga

SEQ ID NO: 776095 - RNA, 22 nt, Human
gcacagaauaacacucugggcu

SEQ ID NO: 776096 - RNA, 23 nt, Human
ugggccagggaguccgguuucuu

SEQ ID NO: 776097 - RNA, 22 nt, Human
auacaguaauuuguaacucauc

SEQ ID NO: 776098 - RNA, 22 nt, Human
ggcaggaggugaguggcgggug

SEQ ID NO: 776099 - RNA, 22 nt, Human
uaaagugaaguucagaauggcu

SEQ ID NO: 776100 - RNA, 22 nt, Human
ugugaauauuuccuucuuugga

SEQ ID NO: 776101 - RNA, 22 nt, Human
uuacauacuuacuagaucuaug

SEQ ID NO: 776102 - RNA, 20 nt, Human
agugucugggccucaggccc

SEQ ID NO: 776103 - RNA, 22 nt, Human
gaaacagcuagaaagccauugg

SEQ ID NO: 776104 - RNA, 22 nt, Human
uggcucugucacugugagcuau

SEQ ID NO: 776105 - RNA, 22 nt, Human
uucuguacaaguuguggcugcu

SEQ ID NO: 776106 - RNA, 22 nt, Human
uuaaaugugauccugguaugca

SEQ ID NO: 776107 - RNA, 22 nt, Human
gcuggaaaucauauuuuguugu

SEQ ID NO: 776108 - RNA, 22 nt, Human
gaaucccaaucuguuauugaca

SEQ ID NO: 776109 - RNA, 22 nt, Human
aacuauguuaauaaguuucauu

SEQ ID NO: 776110 - RNA, 22 nt, Human
ggccucggcccacugcugcggu

SEQ ID NO: 776111 - RNA, 22 nt, Human
augccaaguacaggcacugcuc

SEQ ID NO: 776112 - RNA, 22 nt, Human
ugaaagcacaaguucuaacagg

SEQ ID NO: 776113 - RNA, 22 nt, Human
ucaagcggacugagauacucug

SEQ ID NO: 776114 - RNA, 22 nt, Human
aaaaguaauugcaguuuucgcc

SEQ ID NO: 776115 - RNA, 22 nt, Human
cuccuccacagaccuacugaau

SEQ ID NO: 776116 - RNA, 22 nt, Human
gggaggagggugcuggcuaaac

SEQ ID NO: 776117 - RNA, 22 nt, Human
gugucugcuuucagcuaguagg

SEQ ID NO: 776118 - RNA, 22 nt, Human
auagauacauuagguaacuugu

SEQ ID NO: 776119 - RNA, 22 nt, Human
uuuucagaggccuaagagguuu

SEQ ID NO: 776120 - RNA, 22 nt, Human
cagagccucccuccucugccau

SEQ ID NO: 776121 - RNA, 22 nt, Human
cacaugcuucuuuugauuauga

SEQ ID NO: 776122 - RNA, 22 nt, Human
uggugacugggacuggauauga

SEQ ID NO: 776123 - RNA, 22 nt, Human
uugcaggguccuguggcucucc

SEQ ID NO: 776124 - RNA, 22 nt, Human
gauuaacauuucuaagaugcca

SEQ ID NO: 776125 - RNA, 22 nt, Human
uaaauaugcauguauccuuauc

SEQ ID NO: 776126 - RNA, 22 nt, Human
gggcacugaguggaugaugcag

SEQ ID NO: 776127 - RNA, 22 nt, Human
augacuuauuacaagucauauu

SEQ ID NO: 776128 - RNA, 20 nt, Human
uuuccacuguaauguaugau

SEQ ID NO: 776129 - RNA, 22 nt, Human
cuggcccugguaaggacaccca

SEQ ID NO: 776130 - RNA, 22 nt, Human
uuggaacaugccgggguccagg

SEQ ID NO: 776131 - RNA, 22 nt, Human
aaagaacuauuaacgaggaagc

SEQ ID NO: 776132 - RNA, 20 nt, Human
uucagagucagcaaaugcag

SEQ ID NO: 776133 - RNA, 22 nt, Human
gcugccugcuucaugugggaga

SEQ ID NO: 776134 - RNA, 22 nt, Human
ugguuucuggguuugucuagga

SEQ ID NO: 776135 - RNA, 22 nt, Human
uucuguggguaauaccucauac

SEQ ID NO: 776136 - RNA, 22 nt, Human
uuccuucuucauuguguuacag

SEQ ID NO: 776137 - RNA, 22 nt, Human
augccaagcucuaucccugacc

SEQ ID NO: 776138 - RNA, 22 nt, Human
acugcugauuuagcuuuguggg

SEQ ID NO: 776139 - RNA, 22 nt, Human
uuugcaaaguccauugaaguua

SEQ ID NO: 776140 - RNA, 22 nt, Human
cccuguccuggaugggagcacu

SEQ ID NO: 776141 - RNA, 22 nt, Human
agcuuuaucagaggagucucua

SEQ ID NO: 776142 - RNA, 22 nt, Human
uccaugagggacacuggaugcu

SEQ ID NO: 776143 - RNA, 22 nt, Human
ucgauagaauauacuagcugug

SEQ ID NO: 776144 - RNA, 22 nt, Human
ugaagccaaucugccaggcaga

SEQ ID NO: 776145 - RNA, 22 nt, Human
cuucaugguaaaucugccuuua

SEQ ID NO: 776146 - RNA, 22 nt, Human
aguccaagaucaaggugucagg

SEQ ID NO: 776147 - RNA, 22 nt, Human
uuccuaacuggccuuuauggau

SEQ ID NO: 776148 - RNA, 22 nt, Human
augcaugucagcugugcccaug

SEQ ID NO: 776149 - RNA, 22 nt, Human
uacacaauuaguugcaaaguga

SEQ ID NO: 776150 - RNA, 22 nt, Human
cagugguuuccaaacuuguucc

SEQ ID NO: 776151 - RNA, 22 nt, Human
guggagugcaacgguuggaguu

SEQ ID NO: 776152 - RNA, 20 nt, Human
auuagugcaucuggacaugc

SEQ ID NO: 776153 - RNA, 22 nt, Human
gagacacaggugguuccuguca

SEQ ID NO: 776154 - RNA, 22 nt, Human
ucuuagcauuucauaacaacug

SEQ ID NO: 776155 - RNA, 22 nt, Human
ugcgggucccagggucacaggc

SEQ ID NO: 776156 - RNA, 22 nt, Human
gccugcagaggugcugcuagcu

SEQ ID NO: 776157 - RNA, 22 nt, Human
cuucccacuaguaucacagagc

SEQ ID NO: 776158 - RNA, 22 nt, Human
aaaucguuucguuccugguuuu

SEQ ID NO: 776159 - RNA, 22 nt, Human
cccaucaggaacccaggagccc

SEQ ID NO: 776160 - RNA, 19 nt, Human
aauaauguucaugagauug

SEQ ID NO: 776161 - RNA, 22 nt, Human
ugccaucacugaacuucugaaa

SEQ ID NO: 776162 - RNA, 23 nt, Human
ucuguguccuccuggaccacaga

SEQ ID NO: 776163 - RNA, 22 nt, Human
ccugccaggcgagucuaggcca

SEQ ID NO: 776164 - RNA, 22 nt, Human
gcaguggauccaaugguaucuu

SEQ ID NO: 776165 - RNA, 22 nt, Human
uaaugguuuuuuggagacugcu

SEQ ID NO: 776166 - RNA, 23 nt, Human
ccugagaucuguaagggaccuug

SEQ ID NO: 776167 - RNA, 22 nt, Human
ccagcuggcacuguggcugccc

SEQ ID NO: 776168 - RNA, 22 nt, Human
auuuccaucaucauuaggccua

SEQ ID NO: 776169 - RNA, 22 nt, Human
uacaauagggagguuuagggga

SEQ ID NO: 776170 - RNA, 22 nt, Human
cuacauuuguucaaauaagcug

SEQ ID NO: 776171 - RNA, 22 nt, Human
uggaagaauaggauagaagaac

SEQ ID NO: 776172 - RNA, 22 nt, Human
agugauggcaucggguccagca

SEQ ID NO: 776173 - RNA, 22 nt, Human
gcuuuaaugcaauuucaccuca

SEQ ID NO: 776174 - RNA, 22 nt, Human
auauuugucaucugccuuaguu

SEQ ID NO: 776175 - RNA, 22 nt, Human
uaacauuaaaagagauaauuga

SEQ ID NO: 776176 - RNA, 22 nt, Human
ggcugaaggaugaaagcugcag

SEQ ID NO: 776177 - RNA, 22 nt, Human
agagggccauaggugcauaguu

SEQ ID NO: 776178 - RNA, 22 nt, Human
ucauaacagcuaagucccuuuc

SEQ ID NO: 776179 - RNA, 22 nt, Human
uggagaagauuggucaccauuc

SEQ ID NO: 776180 - RNA, 22 nt, Human
accagagcucuucagcacagga

SEQ ID NO: 776181 - RNA, 22 nt, Human
gaggccugaaaggggaccuaug

SEQ ID NO: 776182 - RNA, 21 nt, Human
aggugcuggcgccccaggaga

SEQ ID NO: 776183 - RNA, 22 nt, Human
aagcccugccacccauucacug

SEQ ID NO: 776184 - RNA, 20 nt, Human
ugucugaaaaggaagcuauc

SEQ ID NO: 776185 - RNA, 22 nt, Human
acagguggucuuugcuccuuuu

SEQ ID NO: 776186 - RNA, 22 nt, Human
caagucauuacugaaaugucac

SEQ ID NO: 776187 - RNA, 22 nt, Human
uacaagauuaaaacuuauacca

SEQ ID NO: 776188 - RNA, 22 nt, Human
agcucccagcuccuuugagaga

SEQ ID NO: 776189 - RNA, 23 nt, Human
agccuuggagguugaggcugcag

SEQ ID NO: 776190 - RNA, 19 nt, Human
aggggcacugucucuagag

SEQ ID NO: 776191 - RNA, 22 nt, Human
cuggcagcauuuuuuucagaag

SEQ ID NO: 776192 - RNA, 22 nt, Human
uaaaacugcuugguauggucua

SEQ ID NO: 776193 - RNA, 22 nt, Human
uaagacagggucuauucuuagu

SEQ ID NO: 776194 - RNA, 22 nt, Human
ggagggagagugacccuaccaa

SEQ ID NO: 776195 - RNA, 22 nt, Human
uuacuuuaucuccuagauucca

SEQ ID NO: 776196 - RNA, 22 nt, Human
gccaaaguaccuagcccucugc

SEQ ID NO: 776197 - RNA, 22 nt, Human
cuuucuuuguccaccaacaaug

SEQ ID NO: 776198 - RNA, 22 nt, Human
aagagagagcauucuucuguua

SEQ ID NO: 776199 - RNA, 18 nt, Human
aggaaagaaaggcaggug

SEQ ID NO: 776200 - RNA, 22 nt, Human
ccucaggcuagcuacugucccu

SEQ ID NO: 776201 - RNA, 22 nt, Human
ccuugcauuuaaaggcguaggg

SEQ ID NO: 776202 - RNA, 22 nt, Human
ugcaaggaagggacagcugaga

SEQ ID NO: 776203 - RNA, 22 nt, Human
uccaggugccggggacugaggc

SEQ ID NO: 776204 - RNA, 22 nt, Human
aggucaaagaaccuagcuauag

SEQ ID NO: 776205 - RNA, 22 nt, Human
ucauugcaguugaguuguguua

SEQ ID NO: 776206 - RNA, 22 nt, Human
cugggacuuuacccuguggccc

SEQ ID NO: 776207 - RNA, 22 nt, Human
cugugucggacgugggcagcag

SEQ ID NO: 776208 - RNA, 22 nt, Human
cacuguggcuuaccaaagcuaa

SEQ ID NO: 776209 - RNA, 22 nt, Human
uugaaguuuaaugguagauucc

SEQ ID NO: 776210 - RNA, 22 nt, Human
acaggcuuuuuuagaaugacau

SEQ ID NO: 776211 - RNA, 22 nt, Human
uaaaucuuguggcaaugcuucu

SEQ ID NO: 776212 - RNA, 22 nt, Human
gaacaggguuugagaggcuuag

SEQ ID NO: 776213 - RNA, 22 nt, Human
uaugaagauugcggucuggaau

SEQ ID NO: 776214 - RNA, 22 nt, Human
uucagcaucuacauauuuagaa

SEQ ID NO: 776215 - RNA, 22 nt, Human
ucucugugugugugacagcauu

SEQ ID NO: 776216 - RNA, 22 nt, Human
uuuccucugucaugacagcuga

SEQ ID NO: 776217 - RNA, 22 nt, Human
uaaaggccagggccugagugcu

SEQ ID NO: 776218 - RNA, 22 nt, Human
gaggagugccagccguggaguc

SEQ ID NO: 776219 - RNA, 22 nt, Human
agaaaucaugucuuauuucuau

SEQ ID NO: 776220 - RNA, 22 nt, Human
augauucucugcuacucuaaau

SEQ ID NO: 776221 - RNA, 22 nt, Human
gcuguggcccuuggcaucugcg

SEQ ID NO: 776222 - RNA, 22 nt, Human
ccugugcuggcuuuauucucag

SEQ ID NO: 776223 - RNA, 22 nt, Human
agcaccugucaaguccaggcug

SEQ ID NO: 776224 - RNA, 22 nt, Human
auggucauaugcuaauucagga

SEQ ID NO: 776225 - RNA, 22 nt, Human
uuucaguugccaagcuaauucu

SEQ ID NO: 776226 - RNA, 22 nt, Human
aaggugucaccagauuggcagg

SEQ ID NO: 776227 - RNA, 22 nt, Human
cagggugcauacccaugcauac

SEQ ID NO: 776228 - RNA, 22 nt, Human
agaguccauaugugggaggagu

SEQ ID NO: 776229 - RNA, 22 nt, Human
acuggacagaggaaauauggag

SEQ ID NO: 776230 - RNA, 22 nt, Human
uucuuaacucaaauauauaucc

SEQ ID NO: 776231 - RNA, 22 nt, Human
aaaucucaggccucuauuuacu

SEQ ID NO: 776232 - RNA, 22 nt, Human
aaagugcaaggauuacaggcau

SEQ ID NO: 776233 - RNA, 22 nt, Human
acacuuaaucuuacugaggauc

SEQ ID NO: 776234 - RNA, 22 nt, Human
acuuguuaguuuuaucugcaug

SEQ ID NO: 776235 - RNA, 18 nt, Human
acuaugcugaauaaaugg

SEQ ID NO: 776236 - RNA, 22 nt, Human
auaguauuuccagaaauagucu

SEQ ID NO: 776237 - RNA, 22 nt, Human
cuagagaaaacuguguaucuug

SEQ ID NO: 776238 - RNA, 22 nt, Human
aggcagccacaugagcuccuga

SEQ ID NO: 776239 - RNA, 22 nt, Human
agguggcagcagaaucagggag

SEQ ID NO: 776240 - RNA, 22 nt, Human
ucuuuaauucagcaugaugcgg

SEQ ID NO: 776241 - RNA, 18 nt, Human
ugggccugcauccuaguc

SEQ ID NO: 776242 - RNA, 22 nt, Human
cucuuaaauaacaucauugcuu

SEQ ID NO: 776243 - RNA, 22 nt, Human
ggcugaguugagaggauuacuu

SEQ ID NO: 776244 - RNA, 22 nt, Human
guguagguaagcaugcagcuga

SEQ ID NO: 776245 - RNA, 22 nt, Human
auacaauccagccauugccaca

SEQ ID NO: 776246 - RNA, 19 nt, Human
agcuguggggccuagcacc

SEQ ID NO: 776247 - RNA, 22 nt, Human
ugaagcaggugaauggaugucg

SEQ ID NO: 776248 - RNA, 22 nt, Human
gucucccaucguuugugaggaa

SEQ ID NO: 776249 - RNA, 22 nt, Human
uucuugaaaauagccauguaca

SEQ ID NO: 776250 - RNA, 22 nt, Human
uuacauaacgguaugaaaaaug

SEQ ID NO: 776251 - RNA, 22 nt, Human
ugagcugugauuaacucugaga

SEQ ID NO: 776252 - RNA, 22 nt, Human
caaccucuuugggccuugguuu

SEQ ID NO: 776253 - RNA, 22 nt, Human
ugagagucucagaccuccuggu

SEQ ID NO: 776254 - RNA, 22 nt, Human
gaauugcuagcgcaccaauucu

SEQ ID NO: 776255 - RNA, 17 nt, Human
uucaagauauugaaaug

SEQ ID NO: 776256 - RNA, 22 nt, Human
aacucucuuuagagagggacaa

SEQ ID NO: 776257 - RNA, 22 nt, Human
gagguucaguaaggaauacuga

SEQ ID NO: 776258 - RNA, 22 nt, Human
ccucuggaucuuucuccacacu

SEQ ID NO: 776259 - RNA, 22 nt, Human
aucauugaauauaagugcuauu

SEQ ID NO: 776260 - RNA, 22 nt, Human
gggcauggugaugugcaccugu

SEQ ID NO: 776261 - RNA, 22 nt, Human
cugggugagcuggccagagggu

SEQ ID NO: 776262 - RNA, 22 nt, Human
uaagaauauugggaauggaugg

SEQ ID NO: 776263 - RNA, 22 nt, Human
ucagaggaccuuacugagaacc

SEQ ID NO: 776264 - RNA, 22 nt, Human
cugcugggccuggucucugagg

SEQ ID NO: 776265 - RNA, 21 nt, Human
uuucuucccuuggcuucugag

SEQ ID NO: 776266 - RNA, 22 nt, Human
ccaggccuuucuucuuggucug

SEQ ID NO: 776267 - RNA, 22 nt, Human
aaaucucugaacuuaauaaugc

SEQ ID NO: 776268 - RNA, 22 nt, Human
ugcaggcugggaagagggacaa

SEQ ID NO: 776269 - RNA, 22 nt, Human
gaggacagagccgccuggcaag

SEQ ID NO: 776270 - RNA, 22 nt, Human
auacugaauuagguaaagcaua

SEQ ID NO: 776271 - RNA, 21 nt, Human
agagccugagaucuuccagca

SEQ ID NO: 776272 - RNA, 22 nt, Human
agugucugccugggaggagcau

SEQ ID NO: 776273 - RNA, 21 nt, Human
aaaaagcuggggcaugcaugc

SEQ ID NO: 776274 - RNA, 22 nt, Human
gcauuuauuaucugccaggcac

SEQ ID NO: 776275 - RNA, 22 nt, Human
uuguugucauuguagaggauuu

SEQ ID NO: 776276 - RNA, 21 nt, Human
uuguuuccucccaaaaugcca

SEQ ID NO: 776277 - RNA, 22 nt, Human
ucuucacaaagcuguuguuaaa

SEQ ID NO: 776278 - RNA, 22 nt, Human
cuuaacagagagaaguguugcu

SEQ ID NO: 776279 - RNA, 18 nt, Human
gaggcagcuagcaauuuu

SEQ ID NO: 776280 - RNA, 21 nt, Human
uuguaaagguuuagaagaaug

SEQ ID NO: 776281 - RNA, 21 nt, Human
agcuuguguguaucacagugu

SEQ ID NO: 776282 - RNA, 22 nt, Human
uguuuguggaauauucuuuaag

SEQ ID NO: 776283 - RNA, 22 nt, Human
uuagaaagaacuuuagauauca

SEQ ID NO: 776284 - RNA, 22 nt, Human
uuggcccuccaccuggcugugc

SEQ ID NO: 776285 - RNA, 22 nt, Human
agagggcugggaugugcugugu

SEQ ID NO: 776286 - RNA, 22 nt, Human
uacuguuucaagcccucacaga

SEQ ID NO: 776287 - RNA, 22 nt, Human
ggaggaugagcuacgaggagcu

SEQ ID NO: 776288 - RNA, 22 nt, Human
ucugacaauaacugaguuuaac

SEQ ID NO: 776289 - RNA, 22 nt, Human
cccaggagaauauaauguucuu

SEQ ID NO: 776290 - RNA, 22 nt, Human
uccuggcaggucagcaggagca

SEQ ID NO: 776291 - RNA, 22 nt, Human
guguaaaucagcuuguguaaua

SEQ ID NO: 776292 - RNA, 22 nt, Human
auccugggaagcugacauugaa

SEQ ID NO: 776293 - RNA, 22 nt, Human
ugcuuauucuuuccacaauuca

SEQ ID NO: 776294 - RNA, 22 nt, Human
uagcccagaagagggaagcaac

SEQ ID NO: 776295 - RNA, 22 nt, Human
gagcccugugaggaaagagggu

SEQ ID NO: 776296 - RNA, 22 nt, Human
augcugugcuggcuaaccaugg

SEQ ID NO: 776297 - RNA, 22 nt, Human
ccucugugucuugguuucaaga

SEQ ID NO: 776298 - RNA, 22 nt, Human
ccaaauauuaacaaaguaauuu

SEQ ID NO: 776299 - RNA, 22 nt, Human
caggccggccggccccagcucu

SEQ ID NO: 776300 - RNA, 22 nt, Human
gccucuggggcagcugagucau

SEQ ID NO: 776301 - RNA, 16 nt, Human
agaggccuugaggaag

SEQ ID NO: 776302 - RNA, 22 nt, Human
ccccugccagcuaucccugaac

SEQ ID NO: 776303 - RNA, 19 nt, Human
gagcaggccacacaugugu

SEQ ID NO: 776304 - RNA, 22 nt, Human
gggcuggacaucuaagguagcu

SEQ ID NO: 776305 - RNA, 22 nt, Human
agccucucuccagcuuggcaga

SEQ ID NO: 776306 - RNA, 22 nt, Human
agagccaguuacaacuguggag

SEQ ID NO: 776307 - RNA, 22 nt, Human
cagaugaacugugacugaaaau

SEQ ID NO: 776308 - RNA, 22 nt, Human
aaugcacauguuguaauaaaua

SEQ ID NO: 776309 - RNA, 20 nt, Human
caccacagaauuggggacag

SEQ ID NO: 776310 - RNA, 22 nt, Human
gucuuauuuaaagagaucauac

SEQ ID NO: 776311 - RNA, 22 nt, Human
uuauggaagugcaaauugugug

SEQ ID NO: 776312 - RNA, 22 nt, Human
ucacagugacagccaauguuuu

SEQ ID NO: 776313 - RNA, 22 nt, Human
uggcaguggcuuugcuggugga

SEQ ID NO: 776314 - RNA, 20 nt, Human
uccugcuuccaccagagcac

SEQ ID NO: 776315 - RNA, 22 nt, Human
cacaaacaucaauccuguuuuc

SEQ ID NO: 776316 - RNA, 22 nt, Human
acagaaggcggggacaaggcgg

SEQ ID NO: 776317 - RNA, 22 nt, Human
ccuggcugcuuccucugccaug

SEQ ID NO: 776318 - RNA, 19 nt, Human
cucucagccugucuccuug

SEQ ID NO: 776319 - RNA, 21 nt, Human
uaaaucucuguauucuucagu

SEQ ID NO: 776320 - RNA, 22 nt, Human
uugggaggucauaaaucuguuc

SEQ ID NO: 776321 - RNA, 22 nt, Human
ccaaaguccauaguuuacauua

SEQ ID NO: 776322 - RNA, 22 nt, Human
ggaaggcugugcaguguuugca

SEQ ID NO: 776323 - RNA, 22 nt, Human
ucuccagguggcuugggcuucu

SEQ ID NO: 776324 - RNA, 22 nt, Human
ccagagggcaaaaugaagcuua

SEQ ID NO: 776325 - RNA, 22 nt, Human
ccagccagcugcccuuggggcc

SEQ ID NO: 776326 - RNA, 22 nt, Human
gaaggauuugagauuauccuag

SEQ ID NO: 776327 - RNA, 22 nt, Human
gaggggauuggaaggaacaccc

SEQ ID NO: 776328 - RNA, 22 nt, Human
auacaaaaauuagccgggagua

SEQ ID NO: 776329 - RNA, 22 nt, Human
aacugcuuaucuuugguagaug

SEQ ID NO: 776330 - RNA, 22 nt, Human
cacucaggguacaauggagggc

SEQ ID NO: 776331 - RNA, 22 nt, Human
aguguuucaauccuagggguug

SEQ ID NO: 776332 - RNA, 21 nt, Human
auucaguuugacaucuagcag

SEQ ID NO: 776333 - RNA, 22 nt, Human
uguucuugagccuuuagaccua

SEQ ID NO: 776334 - RNA, 22 nt, Human
agucuguguaccuuuggccuuc

SEQ ID NO: 776335 - RNA, 22 nt, Human
augcauauuucuuggagcaccu

SEQ ID NO: 776336 - RNA, 19 nt, Human
ggccaccucucuucccagg

SEQ ID NO: 776337 - RNA, 22 nt, Human
guagaaauuccauuuacuuuga

SEQ ID NO: 776338 - RNA, 22 nt, Human
caguacuuugcaucauuccacu

SEQ ID NO: 776339 - RNA, 22 nt, Human
gugcccuggcucacagugucuc

SEQ ID NO: 776340 - RNA, 22 nt, Human
gagagcuggccagcuucaguau

SEQ ID NO: 776341 - RNA, 22 nt, Human
ccuuuuuucuaugccaacucug

SEQ ID NO: 776342 - RNA, 22 nt, Human
gagaacaaggaagagucggcag

SEQ ID NO: 776343 - RNA, 22 nt, Human
acccucagacagcuguggccag

SEQ ID NO: 776344 - RNA, 22 nt, Human
gcaaaguauuaaccaacaggau

SEQ ID NO: 776345 - RNA, 17 nt, Human
aaacuggggucaggagc

SEQ ID NO: 776346 - RNA, 22 nt, Human
ugccauccaacaguuccaucuu

SEQ ID NO: 776347 - RNA, 22 nt, Human
agauucauuaggagacauucag

SEQ ID NO: 776348 - RNA, 22 nt, Human
aaaaccacaaugacuuuugcac

SEQ ID NO: 776349 - RNA, 22 nt, Human
augugcuuuccaaugcuguagg

SEQ ID NO: 776350 - RNA, 22 nt, Human
caaaggcaugugaguauaugug

SEQ ID NO: 776351 - RNA, 21 nt, Human
aucccagcacccaggagugca

SEQ ID NO: 776352 - RNA, 22 nt, Human
ccuuggugaucugggcuggaag

SEQ ID NO: 776353 - RNA, 22 nt, Human
aaggccacgucuccuuccagag

SEQ ID NO: 776354 - RNA, 22 nt, Human
aagccaguggugagaagauagc

SEQ ID NO: 776355 - RNA, 22 nt, Human
gacccugaggaugcaccagcag

SEQ ID NO: 776356 - RNA, 22 nt, Human
ucagaaauuuucucaguaguuc

SEQ ID NO: 776357 - RNA, 22 nt, Human
aaggggcucuugucaggcgcag

SEQ ID NO: 776358 - RNA, 22 nt, Human
agggcugcuuugcuaaauaugg

SEQ ID NO: 776359 - RNA, 22 nt, Human
uuggcagugucugcaaaaugga

SEQ ID NO: 776360 - RNA, 18 nt, Human
cgaggcaggcggaucacg

SEQ ID NO: 776361 - RNA, 22 nt, Human
ucauagaaauguggccagaaac

SEQ ID NO: 776362 - RNA, 22 nt, Human
auggagcagcagaaggggcuug

SEQ ID NO: 776363 - RNA, 22 nt, Human
accugguuugucucaucaccac

SEQ ID NO: 776364 - RNA, 23 nt, Human
guuguaauggauaaugcaaauug

SEQ ID NO: 776365 - RNA, 22 nt, Human
augaguaaaaccacuauuuaca

SEQ ID NO: 776366 - RNA, 22 nt, Human
ugagguggcuagggaggcacuc

SEQ ID NO: 776367 - RNA, 22 nt, Human
ggaaacaugccugcuggacagu

SEQ ID NO: 776368 - RNA, 22 nt, Human
ucauauuuugcaaggucagcua

SEQ ID NO: 776369 - RNA, 22 nt, Human
augaaggcuguguggagccccc

SEQ ID NO: 776370 - RNA, 22 nt, Human
ugcagcuucuuguccugugauu

SEQ ID NO: 776371 - RNA, 22 nt, Human
uacuuaaaaauuaucaaagugg

SEQ ID NO: 776372 - RNA, 22 nt, Human
cuccuggagcagcaggcgcagg

SEQ ID NO: 776373 - RNA, 22 nt, Human
cugaaacuccaugagaaauugc

SEQ ID NO: 776374 - RNA, 22 nt, Human
agggcugccauuucuggcccaa

SEQ ID NO: 776375 - RNA, 22 nt, Human
ugaguuaaaugagaacaugaaa

SEQ ID NO: 776376 - RNA, 22 nt, Human
cagguggcuuauuagggucagu

SEQ ID NO: 776377 - RNA, 22 nt, Human
ugugaaacggagucagggaagg

SEQ ID NO: 776378 - RNA, 22 nt, Human
ugggcccaagugcaaugcagug

SEQ ID NO: 776379 - RNA, 21 nt, Human
gaacccagcagcagugcucug

SEQ ID NO: 776380 - RNA, 22 nt, Human
gcuggccugggcagaggcuaug

SEQ ID NO: 776381 - RNA, 22 nt, Human
uaguucaggguuauuucaaggu

SEQ ID NO: 776382 - RNA, 22 nt, Human
uugcagggcaggaccauggaca

SEQ ID NO: 776383 - RNA, 22 nt, Human
ucagugccuacuuugaucaauu

SEQ ID NO: 776384 - RNA, 22 nt, Human
caucacuuuuaaaggugaucga

SEQ ID NO: 776385 - RNA, 22 nt, Human
aaaugugacagaugcaguacag

SEQ ID NO: 776386 - RNA, 22 nt, Human
uugcacagaugagggugaugcu

SEQ ID NO: 776387 - RNA, 22 nt, Human
aacuguaaagguugagugguaa

SEQ ID NO: 776388 - RNA, 22 nt, Human
gaggcagccucaguggaccucg

SEQ ID NO: 776389 - RNA, 22 nt, Human
ugucauguguucuuaaauacau

SEQ ID NO: 776390 - RNA, 22 nt, Human
uccagucacuucauuuuacaga

SEQ ID NO: 776391 - RNA, 22 nt, Human
guuaugaagucauucacaaaua

SEQ ID NO: 776392 - RNA, 22 nt, Human
ucagagugguagccuauuuucu

SEQ ID NO: 776393 - RNA, 22 nt, Human
uacaaaaaauugauacugacga

SEQ ID NO: 776394 - RNA, 22 nt, Human
gagacaggcagcuaguggguca

SEQ ID NO: 776395 - RNA, 22 nt, Human
uugugucuggauuucagcuuuc

SEQ ID NO: 776396 - RNA, 22 nt, Human
cacauucuuucacaguucugaa

SEQ ID NO: 776397 - RNA, 22 nt, Human
agagaggcauucggugauccca

SEQ ID NO: 776398 - RNA, 22 nt, Human
cugagagaugauauagcuuaau

SEQ ID NO: 776399 - RNA, 22 nt, Human
ggggagcaauaguugaggugug

SEQ ID NO: 776400 - RNA, 22 nt, Human
ggugguggucccgacuugggag

SEQ ID NO: 776401 - RNA, 22 nt, Human
cuggagcuccagggucuccucu

SEQ ID NO: 776402 - RNA, 22 nt, Human
agugacugguuuugacaggaau

SEQ ID NO: 776403 - RNA, 22 nt, Human
cccaggcagagagcuggugagc

SEQ ID NO: 776404 - RNA, 22 nt, Human
aaagaaauagauggcauuuaaa

SEQ ID NO: 776405 - RNA, 22 nt, Human
aguuuucuucauuuuguggcca

SEQ ID NO: 776406 - RNA, 20 nt, Human
aggagaugauccagagucag

SEQ ID NO: 776407 - RNA, 22 nt, Human
gagcuugggugccaugcugagc

SEQ ID NO: 776408 - RNA, 22 nt, Human
aaauuauuuucagaauggagaa

SEQ ID NO: 776409 - RNA, 22 nt, Human
gcuuccugggacaggcuaugug

SEQ ID NO: 776410 - RNA, 22 nt, Human
aggaggaauacaauccagcagc

SEQ ID NO: 776411 - RNA, 19 nt, Human
ugcucucuggugcuucaug

SEQ ID NO: 776412 - RNA, 22 nt, Human
aaguggugguaugaaccgaggg

SEQ ID NO: 776413 - RNA, 22 nt, Human
aagauacauauuuguucuagug

SEQ ID NO: 776414 - RNA, 22 nt, Human
gccccaagggagcccagcacac

SEQ ID NO: 776415 - RNA, 22 nt, Human
guggcuuccaugugcaucugac

SEQ ID NO: 776416 - RNA, 22 nt, Human
aucagcaucggguggugguggg

SEQ ID NO: 776417 - RNA, 22 nt, Human
auucagaaacucugggcagaac

SEQ ID NO: 776418 - RNA, 22 nt, Human
gccaccuggacucagagccagg

SEQ ID NO: 776419 - RNA, 18 nt, Human
cccagugcucacugccuc

SEQ ID NO: 776420 - RNA, 22 nt, Human
uggcagagguaauucaaauccc

SEQ ID NO: 776421 - RNA, 22 nt, Human
ugaagcuuuccuguggucagga

SEQ ID NO: 776422 - RNA, 22 nt, Human
ugagccaggcucaagugauccu

SEQ ID NO: 776423 - RNA, 22 nt, Human
uaaagcauguguuagaagugca

SEQ ID NO: 776424 - RNA, 22 nt, Human
aaauguuuaaguguaggagcaa

SEQ ID NO: 776425 - RNA, 19 nt, Human
ccagcagguucauuucagg

SEQ ID NO: 776426 - RNA, 22 nt, Human
gagucugagucuaauggcccca

SEQ ID NO: 776427 - RNA, 22 nt, Human
auccucucucccauaccagucu

SEQ ID NO: 776428 - RNA, 22 nt, Human
uuuguucaccuagcaaacuuuu

SEQ ID NO: 776429 - RNA, 22 nt, Human
gcuuggcucuaagacaccuauu

SEQ ID NO: 776430 - RNA, 22 nt, Human
ugaugccuaugaauuguaaugu

SEQ ID NO: 776431 - RNA, 22 nt, Human
aaguuauuuccucgugacugaa

SEQ ID NO: 776432 - RNA, 22 nt, Human
cacagaauaaauugguaucaga

SEQ ID NO: 776433 - RNA, 22 nt, Human
ugggagcucugagccugcugug

SEQ ID NO: 776434 - RNA, 22 nt, Human
gcacuugauaaauguuaacuga

SEQ ID NO: 776435 - RNA, 22 nt, Human
aucauagguguguuaccaguua

SEQ ID NO: 776436 - RNA, 20 nt, Human
acaaaauagguacuggguag

SEQ ID NO: 776437 - RNA, 22 nt, Human
ggcagguguggugaccagagau

SEQ ID NO: 776438 - RNA, 22 nt, Human
gcucucuggaagguaucauuau

SEQ ID NO: 776439 - RNA, 22 nt, Human
aaggccugaacaugaggagaug

SEQ ID NO: 776440 - RNA, 22 nt, Human
gagggcaccagaagagccagau

SEQ ID NO: 776441 - RNA, 22 nt, Human
gcauggcaaauaucgagggcag

SEQ ID NO: 776442 - RNA, 23 nt, Human
ucauuucagguugcaugguacca

SEQ ID NO: 776443 - RNA, 22 nt, Human
gaacuguaguuaauacuacaca

SEQ ID NO: 776444 - RNA, 22 nt, Human
ccaggcagaaugaaaccccugu

SEQ ID NO: 776445 - RNA, 22 nt, Human
ugagaauagcagacugguaacu

SEQ ID NO: 776446 - RNA, 22 nt, Human
guggaauuuuuaccuaugaaug

SEQ ID NO: 776447 - RNA, 22 nt, Human
uguacauauauguauguacgca

SEQ ID NO: 776448 - RNA, 22 nt, Human
ugcaggggcuugucugggccug

SEQ ID NO: 776449 - RNA, 22 nt, Human
ugcaugcguuaguuggcguguu

SEQ ID NO: 776450 - RNA, 22 nt, Human
caccagcuacuccagggccgug

SEQ ID NO: 776451 - RNA, 22 nt, Human
aggagcugugaaugggaggggu

SEQ ID NO: 776452 - RNA, 19 nt, Human
uagcagcugccaaaggaga

SEQ ID NO: 776453 - RNA, 22 nt, Human
gugcugcuugggggcagagcag

SEQ ID NO: 776454 - RNA, 22 nt, Human
cuacauucaacagcagaguuuu

SEQ ID NO: 776455 - RNA, 22 nt, Human
uugcauguguauaaaaguugga

SEQ ID NO: 776456 - RNA, 22 nt, Human
auuucuacugugagaaacauga

SEQ ID NO: 776457 - RNA, 22 nt, Human
uacaaugucucucaccugacuu

SEQ ID NO: 776458 - RNA, 22 nt, Human
uccuuccagguccagggaugug

SEQ ID NO: 776459 - RNA, 22 nt, Human
gauuguaaaacagaucauuauc

SEQ ID NO: 776460 - RNA, 22 nt, Human
ugcuucacuggcuccacauagg

SEQ ID NO: 776461 - RNA, 22 nt, Human
uccaagcuugcuuuagccacag

SEQ ID NO: 776462 - RNA, 22 nt, Human
cuugcaguuuagguccucugug

SEQ ID NO: 776463 - RNA, 22 nt, Human
augucacaugagagcgcagcac

SEQ ID NO: 776464 - RNA, 22 nt, Human
acucuguagggacgguucuccc

SEQ ID NO: 776465 - RNA, 22 nt, Human
aacugugggagaaggcgaugug

SEQ ID NO: 776466 - RNA, 22 nt, Human
ucacaggaaccaucagagaaau

SEQ ID NO: 776467 - RNA, 19 nt, Human
aaacucugaaggccacugg

SEQ ID NO: 776468 - RNA, 22 nt, Human
gggugccacagagcuuccacuu

SEQ ID NO: 776469 - RNA, 22 nt, Human
uuacaaugaugaauaaauggca

SEQ ID NO: 776470 - RNA, 22 nt, Human
uccagagccuauauguucaacu

SEQ ID NO: 776471 - RNA, 22 nt, Human
aagugauaccuaggaaaucaag

SEQ ID NO: 776472 - RNA, 22 nt, Human
guacccagaggcaugaucccag

SEQ ID NO: 776473 - RNA, 22 nt, Human
gguggcaggcccugagcauccc

SEQ ID NO: 776474 - RNA, 22 nt, Human
aagcauuugguucugaagacuc

SEQ ID NO: 776475 - RNA, 22 nt, Human
ggucuagaggauguuccuuucc

SEQ ID NO: 776476 - RNA, 22 nt, Human
agaauuuaggaugcaugugaau

SEQ ID NO: 776477 - RNA, 22 nt, Human
cuccucacuuuccagacugggc

SEQ ID NO: 776478 - RNA, 22 nt, Human
uuaugacauaugaguacaagua

SEQ ID NO: 776479 - RNA, 22 nt, Human
uuuucauuguaaaucaggaaac

SEQ ID NO: 776480 - RNA, 22 nt, Human
uugaaacaguagcucauagacc

SEQ ID NO: 776481 - RNA, 22 nt, Human
auuccaaagccugaauaaugga

SEQ ID NO: 776482 - RNA, 22 nt, Human
gccuuuggaugguuuuucuauu

SEQ ID NO: 776483 - RNA, 22 nt, Human
uggcaguaaagcuggaaaagug

SEQ ID NO: 776484 - RNA, 22 nt, Human
ggcucugggugugaccuugggu

SEQ ID NO: 776485 - RNA, 22 nt, Human
ccuaggaagcugagauugcagu

SEQ ID NO: 776486 - RNA, 23 nt, Human
uuuaaccuuggucaagaauuucc

SEQ ID NO: 776487 - RNA, 22 nt, Human
ugagaggauauuuugggaggau

SEQ ID NO: 776488 - RNA, 22 nt, Human
ugugacagucguuaggagcuca

SEQ ID NO: 776489 - RNA, 22 nt, Human
gcagcauugcacuuuuguucuu

SEQ ID NO: 776490 - RNA, 22 nt, Human
gccuccggagucacagugucuu

SEQ ID NO: 776491 - RNA, 22 nt, Human
uccucauagacugacugcuugc

SEQ ID NO: 776492 - RNA, 23 nt, Human
aggauaaacuaaacucauuuugg

SEQ ID NO: 776493 - RNA, 22 nt, Human
agauacacagagguaaagauga

SEQ ID NO: 776494 - RNA, 22 nt, Human
acauccuugauuauguaaggau

SEQ ID NO: 776495 - RNA, 22 nt, Human
agacccucuccucauggacaug

SEQ ID NO: 776496 - RNA, 19 nt, Human
agcugggcuuacucacucg

SEQ ID NO: 776497 - RNA, 22 nt, Human
gaacuacaguaagaauugaugu

SEQ ID NO: 776498 - RNA, 18 nt, Human
caguggugcugggaugug

SEQ ID NO: 776499 - RNA, 22 nt, Human
cccaggccuggucugggccagu

SEQ ID NO: 776500 - RNA, 22 nt, Human
auucuaaugcccuggccccagc

SEQ ID NO: 776501 - RNA, 22 nt, Human
cauuuguaucauauguaucuua

SEQ ID NO: 776502 - RNA, 22 nt, Human
cccaaaggcuguacuuguaacc

SEQ ID NO: 776503 - RNA, 22 nt, Human
aauaugcauguauacaugugua

SEQ ID NO: 776504 - RNA, 22 nt, Human
ugugugcuuauagucuaguagu

SEQ ID NO: 776505 - RNA, 22 nt, Human
gaaaaggccuccccauaggaau

SEQ ID NO: 776506 - RNA, 20 nt, Human
ugagaaggggucagcuguac

SEQ ID NO: 776507 - RNA, 20 nt, Human
ucacacaugguaagcuauga

SEQ ID NO: 776508 - RNA, 22 nt, Human
gcccuuucuucuucuggacugg

SEQ ID NO: 776509 - RNA, 22 nt, Human
aauagcugggaggcacauucau

SEQ ID NO: 776510 - RNA, 22 nt, Human
ucauuuuugaccauggguagga

SEQ ID NO: 776511 - RNA, 20 nt, Human
gaggcucugggcauggcgcc

SEQ ID NO: 776512 - RNA, 22 nt, Human
cugugcaguaggucagggcugg

SEQ ID NO: 776513 - RNA, 22 nt, Human
aagacucaaggaacaacacagu

SEQ ID NO: 776514 - RNA, 22 nt, Human
cugacucuccucaagcauaaau

SEQ ID NO: 776515 - RNA, 22 nt, Human
cagugcagaggugcaagcaugu

SEQ ID NO: 776516 - RNA, 22 nt, Human
gugcugccggcauagcagugaa

SEQ ID NO: 776517 - RNA, 22 nt, Human
uuauugcuauggugagagggau

SEQ ID NO: 776518 - RNA, 22 nt, Human
uucuaguccuagaaacuacaug

SEQ ID NO: 776519 - RNA, 22 nt, Human
gcacuugagccaaugcuaguag

SEQ ID NO: 776520 - RNA, 22 nt, Human
ccuggccagaggcgugccugug

SEQ ID NO: 776521 - RNA, 22 nt, Human
gaggggcuggguagggcaaccc

SEQ ID NO: 776522 - RNA, 22 nt, Human
uuuugcuuaucugagugcagcc

SEQ ID NO: 776523 - RNA, 20 nt, Human
agaggccaguuaggagucua

SEQ ID NO: 776524 - RNA, 22 nt, Human
uguucuuaacuuuuguguauau

SEQ ID NO: 776525 - RNA, 22 nt, Human
cccagagcuccgguccugccca

SEQ ID NO: 776526 - RNA, 22 nt, Human
ggcucagguuuaaagugcuuua

SEQ ID NO: 776527 - RNA, 22 nt, Human
gggugcgguccccacagcccgu

SEQ ID NO: 776528 - RNA, 22 nt, Human
uccugaggcuaaagugcagugg

SEQ ID NO: 776529 - RNA, 22 nt, Human
cugaggcuuguccucucagcuu

SEQ ID NO: 776530 - RNA, 22 nt, Human
uuacaguuagguguguaguggu

SEQ ID NO: 776531 - RNA, 22 nt, Human
ugucuuuuaguuugugagaucu

SEQ ID NO: 776532 - RNA, 22 nt, Human
ucaaagucuaucuguaauuacu

SEQ ID NO: 776533 - RNA, 20 nt, Human
ggcauggguggggcucccag

SEQ ID NO: 776534 - RNA, 22 nt, Human
auuagaagcgugaauccuuuca

SEQ ID NO: 776535 - RNA, 22 nt, Human
uucugugcucaaaacuuuccaa

SEQ ID NO: 776536 - RNA, 22 nt, Human
aaagcuauuugugaguuauaga

SEQ ID NO: 776537 - RNA, 22 nt, Human
augggcaguguauuggaaggaa

SEQ ID NO: 776538 - RNA, 22 nt, Human
aacuuguaaugaaaggcaauag

SEQ ID NO: 776539 - RNA, 22 nt, Human
auuuauguaucuguguagauca

SEQ ID NO: 776540 - RNA, 18 nt, Human
uggagcugagggcaaugc

SEQ ID NO: 776541 - RNA, 22 nt, Human
uucuccagcucaucagggaggg

SEQ ID NO: 776542 - RNA, 22 nt, Human
cacaugcaggagccaauguaca

SEQ ID NO: 776543 - RNA, 22 nt, Human
agagcuuuucuguaauaacauc

SEQ ID NO: 776544 - RNA, 22 nt, Human
ugaggaguuuuucuagagcuaa

SEQ ID NO: 776545 - RNA, 22 nt, Human
cccuuuccugaagaauauuuuu

SEQ ID NO: 776546 - RNA, 22 nt, Human
aggcagggugaugauaaugauu

SEQ ID NO: 776547 - RNA, 21 nt, Human
acugugggguucaacuggcag

SEQ ID NO: 776548 - RNA, 22 nt, Human
ggcuggaacuucuucuggcauu

SEQ ID NO: 776549 - RNA, 21 nt, Human
gcagccagccgagaccaugcc

SEQ ID NO: 776550 - RNA, 22 nt, Human
ccaugggcacuggguggaggua

SEQ ID NO: 776551 - RNA, 22 nt, Human
cagagggucaccaggaagugca

SEQ ID NO: 776552 - RNA, 22 nt, Human
acagccuuggguucucuggggg

SEQ ID NO: 776553 - RNA, 22 nt, Human
aagauccaugggaauguuuggc

SEQ ID NO: 776554 - RNA, 22 nt, Human
uucauucauuacgugccaggca

SEQ ID NO: 776555 - RNA, 22 nt, Human
cacagaaguuucauagucucga

SEQ ID NO: 776556 - RNA, 22 nt, Human
uaaaugaguaauauagcuguuu

SEQ ID NO: 776557 - RNA, 22 nt, Human
gaggcugcuguuagcccugggc

SEQ ID NO: 776558 - RNA, 22 nt, Human
aucucuccuuaugaagcauuau

SEQ ID NO: 776559 - RNA, 19 nt, Human
agaauuguuuugagacccc

SEQ ID NO: 776560 - RNA, 22 nt, Human
auuucucaguaggugcacagug

SEQ ID NO: 776561 - RNA, 22 nt, Human
uuggugacuccccaccaugaug

SEQ ID NO: 776562 - RNA, 22 nt, Human
ugcagggagcucuggggugcag

SEQ ID NO: 776563 - RNA, 22 nt, Human
uauggguagagauggggguuag

SEQ ID NO: 776564 - RNA, 22 nt, Human
uggcaagcuggguuggguagcc

SEQ ID NO: 776565 - RNA, 22 nt, Human
ggucuggauaauuccaguaccu

SEQ ID NO: 776566 - RNA, 22 nt, Human
uaaacuguagcucucguaauuc

SEQ ID NO: 776567 - RNA, 22 nt, Human
cucuuagaaacuauagagauua

SEQ ID NO: 776568 - RNA, 22 nt, Human
ccagcagcugcuaugugguuuu

SEQ ID NO: 776569 - RNA, 22 nt, Human
gacugagaaucauagaaggcaa

SEQ ID NO: 776570 - RNA, 22 nt, Human
ccugauucugccacuacuagcc

SEQ ID NO: 776571 - RNA, 22 nt, Human
ggguucccugccuggccacucu

SEQ ID NO: 776572 - RNA, 22 nt, Human
uggagcuugggacucuugguag

SEQ ID NO: 776573 - RNA, 22 nt, Human
cagucuggcucagcacaaaggg

SEQ ID NO: 776574 - RNA, 22 nt, Human
uaucacaauuccuauaguuugu

SEQ ID NO: 776575 - RNA, 22 nt, Human
cagagcuuaaaacuccauggaa

SEQ ID NO: 776576 - RNA, 22 nt, Human
cugagaguagcuggagaacauu

SEQ ID NO: 776577 - RNA, 22 nt, Human
augcaugcacacacugcauugc

SEQ ID NO: 776578 - RNA, 22 nt, Human
ucccucugggcuccagcacgga

SEQ ID NO: 776579 - RNA, 22 nt, Human
gcugggccccuugaaaggcguc

SEQ ID NO: 776580 - RNA, 22 nt, Human
gcugggcuucaccuccagaguu

SEQ ID NO: 776581 - RNA, 22 nt, Human
agcaucuaaacuaucaguuuga

SEQ ID NO: 776582 - RNA, 22 nt, Human
ugaggcagggaguuuaauuguc

SEQ ID NO: 776583 - RNA, 22 nt, Human
gacagugcauuuccuggcaugg

SEQ ID NO: 776584 - RNA, 22 nt, Human
agacuaaaagaaggaagcuacc

SEQ ID NO: 776585 - RNA, 22 nt, Human
ucucugugaagcucccguuagg

SEQ ID NO: 776586 - RNA, 22 nt, Human
caggaaauaaaugguaaugcau

SEQ ID NO: 776587 - RNA, 22 nt, Human
cuccuucccuucaaguguuccu

SEQ ID NO: 776588 - RNA, 22 nt, Human
uuugcagagugcagaagcaucu

SEQ ID NO: 776589 - RNA, 22 nt, Human
uacuccugcugauccugccagc

SEQ ID NO: 776590 - RNA, 22 nt, Human
guuuacaugcaugcaagaauga

SEQ ID NO: 776591 - RNA, 22 nt, Human
aaagugcauucgaaaguccauc

SEQ ID NO: 776592 - RNA, 22 nt, Human
aguuaacuaaauuaagagacaa

SEQ ID NO: 776593 - RNA, 22 nt, Human
uguuaacauacugcuuucuaau

SEQ ID NO: 776594 - RNA, 22 nt, Human
cuucuggggauggagcccagaa

SEQ ID NO: 776595 - RNA, 22 nt, Human
aaacaaacauagguuugaaagu

SEQ ID NO: 776596 - RNA, 22 nt, Human
cugagaaggaagccuccacucu

SEQ ID NO: 776597 - RNA, 23 nt, Human
aggcuccacaugggcacuuugca

SEQ ID NO: 776598 - RNA, 22 nt, Human
agugaaauagcauuuaugaagc

SEQ ID NO: 776599 - RNA, 22 nt, Human
ggacacaggcagcugggugggu

SEQ ID NO: 776600 - RNA, 22 nt, Human
aaggcaauauugaguuucccuu

SEQ ID NO: 776601 - RNA, 22 nt, Human
gaggcauggccugaggcuagga

SEQ ID NO: 776602 - RNA, 22 nt, Human
cucuugcagauaccuugaagga

SEQ ID NO: 776603 - RNA, 21 nt, Human
auuuucauuaauucagugugg

SEQ ID NO: 776604 - RNA, 22 nt, Human
uguuuuuacugugauccagaaa

SEQ ID NO: 776605 - RNA, 22 nt, Human
gccagccccagacauccuaucg

SEQ ID NO: 776606 - RNA, 22 nt, Human
gcuuucaaauccuaauuccaac

SEQ ID NO: 776607 - RNA, 22 nt, Human
auccuuuaguccuacaacucga

SEQ ID NO: 776608 - RNA, 22 nt, Human
ucagguggcuucggggaguggc

SEQ ID NO: 776609 - RNA, 22 nt, Human
agaggcugucccuugcuauucc

SEQ ID NO: 776610 - RNA, 22 nt, Human
gcauguguuauuucucuguggg

SEQ ID NO: 776611 - RNA, 22 nt, Human
guggggaggcauucuucucccu

SEQ ID NO: 776612 - RNA, 22 nt, Human
uggcucuggcgugaagcccaga

SEQ ID NO: 776613 - RNA, 22 nt, Human
ugugaggguuuuaagggaauga

SEQ ID NO: 776614 - RNA, 22 nt, Human
aggcacagggaugcggagccag

SEQ ID NO: 776615 - RNA, 22 nt, Human
uggagcugacucacaccagcua

SEQ ID NO: 776616 - RNA, 22 nt, Human
uacuuuuccagggcuggcugag

SEQ ID NO: 776617 - RNA, 23 nt, Human
augugcacaucuccuuguccacc

SEQ ID NO: 776618 - RNA, 22 nt, Human
gcauggcuucugccaggcaccu

SEQ ID NO: 776619 - RNA, 21 nt, Human
ggcuaggaugcugggguuucc

SEQ ID NO: 776620 - RNA, 22 nt, Human
uggaaggcugagaguccugggg

SEQ ID NO: 776621 - RNA, 22 nt, Human
gaugcaaaaguaucauuuuaau

SEQ ID NO: 776622 - RNA, 22 nt, Human
auugaauagcugcuuguuguau

SEQ ID NO: 776623 - RNA, 22 nt, Human
augaguuaguuucuugucuaga

SEQ ID NO: 776624 - RNA, 22 nt, Human
cagggacaggggagaaaagaug

SEQ ID NO: 776625 - RNA, 22 nt, Human
auuucugugcaguaaaugguga

SEQ ID NO: 776626 - RNA, 21 nt, Human
ccugucuuggacugaggcacc

SEQ ID NO: 776627 - RNA, 22 nt, Human
gcauggcagccaguacauggug

SEQ ID NO: 776628 - RNA, 22 nt, Human
caguuuccugaagagaaagaau

SEQ ID NO: 776629 - RNA, 22 nt, Human
uuucagaaauuauauuagaugc

SEQ ID NO: 776630 - RNA, 22 nt, Human
caagagugaaacucugucucaa

SEQ ID NO: 776631 - RNA, 22 nt, Human
agggagcuuucagguagcuuaa

SEQ ID NO: 776632 - RNA, 22 nt, Human
gcuaccugagcaagagcuucaa

SEQ ID NO: 776633 - RNA, 17 nt, Human
agguauaaaaugguagc

SEQ ID NO: 776634 - RNA, 22 nt, Human
aaaaugagcauauugauccuuu

SEQ ID NO: 776635 - RNA, 22 nt, Human
aacaguaacgagauguccuaac

SEQ ID NO: 776636 - RNA, 22 nt, Human
auuuugcuggucugaauuacuu

SEQ ID NO: 776637 - RNA, 20 nt, Human
cucugcuuuaggagagucag

SEQ ID NO: 776638 - RNA, 21 nt, Human
agaggaagaagaguguauuau

SEQ ID NO: 776639 - RNA, 22 nt, Human
ccacaggaggauguucagacaa

SEQ ID NO: 776640 - RNA, 22 nt, Human
uucaucaccuugguagcacucc

SEQ ID NO: 776641 - RNA, 22 nt, Human
cccagggaaugacucuggccuu

SEQ ID NO: 776642 - RNA, 22 nt, Human
uuuacagagaauguacauaaag

SEQ ID NO: 776643 - RNA, 22 nt, Human
gcucugucaacagcuagcugug

SEQ ID NO: 776644 - RNA, 22 nt, Human
aggagguggcaacugucgacag

SEQ ID NO: 776645 - RNA, 22 nt, Human
uguccagugauucucaugagcc

SEQ ID NO: 776646 - RNA, 22 nt, Human
uuucacaaaugucuuuaacuug

SEQ ID NO: 776647 - RNA, 22 nt, Human
cugccaggccucaucccagcca

SEQ ID NO: 776648 - RNA, 23 nt, Human
agcacacuuguacaaugcccuag

SEQ ID NO: 776649 - RNA, 22 nt, Human
uuuggaaacugccucagcucuu

SEQ ID NO: 776650 - RNA, 22 nt, Human
uuuccuuugcccaauacauguc

SEQ ID NO: 776651 - RNA, 18 nt, Human
agccaaggaggaggagga

SEQ ID NO: 776652 - RNA, 22 nt, Human
uuauguguauaauuacaggaag

SEQ ID NO: 776653 - RNA, 22 nt, Human
accugcaggcacaggugugcgc

SEQ ID NO: 776654 - RNA, 22 nt, Human
ggggugggguuacucauugugc

SEQ ID NO: 776655 - RNA, 22 nt, Human
cuuggucauuuggggcugcuau

SEQ ID NO: 776656 - RNA, 22 nt, Human
cucuggacacuggcaugggguc

SEQ ID NO: 776657 - RNA, 22 nt, Human
auuacaacuguucccacugucu

SEQ ID NO: 776658 - RNA, 22 nt, Human
gcaaggacucccugggucauuc

SEQ ID NO: 776659 - RNA, 22 nt, Human
caguguggcuuagggaauaggc

SEQ ID NO: 776660 - RNA, 22 nt, Human
aggagggugggaagcaguuuua

SEQ ID NO: 776661 - RNA, 22 nt, Human
aagggugggcccuggcagccau

SEQ ID NO: 776662 - RNA, 22 nt, Human
cagggcagggccacacccccug

SEQ ID NO: 776663 - RNA, 22 nt, Human
aggagagcaggccagccguccc

SEQ ID NO: 776664 - RNA, 22 nt, Human
uccaggcagcccuuccugacuc

SEQ ID NO: 776665 - RNA, 22 nt, Human
cagcaggaggugaguagcaggu

SEQ ID NO: 776666 - RNA, 22 nt, Human
ugcugugacagagucucaugga

SEQ ID NO: 776667 - RNA, 22 nt, Human
ucagggagagccugucugacgu

SEQ ID NO: 776668 - RNA, 22 nt, Human
uacauuccuguuagcaucuaag

SEQ ID NO: 776669 - RNA, 20 nt, Human
gcuucaguuuccucacuggu

SEQ ID NO: 776670 - RNA, 22 nt, Human
uuaauagauaugccucuagagu

SEQ ID NO: 776671 - RNA, 22 nt, Human
uccaggagacacaagguacaua

SEQ ID NO: 776672 - RNA, 22 nt, Human
ucaguauaauugcuggcacuga

SEQ ID NO: 776673 - RNA, 19 nt, Human
caucacauggucugaugaa

SEQ ID NO: 776674 - RNA, 22 nt, Human
gacagguggguucucguaucug

SEQ ID NO: 776675 - RNA, 22 nt, Human
ugucagagcaaugagguucagc

SEQ ID NO: 776676 - RNA, 22 nt, Human
augauugcagcccuacagcugu

SEQ ID NO: 776677 - RNA, 22 nt, Human
acagcacuuggguuuuccuguu

SEQ ID NO: 776678 - RNA, 22 nt, Human
ccuuuucuauccuucuagguuc

SEQ ID NO: 776679 - RNA, 22 nt, Human
agacaggaugcauacucuuggu

SEQ ID NO: 776680 - RNA, 22 nt, Human
cugauacaaugucugcuuuaua

SEQ ID NO: 776681 - RNA, 22 nt, Human
uauucccagccucuuucuaucu

SEQ ID NO: 776682 - RNA, 23 nt, Human
acaaaguaauuccugcuuccaaa

SEQ ID NO: 776683 - RNA, 22 nt, Human
ccaggguuuaaauucugacuau

SEQ ID NO: 776684 - RNA, 22 nt, Human
agcccuggggugcagaaccaug

SEQ ID NO: 776685 - RNA, 22 nt, Human
acaugcauacaagcacauguag

SEQ ID NO: 776686 - RNA, 22 nt, Human
agcacauucugccuugcuuugc

SEQ ID NO: 776687 - RNA, 22 nt, Human
guuuuguuuugagucaacucca

SEQ ID NO: 776688 - RNA, 22 nt, Human
aauggaacuuguaauuaugucc

SEQ ID NO: 776689 - RNA, 23 nt, Human
uugauucuccaguaugggcugag

SEQ ID NO: 776690 - RNA, 22 nt, Human
uauuauuaaauggcagaauuuu

SEQ ID NO: 776691 - RNA, 22 nt, Human
agauggcucuuugaaggggaau

SEQ ID NO: 776692 - RNA, 22 nt, Human
aguagcagaaggucuugaaggg

SEQ ID NO: 776693 - RNA, 22 nt, Human
ucuucuguauuguuaacucagg

SEQ ID NO: 776694 - RNA, 19 nt, Human
ucacucucccugucugucc

SEQ ID NO: 776695 - RNA, 22 nt, Human
uuauuccaguaaucucuguaau

SEQ ID NO: 776696 - RNA, 22 nt, Human
auguuagaaggaauguuaaaag

SEQ ID NO: 776697 - RNA, 22 nt, Human
cugccccaggccuccuuuucuu

SEQ ID NO: 776698 - RNA, 15 nt, Human
aaucagaaguguggc

SEQ ID NO: 776699 - RNA, 22 nt, Human
acagaugaugugcacagauaga

SEQ ID NO: 776700 - RNA, 22 nt, Human
caggauauuuacguucugcuac

SEQ ID NO: 776701 - RNA, 21 nt, Human
auggccacuauggugcagcag

SEQ ID NO: 776702 - RNA, 18 nt, Human
gcugaaauucuaaacaaa

SEQ ID NO: 776703 - RNA, 22 nt, Human
cuaacauuuauugagcacuuag

SEQ ID NO: 776704 - RNA, 22 nt, Human
guguguggaaugcucauuuauu

SEQ ID NO: 776705 - RNA, 22 nt, Human
ggaggagacaguaaaaagcacg

SEQ ID NO: 776706 - RNA, 22 nt, Human
uucuugaaggggauauaaauag

SEQ ID NO: 776707 - RNA, 22 nt, Human
agucacuuccagacaccugccu

SEQ ID NO: 776708 - RNA, 22 nt, Human
uggcacagacagcacagcaaug

SEQ ID NO: 776709 - RNA, 22 nt, Human
cccugcaguccuuucuuggcuc

SEQ ID NO: 776710 - RNA, 22 nt, Human
acacaguugguggcucagucug

SEQ ID NO: 776711 - RNA, 22 nt, Human
gggucagagcaagacugggguc

SEQ ID NO: 776712 - RNA, 22 nt, Human
ugugaauggacaauuaaaucua

SEQ ID NO: 776713 - RNA, 22 nt, Human
ucuggcucacuucaggcuucac

SEQ ID NO: 776714 - RNA, 22 nt, Human
agaggacacaucuuuccucaaa

SEQ ID NO: 776715 - RNA, 20 nt, Human
ucauaaagaggaaauaaaua

SEQ ID NO: 776716 - RNA, 20 nt, Human
cugcaggguuagaggcucca

SEQ ID NO: 776717 - RNA, 22 nt, Human
ggcucugccacuucuuggcugu

SEQ ID NO: 776718 - RNA, 22 nt, Human
auccugugcaaugacugcaucu

SEQ ID NO: 776719 - RNA, 22 nt, Human
cucugugguuagacuauggcug

SEQ ID NO: 776720 - RNA, 22 nt, Human
aggcugugaaauguggcaagga

SEQ ID NO: 776721 - RNA, 22 nt, Human
ucccucgaagagcuuauucuuu

SEQ ID NO: 776722 - RNA, 20 nt, Human
uggggucuaguuggccuggg

SEQ ID NO: 776723 - RNA, 22 nt, Human
aagugcuuuacaaaugucuguu

SEQ ID NO: 776724 - RNA, 22 nt, Human
cugggcucagaaccuuguuaag

SEQ ID NO: 776725 - RNA, 22 nt, Human
agagagcccgggccagggcaca

SEQ ID NO: 776726 - RNA, 22 nt, Human
gcuggcaucacuggcuucggug

SEQ ID NO: 776727 - RNA, 22 nt, Human
aucacauauuuaagaaacaugu

SEQ ID NO: 776728 - RNA, 22 nt, Human
agaugacaaugaaggaaaaugu

SEQ ID NO: 776729 - RNA, 22 nt, Human
ugguggcacugacaucagacac

SEQ ID NO: 776730 - RNA, 23 nt, Human
gucucuagaguguggagcaaaga

SEQ ID NO: 776731 - RNA, 22 nt, Human
cauacauugaauuugcacgugu

SEQ ID NO: 776732 - RNA, 22 nt, Human
caagagcuagaaauugguuaga

SEQ ID NO: 776733 - RNA, 22 nt, Human
uucucccacuccgugcuucagu

SEQ ID NO: 776734 - RNA, 22 nt, Human
agaugauuaugauagcacuguu

SEQ ID NO: 776735 - RNA, 22 nt, Human
gugauuuugagaccuauauagu

SEQ ID NO: 776736 - RNA, 22 nt, Human
aauucacaaaaccagauugcuu

SEQ ID NO: 776737 - RNA, 22 nt, Human
aaaucugagaaauauuguccag

SEQ ID NO: 776738 - RNA, 22 nt, Human
cuuggcaguuucggaaggauga

SEQ ID NO: 776739 - RNA, 22 nt, Human
cuggaaagauuucuuuggaguc

SEQ ID NO: 776740 - RNA, 22 nt, Human
cuguuuaaccagaucucauauc

SEQ ID NO: 776741 - RNA, 22 nt, Human
ugggccugaaggagcugcgccc

SEQ ID NO: 776742 - RNA, 22 nt, Human
gagggcucugaaaggaggucac

SEQ ID NO: 776743 - RNA, 22 nt, Human
ugcaauaaguauugcuuacaug

SEQ ID NO: 776744 - RNA, 22 nt, Human
gcuggagauagaauggccacug

SEQ ID NO: 776745 - RNA, 22 nt, Human
gggccaccuggauuccaugugu

SEQ ID NO: 776746 - RNA, 22 nt, Human
gcuauucaucaauuguucuagc

SEQ ID NO: 776747 - RNA, 22 nt, Human
uaaguaaaacauucaagaaguc

SEQ ID NO: 776748 - RNA, 18 nt, Human
cccagccucuccuuucua

SEQ ID NO: 776749 - RNA, 22 nt, Human
cacauuuaauugguuuagggug

SEQ ID NO: 776750 - RNA, 22 nt, Human
cugacaaaggcaaggcaggggg

SEQ ID NO: 776751 - RNA, 22 nt, Human
aaacuguauauuuauggcaugu

SEQ ID NO: 776752 - RNA, 22 nt, Human
uccugacuccagguccugugug

SEQ ID NO: 776753 - RNA, 22 nt, Human
gagcagggccacuucuguaccu

SEQ ID NO: 776754 - RNA, 22 nt, Human
uccaggcaugucccaagccgga

SEQ ID NO: 776755 - RNA, 22 nt, Human
uggcacaguccugggugccugc

SEQ ID NO: 776756 - RNA, 22 nt, Human
aucaggauucaguaucuccagc

SEQ ID NO: 776757 - RNA, 22 nt, Human
aaauuagucauguuguauuacu

SEQ ID NO: 776758 - RNA, 19 nt, Human
ggugugugcuggggccugu

SEQ ID NO: 776759 - RNA, 22 nt, Human
gucccaggaacauucuggcuag

SEQ ID NO: 776760 - RNA, 22 nt, Human
auggggcucugcggcugcuccc

SEQ ID NO: 776761 - RNA, 22 nt, Human
ccacauuuggagaagauacuuu

SEQ ID NO: 776762 - RNA, 22 nt, Human
uuucauugucuacauaugacau

SEQ ID NO: 776763 - RNA, 22 nt, Human
ucagaggucccuagcaggagug

SEQ ID NO: 776764 - RNA, 22 nt, Human
ccugcugucagcauccucgcga

SEQ ID NO: 776765 - RNA, 22 nt, Human
uugcagcuucuaccacuguuuc

SEQ ID NO: 776766 - RNA, 22 nt, Human
aaagauugaaagagaauuuguc

SEQ ID NO: 776767 - RNA, 22 nt, Human
uaaccugcaacagaucugucuu

SEQ ID NO: 776768 - RNA, 22 nt, Human
aguguacaagaccuuauuguug

SEQ ID NO: 776769 - RNA, 22 nt, Human
ucaucuccauacggucucgcag

SEQ ID NO: 776770 - RNA, 22 nt, Human
uuuaagacucuuguaguacaca

SEQ ID NO: 776771 - RNA, 22 nt, Human
ccaggugguucaggucaccaua

SEQ ID NO: 776772 - RNA, 22 nt, Human
gcuguucccauguggggcucag

SEQ ID NO: 776773 - RNA, 22 nt, Human
aauguguagggugccuguuuuu

SEQ ID NO: 776774 - RNA, 22 nt, Human
aaauugcuggauccuacuccca

SEQ ID NO: 776775 - RNA, 22 nt, Human
gcccucuggugggugagccccg

SEQ ID NO: 776776 - RNA, 22 nt, Human
cuggguggaaagugcugagaau

SEQ ID NO: 776777 - RNA, 22 nt, Human
auucacaaagaagggaaguaca

SEQ ID NO: 776778 - RNA, 22 nt, Human
aaugggaagccagaagacaagg

SEQ ID NO: 776779 - RNA, 22 nt, Human
ugcccaggguggagugcagcgg

SEQ ID NO: 776780 - RNA, 22 nt, Human
gggcagccgcgugaccugccag

SEQ ID NO: 776781 - RNA, 21 nt, Human
agcagccuugugugccaggca

SEQ ID NO: 776782 - RNA, 22 nt, Human
gccaguguuuauagcagugagg

SEQ ID NO: 776783 - RNA, 20 nt, Human
ucugggagggacaagucucc

SEQ ID NO: 776784 - RNA, 22 nt, Human
ucaguguguaauucuuuguuuc

SEQ ID NO: 776785 - RNA, 22 nt, Human
caaaaguaauuaugguuuuugc

SEQ ID NO: 776786 - RNA, 22 nt, Human
ccuggugccacuagagaauguc

SEQ ID NO: 776787 - RNA, 22 nt, Human
aagggcaggcacccacccucac

SEQ ID NO: 776788 - RNA, 22 nt, Human
uagcuguuucagugcagcagaa

SEQ ID NO: 776789 - RNA, 22 nt, Human
agggggcugccaaggaauguaa

SEQ ID NO: 776790 - RNA, 22 nt, Human
ccugucaggguuugccucagaa

SEQ ID NO: 776791 - RNA, 22 nt, Human
gccucugcacuguggcacacca

SEQ ID NO: 776792 - RNA, 22 nt, Human
guggcagagugcgguucugacc

SEQ ID NO: 776793 - RNA, 22 nt, Human
ugaggugguuacuguggugcuc

SEQ ID NO: 776794 - RNA, 22 nt, Human
cugcucacgccaccguucauca

SEQ ID NO: 776795 - RNA, 22 nt, Human
ucagcagaaguauagaggccau

SEQ ID NO: 776796 - RNA, 22 nt, Human
auggaaauaucuuuagagcuua

SEQ ID NO: 776797 - RNA, 22 nt, Human
auaaauuaggaucugggguucc

SEQ ID NO: 776798 - RNA, 22 nt, Human
auggcuccagcugguagagauu

SEQ ID NO: 776799 - RNA, 22 nt, Human
augauaacaacagcagugcugg

SEQ ID NO: 776800 - RNA, 22 nt, Human
caggcucccugcaggccaguga

SEQ ID NO: 776801 - RNA, 22 nt, Human
uggcucauucuacucucccugg

SEQ ID NO: 776802 - RNA, 23 nt, Human
cuggcucauccugguugcagugg

SEQ ID NO: 776803 - RNA, 22 nt, Human
aaugcuauucauuaagccuacu

SEQ ID NO: 776804 - RNA, 22 nt, Human
gugggcuucuguuagggaggcu

SEQ ID NO: 776805 - RNA, 22 nt, Human
agcagaaaacuuucaugcucug

SEQ ID NO: 776806 - RNA, 22 nt, Human
uuacaguaaucgaguguugugg

SEQ ID NO: 776807 - RNA, 22 nt, Human
uuggaagggaacaccauuugac

SEQ ID NO: 776808 - RNA, 22 nt, Human
gaggacaggagacucacuguuu

SEQ ID NO: 776809 - RNA, 22 nt, Human
uucuggaaauggguauagagca

SEQ ID NO: 776810 - RNA, 21 nt, Human
cacaggugggucagugaggcc

SEQ ID NO: 776811 - RNA, 22 nt, Human
caugaggugauaaagcugggau

SEQ ID NO: 776812 - RNA, 22 nt, Human
auauuuuggcaaaugucuagau

SEQ ID NO: 776813 - RNA, 23 nt, Human
uaaugagaagcuuuguuuccuga

SEQ ID NO: 776814 - RNA, 22 nt, Human
auggcugugcagagauugggaa

SEQ ID NO: 776815 - RNA, 22 nt, Human
gggagcugagcuggaagagaau

SEQ ID NO: 776816 - RNA, 22 nt, Human
cacagugcaaucggccacaaau

SEQ ID NO: 776817 - RNA, 22 nt, Human
guguuuccucacuucucugacu

SEQ ID NO: 776818 - RNA, 22 nt, Human
gucuggccauuugcccauugug

SEQ ID NO: 776819 - RNA, 22 nt, Human
gccuuuaucaguuucauggcuu

SEQ ID NO: 776820 - RNA, 22 nt, Human
agucauuacggacuaguacuac

SEQ ID NO: 776821 - RNA, 22 nt, Human
acagccuucucuucacuguguc

SEQ ID NO: 776822 - RNA, 22 nt, Human
aggcacugggaauaugcugagg

SEQ ID NO: 776823 - RNA, 22 nt, Human
acauuucauguuuuccagagca

SEQ ID NO: 776824 - RNA, 22 nt, Human
aaagcugggcuggccaacccag

SEQ ID NO: 776825 - RNA, 22 nt, Human
aggugcuggagucugggcagga

SEQ ID NO: 776826 - RNA, 22 nt, Human
cagccagagaaagggcacugcc

SEQ ID NO: 776827 - RNA, 22 nt, Human
gucuucuaaguaucaaagcaga

SEQ ID NO: 776828 - RNA, 22 nt, Human
guucucuggagucccugggccc

SEQ ID NO: 776829 - RNA, 22 nt, Human
gcacugccaucaaugcaugaca

SEQ ID NO: 776830 - RNA, 22 nt, Human
ggccagcagucacagggucaga

SEQ ID NO: 776831 - RNA, 18 nt, Human
uuuccuuguaugaacaua

SEQ ID NO: 776832 - RNA, 22 nt, Human
cuuguuuaagccgcuguuaagc

SEQ ID NO: 776833 - RNA, 22 nt, Human
gggauauguuuagguguuggag

SEQ ID NO: 776834 - RNA, 22 nt, Human
ggguuaaacaugcuauaugagu

SEQ ID NO: 776835 - RNA, 22 nt, Human
uggcucagccagcccuaggaac

SEQ ID NO: 776836 - RNA, 22 nt, Human
ccucagggaggccucuguggcu

SEQ ID NO: 776837 - RNA, 22 nt, Human
ggcagcuccuccuagucugccc

SEQ ID NO: 776838 - RNA, 22 nt, Human
caggaggcccaaagggcgcaga

SEQ ID NO: 776839 - RNA, 22 nt, Human
cauuugcagagggugacacucu

SEQ ID NO: 776840 - RNA, 22 nt, Human
cugggaagccacaggguguggg

SEQ ID NO: 776841 - RNA, 22 nt, Human
aagauuguuuugggggaagugg

SEQ ID NO: 776842 - RNA, 22 nt, Human
cuggucaggcugaacugccaca

SEQ ID NO: 776843 - RNA, 22 nt, Human
ggcugcucggagccuccuguga

SEQ ID NO: 776844 - RNA, 22 nt, Human
aauguauaauauuuaaugcuuu

SEQ ID NO: 776845 - RNA, 22 nt, Human
ucugggcuuuguaaugggaggu

SEQ ID NO: 776846 - RNA, 22 nt, Human
cuggcuccauccuaggcaaaug

SEQ ID NO: 776847 - RNA, 22 nt, Human
agcugccucagcaacacagacc

SEQ ID NO: 776848 - RNA, 22 nt, Human
ggaacacagaagggcugaaaaa

SEQ ID NO: 776849 - RNA, 22 nt, Human
augucugucuuuguacuccaca

SEQ ID NO: 776850 - RNA, 22 nt, Human
cuccugacuugugagccccucc

SEQ ID NO: 776851 - RNA, 22 nt, Human
ggcucagaggagcuggaacggu

SEQ ID NO: 776852 - RNA, 22 nt, Human
aaagacugggacugcagcaggc

SEQ ID NO: 776853 - RNA, 22 nt, Human
cccugcuuugcacccaggcugg

SEQ ID NO: 776854 - RNA, 22 nt, Human
cucugccaguuucuggccucag

SEQ ID NO: 776855 - RNA, 22 nt, Human
uguaauugcuuguuuaccugcu

SEQ ID NO: 776856 - RNA, 22 nt, Human
ggacaggauaagagacacugcc

SEQ ID NO: 776857 - RNA, 22 nt, Human
cccuggaggaagaaacaauggc

SEQ ID NO: 776858 - RNA, 22 nt, Human
gggccagugagucgggagagcu

SEQ ID NO: 776859 - RNA, 22 nt, Human
aacacagacauagugauuacag

SEQ ID NO: 776860 - RNA, 22 nt, Human
cuccagcuucccucagcugugg

SEQ ID NO: 776861 - RNA, 22 nt, Human
auugcaagugcuagcuaaaaua

SEQ ID NO: 776862 - RNA, 18 nt, Human
agggaucaucacugcagc

SEQ ID NO: 776863 - RNA, 22 nt, Human
ccacuugugaaauaaucaaaua

SEQ ID NO: 776864 - RNA, 22 nt, Human
ucaaagaagauuacccucccau

SEQ ID NO: 776865 - RNA, 23 nt, Human
ugagacccuaauuuagcaagugu

SEQ ID NO: 776866 - RNA, 22 nt, Human
cuucucagcauuuugucagucu

SEQ ID NO: 776867 - RNA, 21 nt, Human
gcaaggcuuuuguguuuccca

SEQ ID NO: 776868 - RNA, 22 nt, Human
uauuauuauauuggaugagacu

SEQ ID NO: 776869 - RNA, 22 nt, Human
ggcugccugcucaggugcggcg

SEQ ID NO: 776870 - RNA, 17 nt, Human
ugccugccagcauugga

SEQ ID NO: 776871 - RNA, 22 nt, Human
acagccaggaauucuggagaag

SEQ ID NO: 776872 - RNA, 22 nt, Human
cuacugucucaucaguguuauu

SEQ ID NO: 776873 - RNA, 21 nt, Human
ugcauucuagcagcucugagg

SEQ ID NO: 776874 - RNA, 22 nt, Human
ugaaggugaccugacaguggcu

SEQ ID NO: 776875 - RNA, 22 nt, Human
uccuugggucagugagugaggu

SEQ ID NO: 776876 - RNA, 22 nt, Human
ccucuucuaggacguccuugug

SEQ ID NO: 776877 - RNA, 22 nt, Human
ucaaagucacaacucucuaauu

SEQ ID NO: 776878 - RNA, 22 nt, Human
cuuuaauucucaggugcacaua

SEQ ID NO: 776879 - RNA, 22 nt, Human
gcagcccaggucucucucacuc

SEQ ID NO: 776880 - RNA, 22 nt, Human
ugauggaagugacugucaguuc

SEQ ID NO: 776881 - RNA, 22 nt, Human
gugugagggacagagaaagggg

SEQ ID NO: 776882 - RNA, 22 nt, Human
caggccugauacacugaacucu

SEQ ID NO: 776883 - RNA, 22 nt, Human
cauuuguuuagaagucuuuaua

SEQ ID NO: 776884 - RNA, 19 nt, Human
aguuuauuauaggugauuc

SEQ ID NO: 776885 - RNA, 22 nt, Human
ggcccaguguugccagaccuga

SEQ ID NO: 776886 - RNA, 22 nt, Human
cuucugaccccuggucuacagc

SEQ ID NO: 776887 - RNA, 23 nt, Human
uuucuucucgaagagggagcuua

SEQ ID NO: 776888 - RNA, 22 nt, Human
gacuguggcagaaauguuguug

SEQ ID NO: 776889 - RNA, 22 nt, Human
caggcugauuaggccucgucca

SEQ ID NO: 776890 - RNA, 22 nt, Human
ugucagcaugucagccaaagau

SEQ ID NO: 776891 - RNA, 22 nt, Human
cagcaccauuuuccuggucagc

SEQ ID NO: 776892 - RNA, 19 nt, Human
aaaugugaugguacaauuc

SEQ ID NO: 776893 - RNA, 22 nt, Human
agggaccucauguaaguggauu

SEQ ID NO: 776894 - RNA, 22 nt, Human
cucugggcacauuuuccaggac

SEQ ID NO: 776895 - RNA, 22 nt, Human
gcuuccuagcauuagccauugc

SEQ ID NO: 776896 - RNA, 22 nt, Human
aaaauguaaagcuugaguguag

SEQ ID NO: 776897 - RNA, 22 nt, Human
uuuguuuagaugguaaaucagu

SEQ ID NO: 776898 - RNA, 22 nt, Human
ucauguuugagacuaauuuuuc

SEQ ID NO: 776899 - RNA, 22 nt, Human
uugcuaauagaagauuugggaa

SEQ ID NO: 776900 - RNA, 22 nt, Human
uggucaguugugacuagaacac

SEQ ID NO: 776901 - RNA, 22 nt, Human
gucccugguuugcccaggacca

SEQ ID NO: 776902 - RNA, 20 nt, Human
agcaguaggaccucugggcc

SEQ ID NO: 776903 - RNA, 22 nt, Human
aaacaguauuaucaauauauuu

SEQ ID NO: 776904 - RNA, 22 nt, Human
uuuguuuucaaugugucauuca

SEQ ID NO: 776905 - RNA, 22 nt, Human
gaucggguggguucugccauca

SEQ ID NO: 776906 - RNA, 22 nt, Human
aggcccuuggacucaugcucga

SEQ ID NO: 776907 - RNA, 22 nt, Human
uguacuuauuuuaugucagcac

SEQ ID NO: 776908 - RNA, 22 nt, Human
gaugucuuggcuugcucucugu

SEQ ID NO: 776909 - RNA, 22 nt, Human
uucggcuuuccaguuugucucg

SEQ ID NO: 776910 - RNA, 22 nt, Human
caggagugagaugcgaucacuu

SEQ ID NO: 776911 - RNA, 22 nt, Human
agcugcucgaagccgguggccc

SEQ ID NO: 776912 - RNA, 22 nt, Human
uuuuuauaugaaggauagugcg

SEQ ID NO: 776913 - RNA, 22 nt, Human
agcuggagaguuuccaggaagg

SEQ ID NO: 776914 - RNA, 22 nt, Human
aaauggcugacuuuucauggga

SEQ ID NO: 776915 - RNA, 20 nt, Human
cuguccauauuugaaaaugc

SEQ ID NO: 776916 - RNA, 22 nt, Human
gaaacuuucaugaauauaagau

SEQ ID NO: 776917 - RNA, 19 nt, Human
cucuuggguggcagaggcc

SEQ ID NO: 776918 - RNA, 22 nt, Human
augcaaaaguaacugugauuuu

SEQ ID NO: 776919 - RNA, 22 nt, Human
agcugggcuccaagagggaucu

SEQ ID NO: 776920 - RNA, 22 nt, Human
aagagagagugcgcucacagaa

SEQ ID NO: 776921 - RNA, 22 nt, Human
ugcccagccuaaacuuggcaag

SEQ ID NO: 776922 - RNA, 22 nt, Human
uuccaggacuucauggcucuga

SEQ ID NO: 776923 - RNA, 22 nt, Human
ugcagagagauauggcaagagg

SEQ ID NO: 776924 - RNA, 22 nt, Human
ggcugccacccucggacuuccg

SEQ ID NO: 776925 - RNA, 22 nt, Human
ugcaggcugugucauuuaguga

SEQ ID NO: 776926 - RNA, 22 nt, Human
ccucuugauugguuggaagcgg

SEQ ID NO: 776927 - RNA, 22 nt, Human
cugcaaaucaaguucuuauaau

SEQ ID NO: 776928 - RNA, 22 nt, Human
ggaagaagggucauuggcagcc

SEQ ID NO: 776929 - RNA, 22 nt, Human
gcuguggguuccuggcauuuga

SEQ ID NO: 776930 - RNA, 22 nt, Human
agcaaggcagucagcuggcugg

SEQ ID NO: 776931 - RNA, 22 nt, Human
uugucugaauucuucuaggcag

SEQ ID NO: 776932 - RNA, 22 nt, Human
agcaggcaggcccagcggcugg

SEQ ID NO: 776933 - RNA, 22 nt, Human
caugaagcuugaagcaguccac

SEQ ID NO: 776934 - RNA, 22 nt, Human
ucacuguguccuuucugcguag

SEQ ID NO: 776935 - RNA, 20 nt, Human
ccugggguacacuggcaugu

SEQ ID NO: 776936 - RNA, 22 nt, Human
uaccucucuaaacccagggaca

SEQ ID NO: 776937 - RNA, 22 nt, Human
uggguucagaucccagcucugu

SEQ ID NO: 776938 - RNA, 22 nt, Human
ugcccuugaggacagcucccag

SEQ ID NO: 776939 - RNA, 22 nt, Human
guguuuuaagaaagaagcucag

SEQ ID NO: 776940 - RNA, 22 nt, Human
ugucacagucucgugagcaucu

SEQ ID NO: 776941 - RNA, 22 nt, Human
uguuccauaaguggugcuuugu

SEQ ID NO: 776942 - RNA, 22 nt, Human
accaggcaugauguggagcaca

SEQ ID NO: 776943 - RNA, 22 nt, Human
gcuuuagauacucccaaugucc

SEQ ID NO: 776944 - RNA, 22 nt, Human
ugucacauccauuuugcaagua

SEQ ID NO: 776945 - RNA, 22 nt, Human
ugcugggcuucacccccacagu

SEQ ID NO: 776946 - RNA, 20 nt, Human
aauuccagcaugauauuuau

SEQ ID NO: 776947 - RNA, 22 nt, Human
gauaaagggggaccaaaugacu

SEQ ID NO: 776948 - RNA, 22 nt, Human
aguguacaguucuaugaauuuc

SEQ ID NO: 776949 - RNA, 22 nt, Human
auaauccaugucuagaguaaag

SEQ ID NO: 776950 - RNA, 21 nt, Human
gacaaagugaagcaggcagga

SEQ ID NO: 776951 - RNA, 22 nt, Human
acucaggaagaaagcagcuggu

SEQ ID NO: 776952 - RNA, 22 nt, Human
aaacuguagugcuucgaucuga

SEQ ID NO: 776953 - RNA, 22 nt, Human
gugcuucuuucuccucaagccu

SEQ ID NO: 776954 - RNA, 22 nt, Human
uccuucagaaaaccucagucuu

SEQ ID NO: 776955 - RNA, 22 nt, Human
ggaggcaaagcacuuugcuugg

SEQ ID NO: 776956 - RNA, 22 nt, Human
aaacuaaaccuggcuuaguaag

SEQ ID NO: 776957 - RNA, 22 nt, Human
uauuuuguuaauaauccagucc

SEQ ID NO: 776958 - RNA, 22 nt, Human
caaauguaauaaggaguuuccc

SEQ ID NO: 776959 - RNA, 22 nt, Human
aggcugagucaaguuaggguga

SEQ ID NO: 776960 - RNA, 22 nt, Human
uagcuuaaaccaaucugaauaa

SEQ ID NO: 776961 - RNA, 22 nt, Human
ccauuugugguuuauuugcucu

SEQ ID NO: 776962 - RNA, 22 nt, Human
aggagagggguaggauuaauuu

SEQ ID NO: 776963 - RNA, 22 nt, Human
gcugaggccaggccccaccgga

SEQ ID NO: 776964 - RNA, 22 nt, Human
ugcuuaaacccugaucaugugu

SEQ ID NO: 776965 - RNA, 22 nt, Human
auucuucucccuuagggcccag

SEQ ID NO: 776966 - RNA, 22 nt, Human
aggagccaccuaggagcuguuu

SEQ ID NO: 776967 - RNA, 22 nt, Human
ucuggcaguuccuuguugauau

SEQ ID NO: 776968 - RNA, 22 nt, Human
cagagacaaugucucugcuugu

SEQ ID NO: 776969 - RNA, 22 nt, Human
aacuuaaugauuucaugcaugu

SEQ ID NO: 776970 - RNA, 22 nt, Human
acuucagccaagaaaacucagu

SEQ ID NO: 776971 - RNA, 22 nt, Human
ugggucagaaucagagaguugc

SEQ ID NO: 776972 - RNA, 22 nt, Human
guugcucaggcaggaguacagu

SEQ ID NO: 776973 - RNA, 22 nt, Human
ccucugcccuuuuccuguauca

SEQ ID NO: 776974 - RNA, 22 nt, Human
gcagagaacccagcagauuggc

SEQ ID NO: 776975 - RNA, 22 nt, Human
uaaaggcaauucagcaagccac

SEQ ID NO: 776976 - RNA, 22 nt, Human
gggaggaggaauguuuugugua

SEQ ID NO: 776977 - RNA, 22 nt, Human
ugggauauuuugagcuuuccuc

SEQ ID NO: 776978 - RNA, 22 nt, Human
uuaaaauuuccccaccauguau

SEQ ID NO: 776979 - RNA, 22 nt, Human
ugagggcuccccgcugcugugu

SEQ ID NO: 776980 - RNA, 22 nt, Human
cuaaugaagcugcuuucuauga

SEQ ID NO: 776981 - RNA, 22 nt, Human
uggcagggccugaaucuuauac

SEQ ID NO: 776982 - RNA, 22 nt, Human
ccagagcugcagguaaaaugcu

SEQ ID NO: 776983 - RNA, 22 nt, Human
cacccagggcugugccugccca

SEQ ID NO: 776984 - RNA, 22 nt, Human
uuagaaaugucacagaucugau

SEQ ID NO: 776985 - RNA, 22 nt, Human
uuacaagauuaauuauuggagu

SEQ ID NO: 776986 - RNA, 23 nt, Human
cucaacccuaguaagggaguagg

SEQ ID NO: 776987 - RNA, 17 nt, Human
ucaaagaaugcaugcag

SEQ ID NO: 776988 - RNA, 22 nt, Human
caggccucuuccaugcagcagc

SEQ ID NO: 776989 - RNA, 22 nt, Human
cagcccaggucucucuuccagu

SEQ ID NO: 776990 - RNA, 22 nt, Human
ccaauguuuauuuuccugcugc

SEQ ID NO: 776991 - RNA, 22 nt, Human
aaugucaacacaagagaaaugc

SEQ ID NO: 776992 - RNA, 22 nt, Human
cccuggcaaaaucccugguaca

SEQ ID NO: 776993 - RNA, 22 nt, Human
cuccugggagcagggauggaug

SEQ ID NO: 776994 - RNA, 22 nt, Human
uucuuaagcaccuaaaaagugg

SEQ ID NO: 776995 - RNA, 22 nt, Human
augaauaaacaggugccucuuc

SEQ ID NO: 776996 - RNA, 22 nt, Human
augcuguguggucaaguuaauu

SEQ ID NO: 776997 - RNA, 22 nt, Human
gcacccaggcuugggcagcaac

SEQ ID NO: 776998 - RNA, 17 nt, Human
cuggucccaccaagccc

SEQ ID NO: 776999 - RNA, 22 nt, Human
ccauccauuuucuugcuugccu

SEQ ID NO: 777000 - RNA, 22 nt, Human
caguauguccuuccucguuggc

SEQ ID NO: 777001 - RNA, 22 nt, Human
caggacgggcaaacaggauggu

SEQ ID NO: 777002 - RNA, 22 nt, Human
uccuggaagaucucugugagau

SEQ ID NO: 777003 - RNA, 22 nt, Human
gcaggccuccccugcuggagcu

SEQ ID NO: 777004 - RNA, 22 nt, Human
cagcucuguguauuuuccccac

SEQ ID NO: 777005 - RNA, 22 nt, Human
uuacgaauguuagauugcaucu

SEQ ID NO: 777006 - RNA, 22 nt, Human
uaaauacagucauuugagccau

SEQ ID NO: 777007 - RNA, 22 nt, Human
caaaugcuggcccugcuacuua

SEQ ID NO: 777008 - RNA, 22 nt, Human
uauugagacuuccaguauauga

SEQ ID NO: 777009 - RNA, 22 nt, Human
uugcaucuaccauaucaaagau

SEQ ID NO: 777010 - RNA, 22 nt, Human
agcagcugcagggagggucugc

SEQ ID NO: 777011 - RNA, 22 nt, Human
acagggcugaggcuggcuucuu

SEQ ID NO: 777012 - RNA, 18 nt, Human
uccugccugugccccagg

SEQ ID NO: 777013 - RNA, 21 nt, Human
ugguggaccagugcugggaga

SEQ ID NO: 777014 - RNA, 22 nt, Human
agcugcucugauaaaccuacuu

SEQ ID NO: 777015 - RNA, 22 nt, Human
uguggccucuaagcucacgaag

SEQ ID NO: 777016 - RNA, 21 nt, Human
acaggauaggacaguguuccu

SEQ ID NO: 777017 - RNA, 22 nt, Human
uaaagcuagaaggugcuguaca

SEQ ID NO: 777018 - RNA, 22 nt, Human
aacacuguggucuuuucaguaa

SEQ ID NO: 777019 - RNA, 22 nt, Human
ugaggaggucagagucuggcug

SEQ ID NO: 777020 - RNA, 22 nt, Human
ccagggugggguccaggaacca

SEQ ID NO: 777021 - RNA, 18 nt, Human
gccuccaccauggagggu

SEQ ID NO: 777022 - RNA, 22 nt, Human
aagggcuguagacaagauugcu

SEQ ID NO: 777023 - RNA, 18 nt, Human
ucagcuuccagcauguuu

SEQ ID NO: 777024 - RNA, 22 nt, Human
gcuucuguucaaggauauaagg

SEQ ID NO: 777025 - RNA, 22 nt, Human
caauuuuuuccaugcucuuaca

SEQ ID NO: 777026 - RNA, 22 nt, Human
uggccaggccggggacagaacu

SEQ ID NO: 777027 - RNA, 22 nt, Human
ggcugcucaaggacucugaucg

SEQ ID NO: 777028 - RNA, 22 nt, Human
aaggcacugaaaaauugugugu

SEQ ID NO: 777029 - RNA, 22 nt, Human
aagugcuuaggucaaaggacau

SEQ ID NO: 777030 - RNA, 22 nt, Human
agcagggggaguuagacuagau

SEQ ID NO: 777031 - RNA, 22 nt, Human
agaccucaauaccaggcaccac

SEQ ID NO: 777032 - RNA, 22 nt, Human
ggaaggaaguaaaugaugcuau

SEQ ID NO: 777033 - RNA, 22 nt, Human
uucauauuucuuuaaggacuuu

SEQ ID NO: 777034 - RNA, 22 nt, Human
auauacacagagcuuaugguga

SEQ ID NO: 777035 - RNA, 18 nt, Human
uggggucucucagguaag

SEQ ID NO: 777036 - RNA, 22 nt, Human
augaaaugugaaugcuuuucau

SEQ ID NO: 777037 - RNA, 21 nt, Human
ugacccuucuagcagaacaca

SEQ ID NO: 777038 - RNA, 22 nt, Human
ucacagaauuuuugcuuccagu

SEQ ID NO: 777039 - RNA, 22 nt, Human
acagugacguuuauuugagacg

SEQ ID NO: 777040 - RNA, 19 nt, Human
uggggaugcugaugaccaa

SEQ ID NO: 777041 - RNA, 22 nt, Human
agaggcaaugaaagcagucucu

SEQ ID NO: 777042 - RNA, 22 nt, Human
ucuuauuuuguuagaugcugua

SEQ ID NO: 777043 - RNA, 18 nt, Human
ucauuagggauugcaaag

SEQ ID NO: 777044 - RNA, 21 nt, Human
caguguggugaccagggucuc

SEQ ID NO: 777045 - RNA, 22 nt, Human
aauuuguuaaaagugagugaca

SEQ ID NO: 777046 - RNA, 22 nt, Human
gugggguagaucuuucucagga

SEQ ID NO: 777047 - RNA, 22 nt, Human
ugaccacuguagccacuuaaga

SEQ ID NO: 777048 - RNA, 22 nt, Human
uguuuaaugcauugaccuuggg

SEQ ID NO: 777049 - RNA, 22 nt, Human
uccuggggcucuuugaugugau

SEQ ID NO: 777050 - RNA, 22 nt, Human
auugauuucugcuuacucacug

SEQ ID NO: 777051 - RNA, 22 nt, Human
ugucaccaaguugaugaaugca

SEQ ID NO: 777052 - RNA, 22 nt, Human
auuagggcuggaugcaaggaaa

SEQ ID NO: 777053 - RNA, 22 nt, Human
ugucaucuacccguuaggcuuu

SEQ ID NO: 777054 - RNA, 22 nt, Human
cuggaagguaacaaggccauua

SEQ ID NO: 777055 - RNA, 22 nt, Human
caccagcuacucggguuuccug

SEQ ID NO: 777056 - RNA, 22 nt, Human
uuaggaggucuauggacauccu

SEQ ID NO: 777057 - RNA, 22 nt, Human
caguuugucuugauucagaaca

SEQ ID NO: 777058 - RNA, 22 nt, Human
uuagcauuucaguacacauguu

SEQ ID NO: 777059 - RNA, 22 nt, Human
caauugcuuuuccaagggcaga

SEQ ID NO: 777060 - RNA, 20 nt, Human
ucaggagccuaggacaugau

SEQ ID NO: 777061 - RNA, 22 nt, Human
ugcugcugauggaugccuggac

SEQ ID NO: 777062 - RNA, 22 nt, Human
ugcugaggagguggcugugcuu

SEQ ID NO: 777063 - RNA, 22 nt, Human
uagaugaagggguucagcaugg

SEQ ID NO: 777064 - RNA, 22 nt, Human
ugaggcucagugagcccugcag

SEQ ID NO: 777065 - RNA, 20 nt, Human
cagcaggcuauggggcaccc

SEQ ID NO: 777066 - RNA, 22 nt, Human
caggcaagauccagaggcugcu

SEQ ID NO: 777067 - RNA, 22 nt, Human
cacaggccaguaagacuguguu

SEQ ID NO: 777068 - RNA, 22 nt, Human
caggcaaggacucugguaauuu

SEQ ID NO: 777069 - RNA, 22 nt, Human
gccauggggagggcagcgccug

SEQ ID NO: 777070 - RNA, 22 nt, Human
aaaggcuuguuugaggacuggu

SEQ ID NO: 777071 - RNA, 19 nt, Human
aauucuguuucagcagauc

SEQ ID NO: 777072 - RNA, 22 nt, Human
guggacguuaggauuguguaga

SEQ ID NO: 777073 - RNA, 22 nt, Human
acguuaaacauuuagcauagua

SEQ ID NO: 777074 - RNA, 22 nt, Human
gcauucaggguucacggucaac

SEQ ID NO: 777075 - RNA, 22 nt, Human
acacucucagcuuuucaacuua

SEQ ID NO: 777076 - RNA, 22 nt, Human
aaaccugaaguacguuacauaa

SEQ ID NO: 777077 - RNA, 22 nt, Human
acauuguaguuguucugcagca

SEQ ID NO: 777078 - RNA, 19 nt, Human
ugaggccagcuggcauuuu

SEQ ID NO: 777079 - RNA, 22 nt, Human
uggcugugcggccucgggcaga

SEQ ID NO: 777080 - RNA, 22 nt, Human
uagccaggucacacuguguguu

SEQ ID NO: 777081 - RNA, 22 nt, Human
gacaaucagccauauccagggu

SEQ ID NO: 777082 - RNA, 22 nt, Human
ggccaugcuguugccugcuggu

SEQ ID NO: 777083 - RNA, 18 nt, Human
ccuguguguguugcaggc

SEQ ID NO: 777084 - RNA, 22 nt, Human
aggagccuggcuggcccacagg

SEQ ID NO: 777085 - RNA, 22 nt, Human
gcucaggacuggaggagcgggg

SEQ ID NO: 777086 - RNA, 22 nt, Human
guuccuuggaagaacuugaggu

SEQ ID NO: 777087 - RNA, 22 nt, Human
aguuuucugauguguagugaga

SEQ ID NO: 777088 - RNA, 22 nt, Human
agcauaaaggcacuagaaagag

SEQ ID NO: 777089 - RNA, 22 nt, Human
cacaguuauauguucacaagga

SEQ ID NO: 777090 - RNA, 22 nt, Human
auacagaacucucaguuguaua

SEQ ID NO: 777091 - RNA, 22 nt, Human
caguuuuaggacauguggaugu

SEQ ID NO: 777092 - RNA, 22 nt, Human
uucucucuuuuggguaggaggu

SEQ ID NO: 777093 - RNA, 22 nt, Human
gcugccuucuggaggaagugaa

SEQ ID NO: 777094 - RNA, 22 nt, Human
ugaaacuuauucaguuucuacc

SEQ ID NO: 777095 - RNA, 21 nt, Human
aaugaaguggcuauuuugagg

SEQ ID NO: 777096 - RNA, 22 nt, Human
cugaagagaaagggagcucuuc

SEQ ID NO: 777097 - RNA, 22 nt, Human
agcugugucauccuggaaaaug

SEQ ID NO: 777098 - RNA, 22 nt, Human
gagggcuggggcuuaggcuuag

SEQ ID NO: 777099 - RNA, 22 nt, Human
gauccagcuucuacacagagcu

SEQ ID NO: 777100 - RNA, 22 nt, Human
agcagcucaaagccugcaagga

SEQ ID NO: 777101 - RNA, 22 nt, Human
gaaggaggucugcauucuacag

SEQ ID NO: 777102 - RNA, 22 nt, Human
ugugcuuuucucugcuccugga

SEQ ID NO: 777103 - RNA, 22 nt, Human
ggccugagcucuggggaggcaa

SEQ ID NO: 777104 - RNA, 22 nt, Human
auauuucuugagcaccugguau

SEQ ID NO: 777105 - RNA, 22 nt, Human
ugagguggcuggaucucagccu

SEQ ID NO: 777106 - RNA, 22 nt, Human
agugucugcaaaaugaaagagc

SEQ ID NO: 777107 - RNA, 22 nt, Human
cuucagggugacgcaggcugca

SEQ ID NO: 777108 - RNA, 22 nt, Human
cacccugggcugggccuguuaa

SEQ ID NO: 777109 - RNA, 22 nt, Human
gcugggcuuguggccagcuggg

SEQ ID NO: 777110 - RNA, 22 nt, Human
ggcagguggaaguuggcagagc

SEQ ID NO: 777111 - RNA, 23 nt, Human
aucuccugagaacccacaguggu

SEQ ID NO: 777112 - RNA, 22 nt, Human
gcagcuuggggacaugaaaaga

SEQ ID NO: 777113 - RNA, 22 nt, Human
agagguauuagguaauucagua

SEQ ID NO: 777114 - RNA, 23 nt, Human
ugucauugugacuacagaaccag

SEQ ID NO: 777115 - RNA, 22 nt, Human
cacagcugccauggcugcacuu

SEQ ID NO: 777116 - RNA, 22 nt, Human
auccccacugcugcugguguag

SEQ ID NO: 777117 - RNA, 22 nt, Human
augcuucagugcuaccuucaaa

SEQ ID NO: 777118 - RNA, 22 nt, Human
cugccaggauucugugaacccc

SEQ ID NO: 777119 - RNA, 22 nt, Human
guacuuuagaguaaaauagacc

SEQ ID NO: 777120 - RNA, 22 nt, Human
cucuccaggagcucagagucua

SEQ ID NO: 777121 - RNA, 22 nt, Human
ucugcaggaucagagccagagg

SEQ ID NO: 777122 - RNA, 21 nt, Human
aaaaaugaaguuguucaggaa

SEQ ID NO: 777123 - RNA, 22 nt, Human
cuaagaaggaggaaaagugcca

SEQ ID NO: 777124 - RNA, 22 nt, Human
acaucagauuaugcuuugcuua

SEQ ID NO: 777125 - RNA, 22 nt, Human
agucucacuucuugagcuaugc

SEQ ID NO: 777126 - RNA, 22 nt, Human
aauucaaucuaagaaaugauca

SEQ ID NO: 777127 - RNA, 22 nt, Human
ccagagaggccaaggucguggu

SEQ ID NO: 777128 - RNA, 22 nt, Human
gugacucuuaccuacccagccu

SEQ ID NO: 777129 - RNA, 22 nt, Human
ccauggcagccaugggagccac

SEQ ID NO: 777130 - RNA, 22 nt, Human
gaggcagagucacaaagagucu

SEQ ID NO: 777131 - RNA, 17 nt, Human
uucuccucuguguccuu

SEQ ID NO: 777132 - RNA, 22 nt, Human
guauacauagaugaugaacaag

SEQ ID NO: 777133 - RNA, 22 nt, Human
uacagguagagucucuaguuua

SEQ ID NO: 777134 - RNA, 22 nt, Human
uuucaaauaccauaaaccuaau

SEQ ID NO: 777135 - RNA, 22 nt, Human
uguagaaguucuucaggagaau

SEQ ID NO: 777136 - RNA, 22 nt, Human
acaacaaucuacccuagcuucu

SEQ ID NO: 777137 - RNA, 22 nt, Human
acagauccugguuacagccauu

SEQ ID NO: 777138 - RNA, 22 nt, Human
uugagguaguucuauugugagu

SEQ ID NO: 777139 - RNA, 22 nt, Human
gccagagguucaacaacugucu

SEQ ID NO: 777140 - RNA, 22 nt, Human
gcuuagaaguacacaugccuuu

SEQ ID NO: 777141 - RNA, 22 nt, Human
gcugagagugugagaucagauu

SEQ ID NO: 777142 - RNA, 22 nt, Human
agauguggauccuaggguagaa

SEQ ID NO: 777143 - RNA, 23 nt, Human
aucugaaaagcauuugcaguuug

SEQ ID NO: 777144 - RNA, 22 nt, Human
ucaggagguccgcccgggaggg

SEQ ID NO: 777145 - RNA, 22 nt, Human
aguaccauuacucacuuauuuu

SEQ ID NO: 777146 - RNA, 22 nt, Human
agcuuuaaagcauauuucuaag

SEQ ID NO: 777147 - RNA, 22 nt, Human
acauucacuauguccaaacucu

SEQ ID NO: 777148 - RNA, 22 nt, Human
gcaggagagucugugccagguu

SEQ ID NO: 777149 - RNA, 22 nt, Human
accugcagcuaaagauguaggg

SEQ ID NO: 777150 - RNA, 22 nt, Human
uuucuucucuaaucucaaugau

SEQ ID NO: 777151 - RNA, 22 nt, Human
ucauguaaguauagaaagcagu

SEQ ID NO: 777152 - RNA, 22 nt, Human
cuggcacacaguaggcaccaau

SEQ ID NO: 777153 - RNA, 21 nt, Human
gcagcaguguucuagaauacu

SEQ ID NO: 777154 - RNA, 22 nt, Human
uccagcuggggccgaaguggau

SEQ ID NO: 777155 - RNA, 22 nt, Human
augugcagcuuuucuagagaag

SEQ ID NO: 777156 - RNA, 22 nt, Human
gacccuggcuggagcuggccug

SEQ ID NO: 777157 - RNA, 22 nt, Human
ccagcuccggugugcuuauuuc

SEQ ID NO: 777158 - RNA, 22 nt, Human
uggcaggaaccaggaggcucuc

SEQ ID NO: 777159 - RNA, 22 nt, Human
cagagacagaaaauggaucuag

SEQ ID NO: 777160 - RNA, 22 nt, Human
cauuucacaguaaagugauuuc

SEQ ID NO: 777161 - RNA, 22 nt, Human
gggggccagucaucucccaaga

SEQ ID NO: 777162 - RNA, 22 nt, Human
gagcucuguguagccugagggu

SEQ ID NO: 777163 - RNA, 22 nt, Human
uguagaugagucagggugcacc

SEQ ID NO: 777164 - RNA, 22 nt, Human
ucugcucuguacugcacuggcc

SEQ ID NO: 777165 - RNA, 22 nt, Human
ggcugccugaacuuuggggaaa

SEQ ID NO: 777166 - RNA, 22 nt, Human
auguuucauuuagauaucaggc

SEQ ID NO: 777167 - RNA, 22 nt, Human
auaagcauuucacagguguguu

SEQ ID NO: 777168 - RNA, 21 nt, Human
ucacuagugccuucugucauu

SEQ ID NO: 777169 - RNA, 21 nt, Human
guggccugauuaugaaugggu

SEQ ID NO: 777170 - RNA, 22 nt, Human
agcuuccugaugcaagagggcu

SEQ ID NO: 777171 - RNA, 16 nt, Human
ucacauacuuccuugc

SEQ ID NO: 777172 - RNA, 21 nt, Human
ucaaacaugaucugggucauc

SEQ ID NO: 777173 - RNA, 22 nt, Human
gaucauuggccuuucugcagug

SEQ ID NO: 777174 - RNA, 22 nt, Human
cagagccauuauggagacuugc

SEQ ID NO: 777175 - RNA, 22 nt, Human
ggcagcaagcagaaguucuaug

SEQ ID NO: 777176 - RNA, 22 nt, Human
acauuguauaaugauuaucaca

SEQ ID NO: 777177 - RNA, 22 nt, Human
cccaggcuccuacuguauucug

SEQ ID NO: 777178 - RNA, 22 nt, Human
gaaagguuucaucuacuuuuca

SEQ ID NO: 777179 - RNA, 22 nt, Human
cugaaggagguagagugacaua

SEQ ID NO: 777180 - RNA, 22 nt, Human
uuccagagucagccacugggag

SEQ ID NO: 777181 - RNA, 20 nt, Human
agcuuugguuaagccagugg

SEQ ID NO: 777182 - RNA, 22 nt, Human
uuccuggguugugcauuguaca

SEQ ID NO: 777183 - RNA, 22 nt, Human
ugcuggaggggccugaccagga

SEQ ID NO: 777184 - RNA, 22 nt, Human
uuauaugauugagcaucuuggu

SEQ ID NO: 777185 - RNA, 22 nt, Human
acuccugggugcugaccagcgu

SEQ ID NO: 777186 - RNA, 22 nt, Human
ugacuuuggcuuaagcagcagu

SEQ ID NO: 777187 - RNA, 22 nt, Human
ccuggccugugaaucugagagc

SEQ ID NO: 777188 - RNA, 22 nt, Human
cuuacaacuuguaugugauugu

SEQ ID NO: 777189 - RNA, 22 nt, Human
ugcuguuaucacauuuuguaaa

SEQ ID NO: 777190 - RNA, 22 nt, Human
acagcuuuaucucagggaucag

SEQ ID NO: 777191 - RNA, 22 nt, Human
uuauugcugcuaacauuuuaug

SEQ ID NO: 777192 - RNA, 22 nt, Human
ugucauuuaaagcuuuccagau

SEQ ID NO: 777193 - RNA, 22 nt, Human
cuuuacagccuccagaaggaac

SEQ ID NO: 777194 - RNA, 19 nt, Human
uucugcuguuccuaggcug

SEQ ID NO: 777195 - RNA, 22 nt, Human
auucuccagcucacuguccaua

SEQ ID NO: 777196 - RNA, 22 nt, Human
cugugacagagcuugagugaga

SEQ ID NO: 777197 - RNA, 22 nt, Human
uauugacagugacuauugguag

SEQ ID NO: 777198 - RNA, 22 nt, Human
uucaugaacgaacauauguaua

SEQ ID NO: 777199 - RNA, 22 nt, Human
aggcaggcucaaugcccagucu

SEQ ID NO: 777200 - RNA, 22 nt, Human
gcagaugcugagauuuauuucu

SEQ ID NO: 777201 - RNA, 22 nt, Human
gcacccagugggaugcuuagca

SEQ ID NO: 777202 - RNA, 22 nt, Human
cuccucuggaaauuccucugcc

SEQ ID NO: 777203 - RNA, 22 nt, Human
ugagacagucccaugaucugca

SEQ ID NO: 777204 - RNA, 22 nt, Human
uggcuacaguggcauaucaaau

SEQ ID NO: 777205 - RNA, 22 nt, Human
gguguugggcucacugguccuu

SEQ ID NO: 777206 - RNA, 22 nt, Human
uguggggcucccuggcagccug

SEQ ID NO: 777207 - RNA, 23 nt, Human
uggaaacuuaagggggagauguc

SEQ ID NO: 777208 - RNA, 22 nt, Human
uuggaagauucugugucuggug

SEQ ID NO: 777209 - RNA, 22 nt, Human
acacugugugacuucugagacu

SEQ ID NO: 777210 - RNA, 22 nt, Human
uaucacacuagccuauagugga

SEQ ID NO: 777211 - RNA, 22 nt, Human
gugcugucauuagcaucuagag

SEQ ID NO: 777212 - RNA, 17 nt, Human
aaaauucuguaaagagg

SEQ ID NO: 777213 - RNA, 22 nt, Human
cuguguccucccgcugcaccca

SEQ ID NO: 777214 - RNA, 22 nt, Human
gugcccacgaggccaggcuggu

SEQ ID NO: 777215 - RNA, 22 nt, Human
uugaaucauuacaauagauaag

SEQ ID NO: 777216 - RNA, 22 nt, Human
cuggcucaugugaugagggcaa

SEQ ID NO: 777217 - RNA, 22 nt, Human
uuggaaggaagaaccgcgguag

SEQ ID NO: 777218 - RNA, 22 nt, Human
uacauucauggugacuuguaug

SEQ ID NO: 777219 - RNA, 19 nt, Human
aagggcugggcaccucacu

SEQ ID NO: 777220 - RNA, 22 nt, Human
cagaggcucuuccucacugccc

SEQ ID NO: 777221 - RNA, 23 nt, Human
uccagggcuggccagaccucggu

SEQ ID NO: 777222 - RNA, 22 nt, Human
gugauggguaacuguuuaggga

SEQ ID NO: 777223 - RNA, 22 nt, Human
caggccuccuaugagcacuagc

SEQ ID NO: 777224 - RNA, 22 nt, Human
aagaguuucugauucaguaggu

SEQ ID NO: 777225 - RNA, 22 nt, Human
uucucuggccauagcuggcuag

SEQ ID NO: 777226 - RNA, 22 nt, Human
gcccaucuucuagcagcuguua

SEQ ID NO: 777227 - RNA, 22 nt, Human
aacacauugccagagaucagca

SEQ ID NO: 777228 - RNA, 22 nt, Human
uccucacagcaugaccaggcag

SEQ ID NO: 777229 - RNA, 22 nt, Human
aaacaugcuggauuuagaauau

SEQ ID NO: 777230 - RNA, 19 nt, Human
cccaggggacccagcccua

SEQ ID NO: 777231 - RNA, 22 nt, Human
ggagugucagaaacaguguccu

SEQ ID NO: 777232 - RNA, 20 nt, Human
ugcauaguugcugcaguuga

SEQ ID NO: 777233 - RNA, 22 nt, Human
gcugucaguuuuacccacagac

SEQ ID NO: 777234 - RNA, 22 nt, Human
gggucuccugagagaagaugcu

SEQ ID NO: 777235 - RNA, 22 nt, Human
aauggcuucugaagcacacuuu

SEQ ID NO: 777236 - RNA, 22 nt, Human
uuucagagaugcagaauucagg

SEQ ID NO: 777237 - RNA, 22 nt, Human
acauuuauuacucagguuguug

SEQ ID NO: 777238 - RNA, 22 nt, Human
uuccuucuauucagcuccaaga

SEQ ID NO: 777239 - RNA, 22 nt, Human
uggcagugggaagcuggaaguc

SEQ ID NO: 777240 - RNA, 22 nt, Human
auuuacagugugccuacuauau

SEQ ID NO: 777241 - RNA, 22 nt, Human
uuguaugaccacaaucugacgu

SEQ ID NO: 777242 - RNA, 22 nt, Human
ucuucauguuaguuggguuuuc

SEQ ID NO: 777243 - RNA, 22 nt, Human
aaguguauuuuuguacuaacau

SEQ ID NO: 777244 - RNA, 22 nt, Human
auucaccuguuaguaaaaaucu

SEQ ID NO: 777245 - RNA, 22 nt, Human
uccagccccuuuuacucauuca

SEQ ID NO: 777246 - RNA, 22 nt, Human
gugguccugccagccaggucca

SEQ ID NO: 777247 - RNA, 22 nt, Human
cucugguucagggcucccuggc

SEQ ID NO: 777248 - RNA, 22 nt, Human
gcagggucugaggccacagagg

SEQ ID NO: 777249 - RNA, 22 nt, Human
cucugggcacuguauggguucu

SEQ ID NO: 777250 - RNA, 22 nt, Human
caguggcuucuuccuagagcca

SEQ ID NO: 777251 - RNA, 22 nt, Human
agucccagugacuuggccagaa

SEQ ID NO: 777252 - RNA, 22 nt, Human
aucauccauggcugaucauaaa

SEQ ID NO: 777253 - RNA, 22 nt, Human
cagagcagaagguccaagccug

SEQ ID NO: 777254 - RNA, 22 nt, Human
ugcacacaaaugugaacgugcc

SEQ ID NO: 777255 - RNA, 22 nt, Human
aagcaccugcaccggucgccuu

SEQ ID NO: 777256 - RNA, 22 nt, Human
acagcuggaggccccauugucc

SEQ ID NO: 777257 - RNA, 22 nt, Human
uuuguguuguacuucugugcau

SEQ ID NO: 777258 - RNA, 22 nt, Human
auacagauguugaauguuauau

SEQ ID NO: 777259 - RNA, 22 nt, Human
uuugcuauuuuucugugcagcu

SEQ ID NO: 777260 - RNA, 22 nt, Human
acacuucaccccugcucccagu

SEQ ID NO: 777261 - RNA, 22 nt, Human
gccuacuuaguagcugggauua

SEQ ID NO: 777262 - RNA, 22 nt, Human
uugagcaaaucagauuguaauu

SEQ ID NO: 777263 - RNA, 22 nt, Human
cccugaggggcuuacuuugccc

SEQ ID NO: 777264 - RNA, 22 nt, Human
aguugacaauaaauuuaauugg

SEQ ID NO: 777265 - RNA, 22 nt, Human
uugagcaaaggaguaaaaugca

SEQ ID NO: 777266 - RNA, 22 nt, Human
ucaucauaauauggaaucuugu

SEQ ID NO: 777267 - RNA, 20 nt, Human
agcaaaaugcaagauuuuca

SEQ ID NO: 777268 - RNA, 22 nt, Human
agauaauuauuuacuucaaagu

SEQ ID NO: 777269 - RNA, 22 nt, Human
gcacagggcaacaggucuguua

SEQ ID NO: 777270 - RNA, 22 nt, Human
ugcccucaagcaacagagagga

SEQ ID NO: 777271 - RNA, 22 nt, Human
ugaggggcauguguuuacacau

SEQ ID NO: 777272 - RNA, 22 nt, Human
ugucucugaggugagggucagc

SEQ ID NO: 777273 - RNA, 22 nt, Human
ucagaaagacgaaacagauggg

SEQ ID NO: 777274 - RNA, 22 nt, Human
ucucaucuuuaaaugaaaauuu

SEQ ID NO: 777275 - RNA, 22 nt, Human
aggcuccaccagucaggugcau

SEQ ID NO: 777276 - RNA, 22 nt, Human
ugugaguaauaaagucauuuuu

SEQ ID NO: 777277 - RNA, 22 nt, Human
aaguccagacuccuuugcgugg

SEQ ID NO: 777278 - RNA, 20 nt, Human
ccagcacccucucagcugaa

SEQ ID NO: 777279 - RNA, 22 nt, Human
auaaaucuauuggacaugugug

SEQ ID NO: 777280 - RNA, 22 nt, Human
ugguccaagugagguggccucu

SEQ ID NO: 777281 - RNA, 22 nt, Human
gggagggaggugaugcuuggcu

SEQ ID NO: 777282 - RNA, 22 nt, Human
acauuccagguuggugcagggu

SEQ ID NO: 777283 - RNA, 22 nt, Human
ucuucaguauuuggauaacauu

SEQ ID NO: 777284 - RNA, 22 nt, Human
gcacugaaauuauaugcauuug

SEQ ID NO: 777285 - RNA, 22 nt, Human
uucugaaauuucaacuuuacua

SEQ ID NO: 777286 - RNA, 22 nt, Human
caggauggagagugagggguca

SEQ ID NO: 777287 - RNA, 22 nt, Human
cugggccaagaaguuguguaug

SEQ ID NO: 777288 - RNA, 22 nt, Human
auacaccaccuuggaucuuuca

SEQ ID NO: 777289 - RNA, 22 nt, Human
gaggggcugcccuggugucagg

SEQ ID NO: 777290 - RNA, 22 nt, Human
ucuggccuauuucugucagauc

SEQ ID NO: 777291 - RNA, 22 nt, Human
acacuucaugcauucuucacuc

SEQ ID NO: 777292 - RNA, 22 nt, Human
ccaggucuuugacuaauaugcu

SEQ ID NO: 777293 - RNA, 22 nt, Human
gccacagggcgagcggaggcca

SEQ ID NO: 777294 - RNA, 22 nt, Human
gggagcuggaguuguguugccu

SEQ ID NO: 777295 - RNA, 22 nt, Human
gggcugugggacccggcacuuu

SEQ ID NO: 777296 - RNA, 22 nt, Human
agguuuaugccuuggagcuggg

SEQ ID NO: 777297 - RNA, 22 nt, Human
ucuuugcaggagcccuuugaac

SEQ ID NO: 777298 - RNA, 22 nt, Human
auccuguuuuagauaagcuuau

SEQ ID NO: 777299 - RNA, 22 nt, Human
cuggacagaaguggcugggcag

SEQ ID NO: 777300 - RNA, 22 nt, Human
aaauuucaagcaaaguagcuau

SEQ ID NO: 777301 - RNA, 22 nt, Human
auacuugagguagcaacuuaag

SEQ ID NO: 777302 - RNA, 22 nt, Human
ucagagaucuucaggaugggac

SEQ ID NO: 777303 - RNA, 22 nt, Human
aucagaaguugugcaugcaugg

SEQ ID NO: 777304 - RNA, 22 nt, Human
ccuaggcccuaggcuuccauca

SEQ ID NO: 777305 - RNA, 22 nt, Human
agccccuugcacuuccccacgc

SEQ ID NO: 777306 - RNA, 21 nt, Human
acaugucucuaaucucaguga

SEQ ID NO: 777307 - RNA, 22 nt, Human
ucuucacauuuuaagaaguucu

SEQ ID NO: 777308 - RNA, 22 nt, Human
uacaucugauuuaccuacugaa

SEQ ID NO: 777309 - RNA, 22 nt, Human
cucuggaguucucaugaggaac

SEQ ID NO: 777310 - RNA, 22 nt, Human
ggcagagcgcaugcgucgcaga

SEQ ID NO: 777311 - RNA, 22 nt, Human
aaacaucuacuguaggcuggag

SEQ ID NO: 777312 - RNA, 22 nt, Human
uccaggaccugacugggccugc

SEQ ID NO: 777313 - RNA, 22 nt, Human
gugcaggauguugggaaucagg

SEQ ID NO: 777314 - RNA, 22 nt, Human
ugaggauggaaugcugugcaag

SEQ ID NO: 777315 - RNA, 22 nt, Human
agccugagcugccugccgccuc

SEQ ID NO: 777316 - RNA, 22 nt, Human
cuuauacacgaacacaaggugu

SEQ ID NO: 777317 - RNA, 22 nt, Human
gaaaucaucugaguaauaaucu

SEQ ID NO: 777318 - RNA, 22 nt, Human
gaguagaaaguaaaguacgaau

SEQ ID NO: 777319 - RNA, 22 nt, Human
uauuaugauucggacguggcag

SEQ ID NO: 777320 - RNA, 22 nt, Human
ucacagaagggaaagaugccaa

SEQ ID NO: 777321 - RNA, 22 nt, Human
caggaugcacuaggaaccaggg

SEQ ID NO: 777322 - RNA, 22 nt, Human
ugugaauguauaguuuguauau

SEQ ID NO: 777323 - RNA, 22 nt, Human
aaggcuuugugggcugcaggca

SEQ ID NO: 777324 - RNA, 22 nt, Human
uucaguuucagucuugcaaaaa

SEQ ID NO: 777325 - RNA, 22 nt, Human
augauguaauggaaagaacaga

SEQ ID NO: 777326 - RNA, 22 nt, Human
caggaggcuuugggauccaagu

SEQ ID NO: 777327 - RNA, 17 nt, Human
uuucuagauuauccucu

SEQ ID NO: 777328 - RNA, 22 nt, Human
gcaaggcagcauccuuuugagg

SEQ ID NO: 777329 - RNA, 22 nt, Human
uuaguguguccaguucugaaaa

SEQ ID NO: 777330 - RNA, 22 nt, Human
gaaacagcuuuaagugauacug

SEQ ID NO: 777331 - RNA, 22 nt, Human
agccaggaaccagcuacagucu

SEQ ID NO: 777332 - RNA, 22 nt, Human
ccuccaaggugagagaggaugg

SEQ ID NO: 777333 - RNA, 22 nt, Human
cucuguggcuacacaaaccucc

SEQ ID NO: 777334 - RNA, 22 nt, Human
ugcuauuugugagugucuucgu

SEQ ID NO: 777335 - RNA, 22 nt, Human
uacagagacccacaagagacug

SEQ ID NO: 777336 - RNA, 22 nt, Human
aggucugagcaggggagaacag

SEQ ID NO: 777337 - RNA, 22 nt, Human
uccucucugcacuggcccugcc

SEQ ID NO: 777338 - RNA, 22 nt, Human
aaaccaucagauaauucauacu

SEQ ID NO: 777339 - RNA, 22 nt, Human
uugauuacuauguguugaaagc

SEQ ID NO: 777340 - RNA, 22 nt, Human
caggaggagcuggccgccucau

SEQ ID NO: 777341 - RNA, 22 nt, Human
uggcauguuuaauguacuguau

SEQ ID NO: 777342 - RNA, 22 nt, Human
uauuucuuucagguauguguug

SEQ ID NO: 777343 - RNA, 22 nt, Human
agcaauauaaauguuggguaga

SEQ ID NO: 777344 - RNA, 22 nt, Human
uuaaggaaugugcaguuuauau

SEQ ID NO: 777345 - RNA, 22 nt, Human
gacaaaggaucagagguuggga

SEQ ID NO: 777346 - RNA, 22 nt, Human
aaauaugaaugauaagaguuau

SEQ ID NO: 777347 - RNA, 22 nt, Human
caggaaugaaaggucaggguug

SEQ ID NO: 777348 - RNA, 22 nt, Human
ucuauuucgcauauaaguuuug

SEQ ID NO: 777349 - RNA, 22 nt, Human
agccagaggucaugagcacagg

SEQ ID NO: 777350 - RNA, 22 nt, Human
gaaggcuugcagcucuguggca

SEQ ID NO: 777351 - RNA, 22 nt, Human
augcuuucuucuuuccuguaag

SEQ ID NO: 777352 - RNA, 22 nt, Human
uugaagacaagggcagggguuc

SEQ ID NO: 777353 - RNA, 22 nt, Human
ccuggccuccuggccuucucau

SEQ ID NO: 777354 - RNA, 17 nt, Human
aggaggaucagagagua

SEQ ID NO: 777355 - RNA, 22 nt, Human
gagcaggaaggccagaaggguc

SEQ ID NO: 777356 - RNA, 22 nt, Human
ucuccagguaaauggcauccug

SEQ ID NO: 777357 - RNA, 22 nt, Human
uucuuacuaguauguuucagca

SEQ ID NO: 777358 - RNA, 22 nt, Human
ucuguuuaugcauauuuaaaac

SEQ ID NO: 777359 - RNA, 22 nt, Human
agcagcagugacagccgaaagc

SEQ ID NO: 777360 - RNA, 22 nt, Human
uuuuaagaggaggcuguuugaa

SEQ ID NO: 777361 - RNA, 22 nt, Human
gaggagacaguggagccgcuac

SEQ ID NO: 777362 - RNA, 22 nt, Human
cagcuccagccgacuguaagaa

SEQ ID NO: 777363 - RNA, 22 nt, Human
ucagacaugggauaugaagcuc

SEQ ID NO: 777364 - RNA, 22 nt, Human
aaguuugcauagauuaagcauu

SEQ ID NO: 777365 - RNA, 22 nt, Human
aggaggugacagccugcaucug

SEQ ID NO: 777366 - RNA, 22 nt, Human
gcucccaggcauggagguaauu

SEQ ID NO: 777367 - RNA, 22 nt, Human
gguaacaacccuacaaauccac

SEQ ID NO: 777368 - RNA, 22 nt, Human
acuuaaagaggcuacuuuuggu

SEQ ID NO: 777369 - RNA, 22 nt, Human
auucuacaaucauguagauccu

SEQ ID NO: 777370 - RNA, 22 nt, Human
gguggaaggcagcagucucagg

SEQ ID NO: 777371 - RNA, 22 nt, Human
uugaaaaccgugggaggcugaa

SEQ ID NO: 777372 - RNA, 22 nt, Human
gacaucugaggcccucagagcc

SEQ ID NO: 777373 - RNA, 22 nt, Human
aggcagaagccagccagggucc

SEQ ID NO: 777374 - RNA, 15 nt, Human
uacauucauuuccac

SEQ ID NO: 777375 - RNA, 22 nt, Human
ucugcucaauacugcucaugaa

SEQ ID NO: 777376 - RNA, 22 nt, Human
cugccucuauucacugaggcag

SEQ ID NO: 777377 - RNA, 22 nt, Human
agcucugauccauaauuuauac

SEQ ID NO: 777378 - RNA, 22 nt, Human
uuucuacagcuggugcaacuuu

SEQ ID NO: 777379 - RNA, 22 nt, Human
agucccuggauugucucuguca

SEQ ID NO: 777380 - RNA, 22 nt, Human
acuaguauuagacuaaaaguca

SEQ ID NO: 777381 - RNA, 22 nt, Human
guaaaugugcuucuuuuaacuu

SEQ ID NO: 777382 - RNA, 22 nt, Human
auuguuaaaaagguggaaaugc

SEQ ID NO: 777383 - RNA, 22 nt, Human
gcagcaggcuuuucauaccuug

SEQ ID NO: 777384 - RNA, 19 nt, Human
ucaugcacuuugauguaac

SEQ ID NO: 777385 - RNA, 22 nt, Human
agagaauuggagcagugacagg

SEQ ID NO: 777386 - RNA, 22 nt, Human
gagugcaguaucuucugugucc

SEQ ID NO: 777387 - RNA, 22 nt, Human
ugaaugaguuuggcugcuguuc

SEQ ID NO: 777388 - RNA, 19 nt, Human
ggcucagggcgcugccgcc

SEQ ID NO: 777389 - RNA, 23 nt, Human
uguaaaagcauuugucagccugg

SEQ ID NO: 777390 - RNA, 22 nt, Human
auuucccaggacuagaaauaua

SEQ ID NO: 777391 - RNA, 22 nt, Human
aaccuagaaguuagaguaucau

SEQ ID NO: 777392 - RNA, 22 nt, Human
ugggccuguugggguugaguua

SEQ ID NO: 777393 - RNA, 22 nt, Human
uaugcacaguuacaagaauauc

SEQ ID NO: 777394 - RNA, 22 nt, Human
uuggcuucuguuuuggcucugu

SEQ ID NO: 777395 - RNA, 22 nt, Human
ucugggcagaagcagugcaaag

SEQ ID NO: 777396 - RNA, 21 nt, Human
gggcuccagagauguagcuuc

SEQ ID NO: 777397 - RNA, 19 nt, Human
uggcauugguccagauaaa

SEQ ID NO: 777398 - RNA, 22 nt, Human
cugggagucuggaauuuuggua

SEQ ID NO: 777399 - RNA, 22 nt, Human
guuuauugauaaaagcuggaca

SEQ ID NO: 777400 - RNA, 22 nt, Human
acuugaaaccuuggcaaacaau

SEQ ID NO: 777401 - RNA, 22 nt, Human
ggugcagaguccacagaaagcu

SEQ ID NO: 777402 - RNA, 22 nt, Human
agaugcuuacuaugguuguaug

SEQ ID NO: 777403 - RNA, 21 nt, Human
acaugggaccugcgaaaggaa

SEQ ID NO: 777404 - RNA, 22 nt, Human
uccugggcuuaguggcuagguc

SEQ ID NO: 777405 - RNA, 22 nt, Human
ugggcucuuccuauaguuuaua

SEQ ID NO: 777406 - RNA, 22 nt, Human
ggguggccuucauagcucaggg

SEQ ID NO: 777407 - RNA, 22 nt, Human
guucuccuuguggcugcagcag

SEQ ID NO: 777408 - RNA, 22 nt, Human
gauuuucauuugcacucuagaa

SEQ ID NO: 777409 - RNA, 22 nt, Human
uguucuuagcaggagcaucuau

SEQ ID NO: 777410 - RNA, 22 nt, Human
uaaguugauuauaaccacugga

SEQ ID NO: 777411 - RNA, 22 nt, Human
aauggcuucuuuuugguauaau

SEQ ID NO: 777412 - RNA, 22 nt, Human
aggugcuggaguagaagaaaaa

SEQ ID NO: 777413 - RNA, 22 nt, Human
cugugauguuagcucuguguua

SEQ ID NO: 777414 - RNA, 22 nt, Human
uccuugaaaaucuugguuuaga

SEQ ID NO: 777415 - RNA, 22 nt, Human
ugcaucuuacguuuugaaaggg

SEQ ID NO: 777416 - RNA, 22 nt, Human
ggaggcggagcuugcagugagc

SEQ ID NO: 777417 - RNA, 22 nt, Human
gaucauuucaguccaguaaaua

SEQ ID NO: 777418 - RNA, 23 nt, Human
agcccagcagagaaccuaggucc

SEQ ID NO: 777419 - RNA, 22 nt, Human
uacaaacuuguuuuaaguaagu

SEQ ID NO: 777420 - RNA, 22 nt, Human
gaaggaagucauuagugcagac

SEQ ID NO: 777421 - RNA, 22 nt, Human
caggagugcagguggugaggca

SEQ ID NO: 777422 - RNA, 22 nt, Human
accagccugucugagucguggg

SEQ ID NO: 777423 - RNA, 22 nt, Human
cuuccuuuccccaaucauaucg

SEQ ID NO: 777424 - RNA, 22 nt, Human
agcuguguuaggauguuaauaa

SEQ ID NO: 777425 - RNA, 22 nt, Human
gucuaugauauuuuguuauagc

SEQ ID NO: 777426 - RNA, 22 nt, Human
cucuucuguaccucggccucca

SEQ ID NO: 777427 - RNA, 22 nt, Human
cuauuuaucuauuucugaauga

SEQ ID NO: 777428 - RNA, 22 nt, Human
uacucacauucuguuucuugcu

SEQ ID NO: 777429 - RNA, 22 nt, Human
aaauuccaguucuuuuaccugc

SEQ ID NO: 777430 - RNA, 22 nt, Human
ccaggcucagcuauuaagaaac

SEQ ID NO: 777431 - RNA, 22 nt, Human
uuuuaugauugagcuggcuaca

SEQ ID NO: 777432 - RNA, 22 nt, Human
agcccugauuaaccuuggcuuu

SEQ ID NO: 777433 - RNA, 22 nt, Human
aaacuucaagauucaagccugg

SEQ ID NO: 777434 - RNA, 22 nt, Human
gccagugcuuguggagcuggca

SEQ ID NO: 777435 - RNA, 22 nt, Human
ccucccagaugugcccaaugga

SEQ ID NO: 777436 - RNA, 22 nt, Human
gaggcugcccacaccugcgccg

SEQ ID NO: 777437 - RNA, 22 nt, Human
uaagcaguuuuucuuguauuaa

SEQ ID NO: 777438 - RNA, 22 nt, Human
acaugcuaaaucugagaugcuu

SEQ ID NO: 777439 - RNA, 22 nt, Human
uagcagagcugcaauauagacc

SEQ ID NO: 777440 - RNA, 22 nt, Human
ugcuggggcagaagagccaaga

SEQ ID NO: 777441 - RNA, 20 nt, Human
gggcaguggcgcuaucucag

SEQ ID NO: 777442 - RNA, 22 nt, Human
augugucuucuguggguuugaa

SEQ ID NO: 777443 - RNA, 22 nt, Human
aaggucaacacugauuuuaguc

SEQ ID NO: 777444 - RNA, 22 nt, Human
ugcaggugguccuuccucugcu

SEQ ID NO: 777445 - RNA, 22 nt, Human
guggcagugaggcaggagcagu

SEQ ID NO: 777446 - RNA, 22 nt, Human
cugggccagucucggccgcucu

SEQ ID NO: 777447 - RNA, 22 nt, Human
gcugccugugcgggucgcuagg

SEQ ID NO: 777448 - RNA, 22 nt, Human
ggccucaggguugggcccauua

SEQ ID NO: 777449 - RNA, 22 nt, Human
cagagcuggacuuaaauauauu

SEQ ID NO: 777450 - RNA, 22 nt, Human
cgcaggugaaagaggcugggca

SEQ ID NO: 777451 - RNA, 22 nt, Human
aucaggaucugcaucauaagaa

SEQ ID NO: 777452 - RNA, 22 nt, Human
guggcaguggagacccgagccu

SEQ ID NO: 777453 - RNA, 18 nt, Human
ugcugggguagaauccac

SEQ ID NO: 777454 - RNA, 22 nt, Human
uaccugaaguaacaaugaauau

SEQ ID NO: 777455 - RNA, 22 nt, Human
ggcagccuccagggcacuggug

SEQ ID NO: 777456 - RNA, 22 nt, Human
aaagcuuuucaguauguucaug

SEQ ID NO: 777457 - RNA, 22 nt, Human
uaaagucaucuuuaaacaugcc

SEQ ID NO: 777458 - RNA, 22 nt, Human
cacaugaagaccuaauuggauu

SEQ ID NO: 777459 - RNA, 22 nt, Human
uuugcugcuguauauggagccc

SEQ ID NO: 777460 - RNA, 22 nt, Human
uucuuuguuguacuuuccuaca

SEQ ID NO: 777461 - RNA, 22 nt, Human
cucaggcccacagcagacccac

SEQ ID NO: 777462 - RNA, 22 nt, Human
gauuuuauagucaggaaaaaga

SEQ ID NO: 777463 - RNA, 22 nt, Human
gcugagguaggagguugcagug

SEQ ID NO: 777464 - RNA, 22 nt, Human
aaaaccaaguuuuccuuagucu

SEQ ID NO: 777465 - RNA, 22 nt, Human
gugcaggaggaugacaacugca

SEQ ID NO: 777466 - RNA, 22 nt, Human
cacagcuucaguuucugacuug

SEQ ID NO: 777467 - RNA, 22 nt, Human
caguuucugggcguucacaggu

SEQ ID NO: 777468 - RNA, 22 nt, Human
uggcauggaccuuggaagaauu

SEQ ID NO: 777469 - RNA, 22 nt, Human
ucugaggcaaacagaggagugu

SEQ ID NO: 777470 - RNA, 22 nt, Human
ucaagauguccagugccuauaa

SEQ ID NO: 777471 - RNA, 22 nt, Human
uacaaacuguuauuauuauugu

SEQ ID NO: 777472 - RNA, 18 nt, Human
auuguucugugacauguc

SEQ ID NO: 777473 - RNA, 22 nt, Human
agggcagcagcuccuccuagcu

SEQ ID NO: 777474 - RNA, 22 nt, Human
auuaguaaaacauuguauaugu

SEQ ID NO: 777475 - RNA, 22 nt, Human
aggaaggcugaucacugcuugu

SEQ ID NO: 777476 - RNA, 22 nt, Human
gcugcccaaugguagugucuuu

SEQ ID NO: 777477 - RNA, 22 nt, Human
aaguuuaguuaaguaaacucuu

SEQ ID NO: 777478 - RNA, 19 nt, Human
ccuggguccacucagacua

SEQ ID NO: 777479 - RNA, 22 nt, Human
agaggccaucugcucugugggg

SEQ ID NO: 777480 - RNA, 16 nt, Human
gagcagccugggccuu

SEQ ID NO: 777481 - RNA, 22 nt, Human
aaaccggguccagaucuucagg

SEQ ID NO: 777482 - RNA, 22 nt, Human
gcucuggcuuggggcacucguc

SEQ ID NO: 777483 - RNA, 22 nt, Human
uuugauccguugcuggugagga

SEQ ID NO: 777484 - RNA, 22 nt, Human
ucagagugaggcccagcaaucu

SEQ ID NO: 777485 - RNA, 22 nt, Human
gaucauuuugaugcccuuuuag

SEQ ID NO: 777486 - RNA, 21 nt, Human
uagaggcaggagggacugcag

SEQ ID NO: 777487 - RNA, 22 nt, Human
ggcuucgcagcucggcagccgc

SEQ ID NO: 777488 - RNA, 22 nt, Human
cuacagaggacacaaagaucuu

SEQ ID NO: 777489 - RNA, 22 nt, Human
ugagggaguuggguguauagga

SEQ ID NO: 777490 - RNA, 22 nt, Human
ugcaggcugcagucucaggugg

SEQ ID NO: 777491 - RNA, 22 nt, Human
agucaaagcuacaggcauuuga

SEQ ID NO: 777492 - RNA, 22 nt, Human
ucucccaagccuggcaggggca

SEQ ID NO: 777493 - RNA, 22 nt, Human
ggcucuggcaaggggaggcuac

SEQ ID NO: 777494 - RNA, 22 nt, Human
ugaaagauaaguuauuauguac

SEQ ID NO: 777495 - RNA, 22 nt, Human
uuguuaaaacuccauugguuug

SEQ ID NO: 777496 - RNA, 22 nt, Human
gcccuggauggcaggagccauc

SEQ ID NO: 777497 - RNA, 22 nt, Human
uuuggcaagugggaaauuagua

SEQ ID NO: 777498 - RNA, 22 nt, Human
uuugaaauguaucaguauaggu

SEQ ID NO: 777499 - RNA, 22 nt, Human
acaacuuugacccuuguucuua

SEQ ID NO: 777500 - RNA, 22 nt, Human
acacuggguaacauaucuguua

SEQ ID NO: 777501 - RNA, 22 nt, Human
uguguauaaacaagagucugug

SEQ ID NO: 777502 - RNA, 22 nt, Human
uuuacucuugcuacacaacugu

SEQ ID NO: 777503 - RNA, 22 nt, Human
agaggccaugcuagaggccugg

SEQ ID NO: 777504 - RNA, 22 nt, Human
ugaaaucaaugucuucugucuc

SEQ ID NO: 777505 - RNA, 22 nt, Human
cugcaggguucggagaguuccc

SEQ ID NO: 777506 - RNA, 22 nt, Human
gccagacacuccccugggcagg

SEQ ID NO: 777507 - RNA, 22 nt, Human
guuuuucuaggaccaugugauu

SEQ ID NO: 777508 - RNA, 22 nt, Human
cugaucuguccuccucagagcc

SEQ ID NO: 777509 - RNA, 23 nt, Human
gcugucgccagagccccaccuac

SEQ ID NO: 777510 - RNA, 22 nt, Human
auggaacagauuaaagugaggg

SEQ ID NO: 777511 - RNA, 22 nt, Human
ugccaggcugucaauucaccca

SEQ ID NO: 777512 - RNA, 22 nt, Human
ugguuuuauuuauguugaguca

SEQ ID NO: 777513 - RNA, 22 nt, Human
uguucuuuucucuaaacugaua

SEQ ID NO: 777514 - RNA, 22 nt, Human
ucucuggguaugguaacguugg

SEQ ID NO: 777515 - RNA, 22 nt, Human
cagguuccaguugcagggacuu

SEQ ID NO: 777516 - RNA, 19 nt, Human
auccaggucauguaguucu

SEQ ID NO: 777517 - RNA, 19 nt, Human
uagaagcacuaggcaaacu

SEQ ID NO: 777518 - RNA, 22 nt, Human
ggagagagaugccgccuugcuc

SEQ ID NO: 777519 - RNA, 22 nt, Human
uuacagagccucauuuuagaga

SEQ ID NO: 777520 - RNA, 22 nt, Human
ugucuucuucauaaggagagug

SEQ ID NO: 777521 - RNA, 22 nt, Human
cuugcucauuaaguagcucaca

SEQ ID NO: 777522 - RNA, 22 nt, Human
uuuauuaagaugcgaaugcuga

SEQ ID NO: 777523 - RNA, 22 nt, Human
cucugggcaaguaugauagaaa

SEQ ID NO: 777524 - RNA, 22 nt, Human
caaggcagugggcuaggaaccu

SEQ ID NO: 777525 - RNA, 19 nt, Human
gcagguagagacagcagcc

SEQ ID NO: 777526 - RNA, 22 nt, Human
cauaguaaauaaugcagaugau

SEQ ID NO: 777527 - RNA, 22 nt, Human
cauuagaagaacaguuauauua

SEQ ID NO: 777528 - RNA, 22 nt, Human
ucuggucccugcucacuucuug

SEQ ID NO: 777529 - RNA, 22 nt, Human
gcugugcagucuuuggugugcc

SEQ ID NO: 777530 - RNA, 22 nt, Human
cuggcucugggccucagacacu

SEQ ID NO: 777531 - RNA, 22 nt, Human
acaagguugauucuggcaucug

SEQ ID NO: 777532 - RNA, 22 nt, Human
acagcagaccccagugccaugg

SEQ ID NO: 777533 - RNA, 22 nt, Human
ucagggaaaagucacacugggu

SEQ ID NO: 777534 - RNA, 22 nt, Human
aaggcuuucagcuaacuugauu

SEQ ID NO: 777535 - RNA, 22 nt, Human
gcaggcuugcccggccuccuuc

SEQ ID NO: 777536 - RNA, 22 nt, Human
cucugcagauucaucccuucac

SEQ ID NO: 777537 - RNA, 22 nt, Human
auuuggaaaagcgguaacuugc

SEQ ID NO: 777538 - RNA, 22 nt, Human
caguucaaaauuuugaagaagg

SEQ ID NO: 777539 - RNA, 22 nt, Human
agcgggcagaaguggggucugc

SEQ ID NO: 777540 - RNA, 17 nt, Human
gagugcagacacaagca

SEQ ID NO: 777541 - RNA, 23 nt, Human
agggccaggugcggaaacagcuc

SEQ ID NO: 777542 - RNA, 22 nt, Human
uucagugugccuaagucaguug

SEQ ID NO: 777543 - RNA, 22 nt, Human
cccagcagggucucugugucua

SEQ ID NO: 777544 - RNA, 22 nt, Human
uuacaaugagaaaugguuggca

SEQ ID NO: 777545 - RNA, 22 nt, Human
caauucaaguugaguacagcuu

SEQ ID NO: 777546 - RNA, 22 nt, Human
aguccaagguucauggcacaga

SEQ ID NO: 777547 - RNA, 22 nt, Human
ccugggaggcggagguugcagu

SEQ ID NO: 777548 - RNA, 22 nt, Human
cccaggaggcggagguuguggu

SEQ ID NO: 777549 - RNA, 22 nt, Human
uguggccuccuguuccugggua

SEQ ID NO: 777550 - RNA, 22 nt, Human
gcauauuuucacaagcucuugg

SEQ ID NO: 777551 - RNA, 20 nt, Human
ucagguagaucuuugagguc

SEQ ID NO: 777552 - RNA, 20 nt, Human
aaguuuucuccaaauacagu

SEQ ID NO: 777553 - RNA, 22 nt, Human
aggaagaacagauaauggacgc

SEQ ID NO: 777554 - RNA, 22 nt, Human
cugggcugcggugguagguugu

SEQ ID NO: 777555 - RNA, 22 nt, Human
cucugcaugccuugcucagaca

SEQ ID NO: 777556 - RNA, 22 nt, Human
auguaugagagauucuuuuauu

SEQ ID NO: 777557 - RNA, 22 nt, Human
ggguaaaggucgcccucaaggu

SEQ ID NO: 777558 - RNA, 22 nt, Human
auuagcaaguuuuccagcuaau

SEQ ID NO: 777559 - RNA, 22 nt, Human
auucccacagcugguauaaaua

SEQ ID NO: 777560 - RNA, 22 nt, Human
ugcuccagcaacaggcuuagcu

SEQ ID NO: 777561 - RNA, 22 nt, Human
agugacagauuaccggcagagc

SEQ ID NO: 777562 - RNA, 22 nt, Human
ccacuugacaauaaacugagcu

SEQ ID NO: 777563 - RNA, 22 nt, Human
acaugcuuuaucggauugacac

SEQ ID NO: 777564 - RNA, 22 nt, Human
ucuguuauacagucuguggcac

SEQ ID NO: 777565 - RNA, 22 nt, Human
ucagaagcauccauuucaccac

SEQ ID NO: 777566 - RNA, 22 nt, Human
auaagcagggucaaaugccuac

SEQ ID NO: 777567 - RNA, 22 nt, Human
uccagagagccacggacagggg

SEQ ID NO: 777568 - RNA, 22 nt, Human
uucuuucugucaugguguacug

SEQ ID NO: 777569 - RNA, 22 nt, Human
ucuagaauuuugccauauagcu

SEQ ID NO: 777570 - RNA, 22 nt, Human
ccugggcuuugcuggcaaggcc

SEQ ID NO: 777571 - RNA, 22 nt, Human
uuacaacuugcagaggauguug

SEQ ID NO: 777572 - RNA, 19 nt, Human
gcuuuggagggagguucua

SEQ ID NO: 777573 - RNA, 22 nt, Human
ccagucaaaaggaagucaaugu

SEQ ID NO: 777574 - RNA, 20 nt, Human
agaggaggauuauuuuauuc

SEQ ID NO: 777575 - RNA, 22 nt, Human
ugucuguuauugguguauaaga

SEQ ID NO: 777576 - RNA, 22 nt, Human
aaagccaugaauguuauagagg

SEQ ID NO: 777577 - RNA, 22 nt, Human
gcugucaccaaagcaggcacug

SEQ ID NO: 777578 - RNA, 22 nt, Human
uguuuauaaauuuucuugccau

SEQ ID NO: 777579 - RNA, 22 nt, Human
guggugcaggaagcaucuggcu

SEQ ID NO: 777580 - RNA, 22 nt, Human
ucugcacaucccccaaaguauu

SEQ ID NO: 777581 - RNA, 22 nt, Human
acuuaacagacauuauuuaccu

SEQ ID NO: 777582 - RNA, 22 nt, Human
cagguucucagaaggcagucac

SEQ ID NO: 777583 - RNA, 22 nt, Human
aaagaacaaauuagcuguuuua

SEQ ID NO: 777584 - RNA, 22 nt, Human
aggccccaaagcagugcaagua

SEQ ID NO: 777585 - RNA, 22 nt, Human
aagacaauuuauguuaggguca

SEQ ID NO: 777586 - RNA, 17 nt, Human
uccagccuccucugcug

SEQ ID NO: 777587 - RNA, 22 nt, Human
aagugguuauuuugaucuagaa

SEQ ID NO: 777588 - RNA, 22 nt, Human
cagagaagaaagugacuauaau

SEQ ID NO: 777589 - RNA, 22 nt, Human
ugcuucugggcaaaugugugug

SEQ ID NO: 777590 - RNA, 22 nt, Human
agcagcagggacaaaggaacag

SEQ ID NO: 777591 - RNA, 22 nt, Human
cacuuuauaugcauuaccucau

SEQ ID NO: 777592 - RNA, 22 nt, Human
ugccucugcugcuguggcauca

SEQ ID NO: 777593 - RNA, 22 nt, Human
acaauauaguccaugagcaugc

SEQ ID NO: 777594 - RNA, 22 nt, Human
uauggcuuuucauuccuaugug

SEQ ID NO: 777595 - RNA, 22 nt, Human
cagacagggcccugugauggua

SEQ ID NO: 777596 - RNA, 21 nt, Human
ccaccaggucuucugcucggg

SEQ ID NO: 777597 - RNA, 21 nt, Human
uccagcugcacaagcaugggg

SEQ ID NO: 777598 - RNA, 22 nt, Human
cccuaaggcagcccagucugug

SEQ ID NO: 777599 - RNA, 22 nt, Human
auuacaacaagaaaaggguaag

SEQ ID NO: 777600 - RNA, 22 nt, Human
uguuaaggagacacaugaaaaa

SEQ ID NO: 777601 - RNA, 22 nt, Human
uugcuucauuaaguucucacag

SEQ ID NO: 777602 - RNA, 22 nt, Human
ucucugucuuuguugucuucac

SEQ ID NO: 777603 - RNA, 23 nt, Human
ugcaggacuacucgagcacugcu

SEQ ID NO: 777604 - RNA, 22 nt, Human
agccacagccugacuuaacugu

SEQ ID NO: 777605 - RNA, 22 nt, Human
uaauguuuuucucaacauugcu

SEQ ID NO: 777606 - RNA, 22 nt, Human
gccuggaggaauguagcugagg

SEQ ID NO: 777607 - RNA, 20 nt, Human
cuggaguguagcaguggcug

SEQ ID NO: 777608 - RNA, 22 nt, Human
uauagagcuuuggcauugauua

SEQ ID NO: 777609 - RNA, 22 nt, Human
ugaguagaccucacgugucaga

SEQ ID NO: 777610 - RNA, 22 nt, Human
ccauuacuuagaaaggaacuga

SEQ ID NO: 777611 - RNA, 22 nt, Human
uccaggcuagccugguagagaa

SEQ ID NO: 777612 - RNA, 22 nt, Human
ggugcugacuucacagucuuac

SEQ ID NO: 777613 - RNA, 20 nt, Human
gcuucuuuucuggcccauga

SEQ ID NO: 777614 - RNA, 22 nt, Human
uucugcuuauucaaaugaucuu

SEQ ID NO: 777615 - RNA, 22 nt, Human
cuucagcugcaguuauguuuag

SEQ ID NO: 777616 - RNA, 22 nt, Human
agacaaguucugugggucaccu

SEQ ID NO: 777617 - RNA, 22 nt, Human
agcugccauccuguucagcacc

SEQ ID NO: 777618 - RNA, 22 nt, Human
uaguuaggggaaaaacgacagg

SEQ ID NO: 777619 - RNA, 22 nt, Human
ugcaggaggauuuuguggagcu

SEQ ID NO: 777620 - RNA, 22 nt, Human
aggcaggauugcugacaacaau

SEQ ID NO: 777621 - RNA, 22 nt, Human
acacacagguaaaggagccugg

SEQ ID NO: 777622 - RNA, 22 nt, Human
ucaguuuuaagguuugagaauu

SEQ ID NO: 777623 - RNA, 22 nt, Human
uccugaagaugaaaagagaggu

SEQ ID NO: 777624 - RNA, 22 nt, Human
ccaugcauggcacuggacuggg

SEQ ID NO: 777625 - RNA, 22 nt, Human
acauuuacauuuucucuggccu

SEQ ID NO: 777626 - RNA, 21 nt, Human
uguaacaaaauacugcagauu

SEQ ID NO: 777627 - RNA, 22 nt, Human
uuucuuugagucucaguuugcu

SEQ ID NO: 777628 - RNA, 22 nt, Human
cuggucugagggcucuugaggc

SEQ ID NO: 777629 - RNA, 22 nt, Human
uucacaauggcaaaccauuaaa

SEQ ID NO: 777630 - RNA, 22 nt, Human
cuccagagggucagacucugag

SEQ ID NO: 777631 - RNA, 22 nt, Human
ggcuccacccugcuuccagaag

SEQ ID NO: 777632 - RNA, 22 nt, Human
gggaagcaucugaggguccacu

SEQ ID NO: 777633 - RNA, 22 nt, Human
accagaggcucugccaccucca

SEQ ID NO: 777634 - RNA, 22 nt, Human
uuuauucacucauucagccagu

SEQ ID NO: 777635 - RNA, 22 nt, Human
ucagaagcugguguccuuugaa

SEQ ID NO: 777636 - RNA, 23 nt, Human
augugugggaggucagagagcca

SEQ ID NO: 777637 - RNA, 22 nt, Human
gcucucuggguggugggcaaca

SEQ ID NO: 777638 - RNA, 22 nt, Human
uucagagguagagaggaucuug

SEQ ID NO: 777639 - RNA, 23 nt, Human
auucaguugugagagaagacaca

SEQ ID NO: 777640 - RNA, 22 nt, Human
cuccucuccaucagcgccaccc

SEQ ID NO: 777641 - RNA, 22 nt, Human
cagcugugagagugcauugaag

SEQ ID NO: 777642 - RNA, 22 nt, Human
aguuuaauauccuucaacuuuc

SEQ ID NO: 777643 - RNA, 22 nt, Human
cuuuccugccuuauucauucau

SEQ ID NO: 777644 - RNA, 22 nt, Human
ucagaaucucuggaggcuuggc

SEQ ID NO: 777645 - RNA, 22 nt, Human
uucugcuucugugugucccagg

SEQ ID NO: 777646 - RNA, 22 nt, Human
uacaugucuggguuuuguuucc

SEQ ID NO: 777647 - RNA, 22 nt, Human
uacccaggaggaaacugaggcu

SEQ ID NO: 777648 - RNA, 22 nt, Human
agcuuugggcagaagaggauuc

SEQ ID NO: 777649 - RNA, 22 nt, Human
cauuuacacuucuaaccacaag

SEQ ID NO: 777650 - RNA, 22 nt, Human
uuguaugcuguaggcaugcauu

SEQ ID NO: 777651 - RNA, 22 nt, Human
cagcagcuggugagacacagcc

SEQ ID NO: 777652 - RNA, 22 nt, Human
ggaccaggcaagcugaggcggg

SEQ ID NO: 777653 - RNA, 22 nt, Human
ucacuguaucauguugcacuua

SEQ ID NO: 777654 - RNA, 22 nt, Human
ugugaagauuaaguuacugggc

SEQ ID NO: 777655 - RNA, 22 nt, Human
agacacagguguaauuucugcu

SEQ ID NO: 777656 - RNA, 22 nt, Human
aacaaugccacauuaaguguau

SEQ ID NO: 777657 - RNA, 22 nt, Human
ccucacaguguucgugucagau

SEQ ID NO: 777658 - RNA, 22 nt, Human
cuccagugcacccagaggauuu

SEQ ID NO: 777659 - RNA, 22 nt, Human
ggaaagaggauaguggguaggu

SEQ ID NO: 777660 - RNA, 22 nt, Human
aauggagacuucaaaauggauu

SEQ ID NO: 777661 - RNA, 22 nt, Human
cuggaggaaucacagaaggcuu

SEQ ID NO: 777662 - RNA, 22 nt, Human
uugccagggaacagggagaggc

SEQ ID NO: 777663 - RNA, 17 nt, Human
aggcaaugacugugguu

SEQ ID NO: 777664 - RNA, 22 nt, Human
ugccccuucuacccgucucugu

SEQ ID NO: 777665 - RNA, 22 nt, Human
ccccauggcaacugcugggggu

SEQ ID NO: 777666 - RNA, 22 nt, Human
uuguguaaaugucugucuuucu

SEQ ID NO: 777667 - RNA, 22 nt, Human
gaaauauugggacucagagcuu

SEQ ID NO: 777668 - RNA, 22 nt, Human
gagaaagauggaaucuuacagg

SEQ ID NO: 777669 - RNA, 22 nt, Human
uuauaguauuagguacucaaca

SEQ ID NO: 777670 - RNA, 22 nt, Human
gcagcaggcacuuaccguugcu

SEQ ID NO: 777671 - RNA, 22 nt, Human
uauguguauguucauucaugca

SEQ ID NO: 777672 - RNA, 22 nt, Human
ggagaggcuuccagagucgugc

SEQ ID NO: 777673 - RNA, 22 nt, Human
acuguuaugauuuacacagucc

SEQ ID NO: 777674 - RNA, 22 nt, Human
ucucaucuauucacauuaacug

SEQ ID NO: 777675 - RNA, 22 nt, Human
aaugccaguguguugauuccag

SEQ ID NO: 777676 - RNA, 22 nt, Human
cacuguucaucaaaacugcucu

SEQ ID NO: 777677 - RNA, 22 nt, Human
cauuaucugccauugacaccau

SEQ ID NO: 777678 - RNA, 22 nt, Human
gaaauccaguucccuacucuua

SEQ ID NO: 777679 - RNA, 22 nt, Human
uaaaaaguugaaaggacuuauc

SEQ ID NO: 777680 - RNA, 23 nt, Human
uucuucucaauuaguugauucag

SEQ ID NO: 777681 - RNA, 22 nt, Human
ucugcagcaaccuuucaccucc

SEQ ID NO: 777682 - RNA, 22 nt, Human
ugaguguggggaaugucaugag

SEQ ID NO: 777683 - RNA, 22 nt, Human
gacauaaaauucaauaauuugu

SEQ ID NO: 777684 - RNA, 22 nt, Human
uuuuaugugucaaagcaguggu

SEQ ID NO: 777685 - RNA, 22 nt, Human
uucacauaggagcaugguuuuu

SEQ ID NO: 777686 - RNA, 22 nt, Human
uugcuucaguagcucuuuaaag

SEQ ID NO: 777687 - RNA, 21 nt, Human
cggcuucauuuucuucugguu

SEQ ID NO: 777688 - RNA, 22 nt, Human
ucuuuucuugcauuauugcacu

SEQ ID NO: 777689 - RNA, 22 nt, Human
gcagaacaacguaggaguggag

SEQ ID NO: 777690 - RNA, 21 nt, Human
uucaauacuauuucaauaguc

SEQ ID NO: 777691 - RNA, 22 nt, Human
agacaugcuuggaggagaagga

SEQ ID NO: 777692 - RNA, 22 nt, Human
cagaggcgaggcagcugaaccu

SEQ ID NO: 777693 - RNA, 22 nt, Human
ugguccuguguucuuccugccu

SEQ ID NO: 777694 - RNA, 22 nt, Human
ucccagggacuggaugaugcag

SEQ ID NO: 777695 - RNA, 22 nt, Human
ucuggaucucccucauccuggg

SEQ ID NO: 777696 - RNA, 22 nt, Human
acaaugaaccaaauuuaccaau

SEQ ID NO: 777697 - RNA, 23 nt, Human
ucagccucuuaggacuucucacc

SEQ ID NO: 777698 - RNA, 22 nt, Human
agucaggagcugcugcauugua

SEQ ID NO: 777699 - RNA, 22 nt, Human
agucuuacaugagaaagaaccu

SEQ ID NO: 777700 - RNA, 22 nt, Human
agugcugagugauugcaaagga

SEQ ID NO: 777701 - RNA, 22 nt, Human
aggcuuaaugaguuaaaucacu

SEQ ID NO: 777702 - RNA, 22 nt, Human
ccacagggucagccacucugca

SEQ ID NO: 777703 - RNA, 22 nt, Human
cccucucugacuucugaacuug

SEQ ID NO: 777704 - RNA, 17 nt, Human
acacugacaugccacac

SEQ ID NO: 777705 - RNA, 22 nt, Human
aucucugcguccccagcaucga

SEQ ID NO: 777706 - RNA, 22 nt, Human
uaaagugucugccucagcucag

SEQ ID NO: 777707 - RNA, 22 nt, Human
uuaaaucaguaggcuacuccuu

SEQ ID NO: 777708 - RNA, 22 nt, Human
agaagccagcuucagcugcccg

SEQ ID NO: 777709 - RNA, 22 nt, Human
agcacccuggggaagcacaaag

SEQ ID NO: 777710 - RNA, 22 nt, Human
uucuuaauaccuauuuucuacc

SEQ ID NO: 777711 - RNA, 22 nt, Human
accuacugcuccacagugacua

SEQ ID NO: 777712 - RNA, 22 nt, Human
accaugaucugcucugguguuu

SEQ ID NO: 777713 - RNA, 22 nt, Human
cucugggcggcccaggccaacc

SEQ ID NO: 777714 - RNA, 22 nt, Human
uggcuucuugaucuuggacuug

SEQ ID NO: 777715 - RNA, 22 nt, Human
gaggaacuuaugauauucuacu

SEQ ID NO: 777716 - RNA, 22 nt, Human
ggugauuuucgaguuucauguu

SEQ ID NO: 777717 - RNA, 22 nt, Human
aauguucucaacaaaaggaagc

SEQ ID NO: 777718 - RNA, 22 nt, Human
ugcuccugagugugcaggagau

SEQ ID NO: 777719 - RNA, 22 nt, Human
auucugaguccaugggggcagg

SEQ ID NO: 777720 - RNA, 22 nt, Human
ucugucuacagggagaaugaua

SEQ ID NO: 777721 - RNA, 22 nt, Human
uauaucuuauaugugcagguac

SEQ ID NO: 777722 - RNA, 22 nt, Human
gcuggccaggaagagucucaga

SEQ ID NO: 777723 - RNA, 22 nt, Human
ugaagggcaaccccaggcccag

SEQ ID NO: 777724 - RNA, 22 nt, Human
ucuucauggucugguucuccag

SEQ ID NO: 777725 - RNA, 22 nt, Human
agcauacacccuaaacugcuua

SEQ ID NO: 777726 - RNA, 22 nt, Human
guuucucaguuuggucugcaga

SEQ ID NO: 777727 - RNA, 22 nt, Human
aguaauaaacucuuuuuaucuc

SEQ ID NO: 777728 - RNA, 22 nt, Human
ucuaaccuuguggucugcuggu

SEQ ID NO: 777729 - RNA, 22 nt, Human
aaaaugaauaaguuaacccagg

SEQ ID NO: 777730 - RNA, 22 nt, Human
uuguaacagguacuaaauaacu

SEQ ID NO: 777731 - RNA, 22 nt, Human
agcuuguguuuuucuaaguauc

SEQ ID NO: 777732 - RNA, 22 nt, Human
uuggaaucauucuuaaaggucu

SEQ ID NO: 777733 - RNA, 22 nt, Human
auccuuuaucuuuccuaggaau

SEQ ID NO: 777734 - RNA, 22 nt, Human
uuuauccauaucauuaaaaucu

SEQ ID NO: 777735 - RNA, 22 nt, Human
uccuggggcugcaaggccuguc

SEQ ID NO: 777736 - RNA, 22 nt, Human
agccuggaccaggggccucaga

SEQ ID NO: 777737 - RNA, 22 nt, Human
aguccagggcucucugugggau

SEQ ID NO: 777738 - RNA, 22 nt, Human
gagcugggucuccaccuuggca

SEQ ID NO: 777739 - RNA, 22 nt, Human
auagaauucuuugaaauuuaug

SEQ ID NO: 777740 - RNA, 22 nt, Human
uccaggggacacuguuucucca

SEQ ID NO: 777741 - RNA, 22 nt, Human
uggagacucagaaggggaagca

SEQ ID NO: 777742 - RNA, 22 nt, Human
ucacaguucaacuaguucagau

SEQ ID NO: 777743 - RNA, 22 nt, Human
uguccccuuucuuuccuucgua

SEQ ID NO: 777744 - RNA, 22 nt, Human
agucccagcucugccacuuacu

SEQ ID NO: 777745 - RNA, 20 nt, Human
gccagcacagggagcaguuc

SEQ ID NO: 777746 - RNA, 22 nt, Human
cucccuggucuuucccaucauu

SEQ ID NO: 777747 - RNA, 22 nt, Human
gaguuacauggacauucucucc

SEQ ID NO: 777748 - RNA, 22 nt, Human
ucugagcacaucacacagcuca

SEQ ID NO: 777749 - RNA, 22 nt, Human
guuuucugauuagcaaaucuga

SEQ ID NO: 777750 - RNA, 22 nt, Human
gcaauacuaagugacuuuuggg

SEQ ID NO: 777751 - RNA, 22 nt, Human
ugcagccaucuuucuuggagga

SEQ ID NO: 777752 - RNA, 22 nt, Human
ucuuuggcacuucuguuuuaag

SEQ ID NO: 777753 - RNA, 22 nt, Human
cucagaaguucagccuagagua

SEQ ID NO: 777754 - RNA, 22 nt, Human
cauguauagacacucauacagu

SEQ ID NO: 777755 - RNA, 22 nt, Human
acagugcauuauugcugaaugc

SEQ ID NO: 777756 - RNA, 22 nt, Human
aaacaguuucuaaucauggaga

SEQ ID NO: 777757 - RNA, 22 nt, Human
acacagaugcauuacacaucua

SEQ ID NO: 777758 - RNA, 22 nt, Human
acuuuguugaugaaauaguuuu

SEQ ID NO: 777759 - RNA, 22 nt, Human
aaucagaauuuguccccugagu

SEQ ID NO: 777760 - RNA, 22 nt, Human
guggcccuuggaguugugaccu

SEQ ID NO: 777761 - RNA, 22 nt, Human
cagggcucaggcucugggauuc

SEQ ID NO: 777762 - RNA, 22 nt, Human
ucagaggaauuugcuuuucaug

SEQ ID NO: 777763 - RNA, 22 nt, Human
ugaagaaacagaccaagaggau

SEQ ID NO: 777764 - RNA, 22 nt, Human
gggcuugcugauuugggcagga

SEQ ID NO: 777765 - RNA, 22 nt, Human
cccaaaguacaaguaaacaugu

SEQ ID NO: 777766 - RNA, 22 nt, Human
ucaagcaaaguuuagcugguua

SEQ ID NO: 777767 - RNA, 22 nt, Human
cuauaaaucuacccagcauugg

SEQ ID NO: 777768 - RNA, 22 nt, Human
ucugguccccauuccagguggg

SEQ ID NO: 777769 - RNA, 22 nt, Human
cagaccagaaggaagccgacaa

SEQ ID NO: 777770 - RNA, 23 nt, Human
agggcaugaagcagaggacgugg

SEQ ID NO: 777771 - RNA, 22 nt, Human
gccaggagcccugggcaaguuc

SEQ ID NO: 777772 - RNA, 22 nt, Human
cugcccucuagggaugcacugg

SEQ ID NO: 777773 - RNA, 22 nt, Human
uaacaauggaguuuugagaaag

SEQ ID NO: 777774 - RNA, 22 nt, Human
uuuuccucugcagagcaguuag

SEQ ID NO: 777775 - RNA, 22 nt, Human
agguaaaauagauaguauuucu

SEQ ID NO: 777776 - RNA, 22 nt, Human
aaccauuugccauuaucuuaag

SEQ ID NO: 777777 - RNA, 21 nt, Human
acugugacuggguguaugggu

SEQ ID NO: 777778 - RNA, 22 nt, Human
ccccacacucuuuacauucaua

SEQ ID NO: 777779 - RNA, 22 nt, Human
ccacaggggcccacgagccgcu

SEQ ID NO: 777780 - RNA, 22 nt, Human
uacaaguagcucagguuuucug

SEQ ID NO: 777781 - RNA, 22 nt, Human
uuugucaccaguggcuuuggua

SEQ ID NO: 777782 - RNA, 22 nt, Human
uuauuaaaaugcggauuuggcu

SEQ ID NO: 777783 - RNA, 22 nt, Human
ggggcacuuuacugccucaucu

SEQ ID NO: 777784 - RNA, 22 nt, Human
gagaaggaugaggaaaugguau

SEQ ID NO: 777785 - RNA, 22 nt, Human
gaugagaauguuuaucaaaugc

SEQ ID NO: 777786 - RNA, 22 nt, Human
gcagaggugcucaguggcagaa

SEQ ID NO: 777787 - RNA, 22 nt, Human
gcacauaacugaccacaucuaa

SEQ ID NO: 777788 - RNA, 18 nt, Human
ugcccagaaaagcaggga

SEQ ID NO: 777789 - RNA, 22 nt, Human
accuuucacgguaucagacauc

SEQ ID NO: 777790 - RNA, 22 nt, Human
aucaauaucagaucagacagga

SEQ ID NO: 777791 - RNA, 22 nt, Human
caggaggaacaagagguucugg

SEQ ID NO: 777792 - RNA, 22 nt, Human
gcucucagcccacugaggggaa

SEQ ID NO: 777793 - RNA, 22 nt, Human
acucaggccuccuucuguccuu

SEQ ID NO: 777794 - RNA, 19 nt, Human
uuugagaaguuauuaucua

SEQ ID NO: 777795 - RNA, 22 nt, Human
acagagcacauagauuggaguu

SEQ ID NO: 777796 - RNA, 20 nt, Human
uacaacaaguagagacauac

SEQ ID NO: 777797 - RNA, 22 nt, Human
uugagagaaaaaauuuauuggu

SEQ ID NO: 777798 - RNA, 22 nt, Human
uucuuaggacuaguauagcaug

SEQ ID NO: 777799 - RNA, 22 nt, Human
cagcaucucauucauucauguu

SEQ ID NO: 777800 - RNA, 22 nt, Human
gagaggugaaauaguuguccgg

SEQ ID NO: 777801 - RNA, 22 nt, Human
aagguauuauuugcaaucauuu

SEQ ID NO: 777802 - RNA, 22 nt, Human
ucagauccgagugugccaagga

SEQ ID NO: 777803 - RNA, 22 nt, Human
cacaauuuuaauacacagucaa

SEQ ID NO: 777804 - RNA, 22 nt, Human
aauguguaugaggaagagagaa

SEQ ID NO: 777805 - RNA, 22 nt, Human
aaagcacagggugcuagagagu

SEQ ID NO: 777806 - RNA, 22 nt, Human
uugcauguuauuuaaucuguau

SEQ ID NO: 777807 - RNA, 22 nt, Human
acaggcccagcucuucaccaga

SEQ ID NO: 777808 - RNA, 22 nt, Human
ugagcagaagauuggaacuuac

SEQ ID NO: 777809 - RNA, 22 nt, Human
cagcacaggcaggggaacuaua

SEQ ID NO: 777810 - RNA, 23 nt, Human
uucauuuaggaguucauaagagc

SEQ ID NO: 777811 - RNA, 22 nt, Human
gucugccugcuaguggcugccu

SEQ ID NO: 777812 - RNA, 22 nt, Human
guccuggugccaccugcgggau

SEQ ID NO: 777813 - RNA, 22 nt, Human
auauggagaacucaaaaaguga

SEQ ID NO: 777814 - RNA, 22 nt, Human
aucaaaguaucucaauauggua

SEQ ID NO: 777815 - RNA, 22 nt, Human
uaugcauauagaugcacacaca

SEQ ID NO: 777816 - RNA, 22 nt, Human
cugucauuugucugcucccucu

SEQ ID NO: 777817 - RNA, 22 nt, Human
ugauucaagauugguuagcugu

SEQ ID NO: 777818 - RNA, 22 nt, Human
gaagcaguauccugacagcacc

SEQ ID NO: 777819 - RNA, 22 nt, Human
aagagguggguuggacagauac

SEQ ID NO: 777820 - RNA, 20 nt, Human
cacaggaaagcuacucaguu

SEQ ID NO: 777821 - RNA, 22 nt, Human
agggcagaaaucgauuacaccu

SEQ ID NO: 777822 - RNA, 22 nt, Human
ccucagaguuggaaucacauuu

SEQ ID NO: 777823 - RNA, 22 nt, Human
ucuggcucucucaucacccaau

SEQ ID NO: 777824 - RNA, 22 nt, Human
cagggaugugaugagcugagcc

SEQ ID NO: 777825 - RNA, 22 nt, Human
uggcuccagauuuccugcugca

SEQ ID NO: 777826 - RNA, 22 nt, Human
ggagcuaggcaaagcucacgga

SEQ ID NO: 777827 - RNA, 22 nt, Human
uaaauaucaguccagcucuucc

SEQ ID NO: 777828 - RNA, 22 nt, Human
uacacaugcucagauuccugug

SEQ ID NO: 777829 - RNA, 22 nt, Human
acugucaugacguuugucaccc

SEQ ID NO: 777830 - RNA, 22 nt, Human
uuggaagaccagaggccuuguc

SEQ ID NO: 777831 - RNA, 22 nt, Human
guccucugaaagaugaaccaug

SEQ ID NO: 777832 - RNA, 22 nt, Human
caccaggagcaucuaggaggcg

SEQ ID NO: 777833 - RNA, 22 nt, Human
uagaaaugcaguguacuguguc

SEQ ID NO: 777834 - RNA, 22 nt, Human
ugucugugaccucuuaggcaag

SEQ ID NO: 777835 - RNA, 22 nt, Human
uccaauaacaucuaaaaacuua

SEQ ID NO: 777836 - RNA, 22 nt, Human
cacauaagaaaugaauaugaga

SEQ ID NO: 777837 - RNA, 22 nt, Human
auguacaguuucuagacucaaa

SEQ ID NO: 777838 - RNA, 22 nt, Human
acagaagcaaaagcaggaucuu

SEQ ID NO: 777839 - RNA, 23 nt, Human
gggcccagcacaggaccuggcag

SEQ ID NO: 777840 - RNA, 22 nt, Human
guccugggccugcugaggcuga

SEQ ID NO: 777841 - RNA, 21 nt, Human
gggcauccuuucccacccugc

SEQ ID NO: 777842 - RNA, 22 nt, Human
ccagcuccccucagcagguaau

SEQ ID NO: 777843 - RNA, 22 nt, Human
cauaacaccugauggcaaugau

SEQ ID NO: 777844 - RNA, 22 nt, Human
aaagcaauagguuaggucaaga

SEQ ID NO: 777845 - RNA, 22 nt, Human
ccugggaagaccggcagugggg

SEQ ID NO: 777846 - RNA, 22 nt, Human
caaggagaguaauugaaugaga

SEQ ID NO: 777847 - RNA, 22 nt, Human
aauuucagaccauuugcaauua

SEQ ID NO: 777848 - RNA, 22 nt, Human
gccuugggggugaaagaggcua

SEQ ID NO: 777849 - RNA, 22 nt, Human
ucuguuuuguaccagauacagc

SEQ ID NO: 777850 - RNA, 22 nt, Human
acucccacuccagaguagaagc

SEQ ID NO: 777851 - RNA, 22 nt, Human
aaacaguccucuuuauuuaguc

SEQ ID NO: 777852 - RNA, 22 nt, Human
gugugcagggcugccugugccg

SEQ ID NO: 777853 - RNA, 22 nt, Human
ccaggccaguguuugguccagg

SEQ ID NO: 777854 - RNA, 19 nt, Human
gcucagagccaugggggcu

SEQ ID NO: 777855 - RNA, 22 nt, Human
ccagcuaggcuugcacucuugu

SEQ ID NO: 777856 - RNA, 22 nt, Human
gaaggcacagauggcaguccac

SEQ ID NO: 777857 - RNA, 22 nt, Human
ccagagcuccagggcuacagaa

SEQ ID NO: 777858 - RNA, 18 nt, Human
aagcagacagcagacagu

SEQ ID NO: 777859 - RNA, 22 nt, Human
gcagugcuaaguagcuggccca

SEQ ID NO: 777860 - RNA, 22 nt, Human
uuuaugaacuacagauauaacu

SEQ ID NO: 777861 - RNA, 22 nt, Human
augcaaauuaacauauaguaga

SEQ ID NO: 777862 - RNA, 22 nt, Human
ucuggugucaguauucuuugaa

SEQ ID NO: 777863 - RNA, 22 nt, Human
uaaccuuuggugaaauauuaac

SEQ ID NO: 777864 - RNA, 21 nt, Human
ugaaagaaggugcagucugaa

SEQ ID NO: 777865 - RNA, 22 nt, Human
ccacuugaaacuuaguggcaua

SEQ ID NO: 777866 - RNA, 22 nt, Human
agacagaacagaauaauuguug

SEQ ID NO: 777867 - RNA, 22 nt, Human
cuugggcucagacuugaggaca

SEQ ID NO: 777868 - RNA, 22 nt, Human
gccucugcucggacuuugccuc

SEQ ID NO: 777869 - RNA, 22 nt, Human
aagaccagaggauauaaccaga

SEQ ID NO: 777870 - RNA, 22 nt, Human
cauuggcaccucacaggauaga

SEQ ID NO: 777871 - RNA, 22 nt, Human
gccuuggccuuccuaggccuga

SEQ ID NO: 777872 - RNA, 22 nt, Human
gagcaacacauugaaugaggau

SEQ ID NO: 777873 - RNA, 22 nt, Human
uaaagauguucucauuucauag

SEQ ID NO: 777874 - RNA, 22 nt, Human
ucugccugcuucuucauagucu

SEQ ID NO: 777875 - RNA, 20 nt, Human
gucaggauuaguaaacucug

SEQ ID NO: 777876 - RNA, 22 nt, Human
gcugcccaggguggagccggcu

SEQ ID NO: 777877 - RNA, 22 nt, Human
ggcugugcugagggggaagccc

SEQ ID NO: 777878 - RNA, 22 nt, Human
gcauggccuccagccaacagca

SEQ ID NO: 777879 - RNA, 20 nt, Human
uucugagaguucacagcccc

SEQ ID NO: 777880 - RNA, 22 nt, Human
augugcuuggaaaagcaguggu

SEQ ID NO: 777881 - RNA, 22 nt, Human
uguaucuuagugugaaaauauu

SEQ ID NO: 777882 - RNA, 22 nt, Human
caggauaaauaguaaauguaag

SEQ ID NO: 777883 - RNA, 18 nt, Human
ucuaggagaguaccuacc

SEQ ID NO: 777884 - RNA, 22 nt, Human
ucaaacauaggcacacauucag

SEQ ID NO: 777885 - RNA, 22 nt, Human
cuguguguuuauaucauuuccu

SEQ ID NO: 777886 - RNA, 22 nt, Human
gaaacguuaaaccauauguaau

SEQ ID NO: 777887 - RNA, 22 nt, Human
agaaggcuggcccuggguggcc

SEQ ID NO: 777888 - RNA, 22 nt, Human
caggcacagaguuauucauuua

SEQ ID NO: 777889 - RNA, 22 nt, Human
uauauaagauggguaggcuugu

SEQ ID NO: 777890 - RNA, 22 nt, Human
aauaaugaacauuuaaaaccug

SEQ ID NO: 777891 - RNA, 22 nt, Human
guauuucccugaguucugugag

SEQ ID NO: 777892 - RNA, 22 nt, Human
aacccaggagacggaguuugug

SEQ ID NO: 777893 - RNA, 23 nt, Human
cagugggaggacugagauaaaac

SEQ ID NO: 777894 - RNA, 22 nt, Human
aauccugaccugggcaugcuug

SEQ ID NO: 777895 - RNA, 22 nt, Human
uugaaugaguguuuuacucaug

SEQ ID NO: 777896 - RNA, 22 nt, Human
ucagcccugggcuuccucaugg

SEQ ID NO: 777897 - RNA, 22 nt, Human
ucucagaggucuucagccucug

SEQ ID NO: 777898 - RNA, 22 nt, Human
ggcaugcaaaugugggugaccu

SEQ ID NO: 777899 - RNA, 22 nt, Human
acugagguuucauuuuaucgcu

SEQ ID NO: 777900 - RNA, 22 nt, Human
uguaaguaguaauggaaggaca

SEQ ID NO: 777901 - RNA, 22 nt, Human
caugcauucagaaucucucaca

SEQ ID NO: 777902 - RNA, 22 nt, Human
cacaugugcaguuacaugaauu

SEQ ID NO: 777903 - RNA, 22 nt, Human
gcauggaauucccuuaugggcc

SEQ ID NO: 777904 - RNA, 22 nt, Human
cuggcagagucugcugucugca

SEQ ID NO: 777905 - RNA, 22 nt, Human
ccucuuugacaaguaccugccc

SEQ ID NO: 777906 - RNA, 18 nt, Human
aggccugcccagcacugu

SEQ ID NO: 777907 - RNA, 22 nt, Human
gccacauagaggaggauauuaa

SEQ ID NO: 777908 - RNA, 22 nt, Human
ggacugagcugacaucuguugg

SEQ ID NO: 777909 - RNA, 22 nt, Human
aucuuggauugacuggcucugc

SEQ ID NO: 777910 - RNA, 22 nt, Human
aucagaccugucuccucuugcc

SEQ ID NO: 777911 - RNA, 22 nt, Human
cauuccagaugaggccaggccc

SEQ ID NO: 777912 - RNA, 22 nt, Human
cagugucugggacagaaaguca

SEQ ID NO: 777913 - RNA, 22 nt, Human
cuaucaaacagccauuaauaua

SEQ ID NO: 777914 - RNA, 21 nt, Human
ucagcccaggugucuuugccc

SEQ ID NO: 777915 - RNA, 22 nt, Human
caggcgagggcccugaggagcc

SEQ ID NO: 777916 - RNA, 22 nt, Human
caagcagagagguuagaacaca

SEQ ID NO: 777917 - RNA, 22 nt, Human
caaaucuccuuaaagguaaaau

SEQ ID NO: 777918 - RNA, 23 nt, Human
agcugggccagguggucagaccu

SEQ ID NO: 777919 - RNA, 22 nt, Human
agggagaagguccaugccuguc

SEQ ID NO: 777920 - RNA, 22 nt, Human
uucagcuugaaucuggcuuuga

SEQ ID NO: 777921 - RNA, 22 nt, Human
gcggagggagauaggccuugcu

SEQ ID NO: 777922 - RNA, 22 nt, Human
ggccugaaauaaaguagcagaa

SEQ ID NO: 777923 - RNA, 22 nt, Human
gcuggcuggaguaaggagggag

SEQ ID NO: 777924 - RNA, 22 nt, Human
ugcauuuaauagaugcucccug

SEQ ID NO: 777925 - RNA, 22 nt, Human
cuacauuuguucuauagcuuuu

SEQ ID NO: 777926 - RNA, 22 nt, Human
ugaucagucccaugaucuucca

SEQ ID NO: 777927 - RNA, 22 nt, Human
acaguguuuauguacagauugu

SEQ ID NO: 777928 - RNA, 22 nt, Human
aagugucuuaacuccuuuuggg

SEQ ID NO: 777929 - RNA, 22 nt, Human
ucucugugacugcagcuuugca

SEQ ID NO: 777930 - RNA, 22 nt, Human
acauucuaaagcaugcucagga

SEQ ID NO: 777931 - RNA, 22 nt, Human
agauaucugcaauauaauuuaa

SEQ ID NO: 777932 - RNA, 22 nt, Human
gcuucucauguuuauuuuuaca

SEQ ID NO: 777933 - RNA, 22 nt, Human
ugcucccagcuccugcagcaac

SEQ ID NO: 777934 - RNA, 22 nt, Human
cugucccauacuaucuggguga

SEQ ID NO: 777935 - RNA, 22 nt, Human
uuuucuaacaucuaguaauuug

SEQ ID NO: 777936 - RNA, 22 nt, Human
uuucuuuguuguuaucacauca

SEQ ID NO: 777937 - RNA, 22 nt, Human
aggcuccaccccgccagaccuu

SEQ ID NO: 777938 - RNA, 22 nt, Human
cccuggaggagcuuagagcuug

SEQ ID NO: 777939 - RNA, 22 nt, Human
cuggcugacacaaagguaucga

SEQ ID NO: 777940 - RNA, 22 nt, Human
uugcaacuaaaagaacuugaca

SEQ ID NO: 777941 - RNA, 22 nt, Human
aggcaucugaguuugcaagcuu

SEQ ID NO: 777942 - RNA, 22 nt, Human
gcagagugaagcaguauggaaa

SEQ ID NO: 777943 - RNA, 18 nt, Human
uguugaaacuucagguaa

SEQ ID NO: 777944 - RNA, 22 nt, Human
uggggaccagauuagaccaugg

SEQ ID NO: 777945 - RNA, 22 nt, Human
caugcagcagaauaaugacuau

SEQ ID NO: 777946 - RNA, 22 nt, Human
uucacacagcaacuguaugaau

SEQ ID NO: 777947 - RNA, 22 nt, Human
uguccuccagcagcaugguaug

SEQ ID NO: 777948 - RNA, 22 nt, Human
aguguauucagaauguagcaaa

SEQ ID NO: 777949 - RNA, 22 nt, Human
uggcagauuuucucuggaggag

SEQ ID NO: 777950 - RNA, 22 nt, Human
aagggcagaaagggacgcuuug

SEQ ID NO: 777951 - RNA, 22 nt, Human
uggaagagaaaauccacccuua

SEQ ID NO: 777952 - RNA, 22 nt, Human
agcauccagaugccugauguca

SEQ ID NO: 777953 - RNA, 22 nt, Human
ucacagaagcuugaagauuuuc

SEQ ID NO: 777954 - RNA, 22 nt, Human
ugugcaguuucuauguugucca

SEQ ID NO: 777955 - RNA, 22 nt, Human
ucuuuagagccuuuccucccga

SEQ ID NO: 777956 - RNA, 22 nt, Human
ggagcaagucccaggcacuagu

SEQ ID NO: 777957 - RNA, 22 nt, Human
aagaaugauuacaaagcaacga

SEQ ID NO: 777958 - RNA, 22 nt, Human
ugcaggcauuggugagagaagc

SEQ ID NO: 777959 - RNA, 22 nt, Human
cccagagcugggugggcagcgg

SEQ ID NO: 777960 - RNA, 22 nt, Human
ucccugcugagagugcucuccc

SEQ ID NO: 777961 - RNA, 22 nt, Human
ugcacauucacuuagguauugu

SEQ ID NO: 777962 - RNA, 22 nt, Human
augucacaucugggauggcccu

SEQ ID NO: 777963 - RNA, 22 nt, Human
acuuuacaauauccugugacuu

SEQ ID NO: 777964 - RNA, 22 nt, Human
ugaggcaggaguuaaugugcuc

SEQ ID NO: 777965 - RNA, 22 nt, Human
guggggggacguuggucacuuu

SEQ ID NO: 777966 - RNA, 22 nt, Human
ugucccaggcugaaguacagug

SEQ ID NO: 777967 - RNA, 22 nt, Human
uauugaauuagacccuaaaaug

SEQ ID NO: 777968 - RNA, 23 nt, Human
ucugagcugucuuuucagcagaa

SEQ ID NO: 777969 - RNA, 22 nt, Human
acagcuguauucaaguugcaag

SEQ ID NO: 777970 - RNA, 22 nt, Human
ugcaauuuaugugcaagugguu

SEQ ID NO: 777971 - RNA, 22 nt, Human
gccaggcuggggggagaugucu

SEQ ID NO: 777972 - RNA, 22 nt, Human
gguuuuauagcaguacuaucag

SEQ ID NO: 777973 - RNA, 22 nt, Human
guccuuggcuucuuguugacug

SEQ ID NO: 777974 - RNA, 22 nt, Human
agggccugaggcugacggggag

SEQ ID NO: 777975 - RNA, 22 nt, Human
uggcaggaagacguggggcacc

SEQ ID NO: 777976 - RNA, 22 nt, Human
gugcauuccaccgugcagguug

SEQ ID NO: 777977 - RNA, 22 nt, Human
uauuagaaagcuuaauaucgug

SEQ ID NO: 777978 - RNA, 22 nt, Human
auaucuuuuagagcaagcuugu

SEQ ID NO: 777979 - RNA, 22 nt, Human
caugugcauccuuaaucucccu

SEQ ID NO: 777980 - RNA, 22 nt, Human
guggaggacaaaagaagccuuu

SEQ ID NO: 777981 - RNA, 22 nt, Human
ggaacauuuuuuaaggcagaaa

SEQ ID NO: 777982 - RNA, 22 nt, Human
cagggcuccccgcaccgcagcc

SEQ ID NO: 777983 - RNA, 22 nt, Human
gaggucaggcucaagcugggcc

SEQ ID NO: 777984 - RNA, 22 nt, Human
cuacauuuuucaccgagccucu

SEQ ID NO: 777985 - RNA, 22 nt, Human
gacauugaaguauuuuugucga

SEQ ID NO: 777986 - RNA, 22 nt, Human
gcagcaggugugcuuuuaauga

SEQ ID NO: 777987 - RNA, 23 nt, Human
gggagaugggaaaugaaggcucu

SEQ ID NO: 777988 - RNA, 22 nt, Human
guuaauaaagguauagaaucag

SEQ ID NO: 777989 - RNA, 22 nt, Human
caaggccaaagggccacuguca

SEQ ID NO: 777990 - RNA, 22 nt, Human
ggaagagccuggggugucaggc

SEQ ID NO: 777991 - RNA, 22 nt, Human
uguacagauugaucauggagag

SEQ ID NO: 777992 - RNA, 22 nt, Human
aauucagugucuggcacugcug

SEQ ID NO: 777993 - RNA, 22 nt, Human
cucacaggcaucucaucaggcu

SEQ ID NO: 777994 - RNA, 22 nt, Human
uugcauuguugcaaugaaguau

SEQ ID NO: 777995 - RNA, 22 nt, Human
auguuucaggcgaacuaacaug

SEQ ID NO: 777996 - RNA, 22 nt, Human
ccuaggaacccccaggcuucug

SEQ ID NO: 777997 - RNA, 22 nt, Human
ucagugcaaaaaaugggcuaga

SEQ ID NO: 777998 - RNA, 22 nt, Human
auucugcucccaggugaugcug

SEQ ID NO: 777999 - RNA, 22 nt, Human
caugaagucacuggagcuuuca

SEQ ID NO: 778000 - RNA, 22 nt, Human
cuggguggagccuggucaucug

SEQ ID NO: 778001 - RNA, 22 nt, Human
aguuauuacucuuuaacauauu

SEQ ID NO: 778002 - RNA, 22 nt, Human
ucagaggauuggacuuuuaugu

SEQ ID NO: 778003 - RNA, 22 nt, Human
cuccagccucaucuccuggcug

SEQ ID NO: 778004 - RNA, 22 nt, Human
uagcagagguaaguguggcaau

SEQ ID NO: 778005 - RNA, 22 nt, Human
aagaggcuggcauugaugguag

SEQ ID NO: 778006 - RNA, 22 nt, Human
caagggcucuuuugaggaaugu

SEQ ID NO: 778007 - RNA, 22 nt, Human
uaaguuuuaagcaaucugauaa

SEQ ID NO: 778008 - RNA, 22 nt, Human
acuguauuggaaauauagcaaa

SEQ ID NO: 778009 - RNA, 22 nt, Human
cucuggucaagcaaagagguuu

SEQ ID NO: 778010 - RNA, 22 nt, Human
agagcugucagcguuuuggcca

SEQ ID NO: 778011 - RNA, 22 nt, Human
augcgugcagggguccuccugg

SEQ ID NO: 778012 - RNA, 22 nt, Human
ccucagcucuucccugugcaca

SEQ ID NO: 778013 - RNA, 22 nt, Human
ggaaccaguggaaugauaugcu

SEQ ID NO: 778014 - RNA, 22 nt, Human
cagcugaauggcucccugcuaa

SEQ ID NO: 778015 - RNA, 22 nt, Human
aagaaugucguugguauuuuaa

SEQ ID NO: 778016 - RNA, 22 nt, Human
uccagggguaccggccaggcag

SEQ ID NO: 778017 - RNA, 22 nt, Human
gggagguucuguucgcacuuga

SEQ ID NO: 778018 - RNA, 22 nt, Human
ucuucaccaucaacagaaugaa

SEQ ID NO: 778019 - RNA, 22 nt, Human
agaaaguuuguuuuuauccaua

SEQ ID NO: 778020 - RNA, 22 nt, Human
uggccuccucgggcugacccug

SEQ ID NO: 778021 - RNA, 19 nt, Human
ccagcuggccugggaccuc

SEQ ID NO: 778022 - RNA, 18 nt, Human
augaucuuagcaaauauu

SEQ ID NO: 778023 - RNA, 19 nt, Human
ggagaagcccaggaauccu

SEQ ID NO: 778024 - RNA, 22 nt, Human
augacaaccugugagcugguau

SEQ ID NO: 778025 - RNA, 22 nt, Human
auaaagauuuuuaggcauuucu

SEQ ID NO: 778026 - RNA, 22 nt, Human
guuugcaguugucauccuccug

SEQ ID NO: 778027 - RNA, 22 nt, Human
ccaguuauccagcaugcugucu

SEQ ID NO: 778028 - RNA, 22 nt, Human
agcugaggcaugaugcuaucag

SEQ ID NO: 778029 - RNA, 22 nt, Human
acauuucagauucaugaaguga

SEQ ID NO: 778030 - RNA, 22 nt, Human
agaaugugggggaaaagagugu

SEQ ID NO: 778031 - RNA, 22 nt, Human
uggcucacuuccguggagaggu

SEQ ID NO: 778032 - RNA, 22 nt, Human
gaacauaacuauugugaauagu

SEQ ID NO: 778033 - RNA, 22 nt, Human
acucuaaugcuaauaguauuuu

SEQ ID NO: 778034 - RNA, 22 nt, Human
gugcauauauaugggagggagc

SEQ ID NO: 778035 - RNA, 22 nt, Human
ugaggccacuuccccacagccc

SEQ ID NO: 778036 - RNA, 22 nt, Human
gcagaaguuaaucgaaggccau

SEQ ID NO: 778037 - RNA, 22 nt, Human
ugcuucucaaaaggagguaggu

SEQ ID NO: 778038 - RNA, 22 nt, Human
gcagggcagcugaagcuaggug

SEQ ID NO: 778039 - RNA, 20 nt, Human
ccuucuccagcuuguucuug

SEQ ID NO: 778040 - RNA, 22 nt, Human
uacauuccaaaggaaacuggcu

SEQ ID NO: 778041 - RNA, 22 nt, Human
guguccugggcauuaggcuuag

SEQ ID NO: 778042 - RNA, 22 nt, Human
cagcuucuguuucuagccccug

SEQ ID NO: 778043 - RNA, 22 nt, Human
ugggcucaggaccccagaggcc

SEQ ID NO: 778044 - RNA, 22 nt, Human
uugcugccagcgcccugcaggg

SEQ ID NO: 778045 - RNA, 22 nt, Human
cagugagcacggccagagggga

SEQ ID NO: 778046 - RNA, 22 nt, Human
agagaaucuagaauguuuauac

SEQ ID NO: 778047 - RNA, 20 nt, Human
acuuggaacucauuuuucuu

SEQ ID NO: 778048 - RNA, 22 nt, Human
uuaaaaugcagauuaugacuca

SEQ ID NO: 778049 - RNA, 22 nt, Human
gaggggcacaguaaaggguccc

SEQ ID NO: 778050 - RNA, 18 nt, Human
ugaggcagucagugaugg

SEQ ID NO: 778051 - RNA, 22 nt, Human
aauaguaaaagauacagcuaau

SEQ ID NO: 778052 - RNA, 22 nt, Human
cagagcuggagggaacccuggc

SEQ ID NO: 778053 - RNA, 22 nt, Human
cucugggaauucugagcaagca

SEQ ID NO: 778054 - RNA, 22 nt, Human
ucuaugugcccuuugugugaug

SEQ ID NO: 778055 - RNA, 16 nt, Human
cuuccucuucacuggc

SEQ ID NO: 778056 - RNA, 22 nt, Human
agucuuagauaagugaccaaug

SEQ ID NO: 778057 - RNA, 22 nt, Human
ggccugagucccaccuggcugu

SEQ ID NO: 778058 - RNA, 22 nt, Human
cucagcaagauuaagcagcuug

SEQ ID NO: 778059 - RNA, 22 nt, Human
ccugaucaaguuuucuggcucc

SEQ ID NO: 778060 - RNA, 22 nt, Human
ccuuugguaacauuccaaccuu

SEQ ID NO: 778061 - RNA, 22 nt, Human
ucucuguggcaagcaugcugcu

SEQ ID NO: 778062 - RNA, 22 nt, Human
ugcaggaacugggagggauagu

SEQ ID NO: 778063 - RNA, 22 nt, Human
cugucuguagacauuuuugguu

SEQ ID NO: 778064 - RNA, 22 nt, Human
cucauagauuuagauagaucga

SEQ ID NO: 778065 - RNA, 22 nt, Human
ggcucugcuuccuggaauugug

SEQ ID NO: 778066 - RNA, 16 nt, Human
gacacaugggggaaaa

SEQ ID NO: 778067 - RNA, 22 nt, Human
caggcucacuuucucagucaca

SEQ ID NO: 778068 - RNA, 22 nt, Human
aaccuagaguugccuuuuuuaa

SEQ ID NO: 778069 - RNA, 22 nt, Human
caggugguuguuuggauucuaa

SEQ ID NO: 778070 - RNA, 20 nt, Human
uggcucucucuaguaagugg

SEQ ID NO: 778071 - RNA, 22 nt, Human
uuccuuaguguuagauucugug

SEQ ID NO: 778072 - RNA, 22 nt, Human
cagggcaggaauuugacauugc

SEQ ID NO: 778073 - RNA, 22 nt, Human
gauuucuucucucccaagagga

SEQ ID NO: 778074 - RNA, 22 nt, Human
aacuaaaagugugucucuugua

SEQ ID NO: 778075 - RNA, 22 nt, Human
cauucuuacacaauauuuuaau

SEQ ID NO: 778076 - RNA, 22 nt, Human
auugggaugccggcugauaaga

SEQ ID NO: 778077 - RNA, 23 nt, Human
ggggacagagggcagcccgcauc

SEQ ID NO: 778078 - RNA, 22 nt, Human
auucuccacacauccagaccuu

SEQ ID NO: 778079 - RNA, 22 nt, Human
cacagagauggucuggcaggug

SEQ ID NO: 778080 - RNA, 22 nt, Human
ugcccacauggugccauggcca

SEQ ID NO: 778081 - RNA, 22 nt, Human
agguccaggauuuguggggucu

SEQ ID NO: 778082 - RNA, 21 nt, Human
agacaugugaacuaaagguga

SEQ ID NO: 778083 - RNA, 22 nt, Human
guuuucaaggggauuuaacuga

SEQ ID NO: 778084 - RNA, 22 nt, Human
auguggccuaguauagaaauga

SEQ ID NO: 778085 - RNA, 22 nt, Human
uauauucuuaccaguguaugua

SEQ ID NO: 778086 - RNA, 22 nt, Human
uuccagauuucuacacaagacc

SEQ ID NO: 778087 - RNA, 22 nt, Human
uucugcugaagccagggagcaa

SEQ ID NO: 778088 - RNA, 22 nt, Human
gugcuuuaccuuauuggucucg

SEQ ID NO: 778089 - RNA, 22 nt, Human
cagcugcugccucauccacuuu

SEQ ID NO: 778090 - RNA, 22 nt, Human
ggcuggagugggcuccagaguu

SEQ ID NO: 778091 - RNA, 22 nt, Human
caacagaagguguacuacugaa

SEQ ID NO: 778092 - RNA, 22 nt, Human
uguguuaacacugcaugauaau

SEQ ID NO: 778093 - RNA, 20 nt, Human
ucuggguugaaaucaagauc

SEQ ID NO: 778094 - RNA, 22 nt, Human
gcugucacucaccaggccugca

SEQ ID NO: 778095 - RNA, 22 nt, Human
cuccagguaguuauuucaagaa

SEQ ID NO: 778096 - RNA, 22 nt, Human
cugggagggguagccaauccua

SEQ ID NO: 778097 - RNA, 22 nt, Human
aaauagcuguauuuacccugua

SEQ ID NO: 778098 - RNA, 16 nt, Human
ggcuuuaauuuauccc

SEQ ID NO: 778099 - RNA, 22 nt, Human
caguccugggcaggucaggcca

SEQ ID NO: 778100 - RNA, 22 nt, Human
ugccaagugcuuacuuggcccu

SEQ ID NO: 778101 - RNA, 22 nt, Human
ggaaaggggccuggaucuuuug

SEQ ID NO: 778102 - RNA, 22 nt, Human
uuuacuuucucaaguauauagg

SEQ ID NO: 778103 - RNA, 22 nt, Human
aacuauacucuguaaaugugcu

SEQ ID NO: 778104 - RNA, 23 nt, Human
ugcugcccugccuucagcucucc

SEQ ID NO: 778105 - RNA, 22 nt, Human
ccugcagguugcagaggcggaa

SEQ ID NO: 778106 - RNA, 22 nt, Human
augagagacuguguguugggag

SEQ ID NO: 778107 - RNA, 22 nt, Human
ucagcaaugugauacugugcaa

SEQ ID NO: 778108 - RNA, 22 nt, Human
ggcaggugugagcuguaaagga

SEQ ID NO: 778109 - RNA, 22 nt, Human
uuccagagaggcucauguuccc

SEQ ID NO: 778110 - RNA, 22 nt, Human
ccugcacagccuuggcugacac

SEQ ID NO: 778111 - RNA, 22 nt, Human
aggcaggcucuggguaugugca

SEQ ID NO: 778112 - RNA, 22 nt, Human
acagaacaagaccugcuuauug

SEQ ID NO: 778113 - RNA, 22 nt, Human
ucuuccuuuuguaccuucugaa

SEQ ID NO: 778114 - RNA, 22 nt, Human
gagugcugcuaaugcaagggug

SEQ ID NO: 778115 - RNA, 22 nt, Human
gacuucuauuaauaccucuacu

SEQ ID NO: 778116 - RNA, 22 nt, Human
ggcaggaagcucauguggacug

SEQ ID NO: 778117 - RNA, 22 nt, Human
gauuucuuugcaagcuguguuc

SEQ ID NO: 778118 - RNA, 22 nt, Human
uaauaauuggcuaacccuggga

SEQ ID NO: 778119 - RNA, 22 nt, Human
guaaagaaggcaaccugguuau

SEQ ID NO: 778120 - RNA, 22 nt, Human
aggcugccucugcaggaucccu

SEQ ID NO: 778121 - RNA, 22 nt, Human
agcaggguauguuagagcugua

SEQ ID NO: 778122 - RNA, 22 nt, Human
guacaauuccugucaagcuggc

SEQ ID NO: 778123 - RNA, 22 nt, Human
uaauuuuaugacaguguauuuu

SEQ ID NO: 778124 - RNA, 22 nt, Human
gugcugaacuauaaaaagcuuu

SEQ ID NO: 778125 - RNA, 22 nt, Human
gauucuuuacaucucugcugac

SEQ ID NO: 778126 - RNA, 22 nt, Human
aaggcugagccagggccccuau

SEQ ID NO: 778127 - RNA, 22 nt, Human
uuuucauuuacauuagggaaga

SEQ ID NO: 778128 - RNA, 20 nt, Human
agguuccuuuguggagaauu

SEQ ID NO: 778129 - RNA, 22 nt, Human
aagugugagacacacaaaauua

SEQ ID NO: 778130 - RNA, 22 nt, Human
gcugccuggagcucagccugcc

SEQ ID NO: 778131 - RNA, 22 nt, Human
ggccaccuuccuguggucucug

SEQ ID NO: 778132 - RNA, 22 nt, Human
cagaagggacaggguuuguaga

SEQ ID NO: 778133 - RNA, 22 nt, Human
cagcagaggugguucacauugu

SEQ ID NO: 778134 - RNA, 23 nt, Human
ggagccuggcauaugagacgcau

SEQ ID NO: 778135 - RNA, 22 nt, Human
guugcuuguuaguggugagguu

SEQ ID NO: 778136 - RNA, 22 nt, Human
gagcaccugcuaaaugacaguu

SEQ ID NO: 778137 - RNA, 21 nt, Human
auggaaaaacagguagagcau

SEQ ID NO: 778138 - RNA, 22 nt, Human
cuguguccuccccaucacuucu

SEQ ID NO: 778139 - RNA, 22 nt, Human
uagaaaagaauuuuauuugaua

SEQ ID NO: 778140 - RNA, 20 nt, Human
ugcauggcgcacaucugugg

SEQ ID NO: 778141 - RNA, 22 nt, Human
ggucuggccucgggcaccccca

SEQ ID NO: 778142 - RNA, 19 nt, Human
auccuaaauccaguuucua

SEQ ID NO: 778143 - RNA, 22 nt, Human
uacacaucacuguaucuuucag

SEQ ID NO: 778144 - RNA, 22 nt, Human
ucauuuacuguaggcaaaaauu

SEQ ID NO: 778145 - RNA, 22 nt, Human
augcacauuguagccacacaau

SEQ ID NO: 778146 - RNA, 22 nt, Human
gccgggaccaaggccacggagc

SEQ ID NO: 778147 - RNA, 23 nt, Human
gagugcagaauagacaugcagug

SEQ ID NO: 778148 - RNA, 22 nt, Human
acuauuagcauaucaugaaugg

SEQ ID NO: 778149 - RNA, 22 nt, Human
ccauggagcaccucacagaggc

SEQ ID NO: 778150 - RNA, 22 nt, Human
uuguggcucgugagauguuagg

SEQ ID NO: 778151 - RNA, 17 nt, Human
uagagcugguucaggag

SEQ ID NO: 778152 - RNA, 23 nt, Human
aagacuaauucuuaauugcuuag

SEQ ID NO: 778153 - RNA, 23 nt, Human
aagugguuuugaacccggacccu

SEQ ID NO: 778154 - RNA, 22 nt, Human
auuagagagagcauauuacugg

SEQ ID NO: 778155 - RNA, 22 nt, Human
ugcccuggugaagugcucuccu

SEQ ID NO: 778156 - RNA, 22 nt, Human
uuuaugacaagcauuacugauu

SEQ ID NO: 778157 - RNA, 22 nt, Human
aaggacaggcacagugguggag

SEQ ID NO: 778158 - RNA, 22 nt, Human
ucuggccugggccugccggugc

SEQ ID NO: 778159 - RNA, 19 nt, Human
guauauuuauauggcugua

SEQ ID NO: 778160 - RNA, 22 nt, Human
cggcagagcuuccugcucagcg

SEQ ID NO: 778161 - RNA, 22 nt, Human
gcagcaggauggccaauugcca

SEQ ID NO: 778162 - RNA, 22 nt, Human
cagcccugcagccauggccugu

SEQ ID NO: 778163 - RNA, 22 nt, Human
ggagccuguuaguugagugcuc

SEQ ID NO: 778164 - RNA, 22 nt, Human
agcagaugggagauggagcugc

SEQ ID NO: 778165 - RNA, 22 nt, Human
uuuucaugugaugugacauuuc

SEQ ID NO: 778166 - RNA, 22 nt, Human
gagaggagguggcuaugacagc

SEQ ID NO: 778167 - RNA, 22 nt, Human
ggugggcaggcgaggcccaggu

SEQ ID NO: 778168 - RNA, 22 nt, Human
ugagcuguauauuguuuuaaua

SEQ ID NO: 778169 - RNA, 23 nt, Human
ugaaauauucuuuugcaugagcu

SEQ ID NO: 778170 - RNA, 22 nt, Human
cagcccucagguccucagcagc

SEQ ID NO: 778171 - RNA, 22 nt, Human
ccaggaggaugaggggcauaga

SEQ ID NO: 778172 - RNA, 22 nt, Human
cuggcacagagacagaaggauu

SEQ ID NO: 778173 - RNA, 19 nt, Human
ggagccuggagcacgugcc

SEQ ID NO: 778174 - RNA, 22 nt, Human
cagcaccauuugcagccucuuu

SEQ ID NO: 778175 - RNA, 22 nt, Human
uagacaaaagggggcagauaug

SEQ ID NO: 778176 - RNA, 20 nt, Human
aauauaauucucugaauuua

SEQ ID NO: 778177 - RNA, 22 nt, Human
uuuucauuguuacuaugagcua

SEQ ID NO: 778178 - RNA, 22 nt, Human
aaacucuguagcuaaacauaau

SEQ ID NO: 778179 - RNA, 22 nt, Human
gacauuuagaagucuaauggcc

SEQ ID NO: 778180 - RNA, 22 nt, Human
uaauacuuaccuugcagagucu

SEQ ID NO: 778181 - RNA, 22 nt, Human
uucuucugacacugaugcugua

SEQ ID NO: 778182 - RNA, 23 nt, Human
ugcagcaggguggucuacuucuc

SEQ ID NO: 778183 - RNA, 22 nt, Human
acaggugguaaaauggacuguc

SEQ ID NO: 778184 - RNA, 22 nt, Human
ggugcagaaggaagggagcugg

SEQ ID NO: 778185 - RNA, 22 nt, Human
uucagugucccuaguagaaguu

SEQ ID NO: 778186 - RNA, 22 nt, Human
auuugcuggugaaauagugaca

SEQ ID NO: 778187 - RNA, 22 nt, Human
agcugugugacucuaagcaagu

SEQ ID NO: 778188 - RNA, 22 nt, Human
gccuucucugugagcuccuagg

SEQ ID NO: 778189 - RNA, 22 nt, Human
gaacagcccuguuaagucuguu

SEQ ID NO: 778190 - RNA, 22 nt, Human
aauauagcucacuauaccaugg

SEQ ID NO: 778191 - RNA, 22 nt, Human
ccgggggaggcaagagacaugc

SEQ ID NO: 778192 - RNA, 22 nt, Human
ccaggaggcagagguuacagug

SEQ ID NO: 778193 - RNA, 22 nt, Human
ggagagaggcuggccgugauga

SEQ ID NO: 778194 - RNA, 22 nt, Human
agcuagagaaugacagagucug

SEQ ID NO: 778195 - RNA, 22 nt, Human
agagcugggacuuggacucaau

SEQ ID NO: 778196 - RNA, 22 nt, Human
cugcaggggaccaaagucugac

SEQ ID NO: 778197 - RNA, 22 nt, Human
ugaucccuggacuugaguaagu

SEQ ID NO: 778198 - RNA, 22 nt, Human
agacagugaggcagagcuuccg

SEQ ID NO: 778199 - RNA, 22 nt, Human
gaggccaggguaccaucaacau

SEQ ID NO: 778200 - RNA, 22 nt, Human
aguucucagaauugcaccucaa

SEQ ID NO: 778201 - RNA, 22 nt, Human
aguguuuacagaguaguggaaa

SEQ ID NO: 778202 - RNA, 22 nt, Human
ggggaagaaccgggauucccau

SEQ ID NO: 778203 - RNA, 23 nt, Human
uuccugagugcuggagagagugc

SEQ ID NO: 778204 - RNA, 22 nt, Human
ucaggaguaaagacagaguucc

SEQ ID NO: 778205 - RNA, 22 nt, Human
uucugcuucacuggccuggagg

SEQ ID NO: 778206 - RNA, 22 nt, Human
acaguuuaugccucugagccug

SEQ ID NO: 778207 - RNA, 22 nt, Human
ucagaaaggaguuagaggucuc

SEQ ID NO: 778208 - RNA, 21 nt, Human
acaggcucacgauccauuucu

SEQ ID NO: 778209 - RNA, 22 nt, Human
agcugugauuauccacuggaau

SEQ ID NO: 778210 - RNA, 22 nt, Human
agggcacagccuaaagccuaug

SEQ ID NO: 778211 - RNA, 22 nt, Human
caccugcaaggagcuuucauuu

SEQ ID NO: 778212 - RNA, 22 nt, Human
ccagcagcucccucaggguccg

SEQ ID NO: 778213 - RNA, 22 nt, Human
uaguaaguucucgcauuguuau

SEQ ID NO: 778214 - RNA, 22 nt, Human
augacaguucuacacuuaaucu

SEQ ID NO: 778215 - RNA, 22 nt, Human
ggagccagaaaugcugugguug

SEQ ID NO: 778216 - RNA, 22 nt, Human
cuggcugcuggccugaggaugc

SEQ ID NO: 778217 - RNA, 22 nt, Human
caggauggucuucauuuggcuc

SEQ ID NO: 778218 - RNA, 22 nt, Human
uaggucccuucuguccuggucu

SEQ ID NO: 778219 - RNA, 22 nt, Human
gauguguagagggaauuucaaa

SEQ ID NO: 778220 - RNA, 21 nt, Human
agcugccacccuagcuucuga

SEQ ID NO: 778221 - RNA, 22 nt, Human
ucauccagagcuucauaaguaa

SEQ ID NO: 778222 - RNA, 22 nt, Human
aucucauuuugguuucuacuua

SEQ ID NO: 778223 - RNA, 22 nt, Human
agucccagagaggucggggcca

SEQ ID NO: 778224 - RNA, 22 nt, Human
cacaaauaccaguuuccuaaca

SEQ ID NO: 778225 - RNA, 21 nt, Human
agcugcuguggccagaaucca

SEQ ID NO: 778226 - RNA, 22 nt, Human
ccugcucuuauagcuguuucca

SEQ ID NO: 778227 - RNA, 22 nt, Human
uugcauauauuucuaaggaggu

SEQ ID NO: 778228 - RNA, 22 nt, Human
aggaagcuggugugaggaugaa

SEQ ID NO: 778229 - RNA, 22 nt, Human
aggaucuugcuguagaggauag

SEQ ID NO: 778230 - RNA, 23 nt, Human
auuacaugagcaaauauagcuau

SEQ ID NO: 778231 - RNA, 22 nt, Human
acaguuuagagcaugaugacca

SEQ ID NO: 778232 - RNA, 18 nt, Human
uggcagggaggaaauaua

SEQ ID NO: 778233 - RNA, 22 nt, Human
acuuccuugucaggugcaucau

SEQ ID NO: 778234 - RNA, 22 nt, Human
aaggccaggagacuuggaguca

SEQ ID NO: 778235 - RNA, 22 nt, Human
aaugaugggaaggagaaaagca

SEQ ID NO: 778236 - RNA, 21 nt, Human
uggaccuguccuucucgcugu

SEQ ID NO: 778237 - RNA, 22 nt, Human
cccacaggcuagggguagggca

SEQ ID NO: 778238 - RNA, 22 nt, Human
ucucucagacuccccaugguuu

SEQ ID NO: 778239 - RNA, 22 nt, Human
agacagcugcucgcagagcuau

SEQ ID NO: 778240 - RNA, 22 nt, Human
uuuguagaacuguagaacaaug

SEQ ID NO: 778241 - RNA, 22 nt, Human
uucuaacucaaagcuucuuuca

SEQ ID NO: 778242 - RNA, 17 nt, Human
gagauggguggaucacc

SEQ ID NO: 778243 - RNA, 22 nt, Human
aaucacauuuacauugcuaauu

SEQ ID NO: 778244 - RNA, 22 nt, Human
auauuaauuauuuacacaugag

SEQ ID NO: 778245 - RNA, 22 nt, Human
cauucauuuacuuucaacagcu

SEQ ID NO: 778246 - RNA, 22 nt, Human
ugcagguaaauuuguggaggau

SEQ ID NO: 778247 - RNA, 22 nt, Human
auuauucaaauucccacuauac

SEQ ID NO: 778248 - RNA, 22 nt, Human
cucuuaguuuguaaaaauaauu

SEQ ID NO: 778249 - RNA, 22 nt, Human
agcugcucccuauccuuuccuu

SEQ ID NO: 778250 - RNA, 18 nt, Human
ucccuccugccugcuucc

SEQ ID NO: 778251 - RNA, 22 nt, Human
aggagauuguacugucaucacu

SEQ ID NO: 778252 - RNA, 19 nt, Human
uacuuauuagaaauauggg

SEQ ID NO: 778253 - RNA, 22 nt, Human
cucaugucaggggugucaaugu

SEQ ID NO: 778254 - RNA, 22 nt, Human
uccagaggggcagcccugugcu

SEQ ID NO: 778255 - RNA, 22 nt, Human
gauggcccgcuagcuggccucu

SEQ ID NO: 778256 - RNA, 22 nt, Human
uccaggagaggccugaccaggu

SEQ ID NO: 778257 - RNA, 22 nt, Human
cuuggcuccaaucccagcucug

SEQ ID NO: 778258 - RNA, 22 nt, Human
ucagcucaucugagugucagcg

SEQ ID NO: 778259 - RNA, 22 nt, Human
auaaaggcagaguagggaggaa

SEQ ID NO: 778260 - RNA, 22 nt, Human
aagcugcccuguguuagaguuc

SEQ ID NO: 778261 - RNA, 22 nt, Human
ccuggaggcucugggagggcag

SEQ ID NO: 778262 - RNA, 22 nt, Human
acaggcugagcguccaucuuca

SEQ ID NO: 778263 - RNA, 22 nt, Human
agaguucaguuguagccauauu

SEQ ID NO: 778264 - RNA, 22 nt, Human
ucuguucuuguccccacuucag

SEQ ID NO: 778265 - RNA, 22 nt, Human
aagaugcuaauuguggaaguug

SEQ ID NO: 778266 - RNA, 20 nt, Human
gaaggcaaugguuuggcaca

SEQ ID NO: 778267 - RNA, 22 nt, Human
caauagugucugcuuguuucua

SEQ ID NO: 778268 - RNA, 22 nt, Human
ucaguaaaguucuuucuugcug

SEQ ID NO: 778269 - RNA, 22 nt, Human
caggggcucugagauugucuaa

SEQ ID NO: 778270 - RNA, 22 nt, Human
gacccaggccuggggcuuaagg

SEQ ID NO: 778271 - RNA, 22 nt, Human
aaacaauguagauuaccauuua

SEQ ID NO: 778272 - RNA, 22 nt, Human
cugggagcccgcguccuggugg

SEQ ID NO: 778273 - RNA, 22 nt, Human
aggacagagccugugcagaccg

SEQ ID NO: 778274 - RNA, 22 nt, Human
aauacauaauaaguuuugucug

SEQ ID NO: 778275 - RNA, 22 nt, Human
caugaucagaaagagaagcuag

SEQ ID NO: 778276 - RNA, 22 nt, Human
ucauuuaucgcugccuuuuaaa

SEQ ID NO: 778277 - RNA, 22 nt, Human
ccauaagguugaaaacuguaca

SEQ ID NO: 778278 - RNA, 22 nt, Human
agaguucugaauuuuauucucu

SEQ ID NO: 778279 - RNA, 22 nt, Human
ugcaggaguuccccucugccug

SEQ ID NO: 778280 - RNA, 22 nt, Human
uuuggacuaucuguguggcuuu

SEQ ID NO: 778281 - RNA, 23 nt, Human
aggcuuccuaucuuagagcuggg

SEQ ID NO: 778282 - RNA, 21 nt, Human
ggacacugauaaucuuguugc

SEQ ID NO: 778283 - RNA, 22 nt, Human
auucuucacuguuucagaauga

SEQ ID NO: 778284 - RNA, 22 nt, Human
cugccaggcacgugcagcauca

SEQ ID NO: 778285 - RNA, 22 nt, Human
cccuuggaggaagcucuaggcu

SEQ ID NO: 778286 - RNA, 22 nt, Human
aucugcuugcccucuuaggacc

SEQ ID NO: 778287 - RNA, 22 nt, Human
ggaaaauacugauucaugccau

SEQ ID NO: 778288 - RNA, 22 nt, Human
uagcucuucaaucacugucucc

SEQ ID NO: 778289 - RNA, 22 nt, Human
gcaguuguaauaugaugugagg

SEQ ID NO: 778290 - RNA, 22 nt, Human
guagcagguauucuggugugag

SEQ ID NO: 778291 - RNA, 21 nt, Human
ugggccagaucugaguuucua

SEQ ID NO: 778292 - RNA, 22 nt, Human
cuuccugcccacuuccugcugg

SEQ ID NO: 778293 - RNA, 22 nt, Human
acaaauccagugaacuccagug

SEQ ID NO: 778294 - RNA, 22 nt, Human
acagggugaaugugacauuauc

SEQ ID NO: 778295 - RNA, 22 nt, Human
uccagcccgggggcaggugacc

SEQ ID NO: 778296 - RNA, 22 nt, Human
acauaaaggugacuaacaucuu

SEQ ID NO: 778297 - RNA, 22 nt, Human
ugucucuccacacagccagugc

SEQ ID NO: 778298 - RNA, 22 nt, Human
ugggcucagucugcaccugcgg

SEQ ID NO: 778299 - RNA, 22 nt, Human
ucagcaggcacaccaaaaacug

SEQ ID NO: 778300 - RNA, 21 nt, Human
ugcaccugugccccauccuuc

SEQ ID NO: 778301 - RNA, 22 nt, Human
aaaagacauaugugggcauucu

SEQ ID NO: 778302 - RNA, 22 nt, Human
gcacugugcuuaguucacuauu

SEQ ID NO: 778303 - RNA, 22 nt, Human
uucggcuucuuagaggcgcucc

SEQ ID NO: 778304 - RNA, 22 nt, Human
aaaugguaagacaacacauuau

SEQ ID NO: 778305 - RNA, 22 nt, Human
auaaaaaugagggcgguagcua

SEQ ID NO: 778306 - RNA, 22 nt, Human
gagguuuuaggcugccauuauu

SEQ ID NO: 778307 - RNA, 22 nt, Human
uuccagcuuagagcaucauguu

SEQ ID NO: 778308 - RNA, 22 nt, Human
ugugcuauuacacauuuauuua

SEQ ID NO: 778309 - RNA, 20 nt, Human
agaucuuuucuauagaagug

SEQ ID NO: 778310 - RNA, 22 nt, Human
ucugcugaaucagauagcuaag

SEQ ID NO: 778311 - RNA, 22 nt, Human
ggcccagugucccggucguggc

SEQ ID NO: 778312 - RNA, 22 nt, Human
aaggcuuguagauuugggcuuu

SEQ ID NO: 778313 - RNA, 22 nt, Human
gcugggagaggcagcuuucgga

SEQ ID NO: 778314 - RNA, 22 nt, Human
guugggguccaaugaagcgagc

SEQ ID NO: 778315 - RNA, 22 nt, Human
ccccagcaggaauacagggguc

SEQ ID NO: 778316 - RNA, 22 nt, Human
agccagggacgcugcaggcuac

SEQ ID NO: 778317 - RNA, 19 nt, Human
acaaagugcgugcucuuuu

SEQ ID NO: 778318 - RNA, 22 nt, Human
ccagcagcuuuauuggcucucc

SEQ ID NO: 778319 - RNA, 22 nt, Human
aaauacuguugaaugaaguaag

SEQ ID NO: 778320 - RNA, 22 nt, Human
ugugauuagcugaauacacugg

SEQ ID NO: 778321 - RNA, 22 nt, Human
augcuauuuaccacacaucauu

SEQ ID NO: 778322 - RNA, 22 nt, Human
uucuucaaaacaacacuggccu

SEQ ID NO: 778323 - RNA, 22 nt, Human
acacacagcgccuaccaugugc

SEQ ID NO: 778324 - RNA, 22 nt, Human
uucuggagaggaacagaaaggu

SEQ ID NO: 778325 - RNA, 19 nt, Human
augcacagucauuuguaag

SEQ ID NO: 778326 - RNA, 22 nt, Human
aagauggcugcagcaauuccaa

SEQ ID NO: 778327 - RNA, 22 nt, Human
ggcaggcuugguggcaccgguu

SEQ ID NO: 778328 - RNA, 22 nt, Human
uuucaaugacacaaaagagaaa

SEQ ID NO: 778329 - RNA, 22 nt, Human
guuucuuaaaagaggaguuaga

SEQ ID NO: 778330 - RNA, 22 nt, Human
gugaauaauuuuuuaguauaag

SEQ ID NO: 778331 - RNA, 22 nt, Human
uugauuaaacaggcauauucaa

SEQ ID NO: 778332 - RNA, 22 nt, Human
uuucuuuuacaguguggcuauu

SEQ ID NO: 778333 - RNA, 22 nt, Human
gugucauguagaaauugaugaa

SEQ ID NO: 778334 - RNA, 22 nt, Human
gggcgagggcgaaagcgagagc

SEQ ID NO: 778335 - RNA, 22 nt, Human
uugcagggauaaaacaagugaa

SEQ ID NO: 778336 - RNA, 22 nt, Human
gagugcaguaugagaggcugcu

SEQ ID NO: 778337 - RNA, 22 nt, Human
gggagggccaggcucacccagg

SEQ ID NO: 778338 - RNA, 22 nt, Human
aguaggacuagggguugaggca

SEQ ID NO: 778339 - RNA, 22 nt, Human
aggccugccuggaucacacaga

SEQ ID NO: 778340 - RNA, 22 nt, Human
auuagcugaccucuaaggagcc

SEQ ID NO: 778341 - RNA, 22 nt, Human
uguccaggacccuauucucacu

SEQ ID NO: 778342 - RNA, 22 nt, Human
ccuggacagggccaggccaugc

SEQ ID NO: 778343 - RNA, 22 nt, Human
cuuggucuacuagagaaaaaga

SEQ ID NO: 778344 - RNA, 22 nt, Human
cacauaauugaacgugaugagu

SEQ ID NO: 778345 - RNA, 22 nt, Human
ugcauagaggauccaguguggu

SEQ ID NO: 778346 - RNA, 22 nt, Human
uugucuguaaagacggccacca

SEQ ID NO: 778347 - RNA, 22 nt, Human
gggaagggagggaccucagucu

SEQ ID NO: 778348 - RNA, 22 nt, Human
guggagcaugugaggacugagu

SEQ ID NO: 778349 - RNA, 22 nt, Human
gcccaggggaguagucaauuua

SEQ ID NO: 778350 - RNA, 22 nt, Human
ucauaauuguauacauuuaugg

SEQ ID NO: 778351 - RNA, 22 nt, Human
caagucaaagacuagaacuagu

SEQ ID NO: 778352 - RNA, 20 nt, Human
ucuaggcaggcaggcucgug

SEQ ID NO: 778353 - RNA, 22 nt, Human
gugcugccugccagcuucuggg

SEQ ID NO: 778354 - RNA, 22 nt, Human
agaggccaguggcugugcuguc

SEQ ID NO: 778355 - RNA, 22 nt, Human
augaggcagaaaaaagucggag

SEQ ID NO: 778356 - RNA, 22 nt, Human
ccuggcacagauccuucauaca

SEQ ID NO: 778357 - RNA, 21 nt, Human
ugaaacuaccuacaagcuacc

SEQ ID NO: 778358 - RNA, 22 nt, Human
ucuucuuuuugucccacagaau

SEQ ID NO: 778359 - RNA, 22 nt, Human
aguccuuugggaaaaaugacua

SEQ ID NO: 778360 - RNA, 22 nt, Human
agcauuccagugcacaguagaa

SEQ ID NO: 778361 - RNA, 22 nt, Human
agagggugcuggagagacauug

SEQ ID NO: 778362 - RNA, 22 nt, Human
agguaaugcaacuacuuugcua

SEQ ID NO: 778363 - RNA, 22 nt, Human
agcuccaggauaagacaggugc

SEQ ID NO: 778364 - RNA, 22 nt, Human
agucaggaaccucagcaagucu

SEQ ID NO: 778365 - RNA, 22 nt, Human
acauuuauauaacucacuagga

SEQ ID NO: 778366 - RNA, 22 nt, Human
acagucauagcagccuuuguua

SEQ ID NO: 778367 - RNA, 22 nt, Human
aaaguacagauggugagguugg

SEQ ID NO: 778368 - RNA, 22 nt, Human
aaaggcuaugagauagaagaua

SEQ ID NO: 778369 - RNA, 22 nt, Human
ucaggcuuuuccugccuccuac

SEQ ID NO: 778370 - RNA, 22 nt, Human
gcugcucugugacagccuccgg

SEQ ID NO: 778371 - RNA, 22 nt, Human
cuuccuaaaagcuucaagagaa

SEQ ID NO: 778372 - RNA, 22 nt, Human
uuauucaggaagguguuacuua

SEQ ID NO: 778373 - RNA, 22 nt, Human
augacacauuugugcuguugaa

SEQ ID NO: 778374 - RNA, 22 nt, Human
uacuucccacuggggucuacca

SEQ ID NO: 778375 - RNA, 22 nt, Human
uaggaaaugcuccauugcauaa

SEQ ID NO: 778376 - RNA, 22 nt, Human
acucugggcuuugauuuguuac

SEQ ID NO: 778377 - RNA, 22 nt, Human
aguagauuuuugaauguaaguu

SEQ ID NO: 778378 - RNA, 22 nt, Human
aaaugccuguguaaauucuagc

SEQ ID NO: 778379 - RNA, 22 nt, Human
ccaaggcaaugugcagcuggug

SEQ ID NO: 778380 - RNA, 18 nt, Human
uguagaaaagauaggaau

SEQ ID NO: 778381 - RNA, 22 nt, Human
uaaugaacacagaauuucacuu

SEQ ID NO: 778382 - RNA, 19 nt, Human
gaggcaguagucaaagcuu

SEQ ID NO: 778383 - RNA, 22 nt, Human
uaguaaacaggcaagggaccac

SEQ ID NO: 778384 - RNA, 22 nt, Human
gccuuugcaccaucagugcaau

SEQ ID NO: 778385 - RNA, 21 nt, Human
agcuguggcgaggggaacaug

SEQ ID NO: 778386 - RNA, 17 nt, Human
auccccagcaucuagaa

SEQ ID NO: 778387 - RNA, 22 nt, Human
uucucuggaacugaaacaagau

SEQ ID NO: 778388 - RNA, 22 nt, Human
cugggaguugacgaggcuugua

SEQ ID NO: 778389 - RNA, 22 nt, Human
ugucugaacccuggcccugccu

SEQ ID NO: 778390 - RNA, 22 nt, Human
aggagggaauaagaaagaguca

SEQ ID NO: 778391 - RNA, 22 nt, Human
gcccugugguuccaggaagcaa

SEQ ID NO: 778392 - RNA, 22 nt, Human
cuuccagugcauagguagauca

SEQ ID NO: 778393 - RNA, 22 nt, Human
ugcagcauuugcugaagcagga

SEQ ID NO: 778394 - RNA, 22 nt, Human
ucucaucauuccuucaaagccc

SEQ ID NO: 778395 - RNA, 22 nt, Human
gcacucugugaucugcagagcc

SEQ ID NO: 778396 - RNA, 22 nt, Human
uacagaaacagcgugguuagaa

SEQ ID NO: 778397 - RNA, 22 nt, Human
uggcagguggcacagccuggga

SEQ ID NO: 778398 - RNA, 22 nt, Human
agccaaagugguauauagggaa

SEQ ID NO: 778399 - RNA, 22 nt, Human
ugaaggcagcaugcacacuagu

SEQ ID NO: 778400 - RNA, 22 nt, Human
uccagggcagugacuacagcgg

SEQ ID NO: 778401 - RNA, 22 nt, Human
gcuggcaaugguguggucuggu

SEQ ID NO: 778402 - RNA, 22 nt, Human
gugggcaucuccuuggaagcca

SEQ ID NO: 778403 - RNA, 17 nt, Human
ucagcaaagacaaagga

SEQ ID NO: 778404 - RNA, 22 nt, Human
acaaaguuucuucuaacaucug

SEQ ID NO: 778405 - RNA, 22 nt, Human
caaugucagagaagcucauauc

SEQ ID NO: 778406 - RNA, 22 nt, Human
uggcccugcuggacacgccugc

SEQ ID NO: 778407 - RNA, 22 nt, Human
ggagaagaggagcuggaagccu

SEQ ID NO: 778408 - RNA, 22 nt, Human
ccagaggaaaaauaucucccua

SEQ ID NO: 778409 - RNA, 22 nt, Human
uaugaacugugagugugauggg

SEQ ID NO: 778410 - RNA, 22 nt, Human
gaaagugcagucagacaaggca

SEQ ID NO: 778411 - RNA, 22 nt, Human
caucaagagucuuacuaucagu

SEQ ID NO: 778412 - RNA, 22 nt, Human
cacaaugauuugguucaaaaau

SEQ ID NO: 778413 - RNA, 22 nt, Human
ucagcuuucucaaagaagcugg

SEQ ID NO: 778414 - RNA, 22 nt, Human
ucagcaucagguugucugaauu

SEQ ID NO: 778415 - RNA, 22 nt, Human
ucucuggagggcuccaggcggg

SEQ ID NO: 778416 - RNA, 22 nt, Human
ugucuaauggcaauuucaugug

SEQ ID NO: 778417 - RNA, 22 nt, Human
ucuagacaaugcacuguaagga

SEQ ID NO: 778418 - RNA, 22 nt, Human
augacagugggucuugcaaaga

SEQ ID NO: 778419 - RNA, 22 nt, Human
ugggcaagggacaggccuggcu

SEQ ID NO: 778420 - RNA, 22 nt, Human
uagcauaauuuguagaaaauca

SEQ ID NO: 778421 - RNA, 19 nt, Human
ggauccagaggaucugcca

SEQ ID NO: 778422 - RNA, 22 nt, Human
agugcauguccaguaguuuaug

SEQ ID NO: 778423 - RNA, 22 nt, Human
uuuucuaaaagaagucacugau

SEQ ID NO: 778424 - RNA, 22 nt, Human
ucugagaaaucaguggugaaua

SEQ ID NO: 778425 - RNA, 22 nt, Human
ggcugcucugcacaggggcugg

SEQ ID NO: 778426 - RNA, 22 nt, Human
gggcagcucggaagugggaaag

SEQ ID NO: 778427 - RNA, 22 nt, Human
ggucagguagcucugacaggcc

SEQ ID NO: 778428 - RNA, 22 nt, Human
cuuggguguuuuaaaacuagau

SEQ ID NO: 778429 - RNA, 22 nt, Human
uuagaaucagguguuauaauca

SEQ ID NO: 778430 - RNA, 22 nt, Human
aaggaucauaguaaacauugau

SEQ ID NO: 778431 - RNA, 22 nt, Human
ccuuggcuguguugccugcccu

SEQ ID NO: 778432 - RNA, 22 nt, Human
uucugggcacacaggcccuggu

SEQ ID NO: 778433 - RNA, 22 nt, Human
uacuuuggauccuuacaauagc

SEQ ID NO: 778434 - RNA, 22 nt, Human
auagauguguguaaguacauaa

SEQ ID NO: 778435 - RNA, 22 nt, Human
uuggccucauggacagcucauc

SEQ ID NO: 778436 - RNA, 22 nt, Human
acauaauagguaccugaauaau

SEQ ID NO: 778437 - RNA, 22 nt, Human
ucugucauccaggcuggaauau

SEQ ID NO: 778438 - RNA, 22 nt, Human
caagccucagaaucuucuccau

SEQ ID NO: 778439 - RNA, 22 nt, Human
cugugagcuggguggccaggac

SEQ ID NO: 778440 - RNA, 22 nt, Human
guccaugacugugacucacaug

SEQ ID NO: 778441 - RNA, 22 nt, Human
cuuuugauggaguucaagaagc

SEQ ID NO: 778442 - RNA, 22 nt, Human
aauuggcaagcagauuuccacu

SEQ ID NO: 778443 - RNA, 22 nt, Human
acagagcagguccagaagugcc

SEQ ID NO: 778444 - RNA, 18 nt, Human
uggcuucugaacaacugc

SEQ ID NO: 778445 - RNA, 22 nt, Human
ccuggccucuccgaguaaccug

SEQ ID NO: 778446 - RNA, 23 nt, Human
agcuccagcugacgugggcagcc

SEQ ID NO: 778447 - RNA, 22 nt, Human
acugggcuguuuuuugagugga

SEQ ID NO: 778448 - RNA, 21 nt, Human
aauaaaacaguuggugucaau

SEQ ID NO: 778449 - RNA, 20 nt, Human
gggagacagggccagugucc

SEQ ID NO: 778450 - RNA, 22 nt, Human
acaguguuacuugauaguguau

SEQ ID NO: 778451 - RNA, 22 nt, Human
agggacuugaugucagggagau

SEQ ID NO: 778452 - RNA, 22 nt, Human
agcagagcagaaugugaaggug

SEQ ID NO: 778453 - RNA, 21 nt, Human
ggccuaggggcagauggugcu

SEQ ID NO: 778454 - RNA, 22 nt, Human
gggcaaguccggugcccagagc

SEQ ID NO: 778455 - RNA, 22 nt, Human
uuacuuuaugugauggauuagu

SEQ ID NO: 778456 - RNA, 22 nt, Human
ggaacuccugcuccaagcagcu

SEQ ID NO: 778457 - RNA, 22 nt, Human
auguuuuauguuccacucaagg

SEQ ID NO: 778458 - RNA, 22 nt, Human
auuuucauggcuucugcucagu

SEQ ID NO: 778459 - RNA, 22 nt, Human
agggucagugaugagggagccc

SEQ ID NO: 778460 - RNA, 22 nt, Human
ugcugagaggaaagaaugcaca

SEQ ID NO: 778461 - RNA, 22 nt, Human
gcucagagggaacaaggggcug

SEQ ID NO: 778462 - RNA, 22 nt, Human
agggucuguauuucuggcaagc

SEQ ID NO: 778463 - RNA, 22 nt, Human
uugucuguccaggcaccccaag

SEQ ID NO: 778464 - RNA, 22 nt, Human
uugagcaauuaggaaauaaaga

SEQ ID NO: 778465 - RNA, 22 nt, Human
gcagcagagaccccaggaagga

SEQ ID NO: 778466 - RNA, 22 nt, Human
cccaagggaugcuugaguaguu

SEQ ID NO: 778467 - RNA, 22 nt, Human
ggcagagguagcuggaaccagg

SEQ ID NO: 778468 - RNA, 22 nt, Human
ggucagaaggcaguuaaacaaa

SEQ ID NO: 778469 - RNA, 21 nt, Human
uccagggaauuucaacuuuua

SEQ ID NO: 778470 - RNA, 22 nt, Human
gagaggcuccgccacugcucag

SEQ ID NO: 778471 - RNA, 22 nt, Human
uucaaaaugcacaaagggcuag

SEQ ID NO: 778472 - RNA, 22 nt, Human
ucuccuggauagauacuaucca

SEQ ID NO: 778473 - RNA, 22 nt, Human
ucccugagagcacuggggagcc

SEQ ID NO: 778474 - RNA, 22 nt, Human
ugaguacucuucucacuacacc

SEQ ID NO: 778475 - RNA, 22 nt, Human
ucauuuguucaucugcucuucu

SEQ ID NO: 778476 - RNA, 22 nt, Human
ugccugucuuaauaucuggaaa

SEQ ID NO: 778477 - RNA, 20 nt, Human
ucucugaguuuccuaauuug

SEQ ID NO: 778478 - RNA, 22 nt, Human
caggucugaagagucacaugcc

SEQ ID NO: 778479 - RNA, 22 nt, Human
gcccaggauucuuucuuccuua

SEQ ID NO: 778480 - RNA, 22 nt, Human
gaaaauaggcagaugcauugua

SEQ ID NO: 778481 - RNA, 22 nt, Human
uaauauguguuacugacuuuuu

SEQ ID NO: 778482 - RNA, 22 nt, Human
cuucacagcaugagcuuuggag

SEQ ID NO: 778483 - RNA, 22 nt, Human
aacauucuaugugcauucagaa

SEQ ID NO: 778484 - RNA, 22 nt, Human
ugaagauuuaagcaucucaauu

SEQ ID NO: 778485 - RNA, 21 nt, Human
gcuuuuuguauggcccaggaa

SEQ ID NO: 778486 - RNA, 22 nt, Human
agaggaucaucuaguuugacuc

SEQ ID NO: 778487 - RNA, 23 nt, Human
agguagguuauugcugcuaccug

SEQ ID NO: 778488 - RNA, 22 nt, Human
gucuggggguccgggugccugc

SEQ ID NO: 778489 - RNA, 22 nt, Human
auugugcaauguuuuacaauuu

SEQ ID NO: 778490 - RNA, 22 nt, Human
accucugccaagaugugcuccc

SEQ ID NO: 778491 - RNA, 22 nt, Human
agcaggcuaggaaccucacugc

SEQ ID NO: 778492 - RNA, 22 nt, Human
caguaggagguucugagguucu

SEQ ID NO: 778493 - RNA, 22 nt, Human
caguggguggcuaaguggcuga

SEQ ID NO: 778494 - RNA, 22 nt, Human
aggccagugccuuuccagggcu

SEQ ID NO: 778495 - RNA, 22 nt, Human
cuuuacacaaugauuuucuuua

SEQ ID NO: 778496 - RNA, 22 nt, Human
ugcaaggcugccucugaggacc

SEQ ID NO: 778497 - RNA, 22 nt, Human
uucaaacacagacagcagcaug

SEQ ID NO: 778498 - RNA, 21 nt, Human
guacacacagguggaugggcu

SEQ ID NO: 778499 - RNA, 22 nt, Human
agucagaugaugugaggagugg

SEQ ID NO: 778500 - RNA, 22 nt, Human
auaauauuuggauaggacagua

SEQ ID NO: 778501 - RNA, 22 nt, Human
gauaaacacugaugauaugggg

SEQ ID NO: 778502 - RNA, 22 nt, Human
uagguucucuauugcccccaaa

SEQ ID NO: 778503 - RNA, 22 nt, Human
gguggcaccuugaucuuggacu

SEQ ID NO: 778504 - RNA, 22 nt, Human
aguccugucucucccagggcca

SEQ ID NO: 778505 - RNA, 22 nt, Human
cagccaggacagggaaacuagu

SEQ ID NO: 778506 - RNA, 23 nt, Human
ccuggcuggauucucugcauuca

SEQ ID NO: 778507 - RNA, 20 nt, Human
ccagguggugccuggagagg

SEQ ID NO: 778508 - RNA, 22 nt, Human
ugagucacauccauuuuugugu

SEQ ID NO: 778509 - RNA, 22 nt, Human
uuuaguauauaaaaagagaagu

SEQ ID NO: 778510 - RNA, 22 nt, Human
ugagacaguucugcagcugggu

SEQ ID NO: 778511 - RNA, 22 nt, Human
cauacuuucuuuuucacgcaua

SEQ ID NO: 778512 - RNA, 22 nt, Human
ccugaggucaugcauuuccaac

SEQ ID NO: 778513 - RNA, 22 nt, Human
cuggagagauccuccugaaaaa

SEQ ID NO: 778514 - RNA, 22 nt, Human
ucacaguguuggaaucagagcu

SEQ ID NO: 778515 - RNA, 22 nt, Human
aguauauugguguuauuccuca

SEQ ID NO: 778516 - RNA, 22 nt, Human
uugcaaaugugaauaauuacac

SEQ ID NO: 778517 - RNA, 22 nt, Human
cagaguaaaccugucaucaaga

SEQ ID NO: 778518 - RNA, 22 nt, Human
ugcuuggcuagcuuggcagcuc

SEQ ID NO: 778519 - RNA, 22 nt, Human
uccuaguucucugccagucgcu

SEQ ID NO: 778520 - RNA, 22 nt, Human
agcccuccucacaucagcgucc

SEQ ID NO: 778521 - RNA, 22 nt, Human
ucccaggauguuggcggcaggu

SEQ ID NO: 778522 - RNA, 22 nt, Human
cccugagcaacaaacugaauac

SEQ ID NO: 778523 - RNA, 22 nt, Human
ucccaaagcuacucuucugacu

SEQ ID NO: 778524 - RNA, 22 nt, Human
uuuacaauagggucugaaugaa

SEQ ID NO: 778525 - RNA, 22 nt, Human
gaaacauugagcagaaggagaa

SEQ ID NO: 778526 - RNA, 22 nt, Human
ggggcgcucggagggauccccu

SEQ ID NO: 778527 - RNA, 22 nt, Human
gaucuugaaauaucuuuuccua

SEQ ID NO: 778528 - RNA, 22 nt, Human
ucuuuucacagacaaauggaga

SEQ ID NO: 778529 - RNA, 22 nt, Human
cagcuuuuggcaggaugaccag

SEQ ID NO: 778530 - RNA, 22 nt, Human
aauguguagcauuuaaugcagu

SEQ ID NO: 778531 - RNA, 22 nt, Human
aucagaggaccuaguugggcag

SEQ ID NO: 778532 - RNA, 22 nt, Human
uuuggcugagaaguugugcuuu

SEQ ID NO: 778533 - RNA, 22 nt, Human
acagugaucaguuacugucugu

SEQ ID NO: 778534 - RNA, 22 nt, Human
acugggaagcuguuuugcuuuu

SEQ ID NO: 778535 - RNA, 22 nt, Human
agcucuuuagagucucccuucu

SEQ ID NO: 778536 - RNA, 22 nt, Human
aguuuacaugacguguauuuca

SEQ ID NO: 778537 - RNA, 22 nt, Human
aauugcauaaauuucauagcau

SEQ ID NO: 778538 - RNA, 22 nt, Human
agaagugagugugacucagcag

SEQ ID NO: 778539 - RNA, 22 nt, Human
uuuuaugcaaguuaugauuaaa

SEQ ID NO: 778540 - RNA, 22 nt, Human
uagaagauucuaaaguggagag

SEQ ID NO: 778541 - RNA, 22 nt, Human
uuucucaguuacuagcuguggu

SEQ ID NO: 778542 - RNA, 22 nt, Human
gcaggguccauggaggcagccc

SEQ ID NO: 778543 - RNA, 19 nt, Human
cauuuuaagcauccccagu

SEQ ID NO: 778544 - RNA, 22 nt, Human
ucuuuccuagaggcugaugagu

SEQ ID NO: 778545 - RNA, 22 nt, Human
aaaaucucauuaucaggaaggg

SEQ ID NO: 778546 - RNA, 22 nt, Human
gaaugcauuccacgguagugau

SEQ ID NO: 778547 - RNA, 20 nt, Human
caagcccucuuuagccugcc

SEQ ID NO: 778548 - RNA, 22 nt, Human
caggcugcagaggccuuucaug

SEQ ID NO: 778549 - RNA, 22 nt, Human
gcaggugaugugaugugagcau

SEQ ID NO: 778550 - RNA, 22 nt, Human
uuuccagauuaagauaccacuu

SEQ ID NO: 778551 - RNA, 22 nt, Human
aauauucaaguuauucuuucuu

SEQ ID NO: 778552 - RNA, 22 nt, Human
uaggaaauugacaccugcuuga

SEQ ID NO: 778553 - RNA, 22 nt, Human
gcacuugaucauuguuacagau

SEQ ID NO: 778554 - RNA, 17 nt, Human
ugggggcgccagggucu

SEQ ID NO: 778555 - RNA, 22 nt, Human
auggcaaaaacugcaguuaccu

SEQ ID NO: 778556 - RNA, 22 nt, Human
uuuuccagagcugucucuugca

SEQ ID NO: 778557 - RNA, 22 nt, Human
cacagcuugggcucugacaaua

SEQ ID NO: 778558 - RNA, 19 nt, Human
gggcagaauggcaucucag

SEQ ID NO: 778559 - RNA, 22 nt, Human
gccccagccaaggugacacgaa

SEQ ID NO: 778560 - RNA, 22 nt, Human
ugggcuagcagggaagagagac

SEQ ID NO: 778561 - RNA, 22 nt, Human
cacaugagugagaacaugcagu

SEQ ID NO: 778562 - RNA, 22 nt, Human
uuuggaauggaauagagauugc

SEQ ID NO: 778563 - RNA, 22 nt, Human
aaguacaugcuuuauucagagu

SEQ ID NO: 778564 - RNA, 22 nt, Human
cucugggaaguggagacuucag

SEQ ID NO: 778565 - RNA, 22 nt, Human
gccaaaguccuccagccaugca

SEQ ID NO: 778566 - RNA, 19 nt, Human
ucuggcuccugccaggcug

SEQ ID NO: 778567 - RNA, 18 nt, Human
gcaggccuagaacuuggu

SEQ ID NO: 778568 - RNA, 17 nt, Human
cagucgaggaggaccug

SEQ ID NO: 778569 - RNA, 20 nt, Human
agcuucugcugccuuucggc

SEQ ID NO: 778570 - RNA, 22 nt, Human
ucucuggcagacuggcugggcu

SEQ ID NO: 778571 - RNA, 22 nt, Human
uuuguuugaaagucucuacagc

SEQ ID NO: 778572 - RNA, 22 nt, Human
aaaguagcuuuguagguacagu

SEQ ID NO: 778573 - RNA, 18 nt, Human
cccagcuccacuucccuc

SEQ ID NO: 778574 - RNA, 22 nt, Human
aggccaagggcaaagcggagag

SEQ ID NO: 778575 - RNA, 22 nt, Human
aguguuccuugcuuucccagag

SEQ ID NO: 778576 - RNA, 22 nt, Human
cuggccaggccccuugcagggc

SEQ ID NO: 778577 - RNA, 22 nt, Human
agaagcagggcagggaaaagca

SEQ ID NO: 778578 - RNA, 22 nt, Human
caaaccuguccuuuugucuccu

SEQ ID NO: 778579 - RNA, 22 nt, Human
cuuuuuuccuaaggcaacauga

SEQ ID NO: 778580 - RNA, 22 nt, Human
cugcaggacagggaggagcaag

SEQ ID NO: 778581 - RNA, 22 nt, Human
aucccagauggaggcuggucac

SEQ ID NO: 778582 - RNA, 22 nt, Human
gauacacuggccaaguggagga

SEQ ID NO: 778583 - RNA, 22 nt, Human
gcugggcccagaucccaggauc

SEQ ID NO: 778584 - RNA, 22 nt, Human
ggcagcuccaaaaggaaacacu

SEQ ID NO: 778585 - RNA, 21 nt, Human
agaugcugugcuccaggagca

SEQ ID NO: 778586 - RNA, 22 nt, Human
gcugugcuugcaugagugucug

SEQ ID NO: 778587 - RNA, 22 nt, Human
cucuguccuaugcuugauagaa

SEQ ID NO: 778588 - RNA, 22 nt, Human
agguacagcaauauaagagguc

SEQ ID NO: 778589 - RNA, 22 nt, Human
gauucaaaaauaagcuccuauu

SEQ ID NO: 778590 - RNA, 20 nt, Human
cagaagcaaggcagguaccu

SEQ ID NO: 778591 - RNA, 22 nt, Human
ggcccuugcagcaggcgcuggc

SEQ ID NO: 778592 - RNA, 22 nt, Human
auuuuaguuuuagcauccaugc

SEQ ID NO: 778593 - RNA, 22 nt, Human
uuguaugaucaaaagaaaugua

SEQ ID NO: 778594 - RNA, 22 nt, Human
caccuguuagcucuaauuuucu

SEQ ID NO: 778595 - RNA, 22 nt, Human
aacuacagugggcagaggcaau

SEQ ID NO: 778596 - RNA, 22 nt, Human
cuauuuaugugcuauuuuguau

SEQ ID NO: 778597 - RNA, 20 nt, Human
ccagcuuucccugcagcauc

SEQ ID NO: 778598 - RNA, 22 nt, Human
agcccagcuuugaaccauauca

SEQ ID NO: 778599 - RNA, 22 nt, Human
gguguuaacuuguuuaugacaa

SEQ ID NO: 778600 - RNA, 22 nt, Human
cacaauaaauguuugcugauga

SEQ ID NO: 778601 - RNA, 22 nt, Human
aggcucauccccacaaagcaaa

SEQ ID NO: 778602 - RNA, 22 nt, Human
ggaggaaaugaaaggaggguuu

SEQ ID NO: 778603 - RNA, 22 nt, Human
acuugcaucuuagagacucacc

SEQ ID NO: 778604 - RNA, 20 nt, Human
ucauugcacauaauggaagc

SEQ ID NO: 778605 - RNA, 22 nt, Human
aauggcuuagugcuucacuucu

SEQ ID NO: 778606 - RNA, 22 nt, Human
cucugcuggccaugaagagaga

SEQ ID NO: 778607 - RNA, 22 nt, Human
cagagccaggguugcaccccug

SEQ ID NO: 778608 - RNA, 22 nt, Human
gcagagcugucuaagucacuuc

SEQ ID NO: 778609 - RNA, 22 nt, Human
ccugggagugugccaucucugu

SEQ ID NO: 778610 - RNA, 22 nt, Human
uagaaaguagccacuuacagag

SEQ ID NO: 778611 - RNA, 22 nt, Human
auggcucucuugaccuaggcac

SEQ ID NO: 778612 - RNA, 22 nt, Human
gggcuucucucaggggcaugag

SEQ ID NO: 778613 - RNA, 22 nt, Human
aaaccuuucucagugcuaaaau

SEQ ID NO: 778614 - RNA, 22 nt, Human
aaaaugcuauuucauggaggag

SEQ ID NO: 778615 - RNA, 18 nt, Human
aauuucuuugacaacuua

SEQ ID NO: 778616 - RNA, 19 nt, Human
ucugcagaaggcauacaug

SEQ ID NO: 778617 - RNA, 22 nt, Human
auuccuuuggacuccuccuugc

SEQ ID NO: 778618 - RNA, 22 nt, Human
guuucccagucugcagaguucu

SEQ ID NO: 778619 - RNA, 22 nt, Human
ccucggagcgggucagagaggg

SEQ ID NO: 778620 - RNA, 19 nt, Human
ugaccccacgcuccagagc

SEQ ID NO: 778621 - RNA, 22 nt, Human
aagggaaaucauauggugcagu

SEQ ID NO: 778622 - RNA, 22 nt, Human
auggccaagcaugccuguggcc

SEQ ID NO: 778623 - RNA, 22 nt, Human
ucauugcagacuaacaaucuca

SEQ ID NO: 778624 - RNA, 22 nt, Human
ggcucuggguaaggcguuugac

SEQ ID NO: 778625 - RNA, 22 nt, Human
uuugauuuacuauaagcagcac

SEQ ID NO: 778626 - RNA, 22 nt, Human
cacaggagguuaggaagugguc

SEQ ID NO: 778627 - RNA, 23 nt, Human
cacauggaggaccguucuuauaa

SEQ ID NO: 778628 - RNA, 22 nt, Human
aggggucuugaggacuccagca

SEQ ID NO: 778629 - RNA, 22 nt, Human
gccaggaaaagaagcuggugcu

SEQ ID NO: 778630 - RNA, 22 nt, Human
gcagagacuaguagugcagacu

SEQ ID NO: 778631 - RNA, 22 nt, Human
ugguccugaucaccgcugggca

SEQ ID NO: 778632 - RNA, 22 nt, Human
auauauaugcugauggcugcca

SEQ ID NO: 778633 - RNA, 22 nt, Human
agauuucagaugcucggcaguu

SEQ ID NO: 778634 - RNA, 22 nt, Human
aaagucaugaugaaccaccgua

SEQ ID NO: 778635 - RNA, 22 nt, Human
cuucuucaagagaaugggagac

SEQ ID NO: 778636 - RNA, 22 nt, Human
ucucuuagucuuauauguaaaa

SEQ ID NO: 778637 - RNA, 22 nt, Human
cagccaagaaagcagugcucca

SEQ ID NO: 778638 - RNA, 22 nt, Human
aauugacaaaucauacuuguau

SEQ ID NO: 778639 - RNA, 22 nt, Human
aguuuuguaauucucaaaaaua

SEQ ID NO: 778640 - RNA, 23 nt, Human
uccuucagagccucccuccaagc

SEQ ID NO: 778641 - RNA, 22 nt, Human
aauggcuuuugcacuuaaaucg

SEQ ID NO: 778642 - RNA, 22 nt, Human
uagcuauuugagcauauuccag

SEQ ID NO: 778643 - RNA, 22 nt, Human
aaagauguuaugaaauaacuau

SEQ ID NO: 778644 - RNA, 22 nt, Human
gugcccuccguguucauagagc

SEQ ID NO: 778645 - RNA, 22 nt, Human
uucacaggcuuggagguggggg

SEQ ID NO: 778646 - RNA, 22 nt, Human
aagccuggcacauuggagucug

SEQ ID NO: 778647 - RNA, 22 nt, Human
ucuguuuaaugggaaugauacu

SEQ ID NO: 778648 - RNA, 22 nt, Human
cagugaguaaguagacagcuua

SEQ ID NO: 778649 - RNA, 22 nt, Human
ucauuuucaaguuugaacagga

SEQ ID NO: 778650 - RNA, 22 nt, Human
uuuaguagaaugauacagggca

SEQ ID NO: 778651 - RNA, 22 nt, Human
gagugucuguauuuugggcaag

SEQ ID NO: 778652 - RNA, 22 nt, Human
cucacagauacggcuauuccug

SEQ ID NO: 778653 - RNA, 21 nt, Human
uucagcuuaugugucacuugc

SEQ ID NO: 778654 - RNA, 22 nt, Human
guacacacuguuugaucauuuc

SEQ ID NO: 778655 - RNA, 22 nt, Human
aaaguccuguuugaaggaccug

SEQ ID NO: 778656 - RNA, 22 nt, Human
ucagcugguguuucuucuccuu

SEQ ID NO: 778657 - RNA, 20 nt, Human
gucucaaguaucucacaguc

SEQ ID NO: 778658 - RNA, 22 nt, Human
uuacaguuuaguccaagccaga

SEQ ID NO: 778659 - RNA, 21 nt, Human
cugccaggauagcaugcaggc

SEQ ID NO: 778660 - RNA, 22 nt, Human
aggcugucucagccugcuugca

SEQ ID NO: 778661 - RNA, 22 nt, Human
aaacucugcacugcgguaaggu

SEQ ID NO: 778662 - RNA, 22 nt, Human
acauuugaggauguuaagaaug

SEQ ID NO: 778663 - RNA, 22 nt, Human
ugcuggaagggucggcgugggc

SEQ ID NO: 778664 - RNA, 22 nt, Human
gcugccucugcacagcucacuc

SEQ ID NO: 778665 - RNA, 22 nt, Human
acagauguaaucuauucacauu

SEQ ID NO: 778666 - RNA, 22 nt, Human
cuguccugcccacccugcaggg

SEQ ID NO: 778667 - RNA, 22 nt, Human
augcauguguguuuacaugcuu

SEQ ID NO: 778668 - RNA, 22 nt, Human
ggggccagcaauguugaggaau

SEQ ID NO: 778669 - RNA, 22 nt, Human
ucaaagcuuagauaauuucuuu

SEQ ID NO: 778670 - RNA, 22 nt, Human
ugucaugguagcugaaggaugu

SEQ ID NO: 778671 - RNA, 22 nt, Human
ucaagagaaggggaaauagacu

SEQ ID NO: 778672 - RNA, 22 nt, Human
agaaauugccagaaugucaggc

SEQ ID NO: 778673 - RNA, 22 nt, Human
ucauauuuaggccuuuaauuca

SEQ ID NO: 778674 - RNA, 22 nt, Human
auucugggacuccuuccucccc

SEQ ID NO: 778675 - RNA, 22 nt, Human
gaauaaacuccucagcuuccuu

SEQ ID NO: 778676 - RNA, 22 nt, Human
uaggcacaagaccaugcaaagg

SEQ ID NO: 778677 - RNA, 23 nt, Human
gugcaaagauauaccacauggcu

SEQ ID NO: 778678 - RNA, 22 nt, Human
aggguugccucugagugcuccg

SEQ ID NO: 778679 - RNA, 22 nt, Human
agggagcucuaaguagagggac

SEQ ID NO: 778680 - RNA, 22 nt, Human
auuuuaacccucuuauauauac

SEQ ID NO: 778681 - RNA, 22 nt, Human
gcaggauugggcagagggugaa

SEQ ID NO: 778682 - RNA, 20 nt, Human
aguggcaggcgaucauuacu

SEQ ID NO: 778683 - RNA, 23 nt, Human
aguacaauaaguauaauucuuuc

SEQ ID NO: 778684 - RNA, 22 nt, Human
ucuuauuggauaaaaggaaacc

SEQ ID NO: 778685 - RNA, 22 nt, Human
aggcgugggaggaucugaggcc

SEQ ID NO: 778686 - RNA, 22 nt, Human
cgccuggagaggaggcgacgcg

SEQ ID NO: 778687 - RNA, 22 nt, Human
ccugaaacaucuucuguaaaua

SEQ ID NO: 778688 - RNA, 21 nt, Human
ccuccaggugauuccgugcuc

SEQ ID NO: 778689 - RNA, 22 nt, Human
gcagcccucgcuagcucucccc

SEQ ID NO: 778690 - RNA, 22 nt, Human
aagagaauacaagcaggcagga

SEQ ID NO: 778691 - RNA, 22 nt, Human
gagggagugccagagggccagc

SEQ ID NO: 778692 - RNA, 22 nt, Human
cuuaauuggcuuauuuccucaa

SEQ ID NO: 778693 - RNA, 22 nt, Human
ggccaggaacuuuugggauggg

SEQ ID NO: 778694 - RNA, 22 nt, Human
uggggaagaauaauguauguac

SEQ ID NO: 778695 - RNA, 22 nt, Human
uggcuuccugcauggauccucu

SEQ ID NO: 778696 - RNA, 22 nt, Human
cuuuggcugggcaaagggaggu

SEQ ID NO: 778697 - RNA, 22 nt, Human
aaaugcacagagccuuagagau

SEQ ID NO: 778698 - RNA, 22 nt, Human
acagaggucaccuuuguaucuu

SEQ ID NO: 778699 - RNA, 22 nt, Human
auucaucaacugauagccauag

SEQ ID NO: 778700 - RNA, 22 nt, Human
agguggcucugacagcucuggu

SEQ ID NO: 778701 - RNA, 22 nt, Human
ucaggcucugccaccuagauua

SEQ ID NO: 778702 - RNA, 22 nt, Human
accuagaauuuaaaacauugcu

SEQ ID NO: 778703 - RNA, 22 nt, Human
gccuccaggguagaggaggaag

SEQ ID NO: 778704 - RNA, 22 nt, Human
guggauggugguccaguaucau

SEQ ID NO: 778705 - RNA, 22 nt, Human
aggcuguguggucaugguggcu

SEQ ID NO: 778706 - RNA, 22 nt, Human
gcagcaucuguacauagacgcu

SEQ ID NO: 778707 - RNA, 22 nt, Human
uuguacaaaggauuuggaagag

SEQ ID NO: 778708 - RNA, 22 nt, Human
uacugugacagaguacuuaaac

SEQ ID NO: 778709 - RNA, 22 nt, Human
uaaugucuuaguaccuuaauuu

SEQ ID NO: 778710 - RNA, 16 nt, Human
guaacauucuguagcc

SEQ ID NO: 778711 - RNA, 22 nt, Human
caaauacuacgauucuugcagu

SEQ ID NO: 778712 - RNA, 22 nt, Human
aguguccuuguuauuacugcuc

SEQ ID NO: 778713 - RNA, 23 nt, Human
uguuaauacaucugccacucauu

SEQ ID NO: 778714 - RNA, 22 nt, Human
cuugcaugcauuugaagaucau

SEQ ID NO: 778715 - RNA, 22 nt, Human
agcaucuucaacaggcauuuua

SEQ ID NO: 778716 - RNA, 22 nt, Human
uggguccauggaacagaggugc

SEQ ID NO: 778717 - RNA, 22 nt, Human
ggcuucaaaaccuaucuuugau

SEQ ID NO: 778718 - RNA, 22 nt, Human
acaugugaggugugagugauac

SEQ ID NO: 778719 - RNA, 22 nt, Human
gugccuuuucuucauaguuacu

SEQ ID NO: 778720 - RNA, 22 nt, Human
agaaacugcagcucagagaagu

SEQ ID NO: 778721 - RNA, 22 nt, Human
ucugaagagucaucuuugggug

SEQ ID NO: 778722 - RNA, 23 nt, Human
aagaauaaaugacauuaaaggug

SEQ ID NO: 778723 - RNA, 22 nt, Human
gaggggcacagcagcuguugca

SEQ ID NO: 778724 - RNA, 22 nt, Human
uuuguacaccuaccuaauacag

SEQ ID NO: 778725 - RNA, 22 nt, Human
uuucacaacacaaucucguuaa

SEQ ID NO: 778726 - RNA, 22 nt, Human
cauucauaagacuuugcucuug

SEQ ID NO: 778727 - RNA, 22 nt, Human
caguacuuuucaaccaguauga

SEQ ID NO: 778728 - RNA, 22 nt, Human
gcagcaggaauaggauaagcaa

SEQ ID NO: 778729 - RNA, 22 nt, Human
acauauaugugcacaugugcag

SEQ ID NO: 778730 - RNA, 19 nt, Human
uuuucucagcuucuagcgg

SEQ ID NO: 778731 - RNA, 22 nt, Human
agcugccuguccuaggccauca

SEQ ID NO: 778732 - RNA, 19 nt, Human
aauguaguguuaugucaac

SEQ ID NO: 778733 - RNA, 20 nt, Human
agcacagcgcgguguuccuu

SEQ ID NO: 778734 - RNA, 22 nt, Human
uuggugagugcuauguaccaca

SEQ ID NO: 778735 - RNA, 22 nt, Human
aguggcugugaaauacauggga

SEQ ID NO: 778736 - RNA, 22 nt, Human
gcuguauuuaacaacuggcuca

SEQ ID NO: 778737 - RNA, 22 nt, Human
uacaguuuuuauucaugacaag

SEQ ID NO: 778738 - RNA, 18 nt, Human
agcaugagagaggcugug

SEQ ID NO: 778739 - RNA, 22 nt, Human
cagaaagcagagcugagccuuu

SEQ ID NO: 778740 - RNA, 22 nt, Human
aagcuuguagaguuugacuucc

SEQ ID NO: 778741 - RNA, 22 nt, Human
agcagccauccuuagagaaaga

SEQ ID NO: 778742 - RNA, 22 nt, Human
ccauccauguggcagggcuggc

SEQ ID NO: 778743 - RNA, 22 nt, Human
aaguguggggucucagagcuga

SEQ ID NO: 778744 - RNA, 22 nt, Human
agauucauuaucuucuuuguac

SEQ ID NO: 778745 - RNA, 22 nt, Human
acaggaggggcaugaaagacgg

SEQ ID NO: 778746 - RNA, 22 nt, Human
uauaauccauucauugauuucu

SEQ ID NO: 778747 - RNA, 22 nt, Human
agaguguguggggcugagguca

SEQ ID NO: 778748 - RNA, 19 nt, Human
agugagcauccagagaggu

SEQ ID NO: 778749 - RNA, 22 nt, Human
accaggcagcaccaaagccggu

SEQ ID NO: 778750 - RNA, 22 nt, Human
guauuagguuggugcaaaagua

SEQ ID NO: 778751 - RNA, 22 nt, Human
ggagccggagggccacuggcag

SEQ ID NO: 778752 - RNA, 22 nt, Human
gugcuaugauuggacagaauag

SEQ ID NO: 778753 - RNA, 22 nt, Human
caggguugguuucuccucaggc

SEQ ID NO: 778754 - RNA, 22 nt, Human
aaacuguaagugccucaagguc

SEQ ID NO: 778755 - RNA, 22 nt, Human
gcucuguguugucagaggcacc

SEQ ID NO: 778756 - RNA, 22 nt, Human
gggcugagugggccucuuacuu

SEQ ID NO: 778757 - RNA, 22 nt, Human
ucacagcuuugagcagagacca

SEQ ID NO: 778758 - RNA, 22 nt, Human
aaagugcuaggauuacaagcgu

SEQ ID NO: 778759 - RNA, 22 nt, Human
uaugagaaaauaaauaucuguu

SEQ ID NO: 778760 - RNA, 22 nt, Human
ucucagagugacaaugagaauu

SEQ ID NO: 778761 - RNA, 22 nt, Human
uccugagccccagggagguugg

SEQ ID NO: 778762 - RNA, 22 nt, Human
aaauugcuggcagccuuuauuc

SEQ ID NO: 778763 - RNA, 22 nt, Human
ugcugucccccgugucugggcu

SEQ ID NO: 778764 - RNA, 22 nt, Human
acuggaaaacacuacuacaugc

SEQ ID NO: 778765 - RNA, 22 nt, Human
uuuuuccuuggaugugucucuc

SEQ ID NO: 778766 - RNA, 22 nt, Human
ggugaaggucagagcaggaaaa

SEQ ID NO: 778767 - RNA, 22 nt, Human
aauggcuuucagcaaggauaga

SEQ ID NO: 778768 - RNA, 22 nt, Human
auacuuaacuguggagucauug

SEQ ID NO: 778769 - RNA, 22 nt, Human
caaaugaauauuuccauggguu

SEQ ID NO: 778770 - RNA, 22 nt, Human
cuauucaguaagccaaaaccau

SEQ ID NO: 778771 - RNA, 21 nt, Human
uagcagagaucauuuucuccu

SEQ ID NO: 778772 - RNA, 21 nt, Human
ugggggagaauugguugcuuu

SEQ ID NO: 778773 - RNA, 22 nt, Human
cccugaggcugaggauaggugg

SEQ ID NO: 778774 - RNA, 22 nt, Human
cacggguggaaucagggacucc

SEQ ID NO: 778775 - RNA, 22 nt, Human
uaaagguuuauucaacaaaaua

SEQ ID NO: 778776 - RNA, 22 nt, Human
acaguugacagggagaggguua

SEQ ID NO: 778777 - RNA, 22 nt, Human
uauuuguuucuaguggcagcaa

SEQ ID NO: 778778 - RNA, 22 nt, Human
uagcuguuaauauacaaauggu

SEQ ID NO: 778779 - RNA, 22 nt, Human
agagcuguagcuuccuagagcc

SEQ ID NO: 778780 - RNA, 22 nt, Human
uuuccugguuggggacgugguu

SEQ ID NO: 778781 - RNA, 15 nt, Human
aacaucacuauuuug

SEQ ID NO: 778782 - RNA, 21 nt, Human
ccagcccagcugugucccagc

SEQ ID NO: 778783 - RNA, 22 nt, Human
cagcucuggcuauugaggacca

SEQ ID NO: 778784 - RNA, 18 nt, Human
agcagggcauuuugccau

SEQ ID NO: 778785 - RNA, 22 nt, Human
uucaaguccuuuggaaggccug

SEQ ID NO: 778786 - RNA, 22 nt, Human
gcucaguguguucaagggcuca

SEQ ID NO: 778787 - RNA, 22 nt, Human
ccugagcacacaucagaaucac

SEQ ID NO: 778788 - RNA, 22 nt, Human
ucagagguggcaggggugucca

SEQ ID NO: 778789 - RNA, 22 nt, Human
ccaggcucugugugggcuagag

SEQ ID NO: 778790 - RNA, 22 nt, Human
cuauuagguaugcagccuauuu

SEQ ID NO: 778791 - RNA, 22 nt, Human
uggaaagcaguucuuagaaucg

SEQ ID NO: 778792 - RNA, 22 nt, Human
uucucagcuuuccuugcaguua

SEQ ID NO: 778793 - RNA, 22 nt, Human
guggucagagaugacagugggu

SEQ ID NO: 778794 - RNA, 17 nt, Human
aaguccagaguugagca

SEQ ID NO: 778795 - RNA, 22 nt, Human
uguaaaauaccauuccuuguca

SEQ ID NO: 778796 - RNA, 22 nt, Human
ugccuucucccuuggacccuga

SEQ ID NO: 778797 - RNA, 22 nt, Human
aggcagcauuugaauccagguc

SEQ ID NO: 778798 - RNA, 22 nt, Human
cacuggggugggccugguagag

SEQ ID NO: 778799 - RNA, 22 nt, Human
caaugguugaacccugucauga

SEQ ID NO: 778800 - RNA, 22 nt, Human
gccuggggucucugacucacag

SEQ ID NO: 778801 - RNA, 22 nt, Human
uaggcugagcuaagagagcuua

SEQ ID NO: 778802 - RNA, 22 nt, Human
ugguggacaccgcagccaugaa

SEQ ID NO: 778803 - RNA, 22 nt, Human
caaagggcauggccugagcacu

SEQ ID NO: 778804 - RNA, 22 nt, Human
cuggcuugggucuaccugccuu

SEQ ID NO: 778805 - RNA, 22 nt, Human
aguuauaugugaaaacacguau

SEQ ID NO: 778806 - RNA, 22 nt, Human
gccaagagaaugugagagaaau

SEQ ID NO: 778807 - RNA, 22 nt, Human
ggccugaggccaccagcagccc

SEQ ID NO: 778808 - RNA, 22 nt, Human
gaaggcauaaaaccaauuuugu

SEQ ID NO: 778809 - RNA, 16 nt, Human
gagccaggugccuuga

SEQ ID NO: 778810 - RNA, 22 nt, Human
gccugcugaaccucaugcaguc

SEQ ID NO: 778811 - RNA, 22 nt, Human
augcagauguuugguucauugu

SEQ ID NO: 778812 - RNA, 22 nt, Human
augaaacugaaggacaaccaga

SEQ ID NO: 778813 - RNA, 19 nt, Human
ucuccaguugcuuucaggg

SEQ ID NO: 778814 - RNA, 22 nt, Human
guuuguaugaauguuuuaugcu

SEQ ID NO: 778815 - RNA, 22 nt, Human
gccuggcucacagagcagccuu

SEQ ID NO: 778816 - RNA, 22 nt, Human
ggcuggaagguagaagaugagg

SEQ ID NO: 778817 - RNA, 22 nt, Human
gacaggauguauuggcaagagg

SEQ ID NO: 778818 - RNA, 22 nt, Human
ucagugucuugggcuugaaugc

SEQ ID NO: 778819 - RNA, 22 nt, Human
ggcaggugcaccugagccaucu

SEQ ID NO: 778820 - RNA, 22 nt, Human
auacuacauuauuagagccugg

SEQ ID NO: 778821 - RNA, 20 nt, Human
acuuaguuuuucucacagga

SEQ ID NO: 778822 - RNA, 22 nt, Human
cagucuucuaaccuagcagccu

SEQ ID NO: 778823 - RNA, 22 nt, Human
ucucucagggggaaggcugaag

SEQ ID NO: 778824 - RNA, 22 nt, Human
uacugaaacucuuguaaauauc

SEQ ID NO: 778825 - RNA, 22 nt, Human
uuuagccaaucagcuugggagc

SEQ ID NO: 778826 - RNA, 22 nt, Human
auugaaagcacaaagaacaagu

SEQ ID NO: 778827 - RNA, 22 nt, Human
gggcuacugagcuggaacuggg

SEQ ID NO: 778828 - RNA, 22 nt, Human
ucugggcugggcuuaggaaccc

SEQ ID NO: 778829 - RNA, 22 nt, Human
aagagacaaugucuuuuggaua

SEQ ID NO: 778830 - RNA, 22 nt, Human
ucagucucaucaacucuauucc

SEQ ID NO: 778831 - RNA, 22 nt, Human
uacuuuaaagagguguaaugag

SEQ ID NO: 778832 - RNA, 19 nt, Human
ugucacugucauggcccag

SEQ ID NO: 778833 - RNA, 22 nt, Human
gacagugugaacaucuaauagu

SEQ ID NO: 778834 - RNA, 22 nt, Human
agccauuguugucuucaucuuc

SEQ ID NO: 778835 - RNA, 22 nt, Human
uuuuuaagcuccuuugauguca

SEQ ID NO: 778836 - RNA, 20 nt, Human
uccuucugaggugaggagga

SEQ ID NO: 778837 - RNA, 22 nt, Human
ggccucaucacagugcauuagu

SEQ ID NO: 778838 - RNA, 22 nt, Human
uacaucauggugagcaggaggc

SEQ ID NO: 778839 - RNA, 19 nt, Human
gugucugccuuugugccac

SEQ ID NO: 778840 - RNA, 22 nt, Human
cuuuaugugcugggcauuaagg

SEQ ID NO: 778841 - RNA, 22 nt, Human
augaaacaaaccucuauggagu

SEQ ID NO: 778842 - RNA, 22 nt, Human
agcagccuugcaggggucgcac

SEQ ID NO: 778843 - RNA, 22 nt, Human
auauguguauggauuucuaucu

SEQ ID NO: 778844 - RNA, 22 nt, Human
gauuucuuuagguguaauagug

SEQ ID NO: 778845 - RNA, 22 nt, Human
ugcucccaggcauucucuguug

SEQ ID NO: 778846 - RNA, 22 nt, Human
gcacagcaugaagagaggaagc

SEQ ID NO: 778847 - RNA, 22 nt, Human
ucagggucagauuccagagccu

SEQ ID NO: 778848 - RNA, 22 nt, Human
auggggaagagccagugagcug

SEQ ID NO: 778849 - RNA, 22 nt, Human
agagccagcaacucuagcccug

SEQ ID NO: 778850 - RNA, 22 nt, Human
cugcauccauguugcugcaaag

SEQ ID NO: 778851 - RNA, 22 nt, Human
ucaggcaaggcccuuagagugu

SEQ ID NO: 778852 - RNA, 19 nt, Human
agggaaggauucugucauu

SEQ ID NO: 778853 - RNA, 22 nt, Human
uggccugguuguugcugccguu

SEQ ID NO: 778854 - RNA, 22 nt, Human
cugggccuuaugaguaccugga

SEQ ID NO: 778855 - RNA, 22 nt, Human
ugucagagcaaggccaggccag

SEQ ID NO: 778856 - RNA, 22 nt, Human
gcuggcugggacagauuccauu

SEQ ID NO: 778857 - RNA, 22 nt, Human
acugagcugcuugaagugaacu

SEQ ID NO: 778858 - RNA, 22 nt, Human
acaaauagaaaaucuggauugg

SEQ ID NO: 778859 - RNA, 22 nt, Human
auuaucacauggacuuugcuuu

SEQ ID NO: 778860 - RNA, 22 nt, Human
ccugggaggcugugggucugcu

SEQ ID NO: 778861 - RNA, 23 nt, Human
aacuccugaaucgugagccaucu

SEQ ID NO: 778862 - RNA, 19 nt, Human
gcaugcagaguaagaaggu

SEQ ID NO: 778863 - RNA, 22 nt, Human
uggcuggauaucagaggaagug

SEQ ID NO: 778864 - RNA, 22 nt, Human
uuguccugauuuugcaacuucu

SEQ ID NO: 778865 - RNA, 22 nt, Human
aaggaacuuugcagaggugauu

SEQ ID NO: 778866 - RNA, 22 nt, Human
ccacagagacagagcccagggu

SEQ ID NO: 778867 - RNA, 22 nt, Human
uuguuaaauggaugcagaauaa

SEQ ID NO: 778868 - RNA, 22 nt, Human
uggaggccgaauuagagcguug

SEQ ID NO: 778869 - RNA, 22 nt, Human
aagauucucagaaaaaggcuau

SEQ ID NO: 778870 - RNA, 22 nt, Human
gagaacacuaaugguuucuuaa

SEQ ID NO: 778871 - RNA, 22 nt, Human
uggccuggaagagaggucgagg

SEQ ID NO: 778872 - RNA, 22 nt, Human
uacaugcucaguaacuuucagu

SEQ ID NO: 778873 - RNA, 22 nt, Human
auccacaggucauguaaugugg

SEQ ID NO: 778874 - RNA, 19 nt, Human
ugaauacagagauacagaa

SEQ ID NO: 778875 - RNA, 20 nt, Human
agcuccucaucacuggaggu

SEQ ID NO: 778876 - RNA, 22 nt, Human
agucugcacucagguggagguc

SEQ ID NO: 778877 - RNA, 22 nt, Human
cuggcuguuucaaauguauaga

SEQ ID NO: 778878 - RNA, 22 nt, Human
aggagggugauccgggcugguc

SEQ ID NO: 778879 - RNA, 18 nt, Human
cucugcuaaugggcagcu

SEQ ID NO: 778880 - RNA, 21 nt, Human
ccagcagcucaaggaucucuu

SEQ ID NO: 778881 - RNA, 22 nt, Human
gcaguuuuagagcuuuaagaug

SEQ ID NO: 778882 - RNA, 22 nt, Human
caucaucaacuggcagguaagu

SEQ ID NO: 778883 - RNA, 22 nt, Human
gaggcacaguucuuccuccaga

SEQ ID NO: 778884 - RNA, 22 nt, Human
uauggguauuauugguaagaau

SEQ ID NO: 778885 - RNA, 22 nt, Human
gcagcuggagcaucuucucauc

SEQ ID NO: 778886 - RNA, 22 nt, Human
uucuacauugugaaguucuuua

SEQ ID NO: 778887 - RNA, 22 nt, Human
gucuuuggaggcacuguugagu

SEQ ID NO: 778888 - RNA, 22 nt, Human
caugcauuacaauugcauagua

SEQ ID NO: 778889 - RNA, 22 nt, Human
caugggcaccuuaaaaugaggc

SEQ ID NO: 778890 - RNA, 22 nt, Human
ucauucaauguaagcauauaua

SEQ ID NO: 778891 - RNA, 22 nt, Human
uagguucaggagauauugcaca

SEQ ID NO: 778892 - RNA, 22 nt, Human
cucagaaaggugccauuuaugu

SEQ ID NO: 778893 - RNA, 22 nt, Human
ugggcugcugagaaugagagag

SEQ ID NO: 778894 - RNA, 22 nt, Human
uuccaaagucauguugcugaua

SEQ ID NO: 778895 - RNA, 22 nt, Human
gagcagcuggcuguauugguuu

SEQ ID NO: 778896 - RNA, 22 nt, Human
cuucacaaaauauuucauuaua

SEQ ID NO: 778897 - RNA, 22 nt, Human
ugaaagaugcucaaugaauggu

SEQ ID NO: 778898 - RNA, 22 nt, Human
cucugugugcuggugggguccu

SEQ ID NO: 778899 - RNA, 22 nt, Human
uugaaaaugguaagcaugauau

SEQ ID NO: 778900 - RNA, 22 nt, Human
cugccugcgccaccaccacguc

SEQ ID NO: 778901 - RNA, 22 nt, Human
uuucuacaacacuucugaaucu

SEQ ID NO: 778902 - RNA, 22 nt, Human
uuuuugugauaugacacuguau

SEQ ID NO: 778903 - RNA, 22 nt, Human
gcaggcugcugagauccuuagg

SEQ ID NO: 778904 - RNA, 22 nt, Human
gugcuuucugcaugguuccuac

SEQ ID NO: 778905 - RNA, 22 nt, Human
uggaacaaaauauuuauguuug

SEQ ID NO: 778906 - RNA, 22 nt, Human
gagcaagacucacugcaucuug

SEQ ID NO: 778907 - RNA, 22 nt, Human
auuuccaggcuguuuugugaau

SEQ ID NO: 778908 - RNA, 22 nt, Human
aacucacacaaguauugccugc

SEQ ID NO: 778909 - RNA, 19 nt, Human
ugugacaucacugggcagc

SEQ ID NO: 778910 - RNA, 22 nt, Human
agcucuggggccugucccacau

SEQ ID NO: 778911 - RNA, 22 nt, Human
uccugccaucugcuguugaucu

SEQ ID NO: 778912 - RNA, 22 nt, Human
aaucuguucuacucuauucaga

SEQ ID NO: 778913 - RNA, 22 nt, Human
gaaggcucuggggauugagaua

SEQ ID NO: 778914 - RNA, 22 nt, Human
uacacauauguguguauaugug

SEQ ID NO: 778915 - RNA, 22 nt, Human
cuuccucucaauaagaugagaa

SEQ ID NO: 778916 - RNA, 22 nt, Human
aggccuggugaaugaaguaucu

SEQ ID NO: 778917 - RNA, 22 nt, Human
acucucccagcuauauguggug

SEQ ID NO: 778918 - RNA, 22 nt, Human
cccaugagaccugguuuaaggc

SEQ ID NO: 778919 - RNA, 22 nt, Human
ugguuaaaugggaagagcaaca

SEQ ID NO: 778920 - RNA, 20 nt, Human
uuacaaagaggcaucgcuuu

SEQ ID NO: 778921 - RNA, 22 nt, Human
agccuaggucugggucuagcag

SEQ ID NO: 778922 - RNA, 22 nt, Human
uauggcagaggagaggcacuag

SEQ ID NO: 778923 - RNA, 22 nt, Human
auuacaguucugcagguaguuu

SEQ ID NO: 778924 - RNA, 22 nt, Human
auugaaugcuugcuaacacuuu

SEQ ID NO: 778925 - RNA, 22 nt, Human
gcagaggugaccagcagcaggg

SEQ ID NO: 778926 - RNA, 22 nt, Human
uuugagauggagucuugcucug

SEQ ID NO: 778927 - RNA, 22 nt, Human
uuuccucuucuucccaugucau

SEQ ID NO: 778928 - RNA, 22 nt, Human
uuucaguuagcugagacccagg

SEQ ID NO: 778929 - RNA, 22 nt, Human
uugcagggcaucuaugucuggu

SEQ ID NO: 778930 - RNA, 22 nt, Human
guggucagaauggagcccagga

SEQ ID NO: 778931 - RNA, 22 nt, Human
uaggaaauauuugaacauagga

SEQ ID NO: 778932 - RNA, 22 nt, Human
uuacaugguaaacacucuuuua

SEQ ID NO: 778933 - RNA, 17 nt, Human
ugaaagaaucagggaga

SEQ ID NO: 778934 - RNA, 22 nt, Human
uuaugcagauggcaugaggagg

SEQ ID NO: 778935 - RNA, 22 nt, Human
uguguauucugagguagguaua

SEQ ID NO: 778936 - RNA, 22 nt, Human
ggcagacacaaaaacauaaggu

SEQ ID NO: 778937 - RNA, 22 nt, Human
gguggguuuggaagagcaggcu

SEQ ID NO: 778938 - RNA, 22 nt, Human
acauucuauuucaucaugucua

SEQ ID NO: 778939 - RNA, 22 nt, Human
ugggugcucugcgaccguaggg

SEQ ID NO: 778940 - RNA, 22 nt, Human
uaaaugcaagugcuccugggag

SEQ ID NO: 778941 - RNA, 22 nt, Human
guguaucaguaacuguggacag

SEQ ID NO: 778942 - RNA, 22 nt, Human
ucugccugaggacugacaccag

SEQ ID NO: 778943 - RNA, 22 nt, Human
uggagugaaguaaagaggacaa

SEQ ID NO: 778944 - RNA, 22 nt, Human
aaaugucuuugaguauuucugc

SEQ ID NO: 778945 - RNA, 22 nt, Human
uagggcucgggcacaggacagg

SEQ ID NO: 778946 - RNA, 16 nt, Human
gcugggagggagaggu

SEQ ID NO: 778947 - RNA, 22 nt, Human
ugaguccugcugagcagagagg

SEQ ID NO: 778948 - RNA, 22 nt, Human
uccagccccggcuuccuuacag

SEQ ID NO: 778949 - RNA, 22 nt, Human
agcagcuguggggacaagggua

SEQ ID NO: 778950 - RNA, 22 nt, Human
caggccuugucaagaaaaugcc

SEQ ID NO: 778951 - RNA, 22 nt, Human
gaaauucaggacaaagacucuu

SEQ ID NO: 778952 - RNA, 22 nt, Human
uguauugaauuguguuauaucu

SEQ ID NO: 778953 - RNA, 22 nt, Human
agugcugucaguuuuauagaua

SEQ ID NO: 778954 - RNA, 22 nt, Human
aggaaauugggacacagagaaa

SEQ ID NO: 778955 - RNA, 22 nt, Human
aagagccuggcugcuaggcuca

SEQ ID NO: 778956 - RNA, 22 nt, Human
cgcuggggcuuuuugcuugaga

SEQ ID NO: 778957 - RNA, 22 nt, Human
uaccaagguaguggagacagaa

SEQ ID NO: 778958 - RNA, 22 nt, Human
ugacagaaugugacucucagau

SEQ ID NO: 778959 - RNA, 22 nt, Human
ccugaaaugacuccagcugagu

SEQ ID NO: 778960 - RNA, 21 nt, Human
ccugagccuguuuauccagaa

SEQ ID NO: 778961 - RNA, 22 nt, Human
cagugggguuucugugggugcu

SEQ ID NO: 778962 - RNA, 22 nt, Human
agagcacacugacgucagucug

SEQ ID NO: 778963 - RNA, 22 nt, Human
gaugaggaaaccaaggcucagg

SEQ ID NO: 778964 - RNA, 22 nt, Human
gcauggccauggcacuauggac

SEQ ID NO: 778965 - RNA, 22 nt, Human
gaggccuggaauuccagccugg

SEQ ID NO: 778966 - RNA, 22 nt, Human
uccuucuucaugaagauauaug

SEQ ID NO: 778967 - RNA, 22 nt, Human
ggagaggugagagguacaaguu

SEQ ID NO: 778968 - RNA, 22 nt, Human
gagggcugaaguguuuuaugag

SEQ ID NO: 778969 - RNA, 22 nt, Human
cuucuccagccacgcccacucc

SEQ ID NO: 778970 - RNA, 22 nt, Human
agaaaugcauuagcacauauag

SEQ ID NO: 778971 - RNA, 22 nt, Human
agaaagagaugaaugcuuuaag

SEQ ID NO: 778972 - RNA, 22 nt, Human
ucuuuugugauucuucaguuac

SEQ ID NO: 778973 - RNA, 22 nt, Human
agucugucuuuggcuucaccac

SEQ ID NO: 778974 - RNA, 18 nt, Human
uuuacucauaggccugac

SEQ ID NO: 778975 - RNA, 22 nt, Human
aaaccucuuuccauuagaggaa

SEQ ID NO: 778976 - RNA, 22 nt, Human
ccuaggagagggaaaaucuagg

SEQ ID NO: 778977 - RNA, 23 nt, Human
cuuuaaugaaauucucugugaag

SEQ ID NO: 778978 - RNA, 22 nt, Human
cauauuagacacuuauguccac

SEQ ID NO: 778979 - RNA, 22 nt, Human
uggagggcuaagcugagggaua

SEQ ID NO: 778980 - RNA, 22 nt, Human
uccuuucuccgggggacuguug

SEQ ID NO: 778981 - RNA, 22 nt, Human
uauguacauguuaaagggcaaa

SEQ ID NO: 778982 - RNA, 22 nt, Human
ccugucuguaucgguucagagu

SEQ ID NO: 778983 - RNA, 22 nt, Human
aagcacaucuccugugcagaac

SEQ ID NO: 778984 - RNA, 22 nt, Human
uggguccuugcugauugcugag

SEQ ID NO: 778985 - RNA, 22 nt, Human
cagaucugugguaucucuauuu

SEQ ID NO: 778986 - RNA, 22 nt, Human
uuugcaauuugugcugcaaaug

SEQ ID NO: 778987 - RNA, 23 nt, Human
gccucagagaaacagcugcacac

SEQ ID NO: 778988 - RNA, 22 nt, Human
aguggcagacacaaugugggca

SEQ ID NO: 778989 - RNA, 22 nt, Human
caagguuuacauugggcuauca

SEQ ID NO: 778990 - RNA, 22 nt, Human
gcagcuggggaggucgugggga

SEQ ID NO: 778991 - RNA, 22 nt, Human
cugucuguggucucaguaggcc

SEQ ID NO: 778992 - RNA, 22 nt, Human
ugcggcagccaccgcguggccc

SEQ ID NO: 778993 - RNA, 22 nt, Human
cacauguuuggcaugucaccaa

SEQ ID NO: 778994 - RNA, 22 nt, Human
uugcauugggagugaggagacc

SEQ ID NO: 778995 - RNA, 22 nt, Human
gagugcaggccugagcaccauc

SEQ ID NO: 778996 - RNA, 22 nt, Human
auguaugcauagugaguaaaug

SEQ ID NO: 778997 - RNA, 22 nt, Human
gcugcgucgagacagccuggca

SEQ ID NO: 778998 - RNA, 22 nt, Human
ucccagagcagaugugcuaaag

SEQ ID NO: 778999 - RNA, 22 nt, Human
aaacaggcuugcaacauguuuu

SEQ ID NO: 779000 - RNA, 22 nt, Human
accagaggaagggaaucucaag

SEQ ID NO: 779001 - RNA, 22 nt, Human
ggaugcugcuaucaggcuucga

SEQ ID NO: 779002 - RNA, 21 nt, Human
uuaaggucacuucugagccua

SEQ ID NO: 779003 - RNA, 22 nt, Human
cuggcuccaucuuugcuuccug

SEQ ID NO: 779004 - RNA, 22 nt, Human
ccuggggagagaaagcccagcc

SEQ ID NO: 779005 - RNA, 22 nt, Human
ugaaugauauauugggaauaau

SEQ ID NO: 779006 - RNA, 22 nt, Human
caauaaagaagauuuuugcaau

SEQ ID NO: 779007 - RNA, 22 nt, Human
uccugggagcauggugccguga

SEQ ID NO: 779008 - RNA, 22 nt, Human
ugccagccagguucugaggcua

SEQ ID NO: 779009 - RNA, 22 nt, Human
cuuguuaaauuauauaagcaga

SEQ ID NO: 779010 - RNA, 22 nt, Human
uuggccuccacauuuuccaggu

SEQ ID NO: 779011 - RNA, 19 nt, Human
auguacccagugucaaucc

SEQ ID NO: 779012 - RNA, 20 nt, Human
acagaaagagagaaugucag

SEQ ID NO: 779013 - RNA, 22 nt, Human
ccuccagacuuuggccauccuc

SEQ ID NO: 779014 - RNA, 22 nt, Human
agaggggguguuccagaagcau

SEQ ID NO: 779015 - RNA, 22 nt, Human
uagcucucuuuaucuuucuaua

SEQ ID NO: 779016 - RNA, 22 nt, Human
uugaggagucaggggcacggaa

SEQ ID NO: 779017 - RNA, 22 nt, Human
cagcuucugcuaucgaacaucu

SEQ ID NO: 779018 - RNA, 22 nt, Human
uaggcagaauuguugaaugaag

SEQ ID NO: 779019 - RNA, 22 nt, Human
caugugguauugugagauccac

SEQ ID NO: 779020 - RNA, 22 nt, Human
aggaggcuuuugcaggugccac

SEQ ID NO: 779021 - RNA, 22 nt, Human
cagcuagggaguggcagagcuu

SEQ ID NO: 779022 - RNA, 20 nt, Human
ccuucagaacuuacauagua

SEQ ID NO: 779023 - RNA, 22 nt, Human
ggagaugguggaagcuggugca

SEQ ID NO: 779024 - RNA, 22 nt, Human
uuauuuauaucucugcaguuua

SEQ ID NO: 779025 - RNA, 22 nt, Human
uacuuaaaacugauagaaucuc

SEQ ID NO: 779026 - RNA, 22 nt, Human
aggcucuauaccgcugggaguu

SEQ ID NO: 779027 - RNA, 22 nt, Human
uuucccaaguguaaacauggca

SEQ ID NO: 779028 - RNA, 22 nt, Human
gcacuguucucagagcauuaga

SEQ ID NO: 779029 - RNA, 22 nt, Human
ucccacaccugucuauuccuag

SEQ ID NO: 779030 - RNA, 22 nt, Human
cugucuguacugagaguucugu

SEQ ID NO: 779031 - RNA, 22 nt, Human
ugggcugaguggcagccagagu

SEQ ID NO: 779032 - RNA, 22 nt, Human
uucugauacagucccaacacaa

SEQ ID NO: 779033 - RNA, 22 nt, Human
gggaagcugaagcuagagaaaa

SEQ ID NO: 779034 - RNA, 22 nt, Human
gggcugaccaaugccuugcuuu

SEQ ID NO: 779035 - RNA, 22 nt, Human
ccuccagcgcgauccacuccgg

SEQ ID NO: 779036 - RNA, 22 nt, Human
ccacccugugcaggcgugggua

SEQ ID NO: 779037 - RNA, 22 nt, Human
ugcccuguuccugccuccagcu

SEQ ID NO: 779038 - RNA, 22 nt, Human
caguuuuaugucgaauguauac

SEQ ID NO: 779039 - RNA, 22 nt, Human
aggcucaguuugguuuccauug

SEQ ID NO: 779040 - RNA, 22 nt, Human
uggacaggugcacacagcagcc

SEQ ID NO: 779041 - RNA, 22 nt, Human
gaaguuauugccugugaugaaa

SEQ ID NO: 779042 - RNA, 22 nt, Human
aauugguuugaguugucucuau

SEQ ID NO: 779043 - RNA, 22 nt, Human
agugaccaaucacugaaugauu

SEQ ID NO: 779044 - RNA, 22 nt, Human
gccccagcagcaaugcgguuga

SEQ ID NO: 779045 - RNA, 19 nt, Human
cagucccaaauucuuguca

SEQ ID NO: 779046 - RNA, 22 nt, Human
aucuuauuuaacacagcaaaac

SEQ ID NO: 779047 - RNA, 22 nt, Human
agaagcuguugcauuccuggcg

SEQ ID NO: 779048 - RNA, 20 nt, Human
gucuccucuuugcauuccua

SEQ ID NO: 779049 - RNA, 22 nt, Human
ggaugucgaggaugggguagca

SEQ ID NO: 779050 - RNA, 22 nt, Human
guuuuguugcugcagagcucaa

SEQ ID NO: 779051 - RNA, 22 nt, Human
ugccacagagcaauucugcuga

SEQ ID NO: 779052 - RNA, 22 nt, Human
uaggcagagguaugguaaggac

SEQ ID NO: 779053 - RNA, 20 nt, Human
ugugugcuaggacuacagug

SEQ ID NO: 779054 - RNA, 22 nt, Human
uauuuaguuaucuuucauaaaa

SEQ ID NO: 779055 - RNA, 22 nt, Human
guccugaaugccuuuaggcaga

SEQ ID NO: 779056 - RNA, 22 nt, Human
gagccugaaauacaggucacug

SEQ ID NO: 779057 - RNA, 22 nt, Human
uguuacacccacaaaaaauucc

SEQ ID NO: 779058 - RNA, 22 nt, Human
augggaggguggaaaggcucug

SEQ ID NO: 779059 - RNA, 22 nt, Human
aacaugaaaacuaccugugauu

SEQ ID NO: 779060 - RNA, 22 nt, Human
ucaggcuggaaugcaguggggc

SEQ ID NO: 779061 - RNA, 22 nt, Human
cagggcaaagagagcacaugcu

SEQ ID NO: 779062 - RNA, 22 nt, Human
uuuauaugaaagugaccagugg

SEQ ID NO: 779063 - RNA, 22 nt, Human
ugcuccacccucacacucuucc

SEQ ID NO: 779064 - RNA, 22 nt, Human
uagaagugaaagacuugauguc

SEQ ID NO: 779065 - RNA, 22 nt, Human
ugguuauaaauugcuaugcaga

SEQ ID NO: 779066 - RNA, 22 nt, Human
uugaaugaauaaaagaguaagg

SEQ ID NO: 779067 - RNA, 22 nt, Human
gaggccaggaggaucucucuaa

SEQ ID NO: 779068 - RNA, 22 nt, Human
acacuguagcugagggcaugcg

SEQ ID NO: 779069 - RNA, 22 nt, Human
ucugaggccugaagcagcagag

SEQ ID NO: 779070 - RNA, 22 nt, Human
uuauuguuuaaagccauguaaa

SEQ ID NO: 779071 - RNA, 23 nt, Human
acaaugucuguucauaaaauacc

SEQ ID NO: 779072 - RNA, 22 nt, Human
uuuaccaagaguugucacuguu

SEQ ID NO: 779073 - RNA, 22 nt, Human
augugucugugggcacacacac

SEQ ID NO: 779074 - RNA, 22 nt, Human
uccuggguucauguccuggugc

SEQ ID NO: 779075 - RNA, 22 nt, Human
guccugguagggcucugugucu

SEQ ID NO: 779076 - RNA, 22 nt, Human
aggcuccuagccuguggcuggu

SEQ ID NO: 779077 - RNA, 22 nt, Human
aucuuauugcuguugccagaua

SEQ ID NO: 779078 - RNA, 22 nt, Human
gagcuagguugagacucacuua

SEQ ID NO: 779079 - RNA, 22 nt, Human
cagcacagcugaggggcugucu

SEQ ID NO: 779080 - RNA, 22 nt, Human
accuuaaaggccgaaguaaaga

SEQ ID NO: 779081 - RNA, 22 nt, Human
uuaauauacaauuuuacgggcu

SEQ ID NO: 779082 - RNA, 22 nt, Human
cauuuccuuccugcugcuccuc

SEQ ID NO: 779083 - RNA, 22 nt, Human
ucagcaaccaggggcacagucc

SEQ ID NO: 779084 - RNA, 22 nt, Human
acccagagccagggucaggagc

SEQ ID NO: 779085 - RNA, 22 nt, Human
cuccaggaccagggcuccugga

SEQ ID NO: 779086 - RNA, 22 nt, Human
aacuugaaccacagaagcugcc

SEQ ID NO: 779087 - RNA, 21 nt, Human
aggaaaauugaggguuguugu

SEQ ID NO: 779088 - RNA, 22 nt, Human
ucacuugagagauauuagaagu

SEQ ID NO: 779089 - RNA, 22 nt, Human
ucaggcagaccaccgugggcag

SEQ ID NO: 779090 - RNA, 22 nt, Human
aucuaagaggaugguuggaaau

SEQ ID NO: 779091 - RNA, 22 nt, Human
auucaguuucaaucauuguagu

SEQ ID NO: 779092 - RNA, 22 nt, Human
agugcauagggggaugcacagc

SEQ ID NO: 779093 - RNA, 22 nt, Human
ucuccuguaugggacuggcgag

SEQ ID NO: 779094 - RNA, 23 nt, Human
agggagaugccacaaagaugccc

SEQ ID NO: 779095 - RNA, 22 nt, Human
gcucuggagauggagccuugag

SEQ ID NO: 779096 - RNA, 17 nt, Human
uguggccuucugagcuu

SEQ ID NO: 779097 - RNA, 21 nt, Human
gcugcaucaaucuacccaggg

SEQ ID NO: 779098 - RNA, 22 nt, Human
ucuaggagcaugaagggaaggc

SEQ ID NO: 779099 - RNA, 22 nt, Human
gggcucugguacuuccuggcuc

SEQ ID NO: 779100 - RNA, 22 nt, Human
uagauuugugcaagaagggauu

SEQ ID NO: 779101 - RNA, 22 nt, Human
aaacuagaaaucagcaagauag

SEQ ID NO: 779102 - RNA, 23 nt, Human
acaaggcaacauagaucagggca

SEQ ID NO: 779103 - RNA, 22 nt, Human
acagucuacaaagugaugugug

SEQ ID NO: 779104 - RNA, 22 nt, Human
ucuuaugcauauucauaacaca

SEQ ID NO: 779105 - RNA, 22 nt, Human
cuggggucagggaucagagagc

SEQ ID NO: 779106 - RNA, 22 nt, Human
uuaaaaccaucagcuguaagau

SEQ ID NO: 779107 - RNA, 17 nt, Human
ugaguuaaguuuagauc

SEQ ID NO: 779108 - RNA, 22 nt, Human
augaaccauaggcaagacaaua

SEQ ID NO: 779109 - RNA, 22 nt, Human
uagcagcccaguuucuggccaa

SEQ ID NO: 779110 - RNA, 22 nt, Human
agcccaugguguacucuguggc

SEQ ID NO: 779111 - RNA, 22 nt, Human
uggguuaauagaaucauuaacu

SEQ ID NO: 779112 - RNA, 22 nt, Human
uuguuuacuaagaaccugguca

SEQ ID NO: 779113 - RNA, 22 nt, Human
cagggucuuggcgccaucaccc

SEQ ID NO: 779114 - RNA, 22 nt, Human
acagcuggagugaggauggagu

SEQ ID NO: 779115 - RNA, 22 nt, Human
gcuuuauuuugugagggauuac

SEQ ID NO: 779116 - RNA, 22 nt, Human
uggcccugacagguccugggca

SEQ ID NO: 779117 - RNA, 22 nt, Human
gagagaagaauguuccgaggcc

SEQ ID NO: 779118 - RNA, 22 nt, Human
aucuuacauucccucaccauuu

SEQ ID NO: 779119 - RNA, 22 nt, Human
ggucagaggucccagaagaagc

SEQ ID NO: 779120 - RNA, 22 nt, Human
uucuauaaaugaauguguauau

SEQ ID NO: 779121 - RNA, 23 nt, Human
aggucuggacccuuggccccugc

SEQ ID NO: 779122 - RNA, 22 nt, Human
guggcccugugaacagcgcagu

SEQ ID NO: 779123 - RNA, 22 nt, Human
ggaacugauuaagucaugagaa

SEQ ID NO: 779124 - RNA, 22 nt, Human
cccucucucuaucgggccccag

SEQ ID NO: 779125 - RNA, 22 nt, Human
agacauuguuggccuauccucu

SEQ ID NO: 779126 - RNA, 22 nt, Human
uucuuaagucaguaagaugcaa

SEQ ID NO: 779127 - RNA, 22 nt, Human
augugugcaucaaugauagauc

SEQ ID NO: 779128 - RNA, 22 nt, Human
guggcccuugaagcagcuucau

SEQ ID NO: 779129 - RNA, 22 nt, Human
uauguuuaaauguauguguaug

SEQ ID NO: 779130 - RNA, 22 nt, Human
ucacagacacagggagaagcau

SEQ ID NO: 779131 - RNA, 22 nt, Human
agagccaggaugucuucugggg

SEQ ID NO: 779132 - RNA, 19 nt, Human
ccuggcugcugugggaugc

SEQ ID NO: 779133 - RNA, 22 nt, Human
ucauuuauagcuaaccuugaau

SEQ ID NO: 779134 - RNA, 20 nt, Human
aggcucagauacccagggaa

SEQ ID NO: 779135 - RNA, 22 nt, Human
gcucagugaagggugccaagua

SEQ ID NO: 779136 - RNA, 22 nt, Human
cauuugaagacuuagaagagga

SEQ ID NO: 779137 - RNA, 22 nt, Human
uacuuuauuguaaaugcugaug

SEQ ID NO: 779138 - RNA, 22 nt, Human
cagcaggcggcccgcgggcccg

SEQ ID NO: 779139 - RNA, 23 nt, Human
agaucacauaguuaucagaugac

SEQ ID NO: 779140 - RNA, 22 nt, Human
uucuuuaugcuucuguuuaggc

SEQ ID NO: 779141 - RNA, 22 nt, Human
aagugaauuucauuccaauucu

SEQ ID NO: 779142 - RNA, 22 nt, Human
gugcugugcgcuuuuucuguau

SEQ ID NO: 779143 - RNA, 22 nt, Human
agucaguugcaaacaucaggca

SEQ ID NO: 779144 - RNA, 22 nt, Human
acaauaugggauauacauuuua

SEQ ID NO: 779145 - RNA, 22 nt, Human
ggaugaggaagauuacugagaa

SEQ ID NO: 779146 - RNA, 22 nt, Human
gaacagacuuugccaauuacag

SEQ ID NO: 779147 - RNA, 22 nt, Human
ggggaagggaguccaaguguua

SEQ ID NO: 779148 - RNA, 22 nt, Human
ccuuucucauuuuaagcauuag

SEQ ID NO: 779149 - RNA, 22 nt, Human
auacaacagaaaaugauuauuc

SEQ ID NO: 779150 - RNA, 22 nt, Human
gucuucuuuucagucugcuugu

SEQ ID NO: 779151 - RNA, 22 nt, Human
gccaggcuguuuuuauuacugu

SEQ ID NO: 779152 - RNA, 22 nt, Human
uccagaggugaacacccaggca

SEQ ID NO: 779153 - RNA, 23 nt, Human
auauggcuguuguguguuaacau

SEQ ID NO: 779154 - RNA, 22 nt, Human
cagggccaugaggcacaggguc

SEQ ID NO: 779155 - RNA, 22 nt, Human
uaacuacuaauugaugauaaug

SEQ ID NO: 779156 - RNA, 22 nt, Human
cagguggcuucucugcagccuu

SEQ ID NO: 779157 - RNA, 22 nt, Human
auucaguuauucagagaaggga

SEQ ID NO: 779158 - RNA, 22 nt, Human
auaguaugaauuaaaucaugag

SEQ ID NO: 779159 - RNA, 18 nt, Human
agcuccugaacucugugg

SEQ ID NO: 779160 - RNA, 22 nt, Human
uccaagaacccaagcgaaugcc

SEQ ID NO: 779161 - RNA, 22 nt, Human
uccacccugcuuucuuaucucc

SEQ ID NO: 779162 - RNA, 22 nt, Human
cuucuggguauuccagauaccu

SEQ ID NO: 779163 - RNA, 22 nt, Human
uugauaucucugcuguguuagg

SEQ ID NO: 779164 - RNA, 22 nt, Human
uauucugugugauauguaaaug

SEQ ID NO: 779165 - RNA, 22 nt, Human
uucagugugcuucaggacguua

SEQ ID NO: 779166 - RNA, 22 nt, Human
cucuggguucagaacagcaagc

SEQ ID NO: 779167 - RNA, 22 nt, Human
ucaguguguaguaaauuguagg

SEQ ID NO: 779168 - RNA, 22 nt, Human
uuagccauugucagcacauggc

SEQ ID NO: 779169 - RNA, 22 nt, Human
cucuuccuacagucugcuaugc

SEQ ID NO: 779170 - RNA, 22 nt, Human
gugggcuuuggccucuuucucc

SEQ ID NO: 779171 - RNA, 22 nt, Human
agguucuuggugagcauuuggu

SEQ ID NO: 779172 - RNA, 22 nt, Human
ccugggcagguguggcuucccc

SEQ ID NO: 779173 - RNA, 20 nt, Human
agacaggagcccccauucag

SEQ ID NO: 779174 - RNA, 22 nt, Human
cauuugcucugugucaguggca

SEQ ID NO: 779175 - RNA, 19 nt, Human
guacaauguguuguuggua

SEQ ID NO: 779176 - RNA, 22 nt, Human
ggcuaaagauguguucuuugga

SEQ ID NO: 779177 - RNA, 22 nt, Human
uugcuuuguggugguucuucca

SEQ ID NO: 779178 - RNA, 22 nt, Human
ucaggcugcuguacugugaaug

SEQ ID NO: 779179 - RNA, 22 nt, Human
agcuaggacagguagagauggg

SEQ ID NO: 779180 - RNA, 22 nt, Human
uggguccuaaaugcagucacau

SEQ ID NO: 779181 - RNA, 22 nt, Human
cccugucucauugaucacuugu

SEQ ID NO: 779182 - RNA, 22 nt, Human
acauuuaaccuuugaggaacug

SEQ ID NO: 779183 - RNA, 22 nt, Human
acgaugaugaaagagaacauuc

SEQ ID NO: 779184 - RNA, 22 nt, Human
aguguuuaaaaauggaaaugca

SEQ ID NO: 779185 - RNA, 22 nt, Human
aaacccagagacuagaaagacc

SEQ ID NO: 779186 - RNA, 22 nt, Human
gcagagcuccccaagacaccaa

SEQ ID NO: 779187 - RNA, 22 nt, Human
aaagagcucuuacucuagugua

SEQ ID NO: 779188 - RNA, 22 nt, Human
ucuccucugcgcggcagugccc

SEQ ID NO: 779189 - RNA, 22 nt, Human
augagguuuuacugccauuuuc

SEQ ID NO: 779190 - RNA, 22 nt, Human
gcauccauggagagcacucuga

SEQ ID NO: 779191 - RNA, 19 nt, Human
ugcuauuugaagaagugua

SEQ ID NO: 779192 - RNA, 22 nt, Human
aacugucuaaggagaauaugaa

SEQ ID NO: 779193 - RNA, 22 nt, Human
gaggcugguuugccuuuuggca

SEQ ID NO: 779194 - RNA, 19 nt, Human
caugaugagcauccugcag

SEQ ID NO: 779195 - RNA, 22 nt, Human
cccugcucuuagugccugugug

SEQ ID NO: 779196 - RNA, 22 nt, Human
gaggcugaaguguacaugggug

SEQ ID NO: 779197 - RNA, 22 nt, Human
cuggcucagacagcugugcagu

SEQ ID NO: 779198 - RNA, 22 nt, Human
auuugaaaaccugagccucccg

SEQ ID NO: 779199 - RNA, 22 nt, Human
cuggcuuugaggauccccucuu

SEQ ID NO: 779200 - RNA, 23 nt, Human
ucuacccacacugcucuagaagg

SEQ ID NO: 779201 - RNA, 22 nt, Human
ggcaagagggcagauggagugc

SEQ ID NO: 779202 - RNA, 22 nt, Human
ucucaugguuugugauucaaau

SEQ ID NO: 779203 - RNA, 22 nt, Human
cauucagagcuuucuuaucaua

SEQ ID NO: 779204 - RNA, 22 nt, Human
gccacagguaggaaccuaccuc

SEQ ID NO: 779205 - RNA, 22 nt, Human
cucugagguuuccucacaagcu

SEQ ID NO: 779206 - RNA, 22 nt, Human
cccaggcugucuguccuuugcu

SEQ ID NO: 779207 - RNA, 22 nt, Human
uucuaacuggcuugacaguuuc

SEQ ID NO: 779208 - RNA, 19 nt, Human
ucucugcuucucuuggcau

SEQ ID NO: 779209 - RNA, 22 nt, Human
augcaggaguuggaaaaaauga

SEQ ID NO: 779210 - RNA, 20 nt, Human
auagauaucaucuuuagaag

SEQ ID NO: 779211 - RNA, 22 nt, Human
uuagggaaggacagugaagaaa

SEQ ID NO: 779212 - RNA, 20 nt, Human
gagguagggcuuaaggcaag

SEQ ID NO: 779213 - RNA, 22 nt, Human
aaaucagacuugaauuuucauc

SEQ ID NO: 779214 - RNA, 19 nt, Human
ucugcccaguugucugccc

SEQ ID NO: 779215 - RNA, 21 nt, Human
ucuuauacagcaauagaucug

SEQ ID NO: 779216 - RNA, 22 nt, Human
ugguuucuuuccacucuccacc

SEQ ID NO: 779217 - RNA, 22 nt, Human
ugggcacaaacaucugccuguu

SEQ ID NO: 779218 - RNA, 22 nt, Human
agggagcuucuggccucagccu

SEQ ID NO: 779219 - RNA, 22 nt, Human
guucucucagccuuuguuauua

SEQ ID NO: 779220 - RNA, 22 nt, Human
ccaggggggcguagaugcuggg

SEQ ID NO: 779221 - RNA, 22 nt, Human
ggucccaaucuaaucacaugag

SEQ ID NO: 779222 - RNA, 22 nt, Human
ucuggccuguguugguggcccc

SEQ ID NO: 779223 - RNA, 22 nt, Human
ugcugaggaaagaggauaaaag

SEQ ID NO: 779224 - RNA, 19 nt, Human
gccuggcugggaugagccc

SEQ ID NO: 779225 - RNA, 22 nt, Human
agaaagugaccuugaaaacugg

SEQ ID NO: 779226 - RNA, 22 nt, Human
gggugcugaggaagacagcagg

SEQ ID NO: 779227 - RNA, 22 nt, Human
ugcccaaggucaccuaguuagu

SEQ ID NO: 779228 - RNA, 20 nt, Human
ccacuccgcccccagagggc

SEQ ID NO: 779229 - RNA, 22 nt, Human
ugucuccucaacucaugcucga

SEQ ID NO: 779230 - RNA, 22 nt, Human
aggacugacuuuugccaugaaa

SEQ ID NO: 779231 - RNA, 22 nt, Human
auacauuagcucauaugauuaa

SEQ ID NO: 779232 - RNA, 22 nt, Human
aguuuuccuuuauugaguacca

SEQ ID NO: 779233 - RNA, 22 nt, Human
caaauguuucuugaacaccaac

SEQ ID NO: 779234 - RNA, 22 nt, Human
gggcugugaggugagaacuuac

SEQ ID NO: 779235 - RNA, 22 nt, Human
cugaggaaaguauugccuggug

SEQ ID NO: 779236 - RNA, 22 nt, Human
auuucacucauucauguuacuu

SEQ ID NO: 779237 - RNA, 19 nt, Human
acagagggcaacugagaaa

SEQ ID NO: 779238 - RNA, 22 nt, Human
cagcugccccuccagggcuggg

SEQ ID NO: 779239 - RNA, 22 nt, Human
ugggcagaaaucaguaucagau

SEQ ID NO: 779240 - RNA, 22 nt, Human
gggagaaaugucuggccugcug

SEQ ID NO: 779241 - RNA, 22 nt, Human
ucuuaacuaucauuugaacacc

SEQ ID NO: 779242 - RNA, 22 nt, Human
ggacuugcuaagguggcugaac

SEQ ID NO: 779243 - RNA, 20 nt, Human
auucacaggcacaaaacccu

SEQ ID NO: 779244 - RNA, 22 nt, Human
uggaaggcaggaccugccuugg

SEQ ID NO: 779245 - RNA, 22 nt, Human
acacagccccacggugagcaaa

SEQ ID NO: 779246 - RNA, 22 nt, Human
ccucuguguccuggucauugaa

SEQ ID NO: 779247 - RNA, 22 nt, Human
ucccuguguguauauaaacggu

SEQ ID NO: 779248 - RNA, 22 nt, Human
acaggcugccuaccaaguauca

SEQ ID NO: 779249 - RNA, 19 nt, Human
cagaacagaggucauggcc

SEQ ID NO: 779250 - RNA, 22 nt, Human
aaagcagcagcacguggaagag

SEQ ID NO: 779251 - RNA, 22 nt, Human
ggagcagggaauuacagcgcag

SEQ ID NO: 779252 - RNA, 18 nt, Human
agcaccagucacuaacag

SEQ ID NO: 779253 - RNA, 22 nt, Human
ucagucuucuaaagggaugcaa

SEQ ID NO: 779254 - RNA, 21 nt, Human
gccugcacacaguaggugcac

SEQ ID NO: 779255 - RNA, 22 nt, Human
cuuuccaggaauccucacagcc

SEQ ID NO: 779256 - RNA, 22 nt, Human
cauauauuauggacugcagaau

SEQ ID NO: 779257 - RNA, 22 nt, Human
uacauguaggugacauuuuaau

SEQ ID NO: 779258 - RNA, 22 nt, Human
ucagugcacaaugacgguggcu

SEQ ID NO: 779259 - RNA, 22 nt, Human
uaacuuuggggacacuucucuu

SEQ ID NO: 779260 - RNA, 22 nt, Human
uacagauauauagugugugccu

SEQ ID NO: 779261 - RNA, 22 nt, Human
aggucuaacugauagaauucau

SEQ ID NO: 779262 - RNA, 22 nt, Human
acaggacaaggggaagaagaua

SEQ ID NO: 779263 - RNA, 23 nt, Human
auaaugcaaguggugguaaucug

SEQ ID NO: 779264 - RNA, 22 nt, Human
gccaggccugcaagugcuggug

SEQ ID NO: 779265 - RNA, 22 nt, Human
agauugugucaauuucucuuua

SEQ ID NO: 779266 - RNA, 22 nt, Human
uuaaagaugcagcuuuagagaa

SEQ ID NO: 779267 - RNA, 22 nt, Human
gcuuucuguagguaguuacugu

SEQ ID NO: 779268 - RNA, 22 nt, Human
cugucucugucuuaacucccag

SEQ ID NO: 779269 - RNA, 22 nt, Human
gccagauuuacagauuugcccu

SEQ ID NO: 779270 - RNA, 22 nt, Human
agagcuggggcauaaaugccac

SEQ ID NO: 779271 - RNA, 22 nt, Human
uucaguaugacagacgcauugg

SEQ ID NO: 779272 - RNA, 22 nt, Human
gaggagcuugugagaagauguc

SEQ ID NO: 779273 - RNA, 22 nt, Human
cauagcgguauuccacgugguu

SEQ ID NO: 779274 - RNA, 22 nt, Human
ugagagccaggaucugcucuau

SEQ ID NO: 779275 - RNA, 22 nt, Human
uuuuccagauuggacuuagucc

SEQ ID NO: 779276 - RNA, 20 nt, Human
cugagcccccagccugcagg

SEQ ID NO: 779277 - RNA, 22 nt, Human
ucaggcaggacaauuauuuagg

SEQ ID NO: 779278 - RNA, 22 nt, Human
agacacugcggaggucgggugg

SEQ ID NO: 779279 - RNA, 22 nt, Human
ggcaggugccuucugugcuagc

SEQ ID NO: 779280 - RNA, 22 nt, Human
acaggcagagaguggcggacuc

SEQ ID NO: 779281 - RNA, 22 nt, Human
auaaacagaguaguugcuacug

SEQ ID NO: 779282 - RNA, 22 nt, Human
ccuggcagcuccuccccggcgg

SEQ ID NO: 779283 - RNA, 22 nt, Human
agguccuggugaccauggaguu

SEQ ID NO: 779284 - RNA, 22 nt, Human
cuccugggaggaugcggacccg

SEQ ID NO: 779285 - RNA, 22 nt, Human
ugccccagacucugcucaccuc

SEQ ID NO: 779286 - RNA, 22 nt, Human
ggcaaaaacagcaaugacuuuu

SEQ ID NO: 779287 - RNA, 22 nt, Human
ucaagcaaguugcauauugcua

SEQ ID NO: 779288 - RNA, 22 nt, Human
auuuucaugacuaccuuaaaua

SEQ ID NO: 779289 - RNA, 22 nt, Human
ggcacugaauuucuuggcaucu

SEQ ID NO: 779290 - RNA, 22 nt, Human
aaggcaggagcuguaucuuauu

SEQ ID NO: 779291 - RNA, 22 nt, Human
gcucagguagaugggguugucc

SEQ ID NO: 779292 - RNA, 20 nt, Human
ucagacagucgcaguucugg

SEQ ID NO: 779293 - RNA, 22 nt, Human
uuggaauuugcuucagcuaaua

SEQ ID NO: 779294 - RNA, 22 nt, Human
cugcgugcaugucugcgugcau

SEQ ID NO: 779295 - RNA, 22 nt, Human
ccugggugacccgugagcgucc

SEQ ID NO: 779296 - RNA, 22 nt, Human
caggacugaagggcacagggaa

SEQ ID NO: 779297 - RNA, 23 nt, Human
cagagcuggcucagagcugccug

SEQ ID NO: 779298 - RNA, 22 nt, Human
caggauccuggcugcauggacg

SEQ ID NO: 779299 - RNA, 22 nt, Human
ugccauuucucaggcuauuuca

SEQ ID NO: 779300 - RNA, 22 nt, Human
ugauucacagacuucacaaggc

SEQ ID NO: 779301 - RNA, 20 nt, Human
ugggaguacaaucaugagca

SEQ ID NO: 779302 - RNA, 22 nt, Human
cugagccaaaaagcagagcuug

SEQ ID NO: 779303 - RNA, 22 nt, Human
uugaaagucacaauggcauuaa

SEQ ID NO: 779304 - RNA, 23 nt, Human
uaggggaaaaaucuucugcaauu

SEQ ID NO: 779305 - RNA, 22 nt, Human
agcagagcuauucuugugcaau

SEQ ID NO: 779306 - RNA, 22 nt, Human
gacacagaaggucacauguuca

SEQ ID NO: 779307 - RNA, 22 nt, Human
cugcugccuaguccaagacgug

SEQ ID NO: 779308 - RNA, 22 nt, Human
uccccagucccggcggugggug

SEQ ID NO: 779309 - RNA, 22 nt, Human
guguaaaugccccauucauuga

SEQ ID NO: 779310 - RNA, 19 nt, Human
uaaagcacauagcaaaagu

SEQ ID NO: 779311 - RNA, 22 nt, Human
ccagcagagcucaaacuuccug

SEQ ID NO: 779312 - RNA, 22 nt, Human
gggcugacucaaccuugcaaag

SEQ ID NO: 779313 - RNA, 22 nt, Human
agcuccaggucagugcaccccu

SEQ ID NO: 779314 - RNA, 22 nt, Human
uucuggggacauaacaguaagc

SEQ ID NO: 779315 - RNA, 22 nt, Human
gacaauuagaucauuccuuuga

SEQ ID NO: 779316 - RNA, 22 nt, Human
gugagccaguucgacuguuucu

SEQ ID NO: 779317 - RNA, 22 nt, Human
cucuucuugccugaugaggcag

SEQ ID NO: 779318 - RNA, 22 nt, Human
acauucuuccagcuggcuguug

SEQ ID NO: 779319 - RNA, 22 nt, Human
cgccugcucuguuuccaugugg

SEQ ID NO: 779320 - RNA, 22 nt, Human
ucucacaggugcacguggcugu

SEQ ID NO: 779321 - RNA, 22 nt, Human
uuaacagacauauauauuugua

SEQ ID NO: 779322 - RNA, 22 nt, Human
cugggucccacagccugcuggg

SEQ ID NO: 779323 - RNA, 22 nt, Human
augcacagaacaauuuuaagag

SEQ ID NO: 779324 - RNA, 22 nt, Human
ugcaggaguuaagugcucuccu

SEQ ID NO: 779325 - RNA, 22 nt, Human
gagcuggaggcagugcugaggu

SEQ ID NO: 779326 - RNA, 22 nt, Human
uuagaaacucaacucugggaau

SEQ ID NO: 779327 - RNA, 22 nt, Human
ucuguuccaguagaaaggugca

SEQ ID NO: 779328 - RNA, 22 nt, Human
aaauguagaccuauagggaccu

SEQ ID NO: 779329 - RNA, 22 nt, Human
aguggccagcagccuagccuag

SEQ ID NO: 779330 - RNA, 22 nt, Human
cacagacuugagaagcaccuua

SEQ ID NO: 779331 - RNA, 22 nt, Human
aaagccagaauucguccagccu

SEQ ID NO: 779332 - RNA, 22 nt, Human
ugccacauggugcauuuccuag

SEQ ID NO: 779333 - RNA, 22 nt, Human
ugagcagaaguuauaaauaaga

SEQ ID NO: 779334 - RNA, 23 nt, Human
ucuggaauccucccccuugguuc

SEQ ID NO: 779335 - RNA, 22 nt, Human
gaggagcugggcugagaggguc

SEQ ID NO: 779336 - RNA, 22 nt, Human
uuacaaagaaaauuaggcauuu

SEQ ID NO: 779337 - RNA, 22 nt, Human
cugauuagaguguuaaugagga

SEQ ID NO: 779338 - RNA, 22 nt, Human
cacagaaucggccgauggugcu

SEQ ID NO: 779339 - RNA, 22 nt, Human
gcaggaagccuuaccaagccca

SEQ ID NO: 779340 - RNA, 22 nt, Human
guccagugacaaguagcuggcc

SEQ ID NO: 779341 - RNA, 22 nt, Human
ggucuucuggaaagcagacugu

SEQ ID NO: 779342 - RNA, 22 nt, Human
cauuuggauuuugaagagagua

SEQ ID NO: 779343 - RNA, 22 nt, Human
uacagaggcacaugcaauuuuc

SEQ ID NO: 779344 - RNA, 22 nt, Human
cagcccauuucugggaccugag

SEQ ID NO: 779345 - RNA, 22 nt, Human
uugaggagcacuagucagguau

SEQ ID NO: 779346 - RNA, 22 nt, Human
agaaagacgugaugaagaagua

SEQ ID NO: 779347 - RNA, 22 nt, Human
ccuggcucugccguaaccacca

SEQ ID NO: 779348 - RNA, 22 nt, Human
ucagugugauuaggcuaucuga

SEQ ID NO: 779349 - RNA, 22 nt, Human
aucuuucaucucuauuauuuga

SEQ ID NO: 779350 - RNA, 22 nt, Human
ggggcacacuuuugguagauau

SEQ ID NO: 779351 - RNA, 22 nt, Human
uggagcuguagccaccacccug

SEQ ID NO: 779352 - RNA, 18 nt, Human
ucagcuggggcugcagcc

SEQ ID NO: 779353 - RNA, 22 nt, Human
gugcaugugucuuuauaguaga

SEQ ID NO: 779354 - RNA, 22 nt, Human
gucuccugcccccggugcuugg

SEQ ID NO: 779355 - RNA, 22 nt, Human
auugugcagcucugcucuuauu

SEQ ID NO: 779356 - RNA, 22 nt, Human
aggaaaggugagagcggccgcg

SEQ ID NO: 779357 - RNA, 22 nt, Human
gggugacauuucccaaugagcc

SEQ ID NO: 779358 - RNA, 22 nt, Human
cuucagcccugagugccagcag

SEQ ID NO: 779359 - RNA, 22 nt, Human
cugggagcccugacuagccugg

SEQ ID NO: 779360 - RNA, 18 nt, Human
cugccuguugcugagagg

SEQ ID NO: 779361 - RNA, 22 nt, Human
caaggagauaaaauguugagcu

SEQ ID NO: 779362 - RNA, 22 nt, Human
ugggcuccaauuuguccuuuca

SEQ ID NO: 779363 - RNA, 22 nt, Human
aagucagugaaaaggcaucauc

SEQ ID NO: 779364 - RNA, 22 nt, Human
gguagaaagcccaagucccccu

SEQ ID NO: 779365 - RNA, 22 nt, Human
uguccccagguccucugccguc

SEQ ID NO: 779366 - RNA, 22 nt, Human
cugugcaagacuuacuuuaaua

SEQ ID NO: 779367 - RNA, 22 nt, Human
ccaggauaguaugaguagggau

SEQ ID NO: 779368 - RNA, 22 nt, Human
uggucugauuucuuucuggagu

SEQ ID NO: 779369 - RNA, 22 nt, Human
aacaucuacagugagauguuag

SEQ ID NO: 779370 - RNA, 21 nt, Human
aacuuuagaaagacugggaag

SEQ ID NO: 779371 - RNA, 22 nt, Human
acaucuguucuucucuuguccc

SEQ ID NO: 779372 - RNA, 22 nt, Human
uggggcuggcacagucucuauu

SEQ ID NO: 779373 - RNA, 22 nt, Human
cagcuguugacugguacaugaa

SEQ ID NO: 779374 - RNA, 22 nt, Human
uucuguuacuugcaaccacagg

SEQ ID NO: 779375 - RNA, 22 nt, Human
gggucugagcugaggggaaauc

SEQ ID NO: 779376 - RNA, 22 nt, Human
caucacuguccaaaguucaguu

SEQ ID NO: 779377 - RNA, 22 nt, Human
agaggccagcagugccuaucug

SEQ ID NO: 779378 - RNA, 22 nt, Human
auucuucacaccuguuccuguu

SEQ ID NO: 779379 - RNA, 18 nt, Human
ugcauuuaguacaucuag

SEQ ID NO: 779380 - RNA, 22 nt, Human
aggagccauggaggugaggcgg

SEQ ID NO: 779381 - RNA, 22 nt, Human
aaagcaagucucuacaaaguac

SEQ ID NO: 779382 - RNA, 22 nt, Human
gcacaugugagaguagaggccu

SEQ ID NO: 779383 - RNA, 21 nt, Human
agaguuacugucauccuaggu

SEQ ID NO: 779384 - RNA, 22 nt, Human
ggugcuguggcagcuccuccuc

SEQ ID NO: 779385 - RNA, 22 nt, Human
aucauguuguauguaaucuuuu

SEQ ID NO: 779386 - RNA, 19 nt, Human
uagcuucacguggucuaga

SEQ ID NO: 779387 - RNA, 22 nt, Human
agugucuuugucucucaagcac

SEQ ID NO: 779388 - RNA, 22 nt, Human
acaguguuuaaaaaucagaucu

SEQ ID NO: 779389 - RNA, 22 nt, Human
cugcccuggcagccuaccaugg

SEQ ID NO: 779390 - RNA, 22 nt, Human
cagcugagaagugauagcugca

SEQ ID NO: 779391 - RNA, 22 nt, Human
guauuuuauggccuggggccua

SEQ ID NO: 779392 - RNA, 22 nt, Human
uuggagauaucacaccuucaca

SEQ ID NO: 779393 - RNA, 22 nt, Human
cacagugugggcauggugccug

SEQ ID NO: 779394 - RNA, 22 nt, Human
ccagcccuuagauaaaccuggc

SEQ ID NO: 779395 - RNA, 22 nt, Human
ccagggcuucagagguuuuggc

SEQ ID NO: 779396 - RNA, 22 nt, Human
caggagauguaagacuucuguu

SEQ ID NO: 779397 - RNA, 20 nt, Human
ccaauguuuacagauuacuu

SEQ ID NO: 779398 - RNA, 22 nt, Human
cugaaccaucucuguucuguau

SEQ ID NO: 779399 - RNA, 19 nt, Human
ugguggaggugcaccugac

SEQ ID NO: 779400 - RNA, 22 nt, Human
auacuuauacuaagaauguacu

SEQ ID NO: 779401 - RNA, 22 nt, Human
uuuuucuggauaacuguaucuc

SEQ ID NO: 779402 - RNA, 22 nt, Human
ugcagcaucuccuuaaaucuug

SEQ ID NO: 779403 - RNA, 22 nt, Human
auaugacauaaaaucauuuuug

SEQ ID NO: 779404 - RNA, 22 nt, Human
cucccagggccaucgagucacu

SEQ ID NO: 779405 - RNA, 22 nt, Human
gugcugucaauugcuuucagua

SEQ ID NO: 779406 - RNA, 21 nt, Human
agcgucaauaucgucaacagg

SEQ ID NO: 779407 - RNA, 22 nt, Human
uaucuacuccucuuucagaugc

SEQ ID NO: 779408 - RNA, 22 nt, Human
aaucaagaaaaugaggauucuu

SEQ ID NO: 779409 - RNA, 20 nt, Human
aagaggugauaacaggugag

SEQ ID NO: 779410 - RNA, 22 nt, Human
aacuacuaccaguaguaguagu

SEQ ID NO: 779411 - RNA, 22 nt, Human
uccagggcaugcucagacucag

SEQ ID NO: 779412 - RNA, 18 nt, Human
augcuccuaucucugagc

SEQ ID NO: 779413 - RNA, 22 nt, Human
ucuauugauuggcuuccuggau

SEQ ID NO: 779414 - RNA, 22 nt, Human
ccugucccccaggccuguacca

SEQ ID NO: 779415 - RNA, 22 nt, Human
uaagagcacugaagucuucuua

SEQ ID NO: 779416 - RNA, 22 nt, Human
cugugcccucuuugcuggccuu

SEQ ID NO: 779417 - RNA, 22 nt, Human
cuuggagcccagcaggccugga

SEQ ID NO: 779418 - RNA, 22 nt, Human
uuccuuaggcuguuugcagugc

SEQ ID NO: 779419 - RNA, 22 nt, Human
uguaugaauauguauuuucaua

SEQ ID NO: 779420 - RNA, 22 nt, Human
cagcugcugauggccugacaga

SEQ ID NO: 779421 - RNA, 22 nt, Human
aggcacugaauauccaguaaaa

SEQ ID NO: 779422 - RNA, 22 nt, Human
aaacuugauuuagaacuaaggc

SEQ ID NO: 779423 - RNA, 22 nt, Human
acugagcaguagauuuucuguu

SEQ ID NO: 779424 - RNA, 22 nt, Human
gcucucuuuaaacugcauggcu

SEQ ID NO: 779425 - RNA, 22 nt, Human
gucuaaaccucaaaucaguguc

SEQ ID NO: 779426 - RNA, 22 nt, Human
auauuauucuaguaacagugau

SEQ ID NO: 779427 - RNA, 22 nt, Human
gucccucugggccaucaggucc

SEQ ID NO: 779428 - RNA, 22 nt, Human
augaacaaucuguugacuucug

SEQ ID NO: 779429 - RNA, 23 nt, Human
caaaaguuagcccuucccaucuc

SEQ ID NO: 779430 - RNA, 22 nt, Human
uguacagucaugcuuucuguuc

SEQ ID NO: 779431 - RNA, 22 nt, Human
aaggcaguaaaaucuaccuugc

SEQ ID NO: 779432 - RNA, 22 nt, Human
ugggguacacguggggcaggau

SEQ ID NO: 779433 - RNA, 20 nt, Human
ccugccugccucggcucauu

SEQ ID NO: 779434 - RNA, 22 nt, Human
cauucacaucuuguuccaucac

SEQ ID NO: 779435 - RNA, 22 nt, Human
guggaaggaagagauggcccca

SEQ ID NO: 779436 - RNA, 23 nt, Human
uacugccuggggccagagagcgg

SEQ ID NO: 779437 - RNA, 22 nt, Human
uuacaaagugcugcaccauuuu

SEQ ID NO: 779438 - RNA, 22 nt, Human
aaauguccauugaauggaugag

SEQ ID NO: 779439 - RNA, 22 nt, Human
augggaucuugcccugagggcu

SEQ ID NO: 779440 - RNA, 22 nt, Human
uggugcugccaccuccucugcu

SEQ ID NO: 779441 - RNA, 22 nt, Human
gaaugcuggcuuacaggcaguu

SEQ ID NO: 779442 - RNA, 22 nt, Human
caggauguucaagggaccuaug

SEQ ID NO: 779443 - RNA, 19 nt, Human
cccaggguuuccucucucc

SEQ ID NO: 779444 - RNA, 22 nt, Human
cagcacaggucaguuuuuuaag

SEQ ID NO: 779445 - RNA, 22 nt, Human
guguucaugccccagugcagga

SEQ ID NO: 779446 - RNA, 22 nt, Human
uaacuguugugcgggucucugg

SEQ ID NO: 779447 - RNA, 22 nt, Human
uuucacauuuguuuuaagaagu

SEQ ID NO: 779448 - RNA, 20 nt, Human
agcauucauucagcaagccu

SEQ ID NO: 779449 - RNA, 21 nt, Human
ggacuuacauagguaaggggu

SEQ ID NO: 779450 - RNA, 22 nt, Human
gggcagaugucuggacaccuca

SEQ ID NO: 779451 - RNA, 22 nt, Human
acaugugucuaagaaugaaaga

SEQ ID NO: 779452 - RNA, 22 nt, Human
ugucucugugacuccuuccgcc

SEQ ID NO: 779453 - RNA, 22 nt, Human
aaggaugauugguaaugacacu

SEQ ID NO: 779454 - RNA, 22 nt, Human
gcagcagcccagggcucucaga

SEQ ID NO: 779455 - RNA, 22 nt, Human
gcagggcucauugccaggcauu

SEQ ID NO: 779456 - RNA, 22 nt, Human
aauaucuagccuuuagcagcuu

SEQ ID NO: 779457 - RNA, 22 nt, Human
acucuggcacuggguaccucag

SEQ ID NO: 779458 - RNA, 22 nt, Human
augacuuuguuguuuuccagcg

SEQ ID NO: 779459 - RNA, 22 nt, Human
caggcauggagaggcagagacu

SEQ ID NO: 779460 - RNA, 22 nt, Human
ugcugcuuggaaauggggcuga

SEQ ID NO: 779461 - RNA, 22 nt, Human
aucagcucauuuugauggaaau

SEQ ID NO: 779462 - RNA, 22 nt, Human
guggaaauuuuaggaucaucuu

SEQ ID NO: 779463 - RNA, 22 nt, Human
auaaauuuauaauuguuuccug

SEQ ID NO: 779464 - RNA, 22 nt, Human
ccauucaauaccuuagagaaaa

SEQ ID NO: 779465 - RNA, 22 nt, Human
gccugccucaaaaucccaguuc

SEQ ID NO: 779466 - RNA, 22 nt, Human
ugugcacaaugugcagguuugu

SEQ ID NO: 779467 - RNA, 22 nt, Human
aagagucauagagacauugauu

SEQ ID NO: 779468 - RNA, 22 nt, Human
guuauuagaagugaaggauugu

SEQ ID NO: 779469 - RNA, 22 nt, Human
uugagcaucuuauagaaagagc

SEQ ID NO: 779470 - RNA, 22 nt, Human
gggugggaucuguggagccuca

SEQ ID NO: 779471 - RNA, 22 nt, Human
ugcuccuggaugagguacucca

SEQ ID NO: 779472 - RNA, 22 nt, Human
cugcugggaaggucugcucagu

SEQ ID NO: 779473 - RNA, 21 nt, Human
uucuccccagcgaauccucgg

SEQ ID NO: 779474 - RNA, 22 nt, Human
auggcugugugacugaguucua

SEQ ID NO: 779475 - RNA, 22 nt, Human
uggcaggaaaaacauuggagau

SEQ ID NO: 779476 - RNA, 22 nt, Human
aguggagaauaugcagaaagcc

SEQ ID NO: 779477 - RNA, 22 nt, Human
gggacucugagagccugagggu

SEQ ID NO: 779478 - RNA, 23 nt, Human
ugacaaagcgagacuccagcuca

SEQ ID NO: 779479 - RNA, 22 nt, Human
uugauuuuuuucuacuaugcgc

SEQ ID NO: 779480 - RNA, 22 nt, Human
caggugaaaaagcaaccauauu

SEQ ID NO: 779481 - RNA, 22 nt, Human
acagaggccccgugggagagcc

SEQ ID NO: 779482 - RNA, 22 nt, Human
uaugacaggcaugagauccuaa

SEQ ID NO: 779483 - RNA, 22 nt, Human
uauuaacacguauaaaguguuu

SEQ ID NO: 779484 - RNA, 22 nt, Human
cuccugagucuccacgccccgu

SEQ ID NO: 779485 - RNA, 22 nt, Human
aaugcacuuaguaugaaugccu

SEQ ID NO: 779486 - RNA, 23 nt, Human
ucagagagcuguugagagcugcc

SEQ ID NO: 779487 - RNA, 22 nt, Human
cagggcugagucauauagccuu

SEQ ID NO: 779488 - RNA, 22 nt, Human
uacaguuuuggugaugaugaug

SEQ ID NO: 779489 - RNA, 22 nt, Human
uuugaaugugugaguuaacuuu

SEQ ID NO: 779490 - RNA, 22 nt, Human
aguuuagaagaggaacuuguua

SEQ ID NO: 779491 - RNA, 22 nt, Human
auacuguuucucuucuacauga

SEQ ID NO: 779492 - RNA, 22 nt, Human
ucccagggccgcaaacgaguuu

SEQ ID NO: 779493 - RNA, 22 nt, Human
gcagggcacacaagaaugauaa

SEQ ID NO: 779494 - RNA, 22 nt, Human
agggcagaaauauugauacugu

SEQ ID NO: 779495 - RNA, 22 nt, Human
uuagaguuuuuguaaguacaau

SEQ ID NO: 779496 - RNA, 22 nt, Human
guuuacaguacucacuugcauu

SEQ ID NO: 779497 - RNA, 22 nt, Human
cagaaaauagaguuucucugag

SEQ ID NO: 779498 - RNA, 22 nt, Human
ugcuaggagaggcagcacagcg

SEQ ID NO: 779499 - RNA, 22 nt, Human
gaggcugcacuggcuaaaggcu

SEQ ID NO: 779500 - RNA, 22 nt, Human
auucuagaugcuguaaguagca

SEQ ID NO: 779501 - RNA, 18 nt, Human
ucuuuggacaacuacugg

SEQ ID NO: 779502 - RNA, 22 nt, Human
agcagggcuccugaaagccgcg

SEQ ID NO: 779503 - RNA, 18 nt, Human
auguuucucuuggcucug

SEQ ID NO: 779504 - RNA, 22 nt, Human
acaugcaugugaauauggacac

SEQ ID NO: 779505 - RNA, 22 nt, Human
agcccagcccgggcugcgcuuu

SEQ ID NO: 779506 - RNA, 22 nt, Human
uccuuucaccaaaaaguguugu

SEQ ID NO: 779507 - RNA, 22 nt, Human
acuguuucugccacaauagccc

SEQ ID NO: 779508 - RNA, 22 nt, Human
uuccgcuguuuaguugaaguuu

SEQ ID NO: 779509 - RNA, 22 nt, Human
caggcacacugucuacacugag

SEQ ID NO: 779510 - RNA, 22 nt, Human
uaccuugggguuuuguugcucu

SEQ ID NO: 779511 - RNA, 22 nt, Human
aggaaucaggagaugagcacgg

SEQ ID NO: 779512 - RNA, 18 nt, Human
cuggauuaagacagugcu

SEQ ID NO: 779513 - RNA, 22 nt, Human
ugucccuggaacuauggcucca

SEQ ID NO: 779514 - RNA, 22 nt, Human
aucugggccaauccuaguacca

SEQ ID NO: 779515 - RNA, 22 nt, Human
cuugcuucauuagugucuuagu

SEQ ID NO: 779516 - RNA, 22 nt, Human
ccagacaggaacacacaucucc

SEQ ID NO: 779517 - RNA, 22 nt, Human
gcccugagccuaugagccucuc

SEQ ID NO: 779518 - RNA, 22 nt, Human
gaugucuucccauguucaugug

SEQ ID NO: 779519 - RNA, 23 nt, Human
uguaaacaucacccccuggaguu

SEQ ID NO: 779520 - RNA, 22 nt, Human
aaacagcuaaguacauucaagg

SEQ ID NO: 779521 - RNA, 21 nt, Human
uacaaugcacaggagagccuc

SEQ ID NO: 779522 - RNA, 22 nt, Human
cagcuauuauuuucucuaaauu

SEQ ID NO: 779523 - RNA, 22 nt, Human
ucugccugagggagcugaggaa

SEQ ID NO: 779524 - RNA, 22 nt, Human
gguuccagaccacggguguucu

SEQ ID NO: 779525 - RNA, 22 nt, Human
cagcuggcaaguggagcagggu

SEQ ID NO: 779526 - RNA, 22 nt, Human
cagguucagcaggaggcauccc

SEQ ID NO: 779527 - RNA, 22 nt, Human
agugcagcaugaagcacaugug

SEQ ID NO: 779528 - RNA, 22 nt, Human
cauuucacacauaaacuugggu

SEQ ID NO: 779529 - RNA, 22 nt, Human
aagcaagcuguuggcaauaggg

SEQ ID NO: 779530 - RNA, 19 nt, Human
ucaaugcaugaaaucagcc

SEQ ID NO: 779531 - RNA, 22 nt, Human
aacaugcuggguguuuuugaug

SEQ ID NO: 779532 - RNA, 22 nt, Human
gcugucuggcauggcguggcug

SEQ ID NO: 779533 - RNA, 22 nt, Human
uguacacauuaagcucuuuaga

SEQ ID NO: 779534 - RNA, 22 nt, Human
uuuagaaguucacacauuuaaa

SEQ ID NO: 779535 - RNA, 22 nt, Human
gcagcccagcagggcccggagc

SEQ ID NO: 779536 - RNA, 22 nt, Human
aguacauuuuucaguggggagu

SEQ ID NO: 779537 - RNA, 22 nt, Human
cauggccaggcacgcgcauagc

SEQ ID NO: 779538 - RNA, 22 nt, Human
aggggagguguccccaaaucuc

SEQ ID NO: 779539 - RNA, 22 nt, Human
ucugaauagagagagguccuuu

SEQ ID NO: 779540 - RNA, 20 nt, Human
gcaguguguaugaauagcug

SEQ ID NO: 779541 - RNA, 22 nt, Human
aagagacaugaauacucgaagg

SEQ ID NO: 779542 - RNA, 22 nt, Human
uauguggaaaaugcacuuaaaa

SEQ ID NO: 779543 - RNA, 22 nt, Human
uauccuuguacuauaguauuua

SEQ ID NO: 779544 - RNA, 22 nt, Human
augcacaguacaaacuggaaac

SEQ ID NO: 779545 - RNA, 22 nt, Human
uuaaaucaggcaucauuucagu

SEQ ID NO: 779546 - RNA, 22 nt, Human
ucugcuauuuucuaucugugug

SEQ ID NO: 779547 - RNA, 22 nt, Human
ccagaggaauugggaaacaugu

SEQ ID NO: 779548 - RNA, 22 nt, Human
ggcaggugaucuagagucaaua

SEQ ID NO: 779549 - RNA, 22 nt, Human
agccaagcugaucuccugcuga

SEQ ID NO: 779550 - RNA, 22 nt, Human
gcucucccgcagccuggugggc

SEQ ID NO: 779551 - RNA, 22 nt, Human
cagaagaguagcugaacaaguu

SEQ ID NO: 779552 - RNA, 22 nt, Human
uauguucuuagaagaggcagca

SEQ ID NO: 779553 - RNA, 22 nt, Human
acagcuggacaggggagaguuu

SEQ ID NO: 779554 - RNA, 22 nt, Human
uggcuucauucuccugugaaua

SEQ ID NO: 779555 - RNA, 22 nt, Human
cuugggaaguguuuaaagcuga

SEQ ID NO: 779556 - RNA, 22 nt, Human
aaagaguucuaugaucuuucca

SEQ ID NO: 779557 - RNA, 19 nt, Human
ccugugugggguagagauc

SEQ ID NO: 779558 - RNA, 22 nt, Human
gugcucuccagccccacgugga

SEQ ID NO: 779559 - RNA, 22 nt, Human
ccucacaguuuggcuaacugug

SEQ ID NO: 779560 - RNA, 22 nt, Human
ugccagugggugugcagagacu

SEQ ID NO: 779561 - RNA, 22 nt, Human
caaccugagacuccaggcaccu

SEQ ID NO: 779562 - RNA, 22 nt, Human
cagcuucuccauucuucuggcu

SEQ ID NO: 779563 - RNA, 22 nt, Human
cuguucucuggcgguggcuguu

SEQ ID NO: 779564 - RNA, 22 nt, Human
aaaccggggccuuuccacaaug

SEQ ID NO: 779565 - RNA, 22 nt, Human
ugcucuaagaacucuaggaauu

SEQ ID NO: 779566 - RNA, 21 nt, Human
gagauuuagaaggaucaauuu

SEQ ID NO: 779567 - RNA, 22 nt, Human
acaagcaugugguaaaaagacc

SEQ ID NO: 779568 - RNA, 22 nt, Human
guccugugcaccgugggauguu

SEQ ID NO: 779569 - RNA, 23 nt, Human
gccuggcuuccaagguaggggag

SEQ ID NO: 779570 - RNA, 22 nt, Human
ugugugaauuacgcguguccug

SEQ ID NO: 779571 - RNA, 22 nt, Human
auggcuuccucuggauuggauu

SEQ ID NO: 779572 - RNA, 19 nt, Human
ccugccugaccccggcuac

SEQ ID NO: 779573 - RNA, 22 nt, Human
auaagagcuagucuuuuccuug

SEQ ID NO: 779574 - RNA, 22 nt, Human
caugggguggugggcaaccuca

SEQ ID NO: 779575 - RNA, 17 nt, Human
gcacucccccaccuccu

SEQ ID NO: 779576 - RNA, 22 nt, Human
cauaauuugauaugcuugaugg

SEQ ID NO: 779577 - RNA, 22 nt, Human
ugccugucuuggaguccuggcc

SEQ ID NO: 779578 - RNA, 22 nt, Human
agaugugggcaauggaauggag

SEQ ID NO: 779579 - RNA, 22 nt, Human
uggcauguuucauggcugcaaa

SEQ ID NO: 779580 - RNA, 22 nt, Human
guguuuauuuucauaguuggcc

SEQ ID NO: 779581 - RNA, 22 nt, Human
ucucagaggcccgacguucucc

SEQ ID NO: 779582 - RNA, 21 nt, Human
cacagcaggguuccugggcuc

SEQ ID NO: 779583 - RNA, 22 nt, Human
ucuauaauccuauuucaacugc

SEQ ID NO: 779584 - RNA, 22 nt, Human
acugggaaauugcccuaguucu

SEQ ID NO: 779585 - RNA, 22 nt, Human
ucucugcucugugccucaguuu

SEQ ID NO: 779586 - RNA, 23 nt, Human
cugggcauggagcuucagaggcu

SEQ ID NO: 779587 - RNA, 22 nt, Human
cuuggcaccaccaaguggccau

SEQ ID NO: 779588 - RNA, 22 nt, Human
cugaaggagaaggccacuguuc

SEQ ID NO: 779589 - RNA, 22 nt, Human
ucagggccaucuuuugccucaa

SEQ ID NO: 779590 - RNA, 22 nt, Human
uuucaaacuguacuuuccccua

SEQ ID NO: 779591 - RNA, 22 nt, Human
caguguggugagauuccaggug

SEQ ID NO: 779592 - RNA, 22 nt, Human
ccccucuggucaaccagucaca

SEQ ID NO: 779593 - RNA, 22 nt, Human
cuggagcugguauagggacaaa

SEQ ID NO: 779594 - RNA, 22 nt, Human
gcucagugcaucauuccaggcu

SEQ ID NO: 779595 - RNA, 22 nt, Human
cagauggcacagauuuagagug

SEQ ID NO: 779596 - RNA, 22 nt, Human
caaggccauauugccuguaugu

SEQ ID NO: 779597 - RNA, 22 nt, Human
ucagugcagggugggagagaga

SEQ ID NO: 779598 - RNA, 22 nt, Human
uccuggauggagcugcccucgc

SEQ ID NO: 779599 - RNA, 22 nt, Human
aguccuucccaucugacacccu

SEQ ID NO: 779600 - RNA, 22 nt, Human
cccauuuagauaacaguucaaa

SEQ ID NO: 779601 - RNA, 22 nt, Human
uuuacaaggcagaacugauuaa

SEQ ID NO: 779602 - RNA, 22 nt, Human
ugaggccaugcccgugccggcc

SEQ ID NO: 779603 - RNA, 22 nt, Human
uagacauuugaaugugaaauga

SEQ ID NO: 779604 - RNA, 22 nt, Human
aagauacauuaugucucucuga

SEQ ID NO: 779605 - RNA, 22 nt, Human
cugcucagaggaaggaaugucu

SEQ ID NO: 779606 - RNA, 22 nt, Human
gcaugggaggacagucugggcu

SEQ ID NO: 779607 - RNA, 21 nt, Human
caaaggacuguagcucacuga

SEQ ID NO: 779608 - RNA, 22 nt, Human
gucucugggugugugaugccaa

SEQ ID NO: 779609 - RNA, 22 nt, Human
accaggacuuuguauucagcuu

SEQ ID NO: 779610 - RNA, 22 nt, Human
uuacugauacacauaagaauuu

SEQ ID NO: 779611 - RNA, 22 nt, Human
aucucccacaggcugcuacuuc

SEQ ID NO: 779612 - RNA, 21 nt, Human
ucauuuauugagaaaugacug

SEQ ID NO: 779613 - RNA, 22 nt, Human
ucucagggcagcaaggaagcau

SEQ ID NO: 779614 - RNA, 22 nt, Human
ucuuccagccaauagcguccuu

SEQ ID NO: 779615 - RNA, 22 nt, Human
cagggcucagaagacagaccuc

SEQ ID NO: 779616 - RNA, 22 nt, Human
ugcaccauacccauuccccucu

SEQ ID NO: 779617 - RNA, 22 nt, Human
ugguggggccagacuucagcuc

SEQ ID NO: 779618 - RNA, 22 nt, Human
cagccagccucucaaccaugca

SEQ ID NO: 779619 - RNA, 22 nt, Human
ccacuguuggcccgaagggguc

SEQ ID NO: 779620 - RNA, 22 nt, Human
cagcauggggaucacuguaggc

SEQ ID NO: 779621 - RNA, 20 nt, Human
gcucccagccugcagucccc

SEQ ID NO: 779622 - RNA, 22 nt, Human
auguuuuuaaauagacuuacag

SEQ ID NO: 779623 - RNA, 22 nt, Human
aagauaaugugucugucuuugc

SEQ ID NO: 779624 - RNA, 22 nt, Human
ugguggcacaagggagagaauc

SEQ ID NO: 779625 - RNA, 22 nt, Human
acaagcaugggcuuugacauca

SEQ ID NO: 779626 - RNA, 22 nt, Human
ucuuccagcuguaggaccuagg

SEQ ID NO: 779627 - RNA, 22 nt, Human
augcugaauauuagccucauga

SEQ ID NO: 779628 - RNA, 22 nt, Human
ggaagggaguaguuggaaugca

SEQ ID NO: 779629 - RNA, 22 nt, Human
guugaaaaugacuuuauaccau

SEQ ID NO: 779630 - RNA, 22 nt, Human
caagauguggugggcugaguuu

SEQ ID NO: 779631 - RNA, 22 nt, Human
ucagagaacuggcauguuuaga

SEQ ID NO: 779632 - RNA, 22 nt, Human
acugggccuguacagagaaaac

SEQ ID NO: 779633 - RNA, 18 nt, Human
gcuuucaauuucuuuccu

SEQ ID NO: 779634 - RNA, 22 nt, Human
uagcaacagcaauagugguauu

SEQ ID NO: 779635 - RNA, 22 nt, Human
ugccccucuccugugauccaag

SEQ ID NO: 779636 - RNA, 22 nt, Human
uguuucaagcaauagcauuuca

SEQ ID NO: 779637 - RNA, 22 nt, Human
cugugucuucuguuuugaaguu

SEQ ID NO: 779638 - RNA, 22 nt, Human
cuuucuggacaagacagaggga

SEQ ID NO: 779639 - RNA, 22 nt, Human
agacagcaugauacaugaugcu

SEQ ID NO: 779640 - RNA, 22 nt, Human
aggggagguggcagaaaugugc

SEQ ID NO: 779641 - RNA, 22 nt, Human
gccaggaggcuuaacuggacag

SEQ ID NO: 779642 - RNA, 22 nt, Human
ugucucugccagcuagcagaau

SEQ ID NO: 779643 - RNA, 22 nt, Human
aagaacagauucagccugaacu

SEQ ID NO: 779644 - RNA, 18 nt, Human
cucugucauaagugucau

SEQ ID NO: 779645 - RNA, 22 nt, Human
ugaguacuuuauguuaguuauu

SEQ ID NO: 779646 - RNA, 17 nt, Human
uauguguguuugcagca

SEQ ID NO: 779647 - RNA, 22 nt, Human
gccaagcuuugcaggaguguug

SEQ ID NO: 779648 - RNA, 22 nt, Human
auaaauggcuuucauuccuagg

SEQ ID NO: 779649 - RNA, 22 nt, Human
ggcccagcucuauugaauuaca

SEQ ID NO: 779650 - RNA, 22 nt, Human
ugucucaguucccuucucugga

SEQ ID NO: 779651 - RNA, 22 nt, Human
caggcucccacuuggcuuaaag

SEQ ID NO: 779652 - RNA, 20 nt, Human
ugcaguguccucacuuguca

SEQ ID NO: 779653 - RNA, 22 nt, Human
gggaaagaccuuccuggggugu

SEQ ID NO: 779654 - RNA, 22 nt, Human
ucacauguauaugcagcacagc

SEQ ID NO: 779655 - RNA, 22 nt, Human
aacauacagugagcaguggacu

SEQ ID NO: 779656 - RNA, 22 nt, Human
aggccacagauacugugaagua

SEQ ID NO: 779657 - RNA, 19 nt, Human
ccuugccugucccugcagc

SEQ ID NO: 779658 - RNA, 22 nt, Human
auuuucaagggagaggccucug

SEQ ID NO: 779659 - RNA, 22 nt, Human
aauauagcauuguaugacugug

SEQ ID NO: 779660 - RNA, 18 nt, Human
ucuguggcagcagugcac

SEQ ID NO: 779661 - RNA, 22 nt, Human
ucuguaaaacuucuuuguaaau

SEQ ID NO: 779662 - RNA, 22 nt, Human
uagcagcaccuuucuaaucuga

SEQ ID NO: 779663 - RNA, 22 nt, Human
uucuuacagauuuggugaauga

SEQ ID NO: 779664 - RNA, 19 nt, Human
ccucuccgcccaccagccc

SEQ ID NO: 779665 - RNA, 22 nt, Human
gaauacaccaaggaaucagaau

SEQ ID NO: 779666 - RNA, 22 nt, Human
gacaggguacgggcuaggcaca

SEQ ID NO: 779667 - RNA, 22 nt, Human
caggccaauaucacaugcuaug

SEQ ID NO: 779668 - RNA, 22 nt, Human
agggccagcccauaaugccaaa

SEQ ID NO: 779669 - RNA, 22 nt, Human
uuccaggcaugucagacauagg

SEQ ID NO: 779670 - RNA, 23 nt, Human
gggugggccaaauuagguagccu

SEQ ID NO: 779671 - RNA, 19 nt, Human
cuuugcaggggauggguga

SEQ ID NO: 779672 - RNA, 22 nt, Human
acacugagauuuuccugacacc

SEQ ID NO: 779673 - RNA, 22 nt, Human
acaugcauggacauguauauau

SEQ ID NO: 779674 - RNA, 22 nt, Human
ucaggcccuuugcugcugcccc

SEQ ID NO: 779675 - RNA, 22 nt, Human
ugcuuugugacagauuaguuuu

SEQ ID NO: 779676 - RNA, 22 nt, Human
acuguuauuuguaauccauuau

SEQ ID NO: 779677 - RNA, 22 nt, Human
ugugcccaucccucuggagugu

SEQ ID NO: 779678 - RNA, 22 nt, Human
caggcagagaacucauccguga

SEQ ID NO: 779679 - RNA, 22 nt, Human
uuuuugucaucuauuucuggug

SEQ ID NO: 779680 - RNA, 22 nt, Human
caggaguccugaaaucugauga

SEQ ID NO: 779681 - RNA, 22 nt, Human
aaauguauugcauaggauauuu

SEQ ID NO: 779682 - RNA, 22 nt, Human
auuggcaguuagugacgaggcu

SEQ ID NO: 779683 - RNA, 17 nt, Human
uccaggcauaucuccua

SEQ ID NO: 779684 - RNA, 22 nt, Human
cuguccuuacugcuucuggcuu

SEQ ID NO: 779685 - RNA, 18 nt, Human
uaggcugggggcuguagu

SEQ ID NO: 779686 - RNA, 22 nt, Human
uggacucuaagcagaggaucua

SEQ ID NO: 779687 - RNA, 22 nt, Human
aauuucuccaagaaugcuuaga

SEQ ID NO: 779688 - RNA, 22 nt, Human
ucucaugaaaggucucuccugg

SEQ ID NO: 779689 - RNA, 22 nt, Human
gcgaggaggggugcugggcccc

SEQ ID NO: 779690 - RNA, 22 nt, Human
guaaaaccugcuuuucaacacc

SEQ ID NO: 779691 - RNA, 22 nt, Human
guuuaacugggagugugggaaa

SEQ ID NO: 779692 - RNA, 22 nt, Human
ucacccagccuuggcggguuug

SEQ ID NO: 779693 - RNA, 22 nt, Human
ucacuucuucccuugcacauau

SEQ ID NO: 779694 - RNA, 22 nt, Human
gagucugagaacugggcucagu

SEQ ID NO: 779695 - RNA, 22 nt, Human
agauccaggaugucccaaaaua

SEQ ID NO: 779696 - RNA, 22 nt, Human
gagcucagaggcgucuuugucc

SEQ ID NO: 779697 - RNA, 22 nt, Human
gggugggcccagcccagagaag

SEQ ID NO: 779698 - RNA, 19 nt, Human
uuaucuguguugcaguggu

SEQ ID NO: 779699 - RNA, 22 nt, Human
aucagaacaaaagaacaguuua

SEQ ID NO: 779700 - RNA, 22 nt, Human
acagguguacaaugcaugacag

SEQ ID NO: 779701 - RNA, 23 nt, Human
uccaggcacgcauuucuucuagc

SEQ ID NO: 779702 - RNA, 22 nt, Human
gaccaaggcccucagugggagg

SEQ ID NO: 779703 - RNA, 22 nt, Human
gcuuuggaaggggcugguggag

SEQ ID NO: 779704 - RNA, 22 nt, Human
aacacucucuguugguaaggcu

SEQ ID NO: 779705 - RNA, 22 nt, Human
uuggagcccugaggaucuggau

SEQ ID NO: 779706 - RNA, 22 nt, Human
ucuagggagaagcucugucugu

SEQ ID NO: 779707 - RNA, 22 nt, Human
cagauaugcugagacuccugug

SEQ ID NO: 779708 - RNA, 22 nt, Human
agcauuaagagagacugaacug

SEQ ID NO: 779709 - RNA, 22 nt, Human
ucagggaaauuuccauguguuu

SEQ ID NO: 779710 - RNA, 22 nt, Human
uaccacagucugccauuagaug

SEQ ID NO: 779711 - RNA, 22 nt, Human
uccagcucuucaguucugcaaa

SEQ ID NO: 779712 - RNA, 22 nt, Human
uguccccaagguucagcccaca

SEQ ID NO: 779713 - RNA, 22 nt, Human
aggugggugccuauguauguau

SEQ ID NO: 779714 - RNA, 22 nt, Human
gcuguccagguuguggagcaac

SEQ ID NO: 779715 - RNA, 22 nt, Human
acagcuaagcucccacaaccug

SEQ ID NO: 779716 - RNA, 22 nt, Human
uaauaugggcagucugaauaua

SEQ ID NO: 779717 - RNA, 22 nt, Human
agcaacuucuacagauauagca

SEQ ID NO: 779718 - RNA, 22 nt, Human
uuuaucugggauuuugcagucu

SEQ ID NO: 779719 - RNA, 22 nt, Human
gucauugagucgucagagucuu

SEQ ID NO: 779720 - RNA, 22 nt, Human
agcccggcuuccccgguugcua

SEQ ID NO: 779721 - RNA, 22 nt, Human
ugugucaggagauagcaaaggg

SEQ ID NO: 779722 - RNA, 22 nt, Human
cgaaaucagcaucuugaggcaa

SEQ ID NO: 779723 - RNA, 20 nt, Human
uguguguguacuucuaaaua

SEQ ID NO: 779724 - RNA, 22 nt, Human
auguuuaaauuuauagacagug

SEQ ID NO: 779725 - RNA, 22 nt, Human
ggaggccaaggcagguggauca

SEQ ID NO: 779726 - RNA, 22 nt, Human
aagcugccacacggugaguacu

SEQ ID NO: 779727 - RNA, 22 nt, Human
uuuguugacaucccuguacuuu

SEQ ID NO: 779728 - RNA, 22 nt, Human
gcaaacauucaggaguacagga

SEQ ID NO: 779729 - RNA, 22 nt, Human
uaugacaaaugauauauuuggc

SEQ ID NO: 779730 - RNA, 22 nt, Human
gauguuuucuggaaaaugaaug

SEQ ID NO: 779731 - RNA, 22 nt, Human
uuugucauaucacacaauuuug

SEQ ID NO: 779732 - RNA, 22 nt, Human
ggcuucaauguauucacauuca

SEQ ID NO: 779733 - RNA, 22 nt, Human
aucagaagugauguguguuauu

SEQ ID NO: 779734 - RNA, 22 nt, Human
uaaggcacgcauaagagggggc

SEQ ID NO: 779735 - RNA, 22 nt, Human
cugagagacuguuuguaauauu

SEQ ID NO: 779736 - RNA, 22 nt, Human
gcaaaaauuccagggacgacuc

SEQ ID NO: 779737 - RNA, 22 nt, Human
gcacacagacuaaccauauuuc

SEQ ID NO: 779738 - RNA, 22 nt, Human
ugcuggccugggcugcaccuug

SEQ ID NO: 779739 - RNA, 22 nt, Human
aauuccagccucaguucuauua

SEQ ID NO: 779740 - RNA, 19 nt, Human
ugagacagggauucaggug

SEQ ID NO: 779741 - RNA, 22 nt, Human
ugugaaagauacuaggcagagg

SEQ ID NO: 779742 - RNA, 22 nt, Human
ucuuuauuuaagucuguuguaa

SEQ ID NO: 779743 - RNA, 22 nt, Human
gagucagacagggucacccaga

SEQ ID NO: 779744 - RNA, 22 nt, Human
augugagaacucaggaaauacu

SEQ ID NO: 779745 - RNA, 22 nt, Human
gcaccccucagcuuguuuacua

SEQ ID NO: 779746 - RNA, 22 nt, Human
gagagggcucuguguggguacu

SEQ ID NO: 779747 - RNA, 22 nt, Human
cauggcuuuguucauauaauuu

SEQ ID NO: 779748 - RNA, 22 nt, Human
agaguacauucagagcuaccua

SEQ ID NO: 779749 - RNA, 22 nt, Human
uucuuauaaguuaauauuucca

SEQ ID NO: 779750 - RNA, 22 nt, Human
cuauuacaaucugcuacuauga

SEQ ID NO: 779751 - RNA, 22 nt, Human
agcacuuugggagauaaagcug

SEQ ID NO: 779752 - RNA, 22 nt, Human
aaguaggaauccgaaugaguag

SEQ ID NO: 779753 - RNA, 22 nt, Human
agaacaaaucgauggaagccug

SEQ ID NO: 779754 - RNA, 22 nt, Human
augacaggaggcagcugggcag

SEQ ID NO: 779755 - RNA, 22 nt, Human
uagauucuguaugucugcucuc

SEQ ID NO: 779756 - RNA, 22 nt, Human
cuccaggacccaguggcuccag

SEQ ID NO: 779757 - RNA, 22 nt, Human
uuauuucauguaaaauuuaugu

SEQ ID NO: 779758 - RNA, 22 nt, Human
gaaggcuaaaggggcagagguu

SEQ ID NO: 779759 - RNA, 22 nt, Human
uaugcuuuaacccucuuauauu

SEQ ID NO: 779760 - RNA, 22 nt, Human
guauaugagaaccauggaggug

SEQ ID NO: 779761 - RNA, 22 nt, Human
ugagaagcagcuuacagguguc

SEQ ID NO: 779762 - RNA, 22 nt, Human
gcugccacgaucucugcuguag

SEQ ID NO: 779763 - RNA, 22 nt, Human
guuuugaauacuacuagaacuu

SEQ ID NO: 779764 - RNA, 22 nt, Human
auuucauugaaguuaauucuuc

SEQ ID NO: 779765 - RNA, 22 nt, Human
ccuggccucgugcucacggcuc

SEQ ID NO: 779766 - RNA, 22 nt, Human
auguuacagaaagcaaagauga

SEQ ID NO: 779767 - RNA, 22 nt, Human
cugcagaccucugagguccaug

SEQ ID NO: 779768 - RNA, 22 nt, Human
uccucuggcucuuucccuagga

SEQ ID NO: 779769 - RNA, 21 nt, Human
ugaagccugaggcauagcccc

SEQ ID NO: 779770 - RNA, 22 nt, Human
gaggaggaguauauauuagaau

SEQ ID NO: 779771 - RNA, 22 nt, Human
aacaugauuuaguauaaugcag

SEQ ID NO: 779772 - RNA, 22 nt, Human
cugaggaguuuggguuguucaa

SEQ ID NO: 779773 - RNA, 22 nt, Human
cacaaauggccguguucaaaga

SEQ ID NO: 779774 - RNA, 22 nt, Human
cuaaagaauuuugcuugaccag

SEQ ID NO: 779775 - RNA, 23 nt, Human
cacauauagcagccacuaagguc

SEQ ID NO: 779776 - RNA, 22 nt, Human
auccaaaguagauuaagucaca

SEQ ID NO: 779777 - RNA, 22 nt, Human
gucccucucaaauuuauaugcu

SEQ ID NO: 779778 - RNA, 22 nt, Human
auagugucuuucuucacaggca

SEQ ID NO: 779779 - RNA, 22 nt, Human
uuuagcaauuucuaaaaguguu

SEQ ID NO: 779780 - RNA, 21 nt, Human
aggcugcaugcaugagugugg

SEQ ID NO: 779781 - RNA, 22 nt, Human
cccuggaguccuggcaguugau

SEQ ID NO: 779782 - RNA, 22 nt, Human
gucacugccucuuaacuuuuuc

SEQ ID NO: 779783 - RNA, 22 nt, Human
agaucacagucaauugcaaguu

SEQ ID NO: 779784 - RNA, 22 nt, Human
uccagggacagcgcuggagcua

SEQ ID NO: 779785 - RNA, 22 nt, Human
gcccucagugaccacugauuca

SEQ ID NO: 779786 - RNA, 17 nt, Human
uuuaaacuacuacaagg

SEQ ID NO: 779787 - RNA, 22 nt, Human
uagcaacugcucuauucuagga

SEQ ID NO: 779788 - RNA, 22 nt, Human
augacaaaauaaauggucucug

SEQ ID NO: 779789 - RNA, 20 nt, Human
uucauucauuccacaacuuc

SEQ ID NO: 779790 - RNA, 22 nt, Human
cacauuuuuacugccaacuuaa

SEQ ID NO: 779791 - RNA, 22 nt, Human
uaggcacaaaaugaaaauggca

SEQ ID NO: 779792 - RNA, 22 nt, Human
uucagcaggcgguagcugccac

SEQ ID NO: 779793 - RNA, 22 nt, Human
ucagugguaugcgugggagcug

SEQ ID NO: 779794 - RNA, 22 nt, Human
agcucuuaucucuaagcacagc

SEQ ID NO: 779795 - RNA, 22 nt, Human
ucugggaugaagccagaaacuu

SEQ ID NO: 779796 - RNA, 22 nt, Human
ggagcucugaggaugcauuggu

SEQ ID NO: 779797 - RNA, 18 nt, Human
gcaaggcucaggccaggc

SEQ ID NO: 779798 - RNA, 22 nt, Human
ggcaugagagguccuggggauu

SEQ ID NO: 779799 - RNA, 22 nt, Human
auugaaagagaauguagcucuu

SEQ ID NO: 779800 - RNA, 19 nt, Human
aagaggcaacccucgagcc

SEQ ID NO: 779801 - RNA, 22 nt, Human
gaccugagauuuugaggcucau

SEQ ID NO: 779802 - RNA, 19 nt, Human
acuggcacacaggggcugc

SEQ ID NO: 779803 - RNA, 22 nt, Human
aggcuucauguagaugguuccc

SEQ ID NO: 779804 - RNA, 22 nt, Human
aauaucaguauauuguaucagu

SEQ ID NO: 779805 - RNA, 22 nt, Human
caguguuuguggaauucaggug

SEQ ID NO: 779806 - RNA, 22 nt, Human
gugaccagccagugcugucugu

SEQ ID NO: 779807 - RNA, 23 nt, Human
ugcugguguuuuugggaccaggg

SEQ ID NO: 779808 - RNA, 22 nt, Human
cagggccacacggaagggaaca

SEQ ID NO: 779809 - RNA, 22 nt, Human
ugggguaggagucagcgagaga

SEQ ID NO: 779810 - RNA, 22 nt, Human
ugcagggauuguuggcauccau

SEQ ID NO: 779811 - RNA, 22 nt, Human
cuuauucagcacuugcucugua

SEQ ID NO: 779812 - RNA, 22 nt, Human
ucacaugauguuuccucugugc

SEQ ID NO: 779813 - RNA, 22 nt, Human
gacagaggcuggagcaccuccu

SEQ ID NO: 779814 - RNA, 22 nt, Human
uaacacuauccagauaugauaa

SEQ ID NO: 779815 - RNA, 22 nt, Human
uaccagcucacacaaucuuugu

SEQ ID NO: 779816 - RNA, 22 nt, Human
uaagaggcaaaagauacucaga

SEQ ID NO: 779817 - RNA, 22 nt, Human
gugagagccugucuggaugucg

SEQ ID NO: 779818 - RNA, 22 nt, Human
ggucacaugguugagcuugauc

SEQ ID NO: 779819 - RNA, 22 nt, Human
uggcuugcuacugaggugucag

SEQ ID NO: 779820 - RNA, 22 nt, Human
acauucaugcaccuuccuaucc

SEQ ID NO: 779821 - RNA, 22 nt, Human
aggagcucagccugcagggagc

SEQ ID NO: 779822 - RNA, 22 nt, Human
agcuggaauuacaggcacgcac

SEQ ID NO: 779823 - RNA, 21 nt, Human
aggacaggaacuggcugaaua

SEQ ID NO: 779824 - RNA, 22 nt, Human
ugcaaacacuucaacgugcauc

SEQ ID NO: 779825 - RNA, 22 nt, Human
ucauuucugagccuuccaugau

SEQ ID NO: 779826 - RNA, 22 nt, Human
uucuuuaaaauagugagaaaga

SEQ ID NO: 779827 - RNA, 22 nt, Human
uuucuggcagcgggacaggggu

SEQ ID NO: 779828 - RNA, 22 nt, Human
agcugaaaggguguuggagugu

SEQ ID NO: 779829 - RNA, 22 nt, Human
ucagugcaggaauuuccuuaga

SEQ ID NO: 779830 - RNA, 22 nt, Human
ccucaggauacaggagccacag

SEQ ID NO: 779831 - RNA, 21 nt, Human
uaacaaagacuucuggucagg

SEQ ID NO: 779832 - RNA, 22 nt, Human
cagcacugcugcuguacacaca

SEQ ID NO: 779833 - RNA, 22 nt, Human
uagcagaguuugguaccugggg

SEQ ID NO: 779834 - RNA, 22 nt, Human
augagguuugagccucuugacc

SEQ ID NO: 779835 - RNA, 22 nt, Human
uuauuucauauaauguuaucaa

SEQ ID NO: 779836 - RNA, 22 nt, Human
ucauguaaauguggaugcuucc

SEQ ID NO: 779837 - RNA, 22 nt, Human
uggcagggccugcucaucaucc

SEQ ID NO: 779838 - RNA, 22 nt, Human
cagugccacaggaauggccaau

SEQ ID NO: 779839 - RNA, 22 nt, Human
agcagggcagcuuuuuucagaa

SEQ ID NO: 779840 - RNA, 22 nt, Human
auucuaacacaugcucuaagaa

SEQ ID NO: 779841 - RNA, 19 nt, Human
aggaaacugucuuuuccag

SEQ ID NO: 779842 - RNA, 22 nt, Human
ggagccaggcauaucggggcac

SEQ ID NO: 779843 - RNA, 22 nt, Human
cacagcagagggagccauugaa

SEQ ID NO: 779844 - RNA, 22 nt, Human
uuauugcuggcaccuucaauuc

SEQ ID NO: 779845 - RNA, 22 nt, Human
uggcagagacuccuccugggag

SEQ ID NO: 779846 - RNA, 22 nt, Human
uguguacuugaaagggcagguc

SEQ ID NO: 779847 - RNA, 22 nt, Human
gcacacaguagggauucaauga

SEQ ID NO: 779848 - RNA, 22 nt, Human
ccacugaggccugggcccaggg

SEQ ID NO: 779849 - RNA, 22 nt, Human
ugauucaauuaucugaugcuuu

SEQ ID NO: 779850 - RNA, 22 nt, Human
cagcaucaacauucucagcucu

SEQ ID NO: 779851 - RNA, 22 nt, Human
ugcaaagauaugagaagcugua

SEQ ID NO: 779852 - RNA, 22 nt, Human
uccugagauccuuuuagggauc

SEQ ID NO: 779853 - RNA, 21 nt, Human
uucaggguuucacaauacuaa

SEQ ID NO: 779854 - RNA, 22 nt, Human
uagauucucugcuggcugacau

SEQ ID NO: 779855 - RNA, 22 nt, Human
caugugugaagacugcgggcca

SEQ ID NO: 779856 - RNA, 22 nt, Human
aaaugcauuuuuaauuagaccc

SEQ ID NO: 779857 - RNA, 22 nt, Human
cugagaauggacagcagggcag

SEQ ID NO: 779858 - RNA, 22 nt, Human
ugucacauucugaugugaggug

SEQ ID NO: 779859 - RNA, 22 nt, Human
cuggcagcuuagcacucugguu

SEQ ID NO: 779860 - RNA, 22 nt, Human
aacauuuauugagcaccuacug

SEQ ID NO: 779861 - RNA, 22 nt, Human
ccugucucuguuaccacauuug

SEQ ID NO: 779862 - RNA, 21 nt, Human
ggggcagagcuaggcccugca

SEQ ID NO: 779863 - RNA, 22 nt, Human
uuaaggaacuugucuuucucuu

SEQ ID NO: 779864 - RNA, 22 nt, Human
augcccgauaccuaguuaacuc

SEQ ID NO: 779865 - RNA, 22 nt, Human
aaugcauguuuccucucagcag

SEQ ID NO: 779866 - RNA, 22 nt, Human
gcagguggucacucauccccag

SEQ ID NO: 779867 - RNA, 22 nt, Human
cugccagcuggagaccaaggaa

SEQ ID NO: 779868 - RNA, 22 nt, Human
ucagaagcaagcuucuacuucu

SEQ ID NO: 779869 - RNA, 22 nt, Human
aaagacauuagauuaacguaca

SEQ ID NO: 779870 - RNA, 22 nt, Human
gcacugugaauauacuagcaaa

SEQ ID NO: 779871 - RNA, 22 nt, Human
ucauuugugugagugauuugac

SEQ ID NO: 779872 - RNA, 22 nt, Human
aggagucacucagggcuucauc

SEQ ID NO: 779873 - RNA, 22 nt, Human
gauguguaacaugcugugacau

SEQ ID NO: 779874 - RNA, 22 nt, Human
auggccagcaagguagggcaau

SEQ ID NO: 779875 - RNA, 22 nt, Human
gcacaguggaguguguccaggg

SEQ ID NO: 779876 - RNA, 22 nt, Human
aguuuuucuccccuggcuucau

SEQ ID NO: 779877 - RNA, 19 nt, Human
gaacacuuacuauauuucu

SEQ ID NO: 779878 - RNA, 22 nt, Human
uacaguagaaucuuauagccca

SEQ ID NO: 779879 - RNA, 22 nt, Human
augcuacgaaugagagcauaua

SEQ ID NO: 779880 - RNA, 19 nt, Human
ccagagacauuggcaucuu

SEQ ID NO: 779881 - RNA, 22 nt, Human
accagagaaaacacagcaggcu

SEQ ID NO: 779882 - RNA, 22 nt, Human
cucuccaguuaccuaggucuga

SEQ ID NO: 779883 - RNA, 18 nt, Human
cuuuaugugcagagcuuu

SEQ ID NO: 779884 - RNA, 22 nt, Human
ucagucccaagguccugaggug

SEQ ID NO: 779885 - RNA, 22 nt, Human
ggagcccuccaucccuugcggc

SEQ ID NO: 779886 - RNA, 22 nt, Human
cuccagagauacacggucuugc

SEQ ID NO: 779887 - RNA, 22 nt, Human
aggcugaggcuggcagcuccag

SEQ ID NO: 779888 - RNA, 22 nt, Human
ucagggcaucaucaugaauaua

SEQ ID NO: 779889 - RNA, 21 nt, Human
gagcugggcgaggcuccgggg

SEQ ID NO: 779890 - RNA, 17 nt, Human
gaggacagggaaguagg

SEQ ID NO: 779891 - RNA, 22 nt, Human
uucacauuuacugguuuguccg

SEQ ID NO: 779892 - RNA, 20 nt, Human
cagcucugggaaagaggcca

SEQ ID NO: 779893 - RNA, 23 nt, Human
ccuugucuggcuggcuggacuuu

SEQ ID NO: 779894 - RNA, 22 nt, Human
agugagaguauuaaugugaacu

SEQ ID NO: 779895 - RNA, 22 nt, Human
uuucagacaguggguccaucca

SEQ ID NO: 779896 - RNA, 21 nt, Human
uuuaguucaaguacagaacca

SEQ ID NO: 779897 - RNA, 22 nt, Human
agggcucccgcgguguccggga

SEQ ID NO: 779898 - RNA, 22 nt, Human
uauuuggaaacaauucacaugc

SEQ ID NO: 779899 - RNA, 18 nt, Human
guccauggccuccaccca

SEQ ID NO: 779900 - RNA, 22 nt, Human
auguguucacgugcacaugugc

SEQ ID NO: 779901 - RNA, 22 nt, Human
acguuugcuuucuuuggccugg

SEQ ID NO: 779902 - RNA, 22 nt, Human
caugcugugugguuagaacugu

SEQ ID NO: 779903 - RNA, 22 nt, Human
uggcucacaaucucccaugaag

SEQ ID NO: 779904 - RNA, 22 nt, Human
ugaccacagacccaaugacuac

SEQ ID NO: 779905 - RNA, 22 nt, Human
gaaacagucaacuuucuuuccc

SEQ ID NO: 779906 - RNA, 22 nt, Human
cucccugggcagauguggcucu

SEQ ID NO: 779907 - RNA, 19 nt, Human
cuccagaauacauguuccu

SEQ ID NO: 779908 - RNA, 22 nt, Human
aaugaauaccguuucacucagu

SEQ ID NO: 779909 - RNA, 22 nt, Human
uauuuuacaugauccagaguug

SEQ ID NO: 779910 - RNA, 22 nt, Human
accuacauggcuuuaaguaagu

SEQ ID NO: 779911 - RNA, 22 nt, Human
gcauguuauguaucugcccagc

SEQ ID NO: 779912 - RNA, 18 nt, Human
ucucagaggccauccuag

SEQ ID NO: 779913 - RNA, 22 nt, Human
auccaagucagggauaguuuga

SEQ ID NO: 779914 - RNA, 22 nt, Human
gaggcagcugggauacaaggga

SEQ ID NO: 779915 - RNA, 22 nt, Human
ccugaggauuguuggugcuucc

SEQ ID NO: 779916 - RNA, 22 nt, Human
ccuccugggacaggcuggcaca

SEQ ID NO: 779917 - RNA, 22 nt, Human
aggcucagacaggaaaaguaac

SEQ ID NO: 779918 - RNA, 22 nt, Human
cacaggugcuccucggggagcu

SEQ ID NO: 779919 - RNA, 22 nt, Human
cuuuuuacucuguugucucagc

SEQ ID NO: 779920 - RNA, 22 nt, Human
uaagagaugguuaucaaaagca

SEQ ID NO: 779921 - RNA, 22 nt, Human
uaaagcauguacugugugcuag

SEQ ID NO: 779922 - RNA, 22 nt, Human
cgcugggcgcgcuccgaacccg

SEQ ID NO: 779923 - RNA, 23 nt, Human
auguuaccaauggaggaaauugg

SEQ ID NO: 779924 - RNA, 22 nt, Human
ucagaaaagacucaggggcuga

SEQ ID NO: 779925 - RNA, 22 nt, Human
ggcaaaaaccgcaauaacuucu

SEQ ID NO: 779926 - RNA, 22 nt, Human
ucagugcaguagaacuuuaguu

SEQ ID NO: 779927 - RNA, 22 nt, Human
gggcuggaggaccggccucgga

SEQ ID NO: 779928 - RNA, 22 nt, Human
uuuagaaauugcagagugggug

SEQ ID NO: 779929 - RNA, 22 nt, Human
cacaugaacaugcuggaaaagc

SEQ ID NO: 779930 - RNA, 22 nt, Human
auucaaacacuuugagaaguuc

SEQ ID NO: 779931 - RNA, 22 nt, Human
aaucauucucaugccaguuucc

SEQ ID NO: 779932 - RNA, 22 nt, Human
gccugccuggagcuugagguga

SEQ ID NO: 779933 - RNA, 22 nt, Human
uuguuuggaacuuggugccacc

SEQ ID NO: 779934 - RNA, 21 nt, Human
uuuauuaacaacuguggacgu

SEQ ID NO: 779935 - RNA, 19 nt, Human
gcgaggaagucacuguggc

SEQ ID NO: 779936 - RNA, 22 nt, Human
uaaggccaccguuauagaacca

SEQ ID NO: 779937 - RNA, 21 nt, Human
ccauaccuaccucaccugguu

SEQ ID NO: 779938 - RNA, 22 nt, Human
agugcuccucagaagaguugga

SEQ ID NO: 779939 - RNA, 22 nt, Human
ggaccuuccuggcuccuggggu

SEQ ID NO: 779940 - RNA, 22 nt, Human
gcagggcugggugggagacaga

SEQ ID NO: 779941 - RNA, 22 nt, Human
cuguggccuggggacacuaucu

SEQ ID NO: 779942 - RNA, 22 nt, Human
aauucaaauuacaauaguuguu

SEQ ID NO: 779943 - RNA, 18 nt, Human
ucuuccaacacugacacc

SEQ ID NO: 779944 - RNA, 20 nt, Human
agaacaaguacuaaaggaga

SEQ ID NO: 779945 - RNA, 22 nt, Human
aacaccagucccaagagaggcu

SEQ ID NO: 779946 - RNA, 22 nt, Human
uuauuuguaaggcagggccagu

SEQ ID NO: 779947 - RNA, 22 nt, Human
ucauaauguaguucauggcugg

SEQ ID NO: 779948 - RNA, 22 nt, Human
ggcggggccucgcgaacggccu

SEQ ID NO: 779949 - RNA, 22 nt, Human
aauuccaaauguuuucaaucca

SEQ ID NO: 779950 - RNA, 22 nt, Human
auccauucuaugugaaaugucc

SEQ ID NO: 779951 - RNA, 22 nt, Human
acccagagugucugucucaguc

SEQ ID NO: 779952 - RNA, 22 nt, Human
ugggagagcagagaacccucuu

SEQ ID NO: 779953 - RNA, 21 nt, Human
agcaagcagaauccaucuaga

SEQ ID NO: 779954 - RNA, 22 nt, Human
cacaugugggaaauggugcuua

SEQ ID NO: 779955 - RNA, 22 nt, Human
ucccagugcuacagacagggca

SEQ ID NO: 779956 - RNA, 21 nt, Human
caguucucuuagauuuccagu

SEQ ID NO: 779957 - RNA, 22 nt, Human
aggagaggcucuaacucugugu

SEQ ID NO: 779958 - RNA, 22 nt, Human
augcaaauaagugcaggcgugg

SEQ ID NO: 779959 - RNA, 22 nt, Human
cucugucaggcugcagaugcuc

SEQ ID NO: 779960 - RNA, 22 nt, Human
accuggcacauucuaccacagu

SEQ ID NO: 779961 - RNA, 22 nt, Human
uuguaagucacaccagggcagg

SEQ ID NO: 779962 - RNA, 22 nt, Human
augcaaaugucaccacuucuaa

SEQ ID NO: 779963 - RNA, 22 nt, Human
acagauuuguucuuuugggcua

SEQ ID NO: 779964 - RNA, 22 nt, Human
aacccagagcuggaggagagua

SEQ ID NO: 779965 - RNA, 22 nt, Human
ccugauggcugucugggccuga

SEQ ID NO: 779966 - RNA, 22 nt, Human
agagugugaagaaagugcaaug

SEQ ID NO: 779967 - RNA, 22 nt, Human
ucagcuuugcaaguuagaaaau

SEQ ID NO: 779968 - RNA, 22 nt, Human
acuucacauuugcaagucuugg

SEQ ID NO: 779969 - RNA, 22 nt, Human
acucaaauagcaacggugagaa

SEQ ID NO: 779970 - RNA, 22 nt, Human
cagaagcagugagagaugugca

SEQ ID NO: 779971 - RNA, 22 nt, Human
cuucugcacugaccuuuugucc

SEQ ID NO: 779972 - RNA, 22 nt, Human
ugggguugccucccgcccugga

SEQ ID NO: 779973 - RNA, 22 nt, Human
aaucuguuuccauuagagucau

SEQ ID NO: 779974 - RNA, 22 nt, Human
uguucucaguaauucuauuuua

SEQ ID NO: 779975 - RNA, 22 nt, Human
cuacauuuuaauaagcugcuua

SEQ ID NO: 779976 - RNA, 22 nt, Human
uacaaagauaguguuagaguaa

SEQ ID NO: 779977 - RNA, 22 nt, Human
aacacauggcaagagcaggaaa

SEQ ID NO: 779978 - RNA, 22 nt, Human
aaugcaaauucuagggcccuau

SEQ ID NO: 779979 - RNA, 22 nt, Human
ggggaccugggcuucaaggguu

SEQ ID NO: 779980 - RNA, 22 nt, Human
ugagcuguacuccuccccaggg

SEQ ID NO: 779981 - RNA, 22 nt, Human
ccugugugccuggccgcgggag

SEQ ID NO: 779982 - RNA, 22 nt, Human
agcaccauuuaucaucuaggua

SEQ ID NO: 779983 - RNA, 22 nt, Human
ggagguggagguugcaaugagc

SEQ ID NO: 779984 - RNA, 22 nt, Human
uuuaagagccuguacaaauauu

SEQ ID NO: 779985 - RNA, 22 nt, Human
acuguacaacugcugagcagaa

SEQ ID NO: 779986 - RNA, 22 nt, Human
aggccuggcaugagaccugaga

SEQ ID NO: 779987 - RNA, 22 nt, Human
augaaugauuugucagucacag

SEQ ID NO: 779988 - RNA, 22 nt, Human
uugcucugauuagguggaaaca

SEQ ID NO: 779989 - RNA, 23 nt, Human
auuugaaacuuucuuguuuccag

SEQ ID NO: 779990 - RNA, 20 nt, Human
aggacuuguuugggcagagu

SEQ ID NO: 779991 - RNA, 22 nt, Human
ccagaacagaccugccugaccu

SEQ ID NO: 779992 - RNA, 22 nt, Human
cccagggaggcccaggcucugc

SEQ ID NO: 779993 - RNA, 22 nt, Human
ugcagaguagugaggggacaga

SEQ ID NO: 779994 - RNA, 22 nt, Human
uuuccacagcuguauaaaauaa

SEQ ID NO: 779995 - RNA, 22 nt, Human
uagcagcuccuaaacaguggug

SEQ ID NO: 779996 - RNA, 22 nt, Human
uagaaacaaagaccugggugcu

SEQ ID NO: 779997 - RNA, 22 nt, Human
ucagggcacaggccuguggguu

SEQ ID NO: 779998 - RNA, 22 nt, Human
aaacaauguugucuccaagagg

SEQ ID NO: 779999 - RNA, 22 nt, Human
gaaguacaaaggacauggaaac

SEQ ID NO: 780000 - RNA, 22 nt, Human
cucucuuucauuggucgccuug

SEQ ID NO: 780001 - RNA, 22 nt, Human
ucagaggcuucugcucaccuca

SEQ ID NO: 780002 - RNA, 22 nt, Human
agugcaaagggaucagauuggg

SEQ ID NO: 780003 - RNA, 22 nt, Human
cuacauuuggagaguauaggaa

SEQ ID NO: 780004 - RNA, 22 nt, Human
uugggugguggggagaguucag

SEQ ID NO: 780005 - RNA, 22 nt, Human
auuauauuugaaagguuggaag

SEQ ID NO: 780006 - RNA, 22 nt, Human
uccagaggcucugagggagagu

SEQ ID NO: 780007 - RNA, 22 nt, Human
aacagccacugauacugaauag

SEQ ID NO: 780008 - RNA, 22 nt, Human
agagaaggguguagccugggcc

SEQ ID NO: 780009 - RNA, 20 nt, Human
uugauaggcagcuugucagg

SEQ ID NO: 780010 - RNA, 22 nt, Human
ggcugcugugaccucaggugau

SEQ ID NO: 780011 - RNA, 22 nt, Human
ugaggacuuuccauguuaaugu

SEQ ID NO: 780012 - RNA, 22 nt, Human
gcuccgugggcauugcuaggug

SEQ ID NO: 780013 - RNA, 22 nt, Human
auuuuguggcagaugcagaacc

SEQ ID NO: 780014 - RNA, 22 nt, Human
agcccaggaguccuuaaggacc

SEQ ID NO: 780015 - RNA, 22 nt, Human
ucucaucugccauuugcaggag

SEQ ID NO: 780016 - RNA, 22 nt, Human
ucuugggagucccaggacauag

SEQ ID NO: 780017 - RNA, 22 nt, Human
augugucuuauuugauuccaca

SEQ ID NO: 780018 - RNA, 22 nt, Human
gaauguuugugcagagucaucu

SEQ ID NO: 780019 - RNA, 22 nt, Human
uaugcauaugaccccaagcuug

SEQ ID NO: 780020 - RNA, 21 nt, Human
agguuuauuucaacuucagga

SEQ ID NO: 780021 - RNA, 22 nt, Human
gcuuacaaacaacagaaauuaa

SEQ ID NO: 780022 - RNA, 21 nt, Human
ucagggaagugugcagaaggg

SEQ ID NO: 780023 - RNA, 22 nt, Human
cugggcacugcagcaggcauca

SEQ ID NO: 780024 - RNA, 19 nt, Human
cuggccacaccugcugguu

SEQ ID NO: 780025 - RNA, 22 nt, Human
ucugugccaccucuccaguguc

SEQ ID NO: 780026 - RNA, 22 nt, Human
uuucaacagaauaugaucagag

SEQ ID NO: 780027 - RNA, 22 nt, Human
gccuggaguacuccuugaagug

SEQ ID NO: 780028 - RNA, 22 nt, Human
uguuucuaggucaauaauuuuu

SEQ ID NO: 780029 - RNA, 22 nt, Human
ucacaucugccuccauagcacc

SEQ ID NO: 780030 - RNA, 22 nt, Human
ggugaaggaggaagcugaugga

SEQ ID NO: 780031 - RNA, 22 nt, Human
uagagcuggaaaacugcaggua

SEQ ID NO: 780032 - RNA, 22 nt, Human
gcagucaguaaggcagccagaa

SEQ ID NO: 780033 - RNA, 22 nt, Human
ugugggugaugaauuuguucuu

SEQ ID NO: 780034 - RNA, 22 nt, Human
auggccagaugaaauaauagag

SEQ ID NO: 780035 - RNA, 22 nt, Human
gacaauuucucaauauagaaac

SEQ ID NO: 780036 - RNA, 22 nt, Human
ugcacugaauaguagacuguac

SEQ ID NO: 780037 - RNA, 22 nt, Human
aauauccacacugugucccugc

SEQ ID NO: 780038 - RNA, 22 nt, Human
auuaaagcuauccagucaugaa

SEQ ID NO: 780039 - RNA, 22 nt, Human
aguaacaucuuugacauuuguu

SEQ ID NO: 780040 - RNA, 22 nt, Human
uauuagggaacugcaagacuaa

SEQ ID NO: 780041 - RNA, 22 nt, Human
uacaaaguuuucuuggauugag

SEQ ID NO: 780042 - RNA, 22 nt, Human
aauguuugcaucuauucacaug

SEQ ID NO: 780043 - RNA, 22 nt, Human
uuaauuaugcaaaaggccccau

SEQ ID NO: 780044 - RNA, 22 nt, Human
uucucuuucugcugggcuggaa

SEQ ID NO: 780045 - RNA, 22 nt, Human
caaaauugaugaauguaugauu

SEQ ID NO: 780046 - RNA, 22 nt, Human
agaguggggacagggccugucc

SEQ ID NO: 780047 - RNA, 22 nt, Human
uccucuccagcaaacuggcuau

SEQ ID NO: 780048 - RNA, 22 nt, Human
uucuucaauaaauucccauaag

SEQ ID NO: 780049 - RNA, 22 nt, Human
acccacgaagaugagcggcaug

SEQ ID NO: 780050 - RNA, 22 nt, Human
gcagcccuuucugggcagggga

SEQ ID NO: 780051 - RNA, 22 nt, Human
acaguguuuuagaaaagcuuga

SEQ ID NO: 780052 - RNA, 22 nt, Human
uggagccaaaaagggaaggaga

SEQ ID NO: 780053 - RNA, 22 nt, Human
uggaggcaccacuggcugcccg

SEQ ID NO: 780054 - RNA, 22 nt, Human
uccccacacagauacagaguag

SEQ ID NO: 780055 - RNA, 22 nt, Human
cuggcugaggucaccaguagcu

SEQ ID NO: 780056 - RNA, 22 nt, Human
acucugccaucccaggugcugu

SEQ ID NO: 780057 - RNA, 22 nt, Human
ccaggccuggccaggggaugcc

SEQ ID NO: 780058 - RNA, 22 nt, Human
uacugaaggacuugaggguuuc

SEQ ID NO: 780059 - RNA, 22 nt, Human
agagaaaguaaagauucuaccu

SEQ ID NO: 780060 - RNA, 22 nt, Human
aagucccugguuccuagcaaaa

SEQ ID NO: 780061 - RNA, 22 nt, Human
ugcaugaugguuuagauggggu

SEQ ID NO: 780062 - RNA, 22 nt, Human
agcuguaugcccaagaugcuau

SEQ ID NO: 780063 - RNA, 22 nt, Human
uagaaagcagaaaccaucagag

SEQ ID NO: 780064 - RNA, 22 nt, Human
ccagcucuguaagcugugaaau

SEQ ID NO: 780065 - RNA, 22 nt, Human
guggauggauugaggcaguggg

SEQ ID NO: 780066 - RNA, 22 nt, Human
agagcagcugcauucagcaccu

SEQ ID NO: 780067 - RNA, 22 nt, Human
agcagaagugccuuagcaauca

SEQ ID NO: 780068 - RNA, 22 nt, Human
uggagaagucaaagugaacagg

SEQ ID NO: 780069 - RNA, 22 nt, Human
auguuucccuucugauuuggga

SEQ ID NO: 780070 - RNA, 22 nt, Human
caaauguaauggcagguuuugc

SEQ ID NO: 780071 - RNA, 22 nt, Human
aauguggcauugucauuauugg

SEQ ID NO: 780072 - RNA, 22 nt, Human
gcugcuuucuguuaggaauugg

SEQ ID NO: 780073 - RNA, 22 nt, Human
uguaugcuuuccaaaaaugcug

SEQ ID NO: 780074 - RNA, 22 nt, Human
gcucuggugaguguaguucagg

SEQ ID NO: 780075 - RNA, 22 nt, Human
ugcuggcccuggcucagggaac

SEQ ID NO: 780076 - RNA, 22 nt, Human
guaccaugagcaucauguuuuu

SEQ ID NO: 780077 - RNA, 22 nt, Human
auuuacagacguggauuagugc

SEQ ID NO: 780078 - RNA, 23 nt, Human
augauaaugccauuaacuuugau

SEQ ID NO: 780079 - RNA, 22 nt, Human
gggugaagcuccugcaggggcc

SEQ ID NO: 780080 - RNA, 22 nt, Human
ucagcuuuggucacauugaguu

SEQ ID NO: 780081 - RNA, 19 nt, Human
uaucacugggcacugagga

SEQ ID NO: 780082 - RNA, 22 nt, Human
cgucuuccucuuacgaugcgcu

SEQ ID NO: 780083 - RNA, 22 nt, Human
acuguauaguauuuauucuuag

SEQ ID NO: 780084 - RNA, 22 nt, Human
ugaaaucuuuaguuucuguccc

SEQ ID NO: 780085 - RNA, 17 nt, Human
gcuccaggcgugaguga

SEQ ID NO: 780086 - RNA, 22 nt, Human
cuguccagucuuuagcaagcug

SEQ ID NO: 780087 - RNA, 20 nt, Human
gcccucugccucccucagcg

SEQ ID NO: 780088 - RNA, 22 nt, Human
cugcccugcagcuccacggacu

SEQ ID NO: 780089 - RNA, 22 nt, Human
augaggagaccaaggccugaug

SEQ ID NO: 780090 - RNA, 22 nt, Human
uuucagaaccgcuaaaauaaau

SEQ ID NO: 780091 - RNA, 22 nt, Human
ucucaggucucaugccaggccu

SEQ ID NO: 780092 - RNA, 22 nt, Human
guggcagagaacaaggagaggu

SEQ ID NO: 780093 - RNA, 22 nt, Human
uuggagugacagaugaggaaac

SEQ ID NO: 780094 - RNA, 22 nt, Human
cuggcccuucucuugcuuccug

SEQ ID NO: 780095 - RNA, 22 nt, Human
auuaaaugguggucauucauuu

SEQ ID NO: 780096 - RNA, 22 nt, Human
uagggcagauucgguggaguuu

SEQ ID NO: 780097 - RNA, 22 nt, Human
uuggagaggcagucuugcucug

SEQ ID NO: 780098 - RNA, 22 nt, Human
cagggacagcacuaaacucuug

SEQ ID NO: 780099 - RNA, 22 nt, Human
ugucaaagcaaggauuaaaugu

SEQ ID NO: 780100 - RNA, 22 nt, Human
uuuccucuuauacaguguuuau

SEQ ID NO: 780101 - RNA, 22 nt, Human
uggcaguggcaucaccccaaua

SEQ ID NO: 780102 - RNA, 22 nt, Human
cacaauuccauggcauucuuug

SEQ ID NO: 780103 - RNA, 22 nt, Human
caagcagagaagucucuaggcu

SEQ ID NO: 780104 - RNA, 22 nt, Human
cuguccugaggcagguggccug

SEQ ID NO: 780105 - RNA, 22 nt, Human
agagauugugcuacucacccaa

SEQ ID NO: 780106 - RNA, 22 nt, Human
agccaggaaugcaugcucugcu

SEQ ID NO: 780107 - RNA, 22 nt, Human
uuagaucuuaggcaaauguguu

SEQ ID NO: 780108 - RNA, 22 nt, Human
cggcagcuccgcgccguaggac

SEQ ID NO: 780109 - RNA, 21 nt, Human
ccaggcuggccaugguauuga

SEQ ID NO: 780110 - RNA, 22 nt, Human
aggugcuagguguguaguggag

SEQ ID NO: 780111 - RNA, 22 nt, Human
cuagcacaguaugguaucagau

SEQ ID NO: 780112 - RNA, 22 nt, Human
aagugcauaaguaugauuauuu

SEQ ID NO: 780113 - RNA, 22 nt, Human
agcaacauugagacugcaguug

SEQ ID NO: 780114 - RNA, 22 nt, Human
ucacagcaguaaagaaaacacu

SEQ ID NO: 780115 - RNA, 22 nt, Human
uaagguuuggcugucucuuggu

SEQ ID NO: 780116 - RNA, 22 nt, Human
gggcagugauuuuccuuagagg

SEQ ID NO: 780117 - RNA, 22 nt, Human
augaucagcaguuuucaguguu

SEQ ID NO: 780118 - RNA, 22 nt, Human
ggagcucaccuuggagucucug

SEQ ID NO: 780119 - RNA, 22 nt, Human
auauagaauacacagggaaagu

SEQ ID NO: 780120 - RNA, 22 nt, Human
ugaauaagaauuauuauaauga

SEQ ID NO: 780121 - RNA, 22 nt, Human
gauacauugaggguggaggacc

SEQ ID NO: 780122 - RNA, 22 nt, Human
guucuucaccaaggucagaggc

SEQ ID NO: 780123 - RNA, 22 nt, Human
uaagguuucuaguuucuaaacu

SEQ ID NO: 780124 - RNA, 22 nt, Human
ugagccacagugagagcuccug

SEQ ID NO: 780125 - RNA, 22 nt, Human
ggcuuaaaaggaaaaugagagu

SEQ ID NO: 780126 - RNA, 22 nt, Human
ucaggaagugguaaaggauguu

SEQ ID NO: 780127 - RNA, 22 nt, Human
uuacacuuaucuagagccaugg

SEQ ID NO: 780128 - RNA, 22 nt, Human
cacauugauaauuaaggccucc

SEQ ID NO: 780129 - RNA, 22 nt, Human
guuuuggcagccguguucacau

SEQ ID NO: 780130 - RNA, 22 nt, Human
uguucauuuggcccuuuuguau

SEQ ID NO: 780131 - RNA, 22 nt, Human
gugagguccucccugcugggag

SEQ ID NO: 780132 - RNA, 22 nt, Human
uggggcucaugccugcuggaac

SEQ ID NO: 780133 - RNA, 22 nt, Human
caaccugacaagguuaaugaau

SEQ ID NO: 780134 - RNA, 22 nt, Human
ccaucuccaguuuauucuuccu

SEQ ID NO: 780135 - RNA, 22 nt, Human
uacaaugcaaaauacugucugc

SEQ ID NO: 780136 - RNA, 19 nt, Human
gaacaaacuuaaacuuuuc

SEQ ID NO: 780137 - RNA, 22 nt, Human
ugaccaaagaguugcuuguauu

SEQ ID NO: 780138 - RNA, 22 nt, Human
uuuaaauuuguguuuagagggu

SEQ ID NO: 780139 - RNA, 22 nt, Human
agucacacuucguaucucuagc

SEQ ID NO: 780140 - RNA, 22 nt, Human
cccagagcugagucugauauau

SEQ ID NO: 780141 - RNA, 22 nt, Human
ugcagagacuugugugcauuug

SEQ ID NO: 780142 - RNA, 22 nt, Human
ccaccaggcucuguccgagcgg

SEQ ID NO: 780143 - RNA, 22 nt, Human
uccugccucaggcucuggagua

SEQ ID NO: 780144 - RNA, 22 nt, Human
gaggggcuugaggcccugaugg

SEQ ID NO: 780145 - RNA, 19 nt, Human
gggagcuuuccaucugucc

SEQ ID NO: 780146 - RNA, 22 nt, Human
aacuuuggccacaaguacccug

SEQ ID NO: 780147 - RNA, 21 nt, Human
uguggcaucauugaucuguga

SEQ ID NO: 780148 - RNA, 22 nt, Human
aagaacauugacuaagaggggc

SEQ ID NO: 780149 - RNA, 22 nt, Human
gaccuccguguacaccucccag

SEQ ID NO: 780150 - RNA, 22 nt, Human
aaccugagcgcguugcuuucua

SEQ ID NO: 780151 - RNA, 22 nt, Human
uauccaauucaccauugauggg

SEQ ID NO: 780152 - RNA, 22 nt, Human
gggcuggcucccagguguugaa

SEQ ID NO: 780153 - RNA, 22 nt, Human
ucagguggccaaaugggagcgc

SEQ ID NO: 780154 - RNA, 21 nt, Human
ggcacuaggcccggaggaagc

SEQ ID NO: 780155 - RNA, 17 nt, Human
ucaaauccucugucugg

SEQ ID NO: 780156 - RNA, 22 nt, Human
acugccucuuggugcugagaga

SEQ ID NO: 780157 - RNA, 19 nt, Human
uggcuucuguuuucauguu

SEQ ID NO: 780158 - RNA, 22 nt, Human
accaaaaauuguggggcugaau

SEQ ID NO: 780159 - RNA, 22 nt, Human
acuuuguagguuucagugaaac

SEQ ID NO: 780160 - RNA, 22 nt, Human
gagauaacucuaggucuucgag

SEQ ID NO: 780161 - RNA, 20 nt, Human
gcuuggcauaggccacuuga

SEQ ID NO: 780162 - RNA, 22 nt, Human
gccaggcucuuccauuuggguc

SEQ ID NO: 780163 - RNA, 22 nt, Human
auaauccauuaauuaaugacca

SEQ ID NO: 780164 - RNA, 22 nt, Human
aaaguguugggaagaaagugca

SEQ ID NO: 780165 - RNA, 22 nt, Human
agagucuggugcaugauaagca

SEQ ID NO: 780166 - RNA, 22 nt, Human
auuuuuaugacaaaccauccuc

SEQ ID NO: 780167 - RNA, 22 nt, Human
uuacacaacaucuguauuauua

SEQ ID NO: 780168 - RNA, 22 nt, Human
agugggucagagagcuccagau

SEQ ID NO: 780169 - RNA, 22 nt, Human
auuuucuucucucccuggcugc

SEQ ID NO: 780170 - RNA, 21 nt, Human
aggcauggaaauggcacacug

SEQ ID NO: 780171 - RNA, 22 nt, Human
uaggaugugccaggaaagaaag

SEQ ID NO: 780172 - RNA, 22 nt, Human
gucaacuguaccuaaagaaagu

SEQ ID NO: 780173 - RNA, 22 nt, Human
augugaaaccugugaguagagu

SEQ ID NO: 780174 - RNA, 22 nt, Human
ucuaaacaguuucacucuuaau

SEQ ID NO: 780175 - RNA, 22 nt, Human
uuuagacagaugugaggugggu

SEQ ID NO: 780176 - RNA, 22 nt, Human
auaaguguuagguaaacaucuu

SEQ ID NO: 780177 - RNA, 22 nt, Human
cuagggacugggaccuuaguua

SEQ ID NO: 780178 - RNA, 22 nt, Human
uaauuuuguauugccauuguag

SEQ ID NO: 780179 - RNA, 22 nt, Human
ucugcagaaguggcugggccac

SEQ ID NO: 780180 - RNA, 22 nt, Human
aauuuacaguugcugaugguac

SEQ ID NO: 780181 - RNA, 22 nt, Human
agaggcugcacuugcucaugau

SEQ ID NO: 780182 - RNA, 22 nt, Human
augggcaguaacaguggcaguc

SEQ ID NO: 780183 - RNA, 22 nt, Human
cagagacaggagugcucccagu

SEQ ID NO: 780184 - RNA, 22 nt, Human
ggucucauguccuaugugcuua

SEQ ID NO: 780185 - RNA, 22 nt, Human
gaaacuuuggcuaaaagccaga

SEQ ID NO: 780186 - RNA, 20 nt, Human
aggcucagcugagcucuugg

SEQ ID NO: 780187 - RNA, 22 nt, Human
ugacccucuuccccaugcgcuc

SEQ ID NO: 780188 - RNA, 22 nt, Human
gaggagagaugguagauugggu

SEQ ID NO: 780189 - RNA, 23 nt, Human
cuccucguaacucuguggugggu

SEQ ID NO: 780190 - RNA, 22 nt, Human
agugaauauuuuuagacaccca

SEQ ID NO: 780191 - RNA, 22 nt, Human
gguguccgcgcuguagaagguc

SEQ ID NO: 780192 - RNA, 22 nt, Human
ugccagaguuacaugaggguca

SEQ ID NO: 780193 - RNA, 22 nt, Human
cucagcauggagggagaacaag

SEQ ID NO: 780194 - RNA, 22 nt, Human
guccaguguguuuaucuuggau

SEQ ID NO: 780195 - RNA, 21 nt, Human
aggcaggauucaaacacagag

SEQ ID NO: 780196 - RNA, 22 nt, Human
auuuuuucccaguuagccagga

SEQ ID NO: 780197 - RNA, 22 nt, Human
acagugugacaauugugucaga

SEQ ID NO: 780198 - RNA, 22 nt, Human
ugcagcuuuaagcuuucaucag

SEQ ID NO: 780199 - RNA, 22 nt, Human
uguggcuuaagaaugccuuuaa

SEQ ID NO: 780200 - RNA, 22 nt, Human
gcucuggggcccagggaucaca

SEQ ID NO: 780201 - RNA, 22 nt, Human
gaggcuguuaggagggacucug

SEQ ID NO: 780202 - RNA, 20 nt, Human
ugaaggccagcagcauaggg

SEQ ID NO: 780203 - RNA, 22 nt, Human
gagagugcugaacggcaagggu

SEQ ID NO: 780204 - RNA, 22 nt, Human
ggccugugggaggacagcuggg

SEQ ID NO: 780205 - RNA, 22 nt, Human
ucucuggguugagaacuaggac

SEQ ID NO: 780206 - RNA, 22 nt, Human
aaaaagauagcauugugcuccu

SEQ ID NO: 780207 - RNA, 22 nt, Human
caggguugggguagauaagaaa

SEQ ID NO: 780208 - RNA, 22 nt, Human
ugaaagaugaaagcaggcuggu

SEQ ID NO: 780209 - RNA, 22 nt, Human
auggcccuguuuaugguaaggc

SEQ ID NO: 780210 - RNA, 22 nt, Human
augcacaucuuacagaugcaga

SEQ ID NO: 780211 - RNA, 22 nt, Human
ugcaggagaaaguacggagcgu

SEQ ID NO: 780212 - RNA, 22 nt, Human
auuguaacaacaauaguuuagg

SEQ ID NO: 780213 - RNA, 22 nt, Human
uuccuuugggaaaucacuaagg

SEQ ID NO: 780214 - RNA, 22 nt, Human
gagaggcucagggacuugcuga

SEQ ID NO: 780215 - RNA, 22 nt, Human
uauguacagggauagaacuuga

SEQ ID NO: 780216 - RNA, 21 nt, Human
uuccuggaggcagaaacguga

SEQ ID NO: 780217 - RNA, 23 nt, Human
ucuuuccuaaugaaacagugaaa

SEQ ID NO: 780218 - RNA, 23 nt, Human
uucuccugaggaagcagggacug

SEQ ID NO: 780219 - RNA, 22 nt, Human
gucugucucccugugacugaga

SEQ ID NO: 780220 - RNA, 22 nt, Human
uuacaucagaaucacccaggaa

SEQ ID NO: 780221 - RNA, 22 nt, Human
agcuuugaaugagugcauugca

SEQ ID NO: 780222 - RNA, 22 nt, Human
aggugaggauagguggccaagg

SEQ ID NO: 780223 - RNA, 22 nt, Human
ggugcaggaaucugcaauugaa

SEQ ID NO: 780224 - RNA, 22 nt, Human
uucauuccuucuguaccuugcc

SEQ ID NO: 780225 - RNA, 22 nt, Human
uuggcuucauugaucucacuuu

SEQ ID NO: 780226 - RNA, 22 nt, Human
caggacagaaauaaggaauaua

SEQ ID NO: 780227 - RNA, 22 nt, Human
ggaaggcuuuguagaagugcca

SEQ ID NO: 780228 - RNA, 19 nt, Human
ugcuuucuaaacacaugca

SEQ ID NO: 780229 - RNA, 22 nt, Human
cuccagauaggagggggucccc

SEQ ID NO: 780230 - RNA, 23 nt, Human
cuugggcuagagacuuagcagug

SEQ ID NO: 780231 - RNA, 22 nt, Human
auuucucaucaagugccaacuc

SEQ ID NO: 780232 - RNA, 22 nt, Human
ccagaaggcggagauugcagug

SEQ ID NO: 780233 - RNA, 22 nt, Human
uggccccuggcacacggaggau

SEQ ID NO: 780234 - RNA, 22 nt, Human
gcugggaaguggcagagcugga

SEQ ID NO: 780235 - RNA, 22 nt, Human
cugcggugggcugggcuguccc

SEQ ID NO: 780236 - RNA, 22 nt, Human
ucuuuagagcacgggaaaaaca

SEQ ID NO: 780237 - RNA, 22 nt, Human
acuugcugguggcauuuacagu

SEQ ID NO: 780238 - RNA, 22 nt, Human
gcuaggagccgcugcacuaggu

SEQ ID NO: 780239 - RNA, 22 nt, Human
uugggcuggcccuugucucugg

SEQ ID NO: 780240 - RNA, 22 nt, Human
cuggugcaggaaggagcuggca

SEQ ID NO: 780241 - RNA, 22 nt, Human
caugugugacaaacugccugca

SEQ ID NO: 780242 - RNA, 22 nt, Human
cuguggucaucucagaguggcc

SEQ ID NO: 780243 - RNA, 22 nt, Human
uggagaguguagacuucagagu

SEQ ID NO: 780244 - RNA, 22 nt, Human
ccaggcaccaaaguaugcuuua

SEQ ID NO: 780245 - RNA, 22 nt, Human
gaugcuuacauagcccaagugu

SEQ ID NO: 780246 - RNA, 22 nt, Human
cucaggcugugaugugauggca

SEQ ID NO: 780247 - RNA, 22 nt, Human
gcaggagccacuucagggaugc

SEQ ID NO: 780248 - RNA, 22 nt, Human
gaccauuucuaggaaucagacu

SEQ ID NO: 780249 - RNA, 19 nt, Human
cccagcucucguggugugc

SEQ ID NO: 780250 - RNA, 22 nt, Human
ucaagacaggguuuaagguuga

SEQ ID NO: 780251 - RNA, 22 nt, Human
ucacacagcuccuuuccuuagu

SEQ ID NO: 780252 - RNA, 22 nt, Human
cagcugagcugccagacuacug

SEQ ID NO: 780253 - RNA, 22 nt, Human
gggugugcaggucauggcgucu

SEQ ID NO: 780254 - RNA, 22 nt, Human
guggccuggaugagcuucgaca

SEQ ID NO: 780255 - RNA, 22 nt, Human
cuuuguucaugacaucugcuuc

SEQ ID NO: 780256 - RNA, 22 nt, Human
aaaagcagguacucagcuuggg

SEQ ID NO: 780257 - RNA, 22 nt, Human
guuucaugguuguuugauggca

SEQ ID NO: 780258 - RNA, 22 nt, Human
gcucugugaccuuaggcaaguu

SEQ ID NO: 780259 - RNA, 22 nt, Human
uccaggaggccucauuuccugu

SEQ ID NO: 780260 - RNA, 22 nt, Human
caggcucaagcccugcuuauau

SEQ ID NO: 780261 - RNA, 22 nt, Human
aggcuucccagcugagcucagc

SEQ ID NO: 780262 - RNA, 22 nt, Human
cagagugaacagugggaugugc

SEQ ID NO: 780263 - RNA, 22 nt, Human
gcuccacuugcagcuaggcuug

SEQ ID NO: 780264 - RNA, 22 nt, Human
guguguaaugcuuauugugcuu

SEQ ID NO: 780265 - RNA, 22 nt, Human
aaugguuuggacuauucaauag

SEQ ID NO: 780266 - RNA, 22 nt, Human
caggacagaccaagaucgugcu

SEQ ID NO: 780267 - RNA, 22 nt, Human
gaggaaggucccaucagaauuu

SEQ ID NO: 780268 - RNA, 22 nt, Human
gugcacaucgugcagguuuguu

SEQ ID NO: 780269 - RNA, 22 nt, Human
caccaucuauagagguauuugg

SEQ ID NO: 780270 - RNA, 22 nt, Human
cacacugucagguaaauaacac

SEQ ID NO: 780271 - RNA, 22 nt, Human
auaugaaaauguuuuagcugua

SEQ ID NO: 780272 - RNA, 22 nt, Human
augauccaaagccacaggggca

SEQ ID NO: 780273 - RNA, 22 nt, Human
acccaaagcaauauucaucagu

SEQ ID NO: 780274 - RNA, 23 nt, Human
aucuuagcauagacuugaguccc

SEQ ID NO: 780275 - RNA, 22 nt, Human
ugcugaaacaauaacauacugg

SEQ ID NO: 780276 - RNA, 19 nt, Human
augaggaacugaggcucag

SEQ ID NO: 780277 - RNA, 18 nt, Human
auccauuuaaugccugga

SEQ ID NO: 780278 - RNA, 22 nt, Human
cugugaggcccugggugcugga

SEQ ID NO: 780279 - RNA, 22 nt, Human
uaguccugaccuugccaccagc

SEQ ID NO: 780280 - RNA, 22 nt, Human
cuucugcuggcauacugcccca

SEQ ID NO: 780281 - RNA, 22 nt, Human
guuuuggcucuggcauguggaa

SEQ ID NO: 780282 - RNA, 22 nt, Human
cauaaucccccauuugugacau

SEQ ID NO: 780283 - RNA, 22 nt, Human
ggcucugcaugugagugggugg

SEQ ID NO: 780284 - RNA, 22 nt, Human
ucugaagacauaugauauggug

SEQ ID NO: 780285 - RNA, 22 nt, Human
ggaggggcaggucccaaguugu

SEQ ID NO: 780286 - RNA, 22 nt, Human
ucuacagguggggccuggcaau

SEQ ID NO: 780287 - RNA, 22 nt, Human
aacuuuucacaggcuagcucuu

SEQ ID NO: 780288 - RNA, 22 nt, Human
uuguccuuaccucaaucuggaa

SEQ ID NO: 780289 - RNA, 22 nt, Human
auuucucucauuguuagcuagg

SEQ ID NO: 780290 - RNA, 22 nt, Human
ggccauggcgggagccggcguc

SEQ ID NO: 780291 - RNA, 22 nt, Human
cuggagccauguauagccuaug

SEQ ID NO: 780292 - RNA, 22 nt, Human
cgcaggcacagaguggacagcg

SEQ ID NO: 780293 - RNA, 22 nt, Human
aagcugaagccggaucaaaaag

SEQ ID NO: 780294 - RNA, 22 nt, Human
gagagguacggaaagagcgugg

SEQ ID NO: 780295 - RNA, 22 nt, Human
ggcuucagugacuggugcccuc

SEQ ID NO: 780296 - RNA, 21 nt, Human
ccuccugcccgcaagcuaggg

SEQ ID NO: 780297 - RNA, 22 nt, Human
ugcaaagaugaaauauuaaagg

SEQ ID NO: 780298 - RNA, 19 nt, Human
ggagacucagcccaugccu

SEQ ID NO: 780299 - RNA, 22 nt, Human
aaggccaggccuagcacggagg

SEQ ID NO: 780300 - RNA, 22 nt, Human
acacugguuguuaauaguaaca

SEQ ID NO: 780301 - RNA, 22 nt, Human
uaggcagauguuaacaggaaaa

SEQ ID NO: 780302 - RNA, 18 nt, Human
ggcagccuacccacuugu

SEQ ID NO: 780303 - RNA, 22 nt, Human
acagcauccuucuaaaguagcu

SEQ ID NO: 780304 - RNA, 22 nt, Human
cagcuucuaccaucaggaaauu

SEQ ID NO: 780305 - RNA, 22 nt, Human
ucccacauuacccugacugaca

SEQ ID NO: 780306 - RNA, 22 nt, Human
gccccuccgggcgcgucauagc

SEQ ID NO: 780307 - RNA, 22 nt, Human
aggagcuggccacuaggaugca

SEQ ID NO: 780308 - RNA, 22 nt, Human
aaugaauucugaagucuuccaa

SEQ ID NO: 780309 - RNA, 22 nt, Human
guccuggugcuggucauugucg

SEQ ID NO: 780310 - RNA, 22 nt, Human
cugaggcuggcguuugaggaag

SEQ ID NO: 780311 - RNA, 22 nt, Human
cuuuguuagcagccaauuuguu

SEQ ID NO: 780312 - RNA, 22 nt, Human
uccucugguuauacuugcaccc

SEQ ID NO: 780313 - RNA, 22 nt, Human
uucuggcaucugggggaggccu

SEQ ID NO: 780314 - RNA, 22 nt, Human
ggguaggccagaagggccugga

SEQ ID NO: 780315 - RNA, 22 nt, Human
cagcccugggucccugcccugg

SEQ ID NO: 780316 - RNA, 22 nt, Human
aggcccuggggucuguuaaauu

SEQ ID NO: 780317 - RNA, 22 nt, Human
uggcuucauguaguuugaguug

SEQ ID NO: 780318 - RNA, 22 nt, Human
uaaugucuuuaagagcauuggg

SEQ ID NO: 780319 - RNA, 22 nt, Human
gccagccugugggggcucugug

SEQ ID NO: 780320 - RNA, 22 nt, Human
agaaaacucuacaucuguaugu

SEQ ID NO: 780321 - RNA, 22 nt, Human
auccacucggagggaauguuua

SEQ ID NO: 780322 - RNA, 22 nt, Human
ucuccucccaggcucuuccagg

SEQ ID NO: 780323 - RNA, 17 nt, Human
caggugaccuggugaug

SEQ ID NO: 780324 - RNA, 20 nt, Human
uuggaagguggagaagagga

SEQ ID NO: 780325 - RNA, 22 nt, Human
augucugcggcccaggccaggg

SEQ ID NO: 780326 - RNA, 22 nt, Human
acagcuggaguguuggugaggu

SEQ ID NO: 780327 - RNA, 22 nt, Human
ugugugcucgauggcccugcag

SEQ ID NO: 780328 - RNA, 22 nt, Human
aauugcuuuucaaggguacagc

SEQ ID NO: 780329 - RNA, 22 nt, Human
ggcaggcaagucugcucuguga

SEQ ID NO: 780330 - RNA, 22 nt, Human
aggggacacggcuucuccaggg

SEQ ID NO: 780331 - RNA, 22 nt, Human
cuguggcuaauaauuaguauuu

SEQ ID NO: 780332 - RNA, 22 nt, Human
ugcagcucuuacggagggcggg

SEQ ID NO: 780333 - RNA, 22 nt, Human
uuggcucaugcuguuuugugca

SEQ ID NO: 780334 - RNA, 22 nt, Human
guuuccugugggaacucggcug

SEQ ID NO: 780335 - RNA, 23 nt, Human
agccuggcaccugcagaucggag

SEQ ID NO: 780336 - RNA, 23 nt, Human
aaauaccugaauuagauauuauc

SEQ ID NO: 780337 - RNA, 22 nt, Human
uucuggaaaucagcagagggug

SEQ ID NO: 780338 - RNA, 19 nt, Human
gacuucugauguccagaug

SEQ ID NO: 780339 - RNA, 22 nt, Human
aaaguugcacaacuuuguauac

SEQ ID NO: 780340 - RNA, 22 nt, Human
ggagaagggaacugaguuuuug

SEQ ID NO: 780341 - RNA, 22 nt, Human
auguaauaggguaacauaacau

SEQ ID NO: 780342 - RNA, 22 nt, Human
uaauggcagagucaugcuuucu

SEQ ID NO: 780343 - RNA, 22 nt, Human
ucccucucuagccuguucagua

SEQ ID NO: 780344 - RNA, 22 nt, Human
cagccagugugaccgaggagga

SEQ ID NO: 780345 - RNA, 22 nt, Human
gacaugauggaaaaaaaugcuc

SEQ ID NO: 780346 - RNA, 18 nt, Human
acugugguuuauguguag

SEQ ID NO: 780347 - RNA, 22 nt, Human
uacacuaugggcuuuguguaau

SEQ ID NO: 780348 - RNA, 20 nt, Human
augugaaagaucaguugucu

SEQ ID NO: 780349 - RNA, 22 nt, Human
gcccauggcagaacugugagca

SEQ ID NO: 780350 - RNA, 22 nt, Human
cuggggcucacuuuggucaggc

SEQ ID NO: 780351 - RNA, 22 nt, Human
aaauucaguuccucagccacau

SEQ ID NO: 780352 - RNA, 20 nt, Human
aguguacagacacuagaaau

SEQ ID NO: 780353 - RNA, 22 nt, Human
gcccugagcuagugugggcagg

SEQ ID NO: 780354 - RNA, 22 nt, Human
auggcuguuggcaggaggccuc

SEQ ID NO: 780355 - RNA, 23 nt, Human
agcugcaagacucccugucugag

SEQ ID NO: 780356 - RNA, 22 nt, Human
cugcauguuuacauuuuugaga

SEQ ID NO: 780357 - RNA, 22 nt, Human
agcuguauuugugaauauuuaa

SEQ ID NO: 780358 - RNA, 22 nt, Human
gaaaguauuuacauuaacaucu

SEQ ID NO: 780359 - RNA, 22 nt, Human
guuucacauaauuuuaaauugu

SEQ ID NO: 780360 - RNA, 22 nt, Human
ugccuuggugcuucuucaugug

SEQ ID NO: 780361 - RNA, 22 nt, Human
auuuacagaagcauguaauagc

SEQ ID NO: 780362 - RNA, 22 nt, Human
agaggcugugcccaccaggcaa

SEQ ID NO: 780363 - RNA, 22 nt, Human
ugcuuuauggauuuguguccug

SEQ ID NO: 780364 - RNA, 22 nt, Human
agcaggacacgaugcggcagga

SEQ ID NO: 780365 - RNA, 22 nt, Human
uaacacauuaguucuccuagau

SEQ ID NO: 780366 - RNA, 22 nt, Human
uuacuguucauguuguacacuu

SEQ ID NO: 780367 - RNA, 22 nt, Human
uccagggacacagaguccuucu

SEQ ID NO: 780368 - RNA, 22 nt, Human
ugggggaguauagucuggccuc

SEQ ID NO: 780369 - RNA, 22 nt, Human
uccuccccucagggcaacggau

SEQ ID NO: 780370 - RNA, 22 nt, Human
caguguggagggagagagccug

SEQ ID NO: 780371 - RNA, 21 nt, Human
agcagcugggcaacauggagg

SEQ ID NO: 780372 - RNA, 20 nt, Human
uuucugugcccaggucuguu

SEQ ID NO: 780373 - RNA, 22 nt, Human
gccagguacauuuaagaagccu

SEQ ID NO: 780374 - RNA, 21 nt, Human
uuucaauuugccuugagucau

SEQ ID NO: 780375 - RNA, 18 nt, Human
uccagucccagcucugcc

SEQ ID NO: 780376 - RNA, 22 nt, Human
aguuauauuccauagauucaga

SEQ ID NO: 780377 - RNA, 22 nt, Human
uguggcagggauacugaggcag

SEQ ID NO: 780378 - RNA, 22 nt, Human
ccugaccauuugccacaugggu

SEQ ID NO: 780379 - RNA, 19 nt, Human
gacagugcaguuguaguac

SEQ ID NO: 780380 - RNA, 22 nt, Human
guaaauguugcauuuaugggua

SEQ ID NO: 780381 - RNA, 22 nt, Human
agucacugagauggugaggcua

SEQ ID NO: 780382 - RNA, 22 nt, Human
ucaugacaugugaauugaauau

SEQ ID NO: 780383 - RNA, 22 nt, Human
ugcucagugagucugugacagg

SEQ ID NO: 780384 - RNA, 22 nt, Human
aaugcacaaaggugucuauugc

SEQ ID NO: 780385 - RNA, 22 nt, Human
uacuuuuuaugauaagaacuga

SEQ ID NO: 780386 - RNA, 22 nt, Human
ugucucagggcagcagcagggg

SEQ ID NO: 780387 - RNA, 22 nt, Human
agcauauaaauggacauauuug

SEQ ID NO: 780388 - RNA, 22 nt, Human
accugaggccuccccagcagac

SEQ ID NO: 780389 - RNA, 22 nt, Human
ucaucugaagauugcuguucaa

SEQ ID NO: 780390 - RNA, 21 nt, Human
guguuggcauauggugguuga

SEQ ID NO: 780391 - RNA, 22 nt, Human
gccaguuccuguggagucagag

SEQ ID NO: 780392 - RNA, 20 nt, Human
uauuuacaacuuagagccuc

SEQ ID NO: 780393 - RNA, 22 nt, Human
aagaacaugaagucacaaaugc

SEQ ID NO: 780394 - RNA, 22 nt, Human
gguuuccugcauugggaaauuu

SEQ ID NO: 780395 - RNA, 22 nt, Human
uuugacaacguuguugugagga

SEQ ID NO: 780396 - RNA, 22 nt, Human
ucuuaaguaccuccuuuaucac

SEQ ID NO: 780397 - RNA, 22 nt, Human
uuccagggcagcaagugaaugg

SEQ ID NO: 780398 - RNA, 22 nt, Human
uucaaacuuaaggagcagcaga

SEQ ID NO: 780399 - RNA, 22 nt, Human
uguggggugugguccaggcauc

SEQ ID NO: 780400 - RNA, 22 nt, Human
caggucucuuuugucacaccac

SEQ ID NO: 780401 - RNA, 22 nt, Human
acacuucuuugucaccugcuuc

SEQ ID NO: 780402 - RNA, 22 nt, Human
uccaagaguucaaggcuacagu

SEQ ID NO: 780403 - RNA, 20 nt, Human
gggaguggugguagccugug

SEQ ID NO: 780404 - RNA, 22 nt, Human
uauguacacuuaaguuugagaa

SEQ ID NO: 780405 - RNA, 22 nt, Human
gaaucauuggaaccacauccaa

SEQ ID NO: 780406 - RNA, 20 nt, Human
acauggaucaaaugucaguu

SEQ ID NO: 780407 - RNA, 22 nt, Human
uuauaguuaugaaagacugagg

SEQ ID NO: 780408 - RNA, 22 nt, Human
caucugcugacuugacaaguac

SEQ ID NO: 780409 - RNA, 22 nt, Human
cugcaucucaggagacgggucu

SEQ ID NO: 780410 - RNA, 22 nt, Human
aaggaaacacugaacuuuguag

SEQ ID NO: 780411 - RNA, 22 nt, Human
ccugggcuguugcaucauccuu

SEQ ID NO: 780412 - RNA, 23 nt, Human
auuuccuacuauaaaagagguaa

SEQ ID NO: 780413 - RNA, 22 nt, Human
agcugugugcccaugguggagg

SEQ ID NO: 780414 - RNA, 22 nt, Human
cacagguaauagccuaggcuau

SEQ ID NO: 780415 - RNA, 18 nt, Human
acagcagguuucauucuu

SEQ ID NO: 780416 - RNA, 20 nt, Human
uguucugucgucuuucuuca

SEQ ID NO: 780417 - RNA, 23 nt, Human
uccaagaaguagggccuggacuu

SEQ ID NO: 780418 - RNA, 22 nt, Human
uauguagagauaaaauccaaau

SEQ ID NO: 780419 - RNA, 22 nt, Human
aggcugugaacucuaugcugaa

SEQ ID NO: 780420 - RNA, 22 nt, Human
ucugacagguugggauauggaa

SEQ ID NO: 780421 - RNA, 22 nt, Human
uuucaaaccacugagguucuga

SEQ ID NO: 780422 - RNA, 22 nt, Human
ccaggaggcaauaucaagucca

SEQ ID NO: 780423 - RNA, 22 nt, Human
agcuggcaguaugacuggugac

SEQ ID NO: 780424 - RNA, 22 nt, Human
ucaucuuuccucaaaagaucca

SEQ ID NO: 780425 - RNA, 22 nt, Human
cagggcaggaugcugugauuau

SEQ ID NO: 780426 - RNA, 22 nt, Human
agugauuugggugucagaaagu

SEQ ID NO: 780427 - RNA, 22 nt, Human
acaucgauggauagagcuugcu

SEQ ID NO: 780428 - RNA, 20 nt, Human
augcccuguccucuucuguu

SEQ ID NO: 780429 - RNA, 17 nt, Human
accaaugucagacaaag

SEQ ID NO: 780430 - RNA, 22 nt, Human
ucaaggaagggauauucuugaa

SEQ ID NO: 780431 - RNA, 22 nt, Human
gcacagagggcagugagccucu

SEQ ID NO: 780432 - RNA, 19 nt, Human
ugagcaugcgagcugagaa

SEQ ID NO: 780433 - RNA, 21 nt, Human
gacucuggggucagcucaacc

SEQ ID NO: 780434 - RNA, 22 nt, Human
cugcagucagcuuuuaagaucu

SEQ ID NO: 780435 - RNA, 22 nt, Human
uuuccucuccggggccuccagg

SEQ ID NO: 780436 - RNA, 18 nt, Human
auuuugaacaaugcugua

SEQ ID NO: 780437 - RNA, 22 nt, Human
cuggcuuuaaaaugcuccugga

SEQ ID NO: 780438 - RNA, 18 nt, Human
gcacagcuaggagggucc

SEQ ID NO: 780439 - RNA, 22 nt, Human
uuuuaugugugaaaugcugucu

SEQ ID NO: 780440 - RNA, 22 nt, Human
augaggcaaagguggagguggg

SEQ ID NO: 780441 - RNA, 19 nt, Human
ucugcuggcagaauucccu

SEQ ID NO: 780442 - RNA, 19 nt, Human
aaaguugagaaacaaugga

SEQ ID NO: 780443 - RNA, 22 nt, Human
ugagccuggcggaagcagcgug

SEQ ID NO: 780444 - RNA, 22 nt, Human
cucugugcucccaugcuaguaa

SEQ ID NO: 780445 - RNA, 22 nt, Human
ugaggccaacuagggagaugga

SEQ ID NO: 780446 - RNA, 22 nt, Human
uuuguuauaacaauaaaaaguc

SEQ ID NO: 780447 - RNA, 22 nt, Human
guuucuguugcucagauaaugc

SEQ ID NO: 780448 - RNA, 22 nt, Human
ggugcucaaggugacaggacau

SEQ ID NO: 780449 - RNA, 22 nt, Human
ugugucuggaccggggaggagc

SEQ ID NO: 780450 - RNA, 22 nt, Human
aguaaagcagaguugcaguaca

SEQ ID NO: 780451 - RNA, 22 nt, Human
uaaauaagucacugaccauuua

SEQ ID NO: 780452 - RNA, 22 nt, Human
guuccucaguuguaaaaaaugu

SEQ ID NO: 780453 - RNA, 22 nt, Human
uuaccaguuuugccauuugcua

SEQ ID NO: 780454 - RNA, 20 nt, Human
acagccagaggaggcagaca

SEQ ID NO: 780455 - RNA, 22 nt, Human
caggcugccgugaagcaggccu

SEQ ID NO: 780456 - RNA, 22 nt, Human
uguguauauauguuuaagucau

SEQ ID NO: 780457 - RNA, 22 nt, Human
cacccacccacugcucauuggc

SEQ ID NO: 780458 - RNA, 22 nt, Human
gcuguucagaugcgauucagga

SEQ ID NO: 780459 - RNA, 22 nt, Human
ugcagaaaccaauucaaguaag

SEQ ID NO: 780460 - RNA, 22 nt, Human
uguuugcauuaauuagaaggua

SEQ ID NO: 780461 - RNA, 22 nt, Human
gauggauacuauaggaggcaca

SEQ ID NO: 780462 - RNA, 22 nt, Human
gauuauggagaagaacaaugaa

SEQ ID NO: 780463 - RNA, 22 nt, Human
aucaggaagaagaauguguugg

SEQ ID NO: 780464 - RNA, 22 nt, Human
gcucugccaaggacccauucuc

SEQ ID NO: 780465 - RNA, 22 nt, Human
aacuuucuuggaugucucaaca

SEQ ID NO: 780466 - RNA, 22 nt, Human
guuuuauaggcuguugcuauau

SEQ ID NO: 780467 - RNA, 23 nt, Human
ugccagggcccugugugcaaugc

SEQ ID NO: 780468 - RNA, 22 nt, Human
agcagaaacagccagucuggac

SEQ ID NO: 780469 - RNA, 22 nt, Human
augaagaugugaaggcuggauu

SEQ ID NO: 780470 - RNA, 22 nt, Human
uuucauugaugggugauagaaa

SEQ ID NO: 780471 - RNA, 22 nt, Human
acaugaucugacuugcuuuuua

SEQ ID NO: 780472 - RNA, 22 nt, Human
cugcguucauuuugagugcugu

SEQ ID NO: 780473 - RNA, 22 nt, Human
gcauugaaauggcaaaaagaga

SEQ ID NO: 780474 - RNA, 22 nt, Human
uacauccaaaguugaggugccu

SEQ ID NO: 780475 - RNA, 17 nt, Human
cugauggauuuuuucca

SEQ ID NO: 780476 - RNA, 21 nt, Human
gccagccuguuuaccuguggu

SEQ ID NO: 780477 - RNA, 22 nt, Human
gugauauuucaagaguggggca

SEQ ID NO: 780478 - RNA, 21 nt, Human
ccucugugcuaaagggcuccc

SEQ ID NO: 780479 - RNA, 22 nt, Human
aacaguauugguugaacucaag

SEQ ID NO: 780480 - RNA, 18 nt, Human
uggagcagguaggcauga

SEQ ID NO: 780481 - RNA, 17 nt, Human
ugcagcugauggggaaa

SEQ ID NO: 780482 - RNA, 22 nt, Human
cuuccaaguugcucugcugacc

SEQ ID NO: 780483 - RNA, 22 nt, Human
agugucacagacccaaucagga

SEQ ID NO: 780484 - RNA, 22 nt, Human
agcuggugugccaguuccaguu

SEQ ID NO: 780485 - RNA, 16 nt, Human
ugcuggggcgccgucc

SEQ ID NO: 780486 - RNA, 22 nt, Human
ggugugggggcaaguuugagau

SEQ ID NO: 780487 - RNA, 22 nt, Human
ggcagagccuucuggagcucgc

SEQ ID NO: 780488 - RNA, 18 nt, Human
gaaagccaugcagcagug

SEQ ID NO: 780489 - RNA, 19 nt, Human
agggauauuuaaaaagcuc

SEQ ID NO: 780490 - RNA, 22 nt, Human
uaaagcaggccacauaugugau

SEQ ID NO: 780491 - RNA, 22 nt, Human
cugcuguguuucacaccucugg

SEQ ID NO: 780492 - RNA, 22 nt, Human
gauacacauuuuagcuuugucu

SEQ ID NO: 780493 - RNA, 22 nt, Human
gacuccagagugacuauuuguc

SEQ ID NO: 780494 - RNA, 20 nt, Human
gccugggauuauccacuggu

SEQ ID NO: 780495 - RNA, 22 nt, Human
ugugccuggcauucugggcuuc

SEQ ID NO: 780496 - RNA, 22 nt, Human
caguguuuagcacagugcuugg

SEQ ID NO: 780497 - RNA, 22 nt, Human
cauucacucagcgaugccagua

SEQ ID NO: 780498 - RNA, 20 nt, Human
ggcuggaaguguggguuugg

SEQ ID NO: 780499 - RNA, 22 nt, Human
aucuugugugaugaugagaaag

SEQ ID NO: 780500 - RNA, 18 nt, Human
aagugggaaaagcaagca

SEQ ID NO: 780501 - RNA, 22 nt, Human
gcaggccagcugugcagauggg

SEQ ID NO: 780502 - RNA, 22 nt, Human
caaauacugaguuuauuuucaa

SEQ ID NO: 780503 - RNA, 22 nt, Human
auaagagucuuguuuucuuauu

SEQ ID NO: 780504 - RNA, 22 nt, Human
ucagcucuacacacaccugugu

SEQ ID NO: 780505 - RNA, 22 nt, Human
auaucaaaauaaacagcaugca

SEQ ID NO: 780506 - RNA, 22 nt, Human
uagagagguuugaauuggcugc

SEQ ID NO: 780507 - RNA, 22 nt, Human
uucugcaugaaaagaacugaac

SEQ ID NO: 780508 - RNA, 22 nt, Human
uggugaagucagcggagcccgg

SEQ ID NO: 780509 - RNA, 22 nt, Human
uuuauuggaugggucagcucua

SEQ ID NO: 780510 - RNA, 22 nt, Human
uuugaaaaaggccuuugguaug

SEQ ID NO: 780511 - RNA, 22 nt, Human
uccaggccugacuauaaaugua

SEQ ID NO: 780512 - RNA, 22 nt, Human
cuaaacaucuugcaaugcacag

SEQ ID NO: 780513 - RNA, 19 nt, Human
ggcuggagaaaggaaucag

SEQ ID NO: 780514 - RNA, 22 nt, Human
uccugguggucugugcuucuuc

SEQ ID NO: 780515 - RNA, 22 nt, Human
caguacuuguccucagguguua

SEQ ID NO: 780516 - RNA, 22 nt, Human
agagugggugaucucuguuguc

SEQ ID NO: 780517 - RNA, 22 nt, Human
augguacagauaauacaugcug

SEQ ID NO: 780518 - RNA, 22 nt, Human
cugcaggggcuggaguuggcuu

SEQ ID NO: 780519 - RNA, 22 nt, Human
ucuggaguggacccagagcacu

SEQ ID NO: 780520 - RNA, 22 nt, Human
cucuccuacauuucauucacaa

SEQ ID NO: 780521 - RNA, 21 nt, Human
ugucaguuauaaucaccacag

SEQ ID NO: 780522 - RNA, 23 nt, Human
ugauuacaggaaguucaaguguu

SEQ ID NO: 780523 - RNA, 22 nt, Human
uccacauuauguuucuccuuuc

SEQ ID NO: 780524 - RNA, 22 nt, Human
gcccuguucuggacaggcacaa

SEQ ID NO: 780525 - RNA, 22 nt, Human
gacacagcacuguacaaggaau

SEQ ID NO: 780526 - RNA, 22 nt, Human
auccacagucuuagccaucaaa

SEQ ID NO: 780527 - RNA, 22 nt, Human
ucccaguguggcaggccaugga

SEQ ID NO: 780528 - RNA, 22 nt, Human
cagaccugagguugaguaccag

SEQ ID NO: 780529 - RNA, 22 nt, Human
acaguuuaucgauucaccuacc

SEQ ID NO: 780530 - RNA, 22 nt, Human
uggguccagugcagcugcgcgu

SEQ ID NO: 780531 - RNA, 22 nt, Human
ucccucucuugggcguggcuca

SEQ ID NO: 780532 - RNA, 22 nt, Human
ugcgauguaugcaguauuuguu

SEQ ID NO: 780533 - RNA, 22 nt, Human
ggcgggagcagcagcucugagc

SEQ ID NO: 780534 - RNA, 22 nt, Human
guccugugcccagacccucugu

SEQ ID NO: 780535 - RNA, 22 nt, Human
uucaaacagaugacucugcucu

SEQ ID NO: 780536 - RNA, 21 nt, Human
aaggacgagguuuugauuaca

SEQ ID NO: 780537 - RNA, 22 nt, Human
aguaucaaggaucuccagcacc

SEQ ID NO: 780538 - RNA, 22 nt, Human
caucagccuggaaggcagccug

SEQ ID NO: 780539 - RNA, 20 nt, Human
ucaucagauagguuaguaca

SEQ ID NO: 780540 - RNA, 22 nt, Human
aaggcuuggaguaagcuuggcu

SEQ ID NO: 780541 - RNA, 22 nt, Human
uggccguguuagauguuuggcu

SEQ ID NO: 780542 - RNA, 22 nt, Human
ggcagcuccucucagcaaaaga

SEQ ID NO: 780543 - RNA, 22 nt, Human
ucagaggcuuccuuccucggag

SEQ ID NO: 780544 - RNA, 22 nt, Human
ugacuuugucccuuucaaaucc

SEQ ID NO: 780545 - RNA, 22 nt, Human
ggcuucuggugggagcaugacu

SEQ ID NO: 780546 - RNA, 23 nt, Human
cacaugaccugaccuaggcuagg

SEQ ID NO: 780547 - RNA, 22 nt, Human
caggcagaguuagugauuuagg

SEQ ID NO: 780548 - RNA, 19 nt, Human
ugcagaagacacaguggug

SEQ ID NO: 780549 - RNA, 22 nt, Human
ucuuugcaaauguuauuaucuu

SEQ ID NO: 780550 - RNA, 21 nt, Human
ucuggagcugcaggcugggca

SEQ ID NO: 780551 - RNA, 22 nt, Human
acucuccuuuugaucuucagaa

SEQ ID NO: 780552 - RNA, 22 nt, Human
acagugucugacacguaggaag

SEQ ID NO: 780553 - RNA, 22 nt, Human
caauuuuuguacuuauaguacu

SEQ ID NO: 780554 - RNA, 23 nt, Human
uaauucacauauacauugcuuca

SEQ ID NO: 780555 - RNA, 22 nt, Human
gaggccacccuaugggucccag

SEQ ID NO: 780556 - RNA, 22 nt, Human
ggagacaggguugaaccacgca

SEQ ID NO: 780557 - RNA, 22 nt, Human
aguucaaagcugcaguaaugga

SEQ ID NO: 780558 - RNA, 22 nt, Human
guauagaaggaucuggugaauu

SEQ ID NO: 780559 - RNA, 22 nt, Human
ugaaugaccuuugaggauggaa

SEQ ID NO: 780560 - RNA, 22 nt, Human
augcagcugugggcaagaaaug

SEQ ID NO: 780561 - RNA, 22 nt, Human
cccagugugguugugaauucug

SEQ ID NO: 780562 - RNA, 22 nt, Human
uccugaacauuaugcaagcuuc

SEQ ID NO: 780563 - RNA, 22 nt, Human
cuggcuuuggaacaaaucauag

SEQ ID NO: 780564 - RNA, 22 nt, Human
aucacugucgucaucugagauu

SEQ ID NO: 780565 - RNA, 22 nt, Human
ggcaggacucuucugugggccg

SEQ ID NO: 780566 - RNA, 22 nt, Human
agccaucacuugagaaucuauu

SEQ ID NO: 780567 - RNA, 22 nt, Human
uuaagucauuucugauuauaga

SEQ ID NO: 780568 - RNA, 21 nt, Human
caguauuuuaagcagugaguu

SEQ ID NO: 780569 - RNA, 22 nt, Human
aguauaauuagauaucaaaagu

SEQ ID NO: 780570 - RNA, 22 nt, Human
ugauggaaauguucuguaucug

SEQ ID NO: 780571 - RNA, 20 nt, Human
ggcagggagggauacugagg

SEQ ID NO: 780572 - RNA, 22 nt, Human
agacccuugcagucugguuguc

SEQ ID NO: 780573 - RNA, 22 nt, Human
uuacaacugggcuugucagcuu

SEQ ID NO: 780574 - RNA, 22 nt, Human
uccuucagaggauaaggaagaa

SEQ ID NO: 780575 - RNA, 22 nt, Human
uuuauucaagaugagguucaug

SEQ ID NO: 780576 - RNA, 22 nt, Human
uuccugguaacaaucucaaagu

SEQ ID NO: 780577 - RNA, 22 nt, Human
ccuggcacugaccaggcacuga

SEQ ID NO: 780578 - RNA, 22 nt, Human
uggcugagggcacuaugaagcc

SEQ ID NO: 780579 - RNA, 20 nt, Human
aggcuccuguaccugaggaa

SEQ ID NO: 780580 - RNA, 22 nt, Human
cugcagugcaagcccagaugga

SEQ ID NO: 780581 - RNA, 22 nt, Human
ggacagggaucauuaucugagc

SEQ ID NO: 780582 - RNA, 22 nt, Human
aagugcugggauuacagguguc

SEQ ID NO: 780583 - RNA, 22 nt, Human
gcugggcagcaggcucuccggg

SEQ ID NO: 780584 - RNA, 22 nt, Human
agaaauguggaggaacagggcu

SEQ ID NO: 780585 - RNA, 22 nt, Human
acuuucaagcccucuagagaca

SEQ ID NO: 780586 - RNA, 22 nt, Human
aucccugagguuccuccugagc

SEQ ID NO: 780587 - RNA, 22 nt, Human
uggcgucucucauaaguaugug

SEQ ID NO: 780588 - RNA, 22 nt, Human
aauucacaugcaugucugugca

SEQ ID NO: 780589 - RNA, 22 nt, Human
aggggcagccucacaauccucu

SEQ ID NO: 780590 - RNA, 22 nt, Human
augcccugcaucaagugacacu

SEQ ID NO: 780591 - RNA, 22 nt, Human
uugaggucugagacugugcagg

SEQ ID NO: 780592 - RNA, 22 nt, Human
aggcccaaaagaaaccacuggg

SEQ ID NO: 780593 - RNA, 22 nt, Human
ucccacagcuucgugcuucccc

SEQ ID NO: 780594 - RNA, 22 nt, Human
augcagguugggcaaguguggg

SEQ ID NO: 780595 - RNA, 22 nt, Human
caaaccuuguaaaugccaaacu

SEQ ID NO: 780596 - RNA, 22 nt, Human
uguguuuuacaaauucucuuaa

SEQ ID NO: 780597 - RNA, 22 nt, Human
uggcagggugggcuucagcccc

SEQ ID NO: 780598 - RNA, 22 nt, Human
agcacagagcuaggaguggagg

SEQ ID NO: 780599 - RNA, 22 nt, Human
cuucugggauuaauuuuuccug

SEQ ID NO: 780600 - RNA, 22 nt, Human
ugccuggaucugaggacccauu

SEQ ID NO: 780601 - RNA, 22 nt, Human
uuuguauaagaacauucuagca

SEQ ID NO: 780602 - RNA, 22 nt, Human
aagcugccugggaggaagggcu

SEQ ID NO: 780603 - RNA, 22 nt, Human
gcaaaaaaugcuuguugcuuag

SEQ ID NO: 780604 - RNA, 19 nt, Human
cguccaggugcuggaagau

SEQ ID NO: 780605 - RNA, 22 nt, Human
guggugaagccccaucucugcu

SEQ ID NO: 780606 - RNA, 22 nt, Human
ggccugaggcgucccagcugug

SEQ ID NO: 780607 - RNA, 22 nt, Human
gggacgggcaguccaagggguc

SEQ ID NO: 780608 - RNA, 22 nt, Human
ugcaggacucaaggguagcagg

SEQ ID NO: 780609 - RNA, 22 nt, Human
ucaaaauuaaaccaacguccag

SEQ ID NO: 780610 - RNA, 22 nt, Human
uccucugggccuauuuguucac

SEQ ID NO: 780611 - RNA, 23 nt, Human
cccagguguggaggcgguggcag

SEQ ID NO: 780612 - RNA, 22 nt, Human
aacaggggugggugcuacugga

SEQ ID NO: 780613 - RNA, 22 nt, Human
uguuuucaugguuaugugucua

SEQ ID NO: 780614 - RNA, 22 nt, Human
uuccauaauuaaguggagagaa

SEQ ID NO: 780615 - RNA, 22 nt, Human
gcaucccucugaggggccaggc

SEQ ID NO: 780616 - RNA, 23 nt, Human
cauaugaauuuuagaggcaguuu

SEQ ID NO: 780617 - RNA, 21 nt, Human
agaugcaguuaugagaugcag

SEQ ID NO: 780618 - RNA, 22 nt, Human
agguuaggaagauacagaaugu

SEQ ID NO: 780619 - RNA, 22 nt, Human
uauacaagugagaagaagaguu

SEQ ID NO: 780620 - RNA, 22 nt, Human
uacagugaccuagaauaaauac

SEQ ID NO: 780621 - RNA, 22 nt, Human
ucagaaggaaacgaugccagcu

SEQ ID NO: 780622 - RNA, 19 nt, Human
agacacaucacauuucucc

SEQ ID NO: 780623 - RNA, 21 nt, Human
gcuggcugucccagggaagca

SEQ ID NO: 780624 - RNA, 22 nt, Human
cugggcuuguguuagcugacaa

SEQ ID NO: 780625 - RNA, 19 nt, Human
ucagcccaggcugggaagc

SEQ ID NO: 780626 - RNA, 22 nt, Human
gguggcuggaggagcugaugga

SEQ ID NO: 780627 - RNA, 21 nt, Human
ggguggucugcugaagaggga

SEQ ID NO: 780628 - RNA, 22 nt, Human
gcugaccauuaggaggacgaua

SEQ ID NO: 780629 - RNA, 22 nt, Human
cuuugcuucuccaaccugcuca

SEQ ID NO: 780630 - RNA, 20 nt, Human
gcagagcuguucugugggga

SEQ ID NO: 780631 - RNA, 22 nt, Human
ggacagcacagcucuugacaac

SEQ ID NO: 780632 - RNA, 22 nt, Human
gguggggcccaggcaucugaug

SEQ ID NO: 780633 - RNA, 22 nt, Human
ucagggcccagagcucaggcaa

SEQ ID NO: 780634 - RNA, 22 nt, Human
aaauagagcuggguuaaacuuu

SEQ ID NO: 780635 - RNA, 19 nt, Human
cagguggcgcucuacaggg

SEQ ID NO: 780636 - RNA, 22 nt, Human
ccaggcucacagcaucccagga

SEQ ID NO: 780637 - RNA, 22 nt, Human
cauugcacuccaucuugggcaa

SEQ ID NO: 780638 - RNA, 22 nt, Human
gacagccucaugaggagcaaaa

SEQ ID NO: 780639 - RNA, 22 nt, Human
gugcacagaaauugguaagacu

SEQ ID NO: 780640 - RNA, 19 nt, Human
uggcagggagaguuugaag

SEQ ID NO: 780641 - RNA, 22 nt, Human
gaugcacaugugaguauagaag

SEQ ID NO: 780642 - RNA, 23 nt, Human
cuggggcuuucaaaucugggcag

SEQ ID NO: 780643 - RNA, 23 nt, Human
acagucguagguauccuuuuccu

SEQ ID NO: 780644 - RNA, 22 nt, Human
gccauuuucugucuuguuuauu

SEQ ID NO: 780645 - RNA, 22 nt, Human
uugcuaaucauauuucaucacu

SEQ ID NO: 780646 - RNA, 22 nt, Human
uugcacuaggaaaaggcagcca

SEQ ID NO: 780647 - RNA, 22 nt, Human
ucugcgccgcauguguucuuuc

SEQ ID NO: 780648 - RNA, 22 nt, Human
aggcuccagggcugugugggag

SEQ ID NO: 780649 - RNA, 22 nt, Human
uggcagccuggaaucucucagc

SEQ ID NO: 780650 - RNA, 20 nt, Human
agaagucagcucagaaguga

SEQ ID NO: 780651 - RNA, 22 nt, Human
cagacccaggauccaaauguug

SEQ ID NO: 780652 - RNA, 22 nt, Human
cugaaaggguuacauaguaagu

SEQ ID NO: 780653 - RNA, 22 nt, Human
acuuuaugcuaaacuuuacucu

SEQ ID NO: 780654 - RNA, 22 nt, Human
uucuauuuccaguccuucagag

SEQ ID NO: 780655 - RNA, 22 nt, Human
cuguggcugcguaggucuggca

SEQ ID NO: 780656 - RNA, 22 nt, Human
ucgcauuugggcaggagaugcu

SEQ ID NO: 780657 - RNA, 22 nt, Human
aauucugcucuuaacauaaugu

SEQ ID NO: 780658 - RNA, 22 nt, Human
cagcaggucccacugagggccc

SEQ ID NO: 780659 - RNA, 22 nt, Human
cagggugcagugucgcugcuag

SEQ ID NO: 780660 - RNA, 16 nt, Human
ggugggaggugaggug

SEQ ID NO: 780661 - RNA, 22 nt, Human
augcauguaacaguguuaugaa

SEQ ID NO: 780662 - RNA, 22 nt, Human
cuuauacauaaaauggguguag

SEQ ID NO: 780663 - RNA, 22 nt, Human
aacugcauguguguggcaugau

SEQ ID NO: 780664 - RNA, 22 nt, Human
ucagugcauucuaccaaaaggc

SEQ ID NO: 780665 - RNA, 22 nt, Human
ggugaguuucaugguuguuuac

SEQ ID NO: 780666 - RNA, 22 nt, Human
gauucaaaguuaaugaagaugc

SEQ ID NO: 780667 - RNA, 22 nt, Human
uuucagaaagcugaacauauga

SEQ ID NO: 780668 - RNA, 22 nt, Human
uucauugauuuaacaaacaagu

SEQ ID NO: 780669 - RNA, 22 nt, Human
gcauugguuuacacagggugaa

SEQ ID NO: 780670 - RNA, 22 nt, Human
auuccaaacuuaccccagagga

SEQ ID NO: 780671 - RNA, 22 nt, Human
gaagcacugcauuucaagauca

SEQ ID NO: 780672 - RNA, 22 nt, Human
caugggggucuggacaacaggc

SEQ ID NO: 780673 - RNA, 22 nt, Human
cacauauuugaugaagcuuugu

SEQ ID NO: 780674 - RNA, 22 nt, Human
uggcucaggccacuucuuuuau

SEQ ID NO: 780675 - RNA, 22 nt, Human
caucauuucacuuagaugaagu

SEQ ID NO: 780676 - RNA, 22 nt, Human
aagagauuccucacucagaaug

SEQ ID NO: 780677 - RNA, 19 nt, Human
gccaggcucuuauucugug

SEQ ID NO: 780678 - RNA, 22 nt, Human
aaacucuuuugcauauuagagg

SEQ ID NO: 780679 - RNA, 22 nt, Human
ucuauaaauuaugcagucucag

SEQ ID NO: 780680 - RNA, 22 nt, Human
uacguuuagcuuuaugagacau

SEQ ID NO: 780681 - RNA, 19 nt, Human
cugucugcggggccuguuc

SEQ ID NO: 780682 - RNA, 22 nt, Human
uacaaacuccgaaguuuguacc

SEQ ID NO: 780683 - RNA, 22 nt, Human
uggcuaaacuugggucagaugu

SEQ ID NO: 780684 - RNA, 22 nt, Human
cuucuucucaaggggcaggugg

SEQ ID NO: 780685 - RNA, 22 nt, Human
acauuucuauagugcaucuguu

SEQ ID NO: 780686 - RNA, 22 nt, Human
auucaugaaucuacauuguggu

SEQ ID NO: 780687 - RNA, 22 nt, Human
auucagugugagguuuucaagu

SEQ ID NO: 780688 - RNA, 21 nt, Human
guugaauauccauguaugugu

SEQ ID NO: 780689 - RNA, 22 nt, Human
gucauuuuugacuuugaaguga

SEQ ID NO: 780690 - RNA, 22 nt, Human
uacacuaauagccacacuaaug

SEQ ID NO: 780691 - RNA, 22 nt, Human
ugggagcucagaaagggagguc

SEQ ID NO: 780692 - RNA, 22 nt, Human
aauguuguuggcucuucaugau

SEQ ID NO: 780693 - RNA, 22 nt, Human
caguuauaggagccauuguaua

SEQ ID NO: 780694 - RNA, 22 nt, Human
uguccuggugcuucuugggauu

SEQ ID NO: 780695 - RNA, 22 nt, Human
uccagcagaccaucaaggcuca

SEQ ID NO: 780696 - RNA, 22 nt, Human
gaugugugcuuuucgcaguguc

SEQ ID NO: 780697 - RNA, 22 nt, Human
uacaguauuacuguguuguuuu

SEQ ID NO: 780698 - RNA, 22 nt, Human
guuuccuaccagugguuccaga

SEQ ID NO: 780699 - RNA, 22 nt, Human
acuuugcaaugggcagaaccca

SEQ ID NO: 780700 - RNA, 22 nt, Human
cuggccccaucuggagucugag

SEQ ID NO: 780701 - RNA, 22 nt, Human
cucaugauguagcgaaugagaa

SEQ ID NO: 780702 - RNA, 22 nt, Human
gcacacaggcaguuuccagcca

SEQ ID NO: 780703 - RNA, 22 nt, Human
cugcuguguugccagugucacc

SEQ ID NO: 780704 - RNA, 22 nt, Human
uguccuggggacaagaggcccu

SEQ ID NO: 780705 - RNA, 22 nt, Human
auuccaauuguacuugcuuuua

SEQ ID NO: 780706 - RNA, 20 nt, Human
cuuucucuaauuuauaagua

SEQ ID NO: 780707 - RNA, 22 nt, Human
ugguguugaaccucagcagggg

SEQ ID NO: 780708 - RNA, 22 nt, Human
aagaauggugguggggccagca

SEQ ID NO: 780709 - RNA, 22 nt, Human
ucaggcucccugcugggcucug

SEQ ID NO: 780710 - RNA, 22 nt, Human
gaaaggucuuccggucuuccag

SEQ ID NO: 780711 - RNA, 23 nt, Human
aaagugcaguugaggaaucauag

SEQ ID NO: 780712 - RNA, 23 nt, Human
ugacagaccuucccagacaguca

SEQ ID NO: 780713 - RNA, 19 nt, Human
ugccagcucacaggagcuc

SEQ ID NO: 780714 - RNA, 22 nt, Human
gcagcuuggauuucuguaguuu

SEQ ID NO: 780715 - RNA, 22 nt, Human
gugugagcagaaaccaugagua

SEQ ID NO: 780716 - RNA, 22 nt, Human
ugggccacacacagaagaauca

SEQ ID NO: 780717 - RNA, 22 nt, Human
ggggaaggauaugauuagacua

SEQ ID NO: 780718 - RNA, 22 nt, Human
acccuuuagaaggcaucucagu

SEQ ID NO: 780719 - RNA, 20 nt, Human
uauugccuaaauaccagaau

SEQ ID NO: 780720 - RNA, 22 nt, Human
gccacccugacgccgcagaccc

SEQ ID NO: 780721 - RNA, 22 nt, Human
gaggccagggaugcaaugagag

SEQ ID NO: 780722 - RNA, 22 nt, Human
cuggcccuggcuggagcccagg

SEQ ID NO: 780723 - RNA, 22 nt, Human
cagagugagggccugcaccugc

SEQ ID NO: 780724 - RNA, 18 nt, Human
gaugggagcaagagaaga

SEQ ID NO: 780725 - RNA, 19 nt, Human
gggcuggagggauagagcc

SEQ ID NO: 780726 - RNA, 17 nt, Human
aacaauaggauguguau

SEQ ID NO: 780727 - RNA, 18 nt, Human
gugugcaguugcaggggu

SEQ ID NO: 780728 - RNA, 22 nt, Human
uaugcuacuagaaauaaaaugg

SEQ ID NO: 780729 - RNA, 22 nt, Human
uuuguccuugaaucaauucaca

SEQ ID NO: 780730 - RNA, 22 nt, Human
aaggcuggagaugguuggaaug

SEQ ID NO: 780731 - RNA, 22 nt, Human
uucuucuuaauguccugggaac

SEQ ID NO: 780732 - RNA, 22 nt, Human
aacucucuugggaguaccugga

SEQ ID NO: 780733 - RNA, 21 nt, Human
uacauugaagaaugggaauga

SEQ ID NO: 780734 - RNA, 22 nt, Human
aggcuccagcagccagaggaag

SEQ ID NO: 780735 - RNA, 22 nt, Human
ggcaggcaccagcucagcaaua

SEQ ID NO: 780736 - RNA, 23 nt, Human
uggcagagacccagaaucuacau

SEQ ID NO: 780737 - RNA, 22 nt, Human
uggcuggcauagccauugcucc

SEQ ID NO: 780738 - RNA, 21 nt, Human
uauuuauuaauuuguaaggcu

SEQ ID NO: 780739 - RNA, 22 nt, Human
uuauacccuccauaccuggccu

SEQ ID NO: 780740 - RNA, 22 nt, Human
uggccugggugcugcugacauc

SEQ ID NO: 780741 - RNA, 19 nt, Human
acagucagggaauaaagac

SEQ ID NO: 780742 - RNA, 22 nt, Human
aggcuggugauuagaagcagcc

SEQ ID NO: 780743 - RNA, 22 nt, Human
cagagcacccaaggagcauuug

SEQ ID NO: 780744 - RNA, 22 nt, Human
uuuauccaucaucugcugaagg

SEQ ID NO: 780745 - RNA, 22 nt, Human
ccugucagcugauggcuaugua

SEQ ID NO: 780746 - RNA, 22 nt, Human
ucaaguguaguggugucagguc

SEQ ID NO: 780747 - RNA, 22 nt, Human
ccagcaucuaacgcuccuggga

SEQ ID NO: 780748 - RNA, 22 nt, Human
cucaggaucgcuugcccuaggg

SEQ ID NO: 780749 - RNA, 22 nt, Human
agaacugugaaguaugugaaau

SEQ ID NO: 780750 - RNA, 22 nt, Human
ugcagcuucuccaucuccuugu

SEQ ID NO: 780751 - RNA, 22 nt, Human
ccuggagagagaggccaacugc

SEQ ID NO: 780752 - RNA, 17 nt, Human
agagagagcaugccacc

SEQ ID NO: 780753 - RNA, 22 nt, Human
acuguccugaauacugcaugac

SEQ ID NO: 780754 - RNA, 22 nt, Human
uuuuuuguuggguagaacggaa

SEQ ID NO: 780755 - RNA, 22 nt, Human
auaugacagcggauucacauau

SEQ ID NO: 780756 - RNA, 22 nt, Human
agucugcaggcugugauuuuuu

SEQ ID NO: 780757 - RNA, 19 nt, Human
ucacagcaucugucugaac

SEQ ID NO: 780758 - RNA, 22 nt, Human
caugauaacuucauuacacaau

SEQ ID NO: 780759 - RNA, 22 nt, Human
aagggaaauccucagcccagga

SEQ ID NO: 780760 - RNA, 22 nt, Human
aaugcuguaaagaugcuaucug

SEQ ID NO: 780761 - RNA, 22 nt, Human
gcacaggaaaugacucauguua

SEQ ID NO: 780762 - RNA, 22 nt, Human
acaggcugaaaguuaaguucug

SEQ ID NO: 780763 - RNA, 22 nt, Human
gggcuauagcacuauguauggg

SEQ ID NO: 780764 - RNA, 22 nt, Human
caauguuuguuagagcucuaga

SEQ ID NO: 780765 - RNA, 17 nt, Human
ugaaaucagcacccagg

SEQ ID NO: 780766 - RNA, 22 nt, Human
gugaagucaagaaugcaauuug

SEQ ID NO: 780767 - RNA, 18 nt, Human
ucucucagggaaacagaa

SEQ ID NO: 780768 - RNA, 22 nt, Human
uuuagcaucgaaguaaauuuag

SEQ ID NO: 780769 - RNA, 22 nt, Human
uguccuggacaacagccccuag

SEQ ID NO: 780770 - RNA, 22 nt, Human
uccagggagagccgcugcucca

SEQ ID NO: 780771 - RNA, 22 nt, Human
caguggcuuaaauaagauuagg

SEQ ID NO: 780772 - RNA, 20 nt, Human
ccaggcacugucccaugcag

SEQ ID NO: 780773 - RNA, 22 nt, Human
ugcacagagcuggacuccgcgg

SEQ ID NO: 780774 - RNA, 22 nt, Human
ccagccuggggaggcagcuucu

SEQ ID NO: 780775 - RNA, 22 nt, Human
ggcucugcgcgguaaagugacu

SEQ ID NO: 780776 - RNA, 22 nt, Human
aacuuaggaaaauaaggcauga

SEQ ID NO: 780777 - RNA, 18 nt, Human
gagaggcccggcugugcc

SEQ ID NO: 780778 - RNA, 22 nt, Human
aguauauuuaccauuggguggg

SEQ ID NO: 780779 - RNA, 22 nt, Human
gcucaguguucaucuguaugca

SEQ ID NO: 780780 - RNA, 22 nt, Human
uaguuuuauaauguuaacaucu

SEQ ID NO: 780781 - RNA, 22 nt, Human
cuggagaagccaaacuagucac

SEQ ID NO: 780782 - RNA, 22 nt, Human
augucuuuauuaauaucaugcc

SEQ ID NO: 780783 - RNA, 22 nt, Human
uggauuucuccagcucuccauu

SEQ ID NO: 780784 - RNA, 22 nt, Human
gccacuguacuccagccugcga

SEQ ID NO: 780785 - RNA, 19 nt, Human
ugaggauugagguccagua

SEQ ID NO: 780786 - RNA, 22 nt, Human
agcagggccaacaguaaacacc

SEQ ID NO: 780787 - RNA, 22 nt, Human
aagggugcugcuaucaggaagc

SEQ ID NO: 780788 - RNA, 22 nt, Human
agucaagauucuggcacuagca

SEQ ID NO: 780789 - RNA, 22 nt, Human
cguauacaugaagacauugcug

SEQ ID NO: 780790 - RNA, 22 nt, Human
caaaugauaccuauuacuaggc

SEQ ID NO: 780791 - RNA, 22 nt, Human
auacaguaauugcauaggcuuc

SEQ ID NO: 780792 - RNA, 22 nt, Human
uuccuguauucuaaagggaaag

SEQ ID NO: 780793 - RNA, 22 nt, Human
gagggcaggggucuugcacggu

SEQ ID NO: 780794 - RNA, 22 nt, Human
gcaggcuccaacuggaggaguu

SEQ ID NO: 780795 - RNA, 22 nt, Human
ggaagccaugagggacaguucu

SEQ ID NO: 780796 - RNA, 22 nt, Human
uuguaagagagaauugcaaauu

SEQ ID NO: 780797 - RNA, 22 nt, Human
uaucuguuaugggcugaauugc

SEQ ID NO: 780798 - RNA, 22 nt, Human
auugcuucauguccuuugccgg

SEQ ID NO: 780799 - RNA, 22 nt, Human
gcagcagaugcuuucauggaca

SEQ ID NO: 780800 - RNA, 21 nt, Human
aggcagccagucaugcucccu

SEQ ID NO: 780801 - RNA, 22 nt, Human
cugcuguguuagcagguuuagu

SEQ ID NO: 780802 - RNA, 22 nt, Human
acacagagauguaaaguuaggc

SEQ ID NO: 780803 - RNA, 22 nt, Human
cagggugcgccacucagaugua

SEQ ID NO: 780804 - RNA, 23 nt, Human
cuguggcugaguccuguuggagu

SEQ ID NO: 780805 - RNA, 22 nt, Human
augacauugaauauguuaacua

SEQ ID NO: 780806 - RNA, 22 nt, Human
ccucucucuccugcacacacac

SEQ ID NO: 780807 - RNA, 22 nt, Human
ugggaccugcccuggccccauc

SEQ ID NO: 780808 - RNA, 22 nt, Human
gggugagacagaaagagcaaaa

SEQ ID NO: 780809 - RNA, 22 nt, Human
cugagaggugcugguggcugca

SEQ ID NO: 780810 - RNA, 22 nt, Human
uggcaggagagcgucagaucag

SEQ ID NO: 780811 - RNA, 19 nt, Human
ucugagcugauaugacauu

SEQ ID NO: 780812 - RNA, 22 nt, Human
uggcagcagacaaaaggccauu

SEQ ID NO: 780813 - RNA, 22 nt, Human
ugggacacccucacgccugcac

SEQ ID NO: 780814 - RNA, 22 nt, Human
ugagcucauagcucuuauuaug

SEQ ID NO: 780815 - RNA, 22 nt, Human
agguuauaugucauacugaagu

SEQ ID NO: 780816 - RNA, 21 nt, Human
cccaggcugaauuaaaaauau

SEQ ID NO: 780817 - RNA, 22 nt, Human
gcaggaugguggaaggccugcu

SEQ ID NO: 780818 - RNA, 22 nt, Human
agcauacaggucugaaacagcu

SEQ ID NO: 780819 - RNA, 21 nt, Human
uguuuaaguacuccuuucugg

SEQ ID NO: 780820 - RNA, 21 nt, Human
ugcuugggggcuucaggagcu

SEQ ID NO: 780821 - RNA, 22 nt, Human
agggcagagacaugcuuccuga

SEQ ID NO: 780822 - RNA, 22 nt, Human
agugguaagggcauaggcacug

SEQ ID NO: 780823 - RNA, 22 nt, Human
acccuguauacgcuacauuuuu

SEQ ID NO: 780824 - RNA, 22 nt, Human
cagaccccgaguuugcagaguu

SEQ ID NO: 780825 - RNA, 22 nt, Human
uuggacugaaucuuucucacac

SEQ ID NO: 780826 - RNA, 22 nt, Human
uuuuacauugggaaaugccucu

SEQ ID NO: 780827 - RNA, 22 nt, Human
uuaguuagaauaauacaaguaa

SEQ ID NO: 780828 - RNA, 22 nt, Human
uacagucagagugccuuucuaa

SEQ ID NO: 780829 - RNA, 22 nt, Human
agaguuugaauuuugaaaagau

SEQ ID NO: 780830 - RNA, 22 nt, Human
cagggcuuuccugagaagugau

SEQ ID NO: 780831 - RNA, 22 nt, Human
gccuuggacucggguggacuca

SEQ ID NO: 780832 - RNA, 17 nt, Human
cugaaauauuaugauaa

SEQ ID NO: 780833 - RNA, 22 nt, Human
agggcagagaaauguaguugag

SEQ ID NO: 780834 - RNA, 22 nt, Human
ccagaugucugagccacacucc

SEQ ID NO: 780835 - RNA, 17 nt, Human
ucuggccuuccugaacu

SEQ ID NO: 780836 - RNA, 22 nt, Human
agcaauagacacaagauggaua

SEQ ID NO: 780837 - RNA, 22 nt, Human
ucaauuaugccauugcaauauu

SEQ ID NO: 780838 - RNA, 22 nt, Human
gcuucucccuacagaugucagu

SEQ ID NO: 780839 - RNA, 22 nt, Human
accacaggggaggaaugaugcc

SEQ ID NO: 780840 - RNA, 22 nt, Human
uccuggcccucugcaaacgcca

SEQ ID NO: 780841 - RNA, 22 nt, Human
ggaagcugccaguccaccagcu

SEQ ID NO: 780842 - RNA, 22 nt, Human
aggauccuuuggccacuucuua

SEQ ID NO: 780843 - RNA, 22 nt, Human
cuguuucucccauguccaagug

SEQ ID NO: 780844 - RNA, 22 nt, Human
aaaugguagguuuucuuaagaa

SEQ ID NO: 780845 - RNA, 22 nt, Human
caguggcuucucaugucauuca

SEQ ID NO: 780846 - RNA, 22 nt, Human
uauugucuaggaauuguuuaaa

SEQ ID NO: 780847 - RNA, 22 nt, Human
uggaaggcaacggagugagcug

SEQ ID NO: 780848 - RNA, 22 nt, Human
gaauuuacaaguugaauaacaa

SEQ ID NO: 780849 - RNA, 23 nt, Human
acauacauaagcaccacauuuug

SEQ ID NO: 780850 - RNA, 22 nt, Human
uaauugcuguauagauugucau

SEQ ID NO: 780851 - RNA, 22 nt, Human
agggcugacaguaaaaguauga

SEQ ID NO: 780852 - RNA, 22 nt, Human
uaauuuauuucaacugccaagg

SEQ ID NO: 780853 - RNA, 22 nt, Human
ggccccucagcaucugagucag

SEQ ID NO: 780854 - RNA, 22 nt, Human
ggacagcugcuuucaggccaca

SEQ ID NO: 780855 - RNA, 22 nt, Human
ccagaggggcugagcaggucac

SEQ ID NO: 780856 - RNA, 22 nt, Human
gugcaggaguaggagagggcuu

SEQ ID NO: 780857 - RNA, 22 nt, Human
acauucucuccaugucuucuuu

SEQ ID NO: 780858 - RNA, 21 nt, Human
auauuuuuguuuggacuguca

SEQ ID NO: 780859 - RNA, 22 nt, Human
aguuuucacacucaccaaaagg

SEQ ID NO: 780860 - RNA, 17 nt, Human
caucugcucugccccuu

SEQ ID NO: 780861 - RNA, 22 nt, Human
cucugagaaagcugugagcuaa

SEQ ID NO: 780862 - RNA, 22 nt, Human
aaugcugcucucauaauuauag

SEQ ID NO: 780863 - RNA, 22 nt, Human
uggggcaguggcuuuucacccu

SEQ ID NO: 780864 - RNA, 22 nt, Human
ggccccaggccuuuggucuggc

SEQ ID NO: 780865 - RNA, 22 nt, Human
auucuucauuguugauucaugu

SEQ ID NO: 780866 - RNA, 22 nt, Human
ucacauucuagaauguuaucgu

SEQ ID NO: 780867 - RNA, 22 nt, Human
uuaaauuaggacucuaguucug

SEQ ID NO: 780868 - RNA, 22 nt, Human
acauuucuaauuuaauguaaca

SEQ ID NO: 780869 - RNA, 22 nt, Human
aagcagaucugauagggcccug

SEQ ID NO: 780870 - RNA, 20 nt, Human
uggcugcccgaggcacacac

SEQ ID NO: 780871 - RNA, 22 nt, Human
cagucacuccagccugccucag

SEQ ID NO: 780872 - RNA, 22 nt, Human
cuccagauuccugcuggcagaa

SEQ ID NO: 780873 - RNA, 22 nt, Human
auggaauuuggagauuaggcau

SEQ ID NO: 780874 - RNA, 22 nt, Human
ugaagcuggaagcaugcagacu

SEQ ID NO: 780875 - RNA, 22 nt, Human
ccuucuugagguagcacauucu

SEQ ID NO: 780876 - RNA, 22 nt, Human
agcaccagcucaaggugcaccu

SEQ ID NO: 780877 - RNA, 22 nt, Human
gcccugagggucuggguuccca

SEQ ID NO: 780878 - RNA, 22 nt, Human
acugcacugauuuaucauccca

SEQ ID NO: 780879 - RNA, 22 nt, Human
cuguggcuucugcuugggccuc

SEQ ID NO: 780880 - RNA, 22 nt, Human
ucaaguccugcuguggaccaca

SEQ ID NO: 780881 - RNA, 22 nt, Human
auuguauaacagcauguauuuu

SEQ ID NO: 780882 - RNA, 22 nt, Human
uagcauuucccaaaugcauuug

SEQ ID NO: 780883 - RNA, 22 nt, Human
uggcccaggaggccagagggca

SEQ ID NO: 780884 - RNA, 22 nt, Human
caggucuguauuaacagagggu

SEQ ID NO: 780885 - RNA, 22 nt, Human
aguauauaguggcgcuguaugc

SEQ ID NO: 780886 - RNA, 22 nt, Human
cuuuacagauaggaacuacuca

SEQ ID NO: 780887 - RNA, 22 nt, Human
gauguacacucagaaaagucau

SEQ ID NO: 780888 - RNA, 22 nt, Human
uccuggugucgccuggucaguu

SEQ ID NO: 780889 - RNA, 22 nt, Human
gagggagcuggagcagacgccg

SEQ ID NO: 780890 - RNA, 22 nt, Human
acagauauaugauuguguaaau

SEQ ID NO: 780891 - RNA, 22 nt, Human
gccccuggcuggccagcuccuc

SEQ ID NO: 780892 - RNA, 22 nt, Human
uuaacaaaguaacgggaaaaga

SEQ ID NO: 780893 - RNA, 22 nt, Human
ccuguguccuuggcagauaucc

SEQ ID NO: 780894 - RNA, 22 nt, Human
aaauugcuaaauuguaagaggg

SEQ ID NO: 780895 - RNA, 22 nt, Human
guacagcuaagaauuucaucuu

SEQ ID NO: 780896 - RNA, 22 nt, Human
guauuuccucgcuugugggauu

SEQ ID NO: 780897 - RNA, 22 nt, Human
aggucuggcucuucuccacaga

SEQ ID NO: 780898 - RNA, 22 nt, Human
gcucaggcucucccaggggaau

SEQ ID NO: 780899 - RNA, 22 nt, Human
ucucugggcuaaaaucaaggug

SEQ ID NO: 780900 - RNA, 22 nt, Human
ggguggcaggauuggcaggagu

SEQ ID NO: 780901 - RNA, 22 nt, Human
uguucccauuuucugcauaauc

SEQ ID NO: 780902 - RNA, 23 nt, Human
cauguuuuucuaucucagcgugu

SEQ ID NO: 780903 - RNA, 22 nt, Human
ggguggggccaggcaauuugca

SEQ ID NO: 780904 - RNA, 22 nt, Human
gcagggaccucacuacccccag

SEQ ID NO: 780905 - RNA, 21 nt, Human
cagagguggccugaccucuga

SEQ ID NO: 780906 - RNA, 22 nt, Human
accuuuccuggcugaccgagga

SEQ ID NO: 780907 - RNA, 22 nt, Human
auguggcuagggaauaaaauau

SEQ ID NO: 780908 - RNA, 22 nt, Human
gggggacaggaugaauaucugu

SEQ ID NO: 780909 - RNA, 22 nt, Human
augugaaacugaagcauccaua

SEQ ID NO: 780910 - RNA, 22 nt, Human
cacagugagcugggcaucaguu

SEQ ID NO: 780911 - RNA, 22 nt, Human
uucauugaaauguuucuagcug

SEQ ID NO: 780912 - RNA, 22 nt, Human
auucugcuuuugcugaccuacc

SEQ ID NO: 780913 - RNA, 22 nt, Human
ugacacaugcaccagucuuuaa

SEQ ID NO: 780914 - RNA, 22 nt, Human
uagggcagcugcaucaggcacu

SEQ ID NO: 780915 - RNA, 18 nt, Human
gggauauaucagugaaga

SEQ ID NO: 780916 - RNA, 19 nt, Human
cuugcugggugguuucugc

SEQ ID NO: 780917 - RNA, 22 nt, Human
uccucaguauuguggagcagau

SEQ ID NO: 780918 - RNA, 22 nt, Human
uaauugcucuuggccgugccag

SEQ ID NO: 780919 - RNA, 22 nt, Human
ggcacagagcaggccacuaauc

SEQ ID NO: 780920 - RNA, 22 nt, Human
gagucagaccgacugggcucau

SEQ ID NO: 780921 - RNA, 22 nt, Human
ggcucuggaauguguagucagg

SEQ ID NO: 780922 - RNA, 22 nt, Human
aaaguuagaaugauaucaacga

SEQ ID NO: 780923 - RNA, 22 nt, Human
uguggcugcucaggugcagacc

SEQ ID NO: 780924 - RNA, 22 nt, Human
cuaaauuauuugcacauuagag

SEQ ID NO: 780925 - RNA, 22 nt, Human
accugaaaauuauuauuuccgc

SEQ ID NO: 780926 - RNA, 22 nt, Human
cagucccaaggaggaagcaguc

SEQ ID NO: 780927 - RNA, 22 nt, Human
gaaagcacaguucugaccaugu

SEQ ID NO: 780928 - RNA, 22 nt, Human
agcugcuuugccaaugcguucc

SEQ ID NO: 780929 - RNA, 22 nt, Human
ugggcagcauccuccacaguca

SEQ ID NO: 780930 - RNA, 19 nt, Human
gcuuccagcacugcaggag

SEQ ID NO: 780931 - RNA, 22 nt, Human
agauucauuguggauauuuucu

SEQ ID NO: 780932 - RNA, 22 nt, Human
uagagucagagaaucauuacag

SEQ ID NO: 780933 - RNA, 22 nt, Human
ccugugugucugucacugcaca

SEQ ID NO: 780934 - RNA, 22 nt, Human
caggcagcagccacucugguau

SEQ ID NO: 780935 - RNA, 22 nt, Human
uucucagaauugacugggagca

SEQ ID NO: 780936 - RNA, 22 nt, Human
ggcucaccauggccucccugcu

SEQ ID NO: 780937 - RNA, 22 nt, Human
ugaggaugacgauggcaauggc

SEQ ID NO: 780938 - RNA, 22 nt, Human
aaauuagugcaccagguugaag

SEQ ID NO: 780939 - RNA, 22 nt, Human
cugagcugggaguggauagugg

SEQ ID NO: 780940 - RNA, 22 nt, Human
gucucagugucaccuccagcug

SEQ ID NO: 780941 - RNA, 22 nt, Human
auuauggguauaacacaguuau

SEQ ID NO: 780942 - RNA, 23 nt, Human
cagaaaacccagagcucaguccc

SEQ ID NO: 780943 - RNA, 22 nt, Human
aaaaguuagcuauuaguaggug

SEQ ID NO: 780944 - RNA, 19 nt, Human
ucauuguugguuugucggg

SEQ ID NO: 780945 - RNA, 22 nt, Human
ucaggcuguggcuuugaccgca

SEQ ID NO: 780946 - RNA, 22 nt, Human
uagugcuuuaggccugaguguc

SEQ ID NO: 780947 - RNA, 22 nt, Human
gaaauaauacagugcucuucuc

SEQ ID NO: 780948 - RNA, 22 nt, Human
auagaucaauauuuagaaacuu

SEQ ID NO: 780949 - RNA, 22 nt, Human
gcuccaggauaauaaaguuguu

SEQ ID NO: 780950 - RNA, 22 nt, Human
ucuccugguuuguuaaauaauu

SEQ ID NO: 780951 - RNA, 22 nt, Human
cagaugcuauagugcugccaua

SEQ ID NO: 780952 - RNA, 22 nt, Human
cagcugagaaggucugaucagg

SEQ ID NO: 780953 - RNA, 22 nt, Human
uucuuauuucccccuucaucau

SEQ ID NO: 780954 - RNA, 21 nt, Human
gcugggucagcagguccucug

SEQ ID NO: 780955 - RNA, 22 nt, Human
ggaagggcggauaguauaaguu

SEQ ID NO: 780956 - RNA, 22 nt, Human
cacaaugcagcauguaaaugca

SEQ ID NO: 780957 - RNA, 22 nt, Human
ugcagucuggauguccucagau

SEQ ID NO: 780958 - RNA, 22 nt, Human
ccuacaggaaauuguaucaaaa

SEQ ID NO: 780959 - RNA, 22 nt, Human
ugggccuggcccuguggaggag

SEQ ID NO: 780960 - RNA, 22 nt, Human
cauuucaauuauuugcucuucu

SEQ ID NO: 780961 - RNA, 22 nt, Human
agcccaagcuaugaggugaccu

SEQ ID NO: 780962 - RNA, 22 nt, Human
aggugacaggacaggagcuggu

SEQ ID NO: 780963 - RNA, 19 nt, Human
ccucuucucuggcagcaga

SEQ ID NO: 780964 - RNA, 18 nt, Human
gcucaggcccuagucagu

SEQ ID NO: 780965 - RNA, 22 nt, Human
uccccucucugcgcucccaggu

SEQ ID NO: 780966 - RNA, 22 nt, Human
aagcagagccaccagcuuugga

SEQ ID NO: 780967 - RNA, 17 nt, Human
gaacuuuuauuaaauuc

SEQ ID NO: 780968 - RNA, 22 nt, Human
aaucugaaaguauggagcagua

SEQ ID NO: 780969 - RNA, 22 nt, Human
accagucauagaaagcaguggu

SEQ ID NO: 780970 - RNA, 22 nt, Human
caccauuuucuaaaaauaugac

SEQ ID NO: 780971 - RNA, 22 nt, Human
uuuggacugcaugaugaucugg

SEQ ID NO: 780972 - RNA, 22 nt, Human
agggccagcagcuuggccaacc

SEQ ID NO: 780973 - RNA, 22 nt, Human
ugaagcaagauagaaagcugcu

SEQ ID NO: 780974 - RNA, 22 nt, Human
acacuagcuaaaugcugauuaa

SEQ ID NO: 780975 - RNA, 22 nt, Human
gcugcucuugaggggcucacug

SEQ ID NO: 780976 - RNA, 22 nt, Human
ccccagcucagugcagggacau

SEQ ID NO: 780977 - RNA, 22 nt, Human
aucuggcugagcgaggcccaca

SEQ ID NO: 780978 - RNA, 22 nt, Human
gcugccugcacagagcugcuuu

SEQ ID NO: 780979 - RNA, 22 nt, Human
auguauuugcgagguuaggaaa

SEQ ID NO: 780980 - RNA, 22 nt, Human
cuggauggaaggaggauaguau

SEQ ID NO: 780981 - RNA, 20 nt, Human
acguggccaccaguggcuua

SEQ ID NO: 780982 - RNA, 18 nt, Human
ggucaagaaaguaaggca

SEQ ID NO: 780983 - RNA, 22 nt, Human
cagcacuucaaugagcauuuca

SEQ ID NO: 780984 - RNA, 22 nt, Human
guuaucuuaggguacaaaggac

SEQ ID NO: 780985 - RNA, 22 nt, Human
agaacauggauugucaaaggua

SEQ ID NO: 780986 - RNA, 22 nt, Human
cuggggcugcagcgaucuucau

SEQ ID NO: 780987 - RNA, 20 nt, Human
caggcaguuugugguuaggg

SEQ ID NO: 780988 - RNA, 22 nt, Human
aaacugguaaucggcaagugag

SEQ ID NO: 780989 - RNA, 22 nt, Human
uuuagcaaaaaagcucugcgua

SEQ ID NO: 780990 - RNA, 22 nt, Human
auuuagcaagaguacaaaauaa

SEQ ID NO: 780991 - RNA, 22 nt, Human
caagcagggagcaucaagggag

SEQ ID NO: 780992 - RNA, 20 nt, Human
acuuaguguaggguuccuag

SEQ ID NO: 780993 - RNA, 20 nt, Human
agcauacaucauaagaaacc

SEQ ID NO: 780994 - RNA, 22 nt, Human
auuggaaauacugagagauaaa

SEQ ID NO: 780995 - RNA, 19 nt, Human
cuuuuucaccuucuagaag

SEQ ID NO: 780996 - RNA, 22 nt, Human
uagucaaaaggaaggauaugcu

SEQ ID NO: 780997 - RNA, 22 nt, Human
gaauuguagagggaacagaagc

SEQ ID NO: 780998 - RNA, 22 nt, Human
uccaggaggcaccuuuggacca

SEQ ID NO: 780999 - RNA, 23 nt, Human
uuuuuugucuugcuaggcugccc

SEQ ID NO: 781000 - RNA, 22 nt, Human
cuucaguauccuccacauguua

SEQ ID NO: 781001 - RNA, 19 nt, Human
ugagugucacgucagugcc

SEQ ID NO: 781002 - RNA, 22 nt, Human
ggucaugcugugaaucagugcu

SEQ ID NO: 781003 - RNA, 22 nt, Human
ggcacaauugcagcaauaaaca

SEQ ID NO: 781004 - RNA, 22 nt, Human
uuagaaagguuuugcucugaaa

SEQ ID NO: 781005 - RNA, 23 nt, Human
ucacacuaugaaguguguuaucc

SEQ ID NO: 781006 - RNA, 22 nt, Human
uugcagacauuccagagcuuuu

SEQ ID NO: 781007 - RNA, 22 nt, Human
cugagguagcugugaauguucu

SEQ ID NO: 781008 - RNA, 22 nt, Human
aagaacaugcuauaauuaucuu

SEQ ID NO: 781009 - RNA, 22 nt, Human
aaaggccacugcaagggaaggu

SEQ ID NO: 781010 - RNA, 22 nt, Human
ucagggaagacuucuuagagga

SEQ ID NO: 781011 - RNA, 22 nt, Human
gaaagggagugaagaugguaua

SEQ ID NO: 781012 - RNA, 22 nt, Human
ccagcuuucugggugguuucug

SEQ ID NO: 781013 - RNA, 22 nt, Human
acagcuauagacgauguauaga

SEQ ID NO: 781014 - RNA, 22 nt, Human
gacugaaauuauaccaaguggu

SEQ ID NO: 781015 - RNA, 22 nt, Human
ggcuguggacacugagcucaga

SEQ ID NO: 781016 - RNA, 22 nt, Human
ucucccaaccucuggugggugc

SEQ ID NO: 781017 - RNA, 22 nt, Human
auucauguucggggccacguug

SEQ ID NO: 781018 - RNA, 22 nt, Human
cuucagaacuauaaaaaguacu

SEQ ID NO: 781019 - RNA, 22 nt, Human
acaguaacaccuacucuguccc

SEQ ID NO: 781020 - RNA, 22 nt, Human
auagccagcauauagcagggag

SEQ ID NO: 781021 - RNA, 20 nt, Human
gagggcucguggauggauaa

SEQ ID NO: 781022 - RNA, 22 nt, Human
gaccacagcuacaagggcaagg

SEQ ID NO: 781023 - RNA, 22 nt, Human
uuacacaaagcuccccaaauag

SEQ ID NO: 781024 - RNA, 22 nt, Human
agcagagccagaauuggaccag

SEQ ID NO: 781025 - RNA, 22 nt, Human
gcugaagcugcagcaggaggaa

SEQ ID NO: 781026 - RNA, 22 nt, Human
aagcccuguucuuucucucacc

SEQ ID NO: 781027 - RNA, 22 nt, Human
ugcuggggucauggggcgcccg

SEQ ID NO: 781028 - RNA, 22 nt, Human
auguggagaggaagugcaaacu

SEQ ID NO: 781029 - RNA, 22 nt, Human
gucacuuuauuaauuuugguga

SEQ ID NO: 781030 - RNA, 22 nt, Human
uuggcuuuagaccugagacugu

SEQ ID NO: 781031 - RNA, 22 nt, Human
uaaccuggggcgguuucccaau

SEQ ID NO: 781032 - RNA, 22 nt, Human
ccaggaggcucuugucccuggu

SEQ ID NO: 781033 - RNA, 22 nt, Human
ugcucuguaacaaauugacaug

SEQ ID NO: 781034 - RNA, 22 nt, Human
ugggagcacucuuugggaagca

SEQ ID NO: 781035 - RNA, 22 nt, Human
ucccagcccagguaugaugaua

SEQ ID NO: 781036 - RNA, 22 nt, Human
auuucucuuccuccuaggguug

SEQ ID NO: 781037 - RNA, 22 nt, Human
aucuggcucuuccuggaguucc

SEQ ID NO: 781038 - RNA, 22 nt, Human
acugggaaggagcaggaucugu

SEQ ID NO: 781039 - RNA, 22 nt, Human
ccuggcagcuguuuggcuuggc

SEQ ID NO: 781040 - RNA, 22 nt, Human
gcagggcugcugaaacuuguuu

SEQ ID NO: 781041 - RNA, 22 nt, Human
uuuuggucagguuggucucgaa

SEQ ID NO: 781042 - RNA, 22 nt, Human
agaaccucuggauacaguuuaa

SEQ ID NO: 781043 - RNA, 22 nt, Human
aggcuccagcccaaggcugcag

SEQ ID NO: 781044 - RNA, 22 nt, Human
ggacuggccggcgcugaggccc

SEQ ID NO: 781045 - RNA, 20 nt, Human
agccaggcucaagcuccccc

SEQ ID NO: 781046 - RNA, 22 nt, Human
uacauguuauuucacuauuggu

SEQ ID NO: 781047 - RNA, 22 nt, Human
cagcccugggaguuggggccga

SEQ ID NO: 781048 - RNA, 22 nt, Human
aaaugcacaggagaaccaauuc

SEQ ID NO: 781049 - RNA, 22 nt, Human
uccagcaugacuaguuccccau

SEQ ID NO: 781050 - RNA, 21 nt, Human
aggugggcagguggaguggcc

SEQ ID NO: 781051 - RNA, 22 nt, Human
ugcugccagggcucugcccaca

SEQ ID NO: 781052 - RNA, 22 nt, Human
guguggggcucagugggaaugu

SEQ ID NO: 781053 - RNA, 22 nt, Human
acacauuauagagaguauaaua

SEQ ID NO: 781054 - RNA, 22 nt, Human
cauuccagcucucauacucugg

SEQ ID NO: 781055 - RNA, 22 nt, Human
acuugcaaagugagggaguguu

SEQ ID NO: 781056 - RNA, 22 nt, Human
cccuggaggaaaaucugaggcu

SEQ ID NO: 781057 - RNA, 22 nt, Human
auguucaaacuuuuuacacacc

SEQ ID NO: 781058 - RNA, 22 nt, Human
uaagucaucacauugcagagau

SEQ ID NO: 781059 - RNA, 22 nt, Human
ugggguugaagaaaggaucuag

SEQ ID NO: 781060 - RNA, 22 nt, Human
uggaaggcauuucacacaggau

SEQ ID NO: 781061 - RNA, 22 nt, Human
ugcuucuuuacuauaggcaauu

SEQ ID NO: 781062 - RNA, 22 nt, Human
cagaccugaggagcacugagcc

SEQ ID NO: 781063 - RNA, 21 nt, Human
guccuucagcaaguuaguggc

SEQ ID NO: 781064 - RNA, 22 nt, Human
uggcugcugagaaggcagcugu

SEQ ID NO: 781065 - RNA, 22 nt, Human
cagggcucaggaaaucagacgu

SEQ ID NO: 781066 - RNA, 22 nt, Human
agggcagcauugccuuucucca

SEQ ID NO: 781067 - RNA, 22 nt, Human
accaaggaagagauucucaguu

SEQ ID NO: 781068 - RNA, 22 nt, Human
guccuucagcuuuaucugaaca

SEQ ID NO: 781069 - RNA, 22 nt, Human
uacccaaggcccuuucaauuuc

SEQ ID NO: 781070 - RNA, 23 nt, Human
ucugcucugaaguucggcugagc

SEQ ID NO: 781071 - RNA, 16 nt, Human
gcagggguggguggag

SEQ ID NO: 781072 - RNA, 22 nt, Human
aggagguggccugagcgugccc

SEQ ID NO: 781073 - RNA, 22 nt, Human
cuuacacuucaucucauccagg

SEQ ID NO: 781074 - RNA, 22 nt, Human
cuuuacauuaauuucuacugau

SEQ ID NO: 781075 - RNA, 22 nt, Human
agacucugcuaagaauauaauu

SEQ ID NO: 781076 - RNA, 22 nt, Human
uuguauucauugcuuacccaau

SEQ ID NO: 781077 - RNA, 22 nt, Human
aaacuguuccuuuuucagcaac

SEQ ID NO: 781078 - RNA, 22 nt, Human
uagggcaggggaggaaucugaa

SEQ ID NO: 781079 - RNA, 22 nt, Human
gcagguggagcaguagucuggu

SEQ ID NO: 781080 - RNA, 22 nt, Human
auaggagaucaauaugcaauuu

SEQ ID NO: 781081 - RNA, 22 nt, Human
uaaagcaagacacacccauagc

SEQ ID NO: 781082 - RNA, 22 nt, Human
ggucccaggaaucuguguucua

SEQ ID NO: 781083 - RNA, 22 nt, Human
auaggcaagggauacaauauac

SEQ ID NO: 781084 - RNA, 22 nt, Human
auuugcauaaggaugcuacugu

SEQ ID NO: 781085 - RNA, 22 nt, Human
gccuguccuggaugcucugcaa

SEQ ID NO: 781086 - RNA, 23 nt, Human
ugagcugggccugcaggggucuc

SEQ ID NO: 781087 - RNA, 22 nt, Human
uaaugagaucauaucuucugag

SEQ ID NO: 781088 - RNA, 22 nt, Human
aucuugaucaaggcuaucauga

SEQ ID NO: 781089 - RNA, 22 nt, Human
ucacauuuuaguaccaugauuu

SEQ ID NO: 781090 - RNA, 22 nt, Human
ucuuggaaguagaacacagucu

SEQ ID NO: 781091 - RNA, 22 nt, Human
ucacaggguguacaucaccuau

SEQ ID NO: 781092 - RNA, 22 nt, Human
uuuacaauucuggugccagcua

SEQ ID NO: 781093 - RNA, 22 nt, Human
gacacagagcucacagucuccu

SEQ ID NO: 781094 - RNA, 22 nt, Human
ccagaggcggagguuugcagug

SEQ ID NO: 781095 - RNA, 22 nt, Human
aucuauuaugcugagaaacugu

SEQ ID NO: 781096 - RNA, 22 nt, Human
ucagauauucaauuaaguuaaa

SEQ ID NO: 781097 - RNA, 22 nt, Human
cauauucuguuggucacauaga

SEQ ID NO: 781098 - RNA, 22 nt, Human
uuacuacauuguaacacaguac

SEQ ID NO: 781099 - RNA, 22 nt, Human
ugagcucuaagauccccucaag

SEQ ID NO: 781100 - RNA, 22 nt, Human
auguuauuuuggaaaauacaaa

SEQ ID NO: 781101 - RNA, 22 nt, Human
aacuccagacuacuaauuuagu

SEQ ID NO: 781102 - RNA, 22 nt, Human
uagcucuggagucuucucagaa

SEQ ID NO: 781103 - RNA, 18 nt, Human
gccugggaggaggaaaug

SEQ ID NO: 781104 - RNA, 22 nt, Human
cacuggcaucuaguggguugag

SEQ ID NO: 781105 - RNA, 22 nt, Human
aaagugccacaacuggacaacc

SEQ ID NO: 781106 - RNA, 22 nt, Human
ucccugaaccacuagugaugag

SEQ ID NO: 781107 - RNA, 22 nt, Human
uccccagccgugaaggagagga

SEQ ID NO: 781108 - RNA, 19 nt, Human
acaggcagaauugggugug

SEQ ID NO: 781109 - RNA, 22 nt, Human
uuacagaauguucuuccaacag

SEQ ID NO: 781110 - RNA, 19 nt, Human
ugcuucuggaaccaugauc

SEQ ID NO: 781111 - RNA, 22 nt, Human
ccagugacuggcuuucuggugu

SEQ ID NO: 781112 - RNA, 22 nt, Human
aguauacaaauaaauguguaau

SEQ ID NO: 781113 - RNA, 22 nt, Human
ggaggcuccuaagcugacuuga

SEQ ID NO: 781114 - RNA, 21 nt, Human
ucugggcccaugcugccucac

SEQ ID NO: 781115 - RNA, 22 nt, Human
aauggcucugauguuguuguga

SEQ ID NO: 781116 - RNA, 22 nt, Human
gcuucgcugcuagcuaguuggu

SEQ ID NO: 781117 - RNA, 22 nt, Human
uggcugaguuucaugcaucaug

SEQ ID NO: 781118 - RNA, 22 nt, Human
uaguauuuccuguaagcuauag

SEQ ID NO: 781119 - RNA, 22 nt, Human
caaacuguaugacccuaggccg

SEQ ID NO: 781120 - RNA, 22 nt, Human
cuguaucuguguuggaugaguu

SEQ ID NO: 781121 - RNA, 21 nt, Human
agagagggagaugaaacaucc

SEQ ID NO: 781122 - RNA, 23 nt, Human
agaaguucaagaccagccugccc

SEQ ID NO: 781123 - RNA, 22 nt, Human
agacaggcugcugucugcuagg

SEQ ID NO: 781124 - RNA, 22 nt, Human
agagccuugcucuaaauuucuc

SEQ ID NO: 781125 - RNA, 22 nt, Human
ucccacagcaugaguaacucuc

SEQ ID NO: 781126 - RNA, 17 nt, Human
uuaaaggaugcucucuc

SEQ ID NO: 781127 - RNA, 22 nt, Human
ucuucacaccgggcagcaggaa

SEQ ID NO: 781128 - RNA, 22 nt, Human
ggaugaggaaaccacagugucc

SEQ ID NO: 781129 - RNA, 22 nt, Human
gugagucugccuagcacaucac

SEQ ID NO: 781130 - RNA, 22 nt, Human
uggaggaaaaaaccaggcagag

SEQ ID NO: 781131 - RNA, 22 nt, Human
uaggaaaagcacaggauguucu

SEQ ID NO: 781132 - RNA, 22 nt, Human
ugucucugcugcaccuucuggg

SEQ ID NO: 781133 - RNA, 22 nt, Human
aguuagaagugugucaucugug

SEQ ID NO: 781134 - RNA, 22 nt, Human
ucucugucucccguguguccgg

SEQ ID NO: 781135 - RNA, 22 nt, Human
gcuguggcuuucuguuucuguu

SEQ ID NO: 781136 - RNA, 22 nt, Human
ugcucaguccuccugcagugcc

SEQ ID NO: 781137 - RNA, 19 nt, Human
ccucuuccucugacacuau

SEQ ID NO: 781138 - RNA, 20 nt, Human
gcuccaggucagagaggacg

SEQ ID NO: 781139 - RNA, 22 nt, Human
cuaggaauccuuuuagaguugg

SEQ ID NO: 781140 - RNA, 23 nt, Human
ccuguugggacagcuuuaccaga

SEQ ID NO: 781141 - RNA, 22 nt, Human
uauacucugagaaacgugucac

SEQ ID NO: 781142 - RNA, 22 nt, Human
uaauugcuuuauccuguuagaa

SEQ ID NO: 781143 - RNA, 18 nt, Human
ggagagugacagagucgu

SEQ ID NO: 781144 - RNA, 22 nt, Human
agagucccagggacacuccaga

SEQ ID NO: 781145 - RNA, 22 nt, Human
cagagucuuguguguucagccc

SEQ ID NO: 781146 - RNA, 22 nt, Human
gaggcagcuuaggguacugacu

SEQ ID NO: 781147 - RNA, 17 nt, Human
ugcaggcuguuauagcc

SEQ ID NO: 781148 - RNA, 22 nt, Human
augaggcagcugacagcuguuc

SEQ ID NO: 781149 - RNA, 22 nt, Human
gucuggaggcacuuucucauga

SEQ ID NO: 781150 - RNA, 22 nt, Human
gucccaggcuuauguggagcuu

SEQ ID NO: 781151 - RNA, 22 nt, Human
cugaggagcguuggucacgugu

SEQ ID NO: 781152 - RNA, 22 nt, Human
gagaaaagcgaaggaccuggag

SEQ ID NO: 781153 - RNA, 22 nt, Human
agggggaguuucaguuagaaag

SEQ ID NO: 781154 - RNA, 22 nt, Human
aaagccaagcugggaaggcagg

SEQ ID NO: 781155 - RNA, 22 nt, Human
cagagcccuaguccugauggcc

SEQ ID NO: 781156 - RNA, 22 nt, Human
agggccagccaggcccuacaaa

SEQ ID NO: 781157 - RNA, 22 nt, Human
aggcauggcauggggcagaugu

SEQ ID NO: 781158 - RNA, 22 nt, Human
uuacaagacacagugcugaagg

SEQ ID NO: 781159 - RNA, 22 nt, Human
uggcacugagcagccgcggcag

SEQ ID NO: 781160 - RNA, 22 nt, Human
ucaggagagaaagaauacaauu

SEQ ID NO: 781161 - RNA, 22 nt, Human
ucaaaggaaacgugguccuggc

SEQ ID NO: 781162 - RNA, 19 nt, Human
ugcagcucagggcaggggc

SEQ ID NO: 781163 - RNA, 22 nt, Human
ccuugcauauauuauaucuuug

SEQ ID NO: 781164 - RNA, 22 nt, Human
uuggcagcagaguguggugcuc

SEQ ID NO: 781165 - RNA, 22 nt, Human
cuuggagaauccugguuauuca

SEQ ID NO: 781166 - RNA, 22 nt, Human
uucagagucagggaucucagag

SEQ ID NO: 781167 - RNA, 22 nt, Human
ucacagacauggugagguaaca

SEQ ID NO: 781168 - RNA, 22 nt, Human
uugaggccccauggaugagaac

SEQ ID NO: 781169 - RNA, 22 nt, Human
ugagacaguaauuguauaguuu

SEQ ID NO: 781170 - RNA, 22 nt, Human
gcagagccugugucugagcaaa

SEQ ID NO: 781171 - RNA, 22 nt, Human
cuaguauuaagugugaguaaaa

SEQ ID NO: 781172 - RNA, 22 nt, Human
auuuacauaauagacuuuaggu

SEQ ID NO: 781173 - RNA, 22 nt, Human
cagcuguucuugggacagacag

SEQ ID NO: 781174 - RNA, 22 nt, Human
gccaagggggcagugcaugggu

SEQ ID NO: 781175 - RNA, 22 nt, Human
cugagcucagucccagcucuac

SEQ ID NO: 781176 - RNA, 22 nt, Human
agacaagacuaggcaguuguug

SEQ ID NO: 781177 - RNA, 22 nt, Human
aaacaacucggcaacugcuuuu

SEQ ID NO: 781178 - RNA, 19 nt, Human
aguguguacugaaagcacu

SEQ ID NO: 781179 - RNA, 22 nt, Human
aggcagugcugugcccugaacc

SEQ ID NO: 781180 - RNA, 22 nt, Human
uuacaacauauuuagcuugauu

SEQ ID NO: 781181 - RNA, 22 nt, Human
guaacaaaggauaacuugguuu

SEQ ID NO: 781182 - RNA, 22 nt, Human
uugcaaaaucauuucucaggau

SEQ ID NO: 781183 - RNA, 17 nt, Human
agacagugagugccuug

SEQ ID NO: 781184 - RNA, 22 nt, Human
ucccagauuccugcucuuauau

SEQ ID NO: 781185 - RNA, 22 nt, Human
uucaaggaagaaguggcuuuga

SEQ ID NO: 781186 - RNA, 22 nt, Human
gcucuccaaacccuguggcuuu

SEQ ID NO: 781187 - RNA, 22 nt, Human
ucagcuggugccacucagucaa

SEQ ID NO: 781188 - RNA, 22 nt, Human
cagguggcauugucccgccagc

SEQ ID NO: 781189 - RNA, 22 nt, Human
agcccuagagcuggaggucagu

SEQ ID NO: 781190 - RNA, 22 nt, Human
ccuucaggucauauaugucaga

SEQ ID NO: 781191 - RNA, 22 nt, Human
uagcagcaauuacacaguccgu

SEQ ID NO: 781192 - RNA, 22 nt, Human
caggccagaguccaacuccaga

SEQ ID NO: 781193 - RNA, 22 nt, Human
acacugacgcuugacagucacc

SEQ ID NO: 781194 - RNA, 22 nt, Human
gguggccugcccugaucccugg

SEQ ID NO: 781195 - RNA, 22 nt, Human
gccaggugcuaucccugcgcug

SEQ ID NO: 781196 - RNA, 22 nt, Human
acaguagagcauuuguuuugau

SEQ ID NO: 781197 - RNA, 22 nt, Human
ugggauucaccaugggcuucag

SEQ ID NO: 781198 - RNA, 22 nt, Human
ugcccacauucaaaaggugaug

SEQ ID NO: 781199 - RNA, 22 nt, Human
aauuucagauauuaaagaauga

SEQ ID NO: 781200 - RNA, 22 nt, Human
uagucacaaccuucaaguuguc

SEQ ID NO: 781201 - RNA, 22 nt, Human
gacuugggcuugggcguggguu

SEQ ID NO: 781202 - RNA, 22 nt, Human
aaacagucugaugccaucugcc

SEQ ID NO: 781203 - RNA, 22 nt, Human
gaggccuggugugucucccgcu

SEQ ID NO: 781204 - RNA, 22 nt, Human
uuggcacaaauuucugaaauaa

SEQ ID NO: 781205 - RNA, 22 nt, Human
gagcacccuaccugccacugag

SEQ ID NO: 781206 - RNA, 22 nt, Human
cccaggagaccuagaucuguuu

SEQ ID NO: 781207 - RNA, 22 nt, Human
acuggggaguugaagcacuuuc

SEQ ID NO: 781208 - RNA, 22 nt, Human
ugagcuggucacuccuucugaa

SEQ ID NO: 781209 - RNA, 22 nt, Human
cucuggccgcagcucagcucug

SEQ ID NO: 781210 - RNA, 22 nt, Human
cagggcagaacauauagauagu

SEQ ID NO: 781211 - RNA, 21 nt, Human
ccugugugucugacugggcua

SEQ ID NO: 781212 - RNA, 22 nt, Human
cuccuucaaaagucauaguaaa

SEQ ID NO: 781213 - RNA, 22 nt, Human
aggaugugaguggacacagucc

SEQ ID NO: 781214 - RNA, 19 nt, Human
acugagaaccugacccagg

SEQ ID NO: 781215 - RNA, 22 nt, Human
ucauugaauuugguucaauaug

SEQ ID NO: 781216 - RNA, 22 nt, Human
uccuggcuccagcagcucuucc

SEQ ID NO: 781217 - RNA, 20 nt, Human
uggcuggcuuguauuuccuu

SEQ ID NO: 781218 - RNA, 22 nt, Human
uggaauuuaguuaauuccauuu

SEQ ID NO: 781219 - RNA, 22 nt, Human
ccugaggcuccaccuccagaga

SEQ ID NO: 781220 - RNA, 22 nt, Human
gucuccugagacugcagucacc

SEQ ID NO: 781221 - RNA, 22 nt, Human
gcugcucugaaaaugacuguug

SEQ ID NO: 781222 - RNA, 22 nt, Human
auuacaauaauacaugcucauu

SEQ ID NO: 781223 - RNA, 22 nt, Human
cacagaugagcugaauagcuuu

SEQ ID NO: 781224 - RNA, 22 nt, Human
uuuccucugaugcugacuugga

SEQ ID NO: 781225 - RNA, 22 nt, Human
acaaacuaccuacagauguuca

SEQ ID NO: 781226 - RNA, 22 nt, Human
ccaggccuguguuguguggagg

SEQ ID NO: 781227 - RNA, 19 nt, Human
ugucucagugucccuuccu

SEQ ID NO: 781228 - RNA, 22 nt, Human
ggcuucaccugugcacucuacc

SEQ ID NO: 781229 - RNA, 22 nt, Human
caugaauauacauccugauggc

SEQ ID NO: 781230 - RNA, 22 nt, Human
uggcagcuugaaugcagucuuu

SEQ ID NO: 781231 - RNA, 22 nt, Human
aagucacaagcauauaugcauu

SEQ ID NO: 781232 - RNA, 22 nt, Human
uccucugcuccaucuuuacugu

SEQ ID NO: 781233 - RNA, 22 nt, Human
aaggcucuugaguggugauagu

SEQ ID NO: 781234 - RNA, 22 nt, Human
aggacccugagcgggcaugccg

SEQ ID NO: 781235 - RNA, 22 nt, Human
uguaaaccagggucauccuuag

SEQ ID NO: 781236 - RNA, 21 nt, Human
aguuacaaguuuauucagagg

SEQ ID NO: 781237 - RNA, 22 nt, Human
cuguuauuuuccucugaacucu

SEQ ID NO: 781238 - RNA, 22 nt, Human
gcugccuuuuaaagccucgcuu

SEQ ID NO: 781239 - RNA, 22 nt, Human
acucagagaauaucuagaagga

SEQ ID NO: 781240 - RNA, 22 nt, Human
aggccacaaccacccugugccc

SEQ ID NO: 781241 - RNA, 22 nt, Human
gcgugggcuggacugggaugaa

SEQ ID NO: 781242 - RNA, 22 nt, Human
cuuucugaaagacauuuuaacu

SEQ ID NO: 781243 - RNA, 21 nt, Human
acagauuuuauaucucugcug

SEQ ID NO: 781244 - RNA, 22 nt, Human
uagaucugauacaauucaucug

SEQ ID NO: 781245 - RNA, 22 nt, Human
ugggacuuguguggcaguauuu

SEQ ID NO: 781246 - RNA, 22 nt, Human
ccaaagcaagucacaugaucaa

SEQ ID NO: 781247 - RNA, 22 nt, Human
caggaaugauauucgaggagau

SEQ ID NO: 781248 - RNA, 22 nt, Human
cuccuuccugguuagcaccuua

SEQ ID NO: 781249 - RNA, 22 nt, Human
agcucccugcacgacccugccc

SEQ ID NO: 781250 - RNA, 22 nt, Human
cugcuuccacacaagcaaagcu

SEQ ID NO: 781251 - RNA, 22 nt, Human
cagcagccuggagggggccacg

SEQ ID NO: 781252 - RNA, 22 nt, Human
cauccauagcuugaucuguucc

SEQ ID NO: 781253 - RNA, 22 nt, Human
caggaacaaggccuaugggacu

SEQ ID NO: 781254 - RNA, 22 nt, Human
ucagaacauuacauuuugagcu

SEQ ID NO: 781255 - RNA, 19 nt, Human
agcagguggguaagaaaau

SEQ ID NO: 781256 - RNA, 22 nt, Human
ugggaagaugauaauucacagu

SEQ ID NO: 781257 - RNA, 22 nt, Human
caacuucacugugccucuaguu

SEQ ID NO: 781258 - RNA, 22 nt, Human
gaaauagacacuuucuaugaau

SEQ ID NO: 781259 - RNA, 22 nt, Human
acaccuggucuuugcaugagca

SEQ ID NO: 781260 - RNA, 22 nt, Human
ucacaaacaaugcuuuggaauu

SEQ ID NO: 781261 - RNA, 22 nt, Human
cagagcuggagcuugaauggag

SEQ ID NO: 781262 - RNA, 22 nt, Human
agcaccagcgugggggccguug

SEQ ID NO: 781263 - RNA, 22 nt, Human
ucagccagcauuaccccugacu

SEQ ID NO: 781264 - RNA, 22 nt, Human
aaguucaagagugacauauuag

SEQ ID NO: 781265 - RNA, 22 nt, Human
cuuuggaugacuggugcagguu

SEQ ID NO: 781266 - RNA, 22 nt, Human
acucugaagaagacuuccagac

SEQ ID NO: 781267 - RNA, 22 nt, Human
cucaggcuugggaggaggccca

SEQ ID NO: 781268 - RNA, 21 nt, Human
cccgcacagcgguaggccgcc

SEQ ID NO: 781269 - RNA, 22 nt, Human
gcacacaggggaguucucagaa

SEQ ID NO: 781270 - RNA, 22 nt, Human
caggccacagcuaaagaggauu

SEQ ID NO: 781271 - RNA, 22 nt, Human
guaggcagugguuggaagagaa

SEQ ID NO: 781272 - RNA, 22 nt, Human
uguucacaucgauggauuuugc

SEQ ID NO: 781273 - RNA, 22 nt, Human
gcuuccugagacaacauugagu

SEQ ID NO: 781274 - RNA, 22 nt, Human
ugcuuccaauucaaaucugugg

SEQ ID NO: 781275 - RNA, 22 nt, Human
agggcucaucugagacugacau

SEQ ID NO: 781276 - RNA, 22 nt, Human
cuggcagcugcccgagaugccc

SEQ ID NO: 781277 - RNA, 22 nt, Human
aggggcacuucucaggcugugg

SEQ ID NO: 781278 - RNA, 22 nt, Human
cucucucuucuuuguaggggcc

SEQ ID NO: 781279 - RNA, 22 nt, Human
caaguguccaugauagucuuag

SEQ ID NO: 781280 - RNA, 19 nt, Human
auuugaaagcugugcuugc

SEQ ID NO: 781281 - RNA, 22 nt, Human
augaaacaugcuuuguggauga

SEQ ID NO: 781282 - RNA, 22 nt, Human
aacauuaagauggcggaacagu

SEQ ID NO: 781283 - RNA, 22 nt, Human
uagagugguuaacaguuuagaa

SEQ ID NO: 781284 - RNA, 22 nt, Human
acugcugcagguccagccccuu

SEQ ID NO: 781285 - RNA, 22 nt, Human
aaagauacuuaauaguugucug

SEQ ID NO: 781286 - RNA, 22 nt, Human
ccaagaggcagaaugcagagaa

SEQ ID NO: 781287 - RNA, 22 nt, Human
uccugggaacucggaaagcucu

SEQ ID NO: 781288 - RNA, 22 nt, Human
uuacagauacuuuguaggcaag

SEQ ID NO: 781289 - RNA, 22 nt, Human
ggcuggcagugugagagaggga

SEQ ID NO: 781290 - RNA, 22 nt, Human
uaagaacauuuucggaaagaua

SEQ ID NO: 781291 - RNA, 22 nt, Human
uagcuucuauacaacuucagca

SEQ ID NO: 781292 - RNA, 22 nt, Human
uuauaaagguuugugcauauuu

SEQ ID NO: 781293 - RNA, 22 nt, Human
cuggcccugccagagaucaaca

SEQ ID NO: 781294 - RNA, 22 nt, Human
gcagauggcgcaguggaaguuc

SEQ ID NO: 781295 - RNA, 22 nt, Human
uccugagauaaaucucauguga

SEQ ID NO: 781296 - RNA, 22 nt, Human
acauggcucagucucaugacag

SEQ ID NO: 781297 - RNA, 22 nt, Human
agagaauuaauuaggagcacug

SEQ ID NO: 781298 - RNA, 22 nt, Human
uuggcugaagguuaagugcugg

SEQ ID NO: 781299 - RNA, 21 nt, Human
ccccagcaccuugccagccug

SEQ ID NO: 781300 - RNA, 22 nt, Human
ccagcugucagugugaaaauaa

SEQ ID NO: 781301 - RNA, 22 nt, Human
cuggugcuggagccuagucccu

SEQ ID NO: 781302 - RNA, 22 nt, Human
uggggugguaauacaccguucu

SEQ ID NO: 781303 - RNA, 22 nt, Human
uggccucugaggcaccuuugcc

SEQ ID NO: 781304 - RNA, 22 nt, Human
gacagcagcauguuuacaggcc

SEQ ID NO: 781305 - RNA, 22 nt, Human
cacauuccccagagcuggggcu

SEQ ID NO: 781306 - RNA, 22 nt, Human
ugcuaauguccugaccguucug

SEQ ID NO: 781307 - RNA, 22 nt, Human
cagcaugaugcucacacaaaac

SEQ ID NO: 781308 - RNA, 22 nt, Human
aagucacacuagacaacugagg

SEQ ID NO: 781309 - RNA, 22 nt, Human
acaugcaugucuaugggcaggu

SEQ ID NO: 781310 - RNA, 22 nt, Human
agagcuauaacagcacuguaca

SEQ ID NO: 781311 - RNA, 22 nt, Human
ucagccccacggggucagccaa

SEQ ID NO: 781312 - RNA, 22 nt, Human
cccugcaggcucagacuggagu

SEQ ID NO: 781313 - RNA, 22 nt, Human
accuggccauccagcuggcauc

SEQ ID NO: 781314 - RNA, 22 nt, Human
uagccuucucaagacaaaguug

SEQ ID NO: 781315 - RNA, 23 nt, Human
uccagggcaguggcugggucugc

SEQ ID NO: 781316 - RNA, 22 nt, Human
aagagcuggauugugcugcaga

SEQ ID NO: 781317 - RNA, 21 nt, Human
ggugacacguggccccgcucu

SEQ ID NO: 781318 - RNA, 22 nt, Human
gaggcacaauacaugucucaag

SEQ ID NO: 781319 - RNA, 20 nt, Human
auucaugucuuuauaaaagc

SEQ ID NO: 781320 - RNA, 22 nt, Human
guguuaaauuucuaauuuguga

SEQ ID NO: 781321 - RNA, 22 nt, Human
agaguuuggugaagcaauuuga

SEQ ID NO: 781322 - RNA, 22 nt, Human
uuagagaauuccaaaugacuac

SEQ ID NO: 781323 - RNA, 22 nt, Human
uccugaaaauaauuucacaaga

SEQ ID NO: 781324 - RNA, 22 nt, Human
gagggaugugccugaaggcagg

SEQ ID NO: 781325 - RNA, 22 nt, Human
gucuggaagggagugcauuuuc

SEQ ID NO: 781326 - RNA, 22 nt, Human
uccccaguaagccugcacugug

SEQ ID NO: 781327 - RNA, 22 nt, Human
uagguucagagaacugaaaaua

SEQ ID NO: 781328 - RNA, 22 nt, Human
auuacuuucagaugugcuguaa

SEQ ID NO: 781329 - RNA, 22 nt, Human
ucagugugaauucauuuuagau

SEQ ID NO: 781330 - RNA, 22 nt, Human
cucaagucuauugauaagugca

SEQ ID NO: 781331 - RNA, 20 nt, Human
acauagaucagugauugaca

SEQ ID NO: 781332 - RNA, 22 nt, Human
ccccacuugcucagcaugucca

SEQ ID NO: 781333 - RNA, 22 nt, Human
ugagggaggcccuuugagcaga

SEQ ID NO: 781334 - RNA, 22 nt, Human
agcuggaauccuacuucuaaca

SEQ ID NO: 781335 - RNA, 22 nt, Human
gugagacacgugugugaccugg

SEQ ID NO: 781336 - RNA, 22 nt, Human
aagagcuggcucuugcagcagc

SEQ ID NO: 781337 - RNA, 22 nt, Human
gacuucaaagcgugauaaagau

SEQ ID NO: 781338 - RNA, 22 nt, Human
cagcuggcugcggugaggggac

SEQ ID NO: 781339 - RNA, 22 nt, Human
cacagccuuacugagauccacu

SEQ ID NO: 781340 - RNA, 22 nt, Human
cuguggcuguauuuggccagag

SEQ ID NO: 781341 - RNA, 22 nt, Human
gcuucucucucagacugcaagc

SEQ ID NO: 781342 - RNA, 22 nt, Human
cugaggaugguguggucuucuc

SEQ ID NO: 781343 - RNA, 22 nt, Human
uuuccauauuuggucuuuggga

SEQ ID NO: 781344 - RNA, 22 nt, Human
gugggccagcuuuucuccuggg

SEQ ID NO: 781345 - RNA, 22 nt, Human
augcaacaaauugugugcaaua

SEQ ID NO: 781346 - RNA, 23 nt, Human
agcuccuuugaaaguauguuuuu

SEQ ID NO: 781347 - RNA, 22 nt, Human
ccagcacugcucucagacugag

SEQ ID NO: 781348 - RNA, 22 nt, Human
acagaugagaaggcugaccagu

SEQ ID NO: 781349 - RNA, 22 nt, Human
uagucauucuccuuacaaagcc

SEQ ID NO: 781350 - RNA, 22 nt, Human
cuuuuguucuacagcuggggaa

SEQ ID NO: 781351 - RNA, 22 nt, Human
agaucauaugaaaaauuucaag

SEQ ID NO: 781352 - RNA, 22 nt, Human
gcacugagucugucaugcugca

SEQ ID NO: 781353 - RNA, 22 nt, Human
auggacucacuaauuccuccac

SEQ ID NO: 781354 - RNA, 22 nt, Human
guucuucacauuucauugagga

SEQ ID NO: 781355 - RNA, 22 nt, Human
gugcuguaucagaaucugcucu

SEQ ID NO: 781356 - RNA, 22 nt, Human
acagucuggaggcugcuucauu

SEQ ID NO: 781357 - RNA, 22 nt, Human
ugggugugagcccgggagccgc

SEQ ID NO: 781358 - RNA, 22 nt, Human
ggcugcucacgcagcccucccu

SEQ ID NO: 781359 - RNA, 22 nt, Human
caucauugaacacuucuuccug

SEQ ID NO: 781360 - RNA, 22 nt, Human
cagccacuguggucuagcugca

SEQ ID NO: 781361 - RNA, 22 nt, Human
ugagauaacuauucugucaacu

SEQ ID NO: 781362 - RNA, 22 nt, Human
cauuuaauccucacaagccuau

SEQ ID NO: 781363 - RNA, 22 nt, Human
uguaaaagguuguucuuucguu

SEQ ID NO: 781364 - RNA, 22 nt, Human
agugugugccuuuggauaccug

SEQ ID NO: 781365 - RNA, 22 nt, Human
uucagagcaucucuaaagccag

SEQ ID NO: 781366 - RNA, 22 nt, Human
uugaacuaauagguaucuugua

SEQ ID NO: 781367 - RNA, 21 nt, Human
acccuggguucuccauacccu

SEQ ID NO: 781368 - RNA, 22 nt, Human
aaaccucuucucaagauuucug

SEQ ID NO: 781369 - RNA, 22 nt, Human
agcagcauagaagcugggagga

SEQ ID NO: 781370 - RNA, 22 nt, Human
aggcacaggaaugucauccagu

SEQ ID NO: 781371 - RNA, 22 nt, Human
aggguggcuggaggaaucagaa

SEQ ID NO: 781372 - RNA, 17 nt, Human
uuccaaggagcauuuga

SEQ ID NO: 781373 - RNA, 22 nt, Human
gcugagagaaaagugagguucu

SEQ ID NO: 781374 - RNA, 22 nt, Human
gcccagcagaucucagugucuc

SEQ ID NO: 781375 - RNA, 22 nt, Human
ugguuucucugaacucuacgac

SEQ ID NO: 781376 - RNA, 22 nt, Human
gugugcgcgcucauaggugugu

SEQ ID NO: 781377 - RNA, 22 nt, Human
uuucaguuaaguggcuaguccc

SEQ ID NO: 781378 - RNA, 21 nt, Human
uuuagggaccaggucauaggc

SEQ ID NO: 781379 - RNA, 22 nt, Human
ggcuucucucuucacauggcuu

SEQ ID NO: 781380 - RNA, 22 nt, Human
ccuucucuacuccugaugcaug

SEQ ID NO: 781381 - RNA, 22 nt, Human
gcuuuagaaaugaguaaauuag

SEQ ID NO: 781382 - RNA, 22 nt, Human
uaugaacuuuaagcucuguguc

SEQ ID NO: 781383 - RNA, 22 nt, Human
agggacaucucacaaacaacuu

SEQ ID NO: 781384 - RNA, 21 nt, Human
uggaaaacauuuaaauagcaa

SEQ ID NO: 781385 - RNA, 22 nt, Human
agaagcacagguaaagugauuu

SEQ ID NO: 781386 - RNA, 21 nt, Human
acagcauguuuguguguuugc

SEQ ID NO: 781387 - RNA, 22 nt, Human
cacacugauaggcuugacaggc

SEQ ID NO: 781388 - RNA, 22 nt, Human
uccuggcccacuccuagcuucu

SEQ ID NO: 781389 - RNA, 22 nt, Human
uuguggggaggauuugaugaga

SEQ ID NO: 781390 - RNA, 22 nt, Human
gugcucuguggauugaguugaa

SEQ ID NO: 781391 - RNA, 22 nt, Human
ucaggaguugaaggggauccug

SEQ ID NO: 781392 - RNA, 22 nt, Human
acuuccagugucugcugcuagc

SEQ ID NO: 781393 - RNA, 22 nt, Human
accaggaguuuugaccaggggc

SEQ ID NO: 781394 - RNA, 22 nt, Human
uuccugggauuauugucaagca

SEQ ID NO: 781395 - RNA, 17 nt, Human
gggugggcacugcuggc

SEQ ID NO: 781396 - RNA, 22 nt, Human
accaucuuuuccucugccuccu

SEQ ID NO: 781397 - RNA, 17 nt, Human
gcaaggccuguuuguuc

SEQ ID NO: 781398 - RNA, 22 nt, Human
aguuuaacuuuguaaacgugag

SEQ ID NO: 781399 - RNA, 22 nt, Human
cugcaugucacucugcuguccc

SEQ ID NO: 781400 - RNA, 19 nt, Human
gggcuuggggcugaagccu

SEQ ID NO: 781401 - RNA, 22 nt, Human
cauacaaucaaguucuuuauua

SEQ ID NO: 781402 - RNA, 23 nt, Human
gagagcccauuggcagggguacc

SEQ ID NO: 781403 - RNA, 22 nt, Human
uuucuaggacaugauaggauau

SEQ ID NO: 781404 - RNA, 22 nt, Human
ccagggcccacggccagaauag

SEQ ID NO: 781405 - RNA, 19 nt, Human
acaagucacuuacuuagua

SEQ ID NO: 781406 - RNA, 22 nt, Human
agcuguggaguaggggguugga

SEQ ID NO: 781407 - RNA, 22 nt, Human
auacacauguuauuguggaagc

SEQ ID NO: 781408 - RNA, 22 nt, Human
uuuauauuucccaggauuggcc

SEQ ID NO: 781409 - RNA, 22 nt, Human
cucccucugaggcuuugagccu

SEQ ID NO: 781410 - RNA, 22 nt, Human
gagcacagauugauuuaaaaua

SEQ ID NO: 781411 - RNA, 22 nt, Human
acaguguucuuggcgcugagug

SEQ ID NO: 781412 - RNA, 22 nt, Human
acuuugaaauguguaagagaga

SEQ ID NO: 781413 - RNA, 22 nt, Human
cagcacaguguuagguaauuug

SEQ ID NO: 781414 - RNA, 22 nt, Human
ucaugcugugaacuguauacau

SEQ ID NO: 781415 - RNA, 22 nt, Human
cugggcugugguguggcccaaa

SEQ ID NO: 781416 - RNA, 20 nt, Human
uggcuuguuucuaugggcag

SEQ ID NO: 781417 - RNA, 22 nt, Human
accaugggucagccaccucagc

SEQ ID NO: 781418 - RNA, 22 nt, Human
uaaguuugugucucuguuacuu

SEQ ID NO: 781419 - RNA, 22 nt, Human
agcuuguuagaaauguagacuc

SEQ ID NO: 781420 - RNA, 22 nt, Human
uuguaacucugaauacauccua

SEQ ID NO: 781421 - RNA, 19 nt, Human
ucuggagcugaugcaggug

SEQ ID NO: 781422 - RNA, 22 nt, Human
cuuaucuguaaaauggauacaa

SEQ ID NO: 781423 - RNA, 22 nt, Human
agucccagaucuacaggaggga

SEQ ID NO: 781424 - RNA, 22 nt, Human
uguuuacuuaaauguuuucaua

SEQ ID NO: 781425 - RNA, 22 nt, Human
uguguacaagccugaguacaga

SEQ ID NO: 781426 - RNA, 22 nt, Human
auaauuuaauuuucacaguggu

SEQ ID NO: 781427 - RNA, 22 nt, Human
gacaggaaauauggggguuguu

SEQ ID NO: 781428 - RNA, 22 nt, Human
ucagacccaggugccaagcugu

SEQ ID NO: 781429 - RNA, 22 nt, Human
aggcuucagggcuuuugagggu

SEQ ID NO: 781430 - RNA, 22 nt, Human
gguuucaaugagaagugcuugu

SEQ ID NO: 781431 - RNA, 22 nt, Human
uucuucuugaaacuuuagguug

SEQ ID NO: 781432 - RNA, 22 nt, Human
aaagcagcuguuugacuuucca

SEQ ID NO: 781433 - RNA, 22 nt, Human
guuaucaugcuucaucaucacu

SEQ ID NO: 781434 - RNA, 22 nt, Human
ugcaucuuuagucuuaugucug

SEQ ID NO: 781435 - RNA, 22 nt, Human
uuggaaaggagauucuauugug

SEQ ID NO: 781436 - RNA, 22 nt, Human
caggggccuguccuggcuucug

SEQ ID NO: 781437 - RNA, 22 nt, Human
cagcagcuccaaagaauagcca

SEQ ID NO: 781438 - RNA, 22 nt, Human
uugugcagagaaaucuuucuug

SEQ ID NO: 781439 - RNA, 22 nt, Human
uuucacagagaauauugccuug

SEQ ID NO: 781440 - RNA, 22 nt, Human
aggcucaggugccucauucaca

SEQ ID NO: 781441 - RNA, 22 nt, Human
aucugucuauguggcuauguau

SEQ ID NO: 781442 - RNA, 22 nt, Human
uccagagccccaauucaccucu

SEQ ID NO: 781443 - RNA, 22 nt, Human
gagaagggauauggcuucuuga

SEQ ID NO: 781444 - RNA, 22 nt, Human
ucacccagauuacauccuguca

SEQ ID NO: 781445 - RNA, 22 nt, Human
uuucugaagguuaaggaauuag

SEQ ID NO: 781446 - RNA, 22 nt, Human
augcagaugguggauggagaaa

SEQ ID NO: 781447 - RNA, 19 nt, Human
gccugccuggguuucugag

SEQ ID NO: 781448 - RNA, 22 nt, Human
aaacagcuccuuaguuuccauc

SEQ ID NO: 781449 - RNA, 21 nt, Human
ugucacauugucccugcugcu

SEQ ID NO: 781450 - RNA, 22 nt, Human
cguauuuagaaggcugcugaaa

SEQ ID NO: 781451 - RNA, 22 nt, Human
caaagaugucauugguaagaca

SEQ ID NO: 781452 - RNA, 19 nt, Human
ccauccauggggccagagg

SEQ ID NO: 781453 - RNA, 22 nt, Human
cuuucacaagauuugagaugcu

SEQ ID NO: 781454 - RNA, 22 nt, Human
uuauugacugaaaugagaguga

SEQ ID NO: 781455 - RNA, 22 nt, Human
aaagaaucguguguaguuugaa

SEQ ID NO: 781456 - RNA, 22 nt, Human
uuacacaguugguaggggcaga

SEQ ID NO: 781457 - RNA, 22 nt, Human
gcugagagcaguguggccuuaa

SEQ ID NO: 781458 - RNA, 22 nt, Human
guggcugguuuccugcaugcaa

SEQ ID NO: 781459 - RNA, 22 nt, Human
caggagaucuuaggaauucuua

SEQ ID NO: 781460 - RNA, 22 nt, Human
ucaugcaacggcucgcugagcc

SEQ ID NO: 781461 - RNA, 22 nt, Human
uggagccuguucugagaagccg

SEQ ID NO: 781462 - RNA, 22 nt, Human
ucugugcuggacugauuucaua

SEQ ID NO: 781463 - RNA, 22 nt, Human
caggaacacaaguucagggaug

SEQ ID NO: 781464 - RNA, 22 nt, Human
uguccaccguucagcaccagag

SEQ ID NO: 781465 - RNA, 22 nt, Human
agccagagcagggaauuggaca

SEQ ID NO: 781466 - RNA, 22 nt, Human
acaggaacuguuaucucagaug

SEQ ID NO: 781467 - RNA, 22 nt, Human
ggcuagggacuccuccucaggg

SEQ ID NO: 781468 - RNA, 22 nt, Human
ggcucaggaccugggauugcca

SEQ ID NO: 781469 - RNA, 18 nt, Human
ccuggagcuccacagcaa

SEQ ID NO: 781470 - RNA, 22 nt, Human
ucccagggcagcuguccagaag

SEQ ID NO: 781471 - RNA, 22 nt, Human
uguggcuguggaugcuuuccag

SEQ ID NO: 781472 - RNA, 22 nt, Human
aaucugucuucuuuugugguuu

SEQ ID NO: 781473 - RNA, 22 nt, Human
guguacugcaaaugcugcugcc

SEQ ID NO: 781474 - RNA, 22 nt, Human
gccaggaacacaaugccaagcu

SEQ ID NO: 781475 - RNA, 22 nt, Human
acugccuggccuggccucacug

SEQ ID NO: 781476 - RNA, 21 nt, Human
agcucccuguuuccucacucu

SEQ ID NO: 781477 - RNA, 22 nt, Human
gucauuucuguuucuucagugc

SEQ ID NO: 781478 - RNA, 22 nt, Human
gcagcaccaaccagggccuguu

SEQ ID NO: 781479 - RNA, 22 nt, Human
uacugcaugggugcaugcugcu

SEQ ID NO: 781480 - RNA, 22 nt, Human
uggcccugcuggccaaaggcua

SEQ ID NO: 781481 - RNA, 23 nt, Human
uccuccugagugagagugccagc

SEQ ID NO: 781482 - RNA, 22 nt, Human
aaagcaugcuacuuuauauagg

SEQ ID NO: 781483 - RNA, 18 nt, Human
cucauguguggucccagc

SEQ ID NO: 781484 - RNA, 22 nt, Human
aggagcugaaacuucucauaug

SEQ ID NO: 781485 - RNA, 22 nt, Human
uucaaaaagguauguucaaguc

SEQ ID NO: 781486 - RNA, 16 nt, Human
uggcagagguucagcc

SEQ ID NO: 781487 - RNA, 22 nt, Human
gcagggcucugcuguaguccua

SEQ ID NO: 781488 - RNA, 22 nt, Human
gguuaaacacuuuggaaguggc

SEQ ID NO: 781489 - RNA, 22 nt, Human
acaggcacaacugaguagacuc

SEQ ID NO: 781490 - RNA, 22 nt, Human
caucacuguccucagcauucca

SEQ ID NO: 781491 - RNA, 22 nt, Human
aucuugaaauacuuucuagaau

SEQ ID NO: 781492 - RNA, 22 nt, Human
ucagcuuggacagcuugguuga

SEQ ID NO: 781493 - RNA, 22 nt, Human
aaugucauagcaaagagaguga

SEQ ID NO: 781494 - RNA, 22 nt, Human
cugcccugggugcuggggaucc

SEQ ID NO: 781495 - RNA, 21 nt, Human
gagacagcccagugccagggc

SEQ ID NO: 781496 - RNA, 22 nt, Human
cucucagaaguuuaugucagaa

SEQ ID NO: 781497 - RNA, 22 nt, Human
cagcccuugcgacacccuggcu

SEQ ID NO: 781498 - RNA, 22 nt, Human
ugaaacaaugugaaguugcuga

SEQ ID NO: 781499 - RNA, 22 nt, Human
aagugcauaguaauggagucaa

SEQ ID NO: 781500 - RNA, 22 nt, Human
uaggcacuggggaggcagcaug

SEQ ID NO: 781501 - RNA, 22 nt, Human
gcccuguggacccaggaacucu

SEQ ID NO: 781502 - RNA, 22 nt, Human
cacauuucugugagucaauauu

SEQ ID NO: 781503 - RNA, 22 nt, Human
acaguguugaggugcuuguuuc

SEQ ID NO: 781504 - RNA, 22 nt, Human
cuguaguugaugauuucugaua

SEQ ID NO: 781505 - RNA, 22 nt, Human
aaugcuaucggcucuaagcaug

SEQ ID NO: 781506 - RNA, 22 nt, Human
aaguucaagaucaagguuccag

SEQ ID NO: 781507 - RNA, 22 nt, Human
guucacaguucagccuguaaca

SEQ ID NO: 781508 - RNA, 22 nt, Human
ucagacagugugaucagucucu

SEQ ID NO: 781509 - RNA, 22 nt, Human
ugagccagguuuuccaucauuc

SEQ ID NO: 781510 - RNA, 22 nt, Human
aagcugccugccacgcuagaua

SEQ ID NO: 781511 - RNA, 22 nt, Human
gggggcaguaaggauauggaaa

SEQ ID NO: 781512 - RNA, 22 nt, Human
caaugucaaggagaccaaaacg

SEQ ID NO: 781513 - RNA, 22 nt, Human
gaggagagagggacugucugca

SEQ ID NO: 781514 - RNA, 22 nt, Human
cucagggcuggaaagccaggaa

SEQ ID NO: 781515 - RNA, 19 nt, Human
cagaacaggaccaggggcc

SEQ ID NO: 781516 - RNA, 22 nt, Human
cuuuacuguucuucugugggaa

SEQ ID NO: 781517 - RNA, 22 nt, Human
cuggagagaauguucauugcag

SEQ ID NO: 781518 - RNA, 22 nt, Human
ggacaggcccucuggucagcuu

SEQ ID NO: 781519 - RNA, 22 nt, Human
uaaaggcaaacucuccaaggau

SEQ ID NO: 781520 - RNA, 22 nt, Human
ggcccagagcucccuggcaccu

SEQ ID NO: 781521 - RNA, 22 nt, Human
aggguccugggugcaguugcuu

SEQ ID NO: 781522 - RNA, 22 nt, Human
uucagcagugcagacacccagu

SEQ ID NO: 781523 - RNA, 22 nt, Human
aguguguguuugggcgguuuau

SEQ ID NO: 781524 - RNA, 22 nt, Human
cugugcuugcggguguggagcc

SEQ ID NO: 781525 - RNA, 22 nt, Human
ugagccagccucagaagucacg

SEQ ID NO: 781526 - RNA, 22 nt, Human
auuaagacuauugauauuuaca

SEQ ID NO: 781527 - RNA, 22 nt, Human
aaagauugaucaugaauugaca

SEQ ID NO: 781528 - RNA, 22 nt, Human
gcuauucauggagcauguacug

SEQ ID NO: 781529 - RNA, 22 nt, Human
ucacagaaaucuguuuuuucua

SEQ ID NO: 781530 - RNA, 22 nt, Human
cagcuauucucugaaaugaaua

SEQ ID NO: 781531 - RNA, 22 nt, Human
aaagacuacacgggaaagagcu

SEQ ID NO: 781532 - RNA, 22 nt, Human
uccaggcuccugacuuuuuggg

SEQ ID NO: 781533 - RNA, 22 nt, Human
uggcagguuaacuuacaacugu

SEQ ID NO: 781534 - RNA, 22 nt, Human
uagaaaugaauguuuaaaaguc

SEQ ID NO: 781535 - RNA, 22 nt, Human
agaggucuuuuggucugcagaa

SEQ ID NO: 781536 - RNA, 22 nt, Human
guguuauuugagugggagcgug

SEQ ID NO: 781537 - RNA, 22 nt, Human
uaagacacaaauaucuuuuaca

SEQ ID NO: 781538 - RNA, 22 nt, Human
uugcuauaaauggucuaucuuu

SEQ ID NO: 781539 - RNA, 22 nt, Human
gcauugauuuaaacaucucucu

SEQ ID NO: 781540 - RNA, 23 nt, Human
agcaaugcugggagacucuguaa

SEQ ID NO: 781541 - RNA, 22 nt, Human
gcagggcuuagaaaugguggcu

SEQ ID NO: 781542 - RNA, 22 nt, Human
uucccacacuccauauaauuca

SEQ ID NO: 781543 - RNA, 22 nt, Human
ccuggccaggcauggagucaca

SEQ ID NO: 781544 - RNA, 22 nt, Human
augcauauggcuugagggaaua

SEQ ID NO: 781545 - RNA, 22 nt, Human
aggguccuaagccucagauaag

SEQ ID NO: 781546 - RNA, 22 nt, Human
aauguguguauuucuaggcgag

SEQ ID NO: 781547 - RNA, 22 nt, Human
ugagagcagaggugggcagccu

SEQ ID NO: 781548 - RNA, 22 nt, Human
aucuacauguugauuuaaagaa

SEQ ID NO: 781549 - RNA, 22 nt, Human
acagccaggcccagcacgcagg

SEQ ID NO: 781550 - RNA, 22 nt, Human
uucacuauaaaguuucaacuuu

SEQ ID NO: 781551 - RNA, 22 nt, Human
guaacauuuugagcaguaggcu

SEQ ID NO: 781552 - RNA, 22 nt, Human
caaagugccuguaccacuuugc

SEQ ID NO: 781553 - RNA, 20 nt, Human
uggcuccucuuggcuguggc

SEQ ID NO: 781554 - RNA, 22 nt, Human
agcuggccucacugcagaaugc

SEQ ID NO: 781555 - RNA, 22 nt, Human
ucuguucuaagcauucuaugug

SEQ ID NO: 781556 - RNA, 22 nt, Human
ucucagaaaagagcuucagaaa

SEQ ID NO: 781557 - RNA, 22 nt, Human
cagaaagcccuauguacagugg

SEQ ID NO: 781558 - RNA, 22 nt, Human
ggagcucugugucucuccugcc

SEQ ID NO: 781559 - RNA, 22 nt, Human
gagguagguguaggaggccugc

SEQ ID NO: 781560 - RNA, 22 nt, Human
gauuacaaaacucaucuaugac

SEQ ID NO: 781561 - RNA, 22 nt, Human
gcugcugggguggagaaacgcu

SEQ ID NO: 781562 - RNA, 22 nt, Human
uagcuggucuuuaagcauguaa

SEQ ID NO: 781563 - RNA, 18 nt, Human
aggugcccuccuuacacu

SEQ ID NO: 781564 - RNA, 18 nt, Human
uugcuuuguaagcuugca

SEQ ID NO: 781565 - RNA, 21 nt, Human
agcagaggcugccuggugacu

SEQ ID NO: 781566 - RNA, 22 nt, Human
uaacacauauuugcaguaagca

SEQ ID NO: 781567 - RNA, 22 nt, Human
ggccuuggccuagcccuccagg

SEQ ID NO: 781568 - RNA, 22 nt, Human
acagcaggaagcuggagggaaa

SEQ ID NO: 781569 - RNA, 20 nt, Human
aggucugaaugucagggcug

SEQ ID NO: 781570 - RNA, 22 nt, Human
uagcagagagguuucagcuaau

SEQ ID NO: 781571 - RNA, 22 nt, Human
caguaguggggagcccaguguc

SEQ ID NO: 781572 - RNA, 22 nt, Human
agaccugcagggccaggccugc

SEQ ID NO: 781573 - RNA, 22 nt, Human
gaucaauucaaacuauuuuccu

SEQ ID NO: 781574 - RNA, 22 nt, Human
ucugcagagauucugggcugag

SEQ ID NO: 781575 - RNA, 22 nt, Human
ucugccuuguugcaggcgcuau

SEQ ID NO: 781576 - RNA, 22 nt, Human
caacacagggguuaugccaugg

SEQ ID NO: 781577 - RNA, 22 nt, Human
aggcugugaguuuugucucaga

SEQ ID NO: 781578 - RNA, 22 nt, Human
agggugugcuguugggucuuuc

SEQ ID NO: 781579 - RNA, 22 nt, Human
gcacagcagccgaaaugcccuu

SEQ ID NO: 781580 - RNA, 22 nt, Human
cuuggacccacucccagaauug

SEQ ID NO: 781581 - RNA, 23 nt, Human
ggacacaggccuugucugcgccu

SEQ ID NO: 781582 - RNA, 22 nt, Human
ccagcccucgguagucccauag

SEQ ID NO: 781583 - RNA, 22 nt, Human
ucagaacaauuccuuuauaaca

SEQ ID NO: 781584 - RNA, 22 nt, Human
gcucucugucguuaugcuucau

SEQ ID NO: 781585 - RNA, 22 nt, Human
uccugagguuuuaaaacuauuc

SEQ ID NO: 781586 - RNA, 22 nt, Human
cucugaggcuuguucuauguau

SEQ ID NO: 781587 - RNA, 22 nt, Human
ccagggaagucacauugucuag

SEQ ID NO: 781588 - RNA, 22 nt, Human
caggaugagguagaggcagaua

SEQ ID NO: 781589 - RNA, 22 nt, Human
agccucagggcucugcgcagac

SEQ ID NO: 781590 - RNA, 22 nt, Human
gacaggcugugauggccgggag

SEQ ID NO: 781591 - RNA, 22 nt, Human
ccucuaaauuguuugaaguugg

SEQ ID NO: 781592 - RNA, 22 nt, Human
cucagcuacuugggaagcuuag

SEQ ID NO: 781593 - RNA, 18 nt, Human
gauguaaaauaguagcuu

SEQ ID NO: 781594 - RNA, 22 nt, Human
cucuccucagaacaggcccucu

SEQ ID NO: 781595 - RNA, 22 nt, Human
uuuaccaucugccacagauaug

SEQ ID NO: 781596 - RNA, 22 nt, Human
aggaucugugagugcugcagac

SEQ ID NO: 781597 - RNA, 22 nt, Human
acuaaaaacuacugccaauagc

SEQ ID NO: 781598 - RNA, 22 nt, Human
gcagcacauauaaacaaagaga

SEQ ID NO: 781599 - RNA, 22 nt, Human
acagugagcgguagugauugcu

SEQ ID NO: 781600 - RNA, 22 nt, Human
ugcaggcucugguuuauagugc

SEQ ID NO: 781601 - RNA, 22 nt, Human
cuggcugcgucugcucugacag

SEQ ID NO: 781602 - RNA, 22 nt, Human
cugcugggucuaugcaagugga

SEQ ID NO: 781603 - RNA, 22 nt, Human
aggaaaaauaaggcagcagggc

SEQ ID NO: 781604 - RNA, 22 nt, Human
acugaauagaaaugcucauagg

SEQ ID NO: 781605 - RNA, 22 nt, Human
auuaaauacugcaggcuaagca

SEQ ID NO: 781606 - RNA, 22 nt, Human
aggugagaaaacgaggguugca

SEQ ID NO: 781607 - RNA, 22 nt, Human
ggagucaggagcaggcugggcu

SEQ ID NO: 781608 - RNA, 22 nt, Human
gcccagcagcugguggagaagg

SEQ ID NO: 781609 - RNA, 22 nt, Human
acugcacagaaccuuagaauau

SEQ ID NO: 781610 - RNA, 21 nt, Human
agcucacaguucuguccuguc

SEQ ID NO: 781611 - RNA, 22 nt, Human
agaagcacaccaguagacaggg

SEQ ID NO: 781612 - RNA, 22 nt, Human
cugggccucauccccagaguuu

SEQ ID NO: 781613 - RNA, 22 nt, Human
gagccugugagccccaacucca

SEQ ID NO: 781614 - RNA, 22 nt, Human
gcccuggccuccuggaacaggc

SEQ ID NO: 781615 - RNA, 22 nt, Human
caaugcauuauucucccacuuc

SEQ ID NO: 781616 - RNA, 22 nt, Human
ccagaaagauaggaaaucaagu

SEQ ID NO: 781617 - RNA, 22 nt, Human
ccagagggccuuuggaguuauc

SEQ ID NO: 781618 - RNA, 20 nt, Human
uggccuuggggagcucacac

SEQ ID NO: 781619 - RNA, 22 nt, Human
uauacagaaagaauucaagucu

SEQ ID NO: 781620 - RNA, 22 nt, Human
auaaaugauucagcaggaaaua

SEQ ID NO: 781621 - RNA, 22 nt, Human
agagagaacacccucggcaugg

SEQ ID NO: 781622 - RNA, 22 nt, Human
aaaaguacuauuuuaacaaagu

SEQ ID NO: 781623 - RNA, 22 nt, Human
aagauacauuuucuucagagaa

SEQ ID NO: 781624 - RNA, 22 nt, Human
gggaguggguuuggccuaggcc

SEQ ID NO: 781625 - RNA, 22 nt, Human
acagccagaagucaggguggga

SEQ ID NO: 781626 - RNA, 22 nt, Human
cagucuguuucugagaaacaga

SEQ ID NO: 781627 - RNA, 22 nt, Human
uuucauguuacaguguaaaagu

SEQ ID NO: 781628 - RNA, 22 nt, Human
agaagcuugaaggagcagugac

SEQ ID NO: 781629 - RNA, 22 nt, Human
acagacaguaaauaguguggcu

SEQ ID NO: 781630 - RNA, 22 nt, Human
uugagguccaggugugggcagg

SEQ ID NO: 781631 - RNA, 22 nt, Human
ccaggaaaauaccaagcuuuaa

SEQ ID NO: 781632 - RNA, 22 nt, Human
ucucuuuacuuucaccaauuug

SEQ ID NO: 781633 - RNA, 22 nt, Human
acagagggucugggcacaggac

SEQ ID NO: 781634 - RNA, 22 nt, Human
ugucucugaaauauguggcucc

SEQ ID NO: 781635 - RNA, 21 nt, Human
uguauacacacauauauguac

SEQ ID NO: 781636 - RNA, 19 nt, Human
ggcuaaugucuuugaaaua

SEQ ID NO: 781637 - RNA, 22 nt, Human
uaggaaaucagagaaagaggug

SEQ ID NO: 781638 - RNA, 22 nt, Human
uccugccuucauacugcuguau

SEQ ID NO: 781639 - RNA, 22 nt, Human
uccuuccugcaggccaaguccu

SEQ ID NO: 781640 - RNA, 22 nt, Human
ucugagagagggucagaugcua

SEQ ID NO: 781641 - RNA, 22 nt, Human
ccuccuagaggaaccccagggc

SEQ ID NO: 781642 - RNA, 22 nt, Human
aacugaacagaacucagagauu

SEQ ID NO: 781643 - RNA, 22 nt, Human
caggucuccagcucagggucca

SEQ ID NO: 781644 - RNA, 22 nt, Human
acaugcuaauugcaaagucuug

SEQ ID NO: 781645 - RNA, 22 nt, Human
caggcugcggucggcucugguc

SEQ ID NO: 781646 - RNA, 18 nt, Human
cucucuggucuggauccc

SEQ ID NO: 781647 - RNA, 22 nt, Human
cugugaacaauagcagcaucuu

SEQ ID NO: 781648 - RNA, 22 nt, Human
caggcagcugggucaccguccc

SEQ ID NO: 781649 - RNA, 22 nt, Human
auagcuucagaauugagauauc

SEQ ID NO: 781650 - RNA, 22 nt, Human
uucaacagacccuucuuucuuu

SEQ ID NO: 781651 - RNA, 20 nt, Human
ccuggccaaugagauaggaa

SEQ ID NO: 781652 - RNA, 22 nt, Human
ucauccaugaagagugacagaa

SEQ ID NO: 781653 - RNA, 22 nt, Human
ugauuaaauuaauuaagaugag

SEQ ID NO: 781654 - RNA, 22 nt, Human
gcacaaacugcaauuacuuuug

SEQ ID NO: 781655 - RNA, 21 nt, Human
aucugaaguuugagaggaaag

SEQ ID NO: 781656 - RNA, 22 nt, Human
aaauuacagaucaccaaugcau

SEQ ID NO: 781657 - RNA, 22 nt, Human
gccucuccgagccacugccucu

SEQ ID NO: 781658 - RNA, 22 nt, Human
auucagcaugcaauuagguaau

SEQ ID NO: 781659 - RNA, 22 nt, Human
uccaggagaaggccauccagcg

SEQ ID NO: 781660 - RNA, 22 nt, Human
uuucagacaucacauggguuug

SEQ ID NO: 781661 - RNA, 21 nt, Human
auccuauuucugaaaaccugc

SEQ ID NO: 781662 - RNA, 22 nt, Human
uuuccccagguagauagauaau

SEQ ID NO: 781663 - RNA, 22 nt, Human
uaguggagaguuguuuugugca

SEQ ID NO: 781664 - RNA, 22 nt, Human
uaacauuugcugucuccuaugu

SEQ ID NO: 781665 - RNA, 19 nt, Human
ccaggagcaguggugagcu

SEQ ID NO: 781666 - RNA, 22 nt, Human
aggcagcauuucugcuuaucca

SEQ ID NO: 781667 - RNA, 22 nt, Human
uuaguuaguggggcugucaguc

SEQ ID NO: 781668 - RNA, 21 nt, Human
uguuuaauacauauuugugga

SEQ ID NO: 781669 - RNA, 22 nt, Human
agcccaguugcuccacgcugca

SEQ ID NO: 781670 - RNA, 21 nt, Human
gaauggcucgcgcgccacacu

SEQ ID NO: 781671 - RNA, 22 nt, Human
ccagucugcagccccuggggac

SEQ ID NO: 781672 - RNA, 22 nt, Human
uaaaccagguaaagaagcucuc

SEQ ID NO: 781673 - RNA, 22 nt, Human
uauaggcuuuuguugcagaaca

SEQ ID NO: 781674 - RNA, 22 nt, Human
ggcucuggugugaagcagccuc

SEQ ID NO: 781675 - RNA, 22 nt, Human
acauauuuugaaagcuuucuaa

SEQ ID NO: 781676 - RNA, 20 nt, Human
cacugaagacuucuugcuca

SEQ ID NO: 781677 - RNA, 22 nt, Human
gugggcuggacccuccugcucc

SEQ ID NO: 781678 - RNA, 22 nt, Human
agaagccauagucugggaggca

SEQ ID NO: 781679 - RNA, 22 nt, Human
aaaguugugaaaccgaacaugu

SEQ ID NO: 781680 - RNA, 22 nt, Human
uuacuguagcuugacauauguc

SEQ ID NO: 781681 - RNA, 22 nt, Human
uauuuggagaugggaucuucaa

SEQ ID NO: 781682 - RNA, 22 nt, Human
agcuggaagugcauuucucacu

SEQ ID NO: 781683 - RNA, 22 nt, Human
cccagggagguagcaggagaaa

SEQ ID NO: 781684 - RNA, 22 nt, Human
ucucagagggaaacaugaguga

SEQ ID NO: 781685 - RNA, 22 nt, Human
cuggcuuuccuugucugcaucc

SEQ ID NO: 781686 - RNA, 22 nt, Human
ggugaaggcacaagagggcaag

SEQ ID NO: 781687 - RNA, 22 nt, Human
uuguggcugugcaccgcugccu

SEQ ID NO: 781688 - RNA, 22 nt, Human
uuugacagcagauaaaauaaaa

SEQ ID NO: 781689 - RNA, 22 nt, Human
acagucucuccacacugcaggg

SEQ ID NO: 781690 - RNA, 22 nt, Human
agaauguagucuuggagauuua

SEQ ID NO: 781691 - RNA, 22 nt, Human
ucugggucuuaguuuucuugau

SEQ ID NO: 781692 - RNA, 22 nt, Human
agaucaaaaacuuaauggcuuu

SEQ ID NO: 781693 - RNA, 22 nt, Human
gucuggaggggagauuuggguu

SEQ ID NO: 781694 - RNA, 22 nt, Human
aaaguucucuaugguguaaaaa

SEQ ID NO: 781695 - RNA, 22 nt, Human
gguuggaggugggaauagcuag

SEQ ID NO: 781696 - RNA, 22 nt, Human
cggccgcagcagugucggccca

SEQ ID NO: 781697 - RNA, 22 nt, Human
guucuuuaaguggagaaggaaa

SEQ ID NO: 781698 - RNA, 22 nt, Human
agauacaccggaaccugaggcu

SEQ ID NO: 781699 - RNA, 22 nt, Human
aucuucaucaaguucacagugg

SEQ ID NO: 781700 - RNA, 22 nt, Human
agaugcugggaggcugagugca

SEQ ID NO: 781701 - RNA, 22 nt, Human
ucugggaauacacacugauuua

SEQ ID NO: 781702 - RNA, 22 nt, Human
ugaaagcacucacuucugcucu

SEQ ID NO: 781703 - RNA, 22 nt, Human
cugaacuucucugagccucagu

SEQ ID NO: 781704 - RNA, 23 nt, Human
agaaaguuugugccuugugacac

SEQ ID NO: 781705 - RNA, 22 nt, Human
agaaaaaucuuggcgcuugucu

SEQ ID NO: 781706 - RNA, 19 nt, Human
ccaguagagacagcugcag

SEQ ID NO: 781707 - RNA, 21 nt, Human
ccuggcuucagggugcacugg

SEQ ID NO: 781708 - RNA, 22 nt, Human
gaaaauaguucaucacaaugau

SEQ ID NO: 781709 - RNA, 22 nt, Human
ccaaguacagauuccuccacug

SEQ ID NO: 781710 - RNA, 22 nt, Human
ucagauuuaugaauauacuaug

SEQ ID NO: 781711 - RNA, 22 nt, Human
caguauuucauucagaauuguu

SEQ ID NO: 781712 - RNA, 22 nt, Human
uccucagcaaacacuucacucu

SEQ ID NO: 781713 - RNA, 22 nt, Human
ccaggccuuccaguacgcagaa

SEQ ID NO: 781714 - RNA, 22 nt, Human
uuuaacagguaaaguaaaugug

SEQ ID NO: 781715 - RNA, 22 nt, Human
cugcaccacagccugaggcagc

SEQ ID NO: 781716 - RNA, 22 nt, Human
uucugcucuuggcuuugcuggu

SEQ ID NO: 781717 - RNA, 22 nt, Human
cuggggccacaacggcgcacgc

SEQ ID NO: 781718 - RNA, 22 nt, Human
agcuccuggacgaacagggagu

SEQ ID NO: 781719 - RNA, 22 nt, Human
aucauuuugugacaaugccugu

SEQ ID NO: 781720 - RNA, 21 nt, Human
gcccagugauuucuucacagu

SEQ ID NO: 781721 - RNA, 22 nt, Human
uguagaugagucagggugcaug

SEQ ID NO: 781722 - RNA, 22 nt, Human
aucaguauccugcaguuucuau

SEQ ID NO: 781723 - RNA, 22 nt, Human
agcaagcauugcugguuagguc

SEQ ID NO: 781724 - RNA, 22 nt, Human
cagaugucauuucccaugcagc

SEQ ID NO: 781725 - RNA, 22 nt, Human
cagugcuauuuggacacaggga

SEQ ID NO: 781726 - RNA, 22 nt, Human
ugaaagcaugcuugccaagcuu

SEQ ID NO: 781727 - RNA, 22 nt, Human
uaggccacaaauaagauccugu

SEQ ID NO: 781728 - RNA, 22 nt, Human
agauacuaagcauuuccagcac

SEQ ID NO: 781729 - RNA, 22 nt, Human
auuuagacucucaccuccaccu

SEQ ID NO: 781730 - RNA, 22 nt, Human
aguguuuaucagacaagcccug

SEQ ID NO: 781731 - RNA, 22 nt, Human
cuguggcuuugugucuauugua

SEQ ID NO: 781732 - RNA, 19 nt, Human
ucacaugaagccuagagaa

SEQ ID NO: 781733 - RNA, 23 nt, Human
uggagaugccccacucccugucu

SEQ ID NO: 781734 - RNA, 22 nt, Human
aaguaacaaugcuguugaauug

SEQ ID NO: 781735 - RNA, 22 nt, Human
gcuuauuuucaccuucucucag

SEQ ID NO: 781736 - RNA, 22 nt, Human
cagcucugccacuuccuagcua

SEQ ID NO: 781737 - RNA, 22 nt, Human
acucugggcccacccucagagu

SEQ ID NO: 781738 - RNA, 22 nt, Human
cccugaggcaaaggcuagaguu

SEQ ID NO: 781739 - RNA, 22 nt, Human
auugacaauuagcccuuaggug

SEQ ID NO: 781740 - RNA, 22 nt, Human
acuuuagaaaaggaacagagga

SEQ ID NO: 781741 - RNA, 22 nt, Human
aggaaauguacaaaugaagaug

SEQ ID NO: 781742 - RNA, 22 nt, Human
aguuucucucaguauagaauag

SEQ ID NO: 781743 - RNA, 23 nt, Human
aucaccagcggaagcugcagacc

SEQ ID NO: 781744 - RNA, 22 nt, Human
aagaguggagaauaaaauagga

SEQ ID NO: 781745 - RNA, 22 nt, Human
agagguugggucugaggugaga

SEQ ID NO: 781746 - RNA, 22 nt, Human
auacacacauaugugaguuuug

SEQ ID NO: 781747 - RNA, 22 nt, Human
agcagcagaagguuugcaccca

SEQ ID NO: 781748 - RNA, 22 nt, Human
ucucuguagaccugaccagcac

SEQ ID NO: 781749 - RNA, 22 nt, Human
aagagucagcuucuguaugggu

SEQ ID NO: 781750 - RNA, 22 nt, Human
ugcauuggucuuaaucuucagg

SEQ ID NO: 781751 - RNA, 22 nt, Human
accuguuuuagucuuuaaucau

SEQ ID NO: 781752 - RNA, 22 nt, Human
gccagcccagcuccaggggaaa

SEQ ID NO: 781753 - RNA, 22 nt, Human
augcaguggcagcuccuggugu

SEQ ID NO: 781754 - RNA, 22 nt, Human
ccucccagugccuccagagcag

SEQ ID NO: 781755 - RNA, 22 nt, Human
ccaggaggaugguuguuaggug

SEQ ID NO: 781756 - RNA, 22 nt, Human
uucugaaaccuucaguaugaag

SEQ ID NO: 781757 - RNA, 22 nt, Human
uguaaugauguacuuagaagga

SEQ ID NO: 781758 - RNA, 22 nt, Human
uuuaucaguagcaaaguuuuaa

SEQ ID NO: 781759 - RNA, 22 nt, Human
gacaggcaccuugucugucuug

SEQ ID NO: 781760 - RNA, 22 nt, Human
guugaggaggcacucacuguca

SEQ ID NO: 781761 - RNA, 22 nt, Human
acacuuuaagcauuucacacug

SEQ ID NO: 781762 - RNA, 21 nt, Human
ugacuaauugugauaaagugc

SEQ ID NO: 781763 - RNA, 17 nt, Human
gcccacccuuaggagcu

SEQ ID NO: 781764 - RNA, 19 nt, Human
cucuggcuuccaaagcauc

SEQ ID NO: 781765 - RNA, 22 nt, Human
caacuuuucugugaauuuaagu

SEQ ID NO: 781766 - RNA, 22 nt, Human
ucacccaggcugguaugcagug

SEQ ID NO: 781767 - RNA, 22 nt, Human
uucagaauauccguuuaaguuu

SEQ ID NO: 781768 - RNA, 22 nt, Human
gcagaacauggaaagagaacua

SEQ ID NO: 781769 - RNA, 22 nt, Human
uagcuucuaauacuuaccaauu

SEQ ID NO: 781770 - RNA, 22 nt, Human
gaaggcauuuaggaacugcaau

SEQ ID NO: 781771 - RNA, 22 nt, Human
uuguggggcaacagcaggugaa

SEQ ID NO: 781772 - RNA, 22 nt, Human
ucugccugcuaacuccugcacc

SEQ ID NO: 781773 - RNA, 22 nt, Human
uggccagcccuucagccaugcc

SEQ ID NO: 781774 - RNA, 22 nt, Human
aagaaaugcagaaaugugcugg

SEQ ID NO: 781775 - RNA, 22 nt, Human
cgugagcaaaauggacacuccc

SEQ ID NO: 781776 - RNA, 22 nt, Human
aggcacuguggguguggccgga

SEQ ID NO: 781777 - RNA, 22 nt, Human
ggccuggcauggggacuaaggg

SEQ ID NO: 781778 - RNA, 22 nt, Human
ccuggagccccucuggccagcc

SEQ ID NO: 781779 - RNA, 22 nt, Human
aagauuuacuagcauaauagcu

SEQ ID NO: 781780 - RNA, 22 nt, Human
ucucaggcuguguguggaggac

SEQ ID NO: 781781 - RNA, 20 nt, Human
ccaggccugggccugcucua

SEQ ID NO: 781782 - RNA, 22 nt, Human
acuuccagcaccucaagcggaa

SEQ ID NO: 781783 - RNA, 22 nt, Human
ugcugggccaaagcaggguuuu

SEQ ID NO: 781784 - RNA, 22 nt, Human
ggcuuggaaauugcaggacaca

SEQ ID NO: 781785 - RNA, 22 nt, Human
aauucuauaggcaagcuauuuu

SEQ ID NO: 781786 - RNA, 22 nt, Human
gggagagguuacccgagcaacu

SEQ ID NO: 781787 - RNA, 22 nt, Human
gucaggucuuggaagauaggcu

SEQ ID NO: 781788 - RNA, 22 nt, Human
aagaugguuucuguagguuuau

SEQ ID NO: 781789 - RNA, 22 nt, Human
gcagggaccugccacugcuguc

SEQ ID NO: 781790 - RNA, 22 nt, Human
guggcuucaugaacacugauga

SEQ ID NO: 781791 - RNA, 22 nt, Human
aucagagugggucuggcaugag

SEQ ID NO: 781792 - RNA, 22 nt, Human
agaaaagggcaggagggauaca

SEQ ID NO: 781793 - RNA, 22 nt, Human
aucuuuaguagaggaauauauu

SEQ ID NO: 781794 - RNA, 22 nt, Human
guuuauacagugcaugguguua

SEQ ID NO: 781795 - RNA, 17 nt, Human
ugcauuguuggaaauuu

SEQ ID NO: 781796 - RNA, 22 nt, Human
gcccuggacagugacggugacc

SEQ ID NO: 781797 - RNA, 22 nt, Human
gaaucuaugccucauauagacc

SEQ ID NO: 781798 - RNA, 22 nt, Human
cuggggaaggcggugacugcgc

SEQ ID NO: 781799 - RNA, 22 nt, Human
uccugggcaaagaggggcagug

SEQ ID NO: 781800 - RNA, 22 nt, Human
ucacagagcacguaucaugccu

SEQ ID NO: 781801 - RNA, 22 nt, Human
cuaggcacuuguaaggccgcuc

SEQ ID NO: 781802 - RNA, 22 nt, Human
caaaggcaggugcugaauauuc

SEQ ID NO: 781803 - RNA, 22 nt, Human
ucagagaugcagugccaccuac

SEQ ID NO: 781804 - RNA, 22 nt, Human
augucuguuugcugagcccggc

SEQ ID NO: 781805 - RNA, 21 nt, Human
uccagcuccugccacuccuua

SEQ ID NO: 781806 - RNA, 22 nt, Human
uugucccugccccugcuugcuu

SEQ ID NO: 781807 - RNA, 22 nt, Human
gaggaaagaaccccagucaaua

SEQ ID NO: 781808 - RNA, 22 nt, Human
agggcucagcaucucauucugu

SEQ ID NO: 781809 - RNA, 22 nt, Human
uccuggacucaggaccacagga

SEQ ID NO: 781810 - RNA, 22 nt, Human
ucucagugacacucuucauaca

SEQ ID NO: 781811 - RNA, 22 nt, Human
cuuuucuuacucccgcaaggca

SEQ ID NO: 781812 - RNA, 22 nt, Human
ggcggguggcgaggcuucucgg

SEQ ID NO: 781813 - RNA, 22 nt, Human
gcaggcagccacgauucccuug

SEQ ID NO: 781814 - RNA, 22 nt, Human
gagcugagacacacuuuggcaa

SEQ ID NO: 781815 - RNA, 22 nt, Human
ggcuggaauguguggaugugau

SEQ ID NO: 781816 - RNA, 19 nt, Human
cugcuucaggcgccuugcc

SEQ ID NO: 781817 - RNA, 22 nt, Human
aauacaguaauuuugaugaguu

SEQ ID NO: 781818 - RNA, 22 nt, Human
uaugugugcauguauacauuaa

SEQ ID NO: 781819 - RNA, 22 nt, Human
uccaggagagguguggggacug

SEQ ID NO: 781820 - RNA, 22 nt, Human
acuuguuugaaucucucuagag

SEQ ID NO: 781821 - RNA, 22 nt, Human
gggcuggaagugcauugaugcu

SEQ ID NO: 781822 - RNA, 22 nt, Human
ugagaacugccuguauuuaucu

SEQ ID NO: 781823 - RNA, 22 nt, Human
auguggcuaguccaauuaauga

SEQ ID NO: 781824 - RNA, 22 nt, Human
ggcacugggcaccggcugaggg

SEQ ID NO: 781825 - RNA, 20 nt, Human
aaccugaggcaguguuccag

SEQ ID NO: 781826 - RNA, 22 nt, Human
aucaggaucacagaaacuuuua

SEQ ID NO: 781827 - RNA, 22 nt, Human
ccuaagaauuaaugaauacacc

SEQ ID NO: 781828 - RNA, 22 nt, Human
ccacagugguuguggcaugugg

SEQ ID NO: 781829 - RNA, 22 nt, Human
ucugggcuuuacacugugcuua

SEQ ID NO: 781830 - RNA, 22 nt, Human
cucaggaguaguucagcagcug

SEQ ID NO: 781831 - RNA, 22 nt, Human
uuccauccuaauaaaagaaguu

SEQ ID NO: 781832 - RNA, 22 nt, Human
aaacaugagcauuucuguuuaa

SEQ ID NO: 781833 - RNA, 22 nt, Human
uuccauccaugucccguuucug

SEQ ID NO: 781834 - RNA, 22 nt, Human
ucuggcugcugcgugagugcuu

SEQ ID NO: 781835 - RNA, 22 nt, Human
gagcauuuuugucugcauuuua

SEQ ID NO: 781836 - RNA, 22 nt, Human
guguauguucuacuuaauauua

SEQ ID NO: 781837 - RNA, 23 nt, Human
uugggcuggcucucgaugccucu

SEQ ID NO: 781838 - RNA, 22 nt, Human
uauucuugacugcuuacuaugu

SEQ ID NO: 781839 - RNA, 22 nt, Human
auuagcaauugcccugugcaau

SEQ ID NO: 781840 - RNA, 22 nt, Human
ugugugagacaauuggcugugg

SEQ ID NO: 781841 - RNA, 22 nt, Human
agcaaagcucaugacauuacag

SEQ ID NO: 781842 - RNA, 22 nt, Human
aggggcuccaaggaaguuuggg

SEQ ID NO: 781843 - RNA, 22 nt, Human
agcagccaaaugaagauuuuac

SEQ ID NO: 781844 - RNA, 22 nt, Human
uuuucuguauuauugugcuuca

SEQ ID NO: 781845 - RNA, 22 nt, Human
uauuaacauuuuaugaaaauaa

SEQ ID NO: 781846 - RNA, 22 nt, Human
agcuaccuggcuuaucacuguc

SEQ ID NO: 781847 - RNA, 22 nt, Human
uguuugcucugacuaucuugcg

SEQ ID NO: 781848 - RNA, 22 nt, Human
ccuccugguaauuagcgaaagg

SEQ ID NO: 781849 - RNA, 22 nt, Human
uauggcuucucagucaugaaaa

SEQ ID NO: 781850 - RNA, 22 nt, Human
aaaaugcaaaccuaccuacaua

SEQ ID NO: 781851 - RNA, 22 nt, Human
guccagccaggcugcagcaccc

SEQ ID NO: 781852 - RNA, 22 nt, Human
gacuucuccagacugccuggua

SEQ ID NO: 781853 - RNA, 22 nt, Human
ccauggcuuucuuucauuguaa

SEQ ID NO: 781854 - RNA, 23 nt, Human
cccaggagccugaguccucucug

SEQ ID NO: 781855 - RNA, 22 nt, Human
ggagauggcuggcagguagaug

SEQ ID NO: 781856 - RNA, 22 nt, Human
uagcacagggcauaugcggugg

SEQ ID NO: 781857 - RNA, 22 nt, Human
cucaggguaaugaaagacgaau

SEQ ID NO: 781858 - RNA, 22 nt, Human
cagaauuauaguugcuuuuuaa

SEQ ID NO: 781859 - RNA, 22 nt, Human
augcugugucuagcaggaacac

SEQ ID NO: 781860 - RNA, 22 nt, Human
aggcugaggcaagaggaucacu

SEQ ID NO: 781861 - RNA, 22 nt, Human
ugcuucuggcacuugagggggu

SEQ ID NO: 781862 - RNA, 22 nt, Human
aggccagcauucucucuccagg

SEQ ID NO: 781863 - RNA, 22 nt, Human
acuuugcaaauaaacucucuaa

SEQ ID NO: 781864 - RNA, 22 nt, Human
uacauucuggaaaggcacagac

SEQ ID NO: 781865 - RNA, 23 nt, Human
agccaggggaucuugggcccugg

SEQ ID NO: 781866 - RNA, 22 nt, Human
ugucugucuuuagugagauugc

SEQ ID NO: 781867 - RNA, 22 nt, Human
cucagagauauagucccugcuu

SEQ ID NO: 781868 - RNA, 22 nt, Human
caguuaaaaugugcuauaagaa

SEQ ID NO: 781869 - RNA, 22 nt, Human
augugaaauagcuggauaugaa

SEQ ID NO: 781870 - RNA, 22 nt, Human
acugggaggcaaagagcaagga

SEQ ID NO: 781871 - RNA, 22 nt, Human
caggggcucugggugaugugag

SEQ ID NO: 781872 - RNA, 22 nt, Human
agaaugugaagauuuugaauua

SEQ ID NO: 781873 - RNA, 22 nt, Human
ucugucacaaguaauccuuuuc

SEQ ID NO: 781874 - RNA, 22 nt, Human
acaggaaagagcuaggcauagg

SEQ ID NO: 781875 - RNA, 22 nt, Human
uucuccagagggcucugcagga

SEQ ID NO: 781876 - RNA, 22 nt, Human
gcuggcuggaacuagcaguugg

SEQ ID NO: 781877 - RNA, 22 nt, Human
auaugagagaggaaagauuuua

SEQ ID NO: 781878 - RNA, 22 nt, Human
gcagcccacagcuggaggccua

SEQ ID NO: 781879 - RNA, 22 nt, Human
augaguucauacuuucaguacc

SEQ ID NO: 781880 - RNA, 22 nt, Human
gccgugcgugcgcaggugcugu

SEQ ID NO: 781881 - RNA, 22 nt, Human
agaaguaucuugggaaggcacu

SEQ ID NO: 781882 - RNA, 22 nt, Human
ccuacucugagcgccuccgcau

SEQ ID NO: 781883 - RNA, 22 nt, Human
ugcuguguucuccugacucacc

SEQ ID NO: 781884 - RNA, 22 nt, Human
ugguccuguagcucucuaaguu

SEQ ID NO: 781885 - RNA, 22 nt, Human
cagaguuuuauguaugcaugua

SEQ ID NO: 781886 - RNA, 22 nt, Human
ccagcugcugugaggaccacag

SEQ ID NO: 781887 - RNA, 19 nt, Human
gggcacagccuccccccag

SEQ ID NO: 781888 - RNA, 22 nt, Human
aggguggcaccacauaucauag

SEQ ID NO: 781889 - RNA, 22 nt, Human
uccuggcucuaaguccugagug

SEQ ID NO: 781890 - RNA, 22 nt, Human
ugcagaggagcuggaaggcugg

SEQ ID NO: 781891 - RNA, 21 nt, Human
gaauggcaccauuagcauaua

SEQ ID NO: 781892 - RNA, 22 nt, Human
agcagacauggcuuggaugugg

SEQ ID NO: 781893 - RNA, 22 nt, Human
agagugacagccacugcaguaa

SEQ ID NO: 781894 - RNA, 22 nt, Human
uagauuucuaacagugugcuug

SEQ ID NO: 781895 - RNA, 22 nt, Human
gguccuggcagcucugugucca

SEQ ID NO: 781896 - RNA, 22 nt, Human
agcugggucuugggccaggaga

SEQ ID NO: 781897 - RNA, 22 nt, Human
cagucucuggcagcugcuggcc

SEQ ID NO: 781898 - RNA, 22 nt, Human
aagcccuguaaauugcccuuaa

SEQ ID NO: 781899 - RNA, 22 nt, Human
gcuccagaugaaaggccagagg

SEQ ID NO: 781900 - RNA, 22 nt, Human
cccaggagguguagcugcgugg

SEQ ID NO: 781901 - RNA, 22 nt, Human
cuuuuugucucuguccugauga

SEQ ID NO: 781902 - RNA, 22 nt, Human
ccagucaaguugacacaccaag

SEQ ID NO: 781903 - RNA, 22 nt, Human
aauuggcuuccauuuucuguuu

SEQ ID NO: 781904 - RNA, 22 nt, Human
gcagaggucucuucaaaauaau

SEQ ID NO: 781905 - RNA, 22 nt, Human
gcuccaagguauccaccagggu

SEQ ID NO: 781906 - RNA, 22 nt, Human
guacaauaacuagucuuauagu

SEQ ID NO: 781907 - RNA, 22 nt, Human
cacauggguggauggaugcaug

SEQ ID NO: 781908 - RNA, 22 nt, Human
uucuuggcauuuucccauuugg

SEQ ID NO: 781909 - RNA, 22 nt, Human
cagcagucaggcaaaugggagg

SEQ ID NO: 781910 - RNA, 22 nt, Human
gggcaguggguggcugcagccu

SEQ ID NO: 781911 - RNA, 22 nt, Human
aaguuucugauauuguuaaagc

SEQ ID NO: 781912 - RNA, 22 nt, Human
uuuauuccaaagcuugcacuuu

SEQ ID NO: 781913 - RNA, 22 nt, Human
uaaugcacauagaaguacuuag

SEQ ID NO: 781914 - RNA, 20 nt, Human
ucacuguaauugccuacauu

SEQ ID NO: 781915 - RNA, 17 nt, Human
ucuccuggcucuaucag

SEQ ID NO: 781916 - RNA, 22 nt, Human
uacuacauacagaauuuagaga

SEQ ID NO: 781917 - RNA, 22 nt, Human
ucccuggcacaagaaggcuguc

SEQ ID NO: 781918 - RNA, 22 nt, Human
cacauuuaaagguugaagcuga

SEQ ID NO: 781919 - RNA, 22 nt, Human
uuucuuggucuucccgaccugg

SEQ ID NO: 781920 - RNA, 20 nt, Human
ucugccacuuuuucugucac

SEQ ID NO: 781921 - RNA, 20 nt, Human
ucacuguaacauuugggggg

SEQ ID NO: 781922 - RNA, 22 nt, Human
ucuaugucucuggaaggagugu

SEQ ID NO: 781923 - RNA, 22 nt, Human
ucugcuguuuacugugugauau

SEQ ID NO: 781924 - RNA, 22 nt, Human
ccagcagcucccucaggguccg

SEQ ID NO: 781925 - RNA, 22 nt, Human
augucccugagggucucucuga

SEQ ID NO: 781926 - RNA, 22 nt, Human
acagcuggaggucugugagcac

SEQ ID NO: 781927 - RNA, 22 nt, Human
gccugccuucggugcgcagcgg

SEQ ID NO: 781928 - RNA, 22 nt, Human
agucacuguuuaaucuagcuaa

SEQ ID NO: 781929 - RNA, 21 nt, Human
acugaacuuguguucuagagg

SEQ ID NO: 781930 - RNA, 22 nt, Human
caguguuuagcacagugcuugg

SEQ ID NO: 781931 - RNA, 22 nt, Human
ucucugccacagcuucugccuu

SEQ ID NO: 781932 - RNA, 22 nt, Human
ucuccucuauuucuguauguau

SEQ ID NO: 781933 - RNA, 22 nt, Human
cugccuuggcccuaguucaugg

SEQ ID NO: 781934 - RNA, 22 nt, Human
agugacauuauuuuguguacua

SEQ ID NO: 781935 - RNA, 22 nt, Human
accaugucauuuauuggccaaa

SEQ ID NO: 781936 - RNA, 22 nt, Human
cccugccuacaggguuuucuuu

SEQ ID NO: 781937 - RNA, 21 nt, Human
gcagcaugagaaagccccaaa

SEQ ID NO: 781938 - RNA, 22 nt, Human
aucccugugacgagcaucccua

SEQ ID NO: 781939 - RNA, 22 nt, Human
cuccccacgccuggacuaagag

SEQ ID NO: 781940 - RNA, 22 nt, Human
gucugcccugcagacaugccuc

SEQ ID NO: 781941 - RNA, 22 nt, Human
ccuuuguucacuggagagugga

SEQ ID NO: 781942 - RNA, 22 nt, Human
ccagcuggaacggcagcccagc

SEQ ID NO: 781943 - RNA, 22 nt, Human
uguguccugugaucucuagggu

SEQ ID NO: 781944 - RNA, 20 nt, Human
cugaccagcagccugucucc

SEQ ID NO: 781945 - RNA, 22 nt, Human
uccagcagguccgagacaaguu

SEQ ID NO: 781946 - RNA, 22 nt, Human
gucccucugccugugguucucu

SEQ ID NO: 781947 - RNA, 22 nt, Human
uaaguauguuagaaaaucaagu

SEQ ID NO: 781948 - RNA, 22 nt, Human
cagcuauuguucuguauaauga

SEQ ID NO: 781949 - RNA, 22 nt, Human
cccagccugaucucggccagcu

SEQ ID NO: 781950 - RNA, 22 nt, Human
uguuugcucugacuaucuugcg

SEQ ID NO: 781951 - RNA, 19 nt, Human
agcagagcagggccguggg

SEQ ID NO: 781952 - RNA, 22 nt, Human
uccugucucaguguauuugcag

SEQ ID NO: 781953 - RNA, 22 nt, Human
gcugcccauugcucucccacuc

SEQ ID NO: 781954 - RNA, 22 nt, Human
guucucugccggcaccuacccg

SEQ ID NO: 781955 - RNA, 22 nt, Human
uuucuucucacccaggacagag

SEQ ID NO: 781956 - RNA, 22 nt, Human
ugucccuggacuccaggagcca

SEQ ID NO: 781957 - RNA, 17 nt, Human
uguguaaguugcauaga

SEQ ID NO: 781958 - RNA, 22 nt, Human
uacuguauacuacugcuguucu

SEQ ID NO: 781959 - RNA, 22 nt, Human
cucuggcaauugcugcugacuc

SEQ ID NO: 781960 - RNA, 22 nt, Human
uuucucuuucaaucugcaguac

SEQ ID NO: 781961 - RNA, 22 nt, Human
uugcaguuuugacagaccaaau

SEQ ID NO: 781962 - RNA, 22 nt, Human
ggaagccaguugcuuggugugg

SEQ ID NO: 781963 - RNA, 22 nt, Human
augcacuaugaugagcuagucu

SEQ ID NO: 781964 - RNA, 22 nt, Human
uuuccuguccugguacuuggca

SEQ ID NO: 781965 - RNA, 22 nt, Human
cucugccagccaaagucaucac

SEQ ID NO: 781966 - RNA, 22 nt, Human
cucccugggccucaguuucucu

SEQ ID NO: 781967 - RNA, 19 nt, Human
cucugccucuggcuguggc

SEQ ID NO: 781968 - RNA, 22 nt, Human
auuuccuguaggggcuugcgaa

SEQ ID NO: 781969 - RNA, 22 nt, Human
auucugcugccuaguuuaugaa

SEQ ID NO: 781970 - RNA, 22 nt, Human
ccaggcauccauugcuuccucu

SEQ ID NO: 781971 - RNA, 22 nt, Human
aauaucuagccuuuagcagcuu

SEQ ID NO: 781972 - RNA, 22 nt, Human
cugucacagcccgcgucuccuc

SEQ ID NO: 781973 - RNA, 22 nt, Human
cccuuguuuuugaguacaauag

SEQ ID NO: 781974 - RNA, 22 nt, Human
uugguuaccuucagaaaugagu

SEQ ID NO: 781975 - RNA, 20 nt, Human
ucucccugcccaucucagau

SEQ ID NO: 781976 - RNA, 22 nt, Human
ucugccaucaagaugcucuggc

SEQ ID NO: 781977 - RNA, 22 nt, Human
cagggcucgcucgcucgcucgc

SEQ ID NO: 781978 - RNA, 22 nt, Human
cagggcuccccagagagccucu

SEQ ID NO: 781979 - RNA, 17 nt, Human
uaaguccuaguuauuuu

SEQ ID NO: 781980 - RNA, 22 nt, Human
cugaccaguccuuagcaccugg

SEQ ID NO: 781981 - RNA, 23 nt, Human
aguacauuugacccaaauaagcu

SEQ ID NO: 781982 - RNA, 18 nt, Human
cugccagugugcucuccg

SEQ ID NO: 781983 - RNA, 19 nt, Human
ugguucuccuuccacaguc

SEQ ID NO: 781984 - RNA, 22 nt, Human
uggcagccugcgugaaggagcu

SEQ ID NO: 781985 - RNA, 22 nt, Human
cagggccugccugguuccugga

SEQ ID NO: 781986 - RNA, 22 nt, Human
cucuagcucccagggagcgucu

SEQ ID NO: 781987 - RNA, 22 nt, Human
uuguuuguaaggcucuuagaau

SEQ ID NO: 781988 - RNA, 22 nt, Human
uuucuaguggguauucccuguu

SEQ ID NO: 781989 - RNA, 22 nt, Human
gucugcccuuggccugggacuu

SEQ ID NO: 781990 - RNA, 22 nt, Human
ugcccauggcaggauuucugaa

SEQ ID NO: 781991 - RNA, 19 nt, Human
gcagcugugggaagagcca

SEQ ID NO: 781992 - RNA, 22 nt, Human
ugucuguccaucugucugggac

SEQ ID NO: 781993 - RNA, 22 nt, Human
gugcuggggagauaggaagaga

SEQ ID NO: 781994 - RNA, 22 nt, Human
ccaggcuccccaggaggcccuu

SEQ ID NO: 781995 - RNA, 18 nt, Human
cugccuguugcugagagg

SEQ ID NO: 781996 - RNA, 22 nt, Human
guucucucagcgauagugaugg

SEQ ID NO: 781997 - RNA, 22 nt, Human
cccugauguuuucucugccuuu

SEQ ID NO: 781998 - RNA, 22 nt, Human
cuggcagcucugagucccuucu

SEQ ID NO: 781999 - RNA, 23 nt, Human
aagugcucaguggacagcauugc

SEQ ID NO: 782000 - RNA, 22 nt, Human
aaauacaguggcagcagauaau

SEQ ID NO: 782001 - RNA, 21 nt, Human
uccugccuuaguccagagcag

SEQ ID NO: 782002 - RNA, 21 nt, Human
ggagucagggucuggcugggg

SEQ ID NO: 782003 - RNA, 22 nt, Human
cuucucuuggguguggugucuu

SEQ ID NO: 782004 - RNA, 22 nt, Human
cuuccugcaacaccuguguugc

SEQ ID NO: 782005 - RNA, 22 nt, Human
gcagccuccgcacugcgagucc

SEQ ID NO: 782006 - RNA, 22 nt, Human
ggcuucuuagaauuugacuuac

SEQ ID NO: 782007 - RNA, 22 nt, Human
ugucuucuaccuugacagcauu

SEQ ID NO: 782008 - RNA, 22 nt, Human
cucugcaggcacccaggguggg

SEQ ID NO: 782009 - RNA, 22 nt, Human
uacauguuauuucacuauuggu

SEQ ID NO: 782010 - RNA, 22 nt, Human
uagaaguuaaaggaauacagaa

SEQ ID NO: 782011 - RNA, 22 nt, Human
uaucuuugguagcuuuccuaag

SEQ ID NO: 782012 - RNA, 22 nt, Human
uuggcaauauuuacugaaguug

SEQ ID NO: 782013 - RNA, 22 nt, Human
uauucacagcugccgcacucag

SEQ ID NO: 782014 - RNA, 22 nt, Human
auguuuguguuucccauucagg

SEQ ID NO: 782015 - RNA, 22 nt, Human
cagggacugagauccagacugu

SEQ ID NO: 782016 - RNA, 22 nt, Human
cuaguagcccauuuuggauacc

SEQ ID NO: 782017 - RNA, 22 nt, Human
cagaugaaguaggugacgagca

SEQ ID NO: 782018 - RNA, 22 nt, Human
auggcuguguuguuccucugaa

SEQ ID NO: 782019 - RNA, 22 nt, Human
agcuggguacacguugucacaa

SEQ ID NO: 782020 - RNA, 22 nt, Human
cucucuccuuagcugcagacca

SEQ ID NO: 782021 - RNA, 22 nt, Human
uucuacauugugaaguucuuua

SEQ ID NO: 782022 - RNA, 22 nt, Human
uucuccucagcaaggcagcuuu

SEQ ID NO: 782023 - RNA, 22 nt, Human
uccuggcaaagauguugguguu

SEQ ID NO: 782024 - RNA, 22 nt, Human
auuuccuggaggaauggaagca

SEQ ID NO: 782025 - RNA, 22 nt, Human
cuggcagcugcccgagaugccc

SEQ ID NO: 782026 - RNA, 22 nt, Human
guauuucuuuacauaugcucau

SEQ ID NO: 782027 - RNA, 22 nt, Human
cugagaguauuggcaggcuugg

SEQ ID NO: 782028 - RNA, 21 nt, Human
ucugcccacacuggccacugc

SEQ ID NO: 782029 - RNA, 22 nt, Human
uucuguucccuaggaccugggg

SEQ ID NO: 782030 - RNA, 22 nt, Human
uuuucuuggaguggcuguccuu

SEQ ID NO: 782031 - RNA, 22 nt, Human
cuuccucuguggccagagugua

SEQ ID NO: 782032 - RNA, 22 nt, Human
ugcccugcagacccugcagugu

SEQ ID NO: 782033 - RNA, 22 nt, Human
ucaucaucauucucccccacuu

SEQ ID NO: 782034 - RNA, 22 nt, Human
cagacucuugagcugauuguau

SEQ ID NO: 782035 - RNA, 22 nt, Human
aaugugcugguaacugcuuugc

SEQ ID NO: 782036 - RNA, 22 nt, Human
gugagagugguuuauguccaug

SEQ ID NO: 782037 - RNA, 22 nt, Human
ggcucucuuaacuggccauccu

SEQ ID NO: 782038 - RNA, 22 nt, Human
gcacuuguuuuauguuccugag

SEQ ID NO: 782039 - RNA, 22 nt, Human
cagggucuuggcgccaucaccc

SEQ ID NO: 782040 - RNA, 22 nt, Human
cucuccaggcgagguccuacug

SEQ ID NO: 782041 - RNA, 22 nt, Human
gagcucagccugaggccuggcu

SEQ ID NO: 782042 - RNA, 22 nt, Human
ucuuugcauggacauguguuuu

SEQ ID NO: 782043 - RNA, 22 nt, Human
gucaucaucaggcagaugcugc

SEQ ID NO: 782044 - RNA, 22 nt, Human
uccuuucugucuuuacucugga

SEQ ID NO: 782045 - RNA, 22 nt, Human
ucccacacagcccgcucaccgg

SEQ ID NO: 782046 - RNA, 22 nt, Human
agagugaaguaauuguuaggau

SEQ ID NO: 782047 - RNA, 22 nt, Human
ugcuuggagaaucagucccagc

SEQ ID NO: 782048 - RNA, 22 nt, Human
gcuugcuuuguaaauaucugug

SEQ ID NO: 782049 - RNA, 22 nt, Human
cccagccuuugcuuccugguuc

SEQ ID NO: 782050 - RNA, 22 nt, Human
ugcuccaucuagagcucugcag

SEQ ID NO: 782051 - RNA, 22 nt, Human
gcucccuggaauguuggcugcc

SEQ ID NO: 782052 - RNA, 22 nt, Human
agccccuugugggcgcacagca

SEQ ID NO: 782053 - RNA, 22 nt, Human
uugcuucacuacuucuaggcuc

SEQ ID NO: 782054 - RNA, 22 nt, Human
acagcuggccgaggcucaggga

SEQ ID NO: 782055 - RNA, 21 nt, Human
uuccuccucuggagaagaaga

SEQ ID NO: 782056 - RNA, 22 nt, Human
agcuggguguagggcuggacaa

SEQ ID NO: 782057 - RNA, 22 nt, Human
ccagcugggucccugcuggggc

SEQ ID NO: 782058 - RNA, 22 nt, Human
ggugagagaaaagaaacacugu

SEQ ID NO: 782059 - RNA, 22 nt, Human
ucugcuugugucuguccagccu

SEQ ID NO: 782060 - RNA, 22 nt, Human
ugucuuuagccacuugccucuu

SEQ ID NO: 782061 - RNA, 22 nt, Human
gagaugaagaggcccuuggagu

SEQ ID NO: 782062 - RNA, 19 nt, Human
cuggcuucaagcaguccuc

SEQ ID NO: 782063 - RNA, 22 nt, Human
ccaucuucucuugaaccuccuu

SEQ ID NO: 782064 - RNA, 22 nt, Human
uccugcagccauuagaggucaa

SEQ ID NO: 782065 - RNA, 22 nt, Human
ucugcucagccgaucugcuccg

SEQ ID NO: 782066 - RNA, 22 nt, Human
uagauuaucccugauuugucca

SEQ ID NO: 782067 - RNA, 22 nt, Human
cucucugggcccaguuggcacc

SEQ ID NO: 782068 - RNA, 22 nt, Human
gcuucuggaagcauaugcaaga

SEQ ID NO: 782069 - RNA, 22 nt, Human
cuagcagcauucuucuaguuag

SEQ ID NO: 782070 - RNA, 22 nt, Human
cugcaguucuucuccucaaggc

SEQ ID NO: 782071 - RNA, 23 nt, Human
uugcauuaauguggaggcacagg

SEQ ID NO: 782072 - RNA, 22 nt, Human
cuggagauaagcagucccaggc

SEQ ID NO: 782073 - RNA, 22 nt, Human
caaguaugagaaagcuauuacc

SEQ ID NO: 782074 - RNA, 22 nt, Human
ucuucaugucucugcuugaguc

SEQ ID NO: 782075 - RNA, 22 nt, Human
ccucccugccggcuggacuagu

SEQ ID NO: 782076 - RNA, 22 nt, Human
uuuguguuguacuucugugcau

SEQ ID NO: 782077 - RNA, 22 nt, Human
ccucucauagucuguauccuuu

SEQ ID NO: 782078 - RNA, 22 nt, Human
cugucucugauaagcucgaggg

SEQ ID NO: 782079 - RNA, 22 nt, Human
agcugggugcccgaagccacgu

SEQ ID NO: 782080 - RNA, 22 nt, Human
uggaaagaggaagugcccagca

SEQ ID NO: 782081 - RNA, 22 nt, Human
ucaugucccguugcuggcugcc

SEQ ID NO: 782082 - RNA, 22 nt, Human
uguaauguuagaaacaauugcu

SEQ ID NO: 782083 - RNA, 22 nt, Human
uucuuucugggguccuucggcu

SEQ ID NO: 782084 - RNA, 19 nt, Human
ucucccaugccugugucua

SEQ ID NO: 782085 - RNA, 22 nt, Human
acagcugggaacucacacagca

SEQ ID NO: 782086 - RNA, 22 nt, Human
ugccuggcugggcugcucaugg

SEQ ID NO: 782087 - RNA, 22 nt, Human
acuccuggguuccggagauucu

SEQ ID NO: 782088 - RNA, 20 nt, Human
uacaauauucccacuuugcu

SEQ ID NO: 782089 - RNA, 22 nt, Human
uucaguaugcugaaugauuuuu

SEQ ID NO: 782090 - RNA, 22 nt, Human
uuauuugcccauguuuagcaga

SEQ ID NO: 782091 - RNA, 22 nt, Human
caggagagcccggguccgggcu

SEQ ID NO: 782092 - RNA, 22 nt, Human
acccaggacaaaauaaccaggu

SEQ ID NO: 782093 - RNA, 21 nt, Human
ggcagcucagcagauggggac

SEQ ID NO: 782094 - RNA, 22 nt, Human
cuggccagaguuggagggugug

SEQ ID NO: 782095 - RNA, 22 nt, Human
cgaggcagggaagcugcaaaag

SEQ ID NO: 782096 - RNA, 21 nt, Human
uuugaaagugggugauucuuu

SEQ ID NO: 782097 - RNA, 22 nt, Human
aaaggccaagcaugagguggac

SEQ ID NO: 782098 - RNA, 22 nt, Human
cugggaaauggcuucgagcuca

SEQ ID NO: 782099 - RNA, 22 nt, Human
aggcugcugaggccaccacgcu

SEQ ID NO: 782100 - RNA, 22 nt, Human
cagcuuucaucagugacacuca

SEQ ID NO: 782101 - RNA, 22 nt, Human
agcagacauaucucaugucaca

SEQ ID NO: 782102 - RNA, 22 nt, Human
uuaaaugaggcugauguagauu

SEQ ID NO: 782103 - RNA, 22 nt, Human
ugcuagugcaggguuuucaguu

SEQ ID NO: 782104 - RNA, 22 nt, Human
caaaugauaccuauuacuaggc

SEQ ID NO: 782105 - RNA, 22 nt, Human
guggaauguccuugaucauaag

SEQ ID NO: 782106 - RNA, 22 nt, Human
uuugacauugccaauuugcuca

SEQ ID NO: 782107 - RNA, 22 nt, Human
ugucccucugaggcuucccugg

SEQ ID NO: 782108 - RNA, 22 nt, Human
ucuuugcaaaauacaacaaugg

SEQ ID NO: 782109 - RNA, 22 nt, Human
caaggccacuccagagacuggu

SEQ ID NO: 782110 - RNA, 22 nt, Human
uucuucuuuccuauaauuaauu

SEQ ID NO: 782111 - RNA, 22 nt, Human
cugcugugcagacagacucucu

SEQ ID NO: 782112 - RNA, 22 nt, Human
cucuggcuucuaccuugcaguu

SEQ ID NO: 782113 - RNA, 22 nt, Human
ucuucagaggaagucagucuuu

SEQ ID NO: 782114 - RNA, 22 nt, Human
uaauuccaaguugagacaugca

SEQ ID NO: 782115 - RNA, 22 nt, Human
gucuuuaugguaugaaaacuga

SEQ ID NO: 782116 - RNA, 20 nt, Human
gagauggacagaugaagggg

SEQ ID NO: 782117 - RNA, 22 nt, Human
cagauggaacacagaaaggaga

SEQ ID NO: 782118 - RNA, 20 nt, Human
gcccaagguccagaaggggg

SEQ ID NO: 782119 - RNA, 22 nt, Human
agcacauucugccuugcuuugc

SEQ ID NO: 782120 - RNA, 22 nt, Human
uuugaaguggaaaaggauuuaa

SEQ ID NO: 782121 - RNA, 22 nt, Human
ggacagcugcuuucaggccaca

SEQ ID NO: 782122 - RNA, 22 nt, Human
ucaggaggccaccaggaccugu

SEQ ID NO: 782123 - RNA, 22 nt, Human
uaacaguguggacuugagaucu

SEQ ID NO: 782124 - RNA, 21 nt, Human
agcagaggggacauguuugau

SEQ ID NO: 782125 - RNA, 22 nt, Human
uuauucuucuucucuugccagg

SEQ ID NO: 782126 - RNA, 22 nt, Human
ugaaaugagauaauuuaagugc

SEQ ID NO: 782127 - RNA, 22 nt, Human
aggccagcuuccagaggggcag

SEQ ID NO: 782128 - RNA, 21 nt, Human
ugaaugaggaggauggcauuu

SEQ ID NO: 782129 - RNA, 22 nt, Human
gacccaggagagaggguugcau

SEQ ID NO: 782130 - RNA, 22 nt, Human
uuugacauuggcuuauucuguu

SEQ ID NO: 782131 - RNA, 22 nt, Human
aaucuuucccuauuaaaugugg

SEQ ID NO: 782132 - RNA, 22 nt, Human
aggguggcaccuggaagggaug

SEQ ID NO: 782133 - RNA, 20 nt, Human
ugcugucguguuuucugcuu

SEQ ID NO: 782134 - RNA, 22 nt, Human
ggaggggagguccagcugaucu

SEQ ID NO: 782135 - RNA, 22 nt, Human
guaguucugcagugucaccuga

SEQ ID NO: 782136 - RNA, 22 nt, Human
aaaauuauagaucuagugccug

SEQ ID NO: 782137 - RNA, 22 nt, Human
acucuucuugcugcucauuaau

SEQ ID NO: 782138 - RNA, 22 nt, Human
ugaaggccagcucuuuaucagc

SEQ ID NO: 782139 - RNA, 22 nt, Human
ugucugugaccucuuaggcaag

SEQ ID NO: 782140 - RNA, 19 nt, Human
uucccaggaaaggggugca

SEQ ID NO: 782141 - RNA, 22 nt, Human
uuuauuuggcauccagggagaa

SEQ ID NO: 782142 - RNA, 22 nt, Human
uuuccaagacuccaguucuccc

SEQ ID NO: 782143 - RNA, 22 nt, Human
ucaggaugguguggaggaaaua

SEQ ID NO: 782144 - RNA, 22 nt, Human
acaucucaugaaugauaaauca

SEQ ID NO: 782145 - RNA, 17 nt, Human
acagagcacaucaagau

SEQ ID NO: 782146 - RNA, 22 nt, Human
aauaucaacaguguccuucuaa

SEQ ID NO: 782147 - RNA, 22 nt, Human
agucucugggcaugguugugac

SEQ ID NO: 782148 - RNA, 22 nt, Human
gacccaggaagcuacuucuggu

SEQ ID NO: 782149 - RNA, 22 nt, Human
gaaguacaguuuuaucuagcca

SEQ ID NO: 782150 - RNA, 22 nt, Human
agugcuuuccuucuugugacau

SEQ ID NO: 782151 - RNA, 22 nt, Human
aggcucagaggugagcaucugc

SEQ ID NO: 782152 - RNA, 22 nt, Human
gggcagcucuuugguauccuuc

SEQ ID NO: 782153 - RNA, 22 nt, Human
cagaggcagccgggggagaacg

SEQ ID NO: 782154 - RNA, 23 nt, Human
cccaggaguuucacugcaaaggu

SEQ ID NO: 782155 - RNA, 22 nt, Human
cugaacucuuuaugacagcuug

SEQ ID NO: 782156 - RNA, 22 nt, Human
uuuccaagagcuuauuucugaa

SEQ ID NO: 782157 - RNA, 22 nt, Human
ucucucagaggaagaggcagug

SEQ ID NO: 782158 - RNA, 22 nt, Human
ugaaggccagcagagugaaggc

SEQ ID NO: 782159 - RNA, 22 nt, Human
cucaagacugaucgcaguggaa

SEQ ID NO: 782160 - RNA, 22 nt, Human
aggcacagcacaccuggccccc

SEQ ID NO: 782161 - RNA, 22 nt, Human
uuuccagagcaugucugcucag

SEQ ID NO: 782162 - RNA, 22 nt, Human
cugcuuuguaaaauagacauaa

SEQ ID NO: 782163 - RNA, 22 nt, Human
gaggcugcuuugaugacaggag

SEQ ID NO: 782164 - RNA, 22 nt, Human
ugaggcaggaggauugcaggau

SEQ ID NO: 782165 - RNA, 22 nt, Human
ugcacauucacuuagguauugu

SEQ ID NO: 782166 - RNA, 22 nt, Human
aaggcaguagguguuucaaacu

SEQ ID NO: 782167 - RNA, 22 nt, Human
ccaggacaaguguggccauggc

SEQ ID NO: 782168 - RNA, 22 nt, Human
ugugcaggugcaggaagggggc

SEQ ID NO: 782169 - RNA, 22 nt, Human
aaauguuucuacuugugagcau

SEQ ID NO: 782170 - RNA, 22 nt, Human
ggaaaugacuuggugcuucguu

SEQ ID NO: 782171 - RNA, 22 nt, Human
aggcagcauuugaauccagguc

SEQ ID NO: 782172 - RNA, 16 nt, Human
aggaggggaauuagga

SEQ ID NO: 782173 - RNA, 23 nt, Human
cugcuguguuggucucgauggga

SEQ ID NO: 782174 - RNA, 22 nt, Human
ucagagaguuacacaaauuguu

SEQ ID NO: 782175 - RNA, 22 nt, Human
uugagaagaauguguugaguuu

SEQ ID NO: 782176 - RNA, 22 nt, Human
caggaugggauguagugggccc

SEQ ID NO: 782177 - RNA, 22 nt, Human
cagcugcuuuaguuuuccaucc

SEQ ID NO: 782178 - RNA, 22 nt, Human
augcugagcagagcugacaugc

SEQ ID NO: 782179 - RNA, 22 nt, Human
uagugcuuuaggccugaguguc

SEQ ID NO: 782180 - RNA, 22 nt, Human
uaucuguuguccaugcagaaag

SEQ ID NO: 782181 - RNA, 22 nt, Human
aggagacaucuaacuguagguu

SEQ ID NO: 782182 - RNA, 16 nt, Human
cuuccucuucacuggc

SEQ ID NO: 782183 - RNA, 19 nt, Human
uucuccaggcugcagaggg

SEQ ID NO: 782184 - RNA, 22 nt, Human
agugcugucaguuuuauagaua

SEQ ID NO: 782185 - RNA, 22 nt, Human
agucucuuuguggacucugccu

SEQ ID NO: 782186 - RNA, 22 nt, Human
cucagugugaaugcucaguaaa

SEQ ID NO: 782187 - RNA, 22 nt, Human
acaguggagaaggcaugaggcu

SEQ ID NO: 782188 - RNA, 22 nt, Human
uuugaaaggugucgagaugugu

SEQ ID NO: 782189 - RNA, 22 nt, Human
ucuuuuggaaaugaugugcagg

SEQ ID NO: 782190 - RNA, 22 nt, Human
uucaggaucauuuguuuuaucu

SEQ ID NO: 782191 - RNA, 22 nt, Human
uugcuuugccaccagaagucua

SEQ ID NO: 782192 - RNA, 22 nt, Human
auccagucaaaauuaguaaggu

SEQ ID NO: 782193 - RNA, 22 nt, Human
acuugcauuauauuuaucacaa

SEQ ID NO: 782194 - RNA, 22 nt, Human
ggcagaagauaggacagggaau

SEQ ID NO: 782195 - RNA, 22 nt, Human
gcucucuuuuuccagugguggu

SEQ ID NO: 782196 - RNA, 22 nt, Human
ggcaggcagaggcugagacagg

SEQ ID NO: 782197 - RNA, 22 nt, Human
cuuguaauuauaauguacuguu

SEQ ID NO: 782198 - RNA, 22 nt, Human
uuuuguuguaauauaccuaucc

SEQ ID NO: 782199 - RNA, 23 nt, Human
cuccccaguguccucaugcaucu

SEQ ID NO: 782200 - RNA, 22 nt, Human
ccaggcugggcuacaaguugag

SEQ ID NO: 782201 - RNA, 22 nt, Human
caggcagaguuagagcaacugg

SEQ ID NO: 782202 - RNA, 22 nt, Human
cgucuuccucuuacgaugcgcu

SEQ ID NO: 782203 - RNA, 22 nt, Human
aauccugugugacucuggggag

SEQ ID NO: 782204 - RNA, 20 nt, Human
agcugccccugggcacugcc

SEQ ID NO: 782205 - RNA, 22 nt, Human
gcagaggccuagguggaaggcc

SEQ ID NO: 782206 - RNA, 21 nt, Human
agcagaggcugccuggugacu

SEQ ID NO: 782207 - RNA, 22 nt, Human
acagugcuaaacacuucuugaa

SEQ ID NO: 782208 - RNA, 22 nt, Human
acucaggaagaaagcagcuggu

SEQ ID NO: 782209 - RNA, 22 nt, Human
auuugcuugugcuaugaaaguu

SEQ ID NO: 782210 - RNA, 22 nt, Human
cucucuguuaugcuuucaugaa

SEQ ID NO: 782211 - RNA, 22 nt, Human
ugaggcagcaauuguauuguau

SEQ ID NO: 782212 - RNA, 22 nt, Human
uucucagauccaucagaagucc

SEQ ID NO: 782213 - RNA, 23 nt, Human
gggcagcuuaagcuuguuuuucu

SEQ ID NO: 782214 - RNA, 22 nt, Human
uugauguacagaauuguucaca

SEQ ID NO: 782215 - RNA, 22 nt, Human
uuugaaaggaauuaggaugaca

SEQ ID NO: 782216 - RNA, 22 nt, Human
agggagcuuccgaacuacagcu

SEQ ID NO: 782217 - RNA, 22 nt, Human
cccaggaggcagagguugcagu

SEQ ID NO: 782218 - RNA, 22 nt, Human
ugcuuugggucucucuaguuuc

SEQ ID NO: 782219 - RNA, 22 nt, Human
agaggccacuuugccugugaug

SEQ ID NO: 782220 - RNA, 22 nt, Human
gaaacuguauguaguuuuuggg

SEQ ID NO: 782221 - RNA, 22 nt, Human
agcugaaagugcuuugaggacu

SEQ ID NO: 782222 - RNA, 22 nt, Human
uggcagcugucagaaugcaaau

SEQ ID NO: 782223 - RNA, 22 nt, Human
ugaaagggguugaguuacagcu

SEQ ID NO: 782224 - RNA, 22 nt, Human
gagggcauaguuaaauaggagg

SEQ ID NO: 782225 - RNA, 22 nt, Human
aaguaaaauguuuccuuuauua

SEQ ID NO: 782226 - RNA, 22 nt, Human
gucccaggugggcuccaccucu

SEQ ID NO: 782227 - RNA, 22 nt, Human
cccaugagguggagguugcagu

SEQ ID NO: 782228 - RNA, 22 nt, Human
uccaugagcuagcuuuccaaag

SEQ ID NO: 782229 - RNA, 22 nt, Human
aggcaguggaaggagaaagcaa

SEQ ID NO: 782230 - RNA, 22 nt, Human
ucugcuguucauucuuuuagcu

SEQ ID NO: 782231 - RNA, 22 nt, Human
ugaaaugauaucugauaacaaa

SEQ ID NO: 782232 - RNA, 18 nt, Human
uggcagcaggaagccauu

SEQ ID NO: 782233 - RNA, 22 nt, Human
ucagccucucugaguccagacc

SEQ ID NO: 782234 - RNA, 22 nt, Human
ucacccuugauaauguucuucu

SEQ ID NO: 782235 - RNA, 22 nt, Human
cagcugugaauugucuuaucua

SEQ ID NO: 782236 - RNA, 22 nt, Human
uuuguuuagaugguaaaucagu

SEQ ID NO: 782237 - RNA, 22 nt, Human
auggaguucuuuaaauucacag

SEQ ID NO: 782238 - RNA, 22 nt, Human
ugaaaugauguacaagaaggca

SEQ ID NO: 782239 - RNA, 22 nt, Human
aaaauaacuucuacuauuugca

SEQ ID NO: 782240 - RNA, 22 nt, Human
gggcagcugccagaggccaugg

SEQ ID NO: 782241 - RNA, 22 nt, Human
gugggagcuuuggcaucaggcu

SEQ ID NO: 782242 - RNA, 22 nt, Human
ucuucaucucagauuaacagga

SEQ ID NO: 782243 - RNA, 22 nt, Human
agaggcggagcuugcagugagc

SEQ ID NO: 782244 - RNA, 22 nt, Human
gggcagcugcagggauggugac

SEQ ID NO: 782245 - RNA, 22 nt, Human
uugugguuaaccgcacauuuuu

SEQ ID NO: 782246 - RNA, 22 nt, Human
guuuucaaggggauuuaacuga

SEQ ID NO: 782247 - RNA, 22 nt, Human
gccaggagccagcuucuuagca

SEQ ID NO: 782248 - RNA, 22 nt, Human
gaggggcagagguagagaacaa

SEQ ID NO: 782249 - RNA, 22 nt, Human
gaacuguaguuaauacuacaca

SEQ ID NO: 782250 - RNA, 22 nt, Human
gaggagaggccaucguuguuau

SEQ ID NO: 782251 - RNA, 21 nt, Human
uuagaaagcucacuacaguua

SEQ ID NO: 782252 - RNA, 22 nt, Human
auguuucaccaguuuuauaaga

SEQ ID NO: 782253 - RNA, 22 nt, Human
uguggaaaagaauaagggagau

SEQ ID NO: 782254 - RNA, 22 nt, Human
aggacagcccuugagagcacau

SEQ ID NO: 782255 - RNA, 22 nt, Human
gugacaguggucacuuguaguu

SEQ ID NO: 782256 - RNA, 22 nt, Human
cagaccagaaggaagccgacaa

SEQ ID NO: 782257 - RNA, 22 nt, Human
auacagauguugaauguuauau

SEQ ID NO: 782258 - RNA, 23 nt, Human
accaggagccaagaucucccugg

SEQ ID NO: 782259 - RNA, 22 nt, Human
ucauuucaaguucugacagcua

SEQ ID NO: 782260 - RNA, 22 nt, Human
aggggcucaaagugugcaggga

SEQ ID NO: 782261 - RNA, 22 nt, Human
aaagcagagguugcagugagcu

SEQ ID NO: 782262 - RNA, 22 nt, Human
guuugcauauuugcacaggaau

SEQ ID NO: 782263 - RNA, 22 nt, Human
gucaggaugggcagccaaacua

SEQ ID NO: 782264 - RNA, 19 nt, Human
uaaggccaaaaguaagugu

SEQ ID NO: 782265 - RNA, 21 nt, Human
gacaaagugaagcaggcagga

SEQ ID NO: 782266 - RNA, 22 nt, Human
uuucaaauagaaucuuuccaaa

SEQ ID NO: 782267 - RNA, 19 nt, Human
agucuuucccacucgucuu

SEQ ID NO: 782268 - RNA, 22 nt, Human
uuacuuuggguccugcuuauaa

SEQ ID NO: 782269 - RNA, 22 nt, Human
gggcagcuguaucugagcuuau

SEQ ID NO: 782270 - RNA, 22 nt, Human
cagucucuugcuucauuaguug

SEQ ID NO: 782271 - RNA, 22 nt, Human
gggcagcucugcccaucagagg

SEQ ID NO: 782272 - RNA, 22 nt, Human
aaauuauuaugccccucuauaa

SEQ ID NO: 782273 - RNA, 22 nt, Human
ccaugagacagcaacugaaagu

SEQ ID NO: 782274 - RNA, 22 nt, Human
gaauauuuuuaaagggacuaau

SEQ ID NO: 782275 - RNA, 22 nt, Human
uucauuaguucugaagaugucu

SEQ ID NO: 782276 - RNA, 22 nt, Human
ugguaauuaauuugauagguuc

SEQ ID NO: 782277 - RNA, 22 nt, Human
ucugggaaaugcuguuccuugu

SEQ ID NO: 782278 - RNA, 22 nt, Human
uaucuguuggcuccuaguugua

SEQ ID NO: 782279 - RNA, 22 nt, Human
uccaggagucuagccucaggcc

SEQ ID NO: 782280 - RNA, 22 nt, Human
gggcagcugccccucucugggc

SEQ ID NO: 782281 - RNA, 22 nt, Human
augcugugagugugccgcagag

SEQ ID NO: 782282 - RNA, 22 nt, Human
cugaacuuauugagugcuugcu

SEQ ID NO: 782283 - RNA, 22 nt, Human
auuacaaaagaagggagaaggu

SEQ ID NO: 782284 - RNA, 22 nt, Human
uaugaacucuggagucugagug

SEQ ID NO: 782285 - RNA, 22 nt, Human
ucagagaguuggaaagaauuaa

SEQ ID NO: 782286 - RNA, 22 nt, Human
gcuucccacagcuggacugggg

SEQ ID NO: 782287 - RNA, 22 nt, Human
ggaggggaggauuaaugacaaa

SEQ ID NO: 782288 - RNA, 22 nt, Human
uggcagcuggagggcaauggcc

SEQ ID NO: 782289 - RNA, 22 nt, Human
caaauguauaaauguacuuucu

SEQ ID NO: 782290 - RNA, 22 nt, Human
cauuuauuggcauguaguaggu

SEQ ID NO: 782291 - RNA, 22 nt, Human
uuuaaaaucagaugggaguugg

SEQ ID NO: 782292 - RNA, 22 nt, Human
cauuuguauagugcuuagacca

SEQ ID NO: 782293 - RNA, 22 nt, Human
ggauguugauugaauggccauu

SEQ ID NO: 782294 - RNA, 22 nt, Human
cucagaagaacaaaggcucuac

SEQ ID NO: 782295 - RNA, 22 nt, Human
uuaguuuucccaucuuuauggu

SEQ ID NO: 782296 - RNA, 22 nt, Human
uugcccagaguccacagcguac

SEQ ID NO: 782297 - RNA, 22 nt, Human
ucaaauaccagcaauuucaugu

SEQ ID NO: 782298 - RNA, 20 nt, Human
aucuucuuggccagcuugcu

SEQ ID NO: 782299 - RNA, 22 nt, Human
cauuuguuuagaagucuuuaua

SEQ ID NO: 782300 - RNA, 22 nt, Human
gcucaggaaauaguuuaguguu

SEQ ID NO: 782301 - RNA, 22 nt, Human
ucaggagauguaaccuuagcug

SEQ ID NO: 782302 - RNA, 22 nt, Human
aucuugcauuugcuaaaaugca

SEQ ID NO: 782303 - RNA, 22 nt, Human
gacccaggguauccagagcugc

SEQ ID NO: 782304 - RNA, 22 nt, Human
augcugugucaggaauuugaua

SEQ ID NO: 782305 - RNA, 18 nt, Human
agggagagaccgcggguc

SEQ ID NO: 782306 - RNA, 22 nt, Human
cccaggaguucgaggcuguagu

SEQ ID NO: 782307 - RNA, 22 nt, Human
aucugcuugaaugagcaacagg

SEQ ID NO: 782308 - RNA, 22 nt, Human
cuucuucauaggcaguccuguu

SEQ ID NO: 782309 - RNA, 22 nt, Human
aaagcagauucugaugcaguag

SEQ ID NO: 782310 - RNA, 22 nt, Human
cagguaaaaauaaauuugugag

SEQ ID NO: 782311 - RNA, 22 nt, Human
ucucccaggcugcccuguggac

SEQ ID NO: 782312 - RNA, 22 nt, Human
acagucauuagauacaaugucu

SEQ ID NO: 782313 - RNA, 22 nt, Human
acccaggauagagugcugcagu

SEQ ID NO: 782314 - RNA, 22 nt, Human
gcuguucucuguaacaugcauu

SEQ ID NO: 782315 - RNA, 22 nt, Human
aaugucugagucucuguauccc

SEQ ID NO: 782316 - RNA, 22 nt, Human
ucccaggaggugcuuccuagga

SEQ ID NO: 782317 - RNA, 22 nt, Human
uugcuucaguagcucuuuaaag

SEQ ID NO: 782318 - RNA, 22 nt, Human
ucucucuucaacccuuaacuag

SEQ ID NO: 782319 - RNA, 22 nt, Human
agcugcccuguggggaggguug

SEQ ID NO: 782320 - RNA, 22 nt, Human
auucugaguccaugggggcagg

SEQ ID NO: 782321 - RNA, 23 nt, Human
acuauaaaguuguucugauuuac

SEQ ID NO: 782322 - RNA, 22 nt, Human
uggaaggaagccaaggaagguu

SEQ ID NO: 782323 - RNA, 22 nt, Human
gcucaggaucagccaccucuuu

SEQ ID NO: 782324 - RNA, 22 nt, Human
ucagagaggcaauacuguuuaa

SEQ ID NO: 782325 - RNA, 22 nt, Human
uggcagcuccuggggccagcac

SEQ ID NO: 782326 - RNA, 22 nt, Human
agauggagaaugacaauuaagg

SEQ ID NO: 782327 - RNA, 22 nt, Human
cucaggauagcugcgcagccug

SEQ ID NO: 782328 - RNA, 22 nt, Human
augcaucuauucccaagggcag

SEQ ID NO: 782329 - RNA, 22 nt, Human
aaaaugaugcuguaauuuggca

SEQ ID NO: 782330 - RNA, 22 nt, Human
aguccaaggagagacagcauuu

SEQ ID NO: 782331 - RNA, 22 nt, Human
augcuguguccuagugaaagaa

SEQ ID NO: 782332 - RNA, 22 nt, Human
uauagccauuuccaguggcauc

SEQ ID NO: 782333 - RNA, 22 nt, Human
augcugugaaaaagaaggcuga

SEQ ID NO: 782334 - RNA, 22 nt, Human
gcuggcagggacagcugcgugu

SEQ ID NO: 782335 - RNA, 21 nt, Human
cacucaggguaugugccaggc

SEQ ID NO: 782336 - RNA, 22 nt, Human
guuuucugauuagcaaaucuga

SEQ ID NO: 782337 - RNA, 23 nt, Human
uuccagaguccacaucugccacc

SEQ ID NO: 782338 - RNA, 22 nt, Human
cuacccagcaccuaggcugccu

SEQ ID NO: 782339 - RNA, 22 nt, Human
aggcagcuuucagugucucuca

SEQ ID NO: 782340 - RNA, 22 nt, Human
ugaacucgggaggaggcugcag

SEQ ID NO: 782341 - RNA, 22 nt, Human
acauuuuuauucaucaaagcag

SEQ ID NO: 782342 - RNA, 22 nt, Human
gggcagcucggaagugggaaag

SEQ ID NO: 782343 - RNA, 22 nt, Human
ugcuggguagaaguauuagucu

SEQ ID NO: 782344 - RNA, 18 nt, Human
gaugggagcaagagaaga

SEQ ID NO: 782345 - RNA, 22 nt, Human
cagcuuccauaagagauggaga

SEQ ID NO: 782346 - RNA, 23 nt, Human
ggagugcaauggcgccaucucgg

SEQ ID NO: 782347 - RNA, 22 nt, Human
uuugcaguagacaucuuauuuu

SEQ ID NO: 782348 - RNA, 22 nt, Human
ucuucacauggaacaugaagcu

SEQ ID NO: 782349 - RNA, 22 nt, Human
acaauacaggcuucuggacuua

SEQ ID NO: 782350 - RNA, 22 nt, Human
ucacuguugaccuggaaguggg

SEQ ID NO: 782351 - RNA, 22 nt, Human
cugcuguguggauucaauggcu

SEQ ID NO: 782352 - RNA, 22 nt, Human
aguggaccagaagacugaagcu

SEQ ID NO: 782353 - RNA, 22 nt, Human
uccaggagcauccaggugaagc

SEQ ID NO: 782354 - RNA, 22 nt, Human
ccucaggaaccacauugcugcu

SEQ ID NO: 782355 - RNA, 22 nt, Human
ggagguggcagagggacauucu

SEQ ID NO: 782356 - RNA, 22 nt, Human
ugcuucagaggaaaggcaaaag

SEQ ID NO: 782357 - RNA, 22 nt, Human
gagguggucgaggagggguacc

SEQ ID NO: 782358 - RNA, 22 nt, Human
uccauguguuuuccuguccaca

SEQ ID NO: 782359 - RNA, 22 nt, Human
gagaggaguuacuauuuccgag

SEQ ID NO: 782360 - RNA, 22 nt, Human
agccagcuguucuggggcagca

SEQ ID NO: 782361 - RNA, 18 nt, Human
gcaggagauggguggggu

SEQ ID NO: 782362 - RNA, 22 nt, Human
aaaggccaauaaagacaagcug

SEQ ID NO: 782363 - RNA, 22 nt, Human
cacugucuuuugugaagacaau

SEQ ID NO: 782364 - RNA, 22 nt, Human
agaccauagggaccucagguug

SEQ ID NO: 782365 - RNA, 22 nt, Human
uucugagguccaugcaguacug

SEQ ID NO: 782366 - RNA, 20 nt, Human
uugauucaagggcugaugga

SEQ ID NO: 782367 - RNA, 21 nt, Human
ugaggcaggggugcuuuuguc

SEQ ID NO: 782368 - RNA, 22 nt, Human
cugcccagaagccagaugggca

SEQ ID NO: 782369 - RNA, 22 nt, Human
aauauuguuucaagaucacaga

SEQ ID NO: 782370 - RNA, 22 nt, Human
gucaggauuuuaaaaucccagu

SEQ ID NO: 782371 - RNA, 22 nt, Human
ccuugcauauauuauaucuuug

SEQ ID NO: 782372 - RNA, 22 nt, Human
uugcagcuucuaccacuguuuc

SEQ ID NO: 782373 - RNA, 22 nt, Human
ugaggcagugauguuuaagcac

SEQ ID NO: 782374 - RNA, 22 nt, Human
uuucaugaggggcaaaaucuca

SEQ ID NO: 782375 - RNA, 22 nt, Human
uuccaugacaccgagggaaguc

SEQ ID NO: 782376 - RNA, 22 nt, Human
uucucugagauagacuaagugg

SEQ ID NO: 782377 - RNA, 23 nt, Human
acagacaacacugaugagagaaa

SEQ ID NO: 782378 - RNA, 22 nt, Human
ugaguuuugucuugcuagaagu

SEQ ID NO: 782379 - RNA, 21 nt, Human
auucugaguugucagucuuca

SEQ ID NO: 782380 - RNA, 22 nt, Human
caaggccaugagcagcgagugu

SEQ ID NO: 782381 - RNA, 19 nt, Human
uauggcaggccgaggcacu

SEQ ID NO: 782382 - RNA, 22 nt, Human
cagagcagucuggagauccagc

SEQ ID NO: 782383 - RNA, 22 nt, Human
acagucuugagcaucagccaga

SEQ ID NO: 782384 - RNA, 18 nt, Human
ggcagcuugacuagcaac

SEQ ID NO: 782385 - RNA, 22 nt, Human
cagcugacagugaggugggggc

SEQ ID NO: 782386 - RNA, 22 nt, Human
ugaaggaaugaguauacuguuu

SEQ ID NO: 782387 - RNA, 22 nt, Human
gcagaggagcaaguugcuacag

SEQ ID NO: 782388 - RNA, 19 nt, Human
uuugaaagaguuuuauugg

SEQ ID NO: 782389 - RNA, 22 nt, Human
guggcaggagagacacagccau

SEQ ID NO: 782390 - RNA, 22 nt, Human
cugcuguguuucacaccucugg

SEQ ID NO: 782391 - RNA, 22 nt, Human
aggcagcugaccacaguaugau

SEQ ID NO: 782392 - RNA, 22 nt, Human
gucugucuguuguugagaagca

SEQ ID NO: 782393 - RNA, 22 nt, Human
aaagauaauguuuccuuauucu

SEQ ID NO: 782394 - RNA, 22 nt, Human
ccccaggagauuugggagcaca

SEQ ID NO: 782395 - RNA, 22 nt, Human
aagaggagacuucagcaacuug

SEQ ID NO: 782396 - RNA, 22 nt, Human
cccaggaaugggaaggaggaau

SEQ ID NO: 782397 - RNA, 22 nt, Human
ucugagaggcaucugcacuucu

SEQ ID NO: 782398 - RNA, 21 nt, Human
acagcaagccuucacaugagu

SEQ ID NO: 782399 - RNA, 23 nt, Human
acauacauggagauaaagugaug

SEQ ID NO: 782400 - RNA, 22 nt, Human
agacaggaugcauacucuuggu

SEQ ID NO: 782401 - RNA, 22 nt, Human
agacaguguguguauauauggu

SEQ ID NO: 782402 - RNA, 22 nt, Human
ugcugaaauuagaacauugagg

SEQ ID NO: 782403 - RNA, 21 nt, Human
agaggcaggcauuaaguacac

SEQ ID NO: 782404 - RNA, 22 nt, Human
cuuuccaaugcauuuccaaugu

SEQ ID NO: 782405 - RNA, 19 nt, Human
gagcgcagagggcagggga

SEQ ID NO: 782406 - RNA, 22 nt, Human
cuccccagguucaggagguggg

SEQ ID NO: 782407 - RNA, 22 nt, Human
uuauacuaaaacgcauugaauu

SEQ ID NO: 782408 - RNA, 22 nt, Human
ccuucuucuguguggcccaaga

SEQ ID NO: 782409 - RNA, 22 nt, Human
aguacauauaguaauuuagcca

SEQ ID NO: 782410 - RNA, 22 nt, Human
guaggcagggcuguggggagaa

SEQ ID NO: 782411 - RNA, 22 nt, Human
cuucagaauccagaaucagaau

SEQ ID NO: 782412 - RNA, 22 nt, Human
cagcugccccgcuggcugacca

SEQ ID NO: 782413 - RNA, 22 nt, Human
cccaggauggggcugcaguuau

SEQ ID NO: 782414 - RNA, 22 nt, Human
aauagcucacugauuucucuuu

SEQ ID NO: 782415 - RNA, 20 nt, Human
agcuucuucugucuaauuuu

SEQ ID NO: 782416 - RNA, 22 nt, Human
ccucuucugcuucaggagcacu

SEQ ID NO: 782417 - RNA, 22 nt, Human
agauggagaccuuggaugaacu

SEQ ID NO: 782418 - RNA, 22 nt, Human
ugaugaaauguugaggcaguga

SEQ ID NO: 782419 - RNA, 22 nt, Human
aggcaccuugagagcaggagcu

SEQ ID NO: 782420 - RNA, 22 nt, Human
uauuuguauguguguacauaua

SEQ ID NO: 782421 - RNA, 22 nt, Human
uccaggagguugagugaguucc

SEQ ID NO: 782422 - RNA, 22 nt, Human
auguucuuccaaaucuguaaca

SEQ ID NO: 782423 - RNA, 22 nt, Human
gucaggauuuacaaacuucagu

SEQ ID NO: 782424 - RNA, 22 nt, Human
auuuguugcuagcagcacugau

SEQ ID NO: 782425 - RNA, 22 nt, Human
aggcaggcucaaugcccagucu

SEQ ID NO: 782426 - RNA, 22 nt, Human
uuccaugaaauguguuaugcuu

SEQ ID NO: 782427 - RNA, 22 nt, Human
ucaggauggcuucugcaucaaa

SEQ ID NO: 782428 - RNA, 23 nt, Human
uuucaaauuacucugcagaugac

SEQ ID NO: 782429 - RNA, 22 nt, Human
auuucacucauucauguuacuu

SEQ ID NO: 782430 - RNA, 22 nt, Human
gggcaguuuauucuagaugguu

SEQ ID NO: 782431 - RNA, 22 nt, Human
ggcagcuaguuuaagaaagagg

SEQ ID NO: 782432 - RNA, 23 nt, Human
guaaaauacgcagugcaguguga

SEQ ID NO: 782433 - RNA, 22 nt, Human
cugcuuugacuguuaagaacca

SEQ ID NO: 782434 - RNA, 22 nt, Human
aagugagugguaaggagcaugg

SEQ ID NO: 782435 - RNA, 22 nt, Human
gcaggagagucugugccagguu

SEQ ID NO: 782436 - RNA, 22 nt, Human
uguccucagauaugucuacucu

SEQ ID NO: 782437 - RNA, 22 nt, Human
caagauggacauaaggagagaa

SEQ ID NO: 782438 - RNA, 22 nt, Human
cugcugugauugggagaaaccg

SEQ ID NO: 782439 - RNA, 22 nt, Human
aguaccaugcuuccugacuggu

SEQ ID NO: 782440 - RNA, 22 nt, Human
uggagacugugcuaagggaguu

SEQ ID NO: 782441 - RNA, 22 nt, Human
cagaaauguacugacaugcagu

SEQ ID NO: 782442 - RNA, 22 nt, Human
gauguagagggaagauuuuaaa

SEQ ID NO: 782443 - RNA, 22 nt, Human
gaagcagcaaguauaggacagg

SEQ ID NO: 782444 - RNA, 22 nt, Human
gagaggcaggcgcugcaauggu

SEQ ID NO: 782445 - RNA, 22 nt, Human
uucugugaaucuuuuuucccac

SEQ ID NO: 782446 - RNA, 22 nt, Human
aaggaaccauuugugugcaugg

SEQ ID NO: 782447 - RNA, 22 nt, Human
ggcuuggaccagucacaguggu

SEQ ID NO: 782448 - RNA, 22 nt, Human
uuuagaaguucacacauuuaaa

SEQ ID NO: 782449 - RNA, 17 nt, Human
gaggacagggaaguagg

SEQ ID NO: 782450 - RNA, 22 nt, Human
uccaggagcucauccacgucaa

SEQ ID NO: 782451 - RNA, 22 nt, Human
gcugcugucagugguggcaguu

SEQ ID NO: 782452 - RNA, 21 nt, Human
gagacagcccagugccagggc

SEQ ID NO: 782453 - RNA, 22 nt, Human
uugaacugguaguuggaaaucu

SEQ ID NO: 782454 - RNA, 22 nt, Human
gcagcuucaguaggugaagaca

SEQ ID NO: 782455 - RNA, 22 nt, Human
uugcugaaguuaaugcuugcaa

SEQ ID NO: 782456 - RNA, 21 nt, Human
agacaguaacucuucuacucc

SEQ ID NO: 782457 - RNA, 22 nt, Human
ugaaagcagcaccaauaccauu

SEQ ID NO: 782458 - RNA, 22 nt, Human
cucaggaucgcuugcccuaggg

SEQ ID NO: 782459 - RNA, 22 nt, Human
caguucuuaauaccaugugguu

SEQ ID NO: 782460 - RNA, 22 nt, Human
gugcauuugacgaauacucacu

SEQ ID NO: 782461 - RNA, 22 nt, Human
auagucuuagaucagauaaagu

SEQ ID NO: 782462 - RNA, 22 nt, Human
ucccaggaaggauucggcauuu

SEQ ID NO: 782463 - RNA, 22 nt, Human
aggguaggaacugaguggaagg

SEQ ID NO: 782464 - RNA, 22 nt, Human
ucaggagaaaauaucaggaagu

SEQ ID NO: 782465 - RNA, 22 nt, Human
uucaaacaguguagaauauaug

SEQ ID NO: 782466 - RNA, 22 nt, Human
caggcagcugggucaccguccc

SEQ ID NO: 782467 - RNA, 18 nt, Human
cucaccauucugcccaau

SEQ ID NO: 782468 - RNA, 22 nt, Human
ugcccaggcuggaaugcagugg

SEQ ID NO: 782469 - RNA, 22 nt, Human
cugcuguggccagccaggucaa

SEQ ID NO: 782470 - RNA, 22 nt, Human
uaucuaaauggaauauuccaga

SEQ ID NO: 782471 - RNA, 22 nt, Human
gauguuucaugcuagcaugugu

SEQ ID NO: 782472 - RNA, 21 nt, Human
aggcagcaggauccagggaca

SEQ ID NO: 782473 - RNA, 22 nt, Human
gaggcagcggcucacagagaaa

SEQ ID NO: 782474 - RNA, 22 nt, Human
gcugcccaggguggagccggcu

SEQ ID NO: 782475 - RNA, 22 nt, Human
gagaggugaaggcugcccuggg

SEQ ID NO: 782476 - RNA, 22 nt, Human
gaauagcuuccuuuuuuccaaa

SEQ ID NO: 782477 - RNA, 22 nt, Human
gcagcugccuucagcuggaugg

SEQ ID NO: 782478 - RNA, 21 nt, Human
cccaggaggcugagaagagca

SEQ ID NO: 782479 - RNA, 19 nt, Human
aucugccuguuaucacaua

SEQ ID NO: 782480 - RNA, 20 nt, Human
augauuuugcacuaacuuca

SEQ ID NO: 782481 - RNA, 23 nt, Human
cuugcaggaagcagauggcacac

SEQ ID NO: 782482 - RNA, 22 nt, Human
cauuuguauguuccuccuuagg

SEQ ID NO: 782483 - RNA, 22 nt, Human
gcagagcuucuguccuucagga

SEQ ID NO: 782484 - RNA, 22 nt, Human
aguguuugagacacauuucacu

SEQ ID NO: 782485 - RNA, 19 nt, Human
aggcagcaggccagggaug

SEQ ID NO: 782486 - RNA, 23 nt, Human
uggcaaggaaugggauggagacu

SEQ ID NO: 782487 - RNA, 22 nt, Human
caggcagccugagggaucuggg

SEQ ID NO: 782488 - RNA, 22 nt, Human
gucauauacacugcauguaauc

SEQ ID NO: 782489 - RNA, 22 nt, Human
uacacacagaggccaugggauu

SEQ ID NO: 782490 - RNA, 20 nt, Human
gaugggaaucggagcuggua

SEQ ID NO: 782491 - RNA, 22 nt, Human
cagagccauuauggagacuugc

SEQ ID NO: 782492 - RNA, 22 nt, Human
acuuuugguucuguaacuguga

SEQ ID NO: 782493 - RNA, 22 nt, Human
agucucuuccuucaaggcuggu

SEQ ID NO: 782494 - RNA, 22 nt, Human
ccuugcugcgugcuagcacaga

SEQ ID NO: 782495 - RNA, 22 nt, Human
accaggagccacaggaggagcc

SEQ ID NO: 782496 - RNA, 22 nt, Human
ucaggauguuaauauagcauua

SEQ ID NO: 782497 - RNA, 22 nt, Human
ugcuucugggcaaaugugugug

SEQ ID NO: 782498 - RNA, 22 nt, Human
gauuucuucauuuguggugaau

SEQ ID NO: 782499 - RNA, 22 nt, Human
aaggcagccuuuugaguugauu

SEQ ID NO: 782500 - RNA, 22 nt, Human
cuaaucaucuuucucuuaaagc

SEQ ID NO: 782501 - RNA, 22 nt, Human
uacuuccuguuuccaugucugu

SEQ ID NO: 782502 - RNA, 22 nt, Human
gcugcuguugauuuaguccaau

SEQ ID NO: 782503 - RNA, 22 nt, Human
agcugcccuuuaugaugcugaa

SEQ ID NO: 782504 - RNA, 22 nt, Human
ucaucucaaaacccaaggggca

SEQ ID NO: 782505 - RNA, 22 nt, Human
cagcuccugaggacugcuggga

SEQ ID NO: 782506 - RNA, 20 nt, Human
cugcugugauucccuccucc

SEQ ID NO: 782507 - RNA, 22 nt, Human
ccugcuguucuguuuagugaac

SEQ ID NO: 782508 - RNA, 22 nt, Human
ucugcugugauuugcuaccugu

SEQ ID NO: 782509 - RNA, 18 nt, Human
agucuucugauccauuuu

SEQ ID NO: 782510 - RNA, 22 nt, Human
agagguagagguugcagugagc

SEQ ID NO: 782511 - RNA, 22 nt, Human
acugccauuggucaaaugagug

SEQ ID NO: 782512 - RNA, 22 nt, Human
uuguuuuaucuuucuacagacu

SEQ ID NO: 782513 - RNA, 22 nt, Human
aauaucagcacuuuugugguau

SEQ ID NO: 782514 - RNA, 22 nt, Human
ccaggaaaauaccaagcuuuaa

SEQ ID NO: 782515 - RNA, 22 nt, Human
cauuuguagcuauuuacuguau

SEQ ID NO: 782516 - RNA, 22 nt, Human
ugugugucagagucuccauggu

SEQ ID NO: 782517 - RNA, 22 nt, Human
aggagcagaauuuaaugugcag

SEQ ID NO: 782518 - RNA, 22 nt, Human
aauauaaugcuguuuuaugcca

SEQ ID NO: 782519 - RNA, 22 nt, Human
uuacaagcagcuacauaucaca

SEQ ID NO: 782520 - RNA, 22 nt, Human
cugcugugggcaggguagcugg

SEQ ID NO: 782521 - RNA, 22 nt, Human
uagcucuucauuucaucugauu

SEQ ID NO: 782522 - RNA, 22 nt, Human
ccucagaugucuuaaggcacug

SEQ ID NO: 782523 - RNA, 22 nt, Human
agggcagcacaaggcauggacu

SEQ ID NO: 782524 - RNA, 22 nt, Human
uaaugucaaggugauagauuug

SEQ ID NO: 782525 - RNA, 22 nt, Human
uugcauuuccuguacuguuuga

SEQ ID NO: 782526 - RNA, 22 nt, Human
ucugcugucacucauuugcuuc

SEQ ID NO: 782527 - RNA, 22 nt, Human
uauuuuaucugccagaguggag

SEQ ID NO: 782528 - RNA, 22 nt, Human
acaauguguuuuuauacauuug

SEQ ID NO: 782529 - RNA, 22 nt, Human
aaggcagcaacuaauggaucuc

SEQ ID NO: 782530 - RNA, 22 nt, Human
gauugaaacauaggcagucgag

SEQ ID NO: 782531 - RNA, 22 nt, Human
caagaugugccuaaucagaccu

SEQ ID NO: 782532 - RNA, 21 nt, Human
uuucacaaaaguaugugacaa

SEQ ID NO: 782533 - RNA, 22 nt, Human
augcuguguuugagaaccuagg

SEQ ID NO: 782534 - RNA, 22 nt, Human
ccaggagaaugggauuacccua

SEQ ID NO: 782535 - RNA, 22 nt, Human
agucucugcugguugugccuau

SEQ ID NO: 782536 - RNA, 21 nt, Human
ggagggcagcccagacuggcu

SEQ ID NO: 782537 - RNA, 22 nt, Human
gaagcagcuggugagauggagc

SEQ ID NO: 782538 - RNA, 22 nt, Human
uaaggccagccagcaaaucugu

SEQ ID NO: 782539 - RNA, 18 nt, Human
uugcuuuguaagcuugca

SEQ ID NO: 782540 - RNA, 22 nt, Human
cauuuguacagaacagcuuuau

SEQ ID NO: 782541 - RNA, 22 nt, Human
gccaggagugucccacucauuu

SEQ ID NO: 782542 - RNA, 19 nt, Human
ugcuagaaauucugugacu

SEQ ID NO: 782543 - RNA, 22 nt, Human
aaguauaagcuauucuucauga

SEQ ID NO: 782544 - RNA, 22 nt, Human
uuaaauuuuagaaacagacucu

SEQ ID NO: 782545 - RNA, 22 nt, Human
auccaugauuaguaggauaaag

SEQ ID NO: 782546 - RNA, 22 nt, Human
caggauggccccggggcugugc

SEQ ID NO: 782547 - RNA, 22 nt, Human
aaaccgcaauuacuuuugcguc

SEQ ID NO: 782548 - RNA, 22 nt, Human
acccaggaugauaauguucaca

SEQ ID NO: 782549 - RNA, 22 nt, Human
augcuuuuccaggagaaauaua

SEQ ID NO: 782550 - RNA, 21 nt, Human
aggcagcuggaaggccuggcu

SEQ ID NO: 782551 - RNA, 22 nt, Human
ugaggcaggaguuaaugugcuc

SEQ ID NO: 782552 - RNA, 22 nt, Human
cugccaggcgauggauuggcug

SEQ ID NO: 782553 - RNA, 22 nt, Human
uggcagucuggguuggcaguua

SEQ ID NO: 782554 - RNA, 22 nt, Human
gguuauauaauucagugcuuuc

SEQ ID NO: 782555 - RNA, 22 nt, Human
uggcagcucccagagcuuccaa

SEQ ID NO: 782556 - RNA, 22 nt, Human
gauuucuugaccccugucucag

SEQ ID NO: 782557 - RNA, 22 nt, Human
gcuccucugucaaaugagagug

SEQ ID NO: 782558 - RNA, 18 nt, Human
ugcuuggagcauuuacca

SEQ ID NO: 782559 - RNA, 22 nt, Human
aaggcagcccuggcucagccug

SEQ ID NO: 782560 - RNA, 22 nt, Human
gcccaggauggcuggaggugcu

SEQ ID NO: 782561 - RNA, 22 nt, Human
gcagagaacccagcagauuggc

SEQ ID NO: 782562 - RNA, 23 nt, Human
auguuauuauuagcagucuugcc

SEQ ID NO: 782563 - RNA, 22 nt, Human
aaggccaacuaggaugagcuag

SEQ ID NO: 782564 - RNA, 22 nt, Human
cuggcaguguccagcucgugau

SEQ ID NO: 782565 - RNA, 22 nt, Human
caaggccaguuucuccuaguca

SEQ ID NO: 782566 - RNA, 22 nt, Human
gaggucaggcuugcagcagggu

SEQ ID NO: 782567 - RNA, 22 nt, Human
cagugauguuucugcaucagag

SEQ ID NO: 782568 - RNA, 22 nt, Human
cuguaugaggaucagacuggac

SEQ ID NO: 782569 - RNA, 22 nt, Human
ucccaggaugugcgugccgccg

SEQ ID NO: 782570 - RNA, 22 nt, Human
ugagccuguccugugcauguga

SEQ ID NO: 782571 - RNA, 22 nt, Human
gagguagcgaguggacagugca

SEQ ID NO: 782572 - RNA, 22 nt, Human
acuucaugcagaagagagcugu

SEQ ID NO: 782573 - RNA, 22 nt, Human
aaauuguugaucuacaguaagg

SEQ ID NO: 782574 - RNA, 22 nt, Human
ugaggcaggagaaucaccggaa

SEQ ID NO: 782575 - RNA, 22 nt, Human
uccaugaggaccaaauucguag

SEQ ID NO: 782576 - RNA, 22 nt, Human
cccaggagguuggggcuacagu

SEQ ID NO: 782577 - RNA, 22 nt, Human
gaaauauuacaguggaggggau

SEQ ID NO: 782578 - RNA, 22 nt, Human
augcuguggaugccuugcccca

SEQ ID NO: 782579 - RNA, 22 nt, Human
cuacagacccaccuuggaagaa

SEQ ID NO: 782580 - RNA, 20 nt, Human
acaggggcagcacaauaaug

SEQ ID NO: 782581 - RNA, 22 nt, Human
aguucucagcuuaguaugcugu

SEQ ID NO: 782582 - RNA, 22 nt, Human
agaggggacagccaccugcccg

SEQ ID NO: 782583 - RNA, 22 nt, Human
cagcuggcuggucagugcacaa

SEQ ID NO: 782584 - RNA, 22 nt, Human
cugcugugagcacuccagccug

SEQ ID NO: 782585 - RNA, 22 nt, Human
ccaggauggggagcagauagaa

SEQ ID NO: 782586 - RNA, 19 nt, Human
ucauuguugguuugucggg

SEQ ID NO: 782587 - RNA, 20 nt, Human
cugcugugugugccucagcc

SEQ ID NO: 782588 - RNA, 22 nt, Human
ggaggaugccaagcugugcaca

SEQ ID NO: 782589 - RNA, 22 nt, Human
gccaggagaaugcuagcagagg

SEQ ID NO: 782590 - RNA, 22 nt, Human
uguugaagauaaaguucucauu

SEQ ID NO: 782591 - RNA, 22 nt, Human
agcaccugucacaagcagaagg

SEQ ID NO: 782592 - RNA, 22 nt, Human
gcccaggaggcagagguugugg

SEQ ID NO: 782593 - RNA, 22 nt, Human
agacagguaaauagagaugcug

SEQ ID NO: 782594 - RNA, 22 nt, Human
uuuugugagcccauaaaugcca

SEQ ID NO: 782595 - RNA, 22 nt, Human
aucaggaugacuauaaggcugc

SEQ ID NO: 782596 - RNA, 22 nt, Human
aaguccaugaucaagauguggc

SEQ ID NO: 782597 - RNA, 19 nt, Human
caggaaggggcgaaucugg

SEQ ID NO: 782598 - RNA, 22 nt, Human
ucugucuucaucagcaugugau

SEQ ID NO: 782599 - RNA, 22 nt, Human
cugcugugcacccaggaaggcu

SEQ ID NO: 782600 - RNA, 22 nt, Human
gucuccugagccuugacugcaa

SEQ ID NO: 782601 - RNA, 22 nt, Human
aaauguuuugcucccauguggu

SEQ ID NO: 782602 - RNA, 22 nt, Human
gcuuugaagacuuuuccagggu

SEQ ID NO: 782603 - RNA, 16 nt, Human
auuuccagauuaugca

SEQ ID NO: 782604 - RNA, 23 nt, Human
acagaaaguucugcuggacagag

SEQ ID NO: 782605 - RNA, 22 nt, Human
uuucuucagccuucacaaccug

SEQ ID NO: 782606 - RNA, 22 nt, Human
uggcaaggcugugggggcagag

SEQ ID NO: 782607 - RNA, 22 nt, Human
gauuuuauuagcccaaacuuug

SEQ ID NO: 782608 - RNA, 22 nt, Human
uuuguaugugauaagacuauuc

SEQ ID NO: 782609 - RNA, 16 nt, Human
ccccaggacuuggcac

SEQ ID NO: 782610 - RNA, 22 nt, Human
agggagcucuaaguagagggac

SEQ ID NO: 782611 - RNA, 22 nt, Human
auuggcagaaacagcagggcca

SEQ ID NO: 782612 - RNA, 22 nt, Human
aagcagagcaagcguauuuauu

SEQ ID NO: 782613 - RNA, 22 nt, Human
uaauaucuacuucauagaguuu

SEQ ID NO: 782614 - RNA, 19 nt, Human
gaggcgaggcgugcaggag

SEQ ID NO: 782615 - RNA, 22 nt, Human
ggagaggagauuguggcauuuu

SEQ ID NO: 782616 - RNA, 22 nt, Human
uuuacuuuugguaaggucauuu

SEQ ID NO: 782617 - RNA, 22 nt, Human
cuuugaauugccguuucaucug

SEQ ID NO: 782618 - RNA, 22 nt, Human
aaguggacuaauacaaggacua

SEQ ID NO: 782619 - RNA, 22 nt, Human
auacacauauguguguauaugu

SEQ ID NO: 782620 - RNA, 19 nt, Human
auacagauguauccaugau

SEQ ID NO: 782621 - RNA, 22 nt, Human
uugcagcugcaguaaauguuca

SEQ ID NO: 782622 - RNA, 22 nt, Human
gcagcuaccacccaggaaggac

SEQ ID NO: 782623 - RNA, 22 nt, Human
agaaguuguagguuugcauauu

SEQ ID NO: 782624 - RNA, 22 nt, Human
uuauuucauguaaaauuuaugu

SEQ ID NO: 782625 - RNA, 22 nt, Human
gaagcacauggcuauagcuauu

SEQ ID NO: 782626 - RNA, 22 nt, Human
ugcauaguucuccuuccuccuc

SEQ ID NO: 782627 - RNA, 22 nt, Human
ccuucauugcaucuuuaagaga

SEQ ID NO: 782628 - RNA, 22 nt, Human
cccaggagguagagguugcagu

SEQ ID NO: 782629 - RNA, 22 nt, Human
gggcagcugucuugguucucaa

SEQ ID NO: 782630 - RNA, 20 nt, Human
uuuuccagaaaguaucauug

SEQ ID NO: 782631 - RNA, 22 nt, Human
gaccauuucuaggaaucagacu

SEQ ID NO: 782632 - RNA, 22 nt, Human
auuuccagugcacugaauagaa

SEQ ID NO: 782633 - RNA, 22 nt, Human
ggaggugggcuaaggacucucu

SEQ ID NO: 782634 - RNA, 20 nt, Human
gaagcagcuucauguagaca

SEQ ID NO: 782635 - RNA, 22 nt, Human
uucaucaauguguuuaauaaug

SEQ ID NO: 782636 - RNA, 22 nt, Human
gucugucucccugugacugaga

SEQ ID NO: 782637 - RNA, 22 nt, Human
uuuaaauuuagaagaaacacug

SEQ ID NO: 782638 - RNA, 22 nt, Human
auuaaauuggacgcugggggaa

SEQ ID NO: 782639 - RNA, 22 nt, Human
aggagcagcuucugaaccaugu

SEQ ID NO: 782640 - RNA, 22 nt, Human
cacagcauaaugaaauauacuu

SEQ ID NO: 782641 - RNA, 22 nt, Human
aggcagccaaucagaggcugac

SEQ ID NO: 782642 - RNA, 22 nt, Human
ggagaggagcuauugggggcuc

SEQ ID NO: 782643 - RNA, 22 nt, Human
auguuucaaugcacuuuagccu

SEQ ID NO: 782644 - RNA, 22 nt, Human
ucgagcucuggagccaaggaug

SEQ ID NO: 782645 - RNA, 21 nt, Human
uucucagagucuauuacaguu

SEQ ID NO: 782646 - RNA, 22 nt, Human
ucccaggaagaucccagggacc

SEQ ID NO: 782647 - RNA, 22 nt, Human
ugaaaugaagggcuuguucugg

SEQ ID NO: 782648 - RNA, 22 nt, Human
guucuucagucacaucacagaa

SEQ ID NO: 782649 - RNA, 22 nt, Human
ucauuuaauagcuuuugucuuu

SEQ ID NO: 782650 - RNA, 18 nt, Human
gugcugugggcaguggcc

SEQ ID NO: 782651 - RNA, 22 nt, Human
ccccaggacacauggaccaagu

SEQ ID NO: 782652 - RNA, 22 nt, Human
uucuucaacaaggacacuguua

SEQ ID NO: 782653 - RNA, 18 nt, Human
aggcaggugcuggaaguc

SEQ ID NO: 782654 - RNA, 22 nt, Human
cuggcuguauuaguuugauccu

SEQ ID NO: 782655 - RNA, 22 nt, Human
uucaggauuguguuuuuccuga

SEQ ID NO: 782656 - RNA, 21 nt, Human
augucaaaugcuuuauuuuau

SEQ ID NO: 782657 - RNA, 22 nt, Human
augcuguggaaguuccugaagc

SEQ ID NO: 782658 - RNA, 22 nt, Human
auucuucacaccuguuccuguu

SEQ ID NO: 782659 - RNA, 22 nt, Human
aguugcagacgcagagauguug

SEQ ID NO: 782660 - RNA, 22 nt, Human
ggacagcucugccaggagcuca

SEQ ID NO: 782661 - RNA, 22 nt, Human
gcugccagcuuuccuuggcuga

SEQ ID NO: 782662 - RNA, 22 nt, Human
augaaggcaguuaaacgucauc

SEQ ID NO: 782663 - RNA, 22 nt, Human
aggcaguuuaggcagcgauuua

SEQ ID NO: 782664 - RNA, 22 nt, Human
cuuugcaaacgauuaccacaug

SEQ ID NO: 782665 - RNA, 22 nt, Human
guccaugauucuguguaguaga

SEQ ID NO: 782666 - RNA, 22 nt, Human
uuucacauuuaggcgugaauug

SEQ ID NO: 782667 - RNA, 22 nt, Human
accauuuuggguauuuucagag

SEQ ID NO: 782668 - RNA, 22 nt, Human
aggcagcuuucuguaggggugu

SEQ ID NO: 782669 - RNA, 23 nt, Human
uucuucucaauuaguugauucag

SEQ ID NO: 782670 - RNA, 22 nt, Human
gaaaggugccccauaggcagga

SEQ ID NO: 782671 - RNA, 22 nt, Human
aaaauacuguggaguguugaaa

SEQ ID NO: 782672 - RNA, 22 nt, Human
uccacauccauugcuugacuuu

SEQ ID NO: 782673 - RNA, 22 nt, Human
ggcagcacugcagcuuguuggg

SEQ ID NO: 782674 - RNA, 22 nt, Human
uuucacagguacaaacacuccu

SEQ ID NO: 782675 - RNA, 22 nt, Human
ucagugcacagagauuuuuguu

SEQ ID NO: 782676 - RNA, 22 nt, Human
gucaggaucucccaguacauau

SEQ ID NO: 782677 - RNA, 22 nt, Human
ccucuucuaggacguccuugug

SEQ ID NO: 782678 - RNA, 22 nt, Human
ucccaggacuuccaguuggagg

SEQ ID NO: 782679 - RNA, 22 nt, Human
agcuucccaagguuggaagguu

SEQ ID NO: 782680 - RNA, 22 nt, Human
ugaggcaggacuugcauaaagu

SEQ ID NO: 782681 - RNA, 22 nt, Human
aaugagacacgugaagcagaug

SEQ ID NO: 782682 - RNA, 23 nt, Human
agaugaggcuucuccauguuggu

SEQ ID NO: 782683 - RNA, 22 nt, Human
caaggccauauugccuguaugu

SEQ ID NO: 782684 - RNA, 22 nt, Human
guucuucaggccauccucccag

SEQ ID NO: 782685 - RNA, 22 nt, Human
uaaaaugaucucucauguucuu

SEQ ID NO: 782686 - RNA, 22 nt, Human
auaucaguaucuauguauuugu

SEQ ID NO: 782687 - RNA, 22 nt, Human
cccuuagcucaauuucuugccc

SEQ ID NO: 782688 - RNA, 22 nt, Human
ugccugugguuccaguuuuuuc

SEQ ID NO: 782689 - RNA, 22 nt, Human
aggagagggguaggauuaauuu

SEQ ID NO: 782690 - RNA, 22 nt, Human
gcagagaagaugcccaggcuuc

SEQ ID NO: 782691 - RNA, 21 nt, Human
ucacuagugccuucugucauu

SEQ ID NO: 782692 - RNA, 22 nt, Human
aaauauagugacacuuauaguc

SEQ ID NO: 782693 - RNA, 21 nt, Human
ucugagagcaacugcccuuua

SEQ ID NO: 782694 - RNA, 23 nt, Human
aaauuauugcucuucaauugccu

SEQ ID NO: 782695 - RNA, 22 nt, Human
uuugaauguuuuagguacuuaa

SEQ ID NO: 782696 - RNA, 22 nt, Human
guugaaagaucauguggcugcc

SEQ ID NO: 782697 - RNA, 22 nt, Human
ugguaaauauguccauucucuu

SEQ ID NO: 782698 - RNA, 19 nt, Human
ugcaagcuuuuucuuguua

SEQ ID NO: 782699 - RNA, 22 nt, Human
ggaggaggggcgcuuugucuau

SEQ ID NO: 782700 - RNA, 22 nt, Human
gugguaaucggauucuuaccgg

SEQ ID NO: 782701 - RNA, 22 nt, Human
uauuucagcaagaagaaugugg

SEQ ID NO: 782702 - RNA, 22 nt, Human
cugcuguguaucauuuuagaug

SEQ ID NO: 782703 - RNA, 22 nt, Human
uggagacucugcaucugugaca

SEQ ID NO: 782704 - RNA, 22 nt, Human
ucucaggaagauuagggcuaag

SEQ ID NO: 782705 - RNA, 23 nt, Human
uccugaggguuucccagccuugg

SEQ ID NO: 782706 - RNA, 22 nt, Human
gaggaggcuuccgggaggcacg

SEQ ID NO: 782707 - RNA, 22 nt, Human
gggaggugauggcaagcagcgg

SEQ ID NO: 782708 - RNA, 22 nt, Human
uuuuccagagcugucucuugca

SEQ ID NO: 782709 - RNA, 22 nt, Human
ugcauguguuugccacagugag

SEQ ID NO: 782710 - RNA, 22 nt, Human
uauuugcaacauaaaacucuga

SEQ ID NO: 782711 - RNA, 20 nt, Human
caucaucacaugagccaauu

SEQ ID NO: 782712 - RNA, 22 nt, Human
uuuccauguuggugaaaugagg

SEQ ID NO: 782713 - RNA, 23 nt, Human
agaggggagcaucugcuggcuga

SEQ ID NO: 782714 - RNA, 22 nt, Human
gggagacacgcugcaggcauaa

SEQ ID NO: 782715 - RNA, 22 nt, Human
gcagcuccuccugggcuggaga

SEQ ID NO: 782716 - RNA, 22 nt, Human
cauuuguuaaccaguguggauu

SEQ ID NO: 782717 - RNA, 22 nt, Human
ccuugcugaccaucaccuuuga

SEQ ID NO: 782718 - RNA, 22 nt, Human
ugucucugauaaguaguucagu

SEQ ID NO: 782719 - RNA, 22 nt, Human
aagcuggcaugucaccugagaa

SEQ ID NO: 782720 - RNA, 22 nt, Human
gugucccaggccucuggaauua

SEQ ID NO: 782721 - RNA, 22 nt, Human
uaaaugaagaaauggagauugu

SEQ ID NO: 782722 - RNA, 22 nt, Human
ucuuccucuagaucugaggccc

SEQ ID NO: 782723 - RNA, 22 nt, Human
uugaaagugccaaguccuagug

SEQ ID NO: 782724 - RNA, 22 nt, Human
uucuucuuuaucucaguauccu

SEQ ID NO: 782725 - RNA, 22 nt, Human
cccuggaggcaaagguugcagu

SEQ ID NO: 782726 - RNA, 22 nt, Human
ugaaggccucugguacaugcca

SEQ ID NO: 782727 - RNA, 22 nt, Human
aguauugugacucaaguauucu

SEQ ID NO: 782728 - RNA, 22 nt, Human
aauggccagcugggagaguuga

SEQ ID NO: 782729 - RNA, 22 nt, Human
gaggcagagaccuucaggaccu

SEQ ID NO: 782730 - RNA, 22 nt, Human
auuucccagcuuugaucaguuu

SEQ ID NO: 782731 - RNA, 22 nt, Human
aucaggauucaccccagagcug

SEQ ID NO: 782732 - RNA, 22 nt, Human
caaggccaguccauuuuggaag

SEQ ID NO: 782733 - RNA, 22 nt, Human
uguucuuuggcuucacagcucu

SEQ ID NO: 782734 - RNA, 22 nt, Human
cauucuuacacaauauuuuaau

SEQ ID NO: 782735 - RNA, 22 nt, Human
ucacauucucagcaucuauaca

SEQ ID NO: 782736 - RNA, 22 nt, Human
gaggagagccugcacuuugacc

SEQ ID NO: 782737 - RNA, 22 nt, Human
ucuucagagugaaagucuguga

SEQ ID NO: 782738 - RNA, 19 nt, Human
ugcccaggccagguugggc

SEQ ID NO: 782739 - RNA, 22 nt, Human
agagcagcuggggcagagacca

SEQ ID NO: 782740 - RNA, 22 nt, Human
uucacagaauggcaaguuaugg

SEQ ID NO: 782741 - RNA, 22 nt, Human
uuauuuacaacucuucucuucc

SEQ ID NO: 782742 - RNA, 22 nt, Human
guaaaauagaauaacguggcua

SEQ ID NO: 782743 - RNA, 22 nt, Human
ucuggcaggcaaucggcucugg

SEQ ID NO: 782744 - RNA, 22 nt, Human
agcagagguguuuauuauggga

SEQ ID NO: 782745 - RNA, 22 nt, Human
gcccaggaaagauagggccuca

SEQ ID NO: 782746 - RNA, 22 nt, Human
accgaaggaaacuggaaccguu

SEQ ID NO: 782747 - RNA, 20 nt, Human
aggcagcugggaaaugaggg

SEQ ID NO: 782748 - RNA, 19 nt, Human
gaggucagcaagaaguauu

SEQ ID NO: 782749 - RNA, 22 nt, Human
cccaggagauaacguucccaag

SEQ ID NO: 782750 - RNA, 22 nt, Human
caggacagcucaacaccuccuc

SEQ ID NO: 782751 - RNA, 22 nt, Human
cccaggaguuggaggcuacggu

SEQ ID NO: 782752 - RNA, 22 nt, Human
gucaggaugcuauuguuauuaa

SEQ ID NO: 782753 - RNA, 22 nt, Human
uuagcaucugcuguaagcuuau

SEQ ID NO: 782754 - RNA, 22 nt, Human
gcccaggaagccaccgggaagu

SEQ ID NO: 782755 - RNA, 18 nt, Human
cauuguacaaugcuuuau

SEQ ID NO: 782756 - RNA, 22 nt, Human
aaaaugagauacaguuugaaag

SEQ ID NO: 782757 - RNA, 22 nt, Human
aaggcagccagauccuuugggu

SEQ ID NO: 782758 - RNA, 22 nt, Human
ggcuuggaaauugcaggacaca

SEQ ID NO: 782759 - RNA, 22 nt, Human
uucugagacaauugagagucua

SEQ ID NO: 782760 - RNA, 22 nt, Human
aucaggaucacagaaacuuuua

SEQ ID NO: 782761 - RNA, 22 nt, Human
cauuugcagagggugacacucu

SEQ ID NO: 782762 - RNA, 22 nt, Human
ugaggcaggaaguuauauaaug

SEQ ID NO: 782763 - RNA, 20 nt, Human
cagaggcaaggagacuugga

SEQ ID NO: 782764 - RNA, 22 nt, Human
gcccaggaucugcucagaucau

SEQ ID NO: 782765 - RNA, 22 nt, Human
cugaaaauguuacacaggaaga

SEQ ID NO: 782766 - RNA, 22 nt, Human
acagcagcuugcgugucugguc

SEQ ID NO: 782767 - RNA, 22 nt, Human
ucucauugguauauacaugugu

SEQ ID NO: 782768 - RNA, 22 nt, Human
ucaaucacguguuccauguucu

SEQ ID NO: 782769 - RNA, 22 nt, Human
augcagcugucagggagaacau

SEQ ID NO: 782770 - RNA, 22 nt, Human
gcugcccagacauugaaucagg

SEQ ID NO: 782771 - RNA, 22 nt, Human
ucuuucaaugagcauucuuucc

SEQ ID NO: 782772 - RNA, 22 nt, Human
aggagcagaacugauucugacu

SEQ ID NO: 782773 - RNA, 22 nt, Human
uucaauucugcucugaucuuag

SEQ ID NO: 782774 - RNA, 22 nt, Human
cagaggcaggaagaugggcagu

SEQ ID NO: 782775 - RNA, 22 nt, Human
aaacugcugguugcuggccagc

SEQ ID NO: 782776 - RNA, 22 nt, Human
gaccuggaggauccucuucuug

SEQ ID NO: 782777 - RNA, 22 nt, Human
uggaaagucucuuuugacugua

SEQ ID NO: 782778 - RNA, 22 nt, Human
auuaaauuaaguggcuaauuua

SEQ ID NO: 782779 - RNA, 22 nt, Human
ugaaaugaaugugauucgauag

SEQ ID NO: 782780 - RNA, 16 nt, Human
aaggagggaagagaau

SEQ ID NO: 782781 - RNA, 22 nt, Human
gggcaguugauggaggucugga

SEQ ID NO: 782782 - RNA, 22 nt, Human
cccaggaaaugggcucuugccu

SEQ ID NO: 782783 - RNA, 22 nt, Human
ggaggggauuuaguagaugcua

SEQ ID NO: 782784 - RNA, 22 nt, Human
cagucuucuaaccuagcagccu

SEQ ID NO: 782785 - RNA, 22 nt, Human
ucacagacacagggagaagcau

SEQ ID NO: 782786 - RNA, 22 nt, Human
uuucuucauagaccuugucuug

SEQ ID NO: 782787 - RNA, 22 nt, Human
agaggccaugcuagaggccugg

SEQ ID NO: 782788 - RNA, 22 nt, Human
uuucacauaugguuguugauug

SEQ ID NO: 782789 - RNA, 22 nt, Human
aggcggcugguguccugcaggu

SEQ ID NO: 782790 - RNA, 22 nt, Human
cccaggagagggaaccaaaugu

SEQ ID NO: 782791 - RNA, 22 nt, Human
cagcugccccuccagggcuggg

SEQ ID NO: 782792 - RNA, 22 nt, Human
ucuucuucccaucccucaaaug

SEQ ID NO: 782793 - RNA, 22 nt, Human
uggagagguuuaaacaaaaguu

SEQ ID NO: 782794 - RNA, 22 nt, Human
gcucaggacuggaggagcgggg

SEQ ID NO: 782795 - RNA, 22 nt, Human
ugagauguaagguaugcuuacu

SEQ ID NO: 782796 - RNA, 22 nt, Human
caggcagcaucagucugcugua

SEQ ID NO: 782797 - RNA, 22 nt, Human
cuucucaguugcaagugucaga

SEQ ID NO: 782798 - RNA, 22 nt, Human
cucaggauguacuacagaaggc

SEQ ID NO: 782799 - RNA, 22 nt, Human
gaggagcuggcugucgggaggc

SEQ ID NO: 782800 - RNA, 22 nt, Human
gcagcugagagaagaacagggc

SEQ ID NO: 782801 - RNA, 22 nt, Human
ucagagagccucaggcacugcc

SEQ ID NO: 782802 - RNA, 22 nt, Human
gaggagaggggcucccaagagc

SEQ ID NO: 782803 - RNA, 22 nt, Human
cugcuguguggugaaacucagu

SEQ ID NO: 782804 - RNA, 22 nt, Human
auucaaguucuucugucuuugc

SEQ ID NO: 782805 - RNA, 22 nt, Human
uugaaagaggcaaaguuugauc

SEQ ID NO: 782806 - RNA, 17 nt, Human
gcgcagcuccuggcgcg

SEQ ID NO: 782807 - RNA, 22 nt, Human
uaaguucauaagcuuauucuua

SEQ ID NO: 782808 - RNA, 22 nt, Human
cuggguaaguuccuaaggcuca

SEQ ID NO: 782809 - RNA, 22 nt, Human
caggaaaggugugucaugaugg

SEQ ID NO: 782810 - RNA, 18 nt, Human
gagucuuuguuacugcug

SEQ ID NO: 782811 - RNA, 19 nt, Human
uguguguuuauauauguau

SEQ ID NO: 782812 - RNA, 22 nt, Human
aggggaugauccucccgcagcg

SEQ ID NO: 782813 - RNA, 20 nt, Human
auccaugagagucuggauuc

SEQ ID NO: 782814 - RNA, 22 nt, Human
acuggcaggcugcuggccggcg

SEQ ID NO: 782815 - RNA, 22 nt, Human
gaggauggaggugugagcuaug

SEQ ID NO: 782816 - RNA, 19 nt, Human
caagugaagccugggaugg

SEQ ID NO: 782817 - RNA, 22 nt, Human
gcagggaagacccggagcagcg

SEQ ID NO: 782818 - RNA, 22 nt, Human
ugcauggaggaagaugaaugca

SEQ ID NO: 782819 - RNA, 22 nt, Human
acauuuaaauaccuauguuucu

SEQ ID NO: 782820 - RNA, 20 nt, Human
uguuaaaggacacuugcuuu

SEQ ID NO: 782821 - RNA, 22 nt, Human
ugaaggcccagccacagaaugg

SEQ ID NO: 782822 - RNA, 22 nt, Human
caugugguucaaguacuccaca

SEQ ID NO: 782823 - RNA, 22 nt, Human
ggaccuggcaauuugcaucucu

SEQ ID NO: 782824 - RNA, 21 nt, Human
cuugaaagguagagucuacag

SEQ ID NO: 782825 - RNA, 22 nt, Human
gcccaggaguucaagucuagug

SEQ ID NO: 782826 - RNA, 22 nt, Human
uuuguuaauucuuauguuagag

SEQ ID NO: 782827 - RNA, 22 nt, Human
agacccagaaagcagcugcauu

SEQ ID NO: 782828 - RNA, 22 nt, Human
uaucuguugucuuuuacaugua

SEQ ID NO: 782829 - RNA, 22 nt, Human
gucaggauuauaauccccaugg

SEQ ID NO: 782830 - RNA, 22 nt, Human
cagucuuuguucccauuacuga

SEQ ID NO: 782831 - RNA, 17 nt, Human
ggcagccucaggcguuu

SEQ ID NO: 782832 - RNA, 22 nt, Human
auucuucaaagagugucaaagu

SEQ ID NO: 782833 - RNA, 22 nt, Human
uuucucugcugccugugucgau

SEQ ID NO: 782834 - RNA, 22 nt, Human
aagggaggccagagguuuugca

SEQ ID NO: 782835 - RNA, 22 nt, Human
guugaaugaaucauucuaugua

SEQ ID NO: 782836 - RNA, 22 nt, Human
auacuaaaguauagaacuuagu

SEQ ID NO: 782837 - RNA, 22 nt, Human
caaggccacguucugcaugcgg

SEQ ID NO: 782838 - RNA, 22 nt, Human
gaggcaucugggcacagaagug

SEQ ID NO: 782839 - RNA, 22 nt, Human
ucucugguuauuaacuaacucc

SEQ ID NO: 782840 - RNA, 22 nt, Human
uuucacaacugcuuauuugaga

SEQ ID NO: 782841 - RNA, 22 nt, Human
ggagaggaaaugccagcacuuc

SEQ ID NO: 782842 - RNA, 22 nt, Human
gacccaggagugcagagagugg

SEQ ID NO: 782843 - RNA, 22 nt, Human
cuguauuuguccucuauuuauu

SEQ ID NO: 782844 - RNA, 22 nt, Human
gaaucucaguggaagcaggaag

SEQ ID NO: 782845 - RNA, 22 nt, Human
agugugagcccuggaguggugc

SEQ ID NO: 782846 - RNA, 22 nt, Human
agcccagggacagggcggaugu

SEQ ID NO: 782847 - RNA, 22 nt, Human
uugaaguuguaguucagugaag

SEQ ID NO: 782848 - RNA, 22 nt, Human
agagagggcauagaaaaaggga

SEQ ID NO: 782849 - RNA, 22 nt, Human
uggaaggagacugggaagugug

SEQ ID NO: 782850 - RNA, 22 nt, Human
cggagaggaccugcaacucgcu

SEQ ID NO: 782851 - RNA, 21 nt, Human
aucauucuggaaaauucaagc

SEQ ID NO: 782852 - RNA, 22 nt, Human
cucuccucugaaguggugaccc

SEQ ID NO: 782853 - RNA, 17 nt, Human
aggccagaugaggcaag

SEQ ID NO: 782854 - RNA, 17 nt, Human
ucccaggaacagggaau

SEQ ID NO: 782855 - RNA, 22 nt, Human
uuaugauuugccacagauuggu

SEQ ID NO: 782856 - RNA, 22 nt, Human
ggcaagaaggcuucagguagcu

SEQ ID NO: 782857 - RNA, 22 nt, Human
gagguagccacagauagagacu

SEQ ID NO: 782858 - RNA, 22 nt, Human
uuugcauaggauggacauuuua

SEQ ID NO: 782859 - RNA, 22 nt, Human
aggaagcuagagccaccggacu

SEQ ID NO: 782860 - RNA, 22 nt, Human
ucuuagaaguuuauggcacgga

SEQ ID NO: 782861 - RNA, 22 nt, Human
acugcccucccaucuauugcaa

SEQ ID NO: 782862 - RNA, 22 nt, Human
ggcagcuggguuggccagaaac

SEQ ID NO: 782863 - RNA, 22 nt, Human
ggggggugcugaucaguggagc

SEQ ID NO: 782864 - RNA, 22 nt, Human
aguaaaucagaccucauuaugu

SEQ ID NO: 782865 - RNA, 22 nt, Human
auugaaagauaggcuacugugg

SEQ ID NO: 782866 - RNA, 22 nt, Human
aucauucugauggucaaugcua

SEQ ID NO: 782867 - RNA, 22 nt, Human
caacugugaauuuuaugauacc

SEQ ID NO: 782868 - RNA, 22 nt, Human
cagaggcaggauaagaacugcg

SEQ ID NO: 782869 - RNA, 22 nt, Human
uaccauuucauucuuuccucau

SEQ ID NO: 782870 - RNA, 22 nt, Human
aggcagccaucugcaggaagga

SEQ ID NO: 782871 - RNA, 22 nt, Human
ucaggauaaaauguaauggcaa

SEQ ID NO: 782872 - RNA, 22 nt, Human
gaggcagugucgguggcaggau

SEQ ID NO: 782873 - RNA, 22 nt, Human
aggcaguuuauccccagagccu

SEQ ID NO: 782874 - RNA, 22 nt, Human
agauggcagggguaccuggaag

SEQ ID NO: 782875 - RNA, 22 nt, Human
cucccaggguagggagagacua

SEQ ID NO: 782876 - RNA, 22 nt, Human
aaagauuauggcauugaaauac

SEQ ID NO: 782877 - RNA, 22 nt, Human
uugaaaguuuauggagucugca

SEQ ID NO: 782878 - RNA, 22 nt, Human
agagacugcgugucagcgcugg

SEQ ID NO: 782879 - RNA, 18 nt, Human
gcagcuagccaggggggc

SEQ ID NO: 782880 - RNA, 22 nt, Human
uucuucaauuuuccauauacug

SEQ ID NO: 782881 - RNA, 18 nt, Human
uuccaugauuccuuucac

SEQ ID NO: 782882 - RNA, 22 nt, Human
aauacauauggaauuccauguu

SEQ ID NO: 782883 - RNA, 22 nt, Human
aucccaugagaccacguuggcu

SEQ ID NO: 782884 - RNA, 22 nt, Human
ugcaggaaucagaggggaagcg

SEQ ID NO: 782885 - RNA, 22 nt, Human
uucaugugauaaaugugugacu

SEQ ID NO: 782886 - RNA, 22 nt, Human
accaggaguuuugaccaggggc

SEQ ID NO: 782887 - RNA, 22 nt, Human
acucaggaaaugaagacugguu

SEQ ID NO: 782888 - RNA, 22 nt, Human
aagggcagccugacucacgguc

SEQ ID NO: 782889 - RNA, 22 nt, Human
caggcagcucgaugccuuguug

SEQ ID NO: 782890 - RNA, 22 nt, Human
ucacugcucuccaauguggagu

SEQ ID NO: 782891 - RNA, 22 nt, Human
auuucagaugaccaaauggaaa

SEQ ID NO: 782892 - RNA, 22 nt, Human
uucugugauugacauguggcuu

SEQ ID NO: 782893 - RNA, 22 nt, Human
uaggagggcccugaaaauggca

SEQ ID NO: 782894 - RNA, 22 nt, Human
auuugcuuaucuccacaguugu

SEQ ID NO: 782895 - RNA, 23 nt, Human
agggagcuaaaaggcuggagcag

SEQ ID NO: 782896 - RNA, 22 nt, Human
guuauaaaaugcacaguuguuu

SEQ ID NO: 782897 - RNA, 22 nt, Human
ucacuucacacccacuaucaug

SEQ ID NO: 782898 - RNA, 22 nt, Human
gaggaaccaaucugugauauuc

SEQ ID NO: 782899 - RNA, 22 nt, Human
cauuuccugucuggaggucaaa

SEQ ID NO: 782900 - RNA, 22 nt, Human
ucaacugcaaguuugcuuaguu

SEQ ID NO: 782901 - RNA, 22 nt, Human
ccagugcuaagguagccucugc

SEQ ID NO: 782902 - RNA, 21 nt, Human
gcugcccaacccugcaucucc

SEQ ID NO: 782903 - RNA, 23 nt, Human
cugcuguuuucuguaccugaagc

SEQ ID NO: 782904 - RNA, 23 nt, Human
ucucuuucaagagcuuaaugugc

SEQ ID NO: 782905 - RNA, 22 nt, Human
gaggcagcucuucugaaugggg

SEQ ID NO: 782906 - RNA, 22 nt, Human
uucaugugaucacagauuguaa

SEQ ID NO: 782907 - RNA, 22 nt, Human
aacaugcugccuuucuacgagu

SEQ ID NO: 782908 - RNA, 22 nt, Human
cuucuucaaccugaaaguuuca

SEQ ID NO: 782909 - RNA, 22 nt, Human
gcagcugcagagaccggguggg

SEQ ID NO: 782910 - RNA, 22 nt, Human
aggcagugccuggaccccagcu

SEQ ID NO: 782911 - RNA, 22 nt, Human
ucagauggcacacagagccugc

SEQ ID NO: 782912 - RNA, 22 nt, Human
ugaaguuauauauguugaaaau

SEQ ID NO: 782913 - RNA, 19 nt, Human
agccuggcuuugcucugcu

SEQ ID NO: 782914 - RNA, 22 nt, Human
gcaguucuacuuauccauagac

SEQ ID NO: 782915 - RNA, 22 nt, Human
uuugaaguguuauuucuaucac

SEQ ID NO: 782916 - RNA, 22 nt, Human
cccaggaaccuaccagcucgag

SEQ ID NO: 782917 - RNA, 20 nt, Human
auaaaauaacugccacaaga

SEQ ID NO: 782918 - RNA, 22 nt, Human
aauugcuaaagauuauguuuuc

SEQ ID NO: 782919 - RNA, 23 nt, Human
ucaggauauugugugccaaggug

SEQ ID NO: 782920 - RNA, 22 nt, Human
ugcugaaacaauaacauacugg

SEQ ID NO: 782921 - RNA, 22 nt, Human
cauuguuaccaucuuuuaccua

SEQ ID NO: 782922 - RNA, 22 nt, Human
uuucaaaccuacuuguauguuu

SEQ ID NO: 782923 - RNA, 22 nt, Human
gauggcagcagcagccagggau

SEQ ID NO: 782924 - RNA, 22 nt, Human
agucugucugucacuucugcag

SEQ ID NO: 782925 - RNA, 22 nt, Human
uucuuuuacauuaagauuucag

SEQ ID NO: 782926 - RNA, 22 nt, Human
cuccaggagggggauggcugua

SEQ ID NO: 782927 - RNA, 22 nt, Human
ggcaggcaaugaggaugggaag

SEQ ID NO: 782928 - RNA, 22 nt, Human
cccaggaguaagugacauuguu

SEQ ID NO: 782929 - RNA, 19 nt, Human
uugaaauuguuugauaugg

SEQ ID NO: 782930 - RNA, 22 nt, Human
uuugaauaucacaaacuuucaa

SEQ ID NO: 782931 - RNA, 22 nt, Human
uuucuuauacuauauugucauc

SEQ ID NO: 782932 - RNA, 22 nt, Human
uuacuuugcuuucucauuacag

SEQ ID NO: 782933 - RNA, 22 nt, Human
uccucagaaaccccugugaggu

SEQ ID NO: 782934 - RNA, 22 nt, Human
cugccaggcagggagauggcug

SEQ ID NO: 782935 - RNA, 22 nt, Human
ucauucuuuaccaaguugucac

SEQ ID NO: 782936 - RNA, 22 nt, Human
uagcacauacauaauagauaga

SEQ ID NO: 782937 - RNA, 22 nt, Human
gaagcagcgaaguggaagggac

SEQ ID NO: 782938 - RNA, 22 nt, Human
uggcuguguuaccacuucaugu

SEQ ID NO: 782939 - RNA, 22 nt, Human
ucuguggauuuuaguguucaug

SEQ ID NO: 782940 - RNA, 22 nt, Human
acccaggacacagagaugaccc

SEQ ID NO: 782941 - RNA, 22 nt, Human
ccaggagagcucuaaauggcug

SEQ ID NO: 782942 - RNA, 22 nt, Human
uuccagcaggcagacaggagau

SEQ ID NO: 782943 - RNA, 22 nt, Human
accauccugaaaccuucaugcu

SEQ ID NO: 782944 - RNA, 22 nt, Human
aggagaggguggcauuaaguuu

SEQ ID NO: 782945 - RNA, 23 nt, Human
gaggcagcuccugcagugcccug

SEQ ID NO: 782946 - RNA, 22 nt, Human
uuaaauuagucaagcuucucug

SEQ ID NO: 782947 - RNA, 22 nt, Human
gaggcagccagagguucucauu

SEQ ID NO: 782948 - RNA, 22 nt, Human
cuucugugauuugguuaggaua

SEQ ID NO: 782949 - RNA, 23 nt, Human
uuuauccaacucuguaaucucuc

SEQ ID NO: 782950 - RNA, 22 nt, Human
agggagcucacaguccaguaga

SEQ ID NO: 782951 - RNA, 22 nt, Human
agaggaugguugaggaagaccu

SEQ ID NO: 782952 - RNA, 22 nt, Human
gcucagagcuugaaguuccacu

SEQ ID NO: 782953 - RNA, 22 nt, Human
gcaggagagccagcaggcuucc

SEQ ID NO: 782954 - RNA, 20 nt, Human
uucacagaggacucagguca

SEQ ID NO: 782955 - RNA, 22 nt, Human
uuuggaaugguaccuucaguug

SEQ ID NO: 782956 - RNA, 22 nt, Human
ggaggcugagaaguccaagauc

SEQ ID NO: 782957 - RNA, 21 nt, Human
gggugggaggacacagcaggc

SEQ ID NO: 782958 - RNA, 19 nt, Human
aucugccuuagugcugcug

SEQ ID NO: 782959 - RNA, 22 nt, Human
ucucaggaagugauauugagac

SEQ ID NO: 782960 - RNA, 22 nt, Human
uucagaaugugaccuuauuugg

SEQ ID NO: 782961 - RNA, 22 nt, Human
uccauuuucuugcucuagguaa

SEQ ID NO: 782962 - RNA, 22 nt, Human
acacauuucucuuuuuguaagu

SEQ ID NO: 782963 - RNA, 22 nt, Human
uggcagcagacaaaaggccauu

SEQ ID NO: 782964 - RNA, 22 nt, Human
aauauaauuuuauuccuagagu

SEQ ID NO: 782965 - RNA, 22 nt, Human
ugaaagguuauuuaggucugcu

SEQ ID NO: 782966 - RNA, 22 nt, Human
ucuuuccauggccacacagucu

SEQ ID NO: 782967 - RNA, 23 nt, Human
accaggagaaaagcuuugcggga

SEQ ID NO: 782968 - RNA, 22 nt, Human
cccaggagaauauuuuuggguc

SEQ ID NO: 782969 - RNA, 22 nt, Human
cuucucagcauuuugucagucu

SEQ ID NO: 782970 - RNA, 22 nt, Human
cggagccugcuuguugcagcug

SEQ ID NO: 782971 - RNA, 20 nt, Human
uuucaguugguuaauggcau

SEQ ID NO: 782972 - RNA, 22 nt, Human
agcauccaacaggagggaaggg

SEQ ID NO: 782973 - RNA, 22 nt, Human
auauauuugagaauauucauga

SEQ ID NO: 782974 - RNA, 22 nt, Human
gggcagcuggcuuauagguuug

SEQ ID NO: 782975 - RNA, 22 nt, Human
ccaggcugagcaugauuggagc

SEQ ID NO: 782976 - RNA, 22 nt, Human
uuuccagguauuaauacuguau

SEQ ID NO: 782977 - RNA, 22 nt, Human
caucacccggaacugugucugc

SEQ ID NO: 782978 - RNA, 22 nt, Human
uccaggagggggagccgugccg

SEQ ID NO: 782979 - RNA, 22 nt, Human
cccaggaggcagaaguugcagu

SEQ ID NO: 782980 - RNA, 22 nt, Human
cugcauuagucaugcuuugcag

SEQ ID NO: 782981 - RNA, 22 nt, Human
gaggcagaaguugcagugagca

SEQ ID NO: 782982 - RNA, 22 nt, Human
uuucucaguuacuagcuguggu

SEQ ID NO: 782983 - RNA, 22 nt, Human
ccaggaagcugucugauaugaa

SEQ ID NO: 782984 - RNA, 23 nt, Human
ucccaggaaucugcauuuuuaac

SEQ ID NO: 782985 - RNA, 22 nt, Human
aucaggauuauuaaaucuggau

SEQ ID NO: 782986 - RNA, 22 nt, Human
accaggaguaacagugaguggu

SEQ ID NO: 782987 - RNA, 22 nt, Human
ugaauaguccuuggaauaacug

SEQ ID NO: 782988 - RNA, 22 nt, Human
acaggagaauuaucuggaacaa

SEQ ID NO: 782989 - RNA, 22 nt, Human
aucacauugccagugauuaccc

SEQ ID NO: 782990 - RNA, 22 nt, Human
uacacacaugcauuugccuuau

SEQ ID NO: 782991 - RNA, 22 nt, Human
agucucuuauucccuauugcug

SEQ ID NO: 782992 - RNA, 22 nt, Human
cuucucagcaugguuacuguga

SEQ ID NO: 782993 - RNA, 22 nt, Human
cccaggagauggugcguggucu

SEQ ID NO: 782994 - RNA, 22 nt, Human
ggagcacuauaauagagauuuu

SEQ ID NO: 782995 - RNA, 22 nt, Human
auaaauaucacuguugucccuc

SEQ ID NO: 782996 - RNA, 22 nt, Human
gcuggcuugauaguuucugcuu

SEQ ID NO: 782997 - RNA, 22 nt, Human
ucucucuugucaccccaucugc

SEQ ID NO: 782998 - RNA, 22 nt, Human
gcaagcugcucuuauguggagg

SEQ ID NO: 782999 - RNA, 22 nt, Human
gaggggaaaguucugcacaagg

SEQ ID NO: 783000 - RNA, 22 nt, Human
cuuaagaugaggucaugcuaua

SEQ ID NO: 783001 - RNA, 21 nt, Human
uucuccccagcgaauccucgg

SEQ ID NO: 783002 - RNA, 22 nt, Human
uuugaaagcaccauuugaguag

SEQ ID NO: 783003 - RNA, 22 nt, Human
augauauuugcaaugugcuugc

SEQ ID NO: 783004 - RNA, 22 nt, Human
ucuuccaagguugcacacuauc

SEQ ID NO: 783005 - RNA, 22 nt, Human
cugugauuguuaguuccuauac

SEQ ID NO: 783006 - RNA, 22 nt, Human
uucccaugccuggccccuaucc

SEQ ID NO: 783007 - RNA, 22 nt, Human
cugcugugucagaguccagggg

SEQ ID NO: 783008 - RNA, 22 nt, Human
aucauucuaguccuuauggucu

SEQ ID NO: 783009 - RNA, 22 nt, Human
gcccaggagaggccagggcuga

SEQ ID NO: 783010 - RNA, 21 nt, Human
uccaggaguucuaauaggugu

SEQ ID NO: 783011 - RNA, 21 nt, Human
aggcaucuaaagagaguagac

SEQ ID NO: 783012 - RNA, 22 nt, Human
uacccaggagaaacagcagggc

SEQ ID NO: 783013 - RNA, 20 nt, Human
ugcguguguauuuauuuucu

SEQ ID NO: 783014 - RNA, 22 nt, Human
auuuccaguccuaaugaucugg

SEQ ID NO: 783015 - RNA, 22 nt, Human
cagaugaggcaaccucauugcu

SEQ ID NO: 783016 - RNA, 22 nt, Human
cagcuggccaaucagggcgccc

SEQ ID NO: 783017 - RNA, 22 nt, Human
guucuucaaagugacaacuaaa

SEQ ID NO: 783018 - RNA, 22 nt, Human
gaggcagcaaaauauaucauaa

SEQ ID NO: 783019 - RNA, 22 nt, Human
ugauuuuuagcuauucugaaga

SEQ ID NO: 783020 - RNA, 22 nt, Human
aaacauuugcaacucgguuugg

SEQ ID NO: 783021 - RNA, 22 nt, Human
ggagcggagggagggccacugu

SEQ ID NO: 783022 - RNA, 22 nt, Human
cuucuucaauagcaagcgcaua

SEQ ID NO: 783023 - RNA, 22 nt, Human
agccuuguuggucugaguuugg

SEQ ID NO: 783024 - RNA, 22 nt, Human
ucacagacauggugagguaaca

SEQ ID NO: 783025 - RNA, 22 nt, Human
uuuauuguuuagaagggggcug

SEQ ID NO: 783026 - RNA, 22 nt, Human
gaggcacuggaggaaaggagaa

SEQ ID NO: 783027 - RNA, 22 nt, Human
cccaggaaguggagguugcagu

SEQ ID NO: 783028 - RNA, 22 nt, Human
uauuuccagcaguaagaagaca

SEQ ID NO: 783029 - RNA, 22 nt, Human
caaaugauacuguuuuuagucu

SEQ ID NO: 783030 - RNA, 22 nt, Human
uuagccauggacugaauugacu

SEQ ID NO: 783031 - RNA, 22 nt, Human
uucuagaugauaaaccagcagc

SEQ ID NO: 783032 - RNA, 22 nt, Human
cauggagauaaacugaaauauu

SEQ ID NO: 783033 - RNA, 22 nt, Human
aaagcagaggugauaugacuua

SEQ ID NO: 783034 - RNA, 22 nt, Human
aggaagcuccuggagagccagu

SEQ ID NO: 783035 - RNA, 22 nt, Human
uaaggccaaggggccauagucu

SEQ ID NO: 783036 - RNA, 22 nt, Human
gaaaggccauuucugaggguuu

SEQ ID NO: 783037 - RNA, 22 nt, Human
gagagaggccuccauguacuga

SEQ ID NO: 783038 - RNA, 22 nt, Human
acacauuuacauguuuacguau

SEQ ID NO: 783039 - RNA, 22 nt, Human
cugcgcagggguggcgccagaa

SEQ ID NO: 783040 - RNA, 22 nt, Human
cagugguugguagauacuugag

SEQ ID NO: 783041 - RNA, 22 nt, Human
ccagaggaggggggucuuucug

SEQ ID NO: 783042 - RNA, 22 nt, Human
auucucuuuguauaacaucuug

SEQ ID NO: 783043 - RNA, 22 nt, Human
cuugcuggugguguuuucuaug

SEQ ID NO: 783044 - RNA, 22 nt, Human
auucuucacuguuucagaauga

SEQ ID NO: 783045 - RNA, 21 nt, Human
ggcagccucuguggaagggga

SEQ ID NO: 783046 - RNA, 22 nt, Human
gaggggagacagggaaaucagu

SEQ ID NO: 783047 - RNA, 22 nt, Human
uuugacaucaauacccuagaau

SEQ ID NO: 783048 - RNA, 22 nt, Human
uucagaaguagcuaagcaguca

SEQ ID NO: 783049 - RNA, 22 nt, Human
auuucagguaccugugggaucc

SEQ ID NO: 783050 - RNA, 22 nt, Human
ugaaggccacuuccugugagcu

SEQ ID NO: 783051 - RNA, 22 nt, Human
ggaggccagggacccagucagc

SEQ ID NO: 783052 - RNA, 22 nt, Human
ugaaugaguuuggcugcuguuc

SEQ ID NO: 783053 - RNA, 22 nt, Human
cacauuuaauccuuuauaagua

SEQ ID NO: 783054 - RNA, 22 nt, Human
ugcugcuguuuccuacaucuca

SEQ ID NO: 783055 - RNA, 22 nt, Human
guuuauaaggcccaauauuucu

SEQ ID NO: 783056 - RNA, 22 nt, Human
cccaggaacagggcucagaccc

SEQ ID NO: 783057 - RNA, 22 nt, Human
uucuucuucuggcugcaccugg

SEQ ID NO: 783058 - RNA, 22 nt, Human
ucaucugucccaggcuuuuuuc

SEQ ID NO: 783059 - RNA, 22 nt, Human
cccaggaggcggagguuguggu

SEQ ID NO: 783060 - RNA, 22 nt, Human
ugaggcaggacugagcgggaug

SEQ ID NO: 783061 - RNA, 22 nt, Human
gagaggauccacaaaccaggaa

SEQ ID NO: 783062 - RNA, 22 nt, Human
uuucugugguggguaguucaga

SEQ ID NO: 783063 - RNA, 22 nt, Human
acuguguggaccacucugaggc

SEQ ID NO: 783064 - RNA, 22 nt, Human
acaccauacucauguugguucc

SEQ ID NO: 783065 - RNA, 22 nt, Human
agcuacccgaggacaggcuaag

SEQ ID NO: 783066 - RNA, 19 nt, Human
agaggcagucuccaacagg

SEQ ID NO: 783067 - RNA, 22 nt, Human
auuuucaaaacaucugcugugu

SEQ ID NO: 783068 - RNA, 22 nt, Human
aaugcuuuuugcgaaaugugca

SEQ ID NO: 783069 - RNA, 22 nt, Human
cuuaaauucuuaaugcccucau

SEQ ID NO: 783070 - RNA, 21 nt, Human
acaggagaccgccuggcaguc

SEQ ID NO: 783071 - RNA, 22 nt, Human
gcugcugucacggugcuaaggg

SEQ ID NO: 783072 - RNA, 22 nt, Human
ugaggcaguucuuacuuguauu

SEQ ID NO: 783073 - RNA, 22 nt, Human
auauaauacaaccugcuaagug

SEQ ID NO: 783074 - RNA, 22 nt, Human
aaucauucuuauuucacagcaa

SEQ ID NO: 783075 - RNA, 22 nt, Human
augcagcugugggcaagaaaug

SEQ ID NO: 783076 - RNA, 22 nt, Human
cagcucccgccaucgggaggca

SEQ ID NO: 783077 - RNA, 22 nt, Human
cauuuguaggaugcuucuuguu

SEQ ID NO: 783078 - RNA, 22 nt, Human
uagugcuuggcccuaccagaua

SEQ ID NO: 783079 - RNA, 17 nt, Human
cccaugagcccacuccc

SEQ ID NO: 783080 - RNA, 22 nt, Human
accaggagagauuuuauugaga

SEQ ID NO: 783081 - RNA, 22 nt, Human
ucccuucacagaugcgauguuu

SEQ ID NO: 783082 - RNA, 22 nt, Human
cagcugcaguucaaugcuugcu

SEQ ID NO: 783083 - RNA, 22 nt, Human
aagagaggacauggugaaccug

SEQ ID NO: 783084 - RNA, 22 nt, Human
ccaggaaauagugcugugaucu

SEQ ID NO: 783085 - RNA, 22 nt, Human
cuucuucagcacaauauugaug

SEQ ID NO: 783086 - RNA, 22 nt, Human
caggcagcaggagcccugcucg

SEQ ID NO: 783087 - RNA, 22 nt, Human
cauuuuaaaugauuuaagccaa

SEQ ID NO: 783088 - RNA, 22 nt, Human
agagggcagucucagauuggga

SEQ ID NO: 783089 - RNA, 22 nt, Human
uugaagagugccuuccagacau

SEQ ID NO: 783090 - RNA, 22 nt, Human
ugaaaugaucaguuugguuacu

SEQ ID NO: 783091 - RNA, 22 nt, Human
ucuuugcacugugcaagcagaa

SEQ ID NO: 783092 - RNA, 21 nt, Human
uucuucaugaugauuaauggc

SEQ ID NO: 783093 - RNA, 22 nt, Human
uaaggccaggcuguggucggca

SEQ ID NO: 783094 - RNA, 22 nt, Human
uugaacauuggcaauuucauau

SEQ ID NO: 783095 - RNA, 22 nt, Human
uccaggagaaaacugacggugg

SEQ ID NO: 783096 - RNA, 22 nt, Human
gagaggugaauguggaugccac

SEQ ID NO: 783097 - RNA, 22 nt, Human
uucuucucagggucccacaugg

SEQ ID NO: 783098 - RNA, 22 nt, Human
auggagggugguaagacagaga

SEQ ID NO: 783099 - RNA, 22 nt, Human
cuggcugggagcgagcugcuca

SEQ ID NO: 783100 - RNA, 22 nt, Human
auuuagaacuuuguuugccaau

SEQ ID NO: 783101 - RNA, 22 nt, Human
uuagaaagaacuuuagauauca

SEQ ID NO: 783102 - RNA, 22 nt, Human
agguccagcuguugcagccucc

SEQ ID NO: 783103 - RNA, 22 nt, Human
ggcaggcugcuugggucauguc

SEQ ID NO: 783104 - RNA, 22 nt, Human
uauuuuaaagacugccagccua

SEQ ID NO: 783105 - RNA, 22 nt, Human
cuucuucauguauugauagucu

SEQ ID NO: 783106 - RNA, 22 nt, Human
cucaggaaaggccaugcaaggg

SEQ ID NO: 783107 - RNA, 22 nt, Human
guaggcagguggaggagugaag

SEQ ID NO: 783108 - RNA, 22 nt, Human
agggcaguucaacuucauagug

SEQ ID NO: 783109 - RNA, 22 nt, Human
gcaggagaaaugaagauugggu

SEQ ID NO: 783110 - RNA, 22 nt, Human
gcugguuuccuuaucuauaaag

SEQ ID NO: 783111 - RNA, 22 nt, Human
ccucaugguacuuacuguagcu

SEQ ID NO: 783112 - RNA, 22 nt, Human
aacacugcugcuggguucugug

SEQ ID NO: 783113 - RNA, 22 nt, Human
uuuauauuucccaggauuggcc

SEQ ID NO: 783114 - RNA, 22 nt, Human
aggaguggugcaggaccugcca

SEQ ID NO: 783115 - RNA, 22 nt, Human
gcucaggaccgaggggugggaa

SEQ ID NO: 783116 - RNA, 23 nt, Human
uuucuucagaagccuugcgaggc

SEQ ID NO: 783117 - RNA, 22 nt, Human
cucuuucugauucgcugggacc

SEQ ID NO: 783118 - RNA, 22 nt, Human
gcuguguuggugaagcuguagc

SEQ ID NO: 783119 - RNA, 22 nt, Human
aaggcagcucagcucauggcag

SEQ ID NO: 783120 - RNA, 22 nt, Human
uucagaauauuuguuuuacaug

SEQ ID NO: 783121 - RNA, 22 nt, Human
ccaagaugaucuuuacaguguu

SEQ ID NO: 783122 - RNA, 23 nt, Human
uuugaaaguaucaacucgccuga

SEQ ID NO: 783123 - RNA, 22 nt, Human
ugaggggagacagaguggacuc

SEQ ID NO: 783124 - RNA, 22 nt, Human
gauuuuauauggcauacugugg

SEQ ID NO: 783125 - RNA, 22 nt, Human
cucagaagccuucagucuuggc

SEQ ID NO: 783126 - RNA, 22 nt, Human
ggagcuguucaggacugcuuca

SEQ ID NO: 783127 - RNA, 20 nt, Human
cucuccucacccgugucagg

SEQ ID NO: 783128 - RNA, 22 nt, Human
ugaaaugacagucuuaagcucu

SEQ ID NO: 783129 - RNA, 22 nt, Human
auucuucaguauguguggauug

SEQ ID NO: 783130 - RNA, 22 nt, Human
cauuuucaugaguuucuguuca

SEQ ID NO: 783131 - RNA, 18 nt, Human
uggcagcuagguaaagaa

SEQ ID NO: 783132 - RNA, 22 nt, Human
ggggcagccuccaggaaagcug

SEQ ID NO: 783133 - RNA, 22 nt, Human
auuuccaggagaaaggauuuua

SEQ ID NO: 783134 - RNA, 20 nt, Human
gcccaggaucucugaggcau

SEQ ID NO: 783135 - RNA, 19 nt, Human
aaaaacuuaguccagaaag

SEQ ID NO: 783136 - RNA, 22 nt, Human
aggacagggauucaaacuccca

SEQ ID NO: 783137 - RNA, 22 nt, Human
aaggcagcagugcacgacugau

SEQ ID NO: 783138 - RNA, 20 nt, Human
agcaagaguaaggacagcga

SEQ ID NO: 783139 - RNA, 22 nt, Human
agaaggggagaagcuaccagga

SEQ ID NO: 783140 - RNA, 22 nt, Human
cuucucaaaguugugaaucagg

SEQ ID NO: 783141 - RNA, 22 nt, Human
uuagccauauagaaaaagagcu

SEQ ID NO: 783142 - RNA, 22 nt, Human
cauucuuauauuuacucauuca

SEQ ID NO: 783143 - RNA, 22 nt, Human
gagccaggggucagcuccgagg

SEQ ID NO: 783144 - RNA, 22 nt, Human
uuacaagauaaccugaugcugu

SEQ ID NO: 783145 - RNA, 22 nt, Human
augcuguggccagaguucaacu

SEQ ID NO: 783146 - RNA, 22 nt, Human
ugaaucauggauaaauagcuua

SEQ ID NO: 783147 - RNA, 21 nt, Human
aggaggggucuuucccacuga

SEQ ID NO: 783148 - RNA, 22 nt, Human
uccauuuuguagguaugcuaca

SEQ ID NO: 783149 - RNA, 22 nt, Human
gcggagggcgagcccgcggagc

SEQ ID NO: 783150 - RNA, 22 nt, Human
aaggcagcaccgccuccugaaa

SEQ ID NO: 783151 - RNA, 22 nt, Human
ucauuucaaugauacuacuaag

SEQ ID NO: 783152 - RNA, 19 nt, Human
uucauucucuuauuguugu

SEQ ID NO: 783153 - RNA, 22 nt, Human
gcugcugugaauuuuuuaaaug

SEQ ID NO: 783154 - RNA, 20 nt, Human
aagggcagagggaacagacu

SEQ ID NO: 783155 - RNA, 22 nt, Human
ugauugaagaggugaggaaguu

SEQ ID NO: 783156 - RNA, 22 nt, Human
aggcagauuuaggagaaaagaa

SEQ ID NO: 783157 - RNA, 22 nt, Human
uggcagcugagugcacccccuc

SEQ ID NO: 783158 - RNA, 22 nt, Human
uuugacauggaauaacucauuu

SEQ ID NO: 783159 - RNA, 22 nt, Human
agcccaggagguggagguugca

SEQ ID NO: 783160 - RNA, 22 nt, Human
aggcagauauuggggugaugug

SEQ ID NO: 783161 - RNA, 22 nt, Human
uuucacauuagauaugucauuu

SEQ ID NO: 783162 - RNA, 22 nt, Human
gaaccucagugaaacuggaggu

SEQ ID NO: 783163 - RNA, 22 nt, Human
cagcaggaggugaguagcaggu

SEQ ID NO: 783164 - RNA, 22 nt, Human
ggaggcgauccugggaaacacc

SEQ ID NO: 783165 - RNA, 22 nt, Human
uuccaugagcucugaguucaca

SEQ ID NO: 783166 - RNA, 22 nt, Human
cuucucagucaccugugagucu

SEQ ID NO: 783167 - RNA, 19 nt, Human
agcauuuggaauucuacac

SEQ ID NO: 783168 - RNA, 20 nt, Human
ugugaaagcaguagaaugac

SEQ ID NO: 783169 - RNA, 22 nt, Human
uucucugaguacguuucagugu

SEQ ID NO: 783170 - RNA, 22 nt, Human
gucacuguauccagguuccagc

SEQ ID NO: 783171 - RNA, 22 nt, Human
agucuccuuggccucaaugccu

SEQ ID NO: 783172 - RNA, 22 nt, Human
aggcacaggaaugucauccagu

SEQ ID NO: 783173 - RNA, 22 nt, Human
uccugaggcucacuuugaaugu

SEQ ID NO: 783174 - RNA, 21 nt, Human
agccagcuaucacacagcauu

SEQ ID NO: 783175 - RNA, 22 nt, Human
uuugaaagcuacuuucggguca

SEQ ID NO: 783176 - RNA, 23 nt, Human
uguugaaguaacuguuacauaga

SEQ ID NO: 783177 - RNA, 21 nt, Human
uagggcaggcauuggaagaga

SEQ ID NO: 783178 - RNA, 22 nt, Human
auguuuccgugagcauccuuga

SEQ ID NO: 783179 - RNA, 22 nt, Human
ucuuugcaaauguuauuaucuu

SEQ ID NO: 783180 - RNA, 22 nt, Human
aacuuucuuggaugucucaaca

SEQ ID NO: 783181 - RNA, 19 nt, Human
ugaguucugugguucucaa

SEQ ID NO: 783182 - RNA, 22 nt, Human
uuuauuugaaucaggggagaau

SEQ ID NO: 783183 - RNA, 22 nt, Human
aggcagugcugugcccugaacc

SEQ ID NO: 783184 - RNA, 22 nt, Human
cucccaggggaacuaucaagua

SEQ ID NO: 783185 - RNA, 22 nt, Human
uucaggaucacuaaacccucca

SEQ ID NO: 783186 - RNA, 22 nt, Human
agcugcuacugcucugccagag

SEQ ID NO: 783187 - RNA, 22 nt, Human
ucuuugcagaauuuaacuuugc

SEQ ID NO: 783188 - RNA, 22 nt, Human
uucagcaaauggacuguucagg

SEQ ID NO: 783189 - RNA, 22 nt, Human
uuagccauugucagcacauggc

SEQ ID NO: 783190 - RNA, 22 nt, Human
uugcuagcugguguaugcauug

SEQ ID NO: 783191 - RNA, 22 nt, Human
uuugaaagacagaauauuuuug

SEQ ID NO: 783192 - RNA, 22 nt, Human
uucacagacauugcagacugaa

SEQ ID NO: 783193 - RNA, 22 nt, Human
gccaugcuugguaugcugugag

SEQ ID NO: 783194 - RNA, 22 nt, Human
ucaggagggugacaggcccugg

SEQ ID NO: 783195 - RNA, 22 nt, Human
aggaugagaagauuggaaucuu

SEQ ID NO: 783196 - RNA, 22 nt, Human
cagcuggcugcaugaugccaaa

SEQ ID NO: 783197 - RNA, 22 nt, Human
ccaugagccaggcugaggaagc

SEQ ID NO: 783198 - RNA, 22 nt, Human
cagcuacuccucccaugacuuc

SEQ ID NO: 783199 - RNA, 22 nt, Human
gaugagcauuguuucauguguu

SEQ ID NO: 783200 - RNA, 22 nt, Human
uagggcaggggaggaaucugaa

SEQ ID NO: 783201 - RNA, 22 nt, Human
cucuucuugcuagacugagugc

SEQ ID NO: 783202 - RNA, 22 nt, Human
uugaacuguaagcaugucugcc

SEQ ID NO: 783203 - RNA, 22 nt, Human
uaaggccaauuacauauguuca

SEQ ID NO: 783204 - RNA, 22 nt, Human
uaucuguuaugggcugaauugc

SEQ ID NO: 783205 - RNA, 22 nt, Human
aggcaggccccugagaauagac

SEQ ID NO: 783206 - RNA, 22 nt, Human
aggcaguggcugagaccagggg

SEQ ID NO: 783207 - RNA, 22 nt, Human
gcccaggauucuuucuuccuua

SEQ ID NO: 783208 - RNA, 22 nt, Human
auauuguugacuauaagaguaa

SEQ ID NO: 783209 - RNA, 19 nt, Human
uucuccagccugaccugag

SEQ ID NO: 783210 - RNA, 17 nt, Human
uucaaagcuuaucaagg

SEQ ID NO: 783211 - RNA, 22 nt, Human
ggcaggcucagcagccaaggag

SEQ ID NO: 783212 - RNA, 22 nt, Human
gccaggagcccugggcaaguuc

SEQ ID NO: 783213 - RNA, 22 nt, Human
ucuucuccagugcuucugcaca

SEQ ID NO: 783214 - RNA, 22 nt, Human
ggcagcaucucuggcagcagcu

SEQ ID NO: 783215 - RNA, 22 nt, Human
cccaggaauuggaggcugcagu

SEQ ID NO: 783216 - RNA, 22 nt, Human
uugcacuaggaaaaggcagcca

SEQ ID NO: 783217 - RNA, 22 nt, Human
cuuucauucuuagauauuagug

SEQ ID NO: 783218 - RNA, 22 nt, Human
uucaggauucuuucagacuggg

SEQ ID NO: 783219 - RNA, 22 nt, Human
agggaggucuuugaggggcuua

SEQ ID NO: 783220 - RNA, 22 nt, Human
aggagacauaacuaugaugaga

SEQ ID NO: 783221 - RNA, 22 nt, Human
uggcagcuacagacagagguga

SEQ ID NO: 783222 - RNA, 22 nt, Human
agaaaugaaaccaaagccuaga

SEQ ID NO: 783223 - RNA, 22 nt, Human
uuguugguggaauugaugcuag

SEQ ID NO: 783224 - RNA, 22 nt, Human
aagcaccugcaguugacaaaaa

SEQ ID NO: 783225 - RNA, 22 nt, Human
uuugaaagucaaccuuccaguu

SEQ ID NO: 783226 - RNA, 22 nt, Human
cauuuccacuucugaaaacugg

SEQ ID NO: 783227 - RNA, 22 nt, Human
uuaacaugucuugacuucaucu

SEQ ID NO: 783228 - RNA, 22 nt, Human
ucuucucuccugcuuggcagaa

SEQ ID NO: 783229 - RNA, 22 nt, Human
auguuauaguuauaaaaugagg

SEQ ID NO: 783230 - RNA, 22 nt, Human
ucacaauuuggauacagcuaug

SEQ ID NO: 783231 - RNA, 22 nt, Human
aaggccagcuuguagggcuggu

SEQ ID NO: 783232 - RNA, 22 nt, Human
acauuucuaguuguucaucucc

SEQ ID NO: 783233 - RNA, 22 nt, Human
augcuguggggagugaggguag

SEQ ID NO: 783234 - RNA, 22 nt, Human
ugaggggagcccgcccuggacg

SEQ ID NO: 783235 - RNA, 22 nt, Human
augcuguguggucaaguuaauu

SEQ ID NO: 783236 - RNA, 22 nt, Human
ucaggagauggucuuuauaggc

SEQ ID NO: 783237 - RNA, 22 nt, Human
ugucucugggugauucaguccu

SEQ ID NO: 783238 - RNA, 20 nt, Human
ugaaggccagcagcauaggg

SEQ ID NO: 783239 - RNA, 22 nt, Human
aucaggaucagggcuagcagag

SEQ ID NO: 783240 - RNA, 22 nt, Human
gaccaaggaagaggggagccag

SEQ ID NO: 783241 - RNA, 22 nt, Human
cauauaaauacaacauguguua

SEQ ID NO: 783242 - RNA, 22 nt, Human
aggcaguuucugggacagcaua

SEQ ID NO: 783243 - RNA, 22 nt, Human
uccaggagugugugcuaauggg

SEQ ID NO: 783244 - RNA, 22 nt, Human
ucaggaugguccuuuaugagaa

SEQ ID NO: 783245 - RNA, 22 nt, Human
gcccaggaguugaaugcagcag

SEQ ID NO: 783246 - RNA, 22 nt, Human
aaaaaucuaugacugcuucucc

SEQ ID NO: 783247 - RNA, 22 nt, Human
gaaauuauugcuagagacugca

SEQ ID NO: 783248 - RNA, 22 nt, Human
ugcuucuggaaacaguggcugu

SEQ ID NO: 783249 - RNA, 22 nt, Human
uaggaggguuagagggaaauau

SEQ ID NO: 783250 - RNA, 22 nt, Human
cuggcuugcagcucaucauaaa

SEQ ID NO: 783251 - RNA, 17 nt, Human
cucacggaggaugaauc

SEQ ID NO: 783252 - RNA, 22 nt, Human
caggauagaaaggccauggagu

SEQ ID NO: 783253 - RNA, 22 nt, Human
guucuucagaggggaaagaacc

SEQ ID NO: 783254 - RNA, 23 nt, Human
uaauucacauauacauugcuuca

SEQ ID NO: 783255 - RNA, 19 nt, Human
ugaaauggcaguugcuaaa

SEQ ID NO: 783256 - RNA, 22 nt, Human
gacagcugugcaggagaagggg

SEQ ID NO: 783257 - RNA, 22 nt, Human
cugcuuugcauagcugccagag

SEQ ID NO: 783258 - RNA, 22 nt, Human
acaaauaugguacucggagaaa

SEQ ID NO: 783259 - RNA, 22 nt, Human
cugcuguguuggcauuggauag

SEQ ID NO: 783260 - RNA, 22 nt, Human
gagugcagaugaacagaagauu

SEQ ID NO: 783261 - RNA, 22 nt, Human
ccaggagagcgcccucccggcc

SEQ ID NO: 783262 - RNA, 22 nt, Human
cuuuggcagccucugcuauuga

SEQ ID NO: 783263 - RNA, 22 nt, Human
aagcgccaugguuccugcgcag

SEQ ID NO: 783264 - RNA, 22 nt, Human
auuuccuuugcaaagacugugc

SEQ ID NO: 783265 - RNA, 22 nt, Human
acucagaagauauaaugacuca

SEQ ID NO: 783266 - RNA, 22 nt, Human
ugcuuggcuuucugagcuucug

SEQ ID NO: 783267 - RNA, 22 nt, Human
uucagugucaauuuuuaaauau

SEQ ID NO: 783268 - RNA, 19 nt, Human
uuagccauccacagugaaa

SEQ ID NO: 783269 - RNA, 22 nt, Human
agggacuuguguccuauguaug

SEQ ID NO: 783270 - RNA, 22 nt, Human
augcuguguuuuaaauggaaau

SEQ ID NO: 783271 - RNA, 22 nt, Human
uucuuacagaguuuacagagcc

SEQ ID NO: 783272 - RNA, 22 nt, Human
auggcagccugagcagaggaau

SEQ ID NO: 783273 - RNA, 22 nt, Human
agagggcaaguguaguccagua

SEQ ID NO: 783274 - RNA, 22 nt, Human
gcuuuggaugugugccugaggu

SEQ ID NO: 783275 - RNA, 22 nt, Human
ugaggcaggagaauggcgggaa

SEQ ID NO: 783276 - RNA, 20 nt, Human
cuucuucagccuaugcuuca

SEQ ID NO: 783277 - RNA, 22 nt, Human
aggccagacagcuagaaacagg

SEQ ID NO: 783278 - RNA, 22 nt, Human
ucccaggaucugagggcagaga

SEQ ID NO: 783279 - RNA, 22 nt, Human
gagggccagcagccucagcaug

SEQ ID NO: 783280 - RNA, 22 nt, Human
uucucagagcucacuguaguaa

SEQ ID NO: 783281 - RNA, 22 nt, Human
uccaggagagguguggggacug

SEQ ID NO: 783282 - RNA, 22 nt, Human
ucagggugaaccaggcaggaau

SEQ ID NO: 783283 - RNA, 22 nt, Human
ucuucagacccuuagcugugau

SEQ ID NO: 783284 - RNA, 22 nt, Human
ugggagcccaagggagcugccg

SEQ ID NO: 783285 - RNA, 22 nt, Human
guggaaugaauagauuugcauu

SEQ ID NO: 783286 - RNA, 22 nt, Human
ucccaggauguuuauggcuggu

SEQ ID NO: 783287 - RNA, 22 nt, Human
ugcuuagacgucaaguacagcc

SEQ ID NO: 783288 - RNA, 22 nt, Human
agaggggaaggaugugauguga

SEQ ID NO: 783289 - RNA, 22 nt, Human
caguaaagcauguaugucuuca

SEQ ID NO: 783290 - RNA, 22 nt, Human
ucauuucuauugcuacugucug

SEQ ID NO: 783291 - RNA, 22 nt, Human
aagcagaggaccgacggaggga

SEQ ID NO: 783292 - RNA, 22 nt, Human
gguuugaacagcuuuggagaag

SEQ ID NO: 783293 - RNA, 22 nt, Human
gcuccucuauuccccacauuuu

SEQ ID NO: 783294 - RNA, 22 nt, Human
ucuuuggaucccaacuggcugg

SEQ ID NO: 783295 - RNA, 22 nt, Human
auuugcuucugugaaaucaagu

SEQ ID NO: 783296 - RNA, 18 nt, Human
uuugcaaaggaaguaugg

SEQ ID NO: 783297 - RNA, 22 nt, Human
cauuuguuaauuacuauuaucu

SEQ ID NO: 783298 - RNA, 23 nt, Human
uugauuucaaaugcagagaacac

SEQ ID NO: 783299 - RNA, 22 nt, Human
cucuccucagaacaggcccucu

SEQ ID NO: 783300 - RNA, 22 nt, Human
auuuccauagagcgucucacag

SEQ ID NO: 783301 - RNA, 22 nt, Human
gacagguggggaaacuaaggua

SEQ ID NO: 783302 - RNA, 22 nt, Human
auucugagacaauugccgucag

SEQ ID NO: 783303 - RNA, 22 nt, Human
cauucauuuaugaaauaucuau

SEQ ID NO: 783304 - RNA, 22 nt, Human
caguugccuacuacauggcagg

SEQ ID NO: 783305 - RNA, 22 nt, Human
ugacauaauaauccaaacauac

SEQ ID NO: 783306 - RNA, 22 nt, Human
ucugggaaguccucugucaugc

SEQ ID NO: 783307 - RNA, 21 nt, Human
auggagggaccagggaagcag

SEQ ID NO: 783308 - RNA, 22 nt, Human
cucaggaugaaagucaugguga

SEQ ID NO: 783309 - RNA, 22 nt, Human
uuggcaguaaaagaaaaugcuu

SEQ ID NO: 783310 - RNA, 22 nt, Human
acagagagaaacaaucagcagc

SEQ ID NO: 783311 - RNA, 22 nt, Human
uccccagggcugcagagggugu

SEQ ID NO: 783312 - RNA, 22 nt, Human
aaagacuuggcuuaugauuugc

SEQ ID NO: 783313 - RNA, 22 nt, Human
uuauuuaaugugaucugaagag

SEQ ID NO: 783314 - RNA, 22 nt, Human
caggcagcugcgacaagagagc

SEQ ID NO: 783315 - RNA, 22 nt, Human
uaggagagcugaacuauugucu

SEQ ID NO: 783316 - RNA, 22 nt, Human
caggaggggguggaguuucgcc

SEQ ID NO: 783317 - RNA, 22 nt, Human
gaggagagagggacugucugca

SEQ ID NO: 783318 - RNA, 22 nt, Human
uugaaagacuucuccugugaaa

SEQ ID NO: 783319 - RNA, 22 nt, Human
ugaaaugaaacagaacauauca

SEQ ID NO: 783320 - RNA, 22 nt, Human
accaggagacaugaccaaugag

SEQ ID NO: 783321 - RNA, 22 nt, Human
uccaggagauucauuaggucau

SEQ ID NO: 783322 - RNA, 22 nt, Human
ucucugaguaagugacaguuca

SEQ ID NO: 783323 - RNA, 22 nt, Human
cuacccaggcuuagagggcugg

SEQ ID NO: 783324 - RNA, 18 nt, Human
ucuuccaacacugacacc

SEQ ID NO: 783325 - RNA, 22 nt, Human
uagggauguccugagacuuggc

SEQ ID NO: 783326 - RNA, 22 nt, Human
uugaauaggacucagcagugau

SEQ ID NO: 783327 - RNA, 22 nt, Human
uucaggaugcucagaguagucu

SEQ ID NO: 783328 - RNA, 23 nt, Human
gugagucuugccuuugcugugga

SEQ ID NO: 783329 - RNA, 22 nt, Human
aaggcagcagaggaaaggugcu

SEQ ID NO: 783330 - RNA, 22 nt, Human
uuucuucagccacuccaaacug

SEQ ID NO: 783331 - RNA, 22 nt, Human
uuuccuaguucuaagaaaugua

SEQ ID NO: 783332 - RNA, 22 nt, Human
uuugacaaaggaaaaaugcaca

SEQ ID NO: 783333 - RNA, 22 nt, Human
aaggcagcacagcaacugcuca

SEQ ID NO: 783334 - RNA, 22 nt, Human
cggcagcuccgcgccguaggac

SEQ ID NO: 783335 - RNA, 22 nt, Human
cccaugagaccugguuuaaggc

SEQ ID NO: 783336 - RNA, 22 nt, Human
aaggcagccaugugcuuugggu

SEQ ID NO: 783337 - RNA, 22 nt, Human
ucaggagacuuaugucacagug

SEQ ID NO: 783338 - RNA, 22 nt, Human
uuucuaggucuuccauacugcc

SEQ ID NO: 783339 - RNA, 22 nt, Human
acacauuucuaaauuuuuaccg

SEQ ID NO: 783340 - RNA, 22 nt, Human
ucacugucugaaagaaauggcc

SEQ ID NO: 783341 - RNA, 22 nt, Human
cauaauauacuacauugaugaa

SEQ ID NO: 783342 - RNA, 19 nt, Human
ucccaggaagcaaauguca

SEQ ID NO: 783343 - RNA, 19 nt, Human
ucuuucauuucuagcucug

SEQ ID NO: 783344 - RNA, 22 nt, Human
gcaggcaguuauuuaguagaau

SEQ ID NO: 783345 - RNA, 22 nt, Human
acaggagaaaucuggucaaaag

SEQ ID NO: 783346 - RNA, 22 nt, Human
ucuuuguaacugucuauugaga

SEQ ID NO: 783347 - RNA, 22 nt, Human
caguuucuauggcugggcucug

SEQ ID NO: 783348 - RNA, 22 nt, Human
cugcuguguuccuccugcaucu

SEQ ID NO: 783349 - RNA, 22 nt, Human
gaggcagcuuaggguacugacu

SEQ ID NO: 783350 - RNA, 22 nt, Human
caagagagaugcagcucacuca

SEQ ID NO: 783351 - RNA, 22 nt, Human
gaggcagcugggcuggugguuu

SEQ ID NO: 783352 - RNA, 22 nt, Human
gugcugugcgcuuuuucuguau

SEQ ID NO: 783353 - RNA, 22 nt, Human
cucaggauuuacuaauuucaag

SEQ ID NO: 783354 - RNA, 22 nt, Human
uuccaagagcuuuaauuguuga

SEQ ID NO: 783355 - RNA, 22 nt, Human
auucuucauaccuacugagguu

SEQ ID NO: 783356 - RNA, 22 nt, Human
caggcagcgcucguggccuggc

SEQ ID NO: 783357 - RNA, 22 nt, Human
aaaaacugcaauuacuuuuguc

SEQ ID NO: 783358 - RNA, 22 nt, Human
uagaaacaucagcuaaccaaaa

SEQ ID NO: 783359 - RNA, 19 nt, Human
ggcagcuugggaagguagc

SEQ ID NO: 783360 - RNA, 22 nt, Human
cccaggagguggagcuugcagu

SEQ ID NO: 783361 - RNA, 22 nt, Human
acgagagguccuuagaaucugu

SEQ ID NO: 783362 - RNA, 18 nt, Human
ugcuggguaacuguaugg

SEQ ID NO: 783363 - RNA, 22 nt, Human
uaggcagcugcaaacuucgguc

SEQ ID NO: 783364 - RNA, 23 nt, Human
gccaggaguggguagacuaaugc

SEQ ID NO: 783365 - RNA, 22 nt, Human
ggagcugugcagugacuacaga

SEQ ID NO: 783366 - RNA, 22 nt, Human
aucaggaucugcaucauaagaa

SEQ ID NO: 783367 - RNA, 22 nt, Human
ccuccucugggaagauucagag

SEQ ID NO: 783368 - RNA, 22 nt, Human
ugaggcagguggauuacaaggu

SEQ ID NO: 783369 - RNA, 22 nt, Human
cagugucuccagaugcuccaau

SEQ ID NO: 783370 - RNA, 22 nt, Human
gagagggauacugaguuuuggu

SEQ ID NO: 783371 - RNA, 22 nt, Human
gcuacugauugaccuuggagag

SEQ ID NO: 783372 - RNA, 20 nt, Human
cccaggagugagcagcuuua

SEQ ID NO: 783373 - RNA, 22 nt, Human
caacugcugacaccaucacucc

SEQ ID NO: 783374 - RNA, 22 nt, Human
aggcagacaaggacacaguggg

SEQ ID NO: 783375 - RNA, 22 nt, Human
uccaggaggcaccuuuggacca

SEQ ID NO: 783376 - RNA, 22 nt, Human
agucucagaaaagaagcaugga

SEQ ID NO: 783377 - RNA, 22 nt, Human
uucauucuuugaaucugaggua

SEQ ID NO: 783378 - RNA, 22 nt, Human
aacaugcucuguuucuuggaug

SEQ ID NO: 783379 - RNA, 20 nt, Human
gcccaggaauuugcauuucu

SEQ ID NO: 783380 - RNA, 22 nt, Human
uuuuuauaacucuuuugugaca

SEQ ID NO: 783381 - RNA, 22 nt, Human
ccaggagagcaggcgugcagcu

SEQ ID NO: 783382 - RNA, 22 nt, Human
acccaggagcucugggguccuc

SEQ ID NO: 783383 - RNA, 22 nt, Human
gaggccaggacaugaaagcuga

SEQ ID NO: 783384 - RNA, 21 nt, Human
cucaggaucuuauauauuagu

SEQ ID NO: 783385 - RNA, 22 nt, Human
acauacauauguuuaaaugcau

SEQ ID NO: 783386 - RNA, 22 nt, Human
ggaagagggaaccacgacugua

SEQ ID NO: 783387 - RNA, 22 nt, Human
uuccucagcuggccugauuggg

SEQ ID NO: 783388 - RNA, 22 nt, Human
caggcagcccugcaccaagugu

SEQ ID NO: 783389 - RNA, 22 nt, Human
gcaaguuauuuccauuuaaagc

SEQ ID NO: 783390 - RNA, 22 nt, Human
cugucccuucauuauucacuac

SEQ ID NO: 783391 - RNA, 22 nt, Human
gcuaugcaggagccuaaugaca

SEQ ID NO: 783392 - RNA, 22 nt, Human
ccugcuguaaugugucuuuauu

SEQ ID NO: 783393 - RNA, 22 nt, Human
agacaggcagaggcugcagagg

SEQ ID NO: 783394 - RNA, 22 nt, Human
gaggcaugcagagcuggagcag

SEQ ID NO: 783395 - RNA, 22 nt, Human
ggagauggaauagauucugacu

SEQ ID NO: 783396 - RNA, 22 nt, Human
aggcaagcauuuaaccacucau

SEQ ID NO: 783397 - RNA, 22 nt, Human
cauuguuauagcauuacacacc

SEQ ID NO: 783398 - RNA, 22 nt, Human
uuucaggguacauggagcaaau

SEQ ID NO: 783399 - RNA, 22 nt, Human
uauuucuucgggauucaagcua

SEQ ID NO: 783400 - RNA, 19 nt, Human
cuucuggcccugagccacc

SEQ ID NO: 783401 - RNA, 22 nt, Human
ggcucagaccucccagcuccag

SEQ ID NO: 783402 - RNA, 22 nt, Human
cccagcaggaggagguugcagu

SEQ ID NO: 783403 - RNA, 22 nt, Human
uccaggagacacaagguacaua

SEQ ID NO: 783404 - RNA, 22 nt, Human
caaauguaaauucuuuugaagc

SEQ ID NO: 783405 - RNA, 22 nt, Human
uuucagggagccuagaagagcu

SEQ ID NO: 783406 - RNA, 22 nt, Human
agcugaugccauguggaacagu

SEQ ID NO: 783407 - RNA, 22 nt, Human
ucauuuaauaauuuuugaguag

SEQ ID NO: 783408 - RNA, 22 nt, Human
acauguaaaaggaacaugcaug

SEQ ID NO: 783409 - RNA, 22 nt, Human
uuucacaucagagguagauuag

SEQ ID NO: 783410 - RNA, 18 nt, Human
cgaggcaggcggaucacg

SEQ ID NO: 783411 - RNA, 22 nt, Human
aaacaugaauagauauuaaaca

SEQ ID NO: 783412 - RNA, 22 nt, Human
acaaaugugucuaauugugccu

SEQ ID NO: 783413 - RNA, 22 nt, Human
cagcugccugucuggaggcaau

SEQ ID NO: 783414 - RNA, 22 nt, Human
cuucugugcuucacaguugcca

SEQ ID NO: 783415 - RNA, 22 nt, Human
uccuucuuucccccuagucauu

SEQ ID NO: 783416 - RNA, 22 nt, Human
agggcagccauugagggauucu

SEQ ID NO: 783417 - RNA, 22 nt, Human
auugaaagauuuugggcucaug

SEQ ID NO: 783418 - RNA, 22 nt, Human
ucugcaucauuuuucagagccg

SEQ ID NO: 783419 - RNA, 22 nt, Human
uucuacaugguugcucagaggg

SEQ ID NO: 783420 - RNA, 22 nt, Human
gccauuuucugucuuguuuauu

SEQ ID NO: 783421 - RNA, 22 nt, Human
gaauacauuggaaaucagaaua

SEQ ID NO: 783422 - RNA, 22 nt, Human
ggcuuugccuggaauuuccuug

SEQ ID NO: 783423 - RNA, 18 nt, Human
augggaggggccaagaga

SEQ ID NO: 783424 - RNA, 22 nt, Human
ggcagacuguaauaggagaauu

SEQ ID NO: 783425 - RNA, 20 nt, Human
agauuauuccuaagauuucu

SEQ ID NO: 783426 - RNA, 19 nt, Human
aguggcagaucuggaagua

SEQ ID NO: 783427 - RNA, 22 nt, Human
cagcugacccagugaggaggca

SEQ ID NO: 783428 - RNA, 23 nt, Human
cccagggacacgaugacaccucc

SEQ ID NO: 783429 - RNA, 22 nt, Human
uuaauuuuaaccuguuuguguc

SEQ ID NO: 783430 - RNA, 18 nt, Human
agcuucccucugagaggg

SEQ ID NO: 783431 - RNA, 22 nt, Human
ucucacuuuccagacuuuucaa

SEQ ID NO: 783432 - RNA, 23 nt, Human
uugcauagacauccucauagauu

SEQ ID NO: 783433 - RNA, 22 nt, Human
uuuuagcacuaagugauaugcu

SEQ ID NO: 783434 - RNA, 20 nt, Human
ccacaggaguccagucgacc

SEQ ID NO: 783435 - RNA, 22 nt, Human
ccaggcugccgaggaaagaaag

SEQ ID NO: 783436 - RNA, 22 nt, Human
agugcuuuaccuagauaauguu

SEQ ID NO: 783437 - RNA, 22 nt, Human
gauguguuuccaggauuuguuu

SEQ ID NO: 783438 - RNA, 22 nt, Human
cagucucagaggugggaguggg

SEQ ID NO: 783439 - RNA, 22 nt, Human
aucuuucaguuucauaccaauu

SEQ ID NO: 783440 - RNA, 17 nt, Human
uggcagcugaaagcucu

SEQ ID NO: 783441 - RNA, 22 nt, Human
caagauggguguugugaugguu

SEQ ID NO: 783442 - RNA, 22 nt, Human
ccacagcugaccgcaggugagc

SEQ ID NO: 783443 - RNA, 22 nt, Human
cagagagagucaaaucuuugcu

SEQ ID NO: 783444 - RNA, 19 nt, Human
ugaggggcucacagucuca

SEQ ID NO: 783445 - RNA, 22 nt, Human
uaaggccagcaugaaugcagca

SEQ ID NO: 783446 - RNA, 22 nt, Human
ggaggaugagcuacgaggagcu

SEQ ID NO: 783447 - RNA, 19 nt, Human
ugaggggaggagaggccug

SEQ ID NO: 783448 - RNA, 22 nt, Human
aggcaagcgcagaagcggagga

SEQ ID NO: 783449 - RNA, 20 nt, Human
acuugcugggcuuuguuacc

SEQ ID NO: 783450 - RNA, 17 nt, Human
agcugaccagauggacu

SEQ ID NO: 783451 - RNA, 22 nt, Human
auccaugaucaauuuauuacua

SEQ ID NO: 783452 - RNA, 22 nt, Human
caggcagcucugcuuuuccuaa

SEQ ID NO: 783453 - RNA, 22 nt, Human
uuucacagcuggguggcagagu

SEQ ID NO: 783454 - RNA, 22 nt, Human
agcccaggaaucugcaucuuga

SEQ ID NO: 783455 - RNA, 22 nt, Human
uuuuagauaguuuaacugcacu

SEQ ID NO: 783456 - RNA, 22 nt, Human
caggcagcagccacucugguau

SEQ ID NO: 783457 - RNA, 22 nt, Human
uuaaaauagccagugccccucu

SEQ ID NO: 783458 - RNA, 22 nt, Human
caggcagcguccugcuuccugu

SEQ ID NO: 783459 - RNA, 22 nt, Human
gcaggggcuaaggacacagaga

SEQ ID NO: 783460 - RNA, 22 nt, Human
uggcagcuggcucugcgcaggc

SEQ ID NO: 783461 - RNA, 22 nt, Human
augaaggcuguguggagccccc

SEQ ID NO: 783462 - RNA, 22 nt, Human
uacuaucucuucuaacuucaga

SEQ ID NO: 783463 - RNA, 22 nt, Human
cccaggaggguggccucugccc

SEQ ID NO: 783464 - RNA, 22 nt, Human
ugccaggagucaggccaggcag

SEQ ID NO: 783465 - RNA, 22 nt, Human
uuauagaaggagcauucacuua

SEQ ID NO: 783466 - RNA, 22 nt, Human
gucaggauuauuuuauuaaaag

SEQ ID NO: 783467 - RNA, 21 nt, Human
cucaggauggcggccuggugg

SEQ ID NO: 783468 - RNA, 22 nt, Human
uggaaagcgaggaguuggcauu

SEQ ID NO: 783469 - RNA, 22 nt, Human
gaggacaggagacucacuguuu

SEQ ID NO: 783470 - RNA, 21 nt, Human
uaauaauuccacuacagagua

SEQ ID NO: 783471 - RNA, 22 nt, Human
augaguucaauuguuucaguca

SEQ ID NO: 783472 - RNA, 22 nt, Human
aaggaguuuggguagucauaca

SEQ ID NO: 783473 - RNA, 23 nt, Human
aggcagcuggguagcaucuuucu

SEQ ID NO: 783474 - RNA, 22 nt, Human
agcccaggucucaaaguacagg

SEQ ID NO: 783475 - RNA, 22 nt, Human
ugagacaguuuuucuauuucca

SEQ ID NO: 783476 - RNA, 22 nt, Human
uuauacauguguuuugagauga

SEQ ID NO: 783477 - RNA, 22 nt, Human
ucucuguacaguacaugccgug

SEQ ID NO: 783478 - RNA, 22 nt, Human
cuugaaagucagcagaguggau

SEQ ID NO: 783479 - RNA, 22 nt, Human
gagacagugguugcagaagcuc

SEQ ID NO: 783480 - RNA, 22 nt, Human
uggaaauguauuugggcaugcc

SEQ ID NO: 783481 - RNA, 22 nt, Human
gugcuuuuaaaggcaauuagua

SEQ ID NO: 783482 - RNA, 19 nt, Human
uuucccagcccuugcugug

SEQ ID NO: 783483 - RNA, 22 nt, Human
aggcagcuggaggcagagacua

SEQ ID NO: 783484 - RNA, 22 nt, Human
acccaggacaugggcacccgug

SEQ ID NO: 783485 - RNA, 22 nt, Human
aagcaauagcaacaacuuuaca

SEQ ID NO: 783486 - RNA, 22 nt, Human
uagggcaggugaagaaaagcua

SEQ ID NO: 783487 - RNA, 22 nt, Human
uugagaagaaauaguuugcaau

SEQ ID NO: 783488 - RNA, 22 nt, Human
uuauccaagcagaagcugcaca

SEQ ID NO: 783489 - RNA, 22 nt, Human
ggaggaggcggcagaaguuccu

SEQ ID NO: 783490 - RNA, 22 nt, Human
gggaggugauuaggaccaugua

SEQ ID NO: 783491 - RNA, 22 nt, Human
uggaaggaaagguagcagagaa

SEQ ID NO: 783492 - RNA, 22 nt, Human
gaggaggcacuugagcagaugu

SEQ ID NO: 783493 - RNA, 19 nt, Human
agcagcuggagguggagug

SEQ ID NO: 783494 - RNA, 22 nt, Human
ggugguggagccagcugggagu

SEQ ID NO: 783495 - RNA, 22 nt, Human
uuucaacaccagagaccaugcg

SEQ ID NO: 783496 - RNA, 22 nt, Human
cccagggaagccauuucugacu

SEQ ID NO: 783497 - RNA, 20 nt, Human
uaggcagcuugacccuuggu

SEQ ID NO: 783498 - RNA, 19 nt, Human
uucaggauugacccuacug

SEQ ID NO: 783499 - RNA, 22 nt, Human
gaggcagccucaguggaccucg

SEQ ID NO: 783500 - RNA, 22 nt, Human
gagagguccauuccccugucag

SEQ ID NO: 783501 - RNA, 22 nt, Human
ccagaggaaaaauaucucccua

SEQ ID NO: 783502 - RNA, 22 nt, Human
ucucacuggguauaaaugagua

SEQ ID NO: 783503 - RNA, 22 nt, Human
gcagaggccaggccaccagcaa

SEQ ID NO: 783504 - RNA, 22 nt, Human
augaaacaguguguauagcaaa

SEQ ID NO: 783505 - RNA, 22 nt, Human
cagaggaugaucuggccucucu

SEQ ID NO: 783506 - RNA, 22 nt, Human
cuuagaaaugcagauucucagg

SEQ ID NO: 783507 - RNA, 22 nt, Human
ugcauaaagugccauaguauua

SEQ ID NO: 783508 - RNA, 22 nt, Human
aggagaaggaagugcaucacua

SEQ ID NO: 783509 - RNA, 22 nt, Human
cacaauguauauguauaucaaa

SEQ ID NO: 783510 - RNA, 22 nt, Human
agaaaugaagagagucaagguu

SEQ ID NO: 783511 - RNA, 22 nt, Human
acagucucuccacacugcaggg

SEQ ID NO: 783512 - RNA, 22 nt, Human
ucauuugugugagugauuugac

SEQ ID NO: 783513 - RNA, 22 nt, Human
caggcagggagcuggaaaggau

SEQ ID NO: 783514 - RNA, 23 nt, Human
agggugagcaagcuauggagacc

SEQ ID NO: 783515 - RNA, 22 nt, Human
agaggauguucuaggcacucau

SEQ ID NO: 783516 - RNA, 22 nt, Human
ugaggcaggagaaucacaugaa

SEQ ID NO: 783517 - RNA, 22 nt, Human
ccagaagaccccguccaccucc

SEQ ID NO: 783518 - RNA, 22 nt, Human
cugucauugagccugucagggc

SEQ ID NO: 783519 - RNA, 17 nt, Human
gccucugcuugugucau

SEQ ID NO: 783520 - RNA, 22 nt, Human
acucaggaaauugagauaaugg

SEQ ID NO: 783521 - RNA, 20 nt, Human
guggcaggcagugaaggagc

SEQ ID NO: 783522 - RNA, 22 nt, Human
aaggcaguaaaaucuaccuugc

SEQ ID NO: 783523 - RNA, 22 nt, Human
cccaggaggcagagcuugcagu

SEQ ID NO: 783524 - RNA, 22 nt, Human
uuucuucacaggguauugggug

SEQ ID NO: 783525 - RNA, 22 nt, Human
cuccaggaaagccugaggcccg

SEQ ID NO: 783526 - RNA, 20 nt, Human
aggcaguuagaaggagauga

SEQ ID NO: 783527 - RNA, 17 nt, Human
agagggaaaaugcgguu

SEQ ID NO: 783528 - RNA, 22 nt, Human
ucucaggacuuugggaagcuca

SEQ ID NO: 783529 - RNA, 22 nt, Human
cauuuguaguaucuguuuauau

SEQ ID NO: 783530 - RNA, 22 nt, Human
uuucaguuuccagcuuugucau

SEQ ID NO: 783531 - RNA, 22 nt, Human
aggcagcuuuaacugguaguag

SEQ ID NO: 783532 - RNA, 22 nt, Human
auucugauaucuuauucuagcu

SEQ ID NO: 783533 - RNA, 22 nt, Human
gaccauuuguugaaaagauuau

SEQ ID NO: 783534 - RNA, 22 nt, Human
gaggccuggagccgccuaggcg

SEQ ID NO: 783535 - RNA, 22 nt, Human
cagcuggcaaguggagcagggu

SEQ ID NO: 783536 - RNA, 22 nt, Human
uuugaaagggacaaagucacug

SEQ ID NO: 783537 - RNA, 18 nt, Human
ggcaucugcacagcagcc

SEQ ID NO: 783538 - RNA, 22 nt, Human
guaggcagauaggagugcagcc

SEQ ID NO: 783539 - RNA, 22 nt, Human
cagaggauucccuagugaccug

SEQ ID NO: 783540 - RNA, 22 nt, Human
agaggacagacggaaagugcca

SEQ ID NO: 783541 - RNA, 20 nt, Human
aguuauaguaucuagccaug

SEQ ID NO: 783542 - RNA, 22 nt, Human
cucaggauuuaaaggggcacuc

SEQ ID NO: 783543 - RNA, 22 nt, Human
gaggucaggggagaggcugaug

SEQ ID NO: 783544 - RNA, 19 nt, Human
gcuuuggagggagguucua

SEQ ID NO: 783545 - RNA, 22 nt, Human
agcucccagagcucgagaguaa

SEQ ID NO: 783546 - RNA, 22 nt, Human
aaaggagacuucagaucuccuu

SEQ ID NO: 783547 - RNA, 22 nt, Human
uauuuccaaaagccuauuauga

SEQ ID NO: 783548 - RNA, 22 nt, Human
cuguggaaggccuguccugaaa

SEQ ID NO: 783549 - RNA, 22 nt, Human
ugucuuuggaauauuuagcuga

SEQ ID NO: 783550 - RNA, 22 nt, Human
auuucccaugugaaucaauugg

SEQ ID NO: 783551 - RNA, 22 nt, Human
ucagucuucccuccagugcaac

SEQ ID NO: 783552 - RNA, 22 nt, Human
ucuuuccaaggacucuguagca

SEQ ID NO: 783553 - RNA, 22 nt, Human
gaggagcugggcugagaggguc

SEQ ID NO: 783554 - RNA, 22 nt, Human
agaaaugacacacaugagacau

SEQ ID NO: 783555 - RNA, 22 nt, Human
uugguuuaggaacuggcuugga

SEQ ID NO: 783556 - RNA, 22 nt, Human
cuucuucaagagaaugggagac

SEQ ID NO: 783557 - RNA, 22 nt, Human
caaaucuauauguugauauucu

SEQ ID NO: 783558 - RNA, 20 nt, Human
cccagugaagcauggaagag

SEQ ID NO: 783559 - RNA, 23 nt, Human
aggcagcagguuguccaggguga

SEQ ID NO: 783560 - RNA, 22 nt, Human
cagacaggaauucuggcguggu

SEQ ID NO: 783561 - RNA, 22 nt, Human
guccaugauucugugacacccu

SEQ ID NO: 783562 - RNA, 22 nt, Human
aggagaggcucuaacucugugu

SEQ ID NO: 783563 - RNA, 22 nt, Human
uccuuagagauacugucuugaa

SEQ ID NO: 783564 - RNA, 22 nt, Human
ggcagcuuucaauaggguuaug

SEQ ID NO: 783565 - RNA, 22 nt, Human
guguuuuaagaaagaagcucag

SEQ ID NO: 783566 - RNA, 22 nt, Human
gagccaaggguugccauggaga

SEQ ID NO: 783567 - RNA, 22 nt, Human
aggcagcuggcaaauucuagag

SEQ ID NO: 783568 - RNA, 22 nt, Human
cauuuguaucugggcugcugug

SEQ ID NO: 783569 - RNA, 22 nt, Human
gcaucuaaacuugcaucauugu

SEQ ID NO: 783570 - RNA, 22 nt, Human
gagguggugguggaggcauagc

SEQ ID NO: 783571 - RNA, 22 nt, Human
cccaggaguuugaguucagcau

SEQ ID NO: 783572 - RNA, 22 nt, Human
uugcagcuucgagucuaucugu

SEQ ID NO: 783573 - RNA, 22 nt, Human
ggccaggaagggaagaucagca

SEQ ID NO: 783574 - RNA, 22 nt, Human
aggcaggcccucuggaaaggua

SEQ ID NO: 783575 - RNA, 17 nt, Human
uagcuguguuucagcua

SEQ ID NO: 783576 - RNA, 18 nt, Human
aagaggaggaaacccagg

SEQ ID NO: 783577 - RNA, 22 nt, Human
uggcagcuaucuuuaaugagau

SEQ ID NO: 783578 - RNA, 22 nt, Human
uuuugcuugagugcacaaaaug

SEQ ID NO: 783579 - RNA, 22 nt, Human
augauguugauaaauuacuuua

SEQ ID NO: 783580 - RNA, 22 nt, Human
ucugaaggugcuagagaaagcu

SEQ ID NO: 783581 - RNA, 22 nt, Human
gaaacugugaucguguucuggg

SEQ ID NO: 783582 - RNA, 22 nt, Human
uuguuugaggucacugauauuu

SEQ ID NO: 783583 - RNA, 22 nt, Human
ucuuuguaaaugccuagcauaa

SEQ ID NO: 783584 - RNA, 22 nt, Human
gauuucuuuagguguaauagug

SEQ ID NO: 783585 - RNA, 22 nt, Human
uggcagcugguacagugggucu

SEQ ID NO: 783586 - RNA, 22 nt, Human
aaauuaguacauugcaaagucc

SEQ ID NO: 783587 - RNA, 22 nt, Human
ucccaggauuuuaggcucucag

SEQ ID NO: 783588 - RNA, 22 nt, Human
acagaaauugggcaaauggaag

SEQ ID NO: 783589 - RNA, 22 nt, Human
cagagacauuaagugccaugau

SEQ ID NO: 783590 - RNA, 22 nt, Human
ugaguucucacccauucuucuu

SEQ ID NO: 783591 - RNA, 22 nt, Human
aagugaagaaauacaugagaau

SEQ ID NO: 783592 - RNA, 22 nt, Human
ucugcaggcuuauaggaugggu

SEQ ID NO: 783593 - RNA, 22 nt, Human
ucauuuguaccauuuuuuaaga

SEQ ID NO: 783594 - RNA, 22 nt, Human
gcagcugcagacccucagugcu

SEQ ID NO: 783595 - RNA, 20 nt, Human
uggcaucucucaauuguagg

SEQ ID NO: 783596 - RNA, 22 nt, Human
uuugcaguuucauugcugaaau

SEQ ID NO: 783597 - RNA, 22 nt, Human
ugaggcagugcugggaagccug

SEQ ID NO: 783598 - RNA, 22 nt, Human
aaaauuauucauggcuuuugga

SEQ ID NO: 783599 - RNA, 22 nt, Human
gacccaggguggucaccugaaa

SEQ ID NO: 783600 - RNA, 22 nt, Human
uagagcugggcagugcucugag

SEQ ID NO: 783601 - RNA, 22 nt, Human
cagcaggagcagucagacuccu

SEQ ID NO: 783602 - RNA, 22 nt, Human
cagcuucugcuaucgaacaucu

SEQ ID NO: 783603 - RNA, 22 nt, Human
aggagaggucucccuuccccag

SEQ ID NO: 783604 - RNA, 23 nt, Human
cugcccugaucuugaucuauugu

SEQ ID NO: 783605 - RNA, 22 nt, Human
uuucuaggcacagugucuuccc

SEQ ID NO: 783606 - RNA, 22 nt, Human
ccuggagauuucuucaagcuuu

SEQ ID NO: 783607 - RNA, 18 nt, Human
aggcagacacuagagguc

SEQ ID NO: 783608 - RNA, 22 nt, Human
ggaagaggcugaggccaugcug

SEQ ID NO: 783609 - RNA, 22 nt, Human
gagaggggcccaagccacauag

SEQ ID NO: 783610 - RNA, 22 nt, Human
aagcuggaacaucuugaggaag

SEQ ID NO: 783611 - RNA, 22 nt, Human
ucaucuugcugccauugcuuua

SEQ ID NO: 783612 - RNA, 21 nt, Human
agucuguuaggaugacucuga

SEQ ID NO: 783613 - RNA, 22 nt, Human
auaaaugauucagcaggaaaua

SEQ ID NO: 783614 - RNA, 22 nt, Human
aaugaaauguagcuuauccaua

SEQ ID NO: 783615 - RNA, 22 nt, Human
uucugaaagccaauucauugaa

SEQ ID NO: 783616 - RNA, 22 nt, Human
gcauguguggaggagaugugcu

SEQ ID NO: 783617 - RNA, 19 nt, Human
acaaaugauguugcacuga

SEQ ID NO: 783618 - RNA, 22 nt, Human
uugcucagcacuggagccagcu

SEQ ID NO: 783619 - RNA, 22 nt, Human
gcccaggagguugggcugugca

SEQ ID NO: 783620 - RNA, 22 nt, Human
aucuuucaaucaggaaaaaucu

SEQ ID NO: 783621 - RNA, 22 nt, Human
gggagagguuacccgagcaacu

SEQ ID NO: 783622 - RNA, 22 nt, Human
aggucagcaugaguagaaggua

SEQ ID NO: 783623 - RNA, 22 nt, Human
gugguuuugccauuacaaguaa

SEQ ID NO: 783624 - RNA, 22 nt, Human
ucagugugaggucuuccacccg

SEQ ID NO: 783625 - RNA, 22 nt, Human
gagugcaguuggggugagggga

SEQ ID NO: 783626 - RNA, 22 nt, Human
aaaggugacugcagcagcuauu

SEQ ID NO: 783627 - RNA, 22 nt, Human
agcuggcagcucucagggguac

SEQ ID NO: 783628 - RNA, 22 nt, Human
cucaggauucucgacacucaca

SEQ ID NO: 783629 - RNA, 22 nt, Human
gaggagagaacauuccuccaua

SEQ ID NO: 783630 - RNA, 22 nt, Human
cucaggaugcaggucacaggac

SEQ ID NO: 783631 - RNA, 22 nt, Human
ccaggcugugguuuagauagag

SEQ ID NO: 783632 - RNA, 22 nt, Human
uaaggccauuauggugggcccg

SEQ ID NO: 783633 - RNA, 18 nt, Human
ucuuuggacaacuacugg

SEQ ID NO: 783634 - RNA, 22 nt, Human
gaggucagucagaccaggguuu

SEQ ID NO: 783635 - RNA, 22 nt, Human
gcucccagcaauugaggcagcc

SEQ ID NO: 783636 - RNA, 22 nt, Human
gaaggccacaaaaaaugucaua

SEQ ID NO: 783637 - RNA, 22 nt, Human
agaggcagaaguguucaaaccc

SEQ ID NO: 783638 - RNA, 22 nt, Human
gggagcugaauggcaauggaga

SEQ ID NO: 783639 - RNA, 20 nt, Human
uuucugugagaaacacuguu

SEQ ID NO: 783640 - RNA, 22 nt, Human
guuuuauaggugaaauauuacu

SEQ ID NO: 783641 - RNA, 22 nt, Human
agugcuuugguauagaacuauu

SEQ ID NO: 783642 - RNA, 22 nt, Human
cagcagagcugggcuuugaauu

SEQ ID NO: 783643 - RNA, 22 nt, Human
aguuggagugaacaugagauug

SEQ ID NO: 783644 - RNA, 22 nt, Human
ucugggaacacacgucacuuca

SEQ ID NO: 783645 - RNA, 22 nt, Human
uuucuucauucaccuucacccc

SEQ ID NO: 783646 - RNA, 22 nt, Human
uuggaugaagucuagcuuuagu

SEQ ID NO: 783647 - RNA, 22 nt, Human
auucugagaaaugcauugucag

SEQ ID NO: 783648 - RNA, 22 nt, Human
cuugggaaugcuaacagaugac

SEQ ID NO: 783649 - RNA, 22 nt, Human
agaggaugauuuuaaggacacu

SEQ ID NO: 783650 - RNA, 22 nt, Human
guugaaaguggagaaccugguu

SEQ ID NO: 783651 - RNA, 22 nt, Human
aagcaaaggcaggagcuuguga

SEQ ID NO: 783652 - RNA, 21 nt, Human
ucuugaaaauuguagcaguuu

SEQ ID NO: 783653 - RNA, 22 nt, Human
gagcagcucugggugacccagu

SEQ ID NO: 783654 - RNA, 22 nt, Human
caagauggaguccgggaaugug

SEQ ID NO: 783655 - RNA, 22 nt, Human
guuaucaugcuucaucaucacu

SEQ ID NO: 783656 - RNA, 22 nt, Human
uccucagacuucccuuugugua

SEQ ID NO: 783657 - RNA, 22 nt, Human
ggagggacccacucuagaggug

SEQ ID NO: 783658 - RNA, 20 nt, Human
uugagcuuuuaguacagaca

SEQ ID NO: 783659 - RNA, 22 nt, Human
auauuucaugggguuccauacu

SEQ ID NO: 783660 - RNA, 22 nt, Human
gagguagcaugcuggaagggac

SEQ ID NO: 783661 - RNA, 22 nt, Human
ggcagccuugacuagugacuua

SEQ ID NO: 783662 - RNA, 22 nt, Human
ugaggcagaaaauagcaguuca

SEQ ID NO: 783663 - RNA, 22 nt, Human
uguggaaaauuggaacguuccu

SEQ ID NO: 783664 - RNA, 22 nt, Human
cagucucucugaaguauuaaga

SEQ ID NO: 783665 - RNA, 22 nt, Human
cccaggagacauauagaaggac

SEQ ID NO: 783666 - RNA, 22 nt, Human
auauucuucuuguucagacuau

SEQ ID NO: 783667 - RNA, 22 nt, Human
gcaggagacaacuguaaggaga

SEQ ID NO: 783668 - RNA, 20 nt, Human
cgugcugugaccuugagcau

SEQ ID NO: 783669 - RNA, 22 nt, Human
auugcuguggaaauauaagaug

SEQ ID NO: 783670 - RNA, 22 nt, Human
cagaggcauacucccagucuug

SEQ ID NO: 783671 - RNA, 22 nt, Human
acugcuuuaucugagaaguccu

SEQ ID NO: 783672 - RNA, 22 nt, Human
cucuucuuuaguccagaccauc

SEQ ID NO: 783673 - RNA, 22 nt, Human
auucuucauuuacuguuacuug

SEQ ID NO: 783674 - RNA, 22 nt, Human
uuucccaguucccugcucuaua

SEQ ID NO: 783675 - RNA, 22 nt, Human
cgaggcagacaaaaguuggaag

SEQ ID NO: 783676 - RNA, 22 nt, Human
agaccaagacuauaaugagagg

SEQ ID NO: 783677 - RNA, 22 nt, Human
aagcuggagaguuaggugaaua

SEQ ID NO: 783678 - RNA, 22 nt, Human
caggcagcucuaauggaaagug

SEQ ID NO: 783679 - RNA, 22 nt, Human
ccucaggauccgcaggugcagu

SEQ ID NO: 783680 - RNA, 22 nt, Human
uuccaagaguaaauucaaauug

SEQ ID NO: 783681 - RNA, 22 nt, Human
cuggccaggcuugggacagaca

SEQ ID NO: 783682 - RNA, 23 nt, Human
cuuuuaacuugaucugagaccag

SEQ ID NO: 783683 - RNA, 22 nt, Human
gcaggcagagguggaggagaca

SEQ ID NO: 783684 - RNA, 19 nt, Human
cccaggagcaguauugaug

SEQ ID NO: 783685 - RNA, 22 nt, Human
cauggcugcgagaagagugggu

SEQ ID NO: 783686 - RNA, 22 nt, Human
ccaggagcagauauggacauaa

SEQ ID NO: 783687 - RNA, 22 nt, Human
cuugcuucauuagugucuuagu

SEQ ID NO: 783688 - RNA, 22 nt, Human
uggcagcugaggggaggcuuug

SEQ ID NO: 783689 - RNA, 22 nt, Human
aaggagaaaugguagaugugca

SEQ ID NO: 783690 - RNA, 22 nt, Human
cuugaaagcacuuaguaaauua

SEQ ID NO: 783691 - RNA, 22 nt, Human
cagcagagaccaagugauuuga

SEQ ID NO: 783692 - RNA, 22 nt, Human
ugcucccagggacucuggcugg

SEQ ID NO: 783693 - RNA, 21 nt, Human
agcaccuuacagcuauaaugg

SEQ ID NO: 783694 - RNA, 22 nt, Human
aggagggaccuaggaauauugc

SEQ ID NO: 783695 - RNA, 22 nt, Human
cuucugaggcagcuauucaguu

SEQ ID NO: 783696 - RNA, 22 nt, Human
uccaggagguugagacugcagu

SEQ ID NO: 783697 - RNA, 22 nt, Human
agaggagguccuuuucugaugu

SEQ ID NO: 783698 - RNA, 22 nt, Human
uacaucauaauaauacuuagaa

SEQ ID NO: 783699 - RNA, 22 nt, Human
aagggaggggauguaagccugg

SEQ ID NO: 783700 - RNA, 22 nt, Human
aggacuuagaacauuauguacu

SEQ ID NO: 783701 - RNA, 23 nt, Human
uucauuugucuacuucacuuguu

SEQ ID NO: 783702 - RNA, 22 nt, Human
agaggaggcagcuuaacucagu

SEQ ID NO: 783703 - RNA, 22 nt, Human
uuauuugcccauguuuagcaga

SEQ ID NO: 783704 - RNA, 22 nt, Human
uguucucacuggaugcuucaca

SEQ ID NO: 783705 - RNA, 22 nt, Human
uugcaucuaccauaucaaagau

SEQ ID NO: 783706 - RNA, 22 nt, Human
uuugaaguucccccauaucaga

SEQ ID NO: 783707 - RNA, 22 nt, Human
ugccuguguccccuucuuggca

SEQ ID NO: 783708 - RNA, 22 nt, Human
cccuggaguccuggcaguugau

SEQ ID NO: 783709 - RNA, 22 nt, Human
agacucaagacugcagaagacg

SEQ ID NO: 783710 - RNA, 22 nt, Human
auucuucaccugagucagucua

SEQ ID NO: 783711 - RNA, 22 nt, Human
aguccaugguucugacucaucu

SEQ ID NO: 783712 - RNA, 22 nt, Human
auuauucuuaugucaucauggc

SEQ ID NO: 783713 - RNA, 22 nt, Human
ccaggagacuguacugauauuu

SEQ ID NO: 783714 - RNA, 22 nt, Human
auguuucaccagcaaauuaccu

SEQ ID NO: 783715 - RNA, 22 nt, Human
gucuucuuguuuugaaggaaau

SEQ ID NO: 783716 - RNA, 22 nt, Human
uauugaugcuuggauugggcca

SEQ ID NO: 783717 - RNA, 22 nt, Human
acuguugucaggcugcuuugga

SEQ ID NO: 783718 - RNA, 22 nt, Human
gaggccaggagugcuguaaguu

SEQ ID NO: 783719 - RNA, 22 nt, Human
aggguagggcccggagacagac

SEQ ID NO: 783720 - RNA, 17 nt, Human
agauggcaggaggcaga

SEQ ID NO: 783721 - RNA, 22 nt, Human
uucacagacuuuccauagauug

SEQ ID NO: 783722 - RNA, 22 nt, Human
cagcagaggcacgucugugaau

SEQ ID NO: 783723 - RNA, 17 nt, Human
agagagagcaugccacc

SEQ ID NO: 783724 - RNA, 17 nt, Human
ucauuuguugugacuag

SEQ ID NO: 783725 - RNA, 22 nt, Human
uagugcuuuaaguuuacagaga

SEQ ID NO: 783726 - RNA, 22 nt, Human
gaaauauuucucuugagccccu

SEQ ID NO: 783727 - RNA, 22 nt, Human
gggcagcucuggcugugggaag

SEQ ID NO: 783728 - RNA, 22 nt, Human
uuugaaaggguuaugagacuga

SEQ ID NO: 783729 - RNA, 19 nt, Human
cuugcugggugguuucugc

SEQ ID NO: 783730 - RNA, 22 nt, Human
aucacauucuuucaaagcaguc

SEQ ID NO: 783731 - RNA, 22 nt, Human
uucuucaaugugcccuguuuuc

SEQ ID NO: 783732 - RNA, 22 nt, Human
auguagagcaguguuguccaau

SEQ ID NO: 783733 - RNA, 21 nt, Human
aggucagcccagcucuggaag

SEQ ID NO: 783734 - RNA, 22 nt, Human
gugcugugucuaucaggaauaa

SEQ ID NO: 783735 - RNA, 22 nt, Human
cccaggaggugugcccaacucg

SEQ ID NO: 783736 - RNA, 22 nt, Human
aggacaggauugagcugaacug

SEQ ID NO: 783737 - RNA, 22 nt, Human
aggcugcucaguagauggagcu

SEQ ID NO: 783738 - RNA, 22 nt, Human
cucaggauuaaggaaucuaaau

SEQ ID NO: 783739 - RNA, 22 nt, Human
uaucuaaaggauuuaauuuagu

SEQ ID NO: 783740 - RNA, 22 nt, Human
aggcaguggagcuggaauaggc

SEQ ID NO: 783741 - RNA, 22 nt, Human
uuccaugaagggcagccucuca

SEQ ID NO: 783742 - RNA, 22 nt, Human
gagcagcucgagaaggaagcag

SEQ ID NO: 783743 - RNA, 22 nt, Human
auucauuuagguauucacuuac

SEQ ID NO: 783744 - RNA, 22 nt, Human
uuuuaucugcuucauuaguuga

SEQ ID NO: 783745 - RNA, 22 nt, Human
uugcauuuuuagaugcuucugu

SEQ ID NO: 783746 - RNA, 22 nt, Human
aggaaaggccuuugcauuuggu

SEQ ID NO: 783747 - RNA, 22 nt, Human
ggaggcagaacuucccgucagu

SEQ ID NO: 783748 - RNA, 22 nt, Human
gcauguguuauuuuauguauga

SEQ ID NO: 783749 - RNA, 22 nt, Human
agcugccccaugagaggcaggu

SEQ ID NO: 783750 - RNA, 17 nt, Human
cauuuguugaucaguug

SEQ ID NO: 783751 - RNA, 22 nt, Human
auguuuuugagauacaaacaga

SEQ ID NO: 783752 - RNA, 22 nt, Human
uuuucagugggcaaugauguga

SEQ ID NO: 783753 - RNA, 17 nt, Human
aggcaggcagagcggga

SEQ ID NO: 783754 - RNA, 22 nt, Human
aaucauaauuguauacauucau

SEQ ID NO: 783755 - RNA, 22 nt, Human
gugauuuucuccuccuagaagu

SEQ ID NO: 783756 - RNA, 22 nt, Human
ggugaagggccuuaggagacag

SEQ ID NO: 783757 - RNA, 22 nt, Human
uccaugagaacccuuggagaua

SEQ ID NO: 783758 - RNA, 23 nt, Human
ggcagcucucaucugaugacuga

SEQ ID NO: 783759 - RNA, 22 nt, Human
cucacugucuguacuagcugau

SEQ ID NO: 783760 - RNA, 22 nt, Human
gcccaggauaaugcugucccug

SEQ ID NO: 783761 - RNA, 22 nt, Human
cuccacagcucaggcucagagu

SEQ ID NO: 783762 - RNA, 22 nt, Human
ccagcagagucuaggaaggagg

SEQ ID NO: 783763 - RNA, 22 nt, Human
caggacagagcccagacugugu

SEQ ID NO: 783764 - RNA, 22 nt, Human
agcugccgaugcccagcugcau

SEQ ID NO: 783765 - RNA, 17 nt, Human
gcuguaguuugauaaga

SEQ ID NO: 783766 - RNA, 22 nt, Human
ugaaagguuaaaaguaguauug

SEQ ID NO: 783767 - RNA, 21 nt, Human
acagacagggccagugucccc

SEQ ID NO: 783768 - RNA, 22 nt, Human
cccaggcagugugugcaugcgu

SEQ ID NO: 783769 - RNA, 22 nt, Human
agugugucugaucacuugugag

SEQ ID NO: 783770 - RNA, 21 nt, Human
agggagcuggccacacagccu

SEQ ID NO: 783771 - RNA, 22 nt, Human
aucaggaugcugucaguuacca

SEQ ID NO: 783772 - RNA, 22 nt, Human
guugaaagaugucuugguuccc

SEQ ID NO: 783773 - RNA, 22 nt, Human
aggcacaggccucagcacccag

SEQ ID NO: 783774 - RNA, 22 nt, Human
uugaaauacugcauuguucagu

SEQ ID NO: 783775 - RNA, 22 nt, Human
uuggcagugaugcagcuuguuc

SEQ ID NO: 783776 - RNA, 22 nt, Human
uaauacagaaguguauuaaaau

SEQ ID NO: 783777 - RNA, 19 nt, Human
ucucacaguuuccuugccu

SEQ ID NO: 783778 - RNA, 22 nt, Human
ucagguggcuuggagggggacg

SEQ ID NO: 783779 - RNA, 22 nt, Human
ugugaaagcaagucuaguucuc

SEQ ID NO: 783780 - RNA, 22 nt, Human
aggaugaauaacugaaauggug

SEQ ID NO: 783781 - RNA, 22 nt, Human
augaggcaaucaugguccaguu

SEQ ID NO: 783782 - RNA, 22 nt, Human
gcccaggagccuggagaugugu

SEQ ID NO: 783783 - RNA, 22 nt, Human
agcccaggaaguugaggcuugc

SEQ ID NO: 783784 - RNA, 22 nt, Human
caggaugagguagaggcagaua

SEQ ID NO: 783785 - RNA, 18 nt, Human
aagaggaggagcagguug

SEQ ID NO: 783786 - RNA, 22 nt, Human
gucuucuuuaaccuacuaaagc

SEQ ID NO: 783787 - RNA, 22 nt, Human
uucuuuucuuuaggcauugugu

SEQ ID NO: 783788 - RNA, 22 nt, Human
cccgggaggaggaaguugcagu

SEQ ID NO: 783789 - RNA, 22 nt, Human
agugcuuucuugcuccaucagu

SEQ ID NO: 783790 - RNA, 22 nt, Human
guugacagcuggugagcugcua

SEQ ID NO: 783791 - RNA, 22 nt, Human
gagaggcagaggccugaaaccg

SEQ ID NO: 783792 - RNA, 22 nt, Human
gagggcuccauuccccgugccc

SEQ ID NO: 783793 - RNA, 22 nt, Human
cugcugugcaggugccuaugau

SEQ ID NO: 783794 - RNA, 22 nt, Human
caggauggucagaugcauuguc

SEQ ID NO: 783795 - RNA, 22 nt, Human
ccuggauucaagucuuucuuuc

SEQ ID NO: 783796 - RNA, 22 nt, Human
gaggcagcaauaaaaagaauuu

SEQ ID NO: 783797 - RNA, 20 nt, Human
auuuggcaugaaguauugau

SEQ ID NO: 783798 - RNA, 22 nt, Human
guguugaugacauuuuagaaac

SEQ ID NO: 783799 - RNA, 22 nt, Human
ggauggcagucugcaugagaaa

SEQ ID NO: 783800 - RNA, 22 nt, Human
gcaggagacuggcugugguagu

SEQ ID NO: 783801 - RNA, 22 nt, Human
uguucuucuagauugccuuuua

SEQ ID NO: 783802 - RNA, 22 nt, Human
gaacccaggcuuuugaggcugu

SEQ ID NO: 783803 - RNA, 22 nt, Human
cucccagagaccaagcugagaa

SEQ ID NO: 783804 - RNA, 19 nt, Human
gcagcugcuugaaaagaaa

SEQ ID NO: 783805 - RNA, 22 nt, Human
ggguggaguagaaagaugaauu

SEQ ID NO: 783806 - RNA, 22 nt, Human
aaggcaguuugggccaccaucu

SEQ ID NO: 783807 - RNA, 22 nt, Human
ugaguuuuuucaacauaugaag

SEQ ID NO: 783808 - RNA, 22 nt, Human
uggcagcuauuacaaggaaguc

SEQ ID NO: 783809 - RNA, 22 nt, Human
ugaguaauaaacugucuugcuc

SEQ ID NO: 783810 - RNA, 20 nt, Human
uucuucucuaguuaucuuca

SEQ ID NO: 783811 - RNA, 22 nt, Human
ugaaaggugacauuucuuggau

SEQ ID NO: 783812 - RNA, 22 nt, Human
uucugaaccauugagcacugcc

SEQ ID NO: 783813 - RNA, 22 nt, Human
agaagucauuuauguuagauga

SEQ ID NO: 783814 - RNA, 22 nt, Human
uaacaauaguguuugcuaguca

SEQ ID NO: 783815 - RNA, 22 nt, Human
uugaagaggacuuugcagcugu

SEQ ID NO: 783816 - RNA, 23 nt, Human
uugcacauuggagcuggucuucu

SEQ ID NO: 783817 - RNA, 23 nt, Human
uccaggagcaugcuggcuggcga

SEQ ID NO: 783818 - RNA, 22 nt, Human
aaauacagaguugcuuaaaagc

SEQ ID NO: 783819 - RNA, 22 nt, Human
ugaaaugagagcacagaauaaa

SEQ ID NO: 783820 - RNA, 22 nt, Human
guaggcagucucucaggugauc

SEQ ID NO: 783821 - RNA, 22 nt, Human
cuccaugaauuugagcuuugug

SEQ ID NO: 783822 - RNA, 22 nt, Human
gcuuccuaaaugcacagggcag

SEQ ID NO: 783823 - RNA, 22 nt, Human
aaauuauuacaagcuaguuggc

SEQ ID NO: 783824 - RNA, 22 nt, Human
uucuucaaccaucuacauaaac

SEQ ID NO: 783825 - RNA, 22 nt, Human
uguuguuuucucauggagaaua

SEQ ID NO: 783826 - RNA, 19 nt, Human
cucucacucgccacauccu

SEQ ID NO: 783827 - RNA, 23 nt, Human
cuuuuaacuagaguaucagcugc

SEQ ID NO: 783828 - RNA, 22 nt, Human
ucucacugcaaauauuauguau

SEQ ID NO: 783829 - RNA, 22 nt, Human
gagggcuccucacauucucuau

SEQ ID NO: 783830 - RNA, 22 nt, Human
uauuucagcacaugggauaggu

SEQ ID NO: 783831 - RNA, 22 nt, Human
auauucuugugauuauaaagua

SEQ ID NO: 783832 - RNA, 22 nt, Human
aucaggauucaguaucuccagc

SEQ ID NO: 783833 - RNA, 22 nt, Human
gagggagugccagagggccagc

SEQ ID NO: 783834 - RNA, 22 nt, Human
gaggcaguuugccaugccagga

SEQ ID NO: 783835 - RNA, 20 nt, Human
gggcagcuccccucauucug

SEQ ID NO: 783836 - RNA, 22 nt, Human
cagaguggcacucugcuggaug

SEQ ID NO: 783837 - RNA, 22 nt, Human
gagggaugguaguugacacuga

SEQ ID NO: 783838 - RNA, 22 nt, Human
cuuaaauuggaugaguuaaguu

SEQ ID NO: 783839 - RNA, 22 nt, Human
aagagggcugcaaucuuauugc

SEQ ID NO: 783840 - RNA, 22 nt, Human
caguuucuuggaugccaauuuc

SEQ ID NO: 783841 - RNA, 22 nt, Human
cgaggcagaggcugaaacggcu

SEQ ID NO: 783842 - RNA, 21 nt, Human
uggagacucugguucuuugug

SEQ ID NO: 783843 - RNA, 17 nt, Human
aaucuguuuacagucag

SEQ ID NO: 783844 - RNA, 22 nt, Human
cugcuguguuucugcuagaaaa

SEQ ID NO: 783845 - RNA, 22 nt, Human
gauggcagguaguggucucauc

SEQ ID NO: 783846 - RNA, 20 nt, Human
cucaggauacugcaaaguug

SEQ ID NO: 783847 - RNA, 22 nt, Human
ccagacaggaacacacaucucc

SEQ ID NO: 783848 - RNA, 22 nt, Human
aaccauuugccauuaucuuaag

SEQ ID NO: 783849 - RNA, 22 nt, Human
gagagcaggaggcagcgggacg

SEQ ID NO: 783850 - RNA, 20 nt, Human
augugucuguaaacaacucu

SEQ ID NO: 783851 - RNA, 22 nt, Human
acuugcugguggcauuuacagu

SEQ ID NO: 783852 - RNA, 22 nt, Human
gcuggcaggagccuuucccuuu

SEQ ID NO: 783853 - RNA, 22 nt, Human
aggguggcugaguagauggaag

SEQ ID NO: 783854 - RNA, 22 nt, Human
uagcacauuguugaccagaagg

SEQ ID NO: 783855 - RNA, 22 nt, Human
gaaacugugaggaucuuaacuu

SEQ ID NO: 783856 - RNA, 22 nt, Human
ugucucugaggugagggucagc

SEQ ID NO: 783857 - RNA, 22 nt, Human
ucuacuguagugaugcugcagu

SEQ ID NO: 783858 - RNA, 22 nt, Human
auucaaguccagcuucucuaca

SEQ ID NO: 783859 - RNA, 22 nt, Human
aaauuauaggugccaccuugga

SEQ ID NO: 783860 - RNA, 22 nt, Human
auugaaagauauacuguucuca

SEQ ID NO: 783861 - RNA, 15 nt, Human
uggcagcuuguuaag

SEQ ID NO: 783862 - RNA, 22 nt, Human
caggguggggaaauagcgcccu

SEQ ID NO: 783863 - RNA, 22 nt, Human
gaggcugcccaacuggagugga

SEQ ID NO: 783864 - RNA, 22 nt, Human
uugaaaguagcagcugcauaug

SEQ ID NO: 783865 - RNA, 22 nt, Human
ucccaggagcaccuuuugagcc

SEQ ID NO: 783866 - RNA, 18 nt, Human
agaggggagguaagucug

SEQ ID NO: 783867 - RNA, 22 nt, Human
ccagcagagcauggggaggaag

SEQ ID NO: 783868 - RNA, 22 nt, Human
ccucagggaaugggaggcuggg

SEQ ID NO: 783869 - RNA, 20 nt, Human
guugaaaguaauaugaugcu

SEQ ID NO: 783870 - RNA, 22 nt, Human
aaauuagucgguuuaggaauuu

SEQ ID NO: 783871 - RNA, 19 nt, Human
ccaggagagcuuggagaag

SEQ ID NO: 783872 - RNA, 22 nt, Human
agguaggggguuugggaacugc

SEQ ID NO: 783873 - RNA, 22 nt, Human
ggcucagagaccugcgaucuga

SEQ ID NO: 783874 - RNA, 22 nt, Human
uuauccuggauuauauauguga

SEQ ID NO: 783875 - RNA, 22 nt, Human
cucucagacugaagggccugug

SEQ ID NO: 783876 - RNA, 22 nt, Human
uucucagagugaccaagucuuu

SEQ ID NO: 783877 - RNA, 22 nt, Human
cuggcuuucucugugguguuca

SEQ ID NO: 783878 - RNA, 19 nt, Human
uggagggguuugaaugugg

SEQ ID NO: 783879 - RNA, 22 nt, Human
cccaggaagagugaguggcauu

SEQ ID NO: 783880 - RNA, 22 nt, Human
aguuuucacacucaccaaaagg

SEQ ID NO: 783881 - RNA, 22 nt, Human
uguuuucagucauauagcaggu

SEQ ID NO: 783882 - RNA, 22 nt, Human
agucuucucauuucacaugcuu

SEQ ID NO: 783883 - RNA, 22 nt, Human
cacaggagagcugggaggugcc

SEQ ID NO: 783884 - RNA, 22 nt, Human
uuaauuaaauucaugagcauug

SEQ ID NO: 783885 - RNA, 19 nt, Human
ucugccucuggucaggcuc

SEQ ID NO: 783886 - RNA, 22 nt, Human
aucuuucuccauauacaucuuu

SEQ ID NO: 783887 - RNA, 22 nt, Human
gaggcagcaucuauggugggaa

SEQ ID NO: 783888 - RNA, 22 nt, Human
gagggugggccagauaugaggg

SEQ ID NO: 783889 - RNA, 22 nt, Human
uggcagcugcguuguguuucug

SEQ ID NO: 783890 - RNA, 22 nt, Human
cuccaggaaaauagggaaugag

SEQ ID NO: 783891 - RNA, 21 nt, Human
aaaggccauaaucacggagca

SEQ ID NO: 783892 - RNA, 22 nt, Human
ucaugcuuaaaagacacuugag

SEQ ID NO: 783893 - RNA, 22 nt, Human
agagacagaggcaauauagcuu

SEQ ID NO: 783894 - RNA, 23 nt, Human
uuuuccagaaucgacucuguaga

SEQ ID NO: 783895 - RNA, 22 nt, Human
gggauggggagcuggaaagggg

SEQ ID NO: 783896 - RNA, 22 nt, Human
uggaagggagugacagucagag

SEQ ID NO: 783897 - RNA, 22 nt, Human
ggacaagccugugaguggguuu

SEQ ID NO: 783898 - RNA, 22 nt, Human
gaggccagcuaguccaggaagu

SEQ ID NO: 783899 - RNA, 22 nt, Human
cccaggaggacauuccauaccc

SEQ ID NO: 783900 - RNA, 22 nt, Human
aucugccuggcuccaggugagc

SEQ ID NO: 783901 - RNA, 22 nt, Human
cucuucuuauggccguggcuga

SEQ ID NO: 783902 - RNA, 22 nt, Human
uuugacauuauccuguuacugg

SEQ ID NO: 783903 - RNA, 22 nt, Human
cccaugagauucugaauuuggc

SEQ ID NO: 783904 - RNA, 22 nt, Human
aggccagccucaggcagggacc

SEQ ID NO: 783905 - RNA, 22 nt, Human
acacaaugcauauuuuuccaga

SEQ ID NO: 783906 - RNA, 22 nt, Human
acaggccacaguggagucucug

SEQ ID NO: 783907 - RNA, 22 nt, Human
aaacugcuuuccacaguggcua

SEQ ID NO: 783908 - RNA, 22 nt, Human
guucuucagcauuagaagucau

SEQ ID NO: 783909 - RNA, 21 nt, Human
uucuucuuggacuguuuuggc

SEQ ID NO: 783910 - RNA, 22 nt, Human
aaucuucuuucuuaacaguaca

SEQ ID NO: 783911 - RNA, 17 nt, Human
agaacuguaguagcucc

SEQ ID NO: 783912 - RNA, 22 nt, Human
uugacacaguuuucucauuaag

SEQ ID NO: 783913 - RNA, 22 nt, Human
aggcagacucaauggcuagaua

SEQ ID NO: 783914 - RNA, 22 nt, Human
ugcauuuccagauuucuggagu

SEQ ID NO: 783915 - RNA, 22 nt, Human
uuuuaguguagucaccgugggu

SEQ ID NO: 783916 - RNA, 22 nt, Human
cacauauuugaugaagcuuugu

SEQ ID NO: 783917 - RNA, 22 nt, Human
uccaggaguccuggguggcccc

SEQ ID NO: 783918 - RNA, 21 nt, Human
ggauggauagggaagagauuu

SEQ ID NO: 783919 - RNA, 22 nt, Human
cuuugcaaacugucacacuuuc

SEQ ID NO: 783920 - RNA, 22 nt, Human
aggcagacugugcgggaagagu

SEQ ID NO: 783921 - RNA, 22 nt, Human
auggaaagggaagcaaggaaca

SEQ ID NO: 783922 - RNA, 22 nt, Human
cagaauggcuuuuauggcucag

SEQ ID NO: 783923 - RNA, 22 nt, Human
gacccaggcccaaggcugccag

SEQ ID NO: 783924 - RNA, 21 nt, Human
uuugaaagcuacaucuauagc

SEQ ID NO: 783925 - RNA, 22 nt, Human
acauuguuugagaauacagaug

SEQ ID NO: 783926 - RNA, 22 nt, Human
gggcagcuggccagguauucug

SEQ ID NO: 783927 - RNA, 22 nt, Human
gaggcagcuuggggcugugggu

SEQ ID NO: 783928 - RNA, 22 nt, Human
cugcuucugggaugauggagua

SEQ ID NO: 783929 - RNA, 22 nt, Human
ugccgcagugcggggagggccc

SEQ ID NO: 783930 - RNA, 22 nt, Human
uagcuguguaagcuugguaaga

SEQ ID NO: 783931 - RNA, 22 nt, Human
cugcacaguuugauuucuugcu

SEQ ID NO: 783932 - RNA, 22 nt, Human
agaggccagguccagaguuugu

SEQ ID NO: 783933 - RNA, 22 nt, Human
ccaggagaugggaaaguagcag

SEQ ID NO: 783934 - RNA, 22 nt, Human
agugcuuugaacgaaaggcuga

SEQ ID NO: 783935 - RNA, 22 nt, Human
cagcuccugggccaucuccuag

SEQ ID NO: 783936 - RNA, 22 nt, Human
ugcuuuggaucuauuugcugag

SEQ ID NO: 783937 - RNA, 22 nt, Human
agaggggaggcgaaccagaguc

SEQ ID NO: 783938 - RNA, 22 nt, Human
cggcagcucgagggccacccgu

SEQ ID NO: 783939 - RNA, 22 nt, Human
aggagggagaugcccauccugg

SEQ ID NO: 783940 - RNA, 22 nt, Human
uugauuucuauucagauguaga

SEQ ID NO: 783941 - RNA, 22 nt, Human
cccaggagguggagguugcagu

SEQ ID NO: 783942 - RNA, 22 nt, Human
uggcaggcagugugggagcugg

SEQ ID NO: 783943 - RNA, 22 nt, Human
uucacagauguauuggaacucc

SEQ ID NO: 783944 - RNA, 22 nt, Human
gaagcagcagcuggggacaguu

SEQ ID NO: 783945 - RNA, 18 nt, Human
ccagguggugacagagau

SEQ ID NO: 783946 - RNA, 22 nt, Human
uaucuuguaauagguccacuug

SEQ ID NO: 783947 - RNA, 22 nt, Human
cacauauuguaguucaccagga

SEQ ID NO: 783948 - RNA, 22 nt, Human
cccaggaggaggaaaaagcucg

SEQ ID NO: 783949 - RNA, 22 nt, Human
gcugucccgcugacuuccagcu

SEQ ID NO: 783950 - RNA, 22 nt, Human
agucacuguucugucaugucaa

SEQ ID NO: 783951 - RNA, 22 nt, Human
ccaggcagcaaauuuucugaau

SEQ ID NO: 783952 - RNA, 22 nt, Human
ucccaggacaggccacauggaa

SEQ ID NO: 783953 - RNA, 22 nt, Human
acaugauuuuaguaucauaaua

SEQ ID NO: 783954 - RNA, 22 nt, Human
gaggcugccccuuccucagcug

SEQ ID NO: 783955 - RNA, 22 nt, Human
uuuguaaaggccugaauuucag

SEQ ID NO: 783956 - RNA, 22 nt, Human
cugcuguggugucaagcaucuc

SEQ ID NO: 783957 - RNA, 22 nt, Human
uggcaucucaaacaggcagauu

SEQ ID NO: 783958 - RNA, 22 nt, Human
gaaauauuguacuggagauguu

SEQ ID NO: 783959 - RNA, 19 nt, Human
uggagaggaaaugcugcuc

SEQ ID NO: 783960 - RNA, 22 nt, Human
agacagcuaauaaaugagugug

SEQ ID NO: 783961 - RNA, 22 nt, Human
gaggcagcugaaggagugacag

SEQ ID NO: 783962 - RNA, 22 nt, Human
gaggccaggggccuggagauga

SEQ ID NO: 783963 - RNA, 22 nt, Human
caacugagcaguagcgucugga

SEQ ID NO: 783964 - RNA, 23 nt, Human
uccuuccuuugagaggcuccauc

SEQ ID NO: 783965 - RNA, 22 nt, Human
agaggagugggaagcagugcaa

SEQ ID NO: 783966 - RNA, 17 nt, Human
ggcagcugugugcaugc

SEQ ID NO: 783967 - RNA, 22 nt, Human
gaggcugauucggggaacagca

SEQ ID NO: 783968 - RNA, 22 nt, Human
cagaaggcuuuguggaguagac

SEQ ID NO: 783969 - RNA, 22 nt, Human
ugguuuugcuaaaauagaaaga

SEQ ID NO: 783970 - RNA, 22 nt, Human
uagaaaugauugguugagcucu

SEQ ID NO: 783971 - RNA, 22 nt, Human
auggagacgcaagggaccuagg

SEQ ID NO: 783972 - RNA, 22 nt, Human
gaggguggguuucuugcacguc

SEQ ID NO: 783973 - RNA, 22 nt, Human
ggagaggauguuuuaguaacuu

SEQ ID NO: 783974 - RNA, 22 nt, Human
uucugggacaucuggacaguuu

SEQ ID NO: 783975 - RNA, 22 nt, Human
gaaaggccagcucacagaugag

SEQ ID NO: 783976 - RNA, 22 nt, Human
ccugccugcaccuucucugggg

SEQ ID NO: 783977 - RNA, 22 nt, Human
caaauaguuuuucauguauuau

SEQ ID NO: 783978 - RNA, 22 nt, Human
agggcagccucucagccuaggu

SEQ ID NO: 783979 - RNA, 22 nt, Human
uaucuguuaggaucagagcugg

SEQ ID NO: 783980 - RNA, 22 nt, Human
ccuccuuuccuguuuuccugag

SEQ ID NO: 783981 - RNA, 22 nt, Human
agcaccuugcucuuggccuucc

SEQ ID NO: 783982 - RNA, 22 nt, Human
cuggaggcacccuuagagaggc

SEQ ID NO: 783983 - RNA, 22 nt, Human
ugaggcagcccacuuuccuuag

SEQ ID NO: 783984 - RNA, 22 nt, Human
auucuucagaauaucuggcacu

SEQ ID NO: 783985 - RNA, 22 nt, Human
accaggagggacccugguggcc

SEQ ID NO: 783986 - RNA, 22 nt, Human
guagccauuggcaaugaagccu

SEQ ID NO: 783987 - RNA, 22 nt, Human
guuuuauaauugcuucauaaga

SEQ ID NO: 783988 - RNA, 23 nt, Human
uacaugcuauaauuucacccuca

SEQ ID NO: 783989 - RNA, 22 nt, Human
cuugcugucuugcauuuagagc

SEQ ID NO: 783990 - RNA, 22 nt, Human
aacauucuauuuugcuaaaaca

SEQ ID NO: 783991 - RNA, 22 nt, Human
ggccagcuuugagcugcaggaa

SEQ ID NO: 783992 - RNA, 20 nt, Human
gaguuccccauuucuccugg

SEQ ID NO: 783993 - RNA, 22 nt, Human
acuaagugauucuaagcaucuu

SEQ ID NO: 783994 - RNA, 22 nt, Human
ggcacagagcccagcuuccuag

SEQ ID NO: 783995 - RNA, 22 nt, Human
cugcaucaguggauaugauggu

SEQ ID NO: 783996 - RNA, 22 nt, Human
cccaggagaucuggaucucguc

SEQ ID NO: 783997 - RNA, 22 nt, Human
gacccaggcucgugggacggcu

SEQ ID NO: 783998 - RNA, 22 nt, Human
gcuccucuucucccacugaaug

SEQ ID NO: 783999 - RNA, 22 nt, Human
uucugggagagaaagggccuug

SEQ ID NO: 784000 - RNA, 22 nt, Human
agaaaugacaagacugaucagg

SEQ ID NO: 784001 - RNA, 22 nt, Human
uuuccuaggagauugaucacau

SEQ ID NO: 784002 - RNA, 22 nt, Human
acaauauuguacccagaaguuu

SEQ ID NO: 784003 - RNA, 22 nt, Human
uuugaauagcauaggauuacau

SEQ ID NO: 784004 - RNA, 22 nt, Human
auuugcaaagucguaucuguga

SEQ ID NO: 784005 - RNA, 21 nt, Human
agggagcuuuagguagaaguu

SEQ ID NO: 784006 - RNA, 22 nt, Human
ggugagaggcagaggacagcuu

SEQ ID NO: 784007 - RNA, 23 nt, Human
ucguugaauagcaauagcacaac

SEQ ID NO: 784008 - RNA, 22 nt, Human
ggagaggggcaaguuuaucuag

SEQ ID NO: 784009 - RNA, 22 nt, Human
aucaggaucacugggagucuug

SEQ ID NO: 784010 - RNA, 22 nt, Human
cacaaaugugcagaaaugugag

SEQ ID NO: 784011 - RNA, 20 nt, Human
aaacauucauguacaaguga

SEQ ID NO: 784012 - RNA, 22 nt, Human
cauuuccagcuccugcaucaug

SEQ ID NO: 784013 - RNA, 22 nt, Human
uuucaaagucaauaucauuacc

SEQ ID NO: 784014 - RNA, 22 nt, Human
aauaugcauuaacuguguacau

SEQ ID NO: 784015 - RNA, 22 nt, Human
auuauauaggacuugcccuucc

SEQ ID NO: 784016 - RNA, 22 nt, Human
ccucaggaaaugaauaaauggc

SEQ ID NO: 784017 - RNA, 20 nt, Human
uauuuacaacuuagagccuc

SEQ ID NO: 784018 - RNA, 22 nt, Human
uaauuauuugaagacauuagag

SEQ ID NO: 784019 - RNA, 22 nt, Human
ucaggaauccagacagggcaca

SEQ ID NO: 784020 - RNA, 22 nt, Human
auaguuugaaggcuguucuacu

SEQ ID NO: 784021 - RNA, 22 nt, Human
caggaggaagaacucugcaaca

SEQ ID NO: 784022 - RNA, 19 nt, Human
caugcugaccugcuguggu

SEQ ID NO: 784023 - RNA, 22 nt, Human
ugcaugcugcacacaugcguag

SEQ ID NO: 784024 - RNA, 22 nt, Human
ccaggagacccagggaaggagc

SEQ ID NO: 784025 - RNA, 22 nt, Human
ccagaccacccuggccaugcac

SEQ ID NO: 784026 - RNA, 20 nt, Human
aucaggauucuugcuuuguu

SEQ ID NO: 784027 - RNA, 22 nt, Human
aauauuuguuaguguuuuaaug

SEQ ID NO: 784028 - RNA, 22 nt, Human
agugcuguuagguuaauauagu

SEQ ID NO: 784029 - RNA, 22 nt, Human
ucagcugcucaaauuuauguca

SEQ ID NO: 784030 - RNA, 19 nt, Human
augucuggguaacagcugc

SEQ ID NO: 784031 - RNA, 22 nt, Human
ugaugaaaauaugauucugagg

SEQ ID NO: 784032 - RNA, 22 nt, Human
uccagaaacuuuuccagucuca

SEQ ID NO: 784033 - RNA, 22 nt, Human
ucacaguuauagucuguagaau

SEQ ID NO: 784034 - RNA, 22 nt, Human
guucuucaggcugugcucuaga

SEQ ID NO: 784035 - RNA, 22 nt, Human
uggcagcugauuagauggugcc

SEQ ID NO: 784036 - RNA, 22 nt, Human
uuuaaauuauaguuaaugucug

SEQ ID NO: 784037 - RNA, 22 nt, Human
cccaggagaauauaauguucuu

SEQ ID NO: 784038 - RNA, 22 nt, Human
agggaguuagaaauccaggaua

SEQ ID NO: 784039 - RNA, 22 nt, Human
aguggcaggcggagauguagga

SEQ ID NO: 784040 - RNA, 22 nt, Human
ucuccucuauuucuguauguau

SEQ ID NO: 784041 - RNA, 22 nt, Human
cuugaacucaaugugaggaaga

SEQ ID NO: 784042 - RNA, 22 nt, Human
uccaggagagguagaggguucc

SEQ ID NO: 784043 - RNA, 22 nt, Human
aggaggggcaaugauagucugg

SEQ ID NO: 784044 - RNA, 22 nt, Human
ccugucacgaugacugcacucu

SEQ ID NO: 784045 - RNA, 22 nt, Human
uguauuuuuagaccuuuagacc

SEQ ID NO: 784046 - RNA, 22 nt, Human
gugguaauagagcuccaaacua

SEQ ID NO: 784047 - RNA, 23 nt, Human
cuuugccacccagagccugacag

SEQ ID NO: 784048 - RNA, 17 nt, Human
aagagaggcugagcugg

SEQ ID NO: 784049 - RNA, 23 nt, Human
uuuggacuugugacucuucuccu

SEQ ID NO: 784050 - RNA, 22 nt, Human
uuaaauauuuucagcaggguca

SEQ ID NO: 784051 - RNA, 22 nt, Human
uuauucuuuucuccagaauccc

SEQ ID NO: 784052 - RNA, 22 nt, Human
aagacauugucauuuuauaauu

SEQ ID NO: 784053 - RNA, 22 nt, Human
ucagugaucuaaggguauggcc

SEQ ID NO: 784054 - RNA, 17 nt, Human
caaggccagcaucuuca

SEQ ID NO: 784055 - RNA, 22 nt, Human
uuaaauuccagccucauaauag

SEQ ID NO: 784056 - RNA, 22 nt, Human
uguccucuuccagugcuccuuc

SEQ ID NO: 784057 - RNA, 22 nt, Human
cucaacagcucugccauacucc

SEQ ID NO: 784058 - RNA, 22 nt, Human
uugauacauuuuuaggauaaac

SEQ ID NO: 784059 - RNA, 22 nt, Human
aaaauugaagugaucaggaacu

SEQ ID NO: 784060 - RNA, 22 nt, Human
agugcuguaacaacuuauuugg

SEQ ID NO: 784061 - RNA, 22 nt, Human
aagaagagaaaugugcugcugg

SEQ ID NO: 784062 - RNA, 22 nt, Human
aauaauuagugggacagagaac

SEQ ID NO: 784063 - RNA, 22 nt, Human
acagauguacacucauauauaa

SEQ ID NO: 784064 - RNA, 22 nt, Human
acauugcugcauucuccuuccc

SEQ ID NO: 784065 - RNA, 22 nt, Human
uuugaaaguguuuacuugggaa

SEQ ID NO: 784066 - RNA, 22 nt, Human
aaaauuauggaguaucccaaag

SEQ ID NO: 784067 - RNA, 22 nt, Human
acauucuuaacaguuaaaaacu

SEQ ID NO: 784068 - RNA, 22 nt, Human
cuugcugucccuugguaugaac

SEQ ID NO: 784069 - RNA, 20 nt, Human
ugaaggccauuuguuccaga

SEQ ID NO: 784070 - RNA, 22 nt, Human
ucucaagaucucaagauggccc

SEQ ID NO: 784071 - RNA, 22 nt, Human
cucacuguuuaauagcuggauc

SEQ ID NO: 784072 - RNA, 22 nt, Human
ugaggcagaguaagauacauga

SEQ ID NO: 784073 - RNA, 22 nt, Human
aagggcagaauagagaagaugg

SEQ ID NO: 784074 - RNA, 22 nt, Human
uacuuucuguccuucuguuaaa

SEQ ID NO: 784075 - RNA, 22 nt, Human
uuggaauucaaguuguagcuua

SEQ ID NO: 784076 - RNA, 22 nt, Human
ugaggcagaaauuccuguuuuc

SEQ ID NO: 784077 - RNA, 22 nt, Human
caugcuguguguuuuagcucca

SEQ ID NO: 784078 - RNA, 22 nt, Human
uucauucuuauuugugaucugg

SEQ ID NO: 784079 - RNA, 22 nt, Human
aaaagucugcucucauuucaga

SEQ ID NO: 784080 - RNA, 22 nt, Human
ggcagcuucucccaggcuguuu

SEQ ID NO: 784081 - RNA, 22 nt, Human
gaggcagcuggguccggucggg

SEQ ID NO: 784082 - RNA, 22 nt, Human
ucacaaauauuuuaacaguagg

SEQ ID NO: 784083 - RNA, 22 nt, Human
ugaggcagcaauugauuauuca

SEQ ID NO: 784084 - RNA, 22 nt, Human
caguugcuggaugugcagcucu

SEQ ID NO: 784085 - RNA, 18 nt, Human
gagagggaucccucagga

SEQ ID NO: 784086 - RNA, 22 nt, Human
ccaggagagcucucguucagug

SEQ ID NO: 784087 - RNA, 22 nt, Human
gaggcaguguuuacugcccugu

SEQ ID NO: 784088 - RNA, 22 nt, Human
cuagcaucagaugagaagcugu

SEQ ID NO: 784089 - RNA, 22 nt, Human
uguuuuuaaauaaugauagaaa

SEQ ID NO: 784090 - RNA, 22 nt, Human
gcugauguaagacuuuugguuu

SEQ ID NO: 784091 - RNA, 23 nt, Human
agcacacuuguacaaugcccuag

SEQ ID NO: 784092 - RNA, 22 nt, Human
aggguggccaugagggagagau

SEQ ID NO: 784093 - RNA, 20 nt, Human
ccucaguguccuggacuggg

SEQ ID NO: 784094 - RNA, 22 nt, Human
uuuuaucuucauuccuaucuac

SEQ ID NO: 784095 - RNA, 22 nt, Human
aggcaguggaugucaggaaugg

SEQ ID NO: 784096 - RNA, 22 nt, Human
augcugagugagugaaacccag

SEQ ID NO: 784097 - RNA, 22 nt, Human
uuuauucaucaucuguucauau

SEQ ID NO: 784098 - RNA, 22 nt, Human
gugguuuucuccaacccagaac

SEQ ID NO: 784099 - RNA, 22 nt, Human
auuucucuuagcaagacauuac

SEQ ID NO: 784100 - RNA, 22 nt, Human
uuugaacuucuaccugucauau

SEQ ID NO: 784101 - RNA, 22 nt, Human
cuggcaaguacugggccagcuc

SEQ ID NO: 784102 - RNA, 22 nt, Human
uaucuguucaauggaagaugac

SEQ ID NO: 784103 - RNA, 19 nt, Human
gaggagcuaucggagacag

SEQ ID NO: 784104 - RNA, 22 nt, Human
aggaugagccgcgcaagcugac

SEQ ID NO: 784105 - RNA, 22 nt, Human
cuucucagaggccagaagcuau

SEQ ID NO: 784106 - RNA, 22 nt, Human
uaaugucagcauaguuuauuuu

SEQ ID NO: 784107 - RNA, 22 nt, Human
uuuguuaaauauuuauugagug

SEQ ID NO: 784108 - RNA, 22 nt, Human
gagggcaguagccucguacccu

SEQ ID NO: 784109 - RNA, 22 nt, Human
agggagcugagcugugagcagc

SEQ ID NO: 784110 - RNA, 22 nt, Human
accaggaggccuggagcacaaa

SEQ ID NO: 784111 - RNA, 22 nt, Human
agcaccaugaccuugccauuga

SEQ ID NO: 784112 - RNA, 22 nt, Human
acacagaguauuuagaaggggu

SEQ ID NO: 784113 - RNA, 22 nt, Human
aggccagcucuacccuuggacu

SEQ ID NO: 784114 - RNA, 22 nt, Human
cccaggagaccugugaaaggac

SEQ ID NO: 784115 - RNA, 20 nt, Human
aggagggaccuggauuggcg

SEQ ID NO: 784116 - RNA, 22 nt, Human
ucauuauccuaguaucuugaau

SEQ ID NO: 784117 - RNA, 23 nt, Human
acacauuuuucccguucugaggu

SEQ ID NO: 784118 - RNA, 22 nt, Human
acaugcauacacguacauaccu

SEQ ID NO: 784119 - RNA, 22 nt, Human
acugugugacuguuauuacugu

SEQ ID NO: 784120 - RNA, 22 nt, Human
cuucugcaauaaguuuuggucc

SEQ ID NO: 784121 - RNA, 22 nt, Human
caggagaggaggcuacuucuua

SEQ ID NO: 784122 - RNA, 20 nt, Human
ugugcaggagagugaggcug

SEQ ID NO: 784123 - RNA, 22 nt, Human
ugaaaugagcauuuauucuuua

SEQ ID NO: 784124 - RNA, 23 nt, Human
uggaaagcggaccuggggcagag

SEQ ID NO: 784125 - RNA, 22 nt, Human
gcaucuaaauaaacgugggagu

SEQ ID NO: 784126 - RNA, 22 nt, Human
cuuguccccagcagguugguuu

SEQ ID NO: 784127 - RNA, 18 nt, Human
gaggcagcuagcaauuuu

SEQ ID NO: 784128 - RNA, 22 nt, Human
uuaggaguccagaugucuuggg

SEQ ID NO: 784129 - RNA, 21 nt, Human
gauuuuaaagagacugccaca

SEQ ID NO: 784130 - RNA, 22 nt, Human
ggaggacaggggcugcagcaca

SEQ ID NO: 784131 - RNA, 22 nt, Human
aggcaguguguagcuggaagag

SEQ ID NO: 784132 - RNA, 22 nt, Human
cugcugugacagcugccguguu

SEQ ID NO: 784133 - RNA, 22 nt, Human
uccaggaguccugggagugauu

SEQ ID NO: 784134 - RNA, 22 nt, Human
agaggggaguccuaaucugauu

SEQ ID NO: 784135 - RNA, 18 nt, Human
gucacuguguuucugagc

SEQ ID NO: 784136 - RNA, 22 nt, Human
agugagggaugaagaacugcgg

SEQ ID NO: 784137 - RNA, 22 nt, Human
acucagaaccauuuacucugag

SEQ ID NO: 784138 - RNA, 22 nt, Human
gcucacugcaaccucugcuucc

SEQ ID NO: 784139 - RNA, 22 nt, Human
uugugaguagugccgcaauaaa

SEQ ID NO: 784140 - RNA, 22 nt, Human
ccucaggggucacugugaggag

SEQ ID NO: 784141 - RNA, 22 nt, Human
gcuugaaaauucauagguauuu

SEQ ID NO: 784142 - RNA, 22 nt, Human
ucaggagaaagccaauuagagu

SEQ ID NO: 784143 - RNA, 20 nt, Human
cugcccagccacugagggau

SEQ ID NO: 784144 - RNA, 22 nt, Human
cuguuaaucugcuugcaugaug

SEQ ID NO: 784145 - RNA, 22 nt, Human
cagaaggcuggcagauugagau

SEQ ID NO: 784146 - RNA, 22 nt, Human
acuuucugcaguguuggaaaug

SEQ ID NO: 784147 - RNA, 22 nt, Human
ucauuuguacuugugugcuugu

SEQ ID NO: 784148 - RNA, 22 nt, Human
uaucuguuugcucacagguguu

SEQ ID NO: 784149 - RNA, 22 nt, Human
agucucugcaugccugcugugc

SEQ ID NO: 784150 - RNA, 22 nt, Human
cccaagagguggagguugcagu

SEQ ID NO: 784151 - RNA, 22 nt, Human
uaacauuagguagacauaagcc

SEQ ID NO: 784152 - RNA, 22 nt, Human
augcuuuuaugucacaugguca

SEQ ID NO: 784153 - RNA, 22 nt, Human
cauugcuguuaauugucucuag

SEQ ID NO: 784154 - RNA, 17 nt, Human
ugauaguucauuuuaag

SEQ ID NO: 784155 - RNA, 22 nt, Human
accaggagucuagccuagucaa

SEQ ID NO: 784156 - RNA, 22 nt, Human
uguugauuaguguuuagacuua

SEQ ID NO: 784157 - RNA, 22 nt, Human
ggcagucuuaucagcauuggac

SEQ ID NO: 784158 - RNA, 22 nt, Human
gucaggaugagggaugaggagu

SEQ ID NO: 784159 - RNA, 22 nt, Human
cucacugacgaggaagcugaga

SEQ ID NO: 784160 - RNA, 22 nt, Human
aggcagcaugggccccagcucc

SEQ ID NO: 784161 - RNA, 22 nt, Human
ucauggauggccgggaggugau

SEQ ID NO: 784162 - RNA, 22 nt, Human
gaaggccacaagagaaguuaag

SEQ ID NO: 784163 - RNA, 22 nt, Human
aaagauuugaguucugcuuaua

SEQ ID NO: 784164 - RNA, 22 nt, Human
cuggaguuagaguagacacuga

SEQ ID NO: 784165 - RNA, 22 nt, Human
accaggaggccuugguucugag

SEQ ID NO: 784166 - RNA, 22 nt, Human
aaaacaguuuaggcaucacagu

SEQ ID NO: 784167 - RNA, 22 nt, Human
ccuggagagagaggccaacugc

SEQ ID NO: 784168 - RNA, 19 nt, Human
cccaggagucuggcugguu

SEQ ID NO: 784169 - RNA, 22 nt, Human
ucucuguaguugggcagcugcu

SEQ ID NO: 784170 - RNA, 22 nt, Human
ugaaaugauuauaugguguuug

SEQ ID NO: 784171 - RNA, 22 nt, Human
ccucaggauacaggagccacag

SEQ ID NO: 784172 - RNA, 22 nt, Human
guuuuucuaggaccaugugauu

SEQ ID NO: 784173 - RNA, 22 nt, Human
aaggccagccugagagcuaaca

SEQ ID NO: 784174 - RNA, 22 nt, Human
ucugcaggcucuagaugagguu

SEQ ID NO: 784175 - RNA, 22 nt, Human
agaccgagaaguucuccaggcc

SEQ ID NO: 784176 - RNA, 19 nt, Human
ucucugcuucucuuggcau

SEQ ID NO: 784177 - RNA, 22 nt, Human
cccaggaggcagauguugcagu

SEQ ID NO: 784178 - RNA, 22 nt, Human
caaggccaaagggccacuguca

SEQ ID NO: 784179 - RNA, 22 nt, Human
gaaauauucuugucuuguuuuc

SEQ ID NO: 784180 - RNA, 22 nt, Human
auguuuccauuuucuuguauca

SEQ ID NO: 784181 - RNA, 22 nt, Human
cccaggaaaucaggcuuucuag

SEQ ID NO: 784182 - RNA, 22 nt, Human
agucaauucuuuucaacucaag

SEQ ID NO: 784183 - RNA, 20 nt, Human
uuucuugucggcuguugcug

SEQ ID NO: 784184 - RNA, 22 nt, Human
uacaacauuguguugcuucaua

SEQ ID NO: 784185 - RNA, 22 nt, Human
ggcagcuuguccuucaggagag

SEQ ID NO: 784186 - RNA, 22 nt, Human
aggcagguuggugagaagacug

SEQ ID NO: 784187 - RNA, 22 nt, Human
aagauauucaaagauuuauuag

SEQ ID NO: 784188 - RNA, 22 nt, Human
ugcuuggccuacuuguccuuug

SEQ ID NO: 784189 - RNA, 22 nt, Human
aggcagugcaugcaaaggucgg

SEQ ID NO: 784190 - RNA, 22 nt, Human
gaggcacugcaguacagugacu

SEQ ID NO: 784191 - RNA, 22 nt, Human
cuucagaagaaaagcagugugu

SEQ ID NO: 784192 - RNA, 22 nt, Human
aagcagcuggaagaguaagaug

SEQ ID NO: 784193 - RNA, 22 nt, Human
cagagccacuuggagaugagaa

SEQ ID NO: 784194 - RNA, 18 nt, Human
cugcccagagcacuugug

SEQ ID NO: 784195 - RNA, 22 nt, Human
auuggcaggaaccgaggagggg

SEQ ID NO: 784196 - RNA, 22 nt, Human
ucaggaugagcucauaacuaug

SEQ ID NO: 784197 - RNA, 22 nt, Human
acccaggagcaggcugggcagu

SEQ ID NO: 784198 - RNA, 22 nt, Human
ugugauauuugaguauugucaa

SEQ ID NO: 784199 - RNA, 22 nt, Human
uagugcuuaacacaaagugauu

SEQ ID NO: 784200 - RNA, 22 nt, Human
ggagcuguuggcagcuaucuug

SEQ ID NO: 784201 - RNA, 22 nt, Human
ucaggagaaucagggcuguccu

SEQ ID NO: 784202 - RNA, 22 nt, Human
uuugaagugggcauuagaaccu

SEQ ID NO: 784203 - RNA, 22 nt, Human
agcuggcaguaugacuggugac

SEQ ID NO: 784204 - RNA, 22 nt, Human
cuuccuucugaagcauagaagc

SEQ ID NO: 784205 - RNA, 22 nt, Human
uugcauuugaucuuggguucuc

SEQ ID NO: 784206 - RNA, 22 nt, Human
uuauuauagauuaugcaagauu

SEQ ID NO: 784207 - RNA, 22 nt, Human
caaauguauucucacuucaggg

SEQ ID NO: 784208 - RNA, 22 nt, Human
cagcaggaccauugaggcauca

SEQ ID NO: 784209 - RNA, 23 nt, Human
uuugaaguugacugccuuccaga

SEQ ID NO: 784210 - RNA, 22 nt, Human
gugagggguggcugagcaguuu

SEQ ID NO: 784211 - RNA, 22 nt, Human
uuuaaauggcauuuucccagau

SEQ ID NO: 784212 - RNA, 22 nt, Human
augauguuauuuucagaaacau

SEQ ID NO: 784213 - RNA, 22 nt, Human
augugaggaagaaagagguaag

SEQ ID NO: 784214 - RNA, 22 nt, Human
cuguggaauugaugcuuagugu

SEQ ID NO: 784215 - RNA, 22 nt, Human
agcagaggaggauuuaguuagg

SEQ ID NO: 784216 - RNA, 22 nt, Human
caggaugagaggcccagggaag

SEQ ID NO: 784217 - RNA, 20 nt, Human
ugaggcaggagaauggcaug

SEQ ID NO: 784218 - RNA, 22 nt, Human
uuauggcauauuccucauugua

SEQ ID NO: 784219 - RNA, 22 nt, Human
cugucauuuaagacauucugga

SEQ ID NO: 784220 - RNA, 22 nt, Human
gauggcagcauauugacagcau

SEQ ID NO: 784221 - RNA, 22 nt, Human
aagcagaguccccuucccaugg

SEQ ID NO: 784222 - RNA, 22 nt, Human
acacauauucauauguacuuac

SEQ ID NO: 784223 - RNA, 22 nt, Human
ucucagucuuugcaaggaugcu

SEQ ID NO: 784224 - RNA, 21 nt, Human
uggcaggcagcuggaagcuug

SEQ ID NO: 784225 - RNA, 22 nt, Human
gaggcagcagggcugguuccuu

SEQ ID NO: 784226 - RNA, 22 nt, Human
ugaaaugacaaagguuuuucuu

SEQ ID NO: 784227 - RNA, 22 nt, Human
uacugcauaacuggcauguggg

SEQ ID NO: 784228 - RNA, 22 nt, Human
gaggagaggcuggacgcgguga

SEQ ID NO: 784229 - RNA, 19 nt, Human
uggggcuguguuuugaccc

SEQ ID NO: 784230 - RNA, 19 nt, Human
uggagacugagagugagca

SEQ ID NO: 784231 - RNA, 22 nt, Human
uauuauuaaauggcagaauuuu

SEQ ID NO: 784232 - RNA, 22 nt, Human
aaguauuucguucugaaaaagu

SEQ ID NO: 784233 - RNA, 22 nt, Human
cagcuguggcugccacugcucc

SEQ ID NO: 784234 - RNA, 22 nt, Human
cagcagagaaauuaaacuucug

SEQ ID NO: 784235 - RNA, 22 nt, Human
ggcagcuuguccuggaggaugg

SEQ ID NO: 784236 - RNA, 22 nt, Human
uugacaauguccuuugaauuuc

SEQ ID NO: 784237 - RNA, 20 nt, Human
agggcagcuugaggagccgg

SEQ ID NO: 784238 - RNA, 22 nt, Human
ggcagcucacgggcauggggug

SEQ ID NO: 784239 - RNA, 22 nt, Human
gaaauaagaguccaugccaggu

SEQ ID NO: 784240 - RNA, 22 nt, Human
ucuucccuaaucaccaucuuca

SEQ ID NO: 784241 - RNA, 22 nt, Human
aguuucuuuagauagaaaguuc

SEQ ID NO: 784242 - RNA, 22 nt, Human
augaggcauuccacucaaacuc

SEQ ID NO: 784243 - RNA, 22 nt, Human
ccaggagagcagaagcccaggc

SEQ ID NO: 784244 - RNA, 21 nt, Human
ugcuggaaaaagugguucuag

SEQ ID NO: 784245 - RNA, 22 nt, Human
ugaggcaguugagcuuccugag

SEQ ID NO: 784246 - RNA, 22 nt, Human
uuuuaacuuaaaauacauagau

SEQ ID NO: 784247 - RNA, 22 nt, Human
ucucuuucuauaugugagucuu

SEQ ID NO: 784248 - RNA, 22 nt, Human
uuucaguucaguuuauuauauc

SEQ ID NO: 784249 - RNA, 22 nt, Human
uccaggaggcucugguugacgu

SEQ ID NO: 784250 - RNA, 22 nt, Human
ucacugcugcugccaugaugga

SEQ ID NO: 784251 - RNA, 22 nt, Human
aggcagcguagcaaggcuagua

SEQ ID NO: 784252 - RNA, 22 nt, Human
uauuugaaaguguacaaaaacu

SEQ ID NO: 784253 - RNA, 22 nt, Human
guuuuucuuugugugaagacaa

SEQ ID NO: 784254 - RNA, 20 nt, Human
ggaggguggaagaaagcaag

SEQ ID NO: 784255 - RNA, 22 nt, Human
uguguuauugccacugaagacc

SEQ ID NO: 784256 - RNA, 22 nt, Human
cccaggaagaggggucaggugu

SEQ ID NO: 784257 - RNA, 22 nt, Human
cccaggaaugaggggcggaggc

SEQ ID NO: 784258 - RNA, 22 nt, Human
caggagggcccgagacucuucc

SEQ ID NO: 784259 - RNA, 22 nt, Human
gcucucuugguggcuguccugg

SEQ ID NO: 784260 - RNA, 22 nt, Human
aaguugagaugucauaggagac

SEQ ID NO: 784261 - RNA, 20 nt, Human
uuucaguuaucuugaccuuc

SEQ ID NO: 784262 - RNA, 21 nt, Human
aaugaaguggcuauuuugagg

SEQ ID NO: 784263 - RNA, 22 nt, Human
aaugucugcucuacucaggagg

SEQ ID NO: 784264 - RNA, 22 nt, Human
uccugagagcagcugcuuugga

SEQ ID NO: 784265 - RNA, 22 nt, Human
cuucucagaucucagcuuugag

SEQ ID NO: 784266 - RNA, 22 nt, Human
ugaggggagcuagcaugccuug

SEQ ID NO: 784267 - RNA, 22 nt, Human
ccucacugcuauguguuugcuc

SEQ ID NO: 784268 - RNA, 22 nt, Human
uuucaaaguugggaauuguaau

SEQ ID NO: 784269 - RNA, 22 nt, Human
ucuuuucaucauuuaauaggua

SEQ ID NO: 784270 - RNA, 22 nt, Human
ugcauauuguccuugauauuau

SEQ ID NO: 784271 - RNA, 22 nt, Human
uauguguuugacacccugcaag

SEQ ID NO: 784272 - RNA, 22 nt, Human
augcugugccuggaaagcggcu

SEQ ID NO: 784273 - RNA, 21 nt, Human
ucacaucuauguuaagcaaac

SEQ ID NO: 784274 - RNA, 22 nt, Human
aggcagacaaggucccuggucu

SEQ ID NO: 784275 - RNA, 22 nt, Human
caaggccagggaauuuuucugg

SEQ ID NO: 784276 - RNA, 22 nt, Human
ugcugcugauggcaccuaggca

SEQ ID NO: 784277 - RNA, 22 nt, Human
aaguguagauuauggagugucu

SEQ ID NO: 784278 - RNA, 22 nt, Human
aggccagaugucgggcuagaag

SEQ ID NO: 784279 - RNA, 22 nt, Human
gaggcagcugggauacaaggga

SEQ ID NO: 784280 - RNA, 20 nt, Human
cccagguaggugccaugagu

SEQ ID NO: 784281 - RNA, 22 nt, Human
gucauucuuaacaacucaguag

SEQ ID NO: 784282 - RNA, 22 nt, Human
gaggccagaguuccccgaguca

SEQ ID NO: 784283 - RNA, 22 nt, Human
gaucauuugcaggaaacauuaa

SEQ ID NO: 784284 - RNA, 22 nt, Human
agggggugcccagaugaaggau

SEQ ID NO: 784285 - RNA, 20 nt, Human
uugauaggcagcuugucagg

SEQ ID NO: 784286 - RNA, 21 nt, Human
cccagggaagccgcagucacc

SEQ ID NO: 784287 - RNA, 22 nt, Human
acuguagcugccacuggaugca

SEQ ID NO: 784288 - RNA, 22 nt, Human
augcuguguggccaccuccaug

SEQ ID NO: 784289 - RNA, 22 nt, Human
ugucuucagcaaaugccuuucu

SEQ ID NO: 784290 - RNA, 22 nt, Human
gaaggccaagaggcuccaagau

SEQ ID NO: 784291 - RNA, 22 nt, Human
aucauucuauuguugagcugcc

SEQ ID NO: 784292 - RNA, 22 nt, Human
uggaggaaguggcuggccagaa

SEQ ID NO: 784293 - RNA, 22 nt, Human
ucccaggauguuggcggcaggu

SEQ ID NO: 784294 - RNA, 22 nt, Human
ucucaguguguuuucucucaga

SEQ ID NO: 784295 - RNA, 22 nt, Human
guacauuucucuuguucuuauu

SEQ ID NO: 784296 - RNA, 22 nt, Human
agagugucugguagcugcucug

SEQ ID NO: 784297 - RNA, 22 nt, Human
cuugcaggauuuugcugcugua

SEQ ID NO: 784298 - RNA, 22 nt, Human
gaagcagccacggggagacaga

SEQ ID NO: 784299 - RNA, 22 nt, Human
aagcagcuuuugaagagugagg

SEQ ID NO: 784300 - RNA, 22 nt, Human
cucagaauuuagggcucugagg

SEQ ID NO: 784301 - RNA, 22 nt, Human
acuuggcaaguaucuauaaagu

SEQ ID NO: 784302 - RNA, 22 nt, Human
auacuguuuugugacuuaucuu

SEQ ID NO: 784303 - RNA, 22 nt, Human
uaggcagccagcaucaguuggg

SEQ ID NO: 784304 - RNA, 22 nt, Human
uuuucagaggccuaagagguuu

SEQ ID NO: 784305 - RNA, 22 nt, Human
ccagugcuucuuugcuagcugg

SEQ ID NO: 784306 - RNA, 22 nt, Human
auguucuguuuuguaauucaua

SEQ ID NO: 784307 - RNA, 22 nt, Human
uccugucuaaagaccugcaggc

SEQ ID NO: 784308 - RNA, 22 nt, Human
aucuucucauguguaaugaggu

SEQ ID NO: 784309 - RNA, 22 nt, Human
cuugauguauaaguugauaugu

SEQ ID NO: 784310 - RNA, 22 nt, Human
ggcaugcucuuuguccacagua

SEQ ID NO: 784311 - RNA, 22 nt, Human
uauuuccaagcugaauccaaug

SEQ ID NO: 784312 - RNA, 22 nt, Human
cccaggagacagaaacagaggu

SEQ ID NO: 784313 - RNA, 22 nt, Human
agugcagccgagaucaggugcu

SEQ ID NO: 784314 - RNA, 22 nt, Human
ugcaggaacugggagggauagu

SEQ ID NO: 784315 - RNA, 17 nt, Human
agaggcagauacuugga

SEQ ID NO: 784316 - RNA, 22 nt, Human
cccuggagguggagguugcagg

SEQ ID NO: 784317 - RNA, 22 nt, Human
cuuaaauuuucaucuacaagaa

SEQ ID NO: 784318 - RNA, 22 nt, Human
gagacagcacaggccacuggga

SEQ ID NO: 784319 - RNA, 22 nt, Human
caugcugugugguuagaacugu

SEQ ID NO: 784320 - RNA, 22 nt, Human
uauguuauuuucauacaacaga

SEQ ID NO: 784321 - RNA, 22 nt, Human
cugcccaggaaccagaggggca

SEQ ID NO: 784322 - RNA, 22 nt, Human
gcagaggacagggauuuagauu

SEQ ID NO: 784323 - RNA, 19 nt, Human
ugcugcuguccuugcaggg

SEQ ID NO: 784324 - RNA, 18 nt, Human
aguaaagcuuauuacaug

SEQ ID NO: 784325 - RNA, 22 nt, Human
uuucauuuugguuaugccauaa

SEQ ID NO: 784326 - RNA, 22 nt, Human
uggcagcucauuuggaaaugga

SEQ ID NO: 784327 - RNA, 22 nt, Human
ugcuuucaaaggcuuucuagau

SEQ ID NO: 784328 - RNA, 22 nt, Human
gaggcaguuccugagugacaag

SEQ ID NO: 784329 - RNA, 22 nt, Human
gauuucuuugcaagcuguguuc

SEQ ID NO: 784330 - RNA, 22 nt, Human
auucaaauuaaguuaauucagc

SEQ ID NO: 784331 - RNA, 22 nt, Human
ucugggaacucugucauuuccc

SEQ ID NO: 784332 - RNA, 22 nt, Human
aagcaccucuaugauugcuuuu

SEQ ID NO: 784333 - RNA, 22 nt, Human
ugaggcaggacauggacaacug

SEQ ID NO: 784334 - RNA, 22 nt, Human
agccagcugugggcucaggcgg

SEQ ID NO: 784335 - RNA, 22 nt, Human
auacuguuucucuucuacauga

SEQ ID NO: 784336 - RNA, 18 nt, Human
acugugugaauuagcucc

SEQ ID NO: 784337 - RNA, 22 nt, Human
cugagggugcuauucuugccuu

SEQ ID NO: 784338 - RNA, 22 nt, Human
uuucuuguaagauguuuauuaa

SEQ ID NO: 784339 - RNA, 22 nt, Human
uuugaaauuaagauauugucca

SEQ ID NO: 784340 - RNA, 22 nt, Human
uuucauggcuaggacuagagug

SEQ ID NO: 784341 - RNA, 22 nt, Human
uuuaacagaugugaaauuuuca

SEQ ID NO: 784342 - RNA, 22 nt, Human
cugcugugugcuuacuuggguu

SEQ ID NO: 784343 - RNA, 22 nt, Human
aagacuguacauuuuccagucu

SEQ ID NO: 784344 - RNA, 22 nt, Human
uucccucuccuacucaggaaag

SEQ ID NO: 784345 - RNA, 22 nt, Human
ugaggcagggagaguggauaug

SEQ ID NO: 784346 - RNA, 22 nt, Human
gaaggccauuuuuagguagaau

SEQ ID NO: 784347 - RNA, 19 nt, Human
aggguggcaaaggagggug

SEQ ID NO: 784348 - RNA, 22 nt, Human
uuuccucauuuaucugcuggga

SEQ ID NO: 784349 - RNA, 22 nt, Human
ccccaggagcuuguuuuagaga

SEQ ID NO: 784350 - RNA, 22 nt, Human
agucaauuaucucuaggucauc

SEQ ID NO: 784351 - RNA, 22 nt, Human
guuuucaauuauaagauggcuu

SEQ ID NO: 784352 - RNA, 22 nt, Human
ggcuuggaaaugguaaugagcu

SEQ ID NO: 784353 - RNA, 22 nt, Human
ucauuucccuccuacaaagagg

SEQ ID NO: 784354 - RNA, 22 nt, Human
uuucaguuuaugucuugaauua

SEQ ID NO: 784355 - RNA, 23 nt, Human
agaggcaggaguggcuugcccgg

SEQ ID NO: 784356 - RNA, 22 nt, Human
uugcugugucauuuguuuaauc

SEQ ID NO: 784357 - RNA, 22 nt, Human
acucaggaaaaauguagugaua

SEQ ID NO: 784358 - RNA, 22 nt, Human
cccaggagccaucugucuuggc

SEQ ID NO: 784359 - RNA, 22 nt, Human
ucugggaacugagcuccccuag

SEQ ID NO: 784360 - RNA, 22 nt, Human
aaaguauucuugacuguuuuuc

SEQ ID NO: 784361 - RNA, 22 nt, Human
ccauccugcauugcuauucaga

SEQ ID NO: 784362 - RNA, 17 nt, Human
uugaacugcugagucag

SEQ ID NO: 784363 - RNA, 22 nt, Human
aaguguauauaugacuuauaaa

SEQ ID NO: 784364 - RNA, 22 nt, Human
cccaggaacuccagagcuccuc

SEQ ID NO: 784365 - RNA, 22 nt, Human
ucugggaacagccuggcugugu

SEQ ID NO: 784366 - RNA, 22 nt, Human
ggcagcuguaagaugagugaau

SEQ ID NO: 784367 - RNA, 22 nt, Human
acaguacauaauccugagucug

SEQ ID NO: 784368 - RNA, 22 nt, Human
gaggaggccaguggaaggaagc

SEQ ID NO: 784369 - RNA, 22 nt, Human
uucaggauaguggugaguggca

SEQ ID NO: 784370 - RNA, 22 nt, Human
uuagccaugugggaaaaacagc

SEQ ID NO: 784371 - RNA, 22 nt, Human
uacugcaugguggaguggagcu

SEQ ID NO: 784372 - RNA, 22 nt, Human
gaggagcugggucagggagaca

SEQ ID NO: 784373 - RNA, 22 nt, Human
gacagcuggcaguggaaaggug

SEQ ID NO: 784374 - RNA, 22 nt, Human
ucaggagagagaaauuggggcu

SEQ ID NO: 784375 - RNA, 22 nt, Human
ggccagcagucacagggucaga

SEQ ID NO: 784376 - RNA, 22 nt, Human
uaggcagcgcuuggcugugcuu

SEQ ID NO: 784377 - RNA, 21 nt, Human
auacacauacacauaaaugug

SEQ ID NO: 784378 - RNA, 22 nt, Human
auacuuucugaccaauuaauug

SEQ ID NO: 784379 - RNA, 22 nt, Human
uggcagcuccggguaggggcug

SEQ ID NO: 784380 - RNA, 22 nt, Human
agcuucuuggcucagcacuugg

SEQ ID NO: 784381 - RNA, 22 nt, Human
cugccaggcacgugcagcauca

SEQ ID NO: 784382 - RNA, 22 nt, Human
cuacccagagugaaucucuuaa

SEQ ID NO: 784383 - RNA, 22 nt, Human
guccucuguuagaaaugugcuu

SEQ ID NO: 784384 - RNA, 22 nt, Human
ggcagggaagcuggcaucacgg

SEQ ID NO: 784385 - RNA, 22 nt, Human
cuucuucaguugcauguauugg

SEQ ID NO: 784386 - RNA, 22 nt, Human
ucaggagacaaagggugcggag

SEQ ID NO: 784387 - RNA, 22 nt, Human
agcagagccugggcuaggggug

SEQ ID NO: 784388 - RNA, 22 nt, Human
uuugacaugcaaagcacuuuag

SEQ ID NO: 784389 - RNA, 23 nt, Human
ccacuagcaccuguucaacuucu

SEQ ID NO: 784390 - RNA, 22 nt, Human
aagaagagaacuggcauccuaa

SEQ ID NO: 784391 - RNA, 22 nt, Human
gcagcucccagcuugaaagguc

SEQ ID NO: 784392 - RNA, 22 nt, Human
caggauggugugagugugagga

SEQ ID NO: 784393 - RNA, 22 nt, Human
ucucgacagccuggcacagugg

SEQ ID NO: 784394 - RNA, 22 nt, Human
ggauggcauguugggcucuguu

SEQ ID NO: 784395 - RNA, 22 nt, Human
uucuucaaauagcagggaguca

SEQ ID NO: 784396 - RNA, 21 nt, Human
ccauaccuaccucaccugguu

SEQ ID NO: 784397 - RNA, 22 nt, Human
ucuuuuggguucuuaugauuua

SEQ ID NO: 784398 - RNA, 20 nt, Human
gcucccagccugcagucccc

SEQ ID NO: 784399 - RNA, 22 nt, Human
gcuuuggagccuguguucugcc

SEQ ID NO: 784400 - RNA, 22 nt, Human
ucuucucucauguaggagggaa

SEQ ID NO: 784401 - RNA, 22 nt, Human
cucuucuugaaagaggaauuca

SEQ ID NO: 784402 - RNA, 22 nt, Human
ggcaagcucaggccucaggugu

SEQ ID NO: 784403 - RNA, 22 nt, Human
uccaggaguuugaccugugggc

SEQ ID NO: 784404 - RNA, 22 nt, Human
gccaggagggaaaggacaauuu

SEQ ID NO: 784405 - RNA, 22 nt, Human
guagggagcccagagcccagug

SEQ ID NO: 784406 - RNA, 22 nt, Human
ggagagugggagcaacuguugc

SEQ ID NO: 784407 - RNA, 22 nt, Human
cuguucucuggcgguggcuguu

SEQ ID NO: 784408 - RNA, 22 nt, Human
cagaagaguagcugaacaaguu

SEQ ID NO: 784409 - RNA, 22 nt, Human
agucucuuuaaucacagugucu

SEQ ID NO: 784410 - RNA, 22 nt, Human
agugcagcaugcuggggaggcu

SEQ ID NO: 784411 - RNA, 22 nt, Human
gcaagcugaugugauagugaaa

SEQ ID NO: 784412 - RNA, 22 nt, Human
agacaaaugguaauuaugucua

SEQ ID NO: 784413 - RNA, 22 nt, Human
cacaauuuccuugcuucacuuu

SEQ ID NO: 784414 - RNA, 21 nt, Human
cccaggagaagaaaagaugca

SEQ ID NO: 784415 - RNA, 22 nt, Human
uucuuuuccuacacagcgauuu

SEQ ID NO: 784416 - RNA, 22 nt, Human
cagaaccaggaacugauggaga

SEQ ID NO: 784417 - RNA, 22 nt, Human
uugcuuuguuacugcaguuucc

SEQ ID NO: 784418 - RNA, 22 nt, Human
ucugggaagcugguccuguucu

SEQ ID NO: 784419 - RNA, 23 nt, Human
aaugauuucaugaugauagcagc

SEQ ID NO: 784420 - RNA, 22 nt, Human
cacaaaugguuguagacauuaa

SEQ ID NO: 784421 - RNA, 22 nt, Human
aggccagcaagaaagagagucu

SEQ ID NO: 784422 - RNA, 22 nt, Human
ugaggcagugugagauaauaaa

SEQ ID NO: 784423 - RNA, 18 nt, Human
cugcugugucgucugggc

SEQ ID NO: 784424 - RNA, 22 nt, Human
ucaggagaguguucaguggagg

SEQ ID NO: 784425 - RNA, 22 nt, Human
uacagcuaggcaaaaaugacau

SEQ ID NO: 784426 - RNA, 22 nt, Human
ugcccagggauaagccuagaga

SEQ ID NO: 784427 - RNA, 22 nt, Human
ucuuugaacuuggcugaucucu

SEQ ID NO: 784428 - RNA, 22 nt, Human
cugcugugagugguucuugccu

SEQ ID NO: 784429 - RNA, 22 nt, Human
cacagacccagaagggaugaag

SEQ ID NO: 784430 - RNA, 22 nt, Human
uauuucuaagagauaucuguac

SEQ ID NO: 784431 - RNA, 22 nt, Human
cugcugugccuuaaaaugcaag

SEQ ID NO: 784432 - RNA, 22 nt, Human
aaaggccaugguuggaguguuu

SEQ ID NO: 784433 - RNA, 22 nt, Human
cacaauuuguuuuaucaguauu

SEQ ID NO: 784434 - RNA, 22 nt, Human
guaggcagugguuggaagagaa

SEQ ID NO: 784435 - RNA, 22 nt, Human
uugaaagucacaauggcauuaa

SEQ ID NO: 784436 - RNA, 22 nt, Human
aggcaggcacacuuccuccagg

SEQ ID NO: 784437 - RNA, 22 nt, Human
gcugcugugccuggcguccugu

SEQ ID NO: 784438 - RNA, 23 nt, Human
aggucagcaggcaaggaaauggc

SEQ ID NO: 784439 - RNA, 22 nt, Human
aggaagcuaaccagggagugag

SEQ ID NO: 784440 - RNA, 22 nt, Human
cagcucugaggaacacuccuuu

SEQ ID NO: 784441 - RNA, 22 nt, Human
uggucuuuaagguagcugucau

SEQ ID NO: 784442 - RNA, 19 nt, Human
ggcaggcuggauagagagg

SEQ ID NO: 784443 - RNA, 22 nt, Human
cccaguuucaacuuuccagugg

SEQ ID NO: 784444 - RNA, 21 nt, Human
auacauucuauuaagcauuua

SEQ ID NO: 784445 - RNA, 22 nt, Human
aggaagcugcuggaguagugug

SEQ ID NO: 784446 - RNA, 22 nt, Human
ugcuuccuauccacacaaugcc

SEQ ID NO: 784447 - RNA, 20 nt, Human
cucaggauugucuagccccu

SEQ ID NO: 784448 - RNA, 22 nt, Human
uuucaaagaguuguaaauuacu

SEQ ID NO: 784449 - RNA, 22 nt, Human
guucucucugcuuccaagaugg

SEQ ID NO: 784450 - RNA, 22 nt, Human
gcagcugaaagggaucucuaca

SEQ ID NO: 784451 - RNA, 22 nt, Human
acuggcaguagagggagcgcau

SEQ ID NO: 784452 - RNA, 22 nt, Human
guugaaagagcauggacuugaa

SEQ ID NO: 784453 - RNA, 22 nt, Human
gucuucuuuucagucugcuugu

SEQ ID NO: 784454 - RNA, 20 nt, Human
uuugucuguuaaguguuucu

SEQ ID NO: 784455 - RNA, 22 nt, Human
aaggccagaguacuagaggcug

SEQ ID NO: 784456 - RNA, 22 nt, Human
gagaaggaguagcugaccuggg

SEQ ID NO: 784457 - RNA, 20 nt, Human
accaggagauggaggcaggg

SEQ ID NO: 784458 - RNA, 22 nt, Human
agcagagguuuguuggaaaccu

SEQ ID NO: 784459 - RNA, 22 nt, Human
uggcagcuguguccagguagaa

SEQ ID NO: 784460 - RNA, 22 nt, Human
uuucaugagauuccuccacauc

SEQ ID NO: 784461 - RNA, 22 nt, Human
caguucuuauuuggccaguguc

SEQ ID NO: 784462 - RNA, 22 nt, Human
uucaaauacauucuuugccacu

SEQ ID NO: 784463 - RNA, 22 nt, Human
caaguaaagaaucacauuucuu

SEQ ID NO: 784464 - RNA, 22 nt, Human
uccaugaguuugaggaaaagag

SEQ ID NO: 784465 - RNA, 22 nt, Human
agagggcugcugcacagugcuc

SEQ ID NO: 784466 - RNA, 23 nt, Human
cuucucagaagucugugccagga

SEQ ID NO: 784467 - RNA, 22 nt, Human
uuauuuaaaagugguaagauuc

SEQ ID NO: 784468 - RNA, 22 nt, Human
ugaagggggagauauaugugug

SEQ ID NO: 784469 - RNA, 22 nt, Human
cuucagaagccugcagccuuug

SEQ ID NO: 784470 - RNA, 22 nt, Human
cucacugugccuuuucccaaac

SEQ ID NO: 784471 - RNA, 18 nt, Human
aaacuggcuuggccugug

SEQ ID NO: 784472 - RNA, 22 nt, Human
uucuucaaaacaacacuggccu

SEQ ID NO: 784473 - RNA, 22 nt, Human
ucuacugcacuggugucucauc

SEQ ID NO: 784474 - RNA, 22 nt, Human
ugcugaugcuguucuguuagga

SEQ ID NO: 784475 - RNA, 22 nt, Human
aggcagcugugaggacuggauu

SEQ ID NO: 784476 - RNA, 22 nt, Human
caggagaggcuguacguuucuc

SEQ ID NO: 784477 - RNA, 22 nt, Human
cugcuaaaccucucugagagcu

SEQ ID NO: 784478 - RNA, 22 nt, Human
aguaaaaauugaggugcaaaau

SEQ ID NO: 784479 - RNA, 22 nt, Human
ucauuuguggaagugauugugg

SEQ ID NO: 784480 - RNA, 22 nt, Human
uuugaauagaggccccucagaa

SEQ ID NO: 784481 - RNA, 19 nt, Human
ggcagucucaagcagcaca

SEQ ID NO: 784482 - RNA, 22 nt, Human
acauauauuacuaguaaagaca

SEQ ID NO: 784483 - RNA, 22 nt, Human
uggcagcugcaggccuccugag

SEQ ID NO: 784484 - RNA, 22 nt, Human
aagggcaggaaaagauggaugu

SEQ ID NO: 784485 - RNA, 22 nt, Human
gccagagguucaacaacugucu

SEQ ID NO: 784486 - RNA, 22 nt, Human
uuuaagauucaguaaggcaaac

SEQ ID NO: 784487 - RNA, 22 nt, Human
ucacaucucccuggaggacaca

SEQ ID NO: 784488 - RNA, 22 nt, Human
gcccaggaaguugaggcugccg

SEQ ID NO: 784489 - RNA, 22 nt, Human
uuauuacacugaaagaauugcg

SEQ ID NO: 784490 - RNA, 22 nt, Human
aagggcagagggaaucccacau

SEQ ID NO: 784491 - RNA, 22 nt, Human
agggagcuucuggccucagccu

SEQ ID NO: 784492 - RNA, 22 nt, Human
gagggaggcaucaugaauccag

SEQ ID NO: 784493 - RNA, 22 nt, Human
aucugccugcaguggagguggg

SEQ ID NO: 784494 - RNA, 22 nt, Human
agacaaauggaguaugagcaac

SEQ ID NO: 784495 - RNA, 22 nt, Human
ugaggcaggaauggggaaaagu

SEQ ID NO: 784496 - RNA, 22 nt, Human
aggcagucuaguccccaggcaa

SEQ ID NO: 784497 - RNA, 22 nt, Human
gaggcauggccugaggcuagga

SEQ ID NO: 784498 - RNA, 22 nt, Human
cccaggagcuucucucugccuc

SEQ ID NO: 784499 - RNA, 22 nt, Human
ggcaugcugcguacagaugaac

SEQ ID NO: 784500 - RNA, 22 nt, Human
agcagcauuaugauauaucuua

SEQ ID NO: 784501 - RNA, 22 nt, Human
uucuucuccgaggagggcuggu

SEQ ID NO: 784502 - RNA, 22 nt, Human
cuacuucuaaguacauggugau

SEQ ID NO: 784503 - RNA, 22 nt, Human
ggucagagggugggcugccugu

SEQ ID NO: 784504 - RNA, 22 nt, Human
uggagucugugaugcucugggu

SEQ ID NO: 784505 - RNA, 22 nt, Human
ucucugaguauccugaacugcc

SEQ ID NO: 784506 - RNA, 19 nt, Human
gccaggagggcucuggcug

SEQ ID NO: 784507 - RNA, 22 nt, Human
gcccaggaaauaaaagugggcu

SEQ ID NO: 784508 - RNA, 22 nt, Human
uccaggaguggggcagaggucu

SEQ ID NO: 784509 - RNA, 22 nt, Human
ucucuucuaauuaggguccaug

SEQ ID NO: 784510 - RNA, 22 nt, Human
uuuuccagauuggacuuagucc

SEQ ID NO: 784511 - RNA, 23 nt, Human
aucauucuccaaucuggagcagg

SEQ ID NO: 784512 - RNA, 22 nt, Human
ccaggagagcaaaggucacucu

SEQ ID NO: 784513 - RNA, 22 nt, Human
gucagagagggcacgugcacac

SEQ ID NO: 784514 - RNA, 22 nt, Human
gcugcccacaaugauuacaugg

SEQ ID NO: 784515 - RNA, 22 nt, Human
ugguaauuuacgcauuucugua

SEQ ID NO: 784516 - RNA, 22 nt, Human
agagugcagauaagagaauguu

SEQ ID NO: 784517 - RNA, 21 nt, Human
cagcagaguaaugcauucgua

SEQ ID NO: 784518 - RNA, 22 nt, Human
ucauuuguucucauucucuacu

SEQ ID NO: 784519 - RNA, 22 nt, Human
caggcgagugaacagacucuca

SEQ ID NO: 784520 - RNA, 22 nt, Human
aggcagcccacaggacacagga

SEQ ID NO: 784521 - RNA, 23 nt, Human
auuugagaaaguauuuuuaagac

SEQ ID NO: 784522 - RNA, 22 nt, Human
acucaggaaaugagaggcucuc

SEQ ID NO: 784523 - RNA, 22 nt, Human
uucucagauauuuacugagcau

SEQ ID NO: 784524 - RNA, 22 nt, Human
ucaguagcagaaagcaaugagu

SEQ ID NO: 784525 - RNA, 20 nt, Human
ucauuguguugccaauuccc

SEQ ID NO: 784526 - RNA, 18 nt, Human
cugcccagagcauuucau

SEQ ID NO: 784527 - RNA, 22 nt, Human
aggcagugcucaagacagcagc

SEQ ID NO: 784528 - RNA, 22 nt, Human
gagugcagaugccagccccagu

SEQ ID NO: 784529 - RNA, 22 nt, Human
aggcaagcccccagugaggcuc

SEQ ID NO: 784530 - RNA, 22 nt, Human
gacagagaggcugagcaguaca

SEQ ID NO: 784531 - RNA, 22 nt, Human
auacauauaugguacuuccugg

SEQ ID NO: 784532 - RNA, 22 nt, Human
uugcaggaaacugagugugagc

SEQ ID NO: 784533 - RNA, 22 nt, Human
gagaggagguggcuaugacagc

SEQ ID NO: 784534 - RNA, 22 nt, Human
ccucacugaagaggugacauuu

SEQ ID NO: 784535 - RNA, 22 nt, Human
ugcaggaaauuccaggguggcc

SEQ ID NO: 784536 - RNA, 22 nt, Human
ugaggcagguaagcaaguuuug

SEQ ID NO: 784537 - RNA, 22 nt, Human
gcccaggaguucaaggcugcag

SEQ ID NO: 784538 - RNA, 22 nt, Human
acccaggagccgugagagguua

SEQ ID NO: 784539 - RNA, 22 nt, Human
accauguguuuuacacauggua

SEQ ID NO: 784540 - RNA, 22 nt, Human
cucccagagagcaggugggccg

SEQ ID NO: 784541 - RNA, 22 nt, Human
gagugcaggccugagcaccauc

SEQ ID NO: 784542 - RNA, 22 nt, Human
gcugggaagugcaagaucaagg

SEQ ID NO: 784543 - RNA, 22 nt, Human
aaaggugacacucugccagcug

SEQ ID NO: 784544 - RNA, 22 nt, Human
gagggagggaaaguuuaacacu

SEQ ID NO: 784545 - RNA, 22 nt, Human
guugaaagcuuuucauuuaguu

SEQ ID NO: 784546 - RNA, 22 nt, Human
uagggaggaggguuuucaaauc

SEQ ID NO: 784547 - RNA, 22 nt, Human
gucacuguuuccuauuauauuu

SEQ ID NO: 784548 - RNA, 20 nt, Human
uucaggauucuagaccacac

SEQ ID NO: 784549 - RNA, 22 nt, Human
aggaggggcauagaaauguaau

SEQ ID NO: 784550 - RNA, 22 nt, Human
agcugcccagcuaggaagaagg

SEQ ID NO: 784551 - RNA, 22 nt, Human
auuucagauucagaaauguagg

SEQ ID NO: 784552 - RNA, 22 nt, Human
acacaaauuguaggauaauugc

SEQ ID NO: 784553 - RNA, 22 nt, Human
cagcuagcuaagaaggccagag

SEQ ID NO: 784554 - RNA, 22 nt, Human
auuugcuuuaagguauaaaagg

SEQ ID NO: 784555 - RNA, 21 nt, Human
cuguggaagggaacuagaggg

SEQ ID NO: 784556 - RNA, 22 nt, Human
uuugaagucaggcuuucuaccc

SEQ ID NO: 784557 - RNA, 22 nt, Human
ccuggagaccagaggauacuuc

SEQ ID NO: 784558 - RNA, 20 nt, Human
aggcagcuggccaggcaggu

SEQ ID NO: 784559 - RNA, 22 nt, Human
uuugcaaagaaauuauugcugu

SEQ ID NO: 784560 - RNA, 22 nt, Human
ggacagaggguugacagaguau

SEQ ID NO: 784561 - RNA, 22 nt, Human
auuacaguaacagcuacaaugc

SEQ ID NO: 784562 - RNA, 22 nt, Human
cuggcagucugccucuucacug

SEQ ID NO: 784563 - RNA, 21 nt, Human
aaauacagaaacuuguuuuca

SEQ ID NO: 784564 - RNA, 22 nt, Human
cccaggaguuagagguuguggu

SEQ ID NO: 784565 - RNA, 22 nt, Human
gccugcagauauauaggauggu

SEQ ID NO: 784566 - RNA, 21 nt, Human
uguaaguuucaucugaauugg

SEQ ID NO: 784567 - RNA, 22 nt, Human
acagucuacuugagcuuguaua

SEQ ID NO: 784568 - RNA, 22 nt, Human
acccaggacucucuuccaguag

SEQ ID NO: 784569 - RNA, 22 nt, Human
uagggauguggugagaacugag

SEQ ID NO: 784570 - RNA, 22 nt, Human
agucccuguacuuuccacugcc

SEQ ID NO: 784571 - RNA, 21 nt, Human
ucacagacuggucagugaggc

SEQ ID NO: 784572 - RNA, 22 nt, Human
caggcagccuucucgucucaca

SEQ ID NO: 784573 - RNA, 22 nt, Human
uuuguuuagaaagagauuggug

SEQ ID NO: 784574 - RNA, 23 nt, Human
ucuugaaaagccuacagcaguuc

SEQ ID NO: 784575 - RNA, 18 nt, Human
ggcagggaaaagauaggg

SEQ ID NO: 784576 - RNA, 22 nt, Human
auguuuccagguucuuccuaug

SEQ ID NO: 784577 - RNA, 22 nt, Human
aggagaggcaucaagaaaaucg

SEQ ID NO: 784578 - RNA, 22 nt, Human
gaauacaugauacaugaacugc

SEQ ID NO: 784579 - RNA, 22 nt, Human
cauguuuacuaccaggagaaug

SEQ ID NO: 784580 - RNA, 22 nt, Human
uucaggaucaaguugccaguag

SEQ ID NO: 784581 - RNA, 22 nt, Human
agaggccaggcugcagagggau

SEQ ID NO: 784582 - RNA, 18 nt, Human
gaaaggagagacaguagg

SEQ ID NO: 784583 - RNA, 22 nt, Human
aucuucucaagcagcauccugu

SEQ ID NO: 784584 - RNA, 22 nt, Human
auucuuauuauaguaaaacagu

SEQ ID NO: 784585 - RNA, 22 nt, Human
gagggucccugcucagggccag

SEQ ID NO: 784586 - RNA, 22 nt, Human
gauggacagccuggaaggaaag

SEQ ID NO: 784587 - RNA, 22 nt, Human
gugauuuugagaccuauauagu

SEQ ID NO: 784588 - RNA, 22 nt, Human
acacaaguucuaaagauugcgc

SEQ ID NO: 784589 - RNA, 22 nt, Human
uauuucagcccuacuacuuggc

SEQ ID NO: 784590 - RNA, 22 nt, Human
ugcuguguggaugugaagaauc

SEQ ID NO: 784591 - RNA, 22 nt, Human
uucuucaugcuguugcugcuug

SEQ ID NO: 784592 - RNA, 22 nt, Human
caggagagauaugaguccccac

SEQ ID NO: 784593 - RNA, 22 nt, Human
gagcagcucugugccuggagac

SEQ ID NO: 784594 - RNA, 22 nt, Human
uuugcauaagucauguccagug

SEQ ID NO: 784595 - RNA, 22 nt, Human
auguauuucuauguagugaaga

SEQ ID NO: 784596 - RNA, 22 nt, Human
uucauguguauggaacauuuuu

SEQ ID NO: 784597 - RNA, 22 nt, Human
gcccaggaggucaaguagcuau

SEQ ID NO: 784598 - RNA, 22 nt, Human
aagaggaggacgguucccagaa

SEQ ID NO: 784599 - RNA, 22 nt, Human
aacaugauggggaagaacaaga

SEQ ID NO: 784600 - RNA, 22 nt, Human
uugcauuuaaguagauguuaca

SEQ ID NO: 784601 - RNA, 22 nt, Human
uccaggaggugaggggaccaaa

SEQ ID NO: 784602 - RNA, 22 nt, Human
augugucuuugagacucugcua

SEQ ID NO: 784603 - RNA, 22 nt, Human
uacuuuuuagcacagugugugc

SEQ ID NO: 784604 - RNA, 22 nt, Human
uugcugaauugaauccuuuggu

SEQ ID NO: 784605 - RNA, 22 nt, Human
caggcagcucaaccuugggagc

SEQ ID NO: 784606 - RNA, 22 nt, Human
ccacagagcauuagauuucaga

SEQ ID NO: 784607 - RNA, 19 nt, Human
aaagcagaggagcaucuga

SEQ ID NO: 784608 - RNA, 22 nt, Human
aggaagcuccaugaaggcagag

SEQ ID NO: 784609 - RNA, 17 nt, Human
gaggagcuccaguaggu

SEQ ID NO: 784610 - RNA, 22 nt, Human
ugaacucucucaagugacagaa

SEQ ID NO: 784611 - RNA, 22 nt, Human
uagcccagaagagggaagcaac

SEQ ID NO: 784612 - RNA, 22 nt, Human
aaucuucuacuugacaguucuc

SEQ ID NO: 784613 - RNA, 22 nt, Human
gccaggagagcuccuucagguu

SEQ ID NO: 784614 - RNA, 22 nt, Human
aguggcagagccaaguagagcc

SEQ ID NO: 784615 - RNA, 23 nt, Human
uaugaacugcauugcuggugugu

SEQ ID NO: 784616 - RNA, 22 nt, Human
ggguacuuaauauuuacggggu

SEQ ID NO: 784617 - RNA, 22 nt, Human
ggaggugggauuaggaccuaaa

SEQ ID NO: 784618 - RNA, 22 nt, Human
aggcagcccugugcuggaugcu

SEQ ID NO: 784619 - RNA, 22 nt, Human
gcugauguuuaguugauguuac

SEQ ID NO: 784620 - RNA, 22 nt, Human
cuguaaauaugaagaauauaug

SEQ ID NO: 784621 - RNA, 22 nt, Human
cucaggauggaagccuacagga

SEQ ID NO: 784622 - RNA, 22 nt, Human
uauuuuaaagugaagggucuug

SEQ ID NO: 784623 - RNA, 22 nt, Human
aucaggaucaugcuggguggga

SEQ ID NO: 784624 - RNA, 22 nt, Human
ccccaggaagccucagauuugc

SEQ ID NO: 784625 - RNA, 22 nt, Human
ucugucucaaguucuugcacuc

SEQ ID NO: 784626 - RNA, 22 nt, Human
aaggcagcaggauuuggugacu

SEQ ID NO: 784627 - RNA, 22 nt, Human
cccaggagagaggggauaaagc

SEQ ID NO: 784628 - RNA, 22 nt, Human
ugccuguguugauuacuuuguc

SEQ ID NO: 784629 - RNA, 22 nt, Human
ggcagaggagcuggaaacaugg

SEQ ID NO: 784630 - RNA, 21 nt, Human
gccaggaguagauuacauuua

SEQ ID NO: 784631 - RNA, 22 nt, Human
ugaggggauacgguacacauug

SEQ ID NO: 784632 - RNA, 22 nt, Human
gauauuuugagaaauccuauga

SEQ ID NO: 784633 - RNA, 22 nt, Human
uuucuucagagagagcuuuccc

SEQ ID NO: 784634 - RNA, 22 nt, Human
agcccaggugagggguucgaaa

SEQ ID NO: 784635 - RNA, 22 nt, Human
auuaaauuagcaaacugugaaa

SEQ ID NO: 784636 - RNA, 18 nt, Human
acucaggaaaugaugaca

SEQ ID NO: 784637 - RNA, 21 nt, Human
auuucagagcacacaaguaaa

SEQ ID NO: 784638 - RNA, 22 nt, Human
aaucuguucuacucuauucaga

SEQ ID NO: 784639 - RNA, 22 nt, Human
acaaauauuuacugaauccacu

SEQ ID NO: 784640 - RNA, 20 nt, Human
guaaaauauggucuuugggu

SEQ ID NO: 784641 - RNA, 22 nt, Human
ucccaggaaugucugaaaguga

SEQ ID NO: 784642 - RNA, 22 nt, Human
ucugcugugggucuauauuuua

SEQ ID NO: 784643 - RNA, 22 nt, Human
gggcagcugccaagugcaucgc

SEQ ID NO: 784644 - RNA, 20 nt, Human
cugcuguguuauuguagaac

SEQ ID NO: 784645 - RNA, 22 nt, Human
aaggcagcuucaccacagcauu

SEQ ID NO: 784646 - RNA, 22 nt, Human
uuccuuaguguuagauucugug

SEQ ID NO: 784647 - RNA, 22 nt, Human
ccagcagaggggcggagugcag

SEQ ID NO: 784648 - RNA, 22 nt, Human
caaauauuccagguacaucccu

SEQ ID NO: 784649 - RNA, 22 nt, Human
cuugaaagcuuugcgucuucua

SEQ ID NO: 784650 - RNA, 22 nt, Human
cucccaggacucagaggagaag

SEQ ID NO: 784651 - RNA, 22 nt, Human
gcucaggagcucuugguggcgc

SEQ ID NO: 784652 - RNA, 22 nt, Human
uuucagcugguaaaggaguagc

SEQ ID NO: 784653 - RNA, 23 nt, Human
cagaaaacccagagcucaguccc

SEQ ID NO: 784654 - RNA, 22 nt, Human
aauuuccagaccccauccacag

SEQ ID NO: 784655 - RNA, 22 nt, Human
ugaaggccagggauuugcagcc

SEQ ID NO: 784656 - RNA, 22 nt, Human
ggcagccuugagggaggccugg

SEQ ID NO: 784657 - RNA, 22 nt, Human
uucaggauucucucccauuuac

SEQ ID NO: 784658 - RNA, 22 nt, Human
cugcuguguugccagugucacc

SEQ ID NO: 784659 - RNA, 22 nt, Human
cagucucucagcuuucagcugu

SEQ ID NO: 784660 - RNA, 22 nt, Human
cucaggauauugggcuggagca

SEQ ID NO: 784661 - RNA, 22 nt, Human
gcgucugaguugcgggggcuca

SEQ ID NO: 784662 - RNA, 22 nt, Human
ggcucagacucccaggcccucu

SEQ ID NO: 784663 - RNA, 22 nt, Human
aggaagcuuagugaaaggacca

SEQ ID NO: 784664 - RNA, 22 nt, Human
gcagaagucagaccaucugaau

SEQ ID NO: 784665 - RNA, 22 nt, Human
cccaggaccgcgcggcugagcg

SEQ ID NO: 784666 - RNA, 22 nt, Human
auacaaagacaaaucucaaucu

SEQ ID NO: 784667 - RNA, 22 nt, Human
cuuaaagaaauugaggagagga

SEQ ID NO: 784668 - RNA, 22 nt, Human
ucaauucaacacaugcacauug

SEQ ID NO: 784669 - RNA, 22 nt, Human
caggcagcugaggacuuugcua

SEQ ID NO: 784670 - RNA, 22 nt, Human
agagggauggccccguaacuca

SEQ ID NO: 784671 - RNA, 22 nt, Human
ggagaggacauggcucccacag

SEQ ID NO: 784672 - RNA, 22 nt, Human
caucaucaaaagugacagagaa

SEQ ID NO: 784673 - RNA, 22 nt, Human
aggugagggugccagugcaugg

SEQ ID NO: 784674 - RNA, 22 nt, Human
aauaucaguauauuguaucagu

SEQ ID NO: 784675 - RNA, 22 nt, Human
ggcagcugcaaaucugcucugu

SEQ ID NO: 784676 - RNA, 22 nt, Human
uuagccaugcccuagaagagga

SEQ ID NO: 784677 - RNA, 22 nt, Human
acucagaaugacugaugcugug

SEQ ID NO: 784678 - RNA, 17 nt, Human
acacagggagagggagc

SEQ ID NO: 784679 - RNA, 21 nt, Human
ucucugugucuuuaagcugga

SEQ ID NO: 784680 - RNA, 22 nt, Human
ccaggagaugggagcaucuaaa

SEQ ID NO: 784681 - RNA, 22 nt, Human
aggcagcagugauaagauagga

SEQ ID NO: 784682 - RNA, 22 nt, Human
ccacugaggcaggcaguaucua

SEQ ID NO: 784683 - RNA, 22 nt, Human
cagagagggcggcccuggcuuc

SEQ ID NO: 784684 - RNA, 22 nt, Human
ggaggggaugguuugacccugg

SEQ ID NO: 784685 - RNA, 22 nt, Human
agaguucugcucuucucaguga

SEQ ID NO: 784686 - RNA, 22 nt, Human
uacuuuuagccuauuugauucu

SEQ ID NO: 784687 - RNA, 22 nt, Human
ucauuguuucugcuuuucauga

SEQ ID NO: 784688 - RNA, 22 nt, Human
uaggcagcagugcuaugauucu

SEQ ID NO: 784689 - RNA, 22 nt, Human
cauuuauucauuugcuagggcu

SEQ ID NO: 784690 - RNA, 22 nt, Human
gugcauuugugcaugcacaugu

SEQ ID NO: 784691 - RNA, 21 nt, Human
uaaggccaagucuauuucugu

SEQ ID NO: 784692 - RNA, 22 nt, Human
ugccuggaaggcccaugggaag

SEQ ID NO: 784693 - RNA, 22 nt, Human
guaucacuuuugagagugagaa

SEQ ID NO: 784694 - RNA, 22 nt, Human
uaacaucuuuagcagcucgaac

SEQ ID NO: 784695 - RNA, 22 nt, Human
cuaauacacccuauugcuuguu

SEQ ID NO: 784696 - RNA, 22 nt, Human
uuaagauagaacccaguagucu

SEQ ID NO: 784697 - RNA, 22 nt, Human
uucuuuugggaauuacguaugc

SEQ ID NO: 784698 - RNA, 21 nt, Human
auugaaagucaacaaucaguu

SEQ ID NO: 784699 - RNA, 22 nt, Human
uucaggauaugugauaucugaa

SEQ ID NO: 784700 - RNA, 22 nt, Human
aaugucugccagaacugaucau

SEQ ID NO: 784701 - RNA, 22 nt, Human
uucaauucuaaacuaauauucu

SEQ ID NO: 784702 - RNA, 22 nt, Human
ugaaacauuugaugaucuuugg

SEQ ID NO: 784703 - RNA, 22 nt, Human
gugcuuucugcugcauuccucu

SEQ ID NO: 784704 - RNA, 18 nt, Human
ugagaggcagguagagga

SEQ ID NO: 784705 - RNA, 22 nt, Human
ucagucucuggggcuucuguuu

SEQ ID NO: 784706 - RNA, 22 nt, Human
agcaccauugcaaauauggcag

SEQ ID NO: 784707 - RNA, 22 nt, Human
ggaugggagcagaggacgacca

SEQ ID NO: 784708 - RNA, 22 nt, Human
ggauggagguucucagaugcuc

SEQ ID NO: 784709 - RNA, 22 nt, Human
agaccaagaaaggaugaggauc

SEQ ID NO: 784710 - RNA, 22 nt, Human
uucauucugcaguucucagcuc

SEQ ID NO: 784711 - RNA, 18 nt, Human
ugugaacacauuuuucug

SEQ ID NO: 784712 - RNA, 22 nt, Human
aggggagguggcagaaaugugc

SEQ ID NO: 784713 - RNA, 22 nt, Human
uuacacaacaucuguauuauua

SEQ ID NO: 784714 - RNA, 22 nt, Human
uaauuauucuagucacauagca

SEQ ID NO: 784715 - RNA, 22 nt, Human
caggauggagggagggcuguua

SEQ ID NO: 784716 - RNA, 22 nt, Human
ccagagagauugcuucuaaaga

SEQ ID NO: 784717 - RNA, 22 nt, Human
aacauuuaugauugagguaaau

SEQ ID NO: 784718 - RNA, 22 nt, Human
agcugcccagauaggaggaggc

SEQ ID NO: 784719 - RNA, 22 nt, Human
uuaacaauagaguuucuucagg

SEQ ID NO: 784720 - RNA, 22 nt, Human
uuucuagucucgaucucuuaau

SEQ ID NO: 784721 - RNA, 22 nt, Human
cauaauaucuccgauuacuugc

SEQ ID NO: 784722 - RNA, 22 nt, Human
agugauggugagugagaagcuc

SEQ ID NO: 784723 - RNA, 22 nt, Human
ucuucacaggagccugccugcc

SEQ ID NO: 784724 - RNA, 22 nt, Human
uccagccuaggggaacagcugc

SEQ ID NO: 784725 - RNA, 22 nt, Human
gccaggaguguguggcuauguu

SEQ ID NO: 784726 - RNA, 22 nt, Human
cuugaaagcacuccuuugacug

SEQ ID NO: 784727 - RNA, 22 nt, Human
uguucauuuggcccuuuuguau

SEQ ID NO: 784728 - RNA, 22 nt, Human
auucaaguggcugcuauguuaa

SEQ ID NO: 784729 - RNA, 22 nt, Human
cucaucugauaaaucacucuua

SEQ ID NO: 784730 - RNA, 21 nt, Human
acagucuccccagaucucucc

SEQ ID NO: 784731 - RNA, 22 nt, Human
caggauggucuucauuuggcuc

SEQ ID NO: 784732 - RNA, 22 nt, Human
ugcugaaaacucaaccauugug

SEQ ID NO: 784733 - RNA, 22 nt, Human
uugggcucaggaguuugagacc

SEQ ID NO: 784734 - RNA, 22 nt, Human
aggccagcacgacagccgcagg

SEQ ID NO: 784735 - RNA, 22 nt, Human
cccaggagguggaguucacagu

SEQ ID NO: 784736 - RNA, 22 nt, Human
aguuugaaauguuggcaauauu

SEQ ID NO: 784737 - RNA, 22 nt, Human
uucagcaaacacgaugcuuguu

SEQ ID NO: 784738 - RNA, 22 nt, Human
caggcagccugcggucugcaca

SEQ ID NO: 784739 - RNA, 22 nt, Human
uuggcagugucugcaaaaugga

SEQ ID NO: 784740 - RNA, 22 nt, Human
ucuucaaguuccaaagugcagg

SEQ ID NO: 784741 - RNA, 20 nt, Human
ccagaagagaugaucaucca

SEQ ID NO: 784742 - RNA, 22 nt, Human
gaagcagcuuucuggugaggag

SEQ ID NO: 784743 - RNA, 22 nt, Human
auugaaagcacaaagaacaagu

SEQ ID NO: 784744 - RNA, 22 nt, Human
cucuuaguaaugccaugaagca

SEQ ID NO: 784745 - RNA, 22 nt, Human
cugcugugcaacauugcaccua

SEQ ID NO: 784746 - RNA, 22 nt, Human
ucaggagagaguuggguaggcu

SEQ ID NO: 784747 - RNA, 23 nt, Human
uugaaagguagcuggcagcuaga

SEQ ID NO: 784748 - RNA, 22 nt, Human
uuucaucuucccagagaccuug

SEQ ID NO: 784749 - RNA, 22 nt, Human
ucuggcuuucauuuguuuaaag

SEQ ID NO: 784750 - RNA, 22 nt, Human
cccaggagaugcacuccauugg

SEQ ID NO: 784751 - RNA, 20 nt, Human
aggcucagcugagcucuugg

SEQ ID NO: 784752 - RNA, 20 nt, Human
aagcacauuucuacaauaau

SEQ ID NO: 784753 - RNA, 22 nt, Human
uuuacaaccucauauucugaug

SEQ ID NO: 784754 - RNA, 22 nt, Human
gccaggagacuccauucauuug

SEQ ID NO: 784755 - RNA, 22 nt, Human
gcgcaggagccgcggagggccg

SEQ ID NO: 784756 - RNA, 21 nt, Human
uacugagaccucacagugugc

SEQ ID NO: 784757 - RNA, 21 nt, Human
uccuuccuugagguccuuucc

SEQ ID NO: 784758 - RNA, 22 nt, Human
gcccaggaguuugcauuuuaac

SEQ ID NO: 784759 - RNA, 22 nt, Human
auacaacuuuaucuguaaugag

SEQ ID NO: 784760 - RNA, 17 nt, Human
ugaaggccaugaccacg

SEQ ID NO: 784761 - RNA, 23 nt, Human
uucuuucaagaaguucacagugc

SEQ ID NO: 784762 - RNA, 22 nt, Human
gcuuggcauugaccauuaucau

SEQ ID NO: 784763 - RNA, 22 nt, Human
uacucagagucauugcccuucu

SEQ ID NO: 784764 - RNA, 22 nt, Human
uuccucagaaaauacuguccaa

SEQ ID NO: 784765 - RNA, 22 nt, Human
ggagccuggucagguuggcucc

SEQ ID NO: 784766 - RNA, 22 nt, Human
caggaaagggaugggcugccac

SEQ ID NO: 784767 - RNA, 17 nt, Human
gcccaggaaggacggcc

SEQ ID NO: 784768 - RNA, 21 nt, Human
aaugcauuaacauaaagcuga

SEQ ID NO: 784769 - RNA, 22 nt, Human
cugcuuugauuagaagaguaca

SEQ ID NO: 784770 - RNA, 22 nt, Human
cagaguucaaagccugcuggga

SEQ ID NO: 784771 - RNA, 22 nt, Human
aaggcagcaagaauuccagguu

SEQ ID NO: 784772 - RNA, 15 nt, Human
cccaggaguucgaga

SEQ ID NO: 784773 - RNA, 22 nt, Human
gaggagcuugugagaagauguc

SEQ ID NO: 784774 - RNA, 22 nt, Human
aauauaugugguauugaccagc

SEQ ID NO: 784775 - RNA, 21 nt, Human
ggcagccugacccccagagag

SEQ ID NO: 784776 - RNA, 22 nt, Human
uggcagcugccauguccacgug

SEQ ID NO: 784777 - RNA, 21 nt, Human
ugcugaugucagagaagcaag

SEQ ID NO: 784778 - RNA, 22 nt, Human
cauuuguaauacugacuugcag

SEQ ID NO: 784779 - RNA, 22 nt, Human
accaggaguagaauaucuguga

SEQ ID NO: 784780 - RNA, 22 nt, Human
aucugcagaggacaggcgagga

SEQ ID NO: 784781 - RNA, 22 nt, Human
cauuguuaauugguaucuuaca

SEQ ID NO: 784782 - RNA, 22 nt, Human
gagggagggacuagcauucucu

SEQ ID NO: 784783 - RNA, 22 nt, Human
acccaggagacagguugcagug

SEQ ID NO: 784784 - RNA, 22 nt, Human
agaaaacuugucacagcucuca

SEQ ID NO: 784785 - RNA, 22 nt, Human
ugaaggcccuaucuccauauac

SEQ ID NO: 784786 - RNA, 22 nt, Human
uuaaaaugaauauugauuagca

SEQ ID NO: 784787 - RNA, 22 nt, Human
gcucaggaaaacagucuaguaa

SEQ ID NO: 784788 - RNA, 22 nt, Human
augauguuaccaguacuuagag

SEQ ID NO: 784789 - RNA, 22 nt, Human
accaggaguugggggugggacc

SEQ ID NO: 784790 - RNA, 22 nt, Human
gagggaauggugugcaagaggu

SEQ ID NO: 784791 - RNA, 22 nt, Human
cuucuucaucuguaaaacuugg

SEQ ID NO: 784792 - RNA, 22 nt, Human
gcccaggaaaugccccguggug

SEQ ID NO: 784793 - RNA, 22 nt, Human
uaguuaaaauaauggagauguu

SEQ ID NO: 784794 - RNA, 23 nt, Human
acuuuauugaccccaggucaguu

SEQ ID NO: 784795 - RNA, 20 nt, Human
ucacuaguaaccaucugcuu

SEQ ID NO: 784796 - RNA, 22 nt, Human
uucaacuagauuuauacaauuc

SEQ ID NO: 784797 - RNA, 22 nt, Human
ggugaagguggaacgcagagca

SEQ ID NO: 784798 - RNA, 22 nt, Human
ucaugcuuauugcauauuugga

SEQ ID NO: 784799 - RNA, 22 nt, Human
agaggaggaagagcuuuaaaau

SEQ ID NO: 784800 - RNA, 22 nt, Human
auuaaaauuccaagguaugcca

SEQ ID NO: 784801 - RNA, 22 nt, Human
ugccaggauauaagagugcgau

SEQ ID NO: 784802 - RNA, 22 nt, Human
ggugaaggcacaagagggcaag

SEQ ID NO: 784803 - RNA, 22 nt, Human
uugauagguuuuauguauaguu

SEQ ID NO: 784804 - RNA, 22 nt, Human
uggcagcuugaaugcagucuuu

SEQ ID NO: 784805 - RNA, 22 nt, Human
gaugccucuuuuggcugaauua

SEQ ID NO: 784806 - RNA, 22 nt, Human
ucaguucugcuagaaaaacagu

SEQ ID NO: 784807 - RNA, 22 nt, Human
ugaggggaacugaugcccauug

SEQ ID NO: 784808 - RNA, 19 nt, Human
caaggccaccauuucuccg

SEQ ID NO: 784809 - RNA, 22 nt, Human
ccacuguuuuucaguuaacuuu

SEQ ID NO: 784810 - RNA, 22 nt, Human
uuugcagugauucuugcaguga

SEQ ID NO: 784811 - RNA, 20 nt, Human
caggaugauuggacacgaug

SEQ ID NO: 784812 - RNA, 22 nt, Human
gagagucuaggaaccucauaua

SEQ ID NO: 784813 - RNA, 22 nt, Human
aaauacuagaauucagaguuga

SEQ ID NO: 784814 - RNA, 22 nt, Human
uggagagguugaauaacuuguc

SEQ ID NO: 784815 - RNA, 22 nt, Human
aaaacuaaauacgcuuugccuc

SEQ ID NO: 784816 - RNA, 22 nt, Human
aggcagcuggacauaacuaacc

SEQ ID NO: 784817 - RNA, 20 nt, Human
aagagaggaaguuauacuag

SEQ ID NO: 784818 - RNA, 22 nt, Human
ucuccuccuuuuuucaacauag

SEQ ID NO: 784819 - RNA, 22 nt, Human
uagcacaucuucuuggccugca

SEQ ID NO: 784820 - RNA, 22 nt, Human
cccaggcagccugcagggaagg

SEQ ID NO: 784821 - RNA, 22 nt, Human
cacagcuaggaggaaagcagag

SEQ ID NO: 784822 - RNA, 22 nt, Human
cggagggguuugaacagaggag

SEQ ID NO: 784823 - RNA, 23 nt, Human
agacaguggccgagagguacuag

SEQ ID NO: 784824 - RNA, 22 nt, Human
cuuaagauuugcgauaccuaau

SEQ ID NO: 784825 - RNA, 22 nt, Human
accaggagaggcacuugcaaug

SEQ ID NO: 784826 - RNA, 22 nt, Human
gccaggaggggagaguguguca

SEQ ID NO: 784827 - RNA, 22 nt, Human
ugaaaugagauagauaaucagg

SEQ ID NO: 784828 - RNA, 17 nt, Human
ccaggagagaugcuugu

SEQ ID NO: 784829 - RNA, 22 nt, Human
ggcagcugucucugaguuagca

SEQ ID NO: 784830 - RNA, 22 nt, Human
agagugcaaccgaaacaagcag

SEQ ID NO: 784831 - RNA, 22 nt, Human
cuugcaggccuuucuagcucua

SEQ ID NO: 784832 - RNA, 22 nt, Human
gaggggaagacuucuggacagu

SEQ ID NO: 784833 - RNA, 22 nt, Human
uucaggauuauacucucuuccc

SEQ ID NO: 784834 - RNA, 22 nt, Human
cucuucucugcagccuuugaag

SEQ ID NO: 784835 - RNA, 22 nt, Human
gauggcaggcaggugaguagag

SEQ ID NO: 784836 - RNA, 23 nt, Human
cccuggaguaaauucuuggaagg

SEQ ID NO: 784837 - RNA, 22 nt, Human
cugcuguggguuaagacacugu

SEQ ID NO: 784838 - RNA, 22 nt, Human
uaaguggaagguuauaugcuaa

SEQ ID NO: 784839 - RNA, 22 nt, Human
uuccugagggacuuuugagauu

SEQ ID NO: 784840 - RNA, 22 nt, Human
agaggucagauuucuccuggug

SEQ ID NO: 784841 - RNA, 22 nt, Human
aacauauaaacucuuaaguuca

SEQ ID NO: 784842 - RNA, 17 nt, Human
gccaggagguuugagcu

SEQ ID NO: 784843 - RNA, 22 nt, Human
aggcagaugggagcuggaaguu

SEQ ID NO: 784844 - RNA, 20 nt, Human
gggcaguucaaugccacucu

SEQ ID NO: 784845 - RNA, 22 nt, Human
cccuguacagucucuguggcac

SEQ ID NO: 784846 - RNA, 22 nt, Human
aucaggauagucuguaaauugu

SEQ ID NO: 784847 - RNA, 22 nt, Human
acaaauguggacauggauaaug

SEQ ID NO: 784848 - RNA, 22 nt, Human
caaggccauaagagauacaaaa

SEQ ID NO: 784849 - RNA, 22 nt, Human
uagggaggcuacuucuuguagg

SEQ ID NO: 784850 - RNA, 22 nt, Human
cacucaggguacaauggagggc

SEQ ID NO: 784851 - RNA, 22 nt, Human
aaaggccaccaacaugaagcau

SEQ ID NO: 784852 - RNA, 22 nt, Human
gcugaaauucagauuccuaggc

SEQ ID NO: 784853 - RNA, 22 nt, Human
ucuucauuccguagauauuuau

SEQ ID NO: 784854 - RNA, 22 nt, Human
aguggacucuucccagugcuug

SEQ ID NO: 784855 - RNA, 22 nt, Human
uuagagucaaaauggcauguua

SEQ ID NO: 784856 - RNA, 22 nt, Human
ucugcagggaugugagggguga

SEQ ID NO: 784857 - RNA, 22 nt, Human
uggcagagugcagaagaggcau

SEQ ID NO: 784858 - RNA, 22 nt, Human
caaaugauagagccgauuauca

SEQ ID NO: 784859 - RNA, 19 nt, Human
gacagugcaguuguaguac

SEQ ID NO: 784860 - RNA, 22 nt, Human
uuucaaagaccauuaacuauca

SEQ ID NO: 784861 - RNA, 22 nt, Human
gaaggccacggaauggagcugg

SEQ ID NO: 784862 - RNA, 22 nt, Human
aagauaaacucuugauuucuga

SEQ ID NO: 784863 - RNA, 22 nt, Human
auaucacaguaguuguuuaguu

SEQ ID NO: 784864 - RNA, 22 nt, Human
gaggcagcaggcugaggaggau

SEQ ID NO: 784865 - RNA, 22 nt, Human
ucauuucucccggccaaaaacu

SEQ ID NO: 784866 - RNA, 22 nt, Human
gcagcugcaauaggcaucaagc

SEQ ID NO: 784867 - RNA, 22 nt, Human
uccaggagauacacugcaccag

SEQ ID NO: 784868 - RNA, 22 nt, Human
cuugcacacauguacaugugua

SEQ ID NO: 784869 - RNA, 22 nt, Human
aaggcagccauagcaccaucca

SEQ ID NO: 784870 - RNA, 22 nt, Human
cccaggaugucgaggcugcagu

SEQ ID NO: 784871 - RNA, 22 nt, Human
cauagagugauguaagguaugu

SEQ ID NO: 784872 - RNA, 22 nt, Human
uuucugcugugcuuucuugcgu

SEQ ID NO: 784873 - RNA, 17 nt, Human
uuugaaaggaugucagu

SEQ ID NO: 784874 - RNA, 22 nt, Human
uccaggaggccucauuuccugu

SEQ ID NO: 784875 - RNA, 20 nt, Human
agaggaggauuauuuuauuc

SEQ ID NO: 784876 - RNA, 22 nt, Human
ugcuguggcaguuuauguauag

SEQ ID NO: 784877 - RNA, 22 nt, Human
ucuuagcauuucauaacaacug

SEQ ID NO: 784878 - RNA, 22 nt, Human
uucuucaguguagcaacuguau

SEQ ID NO: 784879 - RNA, 19 nt, Human
uuacuuggcaaagucaguc

SEQ ID NO: 784880 - RNA, 20 nt, Human
cuucuucaguaguuuguucu

SEQ ID NO: 784881 - RNA, 22 nt, Human
uuagagucaagcugcauguucu

SEQ ID NO: 784882 - RNA, 22 nt, Human
gugacagucaaagacaugacuu

SEQ ID NO: 784883 - RNA, 23 nt, Human
aaacugcuuccaauuccugccau

SEQ ID NO: 784884 - RNA, 22 nt, Human
gaaggaggcguuagcccuagga

SEQ ID NO: 784885 - RNA, 20 nt, Human
ggcagcuugggcagcaguua

SEQ ID NO: 784886 - RNA, 22 nt, Human
cccaggaaaagcagugccagca

SEQ ID NO: 784887 - RNA, 22 nt, Human
cucaggaugcaauuccaucaag

SEQ ID NO: 784888 - RNA, 22 nt, Human
cagaccagcucuaugaacccaa

SEQ ID NO: 784889 - RNA, 22 nt, Human
aagauggaguaguguaaugguu

SEQ ID NO: 784890 - RNA, 22 nt, Human
uucaggaugaaagugugcaaca

SEQ ID NO: 784891 - RNA, 22 nt, Human
acuucuucuucagcugggggau

SEQ ID NO: 784892 - RNA, 22 nt, Human
guuaaauucgaugauggauaaa

SEQ ID NO: 784893 - RNA, 22 nt, Human
cucuucuugucucugguuagaa

SEQ ID NO: 784894 - RNA, 22 nt, Human
agucuuuccugcuugacuguuc

SEQ ID NO: 784895 - RNA, 22 nt, Human
ugaggcagccugcauuaaagag

SEQ ID NO: 784896 - RNA, 23 nt, Human
ccacagagcugccaauuccugug

SEQ ID NO: 784897 - RNA, 22 nt, Human
ccccggaggcggagguugcagu

SEQ ID NO: 784898 - RNA, 22 nt, Human
cccaggaggcgcagguugcggu

SEQ ID NO: 784899 - RNA, 22 nt, Human
uggcagcuauggucuaagggcc

SEQ ID NO: 784900 - RNA, 22 nt, Human
cagagccaggucuaggagucuc

SEQ ID NO: 784901 - RNA, 22 nt, Human
uuuuauagcugaauaguauucc

SEQ ID NO: 784902 - RNA, 22 nt, Human
cuugaaagauuuggccucugug

SEQ ID NO: 784903 - RNA, 22 nt, Human
aagggagguaaagcuauuuaaa

SEQ ID NO: 784904 - RNA, 22 nt, Human
uuuguuuacucauucauugaug

SEQ ID NO: 784905 - RNA, 22 nt, Human
cuguguuggcuuuucucuugua

SEQ ID NO: 784906 - RNA, 22 nt, Human
ggaggugguggcagugacaauu

SEQ ID NO: 784907 - RNA, 22 nt, Human
gcugaaugaauguauuuuaaaa

SEQ ID NO: 784908 - RNA, 22 nt, Human
agggagcuaggauccugaaggu

SEQ ID NO: 784909 - RNA, 22 nt, Human
ucugucccugagagcucaggag

SEQ ID NO: 784910 - RNA, 22 nt, Human
auugaaaguccuaucuaaggga

SEQ ID NO: 784911 - RNA, 22 nt, Human
aaaggccacugcaagggaaggu

SEQ ID NO: 784912 - RNA, 22 nt, Human
uggcagcuagcuguuuucaugc

SEQ ID NO: 784913 - RNA, 21 nt, Human
uucuucaaagaagaaggcaca

SEQ ID NO: 784914 - RNA, 22 nt, Human
caacagcugaucuuugaugaag

SEQ ID NO: 784915 - RNA, 22 nt, Human
uacccaggaggaaacugaggcu

SEQ ID NO: 784916 - RNA, 22 nt, Human
uucuucuuaauguccugggaac

SEQ ID NO: 784917 - RNA, 22 nt, Human
gugguaauuuaauccuacacug

SEQ ID NO: 784918 - RNA, 22 nt, Human
uccauuuuucaugacuccucaa

SEQ ID NO: 784919 - RNA, 22 nt, Human
aaaugauugucaaaguucuguu

SEQ ID NO: 784920 - RNA, 22 nt, Human
acucaggaauggggcugggacu

SEQ ID NO: 784921 - RNA, 22 nt, Human
gaaggccauuagagccugugcc

SEQ ID NO: 784922 - RNA, 22 nt, Human
uugcaauagccuuauuuccaaa

SEQ ID NO: 784923 - RNA, 22 nt, Human
cagcuggcgggcagagccgcca

SEQ ID NO: 784924 - RNA, 22 nt, Human
uggcaguccccugugccuggaa

SEQ ID NO: 784925 - RNA, 22 nt, Human
aaagcagacugauuugcaucac

SEQ ID NO: 784926 - RNA, 22 nt, Human
augcugugucaccuuaggauuu

SEQ ID NO: 784927 - RNA, 22 nt, Human
auuggcaguuagugacgaggcu

SEQ ID NO: 784928 - RNA, 23 nt, Human
gcagaggagcaagcuggacacca

SEQ ID NO: 784929 - RNA, 21 nt, Human
cccaggaggagcuccggcucc

SEQ ID NO: 784930 - RNA, 22 nt, Human
uucucuuuucaccaguugcuaa

SEQ ID NO: 784931 - RNA, 22 nt, Human
cagucucuaaaucaaucugaau

SEQ ID NO: 784932 - RNA, 22 nt, Human
gcucacugccauucucuagaug

SEQ ID NO: 784933 - RNA, 22 nt, Human
ugaugaauaaacuugagaguca

SEQ ID NO: 784934 - RNA, 22 nt, Human
agagcagcacguuguccccaca

SEQ ID NO: 784935 - RNA, 22 nt, Human
ggagggaaugucuagcauucuu

SEQ ID NO: 784936 - RNA, 22 nt, Human
augcuguguauuuuacucuuuc

SEQ ID NO: 784937 - RNA, 22 nt, Human
acuggcagcagcagcccuuggg

SEQ ID NO: 784938 - RNA, 19 nt, Human
agaaguuagacauugcaau

SEQ ID NO: 784939 - RNA, 22 nt, Human
aucauuacuccuguaaaauugu

SEQ ID NO: 784940 - RNA, 22 nt, Human
gggcagcuagcccucuagccca

SEQ ID NO: 784941 - RNA, 22 nt, Human
ucugcaggcuuggaguggcagc

SEQ ID NO: 784942 - RNA, 22 nt, Human
uuaaagggccgauuuccaggcc

SEQ ID NO: 784943 - RNA, 22 nt, Human
ucuacccagagcuaugaccuga

SEQ ID NO: 784944 - RNA, 22 nt, Human
gcccaggaguugaagggcugac

SEQ ID NO: 784945 - RNA, 22 nt, Human
uuccuuaguugacugucuuagu

SEQ ID NO: 784946 - RNA, 22 nt, Human
ucugcagguguuggaaggguca

SEQ ID NO: 784947 - RNA, 22 nt, Human
cugcgcagcaaucagagaggag

SEQ ID NO: 784948 - RNA, 22 nt, Human
augcugugcuggcuaaccaugg

SEQ ID NO: 784949 - RNA, 22 nt, Human
aucaggauguuuggcugucaua

SEQ ID NO: 784950 - RNA, 22 nt, Human
gagguggaaggcaggaacaaau

SEQ ID NO: 784951 - RNA, 22 nt, Human
uuuaaauucugucugccgcuua

SEQ ID NO: 784952 - RNA, 22 nt, Human
gaggcagagugcaccccaggag

SEQ ID NO: 784953 - RNA, 22 nt, Human
gaggcagcagaacauggaagag

SEQ ID NO: 784954 - RNA, 22 nt, Human
ucucuucuauuugagacuauuu

SEQ ID NO: 784955 - RNA, 22 nt, Human
uacccaggggcugagcagaggu

SEQ ID NO: 784956 - RNA, 22 nt, Human
gacggcagaaacucaugagguc

SEQ ID NO: 784957 - RNA, 15 nt, Human
uucaggauaugacuc

SEQ ID NO: 784958 - RNA, 22 nt, Human
cagcuuccgaccgggggcugca

SEQ ID NO: 784959 - RNA, 22 nt, Human
uccaggagaggccugaccaggu

SEQ ID NO: 784960 - RNA, 22 nt, Human
aaaugaugcucacagauuagug

SEQ ID NO: 784961 - RNA, 22 nt, Human
uuucuucaauugcuaacaagga

SEQ ID NO: 784962 - RNA, 22 nt, Human
acccaggaggcagagguugcag

SEQ ID NO: 784963 - RNA, 20 nt, Human
ucucuucuggggagauaaaa

SEQ ID NO: 784964 - RNA, 22 nt, Human
cuucagaggggacucaaaguca

SEQ ID NO: 784965 - RNA, 22 nt, Human
ugagccugguugcagugucugg

SEQ ID NO: 784966 - RNA, 22 nt, Human
gaaggaggugucaguuggacug

SEQ ID NO: 784967 - RNA, 22 nt, Human
uggcagcuuccugcucauagga

SEQ ID NO: 784968 - RNA, 22 nt, Human
uugcugaaaacaguggguauug

SEQ ID NO: 784969 - RNA, 22 nt, Human
ggagugucagaaacaguguccu

SEQ ID NO: 784970 - RNA, 22 nt, Human
aggcagcuuuguaguaaagcua

SEQ ID NO: 784971 - RNA, 22 nt, Human
agccagcucccuccccugcagg

SEQ ID NO: 784972 - RNA, 23 nt, Human
uuagagaugauuaaaaaaucuug

SEQ ID NO: 784973 - RNA, 22 nt, Human
aaauauaauuucugccucaaua

SEQ ID NO: 784974 - RNA, 22 nt, Human
agcgagggaggucugaggacag

SEQ ID NO: 784975 - RNA, 22 nt, Human
uucuucaaacaaaaguggcaug

SEQ ID NO: 784976 - RNA, 22 nt, Human
uucuucuccuaaggagaguccu

SEQ ID NO: 784977 - RNA, 22 nt, Human
caggcaggucagugaagaagga

SEQ ID NO: 784978 - RNA, 22 nt, Human
cucaggaugucggugacuauug

SEQ ID NO: 784979 - RNA, 23 nt, Human
uggcagcuguguaagagaaagca

SEQ ID NO: 784980 - RNA, 22 nt, Human
cugcuguguuagcagguuuagu

SEQ ID NO: 784981 - RNA, 22 nt, Human
cccaaggaagacgcuugugaua

SEQ ID NO: 784982 - RNA, 22 nt, Human
uucuccaacacaagcaugaugu

SEQ ID NO: 784983 - RNA, 22 nt, Human
gagcagcuccagccgcaugacu

SEQ ID NO: 784984 - RNA, 22 nt, Human
ggcagcuuccugagccagcagc

SEQ ID NO: 784985 - RNA, 22 nt, Human
agaggggagagcuaagcaauuc

SEQ ID NO: 784986 - RNA, 22 nt, Human
uccuucuuugacaaguggcaga

SEQ ID NO: 784987 - RNA, 22 nt, Human
augcugugguagacagcauucc

SEQ ID NO: 784988 - RNA, 22 nt, Human
agccuauuccaggaugagcuca

SEQ ID NO: 784989 - RNA, 22 nt, Human
ucagucucaucaacucuauucc

SEQ ID NO: 784990 - RNA, 22 nt, Human
uugaaaggugaacaugaugcac

SEQ ID NO: 784991 - RNA, 22 nt, Human
uacuaaauaguuuaauuccuca

SEQ ID NO: 784992 - RNA, 22 nt, Human
ccauuguaaauucuguggaagu

SEQ ID NO: 784993 - RNA, 20 nt, Human
ggcaggcuuuauauggaggg

SEQ ID NO: 784994 - RNA, 22 nt, Human
cagcugacuucauaggaagaca

SEQ ID NO: 784995 - RNA, 22 nt, Human
ugaggcagggaguuuaauuguc

SEQ ID NO: 784996 - RNA, 21 nt, Human
ccaggaaggacugagcucccu

SEQ ID NO: 784997 - RNA, 22 nt, Human
agggauggaagacuugaagacc

SEQ ID NO: 784998 - RNA, 22 nt, Human
cccaggaggcagagguuggagc

SEQ ID NO: 784999 - RNA, 22 nt, Human
guggcagcggugugcaaggagg

SEQ ID NO: 785000 - RNA, 19 nt, Human
agggaguuuauauuugcac

SEQ ID NO: 785001 - RNA, 22 nt, Human
aggcagcuuucuggugcaccau

SEQ ID NO: 785002 - RNA, 22 nt, Human
ccaggagauaagcugaguuuau

SEQ ID NO: 785003 - RNA, 23 nt, Human
ucucaagaggaagcagggcucau

SEQ ID NO: 785004 - RNA, 22 nt, Human
caauacuuccuuguuagaggca

SEQ ID NO: 785005 - RNA, 22 nt, Human
aguuugaauugaaaugcagaug

SEQ ID NO: 785006 - RNA, 22 nt, Human
gcucaggacccaggugugaccu

SEQ ID NO: 785007 - RNA, 22 nt, Human
gaggcaguguugaaaaggagag

SEQ ID NO: 785008 - RNA, 22 nt, Human
agacucaagcagauaggaauua

SEQ ID NO: 785009 - RNA, 23 nt, Human
aggcccaacucugugagggcugc

SEQ ID NO: 785010 - RNA, 22 nt, Human
guuuuaguggguggccacugau

SEQ ID NO: 785011 - RNA, 22 nt, Human
agacgagggcccccaggacagc

SEQ ID NO: 785012 - RNA, 19 nt, Human
aauacaguguuauagaauu

SEQ ID NO: 785013 - RNA, 23 nt, Human
cagcccuuccugcauguuuuugu

SEQ ID NO: 785014 - RNA, 22 nt, Human
gucaggauguuuauucuccagu

SEQ ID NO: 785015 - RNA, 22 nt, Human
auuuaaauuuucugauggagag

SEQ ID NO: 785016 - RNA, 22 nt, Human
aaggcagccucugccagccggg

SEQ ID NO: 785017 - RNA, 22 nt, Human
aaagcagagcagggcacuuaug

SEQ ID NO: 785018 - RNA, 22 nt, Human
auucauuugcuauuguguaugg

SEQ ID NO: 785019 - RNA, 22 nt, Human
ugagagggcccagagcacacca

SEQ ID NO: 785020 - RNA, 19 nt, Human
uccaggaggcugccauuga

SEQ ID NO: 785021 - RNA, 22 nt, Human
agcccagggaaccaggaagugg

SEQ ID NO: 785022 - RNA, 22 nt, Human
aaaaacuguaauuacuuuugca

SEQ ID NO: 785023 - RNA, 19 nt, Human
ucccaggaaccuuuuauuu

SEQ ID NO: 785024 - RNA, 22 nt, Human
agaaaugaauauguagugguua

SEQ ID NO: 785025 - RNA, 22 nt, Human
uggcagcugaauggcuggaugg

SEQ ID NO: 785026 - RNA, 22 nt, Human
ucuuaaagagcgcaauuugagg

SEQ ID NO: 785027 - RNA, 22 nt, Human
cauuuuaagaugaccugguuuc

SEQ ID NO: 785028 - RNA, 22 nt, Human
agggaagcuuguuacugagaag

SEQ ID NO: 785029 - RNA, 22 nt, Human
uucuucucggcugucagauagu

SEQ ID NO: 785030 - RNA, 16 nt, Human
ucccaggaggcggaac

SEQ ID NO: 785031 - RNA, 22 nt, Human
ucaccgccuugcccggccgggc

SEQ ID NO: 785032 - RNA, 22 nt, Human
ccaugagcuucaacugacacag

SEQ ID NO: 785033 - RNA, 22 nt, Human
gcucccaggcauggagguaauu

SEQ ID NO: 785034 - RNA, 21 nt, Human
ucaggagagcccaucuacaaa

SEQ ID NO: 785035 - RNA, 22 nt, Human
cugcaucacagcaggaggcaca

SEQ ID NO: 785036 - RNA, 22 nt, Human
auugcuguacacuucuagaucu

SEQ ID NO: 785037 - RNA, 22 nt, Human
uauuucagggagaauaaauuug

SEQ ID NO: 785038 - RNA, 22 nt, Human
uucauugucucuguuugccuuc

SEQ ID NO: 785039 - RNA, 22 nt, Human
ucuuagaaauuccccaguggcu

SEQ ID NO: 785040 - RNA, 22 nt, Human
gggacuucauagcuaggcacuu

SEQ ID NO: 785041 - RNA, 22 nt, Human
ggccagagaauaugccuuacgu

SEQ ID NO: 785042 - RNA, 22 nt, Human
cuguauuucccacauucucuau

SEQ ID NO: 785043 - RNA, 22 nt, Human
agacagcugggaaauggagugu

SEQ ID NO: 785044 - RNA, 22 nt, Human
ugcugaugaguccuucuaucgc

SEQ ID NO: 785045 - RNA, 22 nt, Human
ugccuugcacauaauauacauu

SEQ ID NO: 785046 - RNA, 22 nt, Human
cauugcuuccuaugucccuucu

SEQ ID NO: 785047 - RNA, 22 nt, Human
uccauucauucauugaugaaca

SEQ ID NO: 785048 - RNA, 22 nt, Human
ucaagugcuugugagguauuug

SEQ ID NO: 785049 - RNA, 22 nt, Human
gugcauuuaggucacaugaugu

SEQ ID NO: 785050 - RNA, 22 nt, Human
aggcagauuacuugaggccagg

SEQ ID NO: 785051 - RNA, 22 nt, Human
ggcagcuaggggcagggaauuc

SEQ ID NO: 785052 - RNA, 21 nt, Human
cgcagagcgaacuugcggcgc

SEQ ID NO: 785053 - RNA, 22 nt, Human
ucauuuguugcuguuaccugag

SEQ ID NO: 785054 - RNA, 22 nt, Human
acccaggagacggaggugcagu

SEQ ID NO: 785055 - RNA, 21 nt, Human
uuucuucacuuugccccaugu

SEQ ID NO: 785056 - RNA, 22 nt, Human
ccugcugugaagccaggccugu

SEQ ID NO: 785057 - RNA, 20 nt, Human
uauuuguauuugggaaaguu

SEQ ID NO: 785058 - RNA, 22 nt, Human
ugugaaggagaugaagggagug

SEQ ID NO: 785059 - RNA, 22 nt, Human
gaggacagagccgccuggcaag

SEQ ID NO: 785060 - RNA, 22 nt, Human
aggcugcuucaauggauaagau

SEQ ID NO: 785061 - RNA, 23 nt, Human
uggagcugacagucagagggagg

SEQ ID NO: 785062 - RNA, 22 nt, Human
cgccucagccguggucaucuuc

SEQ ID NO: 785063 - RNA, 22 nt, Human
gcagggaagaucuuggagcugc

SEQ ID NO: 785064 - RNA, 22 nt, Human
uuugaaauaugaggcauuauga

SEQ ID NO: 785065 - RNA, 22 nt, Human
gcagcugccccgacugugaguc

SEQ ID NO: 785066 - RNA, 22 nt, Human
uuugaaagaauuuauguacuuu

SEQ ID NO: 785067 - RNA, 22 nt, Human
cagagcucuauguucauggagg

SEQ ID NO: 785068 - RNA, 22 nt, Human
uucucacuauguauguagauug

SEQ ID NO: 785069 - RNA, 22 nt, Human
gguggaaggccuggaaggaggc

SEQ ID NO: 785070 - RNA, 22 nt, Human
caucaucaaaacaaauggaguc

SEQ ID NO: 785071 - RNA, 22 nt, Human
uuucaguuacugcuauaucauu

SEQ ID NO: 785072 - RNA, 22 nt, Human
cugcugucauagccaucccucc

SEQ ID NO: 785073 - RNA, 22 nt, Human
aagagagggguugcauggaaau

SEQ ID NO: 785074 - RNA, 22 nt, Human
uugaaaguccuucuugaguuac

SEQ ID NO: 785075 - RNA, 22 nt, Human
aauacaguaauuuugaugaguu

SEQ ID NO: 785076 - RNA, 22 nt, Human
agaaaauauucauugagaggcu

SEQ ID NO: 785077 - RNA, 22 nt, Human
cagggaggaugggcuguuuugc

SEQ ID NO: 785078 - RNA, 22 nt, Human
gucuucaacaauaacuaccacu

SEQ ID NO: 785079 - RNA, 22 nt, Human
guugaaaguagaugcuauuugg

SEQ ID NO: 785080 - RNA, 22 nt, Human
ucacaaauagcuauauuaagga

SEQ ID NO: 785081 - RNA, 22 nt, Human
cuagccugggauuugaacuuau

SEQ ID NO: 785082 - RNA, 22 nt, Human
agcuggcagucauccuagugag

SEQ ID NO: 785083 - RNA, 22 nt, Human
ugccuugcgggcguuucuguug

SEQ ID NO: 785084 - RNA, 22 nt, Human
cagaggaguucaguacacagcc

SEQ ID NO: 785085 - RNA, 20 nt, Human
acaggagaucugaggaaagg

SEQ ID NO: 785086 - RNA, 22 nt, Human
uucuucuugaaacuuuagguug

SEQ ID NO: 785087 - RNA, 22 nt, Human
gaucuucuagcagaaguaauuu

SEQ ID NO: 785088 - RNA, 22 nt, Human
agagagcauugaggaaaucuuc

SEQ ID NO: 785089 - RNA, 22 nt, Human
caaggccaagguuuugugaacu

SEQ ID NO: 785090 - RNA, 22 nt, Human
agaccaugggcucugaagagca

SEQ ID NO: 785091 - RNA, 22 nt, Human
ugcccaggaucuggcgaugcuc

SEQ ID NO: 785092 - RNA, 22 nt, Human
caggauggagaguuguugguug

SEQ ID NO: 785093 - RNA, 22 nt, Human
uuugaaagaaaccagugaguga

SEQ ID NO: 785094 - RNA, 22 nt, Human
cauuuucagcacccaucugaaa

SEQ ID NO: 785095 - RNA, 22 nt, Human
gccaggaguucagaugcauguu

SEQ ID NO: 785096 - RNA, 22 nt, Human
ugaaagguagcuggccucauag

SEQ ID NO: 785097 - RNA, 22 nt, Human
gagggaggugauacugaacgua

SEQ ID NO: 785098 - RNA, 22 nt, Human
uucauucuugucuuuguauagu

SEQ ID NO: 785099 - RNA, 22 nt, Human
cuagggaguggcagagcuggga

SEQ ID NO: 785100 - RNA, 19 nt, Human
cuuugucagaacaugcuuc

SEQ ID NO: 785101 - RNA, 22 nt, Human
uaaggccaauuaacaaccaggg

SEQ ID NO: 785102 - RNA, 22 nt, Human
aguucuucauaaccuuacugug

SEQ ID NO: 785103 - RNA, 22 nt, Human
uucuacagacuauaacugugau

SEQ ID NO: 785104 - RNA, 22 nt, Human
uuuuuauaugaaggauagugcg

SEQ ID NO: 785105 - RNA, 22 nt, Human
guguguuucagaagccaggugu

SEQ ID NO: 785106 - RNA, 19 nt, Human
uggcaggcccaggauggac

SEQ ID NO: 785107 - RNA, 22 nt, Human
aggcggcuccgggagugugggc

SEQ ID NO: 785108 - RNA, 22 nt, Human
agcugcccuuaauaggcauuca

SEQ ID NO: 785109 - RNA, 22 nt, Human
ggcagcuggggcagugcccugu

SEQ ID NO: 785110 - RNA, 22 nt, Human
ucacacagguuugcaaugauuu

SEQ ID NO: 785111 - RNA, 22 nt, Human
ccaggagauuuuuccauagcac

SEQ ID NO: 785112 - RNA, 22 nt, Human
ggcagcucugcuccacaugagu

SEQ ID NO: 785113 - RNA, 22 nt, Human
cucccaggcacagggaggagcc

SEQ ID NO: 785114 - RNA, 22 nt, Human
ggaguaggaguagaacucauca

SEQ ID NO: 785115 - RNA, 21 nt, Human
uucugggaaaugagcuggggc

SEQ ID NO: 785116 - RNA, 22 nt, Human
auguggaggaaaugaguguaca

SEQ ID NO: 785117 - RNA, 22 nt, Human
uuaucacuuaugagcuuuuugc

SEQ ID NO: 785118 - RNA, 22 nt, Human
agucucugccagcuuguccucu

SEQ ID NO: 785119 - RNA, 22 nt, Human
uucaggaugcagagguuguagu

SEQ ID NO: 785120 - RNA, 22 nt, Human
uauuucagguauggugugaaau

SEQ ID NO: 785121 - RNA, 22 nt, Human
cccaggaggucgaagcugcagu

SEQ ID NO: 785122 - RNA, 22 nt, Human
cccagaaggucgaggcugcagu

SEQ ID NO: 785123 - RNA, 22 nt, Human
uccaugucuucaugugucuaac

SEQ ID NO: 785124 - RNA, 20 nt, Human
aggaggcauagucuggaaag

SEQ ID NO: 785125 - RNA, 22 nt, Human
aggaagcuggugugaggaugaa

SEQ ID NO: 785126 - RNA, 20 nt, Human
agagcagcaguuggugaggu

SEQ ID NO: 785127 - RNA, 22 nt, Human
ucuuagaaugucaacugauguu

SEQ ID NO: 785128 - RNA, 22 nt, Human
uggcagcuguuaauguuuuguu

SEQ ID NO: 785129 - RNA, 22 nt, Human
uucuccagaccuugugacuaug

SEQ ID NO: 785130 - RNA, 22 nt, Human
auuaaauuggaucugcauaguu

SEQ ID NO: 785131 - RNA, 22 nt, Human
uggcuucuugggaugggucauu

SEQ ID NO: 785132 - RNA, 22 nt, Human
caggauggucucgaucuccuga

SEQ ID NO: 785133 - RNA, 22 nt, Human
uaagaacuucggacauguuauc

SEQ ID NO: 785134 - RNA, 22 nt, Human
aauuuccaaauuucugucacac

SEQ ID NO: 785135 - RNA, 22 nt, Human
aagggaggaggauuuauuguac

SEQ ID NO: 785136 - RNA, 22 nt, Human
acauaccauacauggugagaug

SEQ ID NO: 785137 - RNA, 22 nt, Human
ugaggcagcuuuuucugugugu

SEQ ID NO: 785138 - RNA, 22 nt, Human
agaggcagccguauuucaaagg

SEQ ID NO: 785139 - RNA, 22 nt, Human
uucucugaucuugcuagacuga

SEQ ID NO: 785140 - RNA, 20 nt, Human
gucaggauuaguaaacucug

SEQ ID NO: 785141 - RNA, 22 nt, Human
ucuucucuacaccagcagcccc

SEQ ID NO: 785142 - RNA, 22 nt, Human
ucuuugaauuucugacugucuu

SEQ ID NO: 785143 - RNA, 22 nt, Human
uguuuuaaagccauugccuuuc

SEQ ID NO: 785144 - RNA, 22 nt, Human
ggccaggagcugcacagggcuc

SEQ ID NO: 785145 - RNA, 22 nt, Human
agaggcaggaagagcugauuuu

SEQ ID NO: 785146 - RNA, 22 nt, Human
ucccaggaugaagacaguguug

SEQ ID NO: 785147 - RNA, 22 nt, Human
uaguuuuacuugcgaugauaau

SEQ ID NO: 785148 - RNA, 22 nt, Human
uuugaaaguccuaggagagucc

SEQ ID NO: 785149 - RNA, 22 nt, Human
gcccaggaugguguguaguggu

SEQ ID NO: 785150 - RNA, 22 nt, Human
uguugagacugagggagucagc

SEQ ID NO: 785151 - RNA, 21 nt, Human
agagagggagaugaaacaucc

SEQ ID NO: 785152 - RNA, 22 nt, Human
gccaucacauccaggcuaccuc

SEQ ID NO: 785153 - RNA, 23 nt, Human
ugcaugugaauucauacuuguuu

SEQ ID NO: 785154 - RNA, 22 nt, Human
aggccagcgcugcuagcucccg

SEQ ID NO: 785155 - RNA, 22 nt, Human
cuagccaugggcauuaaaggua

SEQ ID NO: 785156 - RNA, 22 nt, Human
cugacagucucauugauuugcu

SEQ ID NO: 785157 - RNA, 22 nt, Human
gauuuuaauuauaggagguccu

SEQ ID NO: 785158 - RNA, 22 nt, Human
aucacauuguuagcauagacug

SEQ ID NO: 785159 - RNA, 22 nt, Human
agagggaucacccuguuucugg

SEQ ID NO: 785160 - RNA, 22 nt, Human
cccaggugcugcgugaagccuc

SEQ ID NO: 785161 - RNA, 22 nt, Human
cacaugaguccugccagguaug

SEQ ID NO: 785162 - RNA, 17 nt, Human
gucauucucagaaaaug

SEQ ID NO: 785163 - RNA, 22 nt, Human
uaaaauagcaugugcagugaaa

SEQ ID NO: 785164 - RNA, 22 nt, Human
ccaggaugacccccacuuuccu

SEQ ID NO: 785165 - RNA, 22 nt, Human
aguuugaaaguauugacagaag

SEQ ID NO: 785166 - RNA, 22 nt, Human
cucacugugaccucagcagaca

SEQ ID NO: 785167 - RNA, 22 nt, Human
caagaugggcaccccagcaccu

SEQ ID NO: 785168 - RNA, 22 nt, Human
uucaacuauuaugaauaaaauu

SEQ ID NO: 785169 - RNA, 22 nt, Human
ucagagaguuagugucuuagcu

SEQ ID NO: 785170 - RNA, 22 nt, Human
aauuuccagaucagaugacuca

SEQ ID NO: 785171 - RNA, 22 nt, Human
uccaggagucagacagauggug

SEQ ID NO: 785172 - RNA, 22 nt, Human
accaggagcauuuuuuauuagu

SEQ ID NO: 785173 - RNA, 22 nt, Human
gaggagagaagcuaacggugcu

SEQ ID NO: 785174 - RNA, 22 nt, Human
ccaggaguggcuggugaccuuc

SEQ ID NO: 785175 - RNA, 22 nt, Human
uucuucucucauagauuaaggu

SEQ ID NO: 785176 - RNA, 22 nt, Human
aacugcuguggccuaguacuua

SEQ ID NO: 785177 - RNA, 22 nt, Human
uaaggccaaguucauauacaac

SEQ ID NO: 785178 - RNA, 22 nt, Human
auuaucuauguagaaugauuuu

SEQ ID NO: 785179 - RNA, 22 nt, Human
ucagucuuugcuuaugacaaua

SEQ ID NO: 785180 - RNA, 22 nt, Human
ugcuugugagaguuuuuucaga

SEQ ID NO: 785181 - RNA, 22 nt, Human
ucaguucuuuauuucacaguga

SEQ ID NO: 785182 - RNA, 22 nt, Human
cauucucaauaguagaugagua

SEQ ID NO: 785183 - RNA, 19 nt, Human
aaggcagcaguagcaucca

SEQ ID NO: 785184 - RNA, 22 nt, Human
augaggcaguacacacaaagcc

SEQ ID NO: 785185 - RNA, 22 nt, Human
ggcagcauauauucagugggca

SEQ ID NO: 785186 - RNA, 22 nt, Human
agcugcccugguaagauugaug

SEQ ID NO: 785187 - RNA, 22 nt, Human
ccacaucucgguccccucuuug

SEQ ID NO: 785188 - RNA, 20 nt, Human
agcauuugaaauaugacuau

SEQ ID NO: 785189 - RNA, 22 nt, Human
aaauaguucagcuuguaaaccc

SEQ ID NO: 785190 - RNA, 22 nt, Human
aggcagcugaggucuggcgccc

SEQ ID NO: 785191 - RNA, 20 nt, Human
uuuacauuuugaaacaguga

SEQ ID NO: 785192 - RNA, 22 nt, Human
uugaaauaucaaguuauuagug

SEQ ID NO: 785193 - RNA, 22 nt, Human
caggggaguuuuaugcaacaga

SEQ ID NO: 785194 - RNA, 22 nt, Human
aggcaggcucaggcccaugcuu

SEQ ID NO: 785195 - RNA, 21 nt, Human
uucucagaucgaguagugaga

SEQ ID NO: 785196 - RNA, 22 nt, Human
ggaggcagaauagagugugggu

SEQ ID NO: 785197 - RNA, 22 nt, Human
cuggaaauuggagaugauguuu

SEQ ID NO: 785198 - RNA, 20 nt, Human
ggggcugcaugcagagaaga

SEQ ID NO: 785199 - RNA, 22 nt, Human
uacccagggcuuuucugaugca

SEQ ID NO: 785200 - RNA, 22 nt, Human
agagggcagggcgguaaguccu

SEQ ID NO: 785201 - RNA, 22 nt, Human
cccaggagagagacuugaaucu

SEQ ID NO: 785202 - RNA, 22 nt, Human
agucugucuacuuaaagucugu

SEQ ID NO: 785203 - RNA, 23 nt, Human
uccaugagaugugggcuucuagu

SEQ ID NO: 785204 - RNA, 22 nt, Human
ugagggagagggcgaaaaugaa

SEQ ID NO: 785205 - RNA, 22 nt, Human
cagcuucugucugauuagcaag

SEQ ID NO: 785206 - RNA, 20 nt, Human
cuucuucauuaacccuacug

SEQ ID NO: 785207 - RNA, 22 nt, Human
ugugccagccucuggcuguguc

SEQ ID NO: 785208 - RNA, 21 nt, Human
uuucuuaggcucuaaaaugac

SEQ ID NO: 785209 - RNA, 22 nt, Human
uuuuucaagacaaccugcaugu

SEQ ID NO: 785210 - RNA, 22 nt, Human
cagcugacgccagaguggaauu

SEQ ID NO: 785211 - RNA, 22 nt, Human
cugaaugaggaaaagagugagg

SEQ ID NO: 785212 - RNA, 22 nt, Human
cccaggagaccuagaucuguuu

SEQ ID NO: 785213 - RNA, 22 nt, Human
gcccaggauggagaauaguggu

SEQ ID NO: 785214 - RNA, 22 nt, Human
cagaggcacaagaaagcaaggc

SEQ ID NO: 785215 - RNA, 22 nt, Human
gggacgggcaguccaagggguc

SEQ ID NO: 785216 - RNA, 22 nt, Human
aagcaauauacugauaugauua

SEQ ID NO: 785217 - RNA, 17 nt, Human
ccuguguuugcuccuuc

SEQ ID NO: 785218 - RNA, 22 nt, Human
cuuuggcaaggguuuuaauugu

SEQ ID NO: 785219 - RNA, 22 nt, Human
ggcugaaggaugaaagcugcag

SEQ ID NO: 785220 - RNA, 22 nt, Human
agcuagccuaggcagagugcau

SEQ ID NO: 785221 - RNA, 22 nt, Human
uaugaacuuuugaugugacaug

SEQ ID NO: 785222 - RNA, 22 nt, Human
uccaugagcuagggauucauca

SEQ ID NO: 785223 - RNA, 21 nt, Human
gagugcagcaagguagagucu

SEQ ID NO: 785224 - RNA, 22 nt, Human
ggauggcaggacaaggacccag

SEQ ID NO: 785225 - RNA, 22 nt, Human
uuucacaaaugucuuuaacuug

SEQ ID NO: 785226 - RNA, 22 nt, Human
gucuucaauagagccucaauuu

SEQ ID NO: 785227 - RNA, 18 nt, Human
ugaauagggguuugcaga

SEQ ID NO: 785228 - RNA, 22 nt, Human
uccaggagugcugguuagagua

SEQ ID NO: 785229 - RNA, 22 nt, Human
gugcagcugugguggagccagg

SEQ ID NO: 785230 - RNA, 22 nt, Human
uaaaugagggcugacaugauug

SEQ ID NO: 785231 - RNA, 23 nt, Human
acagaaaucauuuguaagguacc

SEQ ID NO: 785232 - RNA, 22 nt, Human
cagagggcacaugguuuccuca

SEQ ID NO: 785233 - RNA, 22 nt, Human
gucuccugagacugcagucacc

SEQ ID NO: 785234 - RNA, 22 nt, Human
aggcagucuaucucuggagccu

SEQ ID NO: 785235 - RNA, 22 nt, Human
cuguggaaauaaacaaugcuaa

SEQ ID NO: 785236 - RNA, 22 nt, Human
uuugcauaaaggagcauuucuc

SEQ ID NO: 785237 - RNA, 22 nt, Human
ccuuaaauucuccauuugaaag

SEQ ID NO: 785238 - RNA, 18 nt, Human
gagaggagccagaauuuu

SEQ ID NO: 785239 - RNA, 22 nt, Human
agagcagcugugacauggacag

SEQ ID NO: 785240 - RNA, 22 nt, Human
uuaaauauuauguugucugcaa

SEQ ID NO: 785241 - RNA, 22 nt, Human
cauuucacaaauggccacauca

SEQ ID NO: 785242 - RNA, 23 nt, Human
gugcugugagccccuuggccucc

SEQ ID NO: 785243 - RNA, 22 nt, Human
aagccgaggccacacagcagga

SEQ ID NO: 785244 - RNA, 22 nt, Human
gaggagagaugguagauugggu

SEQ ID NO: 785245 - RNA, 22 nt, Human
ggugaagggugucauggcauuu

SEQ ID NO: 785246 - RNA, 22 nt, Human
cagaggcaaaagagguggaggu

SEQ ID NO: 785247 - RNA, 22 nt, Human
ucuuugaauucaaacuguucaa

SEQ ID NO: 785248 - RNA, 22 nt, Human
aucauuucccuuuagaucacaa

SEQ ID NO: 785249 - RNA, 20 nt, Human
uccaugaguuagagacuaua

SEQ ID NO: 785250 - RNA, 22 nt, Human
ucacaaaugaggaaaucgagca

SEQ ID NO: 785251 - RNA, 22 nt, Human
cuucagaaugggacuguguuug

SEQ ID NO: 785252 - RNA, 20 nt, Human
ucagugauuuugaagaggaa

SEQ ID NO: 785253 - RNA, 22 nt, Human
ggagguggcagggaacauaauu

SEQ ID NO: 785254 - RNA, 22 nt, Human
ggguggagaggcuaaguccagu

SEQ ID NO: 785255 - RNA, 22 nt, Human
agaggcaggagguugacuugag

SEQ ID NO: 785256 - RNA, 22 nt, Human
uuuaacagaugcuaugucuacc

SEQ ID NO: 785257 - RNA, 22 nt, Human
ucuucagauaaagggagaguau

SEQ ID NO: 785258 - RNA, 22 nt, Human
cagagaaaaaauccugcucuca

SEQ ID NO: 785259 - RNA, 22 nt, Human
cggaggggauacauuuucugaa

SEQ ID NO: 785260 - RNA, 22 nt, Human
aagugggaauagaaaugaaggu

SEQ ID NO: 785261 - RNA, 22 nt, Human
gaucuguuauaaucucuuuuau

SEQ ID NO: 785262 - RNA, 22 nt, Human
aguggcaguagaugagcugguu

SEQ ID NO: 785263 - RNA, 22 nt, Human
aaaggccacacagagcagggag

SEQ ID NO: 785264 - RNA, 22 nt, Human
aauggccagcaacaggagugaa

SEQ ID NO: 785265 - RNA, 22 nt, Human
uugaaagaagaagcugcgaugu

SEQ ID NO: 785266 - RNA, 22 nt, Human
uggaggaaguugcuggaaguca

SEQ ID NO: 785267 - RNA, 20 nt, Human
cuguggaauuuuaccaugcg

SEQ ID NO: 785268 - RNA, 22 nt, Human
uucuucuugucugcccucacau

SEQ ID NO: 785269 - RNA, 22 nt, Human
gggcagcugccacuccgcuugc

SEQ ID NO: 785270 - RNA, 22 nt, Human
agggcagcagcggcccaggccu

SEQ ID NO: 785271 - RNA, 22 nt, Human
uccauuuucuaaguaucacuua

SEQ ID NO: 785272 - RNA, 22 nt, Human
ugaggggagaagcagcagccug

SEQ ID NO: 785273 - RNA, 22 nt, Human
cagacagggaccucgcuccaga

SEQ ID NO: 785274 - RNA, 23 nt, Human
aggcgagcucuucuccagcacgu

SEQ ID NO: 785275 - RNA, 22 nt, Human
cccaggaaaguggaggcggcug

SEQ ID NO: 785276 - RNA, 22 nt, Human
uagggauguaaacauaguaauu

SEQ ID NO: 785277 - RNA, 17 nt, Human
cccacggaggugugaaa

SEQ ID NO: 785278 - RNA, 22 nt, Human
aagauuauggcagauaacaauu

SEQ ID NO: 785279 - RNA, 22 nt, Human
ccugcugugaccggggagcagg

SEQ ID NO: 785280 - RNA, 22 nt, Human
ucuuagaaguucauguuccagc

SEQ ID NO: 785281 - RNA, 22 nt, Human
uggcagcuagauaguguguuua

SEQ ID NO: 785282 - RNA, 18 nt, Human
cugcuugggagacgucag

SEQ ID NO: 785283 - RNA, 22 nt, Human
caagauggagaagcagcaaggg

SEQ ID NO: 785284 - RNA, 22 nt, Human
aggagggagcuuaagccaggca

SEQ ID NO: 785285 - RNA, 20 nt, Human
cauuuguuagcuuucuacug

SEQ ID NO: 785286 - RNA, 22 nt, Human
ggugaguugggguucacagguc

SEQ ID NO: 785287 - RNA, 22 nt, Human
aggccagcagcaugacggcauc

SEQ ID NO: 785288 - RNA, 22 nt, Human
gaggcagcugaagcuucaaaga

SEQ ID NO: 785289 - RNA, 19 nt, Human
ggucagcugggcuagaggc

SEQ ID NO: 785290 - RNA, 22 nt, Human
uuggcaggaauauugcagaggu

SEQ ID NO: 785291 - RNA, 22 nt, Human
cagauccacccuuguagugaca

SEQ ID NO: 785292 - RNA, 22 nt, Human
aggaaaacacaguauugaugga

SEQ ID NO: 785293 - RNA, 22 nt, Human
auuucauugaaguuaauucuuc

SEQ ID NO: 785294 - RNA, 22 nt, Human
uggggcuccuccuggcaggagg

SEQ ID NO: 785295 - RNA, 22 nt, Human
aucuacccacugaacacaauau

SEQ ID NO: 785296 - RNA, 22 nt, Human
gcagagcuccccaagacaccaa

SEQ ID NO: 785297 - RNA, 22 nt, Human
aaggcagcuuuaaaaaagaugc

SEQ ID NO: 785298 - RNA, 23 nt, Human
auugaugacuugauuacacuuuu

SEQ ID NO: 785299 - RNA, 22 nt, Human
ggaggggagauguuugggcuca

SEQ ID NO: 785300 - RNA, 22 nt, Human
cccagcaguaaccaguggaaau

SEQ ID NO: 785301 - RNA, 22 nt, Human
cccaggaacagcacagaacagc

SEQ ID NO: 785302 - RNA, 22 nt, Human
uucuccagagggcucugcagga

SEQ ID NO: 785303 - RNA, 22 nt, Human
cucaggauccaucuccugcccu

SEQ ID NO: 785304 - RNA, 22 nt, Human
uuucaucuaacacuacauaggg

SEQ ID NO: 785305 - RNA, 22 nt, Human
uaaggccaaacuauuauaguuc

SEQ ID NO: 785306 - RNA, 22 nt, Human
cagaguggcgacccccucagcu

SEQ ID NO: 785307 - RNA, 22 nt, Human
ugacaguuaagguauacauuca

SEQ ID NO: 785308 - RNA, 17 nt, Human
uccaugagacaugaaga

SEQ ID NO: 785309 - RNA, 22 nt, Human
ucugggaagcugcgugccuguu

SEQ ID NO: 785310 - RNA, 22 nt, Human
auugaaaggcaaaguaggaagc

SEQ ID NO: 785311 - RNA, 22 nt, Human
acucaggagggaucagcuauca

SEQ ID NO: 785312 - RNA, 22 nt, Human
ucacaguaaaagcauggaagag

SEQ ID NO: 785313 - RNA, 22 nt, Human
uaaggccaccguuauagaacca

SEQ ID NO: 785314 - RNA, 22 nt, Human
cugccagucuaugcugcucggc

SEQ ID NO: 785315 - RNA, 22 nt, Human
uuucuuaguccuagagugauuu

SEQ ID NO: 785316 - RNA, 22 nt, Human
aggcaggcacuccggaaguguc

SEQ ID NO: 785317 - RNA, 22 nt, Human
uugcuuuguggugguucuucca

SEQ ID NO: 785318 - RNA, 22 nt, Human
cggagaggugggggcagcaucu

SEQ ID NO: 785319 - RNA, 22 nt, Human
uuuaaauuuguguuuagagggu

SEQ ID NO: 785320 - RNA, 22 nt, Human
aaagccauuacaaaauuucaua

SEQ ID NO: 785321 - RNA, 18 nt, Human
agggaguuuuagggaagg

SEQ ID NO: 785322 - RNA, 22 nt, Human
aacaaaugaccugauuucuucc

SEQ ID NO: 785323 - RNA, 22 nt, Human
uuugagauggagucuugcucug

SEQ ID NO: 785324 - RNA, 22 nt, Human
ucagaaaagguagcugugacaa

SEQ ID NO: 785325 - RNA, 22 nt, Human
cugcugugcuuguggccacccg

SEQ ID NO: 785326 - RNA, 22 nt, Human
cuggccagcugacagcagggcu

SEQ ID NO: 785327 - RNA, 19 nt, Human
acuggcaguuucugcaugg

SEQ ID NO: 785328 - RNA, 17 nt, Human
agcugaaauugcugaag

SEQ ID NO: 785329 - RNA, 22 nt, Human
uucucagguagugcugaugcug

SEQ ID NO: 785330 - RNA, 22 nt, Human
aaauguauugcauaggauauuu

SEQ ID NO: 785331 - RNA, 21 nt, Human
cucuugugucagagccagagg

SEQ ID NO: 785332 - RNA, 22 nt, Human
cccaggaaagagacugcugggu

SEQ ID NO: 785333 - RNA, 22 nt, Human
ggagaagggacagacucagcuu

SEQ ID NO: 785334 - RNA, 22 nt, Human
agggcagcagcuccuccuagcu

SEQ ID NO: 785335 - RNA, 22 nt, Human
aguuauaaucugcuacugauau

SEQ ID NO: 785336 - RNA, 22 nt, Human
ugcauguggaccccuggugccu

SEQ ID NO: 785337 - RNA, 22 nt, Human
uucuuaacucaaauauauaucc

SEQ ID NO: 785338 - RNA, 22 nt, Human
auuguauaacagcauguauuuu

SEQ ID NO: 785339 - RNA, 22 nt, Human
ugugaacuggcagguggacggg

SEQ ID NO: 785340 - RNA, 22 nt, Human
uugaaauggaagugaaaauucu

SEQ ID NO: 785341 - RNA, 22 nt, Human
uauuucagucacuucuucucug

SEQ ID NO: 785342 - RNA, 22 nt, Human
uagauuuuacuucugucauuac

SEQ ID NO: 785343 - RNA, 22 nt, Human
gagccagcuauguagcaagagg

SEQ ID NO: 785344 - RNA, 19 nt, Human
uaucuguuuccugcuuguc

SEQ ID NO: 785345 - RNA, 23 nt, Human
gagugcagaauagacaugcagug

SEQ ID NO: 785346 - RNA, 21 nt, Human
ggacagcugcgcgcagggcuc

SEQ ID NO: 785347 - RNA, 22 nt, Human
uuucucuguucucuaacuguaa

SEQ ID NO: 785348 - RNA, 22 nt, Human
ugauuuccuaggucuggagaag

SEQ ID NO: 785349 - RNA, 22 nt, Human
cagaggcagugggguugcuccu

SEQ ID NO: 785350 - RNA, 23 nt, Human
ucagagagcuguugagagcugcc

SEQ ID NO: 785351 - RNA, 22 nt, Human
uccuuagagacaagaccaguuu

SEQ ID NO: 785352 - RNA, 22 nt, Human
cccaggagacugagcuguaacc

SEQ ID NO: 785353 - RNA, 22 nt, Human
ggagaggguguggaaaguuauc

SEQ ID NO: 785354 - RNA, 22 nt, Human
uuugcaauuugugcugcaaaug

SEQ ID NO: 785355 - RNA, 22 nt, Human
caguggagagacuuuuacucuu

SEQ ID NO: 785356 - RNA, 22 nt, Human
cccucuacagggaagcgcuuuc

SEQ ID NO: 785357 - RNA, 22 nt, Human
uccaggaggacugagggggcug

SEQ ID NO: 785358 - RNA, 21 nt, Human
gcucagaguauugcacuguuu

SEQ ID NO: 785359 - RNA, 22 nt, Human
aucaggauggguuuggcuuagg

SEQ ID NO: 785360 - RNA, 22 nt, Human
gaggccaaguuggagaccaggu

SEQ ID NO: 785361 - RNA, 22 nt, Human
uuugcaaagugacuauuauaug

SEQ ID NO: 785362 - RNA, 22 nt, Human
ugaggcaguauuuuagugacuu

SEQ ID NO: 785363 - RNA, 22 nt, Human
ucccaggaauugaagccagugu

SEQ ID NO: 785364 - RNA, 22 nt, Human
ugcuugaaagggguuucccagu

SEQ ID NO: 785365 - RNA, 22 nt, Human
cagcuccucacgagucuugaaa

SEQ ID NO: 785366 - RNA, 22 nt, Human
agacgagggccuggcacacagu

SEQ ID NO: 785367 - RNA, 22 nt, Human
aggacagcagugcuggcacuug

SEQ ID NO: 785368 - RNA, 22 nt, Human
uuacaguuuaguccaagccaga

SEQ ID NO: 785369 - RNA, 22 nt, Human
gaggagcuugaggcuaggagcc

SEQ ID NO: 785370 - RNA, 22 nt, Human
gcaaagcauucuguggagucua

SEQ ID NO: 785371 - RNA, 22 nt, Human
ccagguaggagagagggauccu

SEQ ID NO: 785372 - RNA, 22 nt, Human
ucccaggaauccguccucuaga

SEQ ID NO: 785373 - RNA, 22 nt, Human
augugaggcagcacggagauua

SEQ ID NO: 785374 - RNA, 22 nt, Human
cauuaaaauaucucaugguguu

SEQ ID NO: 785375 - RNA, 22 nt, Human
gaggcagcgggucaggaccgug

SEQ ID NO: 785376 - RNA, 23 nt, Human
aguaaagcaauuguuggcgagag

SEQ ID NO: 785377 - RNA, 19 nt, Human
cccaggaggcggagguugc

SEQ ID NO: 785378 - RNA, 22 nt, Human
aggcaggcugcuauggaguaga

SEQ ID NO: 785379 - RNA, 20 nt, Human
agaggccaguuaggagucua

SEQ ID NO: 785380 - RNA, 22 nt, Human
cagugguuauacuuacuguuuc

SEQ ID NO: 785381 - RNA, 22 nt, Human
gacagugcauuuccuggcaugg

SEQ ID NO: 785382 - RNA, 22 nt, Human
aggguagguguaagauagcccu

SEQ ID NO: 785383 - RNA, 18 nt, Human
aggcaggcuggagugacu

SEQ ID NO: 785384 - RNA, 19 nt, Human
accaggagacagugagcuu

SEQ ID NO: 785385 - RNA, 22 nt, Human
gaucuucucuuuaguagaaaca

SEQ ID NO: 785386 - RNA, 22 nt, Human
uguuugaauuuugcuaacgugu

SEQ ID NO: 785387 - RNA, 22 nt, Human
cugcugugccucuuuucacgug

SEQ ID NO: 785388 - RNA, 23 nt, Human
accaggaguugucucaggaaaca

SEQ ID NO: 785389 - RNA, 22 nt, Human
ugcccacauggugccauggcca

SEQ ID NO: 785390 - RNA, 20 nt, Human
uuucugugcccaggucuguu

SEQ ID NO: 785391 - RNA, 22 nt, Human
auaucaaacgaaguuauuuuaa

SEQ ID NO: 785392 - RNA, 22 nt, Human
ucuaaccuuugaaacugcuuuc

SEQ ID NO: 785393 - RNA, 22 nt, Human
gaugccuccaaaugagggcaga

SEQ ID NO: 785394 - RNA, 22 nt, Human
aucugcaggaaugugugcagag

SEQ ID NO: 785395 - RNA, 22 nt, Human
aucuuguuauaagagauaaugg

SEQ ID NO: 785396 - RNA, 22 nt, Human
aagcaccuggguuauaucuuag

SEQ ID NO: 785397 - RNA, 22 nt, Human
uagggaugacgaaaggacagag

SEQ ID NO: 785398 - RNA, 22 nt, Human
aguuauaugugaaaacacguau

SEQ ID NO: 785399 - RNA, 22 nt, Human
ugaugaaacugagguuccaaga

SEQ ID NO: 785400 - RNA, 22 nt, Human
cagcaggauuugaaaggaagag

SEQ ID NO: 785401 - RNA, 22 nt, Human
aggcagcuagagagugaaacug

SEQ ID NO: 785402 - RNA, 22 nt, Human
acacauauauacauauuugugc

SEQ ID NO: 785403 - RNA, 22 nt, Human
ugcugugagguugagaaggaag

SEQ ID NO: 785404 - RNA, 22 nt, Human
uucucuuuugugaugugagaug

SEQ ID NO: 785405 - RNA, 22 nt, Human
auacacauguguaugugcaugc

SEQ ID NO: 785406 - RNA, 22 nt, Human
cugcugugugaccauggacagg

SEQ ID NO: 785407 - RNA, 17 nt, Human
gagacagcaggagcccc

SEQ ID NO: 785408 - RNA, 22 nt, Human
caaauaguaugagcaaugauuc

SEQ ID NO: 785409 - RNA, 22 nt, Human
uccaggaggguuuucugccuuc

SEQ ID NO: 785410 - RNA, 22 nt, Human
ucaggaugaccacgagccucua

SEQ ID NO: 785411 - RNA, 22 nt, Human
accaggagguguuugcucaagu

SEQ ID NO: 785412 - RNA, 22 nt, Human
cuuaagauuugagauaccuaau

SEQ ID NO: 785413 - RNA, 22 nt, Human
agagggagcccagucauagcug

SEQ ID NO: 785414 - RNA, 22 nt, Human
accaggagccauagagucaggc

SEQ ID NO: 785415 - RNA, 19 nt, Human
uugaaagauuagcuuucua

SEQ ID NO: 785416 - RNA, 22 nt, Human
ccauggcaauggucagucuauu

SEQ ID NO: 785417 - RNA, 20 nt, Human
agacaggagcccccauucag

SEQ ID NO: 785418 - RNA, 17 nt, Human
aagacagaagccaugag

SEQ ID NO: 785419 - RNA, 22 nt, Human
aaggcaguuaauuuggcuagaa

SEQ ID NO: 785420 - RNA, 22 nt, Human
aggcagcugcccucuccuuccu

SEQ ID NO: 785421 - RNA, 19 nt, Human
ugccuggacaaaugugggg

SEQ ID NO: 785422 - RNA, 22 nt, Human
gcagaggggaagcugaggaauu

SEQ ID NO: 785423 - RNA, 21 nt, Human
gcaaauguucaggaaaaaaga

SEQ ID NO: 785424 - RNA, 22 nt, Human
ucccaggacccaggcauucaca

SEQ ID NO: 785425 - RNA, 22 nt, Human
cagcagaggugguucacauugu

SEQ ID NO: 785426 - RNA, 22 nt, Human
acaagcaugggcuuugacauca

SEQ ID NO: 785427 - RNA, 22 nt, Human
aucauucuagcuguuguguuga

SEQ ID NO: 785428 - RNA, 22 nt, Human
uuucagaaagcugaacauauga

SEQ ID NO: 785429 - RNA, 22 nt, Human
aaaggccacacugcucuuucuc

SEQ ID NO: 785430 - RNA, 22 nt, Human
aagauggagcacgagcagaagc

SEQ ID NO: 785431 - RNA, 22 nt, Human
cuucuucacacuggucugaagc

SEQ ID NO: 785432 - RNA, 22 nt, Human
auuuuacuacuccaauuaauga

SEQ ID NO: 785433 - RNA, 22 nt, Human
aguucuuuugugaacauaugcu

SEQ ID NO: 785434 - RNA, 22 nt, Human
cacaugugugcugaggacugug

SEQ ID NO: 785435 - RNA, 22 nt, Human
aacauuucagcaaauaagaaca

SEQ ID NO: 785436 - RNA, 22 nt, Human
ggaggggucucuagcgaggaga

SEQ ID NO: 785437 - RNA, 22 nt, Human
uaaagcacauaucuuacaauaa

SEQ ID NO: 785438 - RNA, 22 nt, Human
ggcagaggaggggugaauuugc

SEQ ID NO: 785439 - RNA, 22 nt, Human
ugcacagugaccccuggugacu

SEQ ID NO: 785440 - RNA, 22 nt, Human
gaaauauugggacucagagcuu

SEQ ID NO: 785441 - RNA, 22 nt, Human
ggagugggaacaaugacauggu

SEQ ID NO: 785442 - RNA, 22 nt, Human
caggcagcuagauuuauaacaa

SEQ ID NO: 785443 - RNA, 22 nt, Human
cuuaacagagagaaguguugcu

SEQ ID NO: 785444 - RNA, 22 nt, Human
uucucagagcacugcugacaaa

SEQ ID NO: 785445 - RNA, 22 nt, Human
gugcaagguacauccuugaugu

SEQ ID NO: 785446 - RNA, 22 nt, Human
accuugaugccuuuccaagaug

SEQ ID NO: 785447 - RNA, 22 nt, Human
auucuuauuuaaauagagucug

SEQ ID NO: 785448 - RNA, 22 nt, Human
agcaccuguugcacuucauaau

SEQ ID NO: 785449 - RNA, 22 nt, Human
gagggagggccaggucccaacc

SEQ ID NO: 785450 - RNA, 22 nt, Human
aaggcaguacuuuauguccaua

SEQ ID NO: 785451 - RNA, 22 nt, Human
cagucccuaguggagcucacag

SEQ ID NO: 785452 - RNA, 22 nt, Human
cugccuccugccgugcagcuuc

SEQ ID NO: 785453 - RNA, 22 nt, Human
gaaggccaguuuugagauaggu

SEQ ID NO: 785454 - RNA, 22 nt, Human
cugagacuuucaugugcuuuua

SEQ ID NO: 785455 - RNA, 22 nt, Human
aggaaacuccccuacaucucaa

SEQ ID NO: 785456 - RNA, 22 nt, Human
ugaggggagguuggggcacauc

SEQ ID NO: 785457 - RNA, 20 nt, Human
uacagaaugcaauaaaaugg

SEQ ID NO: 785458 - RNA, 22 nt, Human
ucaauucugguccucaggaacu

SEQ ID NO: 785459 - RNA, 22 nt, Human
augcugugucuagcaggaacac

SEQ ID NO: 785460 - RNA, 22 nt, Human
guccucugaaguugugcaaugc

SEQ ID NO: 785461 - RNA, 22 nt, Human
uccaugagggacacuggaugcu

SEQ ID NO: 785462 - RNA, 19 nt, Human
accaggaguaucagagcug

SEQ ID NO: 785463 - RNA, 22 nt, Human
uguguucuggaaagcucacuga

SEQ ID NO: 785464 - RNA, 22 nt, Human
ucccaggaaaacacucgaggac

SEQ ID NO: 785465 - RNA, 22 nt, Human
uugcuguguaacuccuggccug

SEQ ID NO: 785466 - RNA, 22 nt, Human
cauucauuagaauagauaugua

SEQ ID NO: 785467 - RNA, 22 nt, Human
cucuucuuggcccccaugaggg

SEQ ID NO: 785468 - RNA, 22 nt, Human
caucucaugggcaugccaagcu

SEQ ID NO: 785469 - RNA, 22 nt, Human
aaagccaugggucuuuggcaua

SEQ ID NO: 785470 - RNA, 22 nt, Human
uucaugcuuuuaccgcuguuaa

SEQ ID NO: 785471 - RNA, 23 nt, Human
uccaggagaauuccagggcccgg

SEQ ID NO: 785472 - RNA, 22 nt, Human
uucagggagagcgggacgggug

SEQ ID NO: 785473 - RNA, 22 nt, Human
ucugaaagaagggcagucuuuu

SEQ ID NO: 785474 - RNA, 22 nt, Human
cuucaugcugauauccucgaug

SEQ ID NO: 785475 - RNA, 22 nt, Human
gcccaggaagugacucagaugu

SEQ ID NO: 785476 - RNA, 22 nt, Human
aggcagcuaagauggauaauga

SEQ ID NO: 785477 - RNA, 22 nt, Human
aaaguauuugugauuuuuacca

SEQ ID NO: 785478 - RNA, 22 nt, Human
ucauuauuuuggacuggagugu

SEQ ID NO: 785479 - RNA, 22 nt, Human
aggguggcuggaggaaucagaa

SEQ ID NO: 785480 - RNA, 20 nt, Human
aggacagcagcugccacuug

SEQ ID NO: 785481 - RNA, 22 nt, Human
aaugcauauguaggcaagcagu

SEQ ID NO: 785482 - RNA, 22 nt, Human
cacaaauggccguguucaaaga

SEQ ID NO: 785483 - RNA, 22 nt, Human
uccauuuuagaagaaaauccac

SEQ ID NO: 785484 - RNA, 22 nt, Human
cuguaguugaugauuucugaua

SEQ ID NO: 785485 - RNA, 22 nt, Human
augaaacacacacgcgcauacu

SEQ ID NO: 785486 - RNA, 22 nt, Human
aacuagucagugauucucagaa

SEQ ID NO: 785487 - RNA, 22 nt, Human
ggccagcugggccaccaggugc

SEQ ID NO: 785488 - RNA, 22 nt, Human
cacccugggcugggccuguuaa

SEQ ID NO: 785489 - RNA, 22 nt, Human
ugcucuucggggccacugcuug

SEQ ID NO: 785490 - RNA, 22 nt, Human
gcuccuucaggugguagcuguu

SEQ ID NO: 785491 - RNA, 22 nt, Human
cccaagagcuucuaggacgcug

SEQ ID NO: 785492 - RNA, 22 nt, Human
aggaggcacucacucucagggu

SEQ ID NO: 785493 - RNA, 22 nt, Human
ugaggcagucacccccuccugc

SEQ ID NO: 785494 - RNA, 22 nt, Human
gggaagcaggugcagcucgccu

SEQ ID NO: 785495 - RNA, 22 nt, Human
gcccaguaguucaagguugcag

SEQ ID NO: 785496 - RNA, 21 nt, Human
gauuugcagaaacuagacagg

SEQ ID NO: 785497 - RNA, 22 nt, Human
aucugccugagucuagguuuuc

SEQ ID NO: 785498 - RNA, 22 nt, Human
ucucaggaauagaguggcagca

SEQ ID NO: 785499 - RNA, 22 nt, Human
uuugcacuagcauuuguccaug

SEQ ID NO: 785500 - RNA, 22 nt, Human
gcagaggauagcauaugaaccu

SEQ ID NO: 785501 - RNA, 22 nt, Human
uugcagcuuagugauguuaucu

SEQ ID NO: 785502 - RNA, 22 nt, Human
uuuucauuguuccucgagcauu

SEQ ID NO: 785503 - RNA, 22 nt, Human
uuuugaauaauucagaaacagc

SEQ ID NO: 785504 - RNA, 22 nt, Human
uucaacuaauguuuauuuuaug

SEQ ID NO: 785505 - RNA, 22 nt, Human
auguuauuaaaguacagauucu

SEQ ID NO: 785506 - RNA, 23 nt, Human
ugaguucucaucuuggcuucuau

SEQ ID NO: 785507 - RNA, 22 nt, Human
aggaugaggcuggcaggucuug

SEQ ID NO: 785508 - RNA, 23 nt, Human
uccaggagaaccccugucugucc

SEQ ID NO: 785509 - RNA, 22 nt, Human
uucaggauccccuugaugggcu

SEQ ID NO: 785510 - RNA, 22 nt, Human
uuuuuggguccaggcuguaucu

SEQ ID NO: 785511 - RNA, 22 nt, Human
aaggcagcaugaaucccuguac

SEQ ID NO: 785512 - RNA, 22 nt, Human
aggcagcuucugauuagcagcg

SEQ ID NO: 785513 - RNA, 22 nt, Human
agggaagcccuggcugagaccc

SEQ ID NO: 785514 - RNA, 22 nt, Human
aaauauaguaaaugcauaguuc

SEQ ID NO: 785515 - RNA, 22 nt, Human
aggcagcucuguggccucccag

SEQ ID NO: 785516 - RNA, 22 nt, Human
uuauuauuggugaguuaaggaa

SEQ ID NO: 785517 - RNA, 22 nt, Human
uggaaugacagagagucugaau

SEQ ID NO: 785518 - RNA, 22 nt, Human
gaggagagggcugcgggcccac

SEQ ID NO: 785519 - RNA, 22 nt, Human
gucuucuguaagaugagguccc

SEQ ID NO: 785520 - RNA, 22 nt, Human
agugagaguauuaaugugaacu

SEQ ID NO: 785521 - RNA, 22 nt, Human
uugauuaaacaggcauauucaa

SEQ ID NO: 785522 - RNA, 22 nt, Human
uacaguaagaugaaauagcaau

SEQ ID NO: 785523 - RNA, 22 nt, Human
cccaggagauggagguugcagu

SEQ ID NO: 785524 - RNA, 22 nt, Human
gagucuuugguaaagucugcug

SEQ ID NO: 785525 - RNA, 18 nt, Human
ucaggagacacagacgca

SEQ ID NO: 785526 - RNA, 22 nt, Human
cuucagagugcagaagauuggg

SEQ ID NO: 785527 - RNA, 21 nt, Human
aucacauuggcuguuauuauu

SEQ ID NO: 785528 - RNA, 22 nt, Human
augcuuccaaggcuaagacaag

SEQ ID NO: 785529 - RNA, 22 nt, Human
aguggcagagugcacucaggca

SEQ ID NO: 785530 - RNA, 22 nt, Human
gaggccaggaagcccaagauca

SEQ ID NO: 785531 - RNA, 22 nt, Human
agaggcagcagucauacuacag

SEQ ID NO: 785532 - RNA, 22 nt, Human
uaucuguuccaggcacucagcu

SEQ ID NO: 785533 - RNA, 22 nt, Human
caacauuucaaggucuuuagga

SEQ ID NO: 785534 - RNA, 21 nt, Human
acucaggagacuaacuauguc

SEQ ID NO: 785535 - RNA, 22 nt, Human
gaucauuuugaugcccuuuuag

SEQ ID NO: 785536 - RNA, 22 nt, Human
uucuucuuucccccugugguac

SEQ ID NO: 785537 - RNA, 22 nt, Human
caaugugguggcagaugucagu

SEQ ID NO: 785538 - RNA, 22 nt, Human
ucucagucagccuugauguccc

SEQ ID NO: 785539 - RNA, 22 nt, Human
cagugcugggcagaggagagcg

SEQ ID NO: 785540 - RNA, 22 nt, Human
uguccauggauagagcugcucg

SEQ ID NO: 785541 - RNA, 22 nt, Human
aggcacagagaaugcccuccau

SEQ ID NO: 785542 - RNA, 22 nt, Human
aauguauuccucaugcaagagu

SEQ ID NO: 785543 - RNA, 22 nt, Human
caaggccagagccagcgauaag

SEQ ID NO: 785544 - RNA, 22 nt, Human
ucagagagugcaaaauauagcu

SEQ ID NO: 785545 - RNA, 22 nt, Human
aaaggaagaugccaggacucug

SEQ ID NO: 785546 - RNA, 22 nt, Human
ucauuuguucaucugcucuucu

SEQ ID NO: 785547 - RNA, 22 nt, Human
agaggcggagguugcagugagc

SEQ ID NO: 785548 - RNA, 23 nt, Human
auucuucauuaucuucuagaaaa

SEQ ID NO: 785549 - RNA, 22 nt, Human
uggaguuccuuugaaaggcucu

SEQ ID NO: 785550 - RNA, 22 nt, Human
aggccagaaaugucagggagug

SEQ ID NO: 785551 - RNA, 22 nt, Human
uugcauuugacaaauuauuuaa

SEQ ID NO: 785552 - RNA, 22 nt, Human
cccauugugguuguugaggaua

SEQ ID NO: 785553 - RNA, 19 nt, Human
agcuuccauauucucuagu

SEQ ID NO: 785554 - RNA, 19 nt, Human
ugugaaagcuaguguucuu

SEQ ID NO: 785555 - RNA, 21 nt, Human
acagcauguuuguguguuugc

SEQ ID NO: 785556 - RNA, 22 nt, Human
aaaauauuuuagggccaggaga

SEQ ID NO: 785557 - RNA, 22 nt, Human
gcugcccaggagagguggggcu

SEQ ID NO: 785558 - RNA, 22 nt, Human
gaggcagugcauugucuagggg

SEQ ID NO: 785559 - RNA, 22 nt, Human
acuggcagagacccugauggcc

SEQ ID NO: 785560 - RNA, 22 nt, Human
cugcagagcaaguaacauccuc

SEQ ID NO: 785561 - RNA, 22 nt, Human
ugcccaggauugugaggucagg

SEQ ID NO: 785562 - RNA, 22 nt, Human
cugcugagaaaagacugaggga

SEQ ID NO: 785563 - RNA, 22 nt, Human
uucaauucaauucuaaauauau

SEQ ID NO: 785564 - RNA, 22 nt, Human
auuguucaaagugcuuugcaug

SEQ ID NO: 785565 - RNA, 22 nt, Human
ggcaggcugggugucauggagu

SEQ ID NO: 785566 - RNA, 22 nt, Human
uauuuccaggccccacucuaga

SEQ ID NO: 785567 - RNA, 22 nt, Human
cuuaacauccugcauuuuucuu

SEQ ID NO: 785568 - RNA, 22 nt, Human
gucaggaucaaauugaaguuau

SEQ ID NO: 785569 - RNA, 22 nt, Human
uuuggaauauuaaaaugucuca

SEQ ID NO: 785570 - RNA, 22 nt, Human
agagggauaauauguauuguaa

SEQ ID NO: 785571 - RNA, 22 nt, Human
ucuucagacuccaaauguuuua

SEQ ID NO: 785572 - RNA, 22 nt, Human
aaugauuuccccuacacagaag

SEQ ID NO: 785573 - RNA, 20 nt, Human
ucaggaugugcugagugaag

SEQ ID NO: 785574 - RNA, 22 nt, Human
uuggaaagcaagcuggacauac

SEQ ID NO: 785575 - RNA, 21 nt, Human
ucauuugugaucugauuucca

SEQ ID NO: 785576 - RNA, 22 nt, Human
auuuucaucauggguuuaacau

SEQ ID NO: 785577 - RNA, 21 nt, Human
uucuucaguuuaauauaaaau

SEQ ID NO: 785578 - RNA, 22 nt, Human
cagggagggaggaaaauuugcu

SEQ ID NO: 785579 - RNA, 22 nt, Human
uauuuucuguggaggaccagau

SEQ ID NO: 785580 - RNA, 22 nt, Human
acagugacguuuauuugagacg

SEQ ID NO: 785581 - RNA, 22 nt, Human
aggcaggcuggucugaagagug

SEQ ID NO: 785582 - RNA, 22 nt, Human
agucuugcauuuucugaagaug

SEQ ID NO: 785583 - RNA, 22 nt, Human
aucaggauccaccuugagccug

SEQ ID NO: 785584 - RNA, 22 nt, Human
ugagaacugaggauuugaauuc

SEQ ID NO: 785585 - RNA, 22 nt, Human
uagaagcaguaauagaaauagg

SEQ ID NO: 785586 - RNA, 22 nt, Human
uuuucaguaaugucuacauaau

SEQ ID NO: 785587 - RNA, 22 nt, Human
cuuacagagaagaaaauguagu

SEQ ID NO: 785588 - RNA, 22 nt, Human
auucuucaccauggauaauuug

SEQ ID NO: 785589 - RNA, 22 nt, Human
uuuauuguuaucaugggugagu

SEQ ID NO: 785590 - RNA, 22 nt, Human
agaaaugaagcaggaguuauua

SEQ ID NO: 785591 - RNA, 22 nt, Human
auagcuguuagauuggggucga

SEQ ID NO: 785592 - RNA, 22 nt, Human
auucuucauuguugauucaugu

SEQ ID NO: 785593 - RNA, 22 nt, Human
uccaugaggcagggaggcuggc

SEQ ID NO: 785594 - RNA, 22 nt, Human
agggggugucucugauuggguu

SEQ ID NO: 785595 - RNA, 22 nt, Human
ucacaguaucacacaaggauua

SEQ ID NO: 785596 - RNA, 22 nt, Human
gaggaaccaaaucagcuugcac

SEQ ID NO: 785597 - RNA, 22 nt, Human
ccaggagaauaauggcagauua

SEQ ID NO: 785598 - RNA, 22 nt, Human
auaagcauguuagaauauuuga

SEQ ID NO: 785599 - RNA, 22 nt, Human
gcuuugaagucugugucuuuug

SEQ ID NO: 785600 - RNA, 22 nt, Human
auucacaaaaugauauagauac

SEQ ID NO: 785601 - RNA, 22 nt, Human
agaggacagguuuuccaugggc

SEQ ID NO: 785602 - RNA, 22 nt, Human
guucuucaucuuaaccaucugu

SEQ ID NO: 785603 - RNA, 22 nt, Human
aucaggaugacaacugcugggu

SEQ ID NO: 785604 - RNA, 20 nt, Human
cugagagucugugcuuaguc

SEQ ID NO: 785605 - RNA, 22 nt, Human
gaggcagcaugguaccuuggag

SEQ ID NO: 785606 - RNA, 22 nt, Human
ucuaaagaagaggguucugcgg

SEQ ID NO: 785607 - RNA, 22 nt, Human
caguuuuugccauuaagaguaa

SEQ ID NO: 785608 - RNA, 22 nt, Human
acccaggauaaucuguguaucu

SEQ ID NO: 785609 - RNA, 22 nt, Human
uucuucuucauuucugacgaug

SEQ ID NO: 785610 - RNA, 22 nt, Human
uuuguaaauagcaguacucaug

SEQ ID NO: 785611 - RNA, 22 nt, Human
gcuucccagcagaggaaagacu

SEQ ID NO: 785612 - RNA, 22 nt, Human
gcccaggacucagggugucgcg

SEQ ID NO: 785613 - RNA, 22 nt, Human
cagcaggauaugguggagagag

SEQ ID NO: 785614 - RNA, 22 nt, Human
uugcaucuagggcaacccagag

SEQ ID NO: 785615 - RNA, 22 nt, Human
uccaggagguagugcuuaauuu

SEQ ID NO: 785616 - RNA, 22 nt, Human
agaggcaguauacaauccgagc

SEQ ID NO: 785617 - RNA, 21 nt, Human
uccaggaguggcugggcaggg

SEQ ID NO: 785618 - RNA, 22 nt, Human
uucuucaguuugguaaauguaa

SEQ ID NO: 785619 - RNA, 22 nt, Human
ggcagcuucuuaauauggagac

SEQ ID NO: 785620 - RNA, 22 nt, Human
cuuugaagagauuacugugcuc

SEQ ID NO: 785621 - RNA, 22 nt, Human
gagaggaguagacacuuugguu

SEQ ID NO: 785622 - RNA, 22 nt, Human
uuugaaagagcugauacaugaa

SEQ ID NO: 785623 - RNA, 22 nt, Human
auucuucacaaauauauagaag

SEQ ID NO: 785624 - RNA, 20 nt, Human
caggagggacauuucagcau

SEQ ID NO: 785625 - RNA, 22 nt, Human
ccuugcguuuuacagcuucuag

SEQ ID NO: 785626 - RNA, 22 nt, Human
cucaugucuucacccauucuaa

SEQ ID NO: 785627 - RNA, 22 nt, Human
gacagcuguggagaggcaugug

SEQ ID NO: 785628 - RNA, 20 nt, Human
augcuuucuugugugcugcu

SEQ ID NO: 785629 - RNA, 22 nt, Human
uuauucuuuaaacauauauguu

SEQ ID NO: 785630 - RNA, 22 nt, Human
cugccaggcagcagagggagaa

SEQ ID NO: 785631 - RNA, 22 nt, Human
uuucaguuuuugcucgauguau

SEQ ID NO: 785632 - RNA, 22 nt, Human
ugcauggacucaucagacaaga

SEQ ID NO: 785633 - RNA, 22 nt, Human
cucaggauugugccuagggaga

SEQ ID NO: 785634 - RNA, 22 nt, Human
auacaacagaaaaugauuauuc

SEQ ID NO: 785635 - RNA, 22 nt, Human
ucccaggacaugggcucugcuc

SEQ ID NO: 785636 - RNA, 22 nt, Human
ugcccaggguuucuaagagcag

SEQ ID NO: 785637 - RNA, 22 nt, Human
ggaagaggcugagccagguccc

SEQ ID NO: 785638 - RNA, 19 nt, Human
uuugaaaggauuguuauuu

SEQ ID NO: 785639 - RNA, 19 nt, Human
uuucuuaggccuuuggccu

SEQ ID NO: 785640 - RNA, 22 nt, Human
cagcgucucguugugggccucg

SEQ ID NO: 785641 - RNA, 20 nt, Human
uuucacagucccuguuuccu

SEQ ID NO: 785642 - RNA, 22 nt, Human
gggagggguugcauguuugagu

SEQ ID NO: 785643 - RNA, 22 nt, Human
gagagcuggguucaaguagcug

SEQ ID NO: 785644 - RNA, 22 nt, Human
gccucugcccuccugggacugc

SEQ ID NO: 785645 - RNA, 22 nt, Human
cugcugugaguuuggaggucua

SEQ ID NO: 785646 - RNA, 22 nt, Human
ccaugagcuuccuauauagggu

SEQ ID NO: 785647 - RNA, 22 nt, Human
ggaggacacuggcucugccuuc

SEQ ID NO: 785648 - RNA, 22 nt, Human
gcauguguugguuuaugcaugu

SEQ ID NO: 785649 - RNA, 19 nt, Human
guugaaaguaggugagggu

SEQ ID NO: 785650 - RNA, 17 nt, Human
gcugacccuggagaagu

SEQ ID NO: 785651 - RNA, 22 nt, Human
uuugaaagccuggcuuuucucu

SEQ ID NO: 785652 - RNA, 22 nt, Human
ucuucagauggccaguuguccc

SEQ ID NO: 785653 - RNA, 22 nt, Human
ugaggcaggaguucaggcugcg

SEQ ID NO: 785654 - RNA, 22 nt, Human
uaucuguuguaguacagaugau

SEQ ID NO: 785655 - RNA, 22 nt, Human
uggggcucaccuaggcuggaag

SEQ ID NO: 785656 - RNA, 22 nt, Human
gucaggauuggggucaugaguc

SEQ ID NO: 785657 - RNA, 22 nt, Human
ugauuuccccagucuugcugcu

SEQ ID NO: 785658 - RNA, 22 nt, Human
cugagagugcucuuugauguca

SEQ ID NO: 785659 - RNA, 22 nt, Human
ccaaaugugccuguuucaacaa

SEQ ID NO: 785660 - RNA, 20 nt, Human
cccaggaguuugcucuuacu

SEQ ID NO: 785661 - RNA, 22 nt, Human
gauuucuugauaauucaaaucc

SEQ ID NO: 785662 - RNA, 21 nt, Human
aggcagcucaggcccagagag

SEQ ID NO: 785663 - RNA, 23 nt, Human
cccauuuucauguuaacuccugg

SEQ ID NO: 785664 - RNA, 22 nt, Human
ccauccuaucugaccuacuugu

SEQ ID NO: 785665 - RNA, 22 nt, Human
aggucagcaggccaggggcgaa

SEQ ID NO: 785666 - RNA, 22 nt, Human
cggcagcugauugcagagcacc

SEQ ID NO: 785667 - RNA, 22 nt, Human
ucuacagacagagcagguggga

SEQ ID NO: 785668 - RNA, 22 nt, Human
ugcauguguguguauuuauaaa

SEQ ID NO: 785669 - RNA, 22 nt, Human
auuauuauauagggaaaguccc

SEQ ID NO: 785670 - RNA, 22 nt, Human
uuagccauuaauguccugugca

SEQ ID NO: 785671 - RNA, 22 nt, Human
agagagagggaaacugcuaaac

SEQ ID NO: 785672 - RNA, 22 nt, Human
cccaggaagaaauucugauuug

SEQ ID NO: 785673 - RNA, 22 nt, Human
auuauuauuguugauguuaggg

SEQ ID NO: 785674 - RNA, 22 nt, Human
aagacaauuugauacuaguugc

SEQ ID NO: 785675 - RNA, 22 nt, Human
cuuuggcaaugucauuuucaau

SEQ ID NO: 785676 - RNA, 22 nt, Human
aucaggauuacacggggaugcu

SEQ ID NO: 785677 - RNA, 22 nt, Human
cugcccaggcugaaggaacauc

SEQ ID NO: 785678 - RNA, 22 nt, Human
uuuuaucuaccuaugcucauuu

SEQ ID NO: 785679 - RNA, 21 nt, Human
ucucugguuggaguugugcca

SEQ ID NO: 785680 - RNA, 17 nt, Human
caggcagacauguaagc

SEQ ID NO: 785681 - RNA, 22 nt, Human
ucucaggagccacagcgggagu

SEQ ID NO: 785682 - RNA, 17 nt, Human
caagagagaugacugga

SEQ ID NO: 785683 - RNA, 22 nt, Human
auuucaaggcuauuaauauaaa

SEQ ID NO: 785684 - RNA, 22 nt, Human
gcauugaguccacucugucuuu

SEQ ID NO: 785685 - RNA, 22 nt, Human
cgcagggauuucaaggggccuu

SEQ ID NO: 785686 - RNA, 22 nt, Human
gaccauuuuuacagagcauuca

SEQ ID NO: 785687 - RNA, 22 nt, Human
aaaggccagguuggcugguauu

SEQ ID NO: 785688 - RNA, 22 nt, Human
cccaaggacacgggcagggaca

SEQ ID NO: 785689 - RNA, 22 nt, Human
auugaaagcauggauuuggauu

SEQ ID NO: 785690 - RNA, 22 nt, Human
uucaguaaaacacugcaauguc

SEQ ID NO: 785691 - RNA, 22 nt, Human
ucuucuuccucauuuauacaua

SEQ ID NO: 785692 - RNA, 22 nt, Human
cuuaaaaucuggcaguuagcua

SEQ ID NO: 785693 - RNA, 22 nt, Human
agauggaguuaguaccagaguc

SEQ ID NO: 785694 - RNA, 23 nt, Human
uugcuuucaucaugagaugcucc

SEQ ID NO: 785695 - RNA, 23 nt, Human
cuugcagggcuggaggcuuagaa

SEQ ID NO: 785696 - RNA, 22 nt, Human
ucauuguuauguuuugcugucu

SEQ ID NO: 785697 - RNA, 22 nt, Human
aguuauuacucuuuaacauauu

SEQ ID NO: 785698 - RNA, 22 nt, Human
caaggccaagucucugugaaga

SEQ ID NO: 785699 - RNA, 22 nt, Human
gcagaggcuguagggaagguug

SEQ ID NO: 785700 - RNA, 22 nt, Human
auucuucagcaggggacacuau

SEQ ID NO: 785701 - RNA, 22 nt, Human
ggaggaggggugacugaaugcu

SEQ ID NO: 785702 - RNA, 19 nt, Human
uggcaucuguaaaauggug

SEQ ID NO: 785703 - RNA, 22 nt, Human
uucauugugauucuuggcuagc

SEQ ID NO: 785704 - RNA, 22 nt, Human
ucuucacaugaccuucaugucu

SEQ ID NO: 785705 - RNA, 22 nt, Human
ggccagcucuuguccacggagg

SEQ ID NO: 785706 - RNA, 21 nt, Human
cucaaagaccaaaaguguaga

SEQ ID NO: 785707 - RNA, 17 nt, Human
uuucaucugggaccacc

SEQ ID NO: 785708 - RNA, 22 nt, Human
accaggaggcuacacuguccca

SEQ ID NO: 785709 - RNA, 22 nt, Human
gauuucuugauaaguaguguga

SEQ ID NO: 785710 - RNA, 22 nt, Human
acauuuaaccaaacuguuuaau

SEQ ID NO: 785711 - RNA, 22 nt, Human
ucacacagauugguagagcuga

SEQ ID NO: 785712 - RNA, 17 nt, Human
cagcucugcaucuuccu

SEQ ID NO: 785713 - RNA, 22 nt, Human
gauuucuuuaugaaguacagaa

SEQ ID NO: 785714 - RNA, 22 nt, Human
aggguccugggugcaguugcuu

SEQ ID NO: 785715 - RNA, 22 nt, Human
aucugccuccaaguccaugugu

SEQ ID NO: 785716 - RNA, 22 nt, Human
agugcuuuagagaaauggugcu

SEQ ID NO: 785717 - RNA, 22 nt, Human
cacugagcugauagaauuccag

SEQ ID NO: 785718 - RNA, 20 nt, Human
ucucagcauaagaacccuuc

SEQ ID NO: 785719 - RNA, 22 nt, Human
auuaguaaaacauuguauaugu

SEQ ID NO: 785720 - RNA, 22 nt, Human
uugaaaggguuaaagugguaaa

SEQ ID NO: 785721 - RNA, 20 nt, Human
accaauguuagcuuaguacu

SEQ ID NO: 785722 - RNA, 22 nt, Human
ucucucuuuuuaaucauguaau

SEQ ID NO: 785723 - RNA, 22 nt, Human
ggaggggagucucccaaagccg

SEQ ID NO: 785724 - RNA, 22 nt, Human
gagaaaugcaugcaugucauca

SEQ ID NO: 785725 - RNA, 17 nt, Human
ucaggauguagcaguag

SEQ ID NO: 785726 - RNA, 22 nt, Human
gccaggagcaugucauuguuga

SEQ ID NO: 785727 - RNA, 22 nt, Human
ucauuucuccgaccugcugucc

SEQ ID NO: 785728 - RNA, 22 nt, Human
uggaaauggaucugaugagucu

SEQ ID NO: 785729 - RNA, 22 nt, Human
ccaggagaagcaucugagugua

SEQ ID NO: 785730 - RNA, 22 nt, Human
cagggagggacaauugucaccu

SEQ ID NO: 785731 - RNA, 22 nt, Human
aucaggaucugggagccugaaa

SEQ ID NO: 785732 - RNA, 22 nt, Human
gcccaggaguuggaggcugcag

SEQ ID NO: 785733 - RNA, 22 nt, Human
agugcuuucccugaaaccuucc

SEQ ID NO: 785734 - RNA, 22 nt, Human
uuugacaucuaagaauucuuac

SEQ ID NO: 785735 - RNA, 22 nt, Human
auuuugaugcuaucuaaugaau

SEQ ID NO: 785736 - RNA, 22 nt, Human
uccaggagggguaggcaguaug

SEQ ID NO: 785737 - RNA, 22 nt, Human
cuacccagauccaggauggcua

SEQ ID NO: 785738 - RNA, 22 nt, Human
cagcagagggagccauugaaau

SEQ ID NO: 785739 - RNA, 22 nt, Human
gcugccagccaacuugcugugc

SEQ ID NO: 785740 - RNA, 22 nt, Human
auauucuuccaaaacaucauuu

SEQ ID NO: 785741 - RNA, 20 nt, Human
cugcugugguccuuuauuuu

SEQ ID NO: 785742 - RNA, 22 nt, Human
aaaggaagauugagcuuuucca

SEQ ID NO: 785743 - RNA, 22 nt, Human
cuuuggcacagucucauuugau

SEQ ID NO: 785744 - RNA, 22 nt, Human
ggaggagguggguuaaguugua

SEQ ID NO: 785745 - RNA, 22 nt, Human
gagggagucugugcaaagaauu

SEQ ID NO: 785746 - RNA, 23 nt, Human
uuucaacuccugccauuauuucu

SEQ ID NO: 785747 - RNA, 22 nt, Human
gcaggaagcauagaagaaugcc

SEQ ID NO: 785748 - RNA, 22 nt, Human
aucuuucuauuucuaaaaacua

SEQ ID NO: 785749 - RNA, 20 nt, Human
cagaggcauuuucagacucu

SEQ ID NO: 785750 - RNA, 22 nt, Human
acuuugcagggcuugauaucca

SEQ ID NO: 785751 - RNA, 22 nt, Human
ucuccucucuuaccugguacaa

SEQ ID NO: 785752 - RNA, 22 nt, Human
cacucaggcugugucaggagga

SEQ ID NO: 785753 - RNA, 22 nt, Human
gagagcuguuuaucuucuucaa

SEQ ID NO: 785754 - RNA, 22 nt, Human
ugcugcuguauccuuaguguca

SEQ ID NO: 785755 - RNA, 20 nt, Human
ucuggcaggugaacgagcug

SEQ ID NO: 785756 - RNA, 22 nt, Human
ucagugugaguaccaugcucag

SEQ ID NO: 785757 - RNA, 22 nt, Human
aggcuagcuuuggcucaguaaa

SEQ ID NO: 785758 - RNA, 22 nt, Human
caaauagugucacauugugagg

SEQ ID NO: 785759 - RNA, 22 nt, Human
uugacacagaucaauauucaac

SEQ ID NO: 785760 - RNA, 22 nt, Human
gaucauuuacuuguucuggacu

SEQ ID NO: 785761 - RNA, 22 nt, Human
cccaggaaacccgaaggcgacc

SEQ ID NO: 785762 - RNA, 22 nt, Human
auccaugaagguacuucucagg

SEQ ID NO: 785763 - RNA, 22 nt, Human
cuguuucaagugaagucagaca

SEQ ID NO: 785764 - RNA, 22 nt, Human
cugagcugggaguagagacucu

SEQ ID NO: 785765 - RNA, 22 nt, Human
cuugcugggguaagucugugcu

SEQ ID NO: 785766 - RNA, 22 nt, Human
acaaaugucuccucuuuuguua

SEQ ID NO: 785767 - RNA, 20 nt, Human
aggcaccugucacaggugag

SEQ ID NO: 785768 - RNA, 22 nt, Human
aaagccauugaacuguacuuua

SEQ ID NO: 785769 - RNA, 20 nt, Human
aggaggggauagaaucaaag

SEQ ID NO: 785770 - RNA, 22 nt, Human
gaggcugcuguuagcccugggc

SEQ ID NO: 785771 - RNA, 22 nt, Human
gugaaggacuagcauggagggc

SEQ ID NO: 785772 - RNA, 22 nt, Human
gcaugucaugucauguaggaau

SEQ ID NO: 785773 - RNA, 22 nt, Human
ucugaaaugcaaauuugacuga

SEQ ID NO: 785774 - RNA, 22 nt, Human
uuucaaaauuuugcagugguaa

SEQ ID NO: 785775 - RNA, 22 nt, Human
uucuaugccauguucagcuacu

SEQ ID NO: 785776 - RNA, 22 nt, Human
uuugaaagggaaauaaacuccu

SEQ ID NO: 785777 - RNA, 22 nt, Human
auugaaagguuuugagcagaua

SEQ ID NO: 785778 - RNA, 22 nt, Human
ggugaaggucagagcaggaaaa

SEQ ID NO: 785779 - RNA, 22 nt, Human
uuuggaauuggaaagugcugug

SEQ ID NO: 785780 - RNA, 19 nt, Human
cauuuuaagcauccccagu

SEQ ID NO: 785781 - RNA, 22 nt, Human
auuuuacuuugugaauauugac

SEQ ID NO: 785782 - RNA, 22 nt, Human
gcaucuaauccaguccagcauc

SEQ ID NO: 785783 - RNA, 22 nt, Human
augcugugccuucucugugcca

SEQ ID NO: 785784 - RNA, 22 nt, Human
cccaggaggcagagauagcagu

SEQ ID NO: 785785 - RNA, 22 nt, Human
caggcagcauuuacucugauga

SEQ ID NO: 785786 - RNA, 22 nt, Human
uauaucaccaaaaacaguucug

SEQ ID NO: 785787 - RNA, 22 nt, Human
uggcagcuggaucccaaggcag

SEQ ID NO: 785788 - RNA, 22 nt, Human
cccuggaggucagaggccuggg

SEQ ID NO: 785789 - RNA, 22 nt, Human
augaggcaucugcagucacuag

SEQ ID NO: 785790 - RNA, 22 nt, Human
uugaauaguuuuggauagcaua

SEQ ID NO: 785791 - RNA, 21 nt, Human
agccuguugguuuacugcuca

SEQ ID NO: 785792 - RNA, 22 nt, Human
uagcacaucuggcgcuuauagg

SEQ ID NO: 785793 - RNA, 22 nt, Human
uccaggagguuuggaggaagca

SEQ ID NO: 785794 - RNA, 22 nt, Human
aggcugcugccuuggagagugu

SEQ ID NO: 785795 - RNA, 21 nt, Human
cugcuguggcccccgacaugc

SEQ ID NO: 785796 - RNA, 22 nt, Human
gaggccaaucaauagggcaaua

SEQ ID NO: 785797 - RNA, 22 nt, Human
gccucugcaauuacauugugcc

SEQ ID NO: 785798 - RNA, 22 nt, Human
uccaggagaccagauguaggcc

SEQ ID NO: 785799 - RNA, 22 nt, Human
uugcaggauuuuagagaugaca

SEQ ID NO: 785800 - RNA, 22 nt, Human
aaguuugcauagauuaagcauu

SEQ ID NO: 785801 - RNA, 23 nt, Human
cccaggagccugaguccucucug

SEQ ID NO: 785802 - RNA, 22 nt, Human
ggggcagcuaccggaaguaggg

SEQ ID NO: 785803 - RNA, 22 nt, Human
aaggagaguacaggaguuggua

SEQ ID NO: 785804 - RNA, 22 nt, Human
uaaacauuuguuauucuuguuu

SEQ ID NO: 785805 - RNA, 22 nt, Human
agggagcucaguuggaagcggu

SEQ ID NO: 785806 - RNA, 22 nt, Human
aacaguaaagacagaauuuauc

SEQ ID NO: 785807 - RNA, 21 nt, Human
auaagcaugcugauuacauuu

SEQ ID NO: 785808 - RNA, 22 nt, Human
ucugcaggaggcuggcugcagg

SEQ ID NO: 785809 - RNA, 22 nt, Human
uagugcuugagucucuccguac

SEQ ID NO: 785810 - RNA, 22 nt, Human
uuuggacuuagccugcagaauu

SEQ ID NO: 785811 - RNA, 22 nt, Human
uauuuguugaguuguuaugucu

SEQ ID NO: 785812 - RNA, 22 nt, Human
caggagaaauguggcugcuacc

SEQ ID NO: 785813 - RNA, 18 nt, Human
ggucuuuaggucaguguc

SEQ ID NO: 785814 - RNA, 20 nt, Human
gggugggagagucugagggu

SEQ ID NO: 785815 - RNA, 22 nt, Human
aggaagcugccugggaugggaa

SEQ ID NO: 785816 - RNA, 22 nt, Human
caggaugguggcaugaucagaa

SEQ ID NO: 785817 - RNA, 22 nt, Human
uggcagcugugcuucauucuuu

SEQ ID NO: 785818 - RNA, 22 nt, Human
acccaggaggcaagguugcagu

SEQ ID NO: 785819 - RNA, 22 nt, Human
gugcugugugauccaugcuggc

SEQ ID NO: 785820 - RNA, 22 nt, Human
gggcagcucucacagcagccaa

SEQ ID NO: 785821 - RNA, 21 nt, Human
uggaggaauaaagcacagaag

SEQ ID NO: 785822 - RNA, 22 nt, Human
cuucugagcagaccuccugggg

SEQ ID NO: 785823 - RNA, 22 nt, Human
guuugcauuuauuagucuucug

SEQ ID NO: 785824 - RNA, 22 nt, Human
aaauuauucucauguguuucuu

SEQ ID NO: 785825 - RNA, 22 nt, Human
ggguggagcuuggacaccagua

SEQ ID NO: 785826 - RNA, 22 nt, Human
gcagcugagcgugaggaagagu

SEQ ID NO: 785827 - RNA, 22 nt, Human
cugcuuccauaaauaaugugcu

SEQ ID NO: 785828 - RNA, 22 nt, Human
gagagucuagugcaccuaguuu

SEQ ID NO: 785829 - RNA, 22 nt, Human
cccaggagguguagcugcgugg

SEQ ID NO: 785830 - RNA, 22 nt, Human
agugcuuuagcauccaacuguc

SEQ ID NO: 785831 - RNA, 22 nt, Human
caugucuguguacacaugcaca

SEQ ID NO: 785832 - RNA, 22 nt, Human
acccaggacuuggcaaccucau

SEQ ID NO: 785833 - RNA, 19 nt, Human
ucaucucacagggccuggc

SEQ ID NO: 785834 - RNA, 22 nt, Human
auuuucagagacaucuggacuu

SEQ ID NO: 785835 - RNA, 22 nt, Human
uacauaguauucacauuguuuu

SEQ ID NO: 785836 - RNA, 22 nt, Human
uuccaugaaagugaaauggagc

SEQ ID NO: 785837 - RNA, 22 nt, Human
agcuaccuggcuuaucacuguc

SEQ ID NO: 785838 - RNA, 22 nt, Human
cuuuccaagaaugcagauaccu

SEQ ID NO: 785839 - RNA, 22 nt, Human
ccaggagagcauugcacagagg

SEQ ID NO: 785840 - RNA, 22 nt, Human
uucacagaugccugaugugugg

SEQ ID NO: 785841 - RNA, 22 nt, Human
acuuaaaaagaaucuuuucacg

SEQ ID NO: 785842 - RNA, 22 nt, Human
accaggaggaaguguuaaugau

SEQ ID NO: 785843 - RNA, 22 nt, Human
aguguguccagaaaucuguauu

SEQ ID NO: 785844 - RNA, 19 nt, Human
ugagaggcuuaaggcagcu

SEQ ID NO: 785845 - RNA, 22 nt, Human
uauuuccaccuauuauuuucug

SEQ ID NO: 785846 - RNA, 22 nt, Human
aucuccaggcauuucaagagac

SEQ ID NO: 785847 - RNA, 22 nt, Human
uucuuucucaacaugaauguuu

SEQ ID NO: 785848 - RNA, 22 nt, Human
aagcagaggguauggccagguu

SEQ ID NO: 785849 - RNA, 22 nt, Human
aggagaggaaucauuauuacaa

SEQ ID NO: 785850 - RNA, 22 nt, Human
ugcuggaauaauuucauguuaa

SEQ ID NO: 785851 - RNA, 22 nt, Human
uuucacuagaacguucuuguuu

SEQ ID NO: 785852 - RNA, 22 nt, Human
gccaggaggcugcuguguaggc

SEQ ID NO: 785853 - RNA, 22 nt, Human
ggcagcuuucucacccaugacc

SEQ ID NO: 785854 - RNA, 22 nt, Human
aauuuuaaucaguggugcugag

SEQ ID NO: 785855 - RNA, 22 nt, Human
uuagccauuaaauuacaaggug

SEQ ID NO: 785856 - RNA, 22 nt, Human
aggcagcuuaagcccuggccca

SEQ ID NO: 785857 - RNA, 22 nt, Human
uauaucauggagauuaacauuc

SEQ ID NO: 785858 - RNA, 22 nt, Human
uugcugaaaucuaugacauccu

SEQ ID NO: 785859 - RNA, 22 nt, Human
uagggcagaguccaggaugggc

SEQ ID NO: 785860 - RNA, 22 nt, Human
uccaggagugauaaggccacug

SEQ ID NO: 785861 - RNA, 22 nt, Human
uccaggagggauugggcugugg

SEQ ID NO: 785862 - RNA, 22 nt, Human
gaaaggcaguacagcugagccu

SEQ ID NO: 785863 - RNA, 22 nt, Human
gguggagcuggaccaggagagg

SEQ ID NO: 785864 - RNA, 18 nt, Human
ucauuuguuuugcaugaa

SEQ ID NO: 785865 - RNA, 19 nt, Human
ccauggagagagaugcauu

SEQ ID NO: 785866 - RNA, 22 nt, Human
uccaggaggcagggcugugccc

SEQ ID NO: 785867 - RNA, 22 nt, Human
gggagucugggcuagacuccuu

SEQ ID NO: 785868 - RNA, 21 nt, Human
ugaaaugagaaugcugagcac

SEQ ID NO: 785869 - RNA, 22 nt, Human
aauuuuaagcauaugacugguu

SEQ ID NO: 785870 - RNA, 22 nt, Human
ugaacaguuucaagaaaacuuu

SEQ ID NO: 785871 - RNA, 22 nt, Human
uucucuuugacauuauucaggu

SEQ ID NO: 785872 - RNA, 22 nt, Human
uucagcaagaccaccauguacc

SEQ ID NO: 785873 - RNA, 22 nt, Human
aaaggccauuacuugcuuuuag

SEQ ID NO: 785874 - RNA, 22 nt, Human
uucuccucuguuggccuucccu

SEQ ID NO: 785875 - RNA, 22 nt, Human
gcagcugcuggagggaggcagg

SEQ ID NO: 785876 - RNA, 22 nt, Human
agggugguucuuuuaguggaag

SEQ ID NO: 785877 - RNA, 22 nt, Human
uacugccuggagcauuggugcu

SEQ ID NO: 785878 - RNA, 22 nt, Human
uagggaugagccaguggguagu

SEQ ID NO: 785879 - RNA, 21 nt, Human
ggcagcguguggacaggaagg

SEQ ID NO: 785880 - RNA, 19 nt, Human
uccucagugacaaccucag

SEQ ID NO: 785881 - RNA, 22 nt, Human
uuugaaagcaggugugggaggg

SEQ ID NO: 785882 - RNA, 22 nt, Human
uguuuuaagagcgcacuuuaua

SEQ ID NO: 785883 - RNA, 22 nt, Human
acagugcuggcuacaacccugg

SEQ ID NO: 785884 - RNA, 22 nt, Human
uugcauuugagaaaguucuccu

SEQ ID NO: 785885 - RNA, 21 nt, Human
gacaggacuagaccagagcuc

SEQ ID NO: 785886 - RNA, 22 nt, Human
ugaggcaguauucuccauucca

SEQ ID NO: 785887 - RNA, 23 nt, Human
agaugagccaacaccuccaugcc

SEQ ID NO: 785888 - RNA, 22 nt, Human
ucauuuauaaggaugcaauuaa

SEQ ID NO: 785889 - RNA, 22 nt, Human
aggcacaguuucauccccgggc

SEQ ID NO: 785890 - RNA, 22 nt, Human
cugacccauauaagaguggagg

SEQ ID NO: 785891 - RNA, 22 nt, Human
guuauauauaguauuucucuga

SEQ ID NO: 785892 - RNA, 22 nt, Human
uuugaaaucuaaucaaggaaca

SEQ ID NO: 785893 - RNA, 22 nt, Human
cucugcauuuuaacagaugauu

SEQ ID NO: 785894 - RNA, 22 nt, Human
uagcuuuccuuguugccugugc

SEQ ID NO: 785895 - RNA, 22 nt, Human
agaggacaaaaugagaagugcu

SEQ ID NO: 785896 - RNA, 18 nt, Human
uaggagagaauuuauuua

SEQ ID NO: 785897 - RNA, 19 nt, Human
uuugcagugguuccuuugu

SEQ ID NO: 785898 - RNA, 22 nt, Human
aaggccagacaggaccacaucu

SEQ ID NO: 785899 - RNA, 22 nt, Human
gaaucucaaggcuugugaggau

SEQ ID NO: 785900 - RNA, 22 nt, Human
cuucaggauuuaggaagaugaa

SEQ ID NO: 785901 - RNA, 22 nt, Human
cugacuguaauucuguucuuaa

SEQ ID NO: 785902 - RNA, 22 nt, Human
ucugggaauuuauuggcacuuu

SEQ ID NO: 785903 - RNA, 22 nt, Human
ugcugcugaucauuuauagucu

SEQ ID NO: 785904 - RNA, 22 nt, Human
gaggccagaagugccucgggcu

SEQ ID NO: 785905 - RNA, 22 nt, Human
uuugaaaggagcuuuauccaga

SEQ ID NO: 785906 - RNA, 22 nt, Human
ggugagggaguggaacgaggug

SEQ ID NO: 785907 - RNA, 22 nt, Human
uugagaagaggcuuuguaggaa

SEQ ID NO: 785908 - RNA, 22 nt, Human
gcagaggagaugaagauacuuu

SEQ ID NO: 785909 - RNA, 22 nt, Human
agacaggagagggaacugccgg

SEQ ID NO: 785910 - RNA, 22 nt, Human
caggcagcugacugucagauau

SEQ ID NO: 785911 - RNA, 22 nt, Human
cuugcugugugguguucucaga

SEQ ID NO: 785912 - RNA, 22 nt, Human
cacaaugugguuugucaucuuu

SEQ ID NO: 785913 - RNA, 22 nt, Human
cagaagaggacuggguagcuca

SEQ ID NO: 785914 - RNA, 22 nt, Human
ugacccauggucugaucauagg

SEQ ID NO: 785915 - RNA, 22 nt, Human
gaucuucuauguaaugaagugu

SEQ ID NO: 785916 - RNA, 22 nt, Human
ucucuucucuagugagcaacug

SEQ ID NO: 785917 - RNA, 21 nt, Human
gaacauuuggguuguuucuac

SEQ ID NO: 785918 - RNA, 22 nt, Human
caaauacuggguaaguuaauuu

SEQ ID NO: 785919 - RNA, 22 nt, Human
uugaaggacauccuauuucuag

SEQ ID NO: 785920 - RNA, 19 nt, Human
ggcagcuggacgcuguuca

SEQ ID NO: 785921 - RNA, 22 nt, Human
cccaggaaaugaacuucugauu

SEQ ID NO: 785922 - RNA, 22 nt, Human
cuugaaguugcaaaacauuaau

SEQ ID NO: 785923 - RNA, 22 nt, Human
ucugcuguaaagaauuucugcc

SEQ ID NO: 785924 - RNA, 23 nt, Human
gggcaguuauguuguccuuggcu

SEQ ID NO: 785925 - RNA, 22 nt, Human
gggcacagaagucuaagacauc

SEQ ID NO: 785926 - RNA, 22 nt, Human
agugcuuugagcguuugaaaag

SEQ ID NO: 785927 - RNA, 22 nt, Human
aaggagagguuguccguguugu

SEQ ID NO: 785928 - RNA, 22 nt, Human
agcccaggcagagggaugcuug

SEQ ID NO: 785929 - RNA, 22 nt, Human
uuaacauacaucaugaacaaug

SEQ ID NO: 785930 - RNA, 22 nt, Human
aaggcagccgugugacugcaug

SEQ ID NO: 785931 - RNA, 22 nt, Human
uccauuuuagagaugaagaaac

SEQ ID NO: 785932 - RNA, 22 nt, Human
aggcaguuguagagagggcucu

SEQ ID NO: 785933 - RNA, 22 nt, Human
gauaaugaugacaaugacaacc

SEQ ID NO: 785934 - RNA, 22 nt, Human
uauuuucuggacagucuugcuu

SEQ ID NO: 785935 - RNA, 22 nt, Human
auguuucagauacagaucaaau

SEQ ID NO: 785936 - RNA, 22 nt, Human
agaccuggauuccaauccuacc

SEQ ID NO: 785937 - RNA, 22 nt, Human
ucaggagacauucuuaaaguag

SEQ ID NO: 785938 - RNA, 22 nt, Human
aacaucuacuaagugccaggca

SEQ ID NO: 785939 - RNA, 22 nt, Human
gaaggccauugcguccugggau

SEQ ID NO: 785940 - RNA, 22 nt, Human
gagagggagccagccaggaacc

SEQ ID NO: 785941 - RNA, 22 nt, Human
ccaggacagugaacauguaaga

SEQ ID NO: 785942 - RNA, 19 nt, Human
gugcuuuuuaagagcucag

SEQ ID NO: 785943 - RNA, 22 nt, Human
ggaggcaggaaagacagguuca

SEQ ID NO: 785944 - RNA, 22 nt, Human
auacaacuuuacaugcaauucc

SEQ ID NO: 785945 - RNA, 23 nt, Human
cugcugugaaacaugguuuuggu

SEQ ID NO: 785946 - RNA, 22 nt, Human
acacuaaugagaaaggaauuaa

SEQ ID NO: 785947 - RNA, 22 nt, Human
acaacauucuuaaauacacuga

SEQ ID NO: 785948 - RNA, 22 nt, Human
uggagaggagcaccauggccau

SEQ ID NO: 785949 - RNA, 22 nt, Human
gagagaaaugugcaguuugggc

SEQ ID NO: 785950 - RNA, 22 nt, Human
auguucuuguucaaaugucagu

SEQ ID NO: 785951 - RNA, 22 nt, Human
uaggcagcauggauucugaaua

SEQ ID NO: 785952 - RNA, 22 nt, Human
auugaggcagcauaguucaggg

SEQ ID NO: 785953 - RNA, 22 nt, Human
ucugaacuccagcccugcucuc

SEQ ID NO: 785954 - RNA, 22 nt, Human
cagugaaaucacaacuuuaguu

SEQ ID NO: 785955 - RNA, 22 nt, Human
ggccagcucugcacagcagcug

SEQ ID NO: 785956 - RNA, 22 nt, Human
cugaggaagacagcagcugugu

SEQ ID NO: 785957 - RNA, 22 nt, Human
uaaaacuuaacuauccagauua

SEQ ID NO: 785958 - RNA, 22 nt, Human
uaagcugugggagauuggcaua

SEQ ID NO: 785959 - RNA, 22 nt, Human
gaccauuugcuaguaaauugca

SEQ ID NO: 785960 - RNA, 23 nt, Human
ucagucuucccugucaguaauag

SEQ ID NO: 785961 - RNA, 22 nt, Human
aucaggauagugguuaccuggg

SEQ ID NO: 785962 - RNA, 19 nt, Human
uggcagggagaguuugaag

SEQ ID NO: 785963 - RNA, 22 nt, Human
auugcuaggaacagguugcacc

SEQ ID NO: 785964 - RNA, 22 nt, Human
uuccuuaggcuguuugcagugc

SEQ ID NO: 785965 - RNA, 22 nt, Human
gcaggagaacaaagcaagcugc

SEQ ID NO: 785966 - RNA, 22 nt, Human
uucaggauggaguaccuuuuau

SEQ ID NO: 785967 - RNA, 22 nt, Human
uuugaagucagacacugcuuug

SEQ ID NO: 785968 - RNA, 22 nt, Human
aucuuucagggccauuuguauu

SEQ ID NO: 785969 - RNA, 22 nt, Human
augacaguucuacacuuaaucu

SEQ ID NO: 785970 - RNA, 18 nt, Human
uugagggaggggcagagu

SEQ ID NO: 785971 - RNA, 22 nt, Human
ugcuuuggccacuagaauucag

SEQ ID NO: 785972 - RNA, 22 nt, Human
uccaggaguuugagacugcagu

SEQ ID NO: 785973 - RNA, 22 nt, Human
aggguagggccguagggccaug

SEQ ID NO: 785974 - RNA, 22 nt, Human
ucugcaggcuguacaggaagca

SEQ ID NO: 785975 - RNA, 22 nt, Human
aguucucaagacaauuaccugu

SEQ ID NO: 785976 - RNA, 22 nt, Human
ugaaagcacaaguucuaacagg

SEQ ID NO: 785977 - RNA, 22 nt, Human
aggcuagcaaugggagaugagu

SEQ ID NO: 785978 - RNA, 21 nt, Human
ucuuccuccacagcgugccac

SEQ ID NO: 785979 - RNA, 22 nt, Human
ucucaggaaauaggauuugagu

SEQ ID NO: 785980 - RNA, 22 nt, Human
cccauucauccucgcuuccuuc

SEQ ID NO: 785981 - RNA, 22 nt, Human
ccagggaguuuccaaucugaga

SEQ ID NO: 785982 - RNA, 22 nt, Human
acaggacuguggaaggaucucu

SEQ ID NO: 785983 - RNA, 18 nt, Human
aauuuccauaugaauugc

SEQ ID NO: 785984 - RNA, 22 nt, Human
auugaaagaguuuucugcugca

SEQ ID NO: 785985 - RNA, 22 nt, Human
ucaggauguccaaaauccagcc

SEQ ID NO: 785986 - RNA, 22 nt, Human
agagggagugaaauggaauaga

SEQ ID NO: 785987 - RNA, 22 nt, Human
gcucaggaucccaggggugugc

SEQ ID NO: 785988 - RNA, 21 nt, Human
uccaggagcacgggacuagga

SEQ ID NO: 785989 - RNA, 22 nt, Human
cuauuacauuucuggacauuca

SEQ ID NO: 785990 - RNA, 22 nt, Human
aauuuguuaaaagugagugaca

SEQ ID NO: 785991 - RNA, 21 nt, Human
gcugcaucaaucuacccaggg

SEQ ID NO: 785992 - RNA, 22 nt, Human
agacagugcaagaagagcaggc

SEQ ID NO: 785993 - RNA, 22 nt, Human
auugaaagagaauguagcucuu

SEQ ID NO: 785994 - RNA, 22 nt, Human
guucuugccagcauccucaggu

SEQ ID NO: 785995 - RNA, 22 nt, Human
gcuguguuugacaguagcagac

SEQ ID NO: 785996 - RNA, 22 nt, Human
agcccagguucuaaagccaaac

SEQ ID NO: 785997 - RNA, 22 nt, Human
uccaggagguaugaguggcccc

SEQ ID NO: 785998 - RNA, 22 nt, Human
uuucaguguaucuuccaaaagc

SEQ ID NO: 785999 - RNA, 22 nt, Human
aguggcagagguugacugcagu

SEQ ID NO: 786000 - RNA, 22 nt, Human
cugcuuuggacaacuauucuug

SEQ ID NO: 786001 - RNA, 22 nt, Human
aggcagcagucaugaggaaaga

SEQ ID NO: 786002 - RNA, 22 nt, Human
ugaaucaguauaaauucucaaa

SEQ ID NO: 786003 - RNA, 22 nt, Human
gggcagcuggauaguuuuaaau

SEQ ID NO: 786004 - RNA, 22 nt, Human
uguuugaacugaauaacauagu

SEQ ID NO: 786005 - RNA, 22 nt, Human
ugaggggaaggcaugauaaaua

SEQ ID NO: 786006 - RNA, 22 nt, Human
guuguuuuuguucucuauagcu

SEQ ID NO: 786007 - RNA, 22 nt, Human
uacaaaguaauguauaauaucg

SEQ ID NO: 786008 - RNA, 23 nt, Human
aggauguaggauguauggcagag

SEQ ID NO: 786009 - RNA, 23 nt, Human
ugaaggccuggaggacgcguugu

SEQ ID NO: 786010 - RNA, 22 nt, Human
caggcagcugcuggguucagcc

SEQ ID NO: 786011 - RNA, 22 nt, Human
uccaggagacacccuugugugu

SEQ ID NO: 786012 - RNA, 17 nt, Human
cagacaggcugucaccc

SEQ ID NO: 786013 - RNA, 22 nt, Human
aggcagaucacuugaggccagg

SEQ ID NO: 786014 - RNA, 19 nt, Human
agauggcaaaaugcaaaga

SEQ ID NO: 786015 - RNA, 22 nt, Human
acaauucugaugguuucccagu

SEQ ID NO: 786016 - RNA, 22 nt, Human
augcagcuucaggauuaugaug

SEQ ID NO: 786017 - RNA, 20 nt, Human
aggaagcugagauguagagg

SEQ ID NO: 786018 - RNA, 22 nt, Human
gaagcagcugccagagaugucu

SEQ ID NO: 786019 - RNA, 22 nt, Human
aggcagcuggcagcacccaggg

SEQ ID NO: 786020 - RNA, 22 nt, Human
cuuugcaauagaggcacacaug

SEQ ID NO: 786021 - RNA, 22 nt, Human
uuugcaaauaccaugaaacuug

SEQ ID NO: 786022 - RNA, 22 nt, Human
gucaggaugacaagugcuuuca

SEQ ID NO: 786023 - RNA, 22 nt, Human
auggagggugucagagagcgaa

SEQ ID NO: 786024 - RNA, 22 nt, Human
uccauuuucaucucauguauaa

SEQ ID NO: 786025 - RNA, 22 nt, Human
ucuuugcaggccaaauuguuaa

SEQ ID NO: 786026 - RNA, 22 nt, Human
ucaaauaaugccauucaucauc

SEQ ID NO: 786027 - RNA, 22 nt, Human
ucucaggaucuaauacauggua

SEQ ID NO: 786028 - RNA, 22 nt, Human
aggagggacaccaauauauguu

SEQ ID NO: 786029 - RNA, 22 nt, Human
cuggcugugcagucuuccagaa

SEQ ID NO: 786030 - RNA, 22 nt, Human
gaggaaccacucugagaagcca

SEQ ID NO: 786031 - RNA, 22 nt, Human
uuuuuaguagagguggguuuca

SEQ ID NO: 786032 - RNA, 22 nt, Human
cccuugcaucccauguguggcc

SEQ ID NO: 786033 - RNA, 22 nt, Human
acccaggagagagcuauaaaau

SEQ ID NO: 786034 - RNA, 22 nt, Human
gcuguguuuuauguuagguuaa

SEQ ID NO: 786035 - RNA, 22 nt, Human
ggcagcuauuccaagcagcacu

SEQ ID NO: 786036 - RNA, 22 nt, Human
ggaagaggaggagccaggcuuu

SEQ ID NO: 786037 - RNA, 22 nt, Human
ggaggagggguuuacauuggaa

SEQ ID NO: 786038 - RNA, 22 nt, Human
gaggccagggaugcaaugagag

SEQ ID NO: 786039 - RNA, 22 nt, Human
augaaggcuguguagauggaug

SEQ ID NO: 786040 - RNA, 22 nt, Human
uggcagcugucuguggggucuc

SEQ ID NO: 786041 - RNA, 22 nt, Human
acaguuaucuuugaaauagaga

SEQ ID NO: 786042 - RNA, 22 nt, Human
aagggcaggagaagacggauau

SEQ ID NO: 786043 - RNA, 22 nt, Human
cccuggaggcuggaggcaguag

SEQ ID NO: 786044 - RNA, 22 nt, Human
aggccagaaauuuggaguaugu

SEQ ID NO: 786045 - RNA, 22 nt, Human
gucccauaaguagugcaacuug

SEQ ID NO: 786046 - RNA, 22 nt, Human
auucuucaucagagaugcacua

SEQ ID NO: 786047 - RNA, 22 nt, Human
uggaguucucaggugagggcuu

SEQ ID NO: 786048 - RNA, 22 nt, Human
gccaggaggucagccccucaac

SEQ ID NO: 786049 - RNA, 22 nt, Human
cccaggaggccaagguugcagu

SEQ ID NO: 786050 - RNA, 21 nt, Human
cccaggaguccuauuuaaaug

SEQ ID NO: 786051 - RNA, 22 nt, Human
aucacuguguauguauaugcag

SEQ ID NO: 786052 - RNA, 22 nt, Human
acaggagacccugcugguucug

SEQ ID NO: 786053 - RNA, 22 nt, Human
ggccagaggugguacauagcuu

SEQ ID NO: 786054 - RNA, 22 nt, Human
ucauucuugaucacuaguuagu

SEQ ID NO: 786055 - RNA, 21 nt, Human
uuugaaagcccuauguuuuca

SEQ ID NO: 786056 - RNA, 19 nt, Human
uucauucuuucuacuuacc

SEQ ID NO: 786057 - RNA, 22 nt, Human
gcauuuccugugcuuggcauau

SEQ ID NO: 786058 - RNA, 22 nt, Human
gaggggaaagugugaggcugcg

SEQ ID NO: 786059 - RNA, 22 nt, Human
uuagccauuuuauacaagugua

SEQ ID NO: 786060 - RNA, 22 nt, Human
aaggcaguaggaucuuccacag

SEQ ID NO: 786061 - RNA, 22 nt, Human
aagacugugucuauggcuacuc

SEQ ID NO: 786062 - RNA, 22 nt, Human
uauuuccauguuagaacuaagu

SEQ ID NO: 786063 - RNA, 22 nt, Human
ugaacaaacugcauucuucacu

SEQ ID NO: 786064 - RNA, 22 nt, Human
caugauuuugucuuguguuaau

SEQ ID NO: 786065 - RNA, 22 nt, Human
agugcuuuauguuguugugcaa

SEQ ID NO: 786066 - RNA, 22 nt, Human
cagugauggauauggagaaguc

SEQ ID NO: 786067 - RNA, 22 nt, Human
caggcagccaggggaccugucc

SEQ ID NO: 786068 - RNA, 22 nt, Human
guuuuauaggcuguugcuauau

SEQ ID NO: 786069 - RNA, 22 nt, Human
uucccucucacuuaaagcuugg

SEQ ID NO: 786070 - RNA, 22 nt, Human
aagacugucuuuucugagugac

SEQ ID NO: 786071 - RNA, 22 nt, Human
gcccaggagguggaggugcagu

SEQ ID NO: 786072 - RNA, 22 nt, Human
aucacaaaggcugcuucaugau

SEQ ID NO: 786073 - RNA, 17 nt, Human
guccuacccauggucua

SEQ ID NO: 786074 - RNA, 23 nt, Human
ucucaggacacacaugucuauca

SEQ ID NO: 786075 - RNA, 22 nt, Human
gacuucuauuaauaccucuacu

SEQ ID NO: 786076 - RNA, 22 nt, Human
uucuugcaggucacucacugag

SEQ ID NO: 786077 - RNA, 22 nt, Human
uucauucuugggaucagagagu

SEQ ID NO: 786078 - RNA, 22 nt, Human
ggacuucuaagugccagacacu

SEQ ID NO: 786079 - RNA, 22 nt, Human
gcacaauuauuuaugcaguaug

SEQ ID NO: 786080 - RNA, 22 nt, Human
cugcuguggaugcaggaccuca

SEQ ID NO: 786081 - RNA, 22 nt, Human
uucaugugaauauauuugucuu

SEQ ID NO: 786082 - RNA, 22 nt, Human
auuccaguuggguucuaauaca

SEQ ID NO: 786083 - RNA, 22 nt, Human
ucauuuguugaacuuuagugcg

SEQ ID NO: 786084 - RNA, 22 nt, Human
uggccaggcagguagaacggcc

SEQ ID NO: 786085 - RNA, 23 nt, Human
uggaggaaacacaucagaagacc

SEQ ID NO: 786086 - RNA, 22 nt, Human
gaaggggacuggcagcugcaga

SEQ ID NO: 786087 - RNA, 22 nt, Human
caugcugugcaucuugaugacc

SEQ ID NO: 786088 - RNA, 22 nt, Human
uuagaaagcuuuccauagucaa

SEQ ID NO: 786089 - RNA, 22 nt, Human
uugaaaggaauacagaggccua

SEQ ID NO: 786090 - RNA, 22 nt, Human
gaggcagcauucgcauagacag

SEQ ID NO: 786091 - RNA, 21 nt, Human
uuccagagauuguuucaccug

SEQ ID NO: 786092 - RNA, 22 nt, Human
auucauaacggcaaaugucacc

SEQ ID NO: 786093 - RNA, 22 nt, Human
uagcugcugcagcacagggagg

SEQ ID NO: 786094 - RNA, 22 nt, Human
ugaggcaggagguugagaacug

SEQ ID NO: 786095 - RNA, 22 nt, Human
cuuagaaaucgaacucagguua

SEQ ID NO: 786096 - RNA, 22 nt, Human
agggcagcccuucugggagggc

SEQ ID NO: 786097 - RNA, 22 nt, Human
gcaaauauucaagacuuuucca

SEQ ID NO: 786098 - RNA, 22 nt, Human
uuuggaauuggcauucuauucu

SEQ ID NO: 786099 - RNA, 20 nt, Human
ccucaggaugagggugagca

SEQ ID NO: 786100 - RNA, 22 nt, Human
uuauuucauugauuucuaagac

SEQ ID NO: 786101 - RNA, 22 nt, Human
aggcagagcuggguuuugaaau

SEQ ID NO: 786102 - RNA, 22 nt, Human
uuucaucuuccuuggcauaggu

SEQ ID NO: 786103 - RNA, 21 nt, Human
agcagaggcagaauguaugca

SEQ ID NO: 786104 - RNA, 22 nt, Human
gccugcagaacugugaggcaau

SEQ ID NO: 786105 - RNA, 22 nt, Human
aaggagagagcuuugcuggaac

SEQ ID NO: 786106 - RNA, 22 nt, Human
cagaccucaguccucaguagga

SEQ ID NO: 786107 - RNA, 22 nt, Human
cauuuguaguuaaaaaugucuc

SEQ ID NO: 786108 - RNA, 22 nt, Human
uucucagaggagucgggagcug

SEQ ID NO: 786109 - RNA, 20 nt, Human
gggagucuggaugaaagaug

SEQ ID NO: 786110 - RNA, 22 nt, Human
ccucugcucugguccaugugcu

SEQ ID NO: 786111 - RNA, 22 nt, Human
gaagaggaugacaggagccggu

SEQ ID NO: 786112 - RNA, 22 nt, Human
uagggcagagcuuguacacgau

SEQ ID NO: 786113 - RNA, 22 nt, Human
auggaaagugcauggaagucau

SEQ ID NO: 786114 - RNA, 22 nt, Human
uuugaaugcaggacauacagaa

SEQ ID NO: 786115 - RNA, 22 nt, Human
gcccaggaguugguggcugcag

SEQ ID NO: 786116 - RNA, 22 nt, Human
uggcagcagccauggaaggccc

SEQ ID NO: 786117 - RNA, 22 nt, Human
ugcaugugcccacucuggcuua

SEQ ID NO: 786118 - RNA, 18 nt, Human
gcagcugacacuggaguu

SEQ ID NO: 786119 - RNA, 22 nt, Human
uacaaaguagaaauucaguaaa

SEQ ID NO: 786120 - RNA, 22 nt, Human
gcuguggucugugagcuccaaa

SEQ ID NO: 786121 - RNA, 22 nt, Human
uuugaaaggaaguuaauacuuu

SEQ ID NO: 786122 - RNA, 22 nt, Human
cuacccaggcuggagugcagua

SEQ ID NO: 786123 - RNA, 22 nt, Human
gcucccagacugaccagaggug

SEQ ID NO: 786124 - RNA, 23 nt, Human
aaggccagaauuucaauggugcc

SEQ ID NO: 786125 - RNA, 22 nt, Human
auaguuugugaaacacagcagu

SEQ ID NO: 786126 - RNA, 22 nt, Human
aggcaagcugcagagaguccuu

SEQ ID NO: 786127 - RNA, 22 nt, Human
uuguaaaugaccuuuucuaauu

SEQ ID NO: 786128 - RNA, 22 nt, Human
uugaaaguuaucuagauucuga

SEQ ID NO: 786129 - RNA, 22 nt, Human
uucucagaugauucagauaaac

SEQ ID NO: 786130 - RNA, 22 nt, Human
cugcuuugggcagcuuuguggc

SEQ ID NO: 786131 - RNA, 22 nt, Human
aggcuggagggcaauggcaaga

SEQ ID NO: 786132 - RNA, 22 nt, Human
aaggcagccuuuguuugauuga

SEQ ID NO: 786133 - RNA, 22 nt, Human
guucuucaguaaaauuaaaugu

SEQ ID NO: 786134 - RNA, 18 nt, Human
caugucugcgccacaagg

SEQ ID NO: 786135 - RNA, 22 nt, Human
uucuucuucaagugcugcauuc

SEQ ID NO: 786136 - RNA, 22 nt, Human
uuucuucucgacaccuuauccc

SEQ ID NO: 786137 - RNA, 22 nt, Human
ccagagagaaauggauuugagu

SEQ ID NO: 786138 - RNA, 21 nt, Human
ccugcugugaucuuagugagu

SEQ ID NO: 786139 - RNA, 22 nt, Human
ugaguucuaguggcugcagauu

SEQ ID NO: 786140 - RNA, 22 nt, Human
aauacaguagguaauaguucau

SEQ ID NO: 786141 - RNA, 23 nt, Human
uagggcagcugggagggacaugc

SEQ ID NO: 786142 - RNA, 20 nt, Human
ucacaucuggcagcugauga

SEQ ID NO: 786143 - RNA, 17 nt, Human
uccaggagaggcaaugg

SEQ ID NO: 786144 - RNA, 23 nt, Human
gaggcacucaggaaaugugagug

SEQ ID NO: 786145 - RNA, 22 nt, Human
uguagaaagaauauguuucaua

SEQ ID NO: 786146 - RNA, 22 nt, Human
aggaagcucaaagccaugaugu

SEQ ID NO: 786147 - RNA, 22 nt, Human
guccucuggaagaugaguucuu

SEQ ID NO: 786148 - RNA, 20 nt, Human
cccaggagcugugccccauc

SEQ ID NO: 786149 - RNA, 22 nt, Human
ucaggagaaggcaauguggaaa

SEQ ID NO: 786150 - RNA, 23 nt, Human
auguauuuaaauuucagugauga

SEQ ID NO: 786151 - RNA, 22 nt, Human
uucauucugggcucuaaggaac

SEQ ID NO: 786152 - RNA, 22 nt, Human
ucuuugaauccuuuacaucuga

SEQ ID NO: 786153 - RNA, 22 nt, Human
uaugccugauaacugugucucu

SEQ ID NO: 786154 - RNA, 22 nt, Human
aggaaagguagcgugccagcag

SEQ ID NO: 786155 - RNA, 22 nt, Human
aaagccagagcaagcugucaca

SEQ ID NO: 786156 - RNA, 22 nt, Human
uaaauuauguuccauguccuuu

SEQ ID NO: 786157 - RNA, 22 nt, Human
uagcccagcaugagcagagcug

SEQ ID NO: 786158 - RNA, 22 nt, Human
uucaggaugacaccauguccag

SEQ ID NO: 786159 - RNA, 22 nt, Human
acccaggaaaacauggugcaga

SEQ ID NO: 786160 - RNA, 22 nt, Human
uucacauuggugauauguuucu

SEQ ID NO: 786161 - RNA, 22 nt, Human
uuuacauuucccucugucaguu

SEQ ID NO: 786162 - RNA, 22 nt, Human
uuugaaaguucuucugacacua

SEQ ID NO: 786163 - RNA, 19 nt, Human
aggcaggugcagagguccc

SEQ ID NO: 786164 - RNA, 22 nt, Human
uuucauugcagagucugugugc

SEQ ID NO: 786165 - RNA, 22 nt, Human
caggcagcagaggaguguggga

SEQ ID NO: 786166 - RNA, 22 nt, Human
gagggaggggagcuccacccuc

SEQ ID NO: 786167 - RNA, 22 nt, Human
ucugggaaccagugcggcuggg

SEQ ID NO: 786168 - RNA, 19 nt, Human
caggaaugagguaauggcu

SEQ ID NO: 786169 - RNA, 22 nt, Human
uguacauagaucuugaaaauua

SEQ ID NO: 786170 - RNA, 22 nt, Human
auucuuaauugccaugcuguau

SEQ ID NO: 786171 - RNA, 22 nt, Human
cauuuguaucauauguaucuua

SEQ ID NO: 786172 - RNA, 22 nt, Human
ccugcucagagcgucuugugug

SEQ ID NO: 786173 - RNA, 22 nt, Human
ucugggaaugaauaagaccugu

SEQ ID NO: 786174 - RNA, 22 nt, Human
uuccaugaaggagacugagaag

SEQ ID NO: 786175 - RNA, 22 nt, Human
cuuuuauuuugaauuaagggcu

SEQ ID NO: 786176 - RNA, 22 nt, Human
guggcagcaaaugccuggacua

SEQ ID NO: 786177 - RNA, 22 nt, Human
auuguuaugaaaauaagauguu

SEQ ID NO: 786178 - RNA, 22 nt, Human
agaccauggccauccuaggaaa

SEQ ID NO: 786179 - RNA, 22 nt, Human
uggcaaggccacaggugcaguu

SEQ ID NO: 786180 - RNA, 20 nt, Human
gccaggagggugugaugagc

SEQ ID NO: 786181 - RNA, 22 nt, Human
acauuuuuuagagucccacauu

SEQ ID NO: 786182 - RNA, 22 nt, Human
ucauacaucuguccuggagcuc

SEQ ID NO: 786183 - RNA, 22 nt, Human
ugaaucugauuucccuggaggc

SEQ ID NO: 786184 - RNA, 16 nt, Human
gcccaggacgggaggc

SEQ ID NO: 786185 - RNA, 22 nt, Human
ucaggagacuggcagugcccac

SEQ ID NO: 786186 - RNA, 22 nt, Human
uuuuuguagucauuagaagagg

SEQ ID NO: 786187 - RNA, 18 nt, Human
ccucagggagagagacgc

SEQ ID NO: 786188 - RNA, 22 nt, Human
gcugugcuugggaagaaucucu

SEQ ID NO: 786189 - RNA, 22 nt, Human
uugcaaaggggaauaaagcaau

SEQ ID NO: 786190 - RNA, 22 nt, Human
ccuggacucaggcugugggcac

SEQ ID NO: 786191 - RNA, 22 nt, Human
aaauuuucagagcacuagagaa

SEQ ID NO: 786192 - RNA, 22 nt, Human
ucugcuguauuagguugaacug

SEQ ID NO: 786193 - RNA, 22 nt, Human
aggcaacuuuuggggaugaugg

SEQ ID NO: 786194 - RNA, 22 nt, Human
ucuucaauuagauuuaccaauu

SEQ ID NO: 786195 - RNA, 22 nt, Human
aagauuauuuaagacaggaacc

SEQ ID NO: 786196 - RNA, 22 nt, Human
ucuggcaggucaaucauucuuu

SEQ ID NO: 786197 - RNA, 22 nt, Human
uucuuauagaagcaaccauugu

SEQ ID NO: 786198 - RNA, 22 nt, Human
ugcugagguuucgucugcuugc

SEQ ID NO: 786199 - RNA, 22 nt, Human
caggagaucuuaggaauucuua

SEQ ID NO: 786200 - RNA, 22 nt, Human
ggccaggagaggagggcacuga

SEQ ID NO: 786201 - RNA, 22 nt, Human
guucuucagauuccauuucagu

SEQ ID NO: 786202 - RNA, 22 nt, Human
uugguuuacuaggauucaaauu

SEQ ID NO: 786203 - RNA, 22 nt, Human
caaggccacugcucagguuucc

SEQ ID NO: 786204 - RNA, 22 nt, Human
cagagggcucuuggcugccugc

SEQ ID NO: 786205 - RNA, 22 nt, Human
caggaaugaggucguaaguguc

SEQ ID NO: 786206 - RNA, 22 nt, Human
ggagcaggagucucuugaauuu

SEQ ID NO: 786207 - RNA, 17 nt, Human
gagagcugcugcuuccg

SEQ ID NO: 786208 - RNA, 22 nt, Human
uugaacaguccuaagagacccu

SEQ ID NO: 786209 - RNA, 21 nt, Human
gggcagcucuguuuuauuuuc

SEQ ID NO: 786210 - RNA, 22 nt, Human
cagcugccuucugcgggaaguc

SEQ ID NO: 786211 - RNA, 22 nt, Human
uagaaauaaaucugcagcuggg

SEQ ID NO: 786212 - RNA, 22 nt, Human
auucuucaucacuaccuuguga

SEQ ID NO: 786213 - RNA, 21 nt, Human
uugaaaguaaauucagcagcu

SEQ ID NO: 786214 - RNA, 22 nt, Human
gcacagcucgagcucaggaggg

SEQ ID NO: 786215 - RNA, 22 nt, Human
cuugaaagucacaugcagcccu

SEQ ID NO: 786216 - RNA, 22 nt, Human
cacucuccagcacaccccauuu

SEQ ID NO: 786217 - RNA, 22 nt, Human
auuuguagugaagugaaaauaa

SEQ ID NO: 786218 - RNA, 22 nt, Human
uagcucuucaaucacugucucc

SEQ ID NO: 786219 - RNA, 22 nt, Human
auugugcaaauauuaucuguag

SEQ ID NO: 786220 - RNA, 22 nt, Human
acccaggaggugacacagggcu

SEQ ID NO: 786221 - RNA, 22 nt, Human
gcauucuuuuuaggagguuccu

SEQ ID NO: 786222 - RNA, 19 nt, Human
ugcauaaauuauauacuuu

SEQ ID NO: 786223 - RNA, 22 nt, Human
auucuucacauggauaggaucu

SEQ ID NO: 786224 - RNA, 22 nt, Human
auugucuuuccacugagaaguu

SEQ ID NO: 786225 - RNA, 22 nt, Human
gcugcccauuccacuggauggu

SEQ ID NO: 786226 - RNA, 22 nt, Human
agcagccuuugaucaucuggga

SEQ ID NO: 786227 - RNA, 22 nt, Human
cugagccagcuggcaugugcua

SEQ ID NO: 786228 - RNA, 23 nt, Human
uggacgccgacuuuggaggcgcu

SEQ ID NO: 786229 - RNA, 23 nt, Human
acugucugauauguuuuccauca

SEQ ID NO: 786230 - RNA, 22 nt, Human
cuggcugugcugcaggcuuugg

SEQ ID NO: 786231 - RNA, 22 nt, Human
auugcuguaaauuaucuuauua

SEQ ID NO: 786232 - RNA, 22 nt, Human
ugaacuccaaauacugcugauu

SEQ ID NO: 786233 - RNA, 22 nt, Human
uccaggagaaggccauccagcg

SEQ ID NO: 786234 - RNA, 22 nt, Human
ugcacauuaguguuugagaugc

SEQ ID NO: 786235 - RNA, 15 nt, Human
cuccaugauuuugca

SEQ ID NO: 786236 - RNA, 22 nt, Human
uaaauuauggcuggcagagcag

SEQ ID NO: 786237 - RNA, 22 nt, Human
uggaggggcaauggagcgcgga

SEQ ID NO: 786238 - RNA, 22 nt, Human
uuuaacagguaaaguaaaugug

SEQ ID NO: 786239 - RNA, 22 nt, Human
gagcaccucaauuugcuauuug

SEQ ID NO: 786240 - RNA, 22 nt, Human
uuuaucuuuaggacuuugcaga

SEQ ID NO: 786241 - RNA, 22 nt, Human
cgaggcaggcaggcggaggaua

SEQ ID NO: 786242 - RNA, 22 nt, Human
uugcugugaaaccaugggaagu

SEQ ID NO: 786243 - RNA, 22 nt, Human
ggaggggaacuaaucccgugac

SEQ ID NO: 786244 - RNA, 22 nt, Human
uaaauuguuuucuagaaguugu

SEQ ID NO: 786245 - RNA, 22 nt, Human
acagucuugcuguauggucagg

SEQ ID NO: 786246 - RNA, 21 nt, Human
cccacggaaugaugaggcacu

SEQ ID NO: 786247 - RNA, 22 nt, Human
ugucugugaccucuuuggagcc

SEQ ID NO: 786248 - RNA, 21 nt, Human
gugcuuuuccuuaauguucuu

SEQ ID NO: 786249 - RNA, 22 nt, Human
uuucaguuguccuguuaauagc

SEQ ID NO: 786250 - RNA, 22 nt, Human
ugcugaaagucccaaaucucau

SEQ ID NO: 786251 - RNA, 22 nt, Human
aaggaaccuggaguagagggag

SEQ ID NO: 786252 - RNA, 22 nt, Human
agcuagaauguuccuuuucauu

SEQ ID NO: 786253 - RNA, 22 nt, Human
ucuugcuaaagaccaacacauu

SEQ ID NO: 786254 - RNA, 22 nt, Human
ccaggagacaaagaugacugcu

SEQ ID NO: 786255 - RNA, 22 nt, Human
guguguuuagcauuagcagggg

SEQ ID NO: 786256 - RNA, 22 nt, Human
gaggcgagaagcuggagauggu

SEQ ID NO: 786257 - RNA, 22 nt, Human
gauggcaggugauagccgaguc

SEQ ID NO: 786258 - RNA, 22 nt, Human
uaaugcuuaacagcuggcuuuu

SEQ ID NO: 786259 - RNA, 22 nt, Human
cugccaucugagccaaaagugc

SEQ ID NO: 786260 - RNA, 22 nt, Human
uucuacaauaugaauaaugaag

SEQ ID NO: 786261 - RNA, 22 nt, Human
aggcacaguggcucacaccugu

SEQ ID NO: 786262 - RNA, 22 nt, Human
ucuuugaaagcuguucuagagu

SEQ ID NO: 786263 - RNA, 22 nt, Human
cuguguuugaugagaagccacc

SEQ ID NO: 786264 - RNA, 22 nt, Human
gucuuucuaugaugaacuguug

SEQ ID NO: 786265 - RNA, 22 nt, Human
auucuucauacagacaaguccu

SEQ ID NO: 786266 - RNA, 22 nt, Human
ucacaugaguauuauuuuccaa

SEQ ID NO: 786267 - RNA, 22 nt, Human
agugcuuugugcucucacugca

SEQ ID NO: 786268 - RNA, 23 nt, Human
ggagaggggugugggcaucuuua

SEQ ID NO: 786269 - RNA, 22 nt, Human
uagaaaugaauguuuaaaaguc

SEQ ID NO: 786270 - RNA, 22 nt, Human
cccaggagguggagguugcggu

SEQ ID NO: 786271 - RNA, 22 nt, Human
agcugcccugggcuggagaugg

SEQ ID NO: 786272 - RNA, 22 nt, Human
gggcagcuccuguggaauccac

SEQ ID NO: 786273 - RNA, 19 nt, Human
caggaugaucccaugacac

SEQ ID NO: 786274 - RNA, 22 nt, Human
uugaauaguguuuucaguauac

SEQ ID NO: 786275 - RNA, 22 nt, Human
uucaggauggcggauguugggg

SEQ ID NO: 786276 - RNA, 22 nt, Human
uuucaaacauaucuucauuacu

SEQ ID NO: 786277 - RNA, 22 nt, Human
uucucugaaggccaugcucacu

SEQ ID NO: 786278 - RNA, 22 nt, Human
cugguacaaaaugcugauauca

SEQ ID NO: 786279 - RNA, 22 nt, Human
aucugccucuucuucauugcga

SEQ ID NO: 786280 - RNA, 22 nt, Human
uguaggccuauguccagcaauu

SEQ ID NO: 786281 - RNA, 22 nt, Human
agaccaagugcaggugccacua

SEQ ID NO: 786282 - RNA, 22 nt, Human
auguucuuucagccagugcauc

SEQ ID NO: 786283 - RNA, 22 nt, Human
gaaggucaccuccccucucugg

SEQ ID NO: 786284 - RNA, 22 nt, Human
ucucagaguuuagagcugagcc

SEQ ID NO: 786285 - RNA, 22 nt, Human
uuucuagggcucuugucuucug

SEQ ID NO: 786286 - RNA, 22 nt, Human
uacaaagagguaauugcauaua

SEQ ID NO: 786287 - RNA, 22 nt, Human
gauggcagucaaccaggugagg

SEQ ID NO: 786288 - RNA, 22 nt, Human
guucuucaucauuaacacucug

SEQ ID NO: 786289 - RNA, 22 nt, Human
aaucuguuuaguucugcguaug

SEQ ID NO: 786290 - RNA, 22 nt, Human
uaugaaacauucauacaaauaa

SEQ ID NO: 786291 - RNA, 22 nt, Human
ucuacugugguccuuguaacca

SEQ ID NO: 786292 - RNA, 22 nt, Human
cucaugauguagcgaaugagaa

SEQ ID NO: 786293 - RNA, 22 nt, Human
ggggcagcucccgagggcagga

SEQ ID NO: 786294 - RNA, 22 nt, Human
uggagaggaaagugcaguuuug

SEQ ID NO: 786295 - RNA, 22 nt, Human
cagacaggcaggugcugcuuug

SEQ ID NO: 786296 - RNA, 22 nt, Human
cauuuguuggucagauuguagu

SEQ ID NO: 786297 - RNA, 22 nt, Human
cccaggagguggagguugcagc

SEQ ID NO: 786298 - RNA, 17 nt, Human
aggcagcucagaacauc

SEQ ID NO: 786299 - RNA, 22 nt, Human
agaggccggccgagcccauggg

SEQ ID NO: 786300 - RNA, 22 nt, Human
acaacauuauacauagaaagcu

SEQ ID NO: 786301 - RNA, 22 nt, Human
uugauacaggcucuauuucauc

SEQ ID NO: 786302 - RNA, 22 nt, Human
auuuggcaacauuaauugaauc

SEQ ID NO: 786303 - RNA, 22 nt, Human
gucuucuuguguugccugucuu

SEQ ID NO: 786304 - RNA, 22 nt, Human
uuuaaaauuuagaccucuccac

SEQ ID NO: 786305 - RNA, 22 nt, Human
uugcauuucccauugaguaaug

SEQ ID NO: 786306 - RNA, 22 nt, Human
cagcuggccccacaguagaggc

SEQ ID NO: 786307 - RNA, 22 nt, Human
aaaggcaggcuuucacaucuca

SEQ ID NO: 786308 - RNA, 22 nt, Human
uucauugugaacacauucugcc

SEQ ID NO: 786309 - RNA, 22 nt, Human
uucaggauccccaccgcguuua

SEQ ID NO: 786310 - RNA, 22 nt, Human
ucucuucuagcuucuugugguu

SEQ ID NO: 786311 - RNA, 22 nt, Human
uccaugagagguaacuuuacaa

SEQ ID NO: 786312 - RNA, 22 nt, Human
uauucaaaguaccuucauugcc

SEQ ID NO: 786313 - RNA, 22 nt, Human
guccaugacugugacucacaug

SEQ ID NO: 786314 - RNA, 22 nt, Human
cucacuguccaacaggcuuuac

SEQ ID NO: 786315 - RNA, 22 nt, Human
cagcugcuguuacugcuuauua

SEQ ID NO: 786316 - RNA, 20 nt, Human
gcagcuacucugucucgcuc

SEQ ID NO: 786317 - RNA, 22 nt, Human
aggcagaggagaaugaucuucc

SEQ ID NO: 786318 - RNA, 22 nt, Human
gccaggaggcuuaacuggacag

SEQ ID NO: 786319 - RNA, 22 nt, Human
aggcaagcauugggaacagggc

SEQ ID NO: 786320 - RNA, 22 nt, Human
uaucaauacauguuaucagugu

SEQ ID NO: 786321 - RNA, 22 nt, Human
aguccuuugggaaaaaugacua

SEQ ID NO: 786322 - RNA, 22 nt, Human
ggccagaaguuggaaaagagcc

SEQ ID NO: 786323 - RNA, 22 nt, Human
cucuucuugccugaugaggcag

SEQ ID NO: 786324 - RNA, 22 nt, Human
ugaggcagcauucuucaagaca

SEQ ID NO: 786325 - RNA, 22 nt, Human
aagaacuuccuaauauauuuuc

SEQ ID NO: 786326 - RNA, 22 nt, Human
uaggagaggugaauggcacacu

SEQ ID NO: 786327 - RNA, 22 nt, Human
cccuugcacauuugucuuuaau

SEQ ID NO: 786328 - RNA, 22 nt, Human
ggagcagggcagugaauucugg

SEQ ID NO: 786329 - RNA, 22 nt, Human
uucacagucacccuucuccaug

SEQ ID NO: 786330 - RNA, 22 nt, Human
gaucuguuucauucacagucug

SEQ ID NO: 786331 - RNA, 22 nt, Human
ucacugcucagucuguacuaca

SEQ ID NO: 786332 - RNA, 22 nt, Human
gaggcaccucgcgggaggaggc

SEQ ID NO: 786333 - RNA, 22 nt, Human
uggugguuaugcgcuuuguggg

SEQ ID NO: 786334 - RNA, 22 nt, Human
cagcugacccgugggaggcggg

SEQ ID NO: 786335 - RNA, 22 nt, Human
cagggaggcugucuuaugccug

SEQ ID NO: 786336 - RNA, 22 nt, Human
ugauugaacugagcuucaagau

SEQ ID NO: 786337 - RNA, 22 nt, Human
aggcaccuugcgguccagugaa

SEQ ID NO: 786338 - RNA, 22 nt, Human
gaggcaacacauuuggaaagca

SEQ ID NO: 786339 - RNA, 22 nt, Human
cccaucacagacacuggguuau

SEQ ID NO: 786340 - RNA, 22 nt, Human
aacauucugguucuaaaaaccu

SEQ ID NO: 786341 - RNA, 22 nt, Human
ugccaggauggccagggggcca

SEQ ID NO: 786342 - RNA, 22 nt, Human
ugaggcaggaugcuugcacagg

SEQ ID NO: 786343 - RNA, 22 nt, Human
aucaggaugaagcuguagcgaa

SEQ ID NO: 786344 - RNA, 22 nt, Human
agucucugucguagaucagcgu

SEQ ID NO: 786345 - RNA, 22 nt, Human
uuuucaguuccaucucugcucu

SEQ ID NO: 786346 - RNA, 22 nt, Human
uugcugaagugaagguauguuu

SEQ ID NO: 786347 - RNA, 22 nt, Human
aaggcagucugguuucaaagca

SEQ ID NO: 786348 - RNA, 18 nt, Human
guaggucaguaccaagca

SEQ ID NO: 786349 - RNA, 23 nt, Human
cagggaggagauacuguguaucu

SEQ ID NO: 786350 - RNA, 22 nt, Human
gagaggggcgcgcagcucgcga

SEQ ID NO: 786351 - RNA, 22 nt, Human
cucugcaugccuugcucagaca

SEQ ID NO: 786352 - RNA, 22 nt, Human
caggaugagaagggcucuuacg

SEQ ID NO: 786353 - RNA, 22 nt, Human
gccacaggcacuuaagggcugg

SEQ ID NO: 786354 - RNA, 22 nt, Human
cagagggaaaaggggaguaaua

SEQ ID NO: 786355 - RNA, 22 nt, Human
ccagugcuuccaggaauacggu

SEQ ID NO: 786356 - RNA, 22 nt, Human
ccucuucuagguuucagccugc

SEQ ID NO: 786357 - RNA, 22 nt, Human
uaauuauuaugacaacaauugc

SEQ ID NO: 786358 - RNA, 22 nt, Human
auucuucacauaagugcuguac

SEQ ID NO: 786359 - RNA, 22 nt, Human
uucuucagucccacuagccaca

SEQ ID NO: 786360 - RNA, 22 nt, Human
uggaggaaaaaaccaggcagag

SEQ ID NO: 786361 - RNA, 22 nt, Human
uuuuucagccaugaauuacacu

SEQ ID NO: 786362 - RNA, 22 nt, Human
gagaggucaucucccaucagca

SEQ ID NO: 786363 - RNA, 22 nt, Human
ugucucaguacacuccgauguu

SEQ ID NO: 786364 - RNA, 22 nt, Human
auuaaauuuucacuaggcuccc

SEQ ID NO: 786365 - RNA, 22 nt, Human
uugguuuagagagugugguuac

SEQ ID NO: 786366 - RNA, 22 nt, Human
caggguggcacucagcgcaucu

SEQ ID NO: 786367 - RNA, 22 nt, Human
agggagugguuaagaaggugca

SEQ ID NO: 786368 - RNA, 19 nt, Human
caggagagcaugcacuuug

SEQ ID NO: 786369 - RNA, 22 nt, Human
agggcagcucucaccucuggcc

SEQ ID NO: 786370 - RNA, 22 nt, Human
ugcuguguucuccugacucacc

SEQ ID NO: 786371 - RNA, 22 nt, Human
uaucaucuuguugucaugcagc

SEQ ID NO: 786372 - RNA, 22 nt, Human
ccaggaaauggcuugcuucuuu

SEQ ID NO: 786373 - RNA, 22 nt, Human
uuucccagagguaugaauaagu

SEQ ID NO: 786374 - RNA, 22 nt, Human
gucaggauuaaugggaguaugc

SEQ ID NO: 786375 - RNA, 22 nt, Human
gagcgauguggguauguagaag

SEQ ID NO: 786376 - RNA, 22 nt, Human
uccaugagacagauacuguaag

SEQ ID NO: 786377 - RNA, 21 nt, Human
uucaaaaugguguguuugucu

SEQ ID NO: 786378 - RNA, 22 nt, Human
uucuuaaaacuuauggacaggu

SEQ ID NO: 786379 - RNA, 22 nt, Human
guggcaggagacuggaagaugg

SEQ ID NO: 786380 - RNA, 22 nt, Human
uagaaaugugauaauagcuuaa

SEQ ID NO: 786381 - RNA, 22 nt, Human
caguuucuacgaaggucaaccc

SEQ ID NO: 786382 - RNA, 22 nt, Human
uaagauaaguggguugagaugg

SEQ ID NO: 786383 - RNA, 22 nt, Human
uuugcagucaaauuugcuaaau

SEQ ID NO: 786384 - RNA, 23 nt, Human
caguggagacucaugcuuccuua

SEQ ID NO: 786385 - RNA, 22 nt, Human
acagaauugaaaguauaaucug

SEQ ID NO: 786386 - RNA, 22 nt, Human
ugaggcagauauuuauuggguu

SEQ ID NO: 786387 - RNA, 19 nt, Human
cuucuucuuggcagccaag

SEQ ID NO: 786388 - RNA, 22 nt, Human
guuauacauauguguuaacaaa

SEQ ID NO: 786389 - RNA, 22 nt, Human
ucucuucuaauuuucccgagua

SEQ ID NO: 786390 - RNA, 19 nt, Human
uagaggagaagggaagugg

SEQ ID NO: 786391 - RNA, 22 nt, Human
gcagcugaauguccauugcugc

SEQ ID NO: 786392 - RNA, 22 nt, Human
gagcagcugagcuggaaugaga

SEQ ID NO: 786393 - RNA, 22 nt, Human
agucuugcucuugcaucugcuu

SEQ ID NO: 786394 - RNA, 22 nt, Human
ccaggagaugauguuggggauu

SEQ ID NO: 786395 - RNA, 22 nt, Human
aggcagcauccagaggagaaug

SEQ ID NO: 786396 - RNA, 22 nt, Human
ugcuggguuaccuaagccuaaa

SEQ ID NO: 786397 - RNA, 22 nt, Human
acccaggagguggaggcugcag

SEQ ID NO: 786398 - RNA, 22 nt, Human
cugcuucuccaaaguaggacuu

SEQ ID NO: 786399 - RNA, 22 nt, Human
gaggcugaggguuagagaguca

SEQ ID NO: 786400 - RNA, 22 nt, Human
uguacauacauagauauacaca

SEQ ID NO: 786401 - RNA, 22 nt, Human
cccaggagagaggccaguuggc

SEQ ID NO: 786402 - RNA, 20 nt, Human
ucagaugggagugagccauc

SEQ ID NO: 786403 - RNA, 22 nt, Human
ggcaucuccaaaacaugaacuc

SEQ ID NO: 786404 - RNA, 22 nt, Human
ucgcugugguuucuguacaugg

SEQ ID NO: 786405 - RNA, 22 nt, Human
uggcagcucuguucaacaugag

SEQ ID NO: 786406 - RNA, 22 nt, Human
caguucuuuguggggaguucuc

SEQ ID NO: 786407 - RNA, 22 nt, Human
gggugggacugaagucugaggg

SEQ ID NO: 786408 - RNA, 22 nt, Human
aaagccaugaauguuauagagg

SEQ ID NO: 786409 - RNA, 22 nt, Human
aggcagguccccuggaaggcac

SEQ ID NO: 786410 - RNA, 15 nt, Human
caggagaggaagguu

SEQ ID NO: 786411 - RNA, 19 nt, Human
uccaggagcaaagccaguu

SEQ ID NO: 786412 - RNA, 22 nt, Human
aggcagcaugggcccagagucc

SEQ ID NO: 786413 - RNA, 22 nt, Human
aaauugcauuuuaaagguagau

SEQ ID NO: 786414 - RNA, 22 nt, Human
ucauuuuucacacagggucacc

SEQ ID NO: 786415 - RNA, 22 nt, Human
ccaggcugcagucaaggggcau

SEQ ID NO: 786416 - RNA, 22 nt, Human
gugcagcugcaggagucagguc

SEQ ID NO: 786417 - RNA, 22 nt, Human
auacauacauguaugcacauac

SEQ ID NO: 786418 - RNA, 21 nt, Human
uacagaaugcgcuucagucug

SEQ ID NO: 786419 - RNA, 22 nt, Human
aggagagcuggugucuggaauc

SEQ ID NO: 786420 - RNA, 21 nt, Human
gauugaaaccauggcagugag

SEQ ID NO: 786421 - RNA, 22 nt, Human
cccaggaaugagcaggcagggg

SEQ ID NO: 786422 - RNA, 22 nt, Human
ugccuggauucgguuguuguca

SEQ ID NO: 786423 - RNA, 22 nt, Human
uucuuugaguuaguacagucca

SEQ ID NO: 786424 - RNA, 22 nt, Human
cuugaaagaagggucuuuuaau

SEQ ID NO: 786425 - RNA, 22 nt, Human
cucccagggucuaggcugcugg

SEQ ID NO: 786426 - RNA, 22 nt, Human
aaagcagaacugagagagcugg

SEQ ID NO: 786427 - RNA, 22 nt, Human
uagugcuuaauaaauuucagaa

SEQ ID NO: 786428 - RNA, 22 nt, Human
ccccaggacguggcccucauag

SEQ ID NO: 786429 - RNA, 22 nt, Human
cugcccaggaaggagaggaugg

SEQ ID NO: 786430 - RNA, 23 nt, Human
ucuccuccuagauacagucaugg

SEQ ID NO: 786431 - RNA, 22 nt, Human
cugcugugcauauuuaucuagg

SEQ ID NO: 786432 - RNA, 22 nt, Human
aaaggccacuugaaggauuuuu

SEQ ID NO: 786433 - RNA, 22 nt, Human
gggcagcucagccaccaugcag

SEQ ID NO: 786434 - RNA, 22 nt, Human
uaaauuaugucacaugacucug

SEQ ID NO: 786435 - RNA, 22 nt, Human
uguuuuaaucucccauugcucu

SEQ ID NO: 786436 - RNA, 22 nt, Human
ggcagcuuccuaggagagggca

SEQ ID NO: 786437 - RNA, 22 nt, Human
agucauaugacccuucacaaac

SEQ ID NO: 786438 - RNA, 22 nt, Human
uguagggaggaaggguuggaaa

SEQ ID NO: 786439 - RNA, 22 nt, Human
ccacagagacaggguccuugcu

SEQ ID NO: 786440 - RNA, 22 nt, Human
uaugauuuguagacauuugauu

SEQ ID NO: 786441 - RNA, 22 nt, Human
uggaguucauccaugacagcuu

SEQ ID NO: 786442 - RNA, 22 nt, Human
auuugcuuucagguauaaaagg

SEQ ID NO: 786443 - RNA, 20 nt, Human
caguccaaucagaggccacc

SEQ ID NO: 786444 - RNA, 22 nt, Human
auaaagauuucuuuuucucuac

SEQ ID NO: 786445 - RNA, 22 nt, Human
cucaggauagauuguccucuca

SEQ ID NO: 786446 - RNA, 22 nt, Human
gcaccugauugauuucacugcu

SEQ ID NO: 786447 - RNA, 22 nt, Human
caaggccaguucaccaagggca

SEQ ID NO: 786448 - RNA, 22 nt, Human
gccaggagaaaaggcgaaugau

SEQ ID NO: 786449 - RNA, 22 nt, Human
cucagagaggcaguggaaguca

SEQ ID NO: 786450 - RNA, 17 nt, Human
aaggccauuuccaccca

SEQ ID NO: 786451 - RNA, 22 nt, Human
aggcaggcaaccaccugggaag

SEQ ID NO: 786452 - RNA, 17 nt, Human
uucucugagcuguauug

SEQ ID NO: 786453 - RNA, 22 nt, Human
ucaggagagaaagaauacaauu

SEQ ID NO: 786454 - RNA, 23 nt, Human
auuucuaggggauuuucuggugc

SEQ ID NO: 786455 - RNA, 22 nt, Human
aacauacauauuucagugucca

SEQ ID NO: 786456 - RNA, 22 nt, Human
aggacagcaguuggugagguuc

SEQ ID NO: 786457 - RNA, 22 nt, Human
uucucagaauugacugggagca

SEQ ID NO: 786458 - RNA, 22 nt, Human
aggccagcccugggcugagaga

SEQ ID NO: 786459 - RNA, 22 nt, Human
auuuaaaugcuuaagaggguuu

SEQ ID NO: 786460 - RNA, 17 nt, Human
uuucuccuuccaucuca

SEQ ID NO: 786461 - RNA, 22 nt, Human
gaggaacccagcugggguugcc

SEQ ID NO: 786462 - RNA, 22 nt, Human
agaggggaaguaaugaaugaua

SEQ ID NO: 786463 - RNA, 22 nt, Human
ucaggagaacuuccuucuaccc

SEQ ID NO: 786464 - RNA, 22 nt, Human
uucuuaacuggaaaaugucaga

SEQ ID NO: 786465 - RNA, 17 nt, Human
acucaggaucugggagu

SEQ ID NO: 786466 - RNA, 22 nt, Human
uuuguagaggguaauugacaga

SEQ ID NO: 786467 - RNA, 22 nt, Human
uuuuuuaguuaggucagaaugu

SEQ ID NO: 786468 - RNA, 22 nt, Human
ggcagaggaaggaugaauucac

SEQ ID NO: 786469 - RNA, 22 nt, Human
ucuucauuuuauagcaucugug

SEQ ID NO: 786470 - RNA, 22 nt, Human
agacagugauguaagcaggagu

SEQ ID NO: 786471 - RNA, 20 nt, Human
uuucaagucagcaauucuca

SEQ ID NO: 786472 - RNA, 22 nt, Human
uuuggaauguaguuuaaucauc

SEQ ID NO: 786473 - RNA, 22 nt, Human
cuauuucaaggcccagauauga

SEQ ID NO: 786474 - RNA, 22 nt, Human
caggguggcacaucacagcauu

SEQ ID NO: 786475 - RNA, 22 nt, Human
aggagagaauguuccaggcuug

SEQ ID NO: 786476 - RNA, 22 nt, Human
ucucuucuaacacuagaaauuc

SEQ ID NO: 786477 - RNA, 22 nt, Human
uugcucaggcuggugugcagug

SEQ ID NO: 786478 - RNA, 22 nt, Human
ucagauggguuuugaaggaugu

SEQ ID NO: 786479 - RNA, 22 nt, Human
agcaccugccugcauuggcuau

SEQ ID NO: 786480 - RNA, 22 nt, Human
ugaaggccuaacuuccagugcu

SEQ ID NO: 786481 - RNA, 22 nt, Human
ccccaggagaaaucuuaaacua

SEQ ID NO: 786482 - RNA, 22 nt, Human
acaugcauaggagaagucuuua

SEQ ID NO: 786483 - RNA, 22 nt, Human
aucacugucgucaucugagauu

SEQ ID NO: 786484 - RNA, 22 nt, Human
ucugguaaccuuuaucccuccu

SEQ ID NO: 786485 - RNA, 22 nt, Human
aguaaagcagaguugcaguaca

SEQ ID NO: 786486 - RNA, 22 nt, Human
ugucaaauuuuuauugcaguau

SEQ ID NO: 786487 - RNA, 22 nt, Human
uaggcagcuuagguuagaagug

SEQ ID NO: 786488 - RNA, 19 nt, Human
agacagagcucaguggguu

SEQ ID NO: 786489 - RNA, 22 nt, Human
cuuuuccacugagccucacaaa

SEQ ID NO: 786490 - RNA, 22 nt, Human
caggagauguaagacuucuguu

SEQ ID NO: 786491 - RNA, 22 nt, Human
augggaggaugcucgggugcuc

SEQ ID NO: 786492 - RNA, 20 nt, Human
uccaggagguuaguguggcu

SEQ ID NO: 786493 - RNA, 22 nt, Human
uucaggauucugugucugacaa

SEQ ID NO: 786494 - RNA, 22 nt, Human
cuuagcaugugguguccuugua

SEQ ID NO: 786495 - RNA, 20 nt, Human
cagagccaagagcagcaucu

SEQ ID NO: 786496 - RNA, 22 nt, Human
uuugcagucuggccugcuuugg

SEQ ID NO: 786497 - RNA, 22 nt, Human
gaaggccacuuuguguugagaa

SEQ ID NO: 786498 - RNA, 22 nt, Human
guuguuuugcaggauccuuaca

SEQ ID NO: 786499 - RNA, 19 nt, Human
cuggccaggccaggggccc

SEQ ID NO: 786500 - RNA, 20 nt, Human
uccaggagaacugggagccg

SEQ ID NO: 786501 - RNA, 22 nt, Human
cccuuagcuccaagggguuugg

SEQ ID NO: 786502 - RNA, 22 nt, Human
uuaacauuguccuuagcagauu

SEQ ID NO: 786503 - RNA, 22 nt, Human
uuguaaauaguaguaagaugcc

SEQ ID NO: 786504 - RNA, 22 nt, Human
uagcuaucuguguccagaucca

SEQ ID NO: 786505 - RNA, 22 nt, Human
gucaggauuugaacucaggucu

SEQ ID NO: 786506 - RNA, 22 nt, Human
ucugucuccucugaggugccag

SEQ ID NO: 786507 - RNA, 22 nt, Human
cagacaggguccuguccgucac

SEQ ID NO: 786508 - RNA, 22 nt, Human
gacagaggcuggagcaccuccu

SEQ ID NO: 786509 - RNA, 22 nt, Human
augcugugauuguagaaauauu

SEQ ID NO: 786510 - RNA, 21 nt, Human
aaucauacaaaacaugucagg

SEQ ID NO: 786511 - RNA, 22 nt, Human
cuuuguagcugcuucugauuua

SEQ ID NO: 786512 - RNA, 20 nt, Human
ucauuucuugggguuccaag

SEQ ID NO: 786513 - RNA, 18 nt, Human
ugaggcagucagugaugg

SEQ ID NO: 786514 - RNA, 22 nt, Human
uuguuauaaagacuaaauaugu

SEQ ID NO: 786515 - RNA, 22 nt, Human
cuguggaaaauuuguauguaau

SEQ ID NO: 786516 - RNA, 22 nt, Human
aggcaguuguugcugagcagcu

SEQ ID NO: 786517 - RNA, 22 nt, Human
guucuucacauuucauugagga

SEQ ID NO: 786518 - RNA, 22 nt, Human
uccaggaggaggaaggcugcca

SEQ ID NO: 786519 - RNA, 22 nt, Human
aaccauuugcaguuacugagac

SEQ ID NO: 786520 - RNA, 22 nt, Human
ucaucugucauccacaaagcug

SEQ ID NO: 786521 - RNA, 22 nt, Human
uugcugugucugauggcugaga

SEQ ID NO: 786522 - RNA, 22 nt, Human
aauauccacacugugucccugc

SEQ ID NO: 786523 - RNA, 22 nt, Human
uggagcugggguuugaaucugg

SEQ ID NO: 786524 - RNA, 22 nt, Human
gagugucugaauuagagcacaa

SEQ ID NO: 786525 - RNA, 22 nt, Human
uagaaauguugguauuaacauu

SEQ ID NO: 786526 - RNA, 22 nt, Human
cuucccagaccuuagagugcag

SEQ ID NO: 786527 - RNA, 20 nt, Human
augugagggguugaaguggg

SEQ ID NO: 786528 - RNA, 22 nt, Human
gcuagaaaucgacuucagaauu

SEQ ID NO: 786529 - RNA, 22 nt, Human
ucuuagcacagcuauauaaguu

SEQ ID NO: 786530 - RNA, 22 nt, Human
caaguaaacaauaugugauuca

SEQ ID NO: 786531 - RNA, 22 nt, Human
gucuauauauugcuugaauaau

SEQ ID NO: 786532 - RNA, 22 nt, Human
aggcagcuggaaaacuccaggc

SEQ ID NO: 786533 - RNA, 22 nt, Human
uuuccucacuucaugagaguuu

SEQ ID NO: 786534 - RNA, 19 nt, Human
uucacaauuaugaaauuag

SEQ ID NO: 786535 - RNA, 22 nt, Human
aagagggcagcacagguggguc

SEQ ID NO: 786536 - RNA, 22 nt, Human
uuugcagugucagcuucugugu

SEQ ID NO: 786537 - RNA, 22 nt, Human
guucuucaucauuuuagauagg

SEQ ID NO: 786538 - RNA, 22 nt, Human
uggcagcuuuuuguuucaggcu

SEQ ID NO: 786539 - RNA, 22 nt, Human
uggcagagcaaaaagauagaau

SEQ ID NO: 786540 - RNA, 22 nt, Human
acagcauugcuccaucucaaga

SEQ ID NO: 786541 - RNA, 19 nt, Human
acauuuaaauucagaucuc

SEQ ID NO: 786542 - RNA, 22 nt, Human
caggaugaagggcaaaggcaag

SEQ ID NO: 786543 - RNA, 19 nt, Human
auucuucucuuccugcugu

SEQ ID NO: 786544 - RNA, 22 nt, Human
uugauuugauuguaauggcucu

SEQ ID NO: 786545 - RNA, 18 nt, Human
agcucacagaucuguuuu

SEQ ID NO: 786546 - RNA, 22 nt, Human
ugucauauagaauguucuauga

SEQ ID NO: 786547 - RNA, 22 nt, Human
guuguuuuugaacggugguggc

SEQ ID NO: 786548 - RNA, 22 nt, Human
acugguuuuggaaaucaguaca

SEQ ID NO: 786549 - RNA, 22 nt, Human
aagcaauucacaguucacuuaa

SEQ ID NO: 786550 - RNA, 22 nt, Human
acuuuuaaggggccuugauuua

SEQ ID NO: 786551 - RNA, 22 nt, Human
uuuaauuauaucugggcaguua

SEQ ID NO: 786552 - RNA, 22 nt, Human
augcuuucucuuaguucauuga

SEQ ID NO: 786553 - RNA, 22 nt, Human
cugcuguguggauucaauggcu

SEQ ID NO: 786554 - RNA, 22 nt, Human
cuuccucuguggccagagugua

SEQ ID NO: 786555 - RNA, 22 nt, Human
uagauucugacccucuuuuuac

SEQ ID NO: 786556 - RNA, 23 nt, Human
uuguucuuggaucuuccugaagc

SEQ ID NO: 786557 - RNA, 22 nt, Human
aucuucaaggaaaaaauacagu

SEQ ID NO: 786558 - RNA, 22 nt, Human
cugcagaugguauuguucuggu

SEQ ID NO: 786559 - RNA, 21 nt, Human
gacauugagcgugucgcagug

SEQ ID NO: 786560 - RNA, 22 nt, Human
gcuguaacuuuuucauuuucaa

SEQ ID NO: 786561 - RNA, 22 nt, Human
auuugcuuguucaccaguacuu

SEQ ID NO: 786562 - RNA, 22 nt, Human
guucuucaaagugacaacuaaa

SEQ ID NO: 786563 - RNA, 19 nt, Human
ugguucuccuuccacaguc

SEQ ID NO: 786564 - RNA, 22 nt, Human
uugcugccuuuguacucugaug

SEQ ID NO: 786565 - RNA, 22 nt, Human
acauuuuuggguugaugucuga

SEQ ID NO: 786566 - RNA, 22 nt, Human
caacagcuggaggcuuggcccg

SEQ ID NO: 786567 - RNA, 18 nt, Human
auggcuccagugucuucc

SEQ ID NO: 786568 - RNA, 22 nt, Human
uuucugcagcagacucagugug

SEQ ID NO: 786569 - RNA, 22 nt, Human
guucuucagcccucagguccua

SEQ ID NO: 786570 - RNA, 22 nt, Human
ugccugugggugaugauuugau

SEQ ID NO: 786571 - RNA, 22 nt, Human
cugcugagguggagauugcagu

SEQ ID NO: 786572 - RNA, 22 nt, Human
aaugcuuuuugcgaaaugugca

SEQ ID NO: 786573 - RNA, 22 nt, Human
agccugugagggaugcugcagu

SEQ ID NO: 786574 - RNA, 22 nt, Human
gauugcugggucccacucccag

SEQ ID NO: 786575 - RNA, 22 nt, Human
ugcuuguauucauaucacagcu

SEQ ID NO: 786576 - RNA, 22 nt, Human
auguuguugaacucuuugcaug

SEQ ID NO: 786577 - RNA, 22 nt, Human
cuugccagggacucagucaggg

SEQ ID NO: 786578 - RNA, 20 nt, Human
uauuucugggcaaccauuua

SEQ ID NO: 786579 - RNA, 21 nt, Human
gucuuuuuaauugcgauuucc

SEQ ID NO: 786580 - RNA, 22 nt, Human
uuuaauuuucugggcccagcag

SEQ ID NO: 786581 - RNA, 22 nt, Human
uuuggucuggaaucuucagggu

SEQ ID NO: 786582 - RNA, 22 nt, Human
ucuuggcaguucuugugcuuuu

SEQ ID NO: 786583 - RNA, 22 nt, Human
ugcuccugaacacagcccuaug

SEQ ID NO: 786584 - RNA, 22 nt, Human
uuuuuugucuugaagaaauggu

SEQ ID NO: 786585 - RNA, 22 nt, Human
uaauuuugucacagugacaugc

SEQ ID NO: 786586 - RNA, 22 nt, Human
gucugcugacagagcauggacc

SEQ ID NO: 786587 - RNA, 22 nt, Human
uuuucaguuccaucucugcucu

SEQ ID NO: 786588 - RNA, 22 nt, Human
cuuauuugcccauguuucuuua

SEQ ID NO: 786589 - RNA, 22 nt, Human
cagcugcuguucaguuuuguuu

SEQ ID NO: 786590 - RNA, 22 nt, Human
aacaggcuaaauuguccauuuc

SEQ ID NO: 786591 - RNA, 22 nt, Human
uucacagugguagugcauuuag

SEQ ID NO: 786592 - RNA, 22 nt, Human
uucuuuuaauuucugucugcag

SEQ ID NO: 786593 - RNA, 22 nt, Human
uuauuuuguagcucugaucuuu

SEQ ID NO: 786594 - RNA, 20 nt, Human
cagcucugggcaggucgagg

SEQ ID NO: 786595 - RNA, 22 nt, Human
auucaugcaggauugucuccaa

SEQ ID NO: 786596 - RNA, 22 nt, Human
agcuggguacacguugucacaa

SEQ ID NO: 786597 - RNA, 20 nt, Human
cucuuuucacucucaguggu

SEQ ID NO: 786598 - RNA, 22 nt, Human
uuuucuaacaucuaguaauuug

SEQ ID NO: 786599 - RNA, 22 nt, Human
ugauucaguacuuucucuaacu

SEQ ID NO: 786600 - RNA, 22 nt, Human
gguguuguacauucuguggauu

SEQ ID NO: 786601 - RNA, 22 nt, Human
cauugcuguuaauugucucuag

SEQ ID NO: 786602 - RNA, 22 nt, Human
uugcuucacuacuucuaggcuc

SEQ ID NO: 786603 - RNA, 22 nt, Human
gcaguugcaggauuuguguugu

SEQ ID NO: 786604 - RNA, 21 nt, Human
gcacuucugcagggcugcugg

SEQ ID NO: 786605 - RNA, 22 nt, Human
auuguugacuugauuacucaac

SEQ ID NO: 786606 - RNA, 22 nt, Human
gcucugugccccugccguggac

SEQ ID NO: 786607 - RNA, 22 nt, Human
uuaaguccuugguaauuuucuu

SEQ ID NO: 786608 - RNA, 22 nt, Human
uucuaguuacagaagccuugcu

SEQ ID NO: 786609 - RNA, 22 nt, Human
uggccugauuuugcuaagagaa

SEQ ID NO: 786610 - RNA, 22 nt, Human
gagcugcuggccuccugcggga

SEQ ID NO: 786611 - RNA, 22 nt, Human
cuucagggguguuaguuuugug

SEQ ID NO: 786612 - RNA, 22 nt, Human
gugcaggacagcacaucuccug

SEQ ID NO: 786613 - RNA, 22 nt, Human
uaacuugagcucucagugcuau

SEQ ID NO: 786614 - RNA, 22 nt, Human
ucugcuugugucuguccagccu

SEQ ID NO: 786615 - RNA, 22 nt, Human
ugcugcuuguuuuguaaauaaa

SEQ ID NO: 786616 - RNA, 22 nt, Human
ugcuugcugaaaggcauuuaga

SEQ ID NO: 786617 - RNA, 22 nt, Human
cauuguuggcagagggacagag

SEQ ID NO: 786618 - RNA, 22 nt, Human
augguuuuguccucuuugguuc

SEQ ID NO: 786619 - RNA, 22 nt, Human
gucuguggaguugcuugcugga

SEQ ID NO: 786620 - RNA, 22 nt, Human
uuuacuucugcauuuccccuag

SEQ ID NO: 786621 - RNA, 22 nt, Human
cuugcuuuaucugguuucucau

SEQ ID NO: 786622 - RNA, 22 nt, Human
guugcagcaucacugcugagug

SEQ ID NO: 786623 - RNA, 21 nt, Human
caagacauaugaguacucugg

SEQ ID NO: 786624 - RNA, 22 nt, Human
cugcaguucuucuccucaaggc

SEQ ID NO: 786625 - RNA, 22 nt, Human
uucuguuuauaauuugcaguug

SEQ ID NO: 786626 - RNA, 20 nt, Human
uugagcagcagugcuguguc

SEQ ID NO: 786627 - RNA, 22 nt, Human
acuucacagauauuuauuuggu

SEQ ID NO: 786628 - RNA, 22 nt, Human
ucuacaacgugguuuuguugua

SEQ ID NO: 786629 - RNA, 22 nt, Human
ugugagauuuuauuugauaugc

SEQ ID NO: 786630 - RNA, 22 nt, Human
uuuacuuuugguaaggucauuu

SEQ ID NO: 786631 - RNA, 22 nt, Human
gcugcucucucccuaaguuggg

SEQ ID NO: 786632 - RNA, 22 nt, Human
cagcucugguuccugggcccag

SEQ ID NO: 786633 - RNA, 17 nt, Human
uuucugcaugauuggac

SEQ ID NO: 786634 - RNA, 22 nt, Human
uuuggauugcuuggaugcuucg

SEQ ID NO: 786635 - RNA, 22 nt, Human
guucuucagauuccauuucagu

SEQ ID NO: 786636 - RNA, 22 nt, Human
ugguuuguauauguuugugaga

SEQ ID NO: 786637 - RNA, 17 nt, Human
cauucuguaaucuuucu

SEQ ID NO: 786638 - RNA, 22 nt, Human
ugaagccagggacugacacuuc

SEQ ID NO: 786639 - RNA, 22 nt, Human
ccugugcuucacucaacaagcc

SEQ ID NO: 786640 - RNA, 22 nt, Human
gcugcuggcuuccugcuguuuu

SEQ ID NO: 786641 - RNA, 22 nt, Human
uuccuguucaggaaaguugugu

SEQ ID NO: 786642 - RNA, 22 nt, Human
cagcugcucugguggucucucc

SEQ ID NO: 786643 - RNA, 22 nt, Human
uuaggauuugaaaaggggcaga

SEQ ID NO: 786644 - RNA, 22 nt, Human
guuuuguucaugaacauugggu

SEQ ID NO: 786645 - RNA, 23 nt, Human
gguucugccgcuuacugcugugc

SEQ ID NO: 786646 - RNA, 22 nt, Human
uuuucaguugugcucucuaguu

SEQ ID NO: 786647 - RNA, 22 nt, Human
ccaucuucucuugaaccuccuu

SEQ ID NO: 786648 - RNA, 19 nt, Human
ggguccauggugucaagga

SEQ ID NO: 786649 - RNA, 22 nt, Human
gcugcaagugcauguugcaacu

SEQ ID NO: 786650 - RNA, 22 nt, Human
gagcagcuguucugacuugucu

SEQ ID NO: 786651 - RNA, 22 nt, Human
aacagguagggacucuaacuug

SEQ ID NO: 786652 - RNA, 22 nt, Human
cuuuggucuccgucaucaauca

SEQ ID NO: 786653 - RNA, 22 nt, Human
caguuuuucaaaauuacaugau

SEQ ID NO: 786654 - RNA, 22 nt, Human
uucuucauucccuuacuuccga

SEQ ID NO: 786655 - RNA, 22 nt, Human
gcacuuguuuuauguuccugag

SEQ ID NO: 786656 - RNA, 22 nt, Human
ugcuuuauucgacaucugguag

SEQ ID NO: 786657 - RNA, 22 nt, Human
uugagcagaucgggcugugggg

SEQ ID NO: 786658 - RNA, 22 nt, Human
ucuccucuccuuucauguuguu

SEQ ID NO: 786659 - RNA, 22 nt, Human
aauuauguuugcuuuagaugga

SEQ ID NO: 786660 - RNA, 22 nt, Human
uagcugcuugaccaggcagugg

SEQ ID NO: 786661 - RNA, 22 nt, Human
uguuaguauuggcaaauuuguu

SEQ ID NO: 786662 - RNA, 22 nt, Human
guucuucaggcugugcucuaga

SEQ ID NO: 786663 - RNA, 22 nt, Human
ggcucucuuaacuggccauccu

SEQ ID NO: 786664 - RNA, 22 nt, Human
ggaaacugcuuacacuagaggg

SEQ ID NO: 786665 - RNA, 22 nt, Human
uucaguuuugcuuuuaaucaug

SEQ ID NO: 786666 - RNA, 22 nt, Human
uguucaguuugcuaucauaauc

SEQ ID NO: 786667 - RNA, 22 nt, Human
ucugcuguuuacugugugauau

SEQ ID NO: 786668 - RNA, 22 nt, Human
gucuuuuuuacaccuuacauca

SEQ ID NO: 786669 - RNA, 22 nt, Human
uugucaggaacuaugauuaugc

SEQ ID NO: 786670 - RNA, 22 nt, Human
uguucugcaaugcugccuccuu

SEQ ID NO: 786671 - RNA, 23 nt, Human
cguuuuuuccucagauguucugg

SEQ ID NO: 786672 - RNA, 22 nt, Human
ugugucuaaugacuauuucuuc

SEQ ID NO: 786673 - RNA, 22 nt, Human
auguuuguguuucccauucagg

SEQ ID NO: 786674 - RNA, 22 nt, Human
ucuuucagaaacuuugucugcg

SEQ ID NO: 786675 - RNA, 22 nt, Human
guccuguguaaguacuugcuca

SEQ ID NO: 786676 - RNA, 22 nt, Human
cuucucuuggguguggugucuu

SEQ ID NO: 786677 - RNA, 22 nt, Human
acugcauucuuuaucccacaac

SEQ ID NO: 786678 - RNA, 20 nt, Human
uuugauugccccucugacuu

SEQ ID NO: 786679 - RNA, 22 nt, Human
ucucuuugacccuuuagcucca

SEQ ID NO: 786680 - RNA, 22 nt, Human
gugauuucaaauauagagugag

SEQ ID NO: 786681 - RNA, 18 nt, Human
cuuuagcugucaucuuug

SEQ ID NO: 786682 - RNA, 22 nt, Human
cuucaguucuaaaguagaaugu

SEQ ID NO: 786683 - RNA, 22 nt, Human
ugcauguuuuauaccaaagcuu

SEQ ID NO: 786684 - RNA, 22 nt, Human
agcaauguuggccuauauaccu

SEQ ID NO: 786685 - RNA, 22 nt, Human
ccugugggcgcagcuggaguca

SEQ ID NO: 786686 - RNA, 22 nt, Human
uugcaggucuggggguccuggu

SEQ ID NO: 786687 - RNA, 22 nt, Human
cugguuuuccaauguuuugacu

SEQ ID NO: 786688 - RNA, 22 nt, Human
cucuguccugguuuauacuggc

SEQ ID NO: 786689 - RNA, 22 nt, Human
guguuuugugaggccuucuuuc

SEQ ID NO: 786690 - RNA, 22 nt, Human
cacuguugagcaauguacagug

SEQ ID NO: 786691 - RNA, 22 nt, Human
caaauguuugguggcauuuugu

SEQ ID NO: 786692 - RNA, 22 nt, Human
cuuucuuucgaagacgugauua

SEQ ID NO: 786693 - RNA, 22 nt, Human
gcagcucucuggccugcccugg

SEQ ID NO: 786694 - RNA, 22 nt, Human
uuguaacaguagcugucagcuc

SEQ ID NO: 786695 - RNA, 22 nt, Human
ugcagcaucuccuugugccaug

SEQ ID NO: 786696 - RNA, 22 nt, Human
cauugcugugggcauuugcugc

SEQ ID NO: 786697 - RNA, 22 nt, Human
uguuugcucugacuaucuugcg

SEQ ID NO: 786698 - RNA, 22 nt, Human
ccuuuguucacuggagagugga

SEQ ID NO: 786699 - RNA, 22 nt, Human
ccacugcuguuacuuacgcaaa

SEQ ID NO: 786700 - RNA, 22 nt, Human
gugguuguuuccagguuugaaa

SEQ ID NO: 786701 - RNA, 22 nt, Human
cugucucugauaagcucgaggg

SEQ ID NO: 786702 - RNA, 22 nt, Human
cuugccaguguugcagaagcuc

SEQ ID NO: 786703 - RNA, 22 nt, Human
acugcuuacccggccugacuuc

SEQ ID NO: 786704 - RNA, 23 nt, Human
cuguuauauggguguuaugugcu

SEQ ID NO: 786705 - RNA, 22 nt, Human
uuuacagcuacuguccuauuuc

SEQ ID NO: 786706 - RNA, 22 nt, Human
agcugcugcaaguggugcuaac

SEQ ID NO: 786707 - RNA, 22 nt, Human
aucauuugaacagaauuuguuu

SEQ ID NO: 786708 - RNA, 22 nt, Human
auuauguagcuaaaaauugugu

SEQ ID NO: 786709 - RNA, 22 nt, Human
cauugcuuugugcauauuuaaa

SEQ ID NO: 786710 - RNA, 22 nt, Human
caaaauuguugaugcugcuuug

SEQ ID NO: 786711 - RNA, 22 nt, Human
uguguuuuggaaggaacaugca

SEQ ID NO: 786712 - RNA, 22 nt, Human
auugacuuucccuucuccucau

SEQ ID NO: 786713 - RNA, 21 nt, Human
uuuguucaggggcaaaguuaa

SEQ ID NO: 786714 - RNA, 22 nt, Human
ccaaggcuggagggcuuaugua

SEQ ID NO: 786715 - RNA, 22 nt, Human
cugcuucacccugccugagaac

SEQ ID NO: 786716 - RNA, 22 nt, Human
ugcugcacuuauggcucugagg

SEQ ID NO: 786717 - RNA, 22 nt, Human
acauuguugagccucuuguuca

SEQ ID NO: 786718 - RNA, 22 nt, Human
guucaguuauuucugaagauau

SEQ ID NO: 786719 - RNA, 22 nt, Human
cuucauuucaggcugaagaaua

SEQ ID NO: 786720 - RNA, 22 nt, Human
uuguuuguaaggcucuuagaau

SEQ ID NO: 786721 - RNA, 22 nt, Human
uuugacaacugugcaguuugua

SEQ ID NO: 786722 - RNA, 22 nt, Human
aagcucucuguccccuggacug

SEQ ID NO: 786723 - RNA, 22 nt, Human
ccugugucaucagcuguggcua

SEQ ID NO: 786724 - RNA, 22 nt, Human
ucauuguuucugcuuuucauga

SEQ ID NO: 786725 - RNA, 22 nt, Human
cauuuugugcuagacacuaugg

SEQ ID NO: 786726 - RNA, 22 nt, Human
cuuguuuucuucugcagucuau

SEQ ID NO: 786727 - RNA, 22 nt, Human
uugcaguugcuguauuuaagga

SEQ ID NO: 786728 - RNA, 22 nt, Human
ucuauuaaugauucaauagugu

SEQ ID NO: 786729 - RNA, 19 nt, Human
ugcucucuggugcuucaug

SEQ ID NO: 786730 - RNA, 22 nt, Human
gagcagcaggccagguugcagg

SEQ ID NO: 786731 - RNA, 23 nt, Human
auuuccuaaaagauaaucauuac

SEQ ID NO: 786732 - RNA, 21 nt, Human
cuuuucuagucccagccccgc

SEQ ID NO: 786733 - RNA, 22 nt, Human
aauuauugagcaucuacugugu

SEQ ID NO: 786734 - RNA, 22 nt, Human
aacaugaugacauuguaagcuu

SEQ ID NO: 786735 - RNA, 22 nt, Human
uugagcuugaggaguuauuuga

SEQ ID NO: 786736 - RNA, 22 nt, Human
aagugauuucugccugcauguu

SEQ ID NO: 786737 - RNA, 22 nt, Human
acuuggucguggugcagcaugg

SEQ ID NO: 786738 - RNA, 22 nt, Human
acauuuaaugauccuacuguga

SEQ ID NO: 786739 - RNA, 22 nt, Human
uuuuccuuaacagagggagaaa

SEQ ID NO: 786740 - RNA, 22 nt, Human
augauugaaaaugacauugcca

SEQ ID NO: 786741 - RNA, 22 nt, Human
ugcuuucaaugaauuguauacu

SEQ ID NO: 786742 - RNA, 22 nt, Human
cacuuuuaacaggagaauuccc

SEQ ID NO: 786743 - RNA, 22 nt, Human
acauuugauauggaguugugua

SEQ ID NO: 786744 - RNA, 19 nt, Human
uugcuucaugucuuuugcu

SEQ ID NO: 786745 - RNA, 22 nt, Human
uacauguuauuucacuauuggu

SEQ ID NO: 786746 - RNA, 22 nt, Human
agauauguuaggcuuguucccu

SEQ ID NO: 786747 - RNA, 22 nt, Human
cuucauuaaugucuauaaguuu

SEQ ID NO: 786748 - RNA, 19 nt, Human
cucucagccugucuccuug

SEQ ID NO: 786749 - RNA, 22 nt, Human
gcagcugcgcugguguggggca

SEQ ID NO: 786750 - RNA, 21 nt, Human
ugcuaagugucacaugucugc

SEQ ID NO: 786751 - RNA, 22 nt, Human
aucacaguuuuaccauuuggua

SEQ ID NO: 786752 - RNA, 18 nt, Human
agguguguuucuaggagc

SEQ ID NO: 786753 - RNA, 17 nt, Human
aguuuuuggaccugugu

SEQ ID NO: 786754 - RNA, 22 nt, Human
agcagcaggugaccucgaugcc

SEQ ID NO: 786755 - RNA, 20 nt, Human
cuugaguucagagcugucau

SEQ ID NO: 786756 - RNA, 22 nt, Human
uugcaguuuugacagaccaaau

SEQ ID NO: 786757 - RNA, 22 nt, Human
acaguucuguccuagacuucgu

SEQ ID NO: 786758 - RNA, 22 nt, Human
ccacugcuaacuugcugcagcu

SEQ ID NO: 786759 - RNA, 21 nt, Human
aaagugguaaggauuauuuug

SEQ ID NO: 786760 - RNA, 22 nt, Human
uccucuucaaaauagcucugaa

SEQ ID NO: 786761 - RNA, 22 nt, Human
cugguuuuuagugcuuaggagu

SEQ ID NO: 786762 - RNA, 22 nt, Human
augauuuguuaacagacuuaau

SEQ ID NO: 786763 - RNA, 22 nt, Human
ugacuuuggacuagugauuuaa

SEQ ID NO: 786764 - RNA, 22 nt, Human
uuucauguuggauacuguuuca

SEQ ID NO: 786765 - RNA, 22 nt, Human
acucauuugcaugaugugcuau

SEQ ID NO: 786766 - RNA, 22 nt, Human
uuugucaccaguggcuuuggua

SEQ ID NO: 786767 - RNA, 22 nt, Human
caauuuuuaaacuaugaaguug

SEQ ID NO: 786768 - RNA, 22 nt, Human
caaaugaugcauggcuagugag

SEQ ID NO: 786769 - RNA, 22 nt, Human
acugcacuccagcccgagcaac

SEQ ID NO: 786770 - RNA, 22 nt, Human
uuaaguauauccauuugacugg

SEQ ID NO: 786771 - RNA, 22 nt, Human
uuucuucucacccaggacagag

SEQ ID NO: 786772 - RNA, 22 nt, Human
uuccaauaaaauguuauuugca

SEQ ID NO: 786773 - RNA, 22 nt, Human
ucacagcugggguuuuggcagc

SEQ ID NO: 786774 - RNA, 17 nt, Human
uguguaaguugcauaga

SEQ ID NO: 786775 - RNA, 22 nt, Human
caacauuucaaggucuuuagga

SEQ ID NO: 786776 - RNA, 22 nt, Human
acugauuucagggaugagaaga

SEQ ID NO: 786777 - RNA, 20 nt, Human
gacuucaauuucuaucuuuu

SEQ ID NO: 786778 - RNA, 22 nt, Human
aaguuugucucauuugaucuuc

SEQ ID NO: 786779 - RNA, 22 nt, Human
auccauuugccgugcuaugugc

SEQ ID NO: 786780 - RNA, 22 nt, Human
cucucuuuuucgugugccgaag

SEQ ID NO: 786781 - RNA, 22 nt, Human
aucuucaaagcacaucguuugu

SEQ ID NO: 786782 - RNA, 22 nt, Human
ugugcuauuuuugcauaugugu

SEQ ID NO: 786783 - RNA, 22 nt, Human
ucugcucagccgaucugcuccg

SEQ ID NO: 786784 - RNA, 22 nt, Human
ucucagcucauggcagccuuga

SEQ ID NO: 786785 - RNA, 22 nt, Human
ugccuguguccccuucuuggca

SEQ ID NO: 786786 - RNA, 22 nt, Human
agccugugcuguguuugcucca

SEQ ID NO: 786787 - RNA, 22 nt, Human
agacauauuggcuugcuuuaau

SEQ ID NO: 786788 - RNA, 19 nt, Human
cuccacagggauugugauu

SEQ ID NO: 786789 - RNA, 22 nt, Human
ucuuccagauacuuccugacuu

SEQ ID NO: 786790 - RNA, 22 nt, Human
gucauuuuugacuuugaaguga

SEQ ID NO: 786791 - RNA, 22 nt, Human
gauugcugccagcguguccgug

SEQ ID NO: 786792 - RNA, 22 nt, Human
cuuuacuucagcaagcuuuccu

SEQ ID NO: 786793 - RNA, 22 nt, Human
uucucuucacagggaucauccu

SEQ ID NO: 786794 - RNA, 22 nt, Human
cuucuucagaggccagccucug

SEQ ID NO: 786795 - RNA, 22 nt, Human
uccuuucuucuucugcccaugg

SEQ ID NO: 786796 - RNA, 22 nt, Human
acuuuucuuaucagaaaggcca

SEQ ID NO: 786797 - RNA, 21 nt, Human
uugauuuagcagaucuagcug

SEQ ID NO: 786798 - RNA, 22 nt, Human
cuguuuauucucaucuaaaaug

SEQ ID NO: 786799 - RNA, 22 nt, Human
ggcagucuuucccuugagcucu

SEQ ID NO: 786800 - RNA, 22 nt, Human
gcagcugccgugagcucacgcc

SEQ ID NO: 786801 - RNA, 22 nt, Human
auagucuuagaaucuugagugu

SEQ ID NO: 786802 - RNA, 22 nt, Human
gauuugucuauauucaaauaug

SEQ ID NO: 786803 - RNA, 23 nt, Human
augcaacauugccaguaugggca

SEQ ID NO: 786804 - RNA, 22 nt, Human
ugacauuugagagagauauaca

SEQ ID NO: 786805 - RNA, 22 nt, Human
acaguguuacuugauaguguau

SEQ ID NO: 786806 - RNA, 22 nt, Human metapneumovirus
caucgccuaccuccaguguaaa

SEQ ID NO: 786807 - RNA, 22 nt, Human metapneumovirus
ggcauaugaagagucauuuuca

SEQ ID NO: 786808 - RNA, 22 nt, Human
ucuguagcauucaccagcccug

SEQ ID NO: 786809 - RNA, 23 nt, Human
agcaacagugggugaguguugcu

SEQ ID NO: 786810 - RNA, 22 nt, Human
gaaggcaagcagcauaaauguc

SEQ ID NO: 786811 - RNA, 22 nt, Human
gacacuacguggcucacauuuc

SEQ ID NO: 786812 - RNA, 21 nt, Human
acucaucuuuuuggagaccag

SEQ ID NO: 786813 - RNA, 22 nt, Human
uauagcagcaugauuuauaguc

SEQ ID NO: 786814 - RNA, 22 nt, Human
uaugaaggauacaccucugauu

SEQ ID NO: 786815 - RNA, 22 nt, Human
uucuaguuacagaagccuugcu

SEQ ID NO: 786816 - RNA, 22 nt, Human
auuuacucgugcuucauugaau

SEQ ID NO: 786817 - RNA, 22 nt, Human
agcuaguauuucauugaggauu

SEQ ID NO: 786818 - RNA, 22 nt, Human
ucugccaucaagaugcucuggc

SEQ ID NO: 786819 - RNA, 22 nt, Human
aaugacaguggcacagucacuu

SEQ ID NO: 786820 - RNA, 22 nt, Human
uucaacaacuugguucaaaugg

SEQ ID NO: 786821 - RNA, 22 nt, Human
agucauguguucaucuuucauu

SEQ ID NO: 786822 - RNA, 22 nt, Human
ugcauguuuuauaccaaagcuu

SEQ ID NO: 786823 - RNA, 18 nt, Human
uccaccgcgugcaccucu

SEQ ID NO: 786824 - RNA, 22 nt, Human
aaugucaacacaagagaaaugc

SEQ ID NO: 786825 - RNA, 22 nt, Human
uugcuauuuugagagucauagu

SEQ ID NO: 786826 - RNA, 20 nt, Human
gugcccaguuggugacagac

SEQ ID NO: 786827 - RNA, 22 nt, Human
cacaguuuugucuugguuucca

SEQ ID NO: 786828 - RNA, 19 nt, Human
auacacguguauacauaca

SEQ ID NO: 786829 - RNA, 22 nt, Human
uacauguacaugcauagguaga

SEQ ID NO: 786830 - RNA, 22 nt, Human
caggaacacaaugagucucaaa

SEQ ID NO: 786831 - RNA, 22 nt, Human
caagauauguccuguuacuaag

SEQ ID NO: 786832 - RNA, 22 nt, Human
cuucuaauucuuauguaagcuu

SEQ ID NO: 786833 - RNA, 22 nt, Human
gacauacagcccucucccuggu

SEQ ID NO: 786834 - RNA, 22 nt, Human
uuuucuuggaguggcuguccuu

SEQ ID NO: 786835 - RNA, 23 nt, Human
ccccacuaccgugaugugcgagg

SEQ ID NO: 786836 - RNA, 22 nt, Human
auguacauuauucgagugaugg

SEQ ID NO: 786837 - RNA, 22 nt, Human
uuccaauaaaauguuauuugca

SEQ ID NO: 786838 - RNA, 22 nt, Human
auauaaguguguggcuguuagu

SEQ ID NO: 786839 - RNA, 23 nt, Human
uacagccaugucgcugauuuaac

SEQ ID NO: 786840 - RNA, 22 nt, Human
acaguguuucacuuaaccguuu

SEQ ID NO: 786841 - RNA, 22 nt, Human
auggcuguguuguuccucugaa

SEQ ID NO: 786842 - RNA, 22 nt, Human
aaaugcaugugcuauagaugug

SEQ ID NO: 786843 - RNA, 22 nt, Human
uuguugcugcucaaccucuaua

SEQ ID NO: 786844 - RNA, 22 nt, Human
acaguuaguugaggaguguuug

SEQ ID NO: 786845 - RNA, 22 nt, Human
ugucacagagcgugcaacagaa

SEQ ID NO: 786846 - RNA, 21 nt, Human
guucaauagcucuuugaaugc

SEQ ID NO: 786847 - RNA, 22 nt, Human
uaacacauagauauuuuaacuu

SEQ ID NO: 786848 - RNA, 22 nt, Human
cugcgugguaggacucaguucu

SEQ ID NO: 786849 - RNA, 22 nt, Human
uucucucaguuaaacuuuguga

SEQ ID NO: 786850 - RNA, 22 nt, Human
uacaccagauuauuuauaacau

SEQ ID NO: 786851 - RNA, 22 nt, Human
uggcacaguuaaaguuguagaa

SEQ ID NO: 786852 - RNA, 22 nt, Human
auguuugaaauuguaaguauau

SEQ ID NO: 786853 - RNA, 19 nt, Human
aacuacagcgcacuguccu

SEQ ID NO: 786854 - RNA, 22 nt, Human
agaaacaucgcuuaguccucau

SEQ ID NO: 786855 - RNA, 22 nt, Human
cacucucacaugcccugucagu

SEQ ID NO: 786856 - RNA, 22 nt, Human
aggcucaguauagcuggcaagu

SEQ ID NO: 786857 - RNA, 22 nt, Human
augcaguuagguaauagucuca

SEQ ID NO: 786858 - RNA, 21 nt, Human
auacaagaagauggcagucug

SEQ ID NO: 786859 - RNA, 22 nt, Human
auauggcuguugcacaucuaag

SEQ ID NO: 786860 - RNA, 22 nt, Human
ucacuuuaccucauucaggcag

SEQ ID NO: 786861 - RNA, 22 nt, Human
uguguacauguaucaacuaucg

SEQ ID NO: 786862 - RNA, 22 nt, Human
uauaagaaacaaggcaaauuuu

SEQ ID NO: 786863 - RNA, 22 nt, Human
aucccugugacgagcaucccua

SEQ ID NO: 786864 - RNA, 22 nt, Human
auacaugugugugcauacaugu

SEQ ID NO: 786865 - RNA, 22 nt, Human
uuguacacacaggaacaaacgu

SEQ ID NO: 786866 - RNA, 22 nt, Human
uguacauacauagauauacaca

SEQ ID NO: 786867 - RNA, 22 nt, Human
auacaugacucacacauucugc

SEQ ID NO: 786868 - RNA, 22 nt, Human
augcacacguacccuacaaggc

SEQ ID NO: 786869 - RNA, 22 nt, Human
uucguuuaguccacaaaugcau

SEQ ID NO: 786870 - RNA, 22 nt, Human
uaagaaacauuuuuaugacagu

SEQ ID NO: 786871 - RNA, 22 nt, Human
auuguuacuggguuaauuugga

SEQ ID NO: 786872 - RNA, 22 nt, Human
uaaugccuuucuguacuauaug

SEQ ID NO: 786873 - RNA, 22 nt, Human
aaugcaaugcagcaccuccuug

SEQ ID NO: 786874 - RNA, 22 nt, Human
ccucauucucgcguguguuucu

SEQ ID NO: 786875 - RNA, 22 nt, Human
auccauuugccgugcuaugugc

SEQ ID NO: 786876 - RNA, 22 nt, Human
cacuguugagcaauguacagug

SEQ ID NO: 786877 - RNA, 22 nt, Human
uccccaguaagccugcacugug

SEQ ID NO: 786878 - RNA, 22 nt, Human
uguccugugcacuguagcaugu

SEQ ID NO: 786879 - RNA, 22 nt, Human
gauacuuuguggaauccuggau

SEQ ID NO: 786880 - RNA, 22 nt, Human
caugcauuucuaccaaggaaua

SEQ ID NO: 786881 - RNA, 22 nt, Human
aagcauuuuagauaaagcauca

SEQ ID NO: 786882 - RNA, 19 nt, Human
acacaccagugccugugac

SEQ ID NO: 786883 - RNA, 22 nt, Human
ucauacauguuguguucaaaug

SEQ ID NO: 786884 - RNA, 22 nt, Human
uucacauaaucugcagcaagcg

SEQ ID NO: 786885 - RNA, 22 nt, Human
guuuacaacaucuuguccuuca

SEQ ID NO: 786886 - RNA, 22 nt, Human
auauacacuguuucaguugaag

SEQ ID NO: 786887 - RNA, 22 nt, Human
agucaacauuugagaugcaaug

SEQ ID NO: 786888 - RNA, 22 nt, Human
auacaacagaaaaugauuauuc

SEQ ID NO: 786889 - RNA, 22 nt, Human
cucuguccugguuuauacuggc

SEQ ID NO: 786890 - RNA, 22 nt, Human
agucaggacagauuuucugggg

SEQ ID NO: 786891 - RNA, 22 nt, Human
caugugaccgcugggugagcga

SEQ ID NO: 786892 - RNA, 22 nt, Human
uugcaguugcuguauuuaagga

SEQ ID NO: 786893 - RNA, 22 nt, Human
aauaucuagccuuuagcagcuu

SEQ ID NO: 786894 - RNA, 22 nt, Human
aauguuaaguuuagauuauaac

SEQ ID NO: 786895 - RNA, 22 nt, Human
caugccugccuggugggcgugg

SEQ ID NO: 786896 - RNA, 22 nt, Human
ccaucuucucuugaaccuccuu

SEQ ID NO: 786897 - RNA, 22 nt, Human
uguauauacacacucccauguu

SEQ ID NO: 786898 - RNA, 22 nt, Human
gugacagguauacucaccauug

SEQ ID NO: 786899 - RNA, 22 nt, Human
cacauuuaugggcugggaggca

SEQ ID NO: 786900 - RNA, 22 nt, Human
caauguacaaaauaauuacaca

SEQ ID NO: 786901 - RNA, 22 nt, Human
uguguccugugaucucuagggu

SEQ ID NO: 786902 - RNA, 22 nt, Human
ugugcugcucucagugacagcc

SEQ ID NO: 786903 - RNA, 22 nt, Human
uaaaaucaugacagauugacau

SEQ ID NO: 786904 - RNA, 22 nt, Human
cauuuacauuuaagguuaauau

SEQ ID NO: 786905 - RNA, 18 nt, Human
cugccuguugcugagagg

SEQ ID NO: 786906 - RNA, 22 nt, Human
uccugugccuccaccugcuccg

SEQ ID NO: 786907 - RNA, 22 nt, Human
aaauugcaaaaguacuuuuagg

SEQ ID NO: 786908 - RNA, 21 nt, Human
aggcaugagcccugcauggac

SEQ ID NO: 786909 - RNA, 22 nt, Human
acugcauuaucaccaagaugua

SEQ ID NO: 786910 - RNA, 22 nt, Human
accauccuuuaguuugcguuuc

SEQ ID NO: 786911 - RNA, 22 nt, Human
uuuacuuuugguaaggucauuu

SEQ ID NO: 786912 - RNA, 22 nt, Human
uguacauauucaagcacuucua

SEQ ID NO: 786913 - RNA, 22 nt, Human
ccauuuguaccauuucuuugua

SEQ ID NO: 786914 - RNA, 20 nt, Human
acaacuuaguugagagacua

SEQ ID NO: 786915 - RNA, 22 nt, Human
agugaaaaccuaaucaugcagu

SEQ ID NO: 786916 - RNA, 22 nt, Human
uaaaugcaguacaaauuguucu

SEQ ID NO: 786917 - RNA, 22 nt, Human
cacuuuuaacaggagaauuccc

SEQ ID NO: 786918 - RNA, 21 nt, Human
ugcauauauaagugcauacac

SEQ ID NO: 786919 - RNA, 22 nt, Human
gaaggcaagugagccaagagaa

SEQ ID NO: 786920 - RNA, 22 nt, Human
ucgcuuuaauggucuucacagc

SEQ ID NO: 786921 - RNA, 22 nt, Human
uaucacauacuucucauccagg

SEQ ID NO: 786922 - RNA, 22 nt, Human
guccacauaggaacccagcuuc

SEQ ID NO: 786923 - RNA, 22 nt, Human
ucacacaucucagguguuuaau

SEQ ID NO: 786924 - RNA, 22 nt, Human
cuccacagccccuccaguggca

SEQ ID NO: 786925 - RNA, 22 nt, Human
auacacauguuauuguggaagc

SEQ ID NO: 786926 - RNA, 22 nt, Human
uuguguacucaccagcacauac

SEQ ID NO: 786927 - RNA, 22 nt, Human
uagcagcacuauuuguuguagu

SEQ ID NO: 786928 - RNA, 22 nt, Human
gcuacaggggucaguccuuugc

SEQ ID NO: 786929 - RNA, 22 nt, Human
uucaaacaguguagaauauaug

SEQ ID NO: 786930 - RNA, 22 nt, Human
acugcauucuuuaucccacaac

SEQ ID NO: 786931 - RNA, 22 nt, Human
ucaucuguuaugggaguuuuug

SEQ ID NO: 786932 - RNA, 22 nt, Human
ugugacagugccagcuucauag

SEQ ID NO: 786933 - RNA, 22 nt, Human
uguguccuucugggagucccag

SEQ ID NO: 786934 - RNA, 22 nt, Human
ugggaugagcuauauagaaagu

SEQ ID NO: 786935 - RNA, 22 nt, Human
uaccuugugagcuuucuaacau

SEQ ID NO: 786936 - RNA, 22 nt, Human
ugcauuucccauuguguggcuc

SEQ ID NO: 786937 - RNA, 22 nt, Human
ugaaaugccuaugaagucagga

SEQ ID NO: 786938 - RNA, 18 nt, Human
agguauaugaaucucuuu

SEQ ID NO: 786939 - RNA, 22 nt, Human
cacauuuaaagguugaagcuga

SEQ ID NO: 786940 - RNA, 22 nt, Human
acaggaaaugaaaugguaucua

SEQ ID NO: 786941 - RNA, 22 nt, Human
agcacguucuucauuacuucac

SEQ ID NO: 786942 - RNA, 22 nt, Human
auggcuucugucuuggaaauuu

SEQ ID NO: 786943 - RNA, 19 nt, Human
cuccacagggauugugauu

SEQ ID NO: 786944 - RNA, 22 nt, Human
cucagucucuugggcugugaag

SEQ ID NO: 786945 - RNA, 22 nt, Human
acauuuaaugauccuacuguga

SEQ ID NO: 786946 - RNA, 22 nt, Human
acaccacaaguaacucuuuucc

SEQ ID NO: 786947 - RNA, 22 nt, Human
cuuuauguuggggugucuuagu

SEQ ID NO: 786948 - RNA, 22 nt, Human
guuuauuggguauuguggagcc

SEQ ID NO: 786949 - RNA, 22 nt, Human
auugcacaucugcacuacagcc

SEQ ID NO: 786950 - RNA, 22 nt, Human
cacaguuuuaucuuauacugau

SEQ ID NO: 786951 - RNA, 22 nt, Human
ccacuguuggcccgaagggguc

SEQ ID NO: 786952 - RNA, 22 nt, Human
uucaaacacugcuuugagaggg

SEQ ID NO: 786953 - RNA, 22 nt, Human
ugauuugaaaccuuuggcaaga

SEQ ID NO: 786954 - RNA, 22 nt, Human
caguuuuucaaaauuacaugau

SEQ ID NO: 786955 - RNA, 22 nt, Human
auguaacauaugugaucgcauu

SEQ ID NO: 786956 - RNA, 22 nt, Human
ugcauuugcaauggguacacaa

SEQ ID NO: 786957 - RNA, 21 nt, Human
uaaacauaaccuuguauggcu

SEQ ID NO: 786958 - RNA, 22 nt, Human
ccaaacauuucaaauuuagaga

SEQ ID NO: 786959 - RNA, 22 nt, Human
uguuaguauuggcaaauuuguu

SEQ ID NO: 786960 - RNA, 22 nt, Human
ccuguaccgcgaucugcugcgc

SEQ ID NO: 786961 - RNA, 22 nt, Human
aagcacagggacucaggaccgg

SEQ ID NO: 786962 - RNA, 22 nt, Human
ugccuguguccccuucuuggca

SEQ ID NO: 786963 - RNA, 22 nt, Human
aaaugccucauuuucucucacu

SEQ ID NO: 786964 - RNA, 21 nt, Human
cacuccacuuagaacaggguu

SEQ ID NO: 786965 - RNA, 22 nt, Human
uagcuucccugcuggaucauaa

SEQ ID NO: 786966 - RNA, 22 nt, Human
uguaauguuagaaacaauugcu

SEQ ID NO: 786967 - RNA, 22 nt, Human
uacaguaaccagucuacuuaga

SEQ ID NO: 786968 - RNA, 22 nt, Human
uauacuacgcaccaaacaaagg

SEQ ID NO: 786969 - RNA, 21 nt, Human
gccaccucaaucuucuagcgc

SEQ ID NO: 786970 - RNA, 22 nt, Human
cauaacauccuugcuacuuuga

SEQ ID NO: 786971 - RNA, 22 nt, Human
acucaucuuugaauuuucagua

SEQ ID NO: 786972 - RNA, 22 nt, Human
cauuuugugcuagacacuaugg

SEQ ID NO: 786973 - RNA, 22 nt, Human
gcacaaaagguacuucauguag

SEQ ID NO: 786974 - RNA, 22 nt, Human
augcacaagguagauuauuauu

SEQ ID NO: 786975 - RNA, 22 nt, Human
uccucuucaaaauagcucugaa

SEQ ID NO: 786976 - RNA, 22 nt, Human
acaacuuuaauggguuucagcu

SEQ ID NO: 786977 - RNA, 22 nt, Human
aacaguaugugagauuuacaca

SEQ ID NO: 786978 - RNA, 22 nt, Human
gauguauagcuuuaacugaccc

SEQ ID NO: 786979 - RNA, 22 nt, Human
uguccugugaccuggcaccaca

SEQ ID NO: 786980 - RNA, 22 nt, Human
uuaccacagugccugucuaaug

SEQ ID NO: 786981 - RNA, 22 nt, Human
acaugacagugacuuuauaaga

SEQ ID NO: 786982 - RNA, 22 nt, Human
uuuccacacucacugcacucau

SEQ ID NO: 786983 - RNA, 22 nt, Human
acagggcaccugagguaggaag

SEQ ID NO: 786984 - RNA, 22 nt, Human
uacuacauacagaauuuagaga

SEQ ID NO: 786985 - RNA, 22 nt, Human
auuccaaagccugaauaaugga

SEQ ID NO: 786986 - RNA, 22 nt, Human
auauauacuuugacacauucug

SEQ ID NO: 786987 - RNA, 22 nt, Human
auaguguguaaagugcagugau

SEQ ID NO: 786988 - RNA, 22 nt, Human
gguuuguggagcuggaaacacu

SEQ ID NO: 786989 - RNA, 20 nt, Human
uaugauaauuacaaaauagu

SEQ ID NO: 786990 - RNA, 22 nt, Human
ucacacuuuauuuauuucaugc

SEQ ID NO: 786991 - RNA, 22 nt, Human
uuccaaggcugcuauuuguuuc

SEQ ID NO: 786992 - RNA, 22 nt, Human
cuguccuaugaguacucacuag

SEQ ID NO: 786993 - RNA, 22 nt, Human
uuuugguaauuaaguagauauu

SEQ ID NO: 786994 - RNA, 22 nt, Human
ucuucaugucaugguauauuga

SEQ ID NO: 786995 - RNA, 22 nt, Human
ugcugcucuucaccauggccuc

SEQ ID NO: 786996 - RNA, 22 nt, Human
aaacccugagacuuggggccag

SEQ ID NO: 786997 - RNA, 22 nt, Human
uguuuuaagggucaacugucac

SEQ ID NO: 786998 - RNA, 22 nt, Human
uaaugccuuaugucaaauguaa

SEQ ID NO: 786999 - RNA, 22 nt, Human
cagggaugggauggagucaguu

SEQ ID NO: 787000 - RNA, 22 nt, Human
uugcucuauguuuguaaacaga

SEQ ID NO: 787001 - RNA, 22 nt, Human
ugcacacaguucucaggaaaga

SEQ ID NO: 787002 - RNA, 22 nt, Human
ugcaggaacucgaaaacuauag

SEQ ID NO: 787003 - RNA, 22 nt, Human
guuauguaaucuaacacucagu

SEQ ID NO: 787004 - RNA, 22 nt, Human
cuguauaugugcauacacacac

SEQ ID NO: 787005 - RNA, 22 nt, Human
uacauguuauuucacuauuggu

SEQ ID NO: 787006 - RNA, 22 nt, Human
aauggcuguucucugugauugg

SEQ ID NO: 787007 - RNA, 22 nt, Human
augcuacauuuugguuuauaaa

SEQ ID NO: 787008 - RNA, 22 nt, Human
ccccagcagacucagggcaggu

SEQ ID NO: 787009 - RNA, 22 nt, Human
auaguagcgagaucucagcuca

SEQ ID NO: 787010 - RNA, 22 nt, Human
cucagcaacccacacacggucu

SEQ ID NO: 787011 - RNA, 22 nt, Human
accagucauagaaagcaguggu

SEQ ID NO: 787012 - RNA, 22 nt, Human
aggcuguccucucuugcucagu

SEQ ID NO: 787013 - RNA, 22 nt, Human
uuauugcuaugaugauguguag

SEQ ID NO: 787014 - RNA, 22 nt, Human
uagcaggaggcaguuccucgcu

SEQ ID NO: 787015 - RNA, 22 nt, Human
ugcauguuucuguauguuaaug

SEQ ID NO: 787016 - RNA, 22 nt, Human
ucugagugggaacucucaugac

SEQ ID NO: 787017 - RNA, 22 nt, Human
gcaguggccacauggaggagga

SEQ ID NO: 787018 - RNA, 22 nt, Human
cacagcuaccugcaugccugcu

SEQ ID NO: 787019 - RNA, 22 nt, Human
cugucacagcccgcgucuccuc

SEQ ID NO: 787020 - RNA, 22 nt, Human
acaggacagucuaguaacagua

SEQ ID NO: 787021 - RNA, 22 nt, Human
uguccagaucaaugcccacaug

SEQ ID NO: 787022 - RNA, 22 nt, Human
gaaaauaguucaucacaaugau

SEQ ID NO: 787023 - RNA, 22 nt, Human
auuucauccauuaagaguacuc

SEQ ID NO: 787024 - RNA, 22 nt, Human
auuuacagacguggauuagugc

SEQ ID NO: 787025 - RNA, 22 nt, Human
acaaaugcuuaguucaccaaaa

SEQ ID NO: 787026 - RNA, 22 nt, Human
ucaguaaaugagcaaaaauuuc

SEQ ID NO: 787027 - RNA, 22 nt, Human
cacaucauguuaauucauuaca

SEQ ID NO: 787028 - RNA, 22 nt, Human
agucacuguuuaaucuagcuaa

SEQ ID NO: 787029 - RNA, 22 nt, Human
gaggucaggggagaggcugaug

SEQ ID NO: 787030 - RNA, 22 nt, Human
uucagucuuguugaaaacuugg

SEQ ID NO: 787031 - RNA, 20 nt, Human
ucauaugugguuguauacaa

SEQ ID NO: 787032 - RNA, 22 nt, Human
uacugcaaaccauuuacaguag

SEQ ID NO: 787033 - RNA, 22 nt, Human
ugucaccuugcucauccucgga

SEQ ID NO: 787034 - RNA, 22 nt, Human
aagcaauucacaguucacuuaa

SEQ ID NO: 787035 - RNA, 22 nt, Human
auguaguauuuggaaauguaaa

SEQ ID NO: 787036 - RNA, 22 nt, Human
acaugacagugacuuuauaaga

SEQ ID NO: 787037 - RNA, 22 nt, Human
auuauguagcuaaaaauugugu

SEQ ID NO: 787038 - RNA, 22 nt, Human
uggcauuuuguagcuguguauc

SEQ ID NO: 787039 - RNA, 20 nt, Human
uaugauaauuacaaaauagu

SEQ ID NO: 787040 - RNA, 22 nt, Human
uuugcacuuaaauuuacaacac

SEQ ID NO: 787041 - RNA, 19 nt, Human
ugcucucuggugcuucaug

SEQ ID NO: 787042 - RNA, 22 nt, Human
cuaguauuaagugugaguaaaa

SEQ ID NO: 787043 - RNA, 22 nt, Human
uaucuguagucucaugguuccu

SEQ ID NO: 787044 - RNA, 22 nt, Human
acagcugggaacucacacagca

SEQ ID NO: 787045 - RNA, 20 nt, Human
uccaguuuuggagacauucu

SEQ ID NO: 787046 - RNA, 22 nt, Human
aaaugcacugaauauuccaaau

SEQ ID NO: 787047 - RNA, 22 nt, Human
accaaauaggcuuccuggguug

SEQ ID NO: 787048 - RNA, 22 nt, Human
ggugucagugaagguagaguuu

SEQ ID NO: 787049 - RNA, 22 nt, Human
uugcuauuuugagagucauagu

SEQ ID NO: 787050 - RNA, 22 nt, Human
auauaguuggguuucauucuac

SEQ ID NO: 787051 - RNA, 22 nt, Human
aaaacauuuuacugccaucuca

SEQ ID NO: 787052 - RNA, 22 nt, Human
acaguaaucugggaacuuguua

SEQ ID NO: 787053 - RNA, 22 nt, Human
acugccaguuguuuuguccagu

SEQ ID NO: 787054 - RNA, 22 nt, Human
caguuuuucaaaauuacaugau

SEQ ID NO: 787055 - RNA, 22 nt, Human
cacaguuuugucuugguuucca

SEQ ID NO: 787056 - RNA, 22 nt, Human
uccacagugguggaauuguuca

SEQ ID NO: 787057 - RNA, 22 nt, Human
acugcauucuuuaucccacaac

SEQ ID NO: 787058 - RNA, 22 nt, Human
auagacacagcuaugauuugag

SEQ ID NO: 787059 - RNA, 22 nt, Human
uaaaaucaugacagauugacau

SEQ ID NO: 787060 - RNA, 22 nt, Human
ugugguuuugguucagaaacaa

SEQ ID NO: 787061 - RNA, 22 nt, Human
aaugugcugguaacugcuuugc

SEQ ID NO: 787062 - RNA, 22 nt, Human
aaauugcaaaaguacuuuuagg

SEQ ID NO: 787063 - RNA, 22 nt, Human
aguuggcauuuuauuuaaguau

SEQ ID NO: 787064 - RNA, 22 nt, Human
caguauguuuauuagaacugca

SEQ ID NO: 787065 - RNA, 22 nt, Human
uacaucucaucugugcucuccg

SEQ ID NO: 787066 - RNA, 22 nt, Human
augcaguuagguaauagucuca

SEQ ID NO: 787067 - RNA, 22 nt, Human
caacauuucaaggucuuuagga

SEQ ID NO: 787068 - RNA, 22 nt, Human
aauuauguuugcuuuagaugga

SEQ ID NO: 787069 - RNA, 22 nt, Human
cuccugcagcccucagcagcca

SEQ ID NO: 787070 - RNA, 22 nt, Human
uagcauuucacugaucuucacu

SEQ ID NO: 787071 - RNA, 22 nt, Human
gugcaggacagcacaucuccug

SEQ ID NO: 787072 - RNA, 22 nt, Human
ucuuugcauggacauguguuuu

SEQ ID NO: 787073 - RNA, 22 nt, Human
ugcauguuucuguauguuaaug

SEQ ID NO: 787074 - RNA, 22 nt, Human
gucucuaucauagcugaacccu

SEQ ID NO: 787075 - RNA, 22 nt, Human
uuguaacaguagcugucagcuc

SEQ ID NO: 787076 - RNA, 22 nt, Human
ugcaaauauuccaugcuguuca

SEQ ID NO: 787077 - RNA, 22 nt, Human
cucugcaggcacccaggguggg

SEQ ID NO: 787078 - RNA, 22 nt, Human
cuuaagacaggcucaaagauua

SEQ ID NO: 787079 - RNA, 22 nt, Human
uauaugcagauuuucaucaucg

SEQ ID NO: 787080 - RNA, 20 nt, Human
uuucacaaugaacaugucuc

SEQ ID NO: 787081 - RNA, 22 nt, Human
gcacaaaagguacuucauguag

SEQ ID NO: 787082 - RNA, 18 nt, Human
cgauguguaugugauuug

SEQ ID NO: 787083 - RNA, 22 nt, Human
uacuguauacuacugcuguucu

SEQ ID NO: 787084 - RNA, 22 nt, Human
cacuuuuaacaggagaauuccc

SEQ ID NO: 787085 - RNA, 22 nt, Human
gcaguuaccuauuuuguagaaa

SEQ ID NO: 787086 - RNA, 17 nt, Human
acuuguauugugcuuua

SEQ ID NO: 787087 - RNA, 22 nt, Human
uuuauacuccacucugcaagcg

SEQ ID NO: 787088 - RNA, 22 nt, Human
augaacaguacaaagcacagac

SEQ ID NO: 787089 - RNA, 22 nt, Human
cucuggaucugcccugacgcca

SEQ ID NO: 787090 - RNA, 22 nt, Human
ucugagaaugguggauguggug

SEQ ID NO: 787091 - RNA, 22 nt, Human
agucaggacagauuuucugggg

SEQ ID NO: 787092 - RNA, 22 nt, Human
gugucccaaagauuagaaauca

SEQ ID NO: 787093 - RNA, 21 nt, Human
uuuguucaggggcaaaguuaa

SEQ ID NO: 787094 - RNA, 22 nt, Human
cacuguuuuacauguuauuuaa

SEQ ID NO: 787095 - RNA, 22 nt, Human
uucaguaugcugaaugauuuuu

SEQ ID NO: 787096 - RNA, 22 nt, Human
agucuggagugauuauguggga

SEQ ID NO: 787097 - RNA, 22 nt, Human
aucuaugugggaaucauaauag

SEQ ID NO: 787098 - RNA, 22 nt, Human
ugucauauagaauguucuauga

SEQ ID NO: 787099 - RNA, 22 nt, Human
cauguguauuauucuuguggaa

SEQ ID NO: 787100 - RNA, 22 nt, Human
guuauguaaucuaacacucagu

SEQ ID NO: 787101 - RNA, 22 nt, Human
uccucuucaaaauagcucugaa

SEQ ID NO: 787102 - RNA, 22 nt, Human
gguagacaacuuuguaauagcc

SEQ ID NO: 787103 - RNA, 22 nt, Human
auguaguauuuggaaauguaaa

SEQ ID NO: 787104 - RNA, 22 nt, Human
ucugcuugugucuguccagccu

SEQ ID NO: 787105 - RNA, 21 nt, Human
acuguauuguuuucaaggauc

SEQ ID NO: 787106 - RNA, 22 nt, Human
uuauuuaaaagugguaagauuc

SEQ ID NO: 787107 - RNA, 22 nt, Human
uaacacauagauauuuuaacuu

SEQ ID NO: 787108 - RNA, 22 nt, Human
uaucacauacuucucauccagg

SEQ ID NO: 787109 - RNA, 22 nt, Human
augcacaagguagauuauuauu

SEQ ID NO: 787110 - RNA, 22 nt, Human
uuucuacacuucgugguguuuu

SEQ ID NO: 787111 - RNA, 22 nt, Human
uccaaauagcuggaugauggug

SEQ ID NO: 787112 - RNA, 22 nt, Human
auguccaggaagucuuaacuca

SEQ ID NO: 787113 - RNA, 22 nt, Human
caacuuuagaccccaaguagcu

SEQ ID NO: 787114 - RNA, 22 nt, Human
gugcauauguguguauacaaac

SEQ ID NO: 787115 - RNA, 22 nt, Human
acagacacaggcguggagucgc

SEQ ID NO: 787116 - RNA, 22 nt, Human
ccugugauauuguucauaauau

SEQ ID NO: 787117 - RNA, 22 nt, Human
cugcaguucuucuccucaaggc

SEQ ID NO: 787118 - RNA, 22 nt, Human
cugucuacagaugaaauaagca

SEQ ID NO: 787119 - RNA, 22 nt, Human
ucagacaccgucuauuuugccu

SEQ ID NO: 787120 - RNA, 22 nt, Human
uaucuguauucugacagucacu

SEQ ID NO: 787121 - RNA, 22 nt, Human
uuugugcaagagggccaccuua

SEQ ID NO: 787122 - RNA, 22 nt, Human
caagauauguccuguuacuaag

SEQ ID NO: 787123 - RNA, 20 nt, Human
ucauaugugguuguauacaa

SEQ ID NO: 787124 - RNA, 18 nt, Human
ucagacaaguuagacagg

SEQ ID NO: 787125 - RNA, 23 nt, Human
ugucuggauucgacugugguugg

SEQ ID NO: 787126 - RNA, 22 nt, Human
uuccagcuaacucacaucccuu

SEQ ID NO: 787127 - RNA, 22 nt, Human
aagcauuucagguagagauauu

SEQ ID NO: 787128 - RNA, 22 nt, Human
uuacuguagcuugacauauguc

SEQ ID NO: 787129 - RNA, 22 nt, Human
uccccaguaagccugcacugug

SEQ ID NO: 787130 - RNA, 22 nt, Human
aaugcuuuuugcgaaaugugca

SEQ ID NO: 787131 - RNA, 22 nt, Human
acaagucaguggaauuaauauu

SEQ ID NO: 787132 - RNA, 22 nt, Human
cucuguccugguuuauacuggc

SEQ ID NO: 787133 - RNA, 22 nt, Human
auguacaaucuaucacaagaag

SEQ ID NO: 787134 - RNA, 22 nt, Human
gccauguucuugaaucuggguc

SEQ ID NO: 787135 - RNA, 20 nt, Human
acaacuuaguugagagacua

SEQ ID NO: 787136 - RNA, 22 nt, Human
agaguuuacagaaauaagcugu

SEQ ID NO: 787137 - RNA, 22 nt, Human
ugguacauggguagguaucucu

SEQ ID NO: 787138 - RNA, 21 nt, Human
uccugccuuaguccagagcag

SEQ ID NO: 787139 - RNA, 22 nt, Human
aguaacagguguacagacuauc

SEQ ID NO: 787140 - RNA, 22 nt, Human
cauuaacacuuuggauuuagac

SEQ ID NO: 787141 - RNA, 22 nt, Human
uaucuguuuuuacagugucuuu

SEQ ID NO: 787142 - RNA, 22 nt, Human
augauuuguuaacagacuuaau

SEQ ID NO: 787143 - RNA, 22 nt, Human
aaugcugugauuuauuaaguau

SEQ ID NO: 787144 - RNA, 22 nt, Human
uacaguaaccagucuacuuaga

SEQ ID NO: 787145 - RNA, 22 nt, Human
uguauuucugcuuucucuagua

SEQ ID NO: 787146 - RNA, 22 nt, Human
ccucuucuaggacguccuugug

SEQ ID NO: 787147 - RNA, 22 nt, Human
caagcagauauuuuagucaaga

SEQ ID NO: 787148 - RNA, 22 nt, Human
guuagguagaaguuuacuuuga

SEQ ID NO: 787149 - RNA, 21 nt, Human
guucaauagcucuuugaaugc

SEQ ID NO: 787150 - RNA, 22 nt, Human
aaacacaucauucaugucguca

SEQ ID NO: 787151 - RNA, 22 nt, Human
aaaugcacaauaaaguaaaggc

SEQ ID NO: 787152 - RNA, 22 nt, Human
aguaucagaugugauuaaaggg

SEQ ID NO: 787153 - RNA, 22 nt, Human
ccacuguuuccuuucugcuggc

SEQ ID NO: 787154 - RNA, 22 nt, Human
aggcuguccucucuugcucagu

SEQ ID NO: 787155 - RNA, 22 nt, Human
uuauuuaaaauguagguuggga

SEQ ID NO: 787156 - RNA, 22 nt, Human
guuuccagccuccuggguaaag

SEQ ID NO: 787157 - RNA, 20 nt, Human
aaaaacaguaaugcugaaga

SEQ ID NO: 787158 - RNA, 22 nt, Human
aagacacuuucuaaauagaagu

SEQ ID NO: 787159 - RNA, 22 nt, Human
gaaacuguauguaguuuuuggg

SEQ ID NO: 787160 - RNA, 18 nt, Human
augcucuagucuuuccug

SEQ ID NO: 787161 - RNA, 22 nt, Human
gucuuuuuuacaccuuacauca

SEQ ID NO: 787162 - RNA, 22 nt, Human
acaaucagcacugaguuuaucu

SEQ ID NO: 787163 - RNA, 22 nt, Human
uauacuacgcaccaaacaaagg

SEQ ID NO: 787164 - RNA, 22 nt, Human
agacacuguguacagaaaaaga

SEQ ID NO: 787165 - RNA, 22 nt, Human
uuccugcaggccauagagccug

SEQ ID NO: 787166 - RNA, 21 nt, Human
ccacaauucuaguuacauaug

SEQ ID NO: 787167 - RNA, 22 nt, Human
aggagucaccugcccaaaguca

SEQ ID NO: 787168 - RNA, 23 nt, Human
ugucuccaucucauuacuugggg

SEQ ID NO: 787169 - RNA, 23 nt, Human
auaugucaugcaccagcacuuua

SEQ ID NO: 787170 - RNA, 18 nt, Human
uauaaacacacuuagguu

SEQ ID NO: 787171 - RNA, 22 nt, Human
auuacugaggcaaaguaguuuu

SEQ ID NO: 787172 - RNA, 22 nt, Human
uguaauguuagaaacaauugcu

SEQ ID NO: 787173 - RNA, 22 nt, Human
uugcaguuuugacagaccaaau

SEQ ID NO: 787174 - RNA, 22 nt, Human
aguguguccaggaagcagaugg

SEQ ID NO: 787175 - RNA, 22 nt, Human
aacacuaaaggucaguuagaag

SEQ ID NO: 787176 - RNA, 22 nt, Human
uuuaauuauaucugggcaguua

SEQ ID NO: 787177 - RNA, 22 nt, Human
gugcuaugauuggacagaauag

SEQ ID NO: 787178 - RNA, 22 nt, Human
ugcagcaucuccuugugccaug

SEQ ID NO: 787179 - RNA, 22 nt, Human
auauuuguuuggcagaguucag

SEQ ID NO: 787180 - RNA, 22 nt, Human
uugcaguugcuguauuuaagga

SEQ ID NO: 787181 - RNA, 22 nt, Human
auagcaaaggacaauagucagu

SEQ ID NO: 787182 - RNA, 22 nt, Human
ccuguaccgcgaucugcugcgc

SEQ ID NO: 787183 - RNA, 22 nt, Human
cucucuguuaugcuuucaugaa

SEQ ID NO: 787184 - RNA, 22 nt, Human
augguuuuguccucuuugguuc

SEQ ID NO: 787185 - RNA, 22 nt, Human
gacauacagcccucucccuggu

SEQ ID NO: 787186 - RNA, 22 nt, Human
caauaguaaauuacggaggaga

SEQ ID NO: 787187 - RNA, 22 nt, Human
uaauucuagauugacauuuuga

SEQ ID NO: 787188 - RNA, 22 nt, Human
uucaacaacuugguucaaaugg

SEQ ID NO: 787189 - RNA, 22 nt, Human
auacaacagaaaaugauuauuc

SEQ ID NO: 787190 - RNA, 22 nt, Human
uuuaaacuaacaguacacguug

SEQ ID NO: 787191 - RNA, 22 nt, Human
cauagacauugauagguuauau

SEQ ID NO: 787192 - RNA, 22 nt, Human
gcugcagugagccaagaucgug

SEQ ID NO: 787193 - RNA, 22 nt, Human
uguacacauuaagcucuuuaga

SEQ ID NO: 787194 - RNA, 22 nt, Human
aacaucuagguucucaucgaua

SEQ ID NO: 787195 - RNA, 22 nt, Human
aacagaaugcaggggaugcugc

SEQ ID NO: 787196 - RNA, 22 nt, Human
caguuaaacagauugaguguua

SEQ ID NO: 787197 - RNA, 22 nt, Human
uacuuugucauucuaaccuucc

SEQ ID NO: 787198 - RNA, 22 nt, Human
gucuguccacuuggaagcuccc

SEQ ID NO: 787199 - RNA, 17 nt, Human
aguuggcagccguugcu

SEQ ID NO: 787200 - RNA, 22 nt, Human
aagcauuuuagauaaagcauca

SEQ ID NO: 787201 - RNA, 22 nt, Human
ccacaguuauucauuugugaca

SEQ ID NO: 787202 - RNA, 22 nt, Human
cuuuggcuugcacuauuacacu

SEQ ID NO: 787203 - RNA, 22 nt, Human
caucuuuggagaaacuuccguu

SEQ ID NO: 787204 - RNA, 22 nt, Human
aacaauguucuuuuagcuugaa

SEQ ID NO: 787205 - RNA, 22 nt, Human
agguggagaagagaugggcagu

SEQ ID NO: 787206 - RNA, 22 nt, Human
acaucuuugcucuuauagagcu

SEQ ID NO: 787207 - RNA, 22 nt, Human
agcuguuggcuggcugagcucu

SEQ ID NO: 787208 - RNA, 22 nt, Human
ugcaggcuccaugaggacaggc

SEQ ID NO: 787209 - RNA, 22 nt, Human
ggcccagagacgugcaauguac

SEQ ID NO: 787210 - RNA, 22 nt, Human
agcauacaaacauuugaggcag

SEQ ID NO: 787211 - RNA, 22 nt, Human
ggcccagagucugcaauggagu

SEQ ID NO: 787212 - RNA, 22 nt, Human
ucagcccaucacucacguauua

SEQ ID NO: 787213 - RNA, 22 nt, Human
cagcccagcgcaaacaacuggc

SEQ ID NO: 787214 - RNA, 22 nt, Human
ucuguugaccaagucuucuucc

SEQ ID NO: 787215 - RNA, 22 nt, Human
cacaucuacugaaugagcagug

SEQ ID NO: 787216 - RNA, 22 nt, Human
gcaggcuugcccggccuccuuc

SEQ ID NO: 787217 - RNA, 22 nt, Human
ggccagagcucaaacagucgca

SEQ ID NO: 787218 - RNA, 22 nt, Human
gggacagaggcaaacuagcaga

SEQ ID NO: 787219 - RNA, 22 nt, Human
aggccagauauugugcuaccca

SEQ ID NO: 787220 - RNA, 22 nt, Human
gaacacagguggcccggcaggg

SEQ ID NO: 787221 - RNA, 22 nt, Human
uccucaguuuucuaguauggca

SEQ ID NO: 787222 - RNA, 22 nt, Human
uuggauccaucucaggcauagg

SEQ ID NO: 787223 - RNA, 22 nt, Human
uugagcucccgcuucuucuuug

SEQ ID NO: 787224 - RNA, 22 nt, Human
ccagcugcggucucccaaaguu

SEQ ID NO: 787225 - RNA, 22 nt, Human
agccaggggagucagcugcugg

SEQ ID NO: 787226 - RNA, 22 nt, Human
gcagagugaagggagaggugug

SEQ ID NO: 787227 - RNA, 22 nt, Human
aucuuugugaaucucaacuugg

SEQ ID NO: 787228 - RNA, 22 nt, Human
gagguggguguaucacagguca

SEQ ID NO: 787229 - RNA, 22 nt, Human
ccagcccaaacaagccgccuuc

SEQ ID NO: 787230 - RNA, 22 nt, Human
guuccugggaggcaugggcugg

SEQ ID NO: 787231 - RNA, 22 nt, Human
ggccagggccuggggacugucc

SEQ ID NO: 787232 - RNA, 22 nt, Human
gaauaucccgcuaugcaaagua

SEQ ID NO: 787233 - RNA, 22 nt, Human
gccuagggguaagaguacuggc

SEQ ID NO: 787234 - RNA, 20 nt, Human
auuccacuuauaugaggucc

SEQ ID NO: 787235 - RNA, 22 nt, Human
acaaguuagguuuuaauccaaa

SEQ ID NO: 787236 - RNA, 22 nt, Human
acagaguguuuuuaaguauauu

SEQ ID NO: 787237 - RNA, 22 nt, Human
ccugaaaugacuccagcugagu

SEQ ID NO: 787238 - RNA, 22 nt, Human
acauuugagaugccuuuuaggu

SEQ ID NO: 787239 - RNA, 22 nt, Human
uuucuacagcuggugcaacuuu

SEQ ID NO: 787240 - RNA, 22 nt, Human
cacaucuauggagacagagagu

SEQ ID NO: 787241 - RNA, 22 nt, Human
ucaggggcugugcauuucccag

SEQ ID NO: 787242 - RNA, 22 nt, Human
caucuuuguuucaucuguccag

SEQ ID NO: 787243 - RNA, 23 nt, Human
ccagggccccuacaccacugucc

SEQ ID NO: 787244 - RNA, 22 nt, Human
cacucugagcccaagcaggcug

SEQ ID NO: 787245 - RNA, 22 nt, Human
aguggaaggucaggggacagug

SEQ ID NO: 787246 - RNA, 22 nt, Human
aggcccugcccagugccacaag

SEQ ID NO: 787247 - RNA, 22 nt, Human
aggcccuggucaggucuggcug

SEQ ID NO: 787248 - RNA, 18 nt, Human
ugacauuuccagagugua

SEQ ID NO: 787249 - RNA, 22 nt, Human
agggcuaggaauggaacuggag

SEQ ID NO: 787250 - RNA, 22 nt, Human
uucuagcuguugcuguuuauag

SEQ ID NO: 787251 - RNA, 23 nt, Human
gcuuccagaagacucauugacau

SEQ ID NO: 787252 - RNA, 22 nt, Human
aguuugaaagcuuaacaguaca

SEQ ID NO: 787253 - RNA, 22 nt, Human
caguccucugcaacaccccuuc

SEQ ID NO: 787254 - RNA, 22 nt, Human
cacuuucuguguugugcaaaaa

SEQ ID NO: 787255 - RNA, 22 nt, Human
aggcccugcauuguacugaggg

SEQ ID NO: 787256 - RNA, 22 nt, Human
aagccaggagcgaggccucggc

SEQ ID NO: 787257 - RNA, 22 nt, Human
aagcuguuguucauccugaauu

SEQ ID NO: 787258 - RNA, 22 nt, Human
ugagcaggggagagcgaaugug

SEQ ID NO: 787259 - RNA, 22 nt, Human
aagggggagagguguuuggaug

SEQ ID NO: 787260 - RNA, 22 nt, Human
gauccacagcccgcuugggccc

SEQ ID NO: 787261 - RNA, 21 nt, Human
auuccacuuuuccuucaggga

SEQ ID NO: 787262 - RNA, 22 nt, Human
guggaggguuugcaaugugcag

SEQ ID NO: 787263 - RNA, 20 nt, Human
acaggggcagcacaauaaug

SEQ ID NO: 787264 - RNA, 22 nt, Human
uggaaggggagcuggaaagggg

SEQ ID NO: 787265 - RNA, 22 nt, Human
ugucuccaugugauaguggccu

SEQ ID NO: 787266 - RNA, 22 nt, Human
uucuuccucacacucucaccca

SEQ ID NO: 787267 - RNA, 20 nt, Human
acaggcgcuggggagauggc

SEQ ID NO: 787268 - RNA, 22 nt, Human
caguuaaagugcuuaucacaga

SEQ ID NO: 787269 - RNA, 22 nt, Human
gcuggagauagaauggccacug

SEQ ID NO: 787270 - RNA, 22 nt, Human
cuuucauccgcagaugagccuc

SEQ ID NO: 787271 - RNA, 22 nt, Human
gagcccagcugcggcccucagc

SEQ ID NO: 787272 - RNA, 22 nt, Human
uagaggccgaaugcugagcugg

SEQ ID NO: 787273 - RNA, 22 nt, Human
acagggccuuugauggauuaua

SEQ ID NO: 787274 - RNA, 22 nt, Human
cugcaggaggauccugagagug

SEQ ID NO: 787275 - RNA, 22 nt, Human
uggcugcagaucaagggcaggc

SEQ ID NO: 787276 - RNA, 22 nt, Human
ugggccagaggcauggagcuau

SEQ ID NO: 787277 - RNA, 22 nt, Human
ggggccagguccagcuuccaaa

SEQ ID NO: 787278 - RNA, 22 nt, Human
auuauccagcaccaaugucaga

SEQ ID NO: 787279 - RNA, 22 nt, Human
aguuaacacaaguaagauucca

SEQ ID NO: 787280 - RNA, 22 nt, Human
uggagagucucaaggcaggaaa

SEQ ID NO: 787281 - RNA, 22 nt, Human
cccagagagcauuuggacaaag

SEQ ID NO: 787282 - RNA, 22 nt, Human
cccagaguucaaacccugcguc

SEQ ID NO: 787283 - RNA, 22 nt, Human
gugucccagccccacaggccug

SEQ ID NO: 787284 - RNA, 22 nt, Human
gcuggccuugaggugucuuuau

SEQ ID NO: 787285 - RNA, 22 nt, Human
caucuuugccauaugauguaau

SEQ ID NO: 787286 - RNA, 23 nt, Human
ccuggcucaccccuuauguccag

SEQ ID NO: 787287 - RNA, 22 nt, Human
agcaggcuuuccacagaaggag

SEQ ID NO: 787288 - RNA, 22 nt, Human
agggacaguuacaucaucagac

SEQ ID NO: 787289 - RNA, 22 nt, Human
ugagcagggagcugggcugagc

SEQ ID NO: 787290 - RNA, 22 nt, Human
agaaaaaucuuggcgcuugucu

SEQ ID NO: 787291 - RNA, 22 nt, Human
ucagucuucaaaucugagucgu

SEQ ID NO: 787292 - RNA, 21 nt, Human
ugcuggccaugugcugggcau

SEQ ID NO: 787293 - RNA, 22 nt, Human
cagggccucugugggcucucuc

SEQ ID NO: 787294 - RNA, 22 nt, Human
uucuacuucugacacuguuugu

SEQ ID NO: 787295 - RNA, 22 nt, Human
uguuucagucccuguguucaau

SEQ ID NO: 787296 - RNA, 22 nt, Human
uuuggcgucucucaggagcuca

SEQ ID NO: 787297 - RNA, 22 nt, Human
aacaauguguucagcacugugg

SEQ ID NO: 787298 - RNA, 22 nt, Human
cagcccugccauggagccuccu

SEQ ID NO: 787299 - RNA, 22 nt, Human
ugucuccagaaagcaccaggag

SEQ ID NO: 787300 - RNA, 22 nt, Human
auuaaauuaaguggcuaauuua

SEQ ID NO: 787301 - RNA, 22 nt, Human
agggccacaguggggccugaga

SEQ ID NO: 787302 - RNA, 22 nt, Human
ugagcaggugagucuagggcag

SEQ ID NO: 787303 - RNA, 22 nt, Human
cugggcucagugucucacuccu

SEQ ID NO: 787304 - RNA, 22 nt, Human
ccagagugacgugaagugugaa

SEQ ID NO: 787305 - RNA, 22 nt, Human
agcuguuuaauaaaugucuguu

SEQ ID NO: 787306 - RNA, 20 nt, Human
acuguuaguauacuugugcc

SEQ ID NO: 787307 - RNA, 22 nt, Human
acacugugucuagcauuuuaca

SEQ ID NO: 787308 - RNA, 22 nt, Human
ucuaaagauuuggauucauuug

SEQ ID NO: 787309 - RNA, 22 nt, Human
gugucccaggccucuggaauua

SEQ ID NO: 787310 - RNA, 22 nt, Human
uggagcugguaaacagugacau

SEQ ID NO: 787311 - RNA, 22 nt, Human
ugcaaaaagagcgaggagcccu

SEQ ID NO: 787312 - RNA, 22 nt, Human
caggggcucuaaugcaugauca

SEQ ID NO: 787313 - RNA, 22 nt, Human
auccacaguggggguggcggaa

SEQ ID NO: 787314 - RNA, 22 nt, Human
agaguggagagaaacaacucug

SEQ ID NO: 787315 - RNA, 23 nt, Human
agaggccagccuuuggagacacc

SEQ ID NO: 787316 - RNA, 22 nt, Human
agaaaucccaaggcaucaacca

SEQ ID NO: 787317 - RNA, 22 nt, Human
auucuuuccagacacugauugc

SEQ ID NO: 787318 - RNA, 21 nt, Human
agagacagagaaaguaacauu

SEQ ID NO: 787319 - RNA, 21 nt, Human
gauccacugaccuggggaucc

SEQ ID NO: 787320 - RNA, 22 nt, Human
gucaucuugcuguuuuagaucu

SEQ ID NO: 787321 - RNA, 22 nt, Human
cuguuagucuuuugcaggagag

SEQ ID NO: 787322 - RNA, 22 nt, Human
aagauccaugggaauguuuggc

SEQ ID NO: 787323 - RNA, 22 nt, Human
gacaggguacgggcuaggcaca

SEQ ID NO: 787324 - RNA, 22 nt, Human
gaguggggucugggcaucaguc

SEQ ID NO: 787325 - RNA, 19 nt, Human
ucuuucauuucuagcucug

SEQ ID NO: 787326 - RNA, 22 nt, Human
ggguguccuucuguggacucug

SEQ ID NO: 787327 - RNA, 17 nt, Human
ugcaggcuguuauagcc

SEQ ID NO: 787328 - RNA, 22 nt, Human
ucaacaguugcacuggagaggu

SEQ ID NO: 787329 - RNA, 22 nt, Human
gaguuaaauauuuucugaaguu

SEQ ID NO: 787330 - RNA, 22 nt, Human
ggaacagggauuuggccugguu

SEQ ID NO: 787331 - RNA, 22 nt, Human
cagggccaguucucgcagcagu

SEQ ID NO: 787332 - RNA, 22 nt, Human
gcagagugguuucagaguugag

SEQ ID NO: 787333 - RNA, 22 nt, Human
ccuggcuccagcugccuguccu

SEQ ID NO: 787334 - RNA, 22 nt, Human
ggggaaaggccauggcaagaac

SEQ ID NO: 787335 - RNA, 22 nt, Human
cauauccagguuucuuugguuu

SEQ ID NO: 787336 - RNA, 22 nt, Human
acuucuucuucagcugggggau

SEQ ID NO: 787337 - RNA, 22 nt, Human
aguggaguugaguugauggauu

SEQ ID NO: 787338 - RNA, 20 nt, Human
cagggacagcaguggguuuu

SEQ ID NO: 787339 - RNA, 22 nt, Human
uggagaguguagacuucagagu

SEQ ID NO: 787340 - RNA, 22 nt, Human
uguuaaauguuccuuuacugga

SEQ ID NO: 787341 - RNA, 22 nt, Human
ucuguuuugugucucucuggug

SEQ ID NO: 787342 - RNA, 22 nt, Human
gaggagugccagccguggaguc

SEQ ID NO: 787343 - RNA, 22 nt, Human
uauaaauuauuaggcugcuaaa

SEQ ID NO: 787344 - RNA, 22 nt, Human
ugcugcagcuuugucacaugca

SEQ ID NO: 787345 - RNA, 22 nt, Human
uccagccccggcuuccuuacag

SEQ ID NO: 787346 - RNA, 18 nt, Human
gcccagagcccucuuauu

SEQ ID NO: 787347 - RNA, 22 nt, Human
aacuucuaaucuguacaguuuu

SEQ ID NO: 787348 - RNA, 22 nt, Human
cagggccagcgcccaggcccag

SEQ ID NO: 787349 - RNA, 22 nt, Human
aagcuguuaucuucuggcggac

SEQ ID NO: 787350 - RNA, 22 nt, Human
ggcuguggggaccaacaggacu

SEQ ID NO: 787351 - RNA, 17 nt, Human
aggugcuggagcaucag

SEQ ID NO: 787352 - RNA, 22 nt, Human
aucaucuugcuuucuguuuacu

SEQ ID NO: 787353 - RNA, 22 nt, Human
aggcuuggagguucuguagcca

SEQ ID NO: 787354 - RNA, 22 nt, Human
cagcuguugucucucacauauu

SEQ ID NO: 787355 - RNA, 22 nt, Human
ugaggggagacagaguggacuc

SEQ ID NO: 787356 - RNA, 22 nt, Human
guucuauuacucccugcuucuu

SEQ ID NO: 787357 - RNA, 20 nt, Human
aaaaacaguaaugcugaaga

SEQ ID NO: 787358 - RNA, 22 nt, Human
caguuaaaugaugugcccuaga

SEQ ID NO: 787359 - RNA, 22 nt, Human
uccacagugguugaacuaguuu

SEQ ID NO: 787360 - RNA, 21 nt, Human
ugcuguccuagaaccagggcc

SEQ ID NO: 787361 - RNA, 22 nt, Human
aaacaaauagugcaugggaauu

SEQ ID NO: 787362 - RNA, 22 nt, Human
uccugcaggccagaggggugag

SEQ ID NO: 787363 - RNA, 22 nt, Human
gggacaggcugagacuugagcu

SEQ ID NO: 787364 - RNA, 22 nt, Human
ugcagcugauuaaagggcagac

SEQ ID NO: 787365 - RNA, 22 nt, Human
cagugaaaucacaacuuuaguu

SEQ ID NO: 787366 - RNA, 22 nt, Human
gggacaggcaaagguaugcuuc

SEQ ID NO: 787367 - RNA, 22 nt, Human
aaacuguauauuuauggcaugu

SEQ ID NO: 787368 - RNA, 19 nt, Human
cuccacagggauugugauu

SEQ ID NO: 787369 - RNA, 22 nt, Human
aggugggguucagucucagccg

SEQ ID NO: 787370 - RNA, 22 nt, Human
aagcagaggguauggccagguu

SEQ ID NO: 787371 - RNA, 22 nt, Human
gcugggcuggaaggccaaggca

SEQ ID NO: 787372 - RNA, 21 nt, Human
gagugggacaugggagugguu

SEQ ID NO: 787373 - RNA, 22 nt, Human
gcugggcuucucaaugcugccu

SEQ ID NO: 787374 - RNA, 22 nt, Human
gugucccacucuggaggugaag

SEQ ID NO: 787375 - RNA, 22 nt, Human
auuaaauuggaucugcauaguu

SEQ ID NO: 787376 - RNA, 22 nt, Human
agcugcugggauacaguaguga

SEQ ID NO: 787377 - RNA, 19 nt, Human
ccagcccacagugacuuuc

SEQ ID NO: 787378 - RNA, 22 nt, Human
caguggagugggacuggucuga

SEQ ID NO: 787379 - RNA, 22 nt, Human
agcuguuuuacucagaaacaua

SEQ ID NO: 787380 - RNA, 20 nt, Human
ccaggccugggccugcucua

SEQ ID NO: 787381 - RNA, 22 nt, Human
aaacaaauuucaagcugugaca

SEQ ID NO: 787382 - RNA, 22 nt, Human
ggguguccagggcgugucugga

SEQ ID NO: 787383 - RNA, 22 nt, Human
ugucugcagugccacaguggga

SEQ ID NO: 787384 - RNA, 22 nt, Human
aauccauuuacucuuuacaaga

SEQ ID NO: 787385 - RNA, 22 nt, Human
ugcaggcucugugugugccugg

SEQ ID NO: 787386 - RNA, 22 nt, Human
cacaguuuugcccagggcuucu

SEQ ID NO: 787387 - RNA, 22 nt, Human
cagcccugucccugagggaccu

SEQ ID NO: 787388 - RNA, 22 nt, Human
guacagggccccucagcagggc

SEQ ID NO: 787389 - RNA, 22 nt, Human
accuguuuagaaagcuuaugag

SEQ ID NO: 787390 - RNA, 22 nt, Human
ugcaggugugguuccucagcca

SEQ ID NO: 787391 - RNA, 22 nt, Human
ggugucccaggccagcugugug

SEQ ID NO: 787392 - RNA, 22 nt, Human
gugucccaauguucaggacggc

SEQ ID NO: 787393 - RNA, 22 nt, Human
gcugucccgcugacuuccagcu

SEQ ID NO: 787394 - RNA, 22 nt, Human
cccagaguuggucaggggaccc

SEQ ID NO: 787395 - RNA, 20 nt, Human
ugcugggcaugcaguggaaa

SEQ ID NO: 787396 - RNA, 19 nt, Human
uugcuggcauuugaucucu

SEQ ID NO: 787397 - RNA, 22 nt, Human
ugcacgugugagcauucacaug

SEQ ID NO: 787398 - RNA, 22 nt, Human
acacauaucuaagauagaugac

SEQ ID NO: 787399 - RNA, 22 nt, Human
ugagcagggacuuugaguguag

SEQ ID NO: 787400 - RNA, 22 nt, Human
ugcaaaacuucucagagccuuu

SEQ ID NO: 787401 - RNA, 21 nt, Human
gcccagaguccucccacucca

SEQ ID NO: 787402 - RNA, 22 nt, Human
gcagcuuugaagacuuauuugc

SEQ ID NO: 787403 - RNA, 22 nt, Human
ugaggggagguuggggcacauc

SEQ ID NO: 787404 - RNA, 22 nt, Human
gauccacaguuugaugaucaua

SEQ ID NO: 787405 - RNA, 22 nt, Human
gcugcaguguuggaccucaggg

SEQ ID NO: 787406 - RNA, 22 nt, Human
caagucugucugcuccugugug

SEQ ID NO: 787407 - RNA, 22 nt, Human
gcccagaguucaaggcugcagu

SEQ ID NO: 787408 - RNA, 22 nt, Human
agccagggauggcagugcccag

SEQ ID NO: 787409 - RNA, 21 nt, Human
ugcacuuugggggacaggcug

SEQ ID NO: 787410 - RNA, 22 nt, Human
uuacagaauguucuuccaacag

SEQ ID NO: 787411 - RNA, 22 nt, Human
aggccagaacagcucugcacca

SEQ ID NO: 787412 - RNA, 22 nt, Human
uuucuacagaagauacacugcu

SEQ ID NO: 787413 - RNA, 22 nt, Human
ccagagccggcucccucagcuu

SEQ ID NO: 787414 - RNA, 22 nt, Human
agggccugugcugaguagacga

SEQ ID NO: 787415 - RNA, 23 nt, Human
ugcuguccaacagacuggccaug

SEQ ID NO: 787416 - RNA, 22 nt, Human
gcacagagucacuagcuaagca

SEQ ID NO: 787417 - RNA, 22 nt, Human
acuguuuucuguaaagggccag

SEQ ID NO: 787418 - RNA, 22 nt, Human
cauacaagcgugcaugugcuug

SEQ ID NO: 787419 - RNA, 20 nt, Human
cccuggagagaagcuccacg

SEQ ID NO: 787420 - RNA, 21 nt, Human
gacaggggaagaagcaaggag

SEQ ID NO: 787421 - RNA, 20 nt, Human
aucaucuuuacaaugucagu

SEQ ID NO: 787422 - RNA, 22 nt, Human
agugcuuuagcauccaacuguc

SEQ ID NO: 787423 - RNA, 22 nt, Human
aagccaggugugcccaggaucc

SEQ ID NO: 787424 - RNA, 22 nt, Human
cccagagaauuccacauagagg

SEQ ID NO: 787425 - RNA, 22 nt, Human
uaaagcaagacacacccauagc

SEQ ID NO: 787426 - RNA, 22 nt, Human
cugugugucauuugucaauccu

SEQ ID NO: 787427 - RNA, 22 nt, Human
ugacauuuuuauaagagucaaa

SEQ ID NO: 787428 - RNA, 20 nt, Human
uccagcccugcuucucucuu

SEQ ID NO: 787429 - RNA, 22 nt, Human
uacgagcgcucuugcuggccaa

SEQ ID NO: 787430 - RNA, 23 nt, Human
agcaggcugcuucuccacagcug

SEQ ID NO: 787431 - RNA, 22 nt, Human
ggcucagguuaccagucccucc

SEQ ID NO: 787432 - RNA, 22 nt, Human
cccagaguauuugugauguuag

SEQ ID NO: 787433 - RNA, 22 nt, Human
gaguuaaaguaccuuuguaugu

SEQ ID NO: 787434 - RNA, 22 nt, Human
aaagacaguggauucaaaaucc

SEQ ID NO: 787435 - RNA, 22 nt, Human
agcuuaucuuguuaguuucauu

SEQ ID NO: 787436 - RNA, 21 nt, Human
ugagcaggugcagggaagugg

SEQ ID NO: 787437 - RNA, 21 nt, Human
ucagcccaggugucuuugccc

SEQ ID NO: 787438 - RNA, 20 nt, Human
uaugaguauuacuuucagga

SEQ ID NO: 787439 - RNA, 22 nt, Human
ugggcuagcagggaagagagac

SEQ ID NO: 787440 - RNA, 22 nt, Human
ucaucuuuguaucccuaacaca

SEQ ID NO: 787441 - RNA, 20 nt, Human
caucuuuggcaggacuccuu

SEQ ID NO: 787442 - RNA, 19 nt, Human
ccaggccucuggggccugu

SEQ ID NO: 787443 - RNA, 22 nt, Human
agcagggugugguggcccugga

SEQ ID NO: 787444 - RNA, 22 nt, Human
ucauauaccugcaugugcaugu

SEQ ID NO: 787445 - RNA, 22 nt, Human
uccugcagccuugggcuggagc

SEQ ID NO: 787446 - RNA, 22 nt, Human
gucccagcuucccacuagcagc

SEQ ID NO: 787447 - RNA, 22 nt, Human
ugagcagggacuuuggagucug

SEQ ID NO: 787448 - RNA, 22 nt, Human
auccacaggguguguuaagaug

SEQ ID NO: 787449 - RNA, 22 nt, Human
agcuccagccgcugauggguuu

SEQ ID NO: 787450 - RNA, 22 nt, Human
aggccagagaggggaccagccu

SEQ ID NO: 787451 - RNA, 22 nt, Human
ugcugucaagguuacaugcuuu

SEQ ID NO: 787452 - RNA, 22 nt, Human
uuaaauuauugagggauuguca

SEQ ID NO: 787453 - RNA, 18 nt, Human
uucuuuucaugugaucuc

SEQ ID NO: 787454 - RNA, 22 nt, Human
agugcuuuuauaucauuaaucc

SEQ ID NO: 787455 - RNA, 22 nt, Human
ggcccagauuagaagcugaaug

SEQ ID NO: 787456 - RNA, 18 nt, Human
caguccuguuucuacagg

SEQ ID NO: 787457 - RNA, 22 nt, Human
gugcagguguuuuggcugccag

SEQ ID NO: 787458 - RNA, 22 nt, Human
ccaggccuggccaggggaugcc

SEQ ID NO: 787459 - RNA, 22 nt, Human
uuaaagaauagugccccuauug

SEQ ID NO: 787460 - RNA, 22 nt, Human
uggagaguaaauggcagaauca

SEQ ID NO: 787461 - RNA, 18 nt, Human
ccaguaccuccuccucuc

SEQ ID NO: 787462 - RNA, 22 nt, Human
uuucuuucaauucuccuaaugc

SEQ ID NO: 787463 - RNA, 22 nt, Human
aagcacagcuggaacagcagga

SEQ ID NO: 787464 - RNA, 22 nt, Human
cuguuagugaucaaagggagag

SEQ ID NO: 787465 - RNA, 22 nt, Human
ucuaaauuacuuugggcaguau

SEQ ID NO: 787466 - RNA, 22 nt, Human
uuaacauuguccuuagcagauu

SEQ ID NO: 787467 - RNA, 22 nt, Human
caucuuugagacagcauuaccc

SEQ ID NO: 787468 - RNA, 18 nt, Human
ggucaggggcggagagaa

SEQ ID NO: 787469 - RNA, 21 nt, Human
ugagcaggugcugcuuuuaug

SEQ ID NO: 787470 - RNA, 22 nt, Human
agugcagagaccuggucaggca

SEQ ID NO: 787471 - RNA, 22 nt, Human
uaaaaaucuuaugaauggcaag

SEQ ID NO: 787472 - RNA, 22 nt, Human
acagguggggcacuuggagccu

SEQ ID NO: 787473 - RNA, 19 nt, Human
ccaguaguauagcacaguc

SEQ ID NO: 787474 - RNA, 22 nt, Human
ucuacagguggggccuggcaau

SEQ ID NO: 787475 - RNA, 22 nt, Human
agguggagacccagagaaggcg

SEQ ID NO: 787476 - RNA, 22 nt, Human
uggagaugcacgagcaggugga

SEQ ID NO: 787477 - RNA, 22 nt, Human
auccacagucagaacgggccua

SEQ ID NO: 787478 - RNA, 19 nt, Human
uccuccuuacuuccucuug

SEQ ID NO: 787479 - RNA, 22 nt, Human
ucaggcugaggucaucugcauc

SEQ ID NO: 787480 - RNA, 22 nt, Human
gucaucuucucucagcccaggc

SEQ ID NO: 787481 - RNA, 22 nt, Human
uggcugggagcuggaacugggc

SEQ ID NO: 787482 - RNA, 22 nt, Human
gcauuccuugaguucccugugc

SEQ ID NO: 787483 - RNA, 22 nt, Human
gaaccuguuuauguuaccugcg

SEQ ID NO: 787484 - RNA, 22 nt, Human
uucuuuuccuguggcucaucca

SEQ ID NO: 787485 - RNA, 22 nt, Human
ggcccagagggucaggagcuga

SEQ ID NO: 787486 - RNA, 22 nt, Human
ccagagcuucggggcggcugua

SEQ ID NO: 787487 - RNA, 19 nt, Human
acaggggccuuuccagggu

SEQ ID NO: 787488 - RNA, 22 nt, Human
ugcugcagaaauucugugagga

SEQ ID NO: 787489 - RNA, 22 nt, Human
gauccacaggaaccaaaacgca

SEQ ID NO: 787490 - RNA, 22 nt, Human
ccagggcccacggccagaauag

SEQ ID NO: 787491 - RNA, 21 nt, Human
ggccugaaaaagugaaugcuu

SEQ ID NO: 787492 - RNA, 22 nt, Human
cugcagaauggggccaagugga

SEQ ID NO: 787493 - RNA, 19 nt, Human
gcacacaguagggcuggca

SEQ ID NO: 787494 - RNA, 18 nt, Human
ugagcaggggcugaccuu

SEQ ID NO: 787495 - RNA, 22 nt, Human
ugucccagucaaggcugucauc

SEQ ID NO: 787496 - RNA, 22 nt, Human
caucuaccuccacccuauauau

SEQ ID NO: 787497 - RNA, 19 nt, Human
caaggguugggucugucau

SEQ ID NO: 787498 - RNA, 22 nt, Human
gcccagggcagggcaagaguga

SEQ ID NO: 787499 - RNA, 22 nt, Human
uuucuaggucuuccauacugcc

SEQ ID NO: 787500 - RNA, 22 nt, Human
cugcagcuguagaggacagugg

SEQ ID NO: 787501 - RNA, 22 nt, Human
gcacaauuccaugggacagccc

SEQ ID NO: 787502 - RNA, 18 nt, Human
uccaccagucaaucuguc

SEQ ID NO: 787503 - RNA, 22 nt, Human
accuuccucuaagacauuuagc

SEQ ID NO: 787504 - RNA, 22 nt, Human
ccaggcccuugcaagucccacc

SEQ ID NO: 787505 - RNA, 21 nt, Human
gggccacaccuucugcagacc

SEQ ID NO: 787506 - RNA, 22 nt, Human
uagcccaggcuggagggcagug

SEQ ID NO: 787507 - RNA, 22 nt, Human
ccuguaggauauuguagaauac

SEQ ID NO: 787508 - RNA, 22 nt, Human
acaucuuuauacuaguccuuga

SEQ ID NO: 787509 - RNA, 22 nt, Human
auuaaagaaacccagcauguga

SEQ ID NO: 787510 - RNA, 22 nt, Human
uaucuuuguaucaaucuccauu

SEQ ID NO: 787511 - RNA, 22 nt, Human
auccacaggucauguaaugugg

SEQ ID NO: 787512 - RNA, 22 nt, Human
uggagcagaaauuugaagccau

SEQ ID NO: 787513 - RNA, 22 nt, Human
acaggggcuccgaaggugaggg

SEQ ID NO: 787514 - RNA, 22 nt, Human
uagcccagaagagggaagcaac

SEQ ID NO: 787515 - RNA, 22 nt, Human
aauuaugguauguucaacaacu

SEQ ID NO: 787516 - RNA, 22 nt, Human
ggaacaggaaaggagggaugcu

SEQ ID NO: 787517 - RNA, 22 nt, Human
gggaccagugucugugagaaaa

SEQ ID NO: 787518 - RNA, 22 nt, Human
ugagcaggcaaacaaugguuau

SEQ ID NO: 787519 - RNA, 22 nt, Human
agcaguuguagucauggaaaau

SEQ ID NO: 787520 - RNA, 22 nt, Human
uccuggcuuagguuuccagaac

SEQ ID NO: 787521 - RNA, 22 nt, Human
ugagcaggucaagacuccagcu

SEQ ID NO: 787522 - RNA, 22 nt, Human
guaaagaaguuuuugaaugcau

SEQ ID NO: 787523 - RNA, 22 nt, Human
ggcuggagacaacguccugccc

SEQ ID NO: 787524 - RNA, 19 nt, Human
acaggggcuagcggaagca

SEQ ID NO: 787525 - RNA, 22 nt, Human
cagggccugucacgacgcucau

SEQ ID NO: 787526 - RNA, 22 nt, Human
acagggccagccugggaccugg

SEQ ID NO: 787527 - RNA, 22 nt, Human
uugaaauuggguguggcuguca

SEQ ID NO: 787528 - RNA, 22 nt, Human
cacaguuugguauagaagugau

SEQ ID NO: 787529 - RNA, 22 nt, Human
agccuuagaggaaaacauuagu

SEQ ID NO: 787530 - RNA, 22 nt, Human
ggccagagcugaccuaucaaug

SEQ ID NO: 787531 - RNA, 22 nt, Human
aauauccagguagaugucuucu

SEQ ID NO: 787532 - RNA, 22 nt, Human
gagguggauguugcagugagcu

SEQ ID NO: 787533 - RNA, 22 nt, Human
gggauagguuuggaagaggugg

SEQ ID NO: 787534 - RNA, 20 nt, Human
acuggaguacccuagagaag

SEQ ID NO: 787535 - RNA, 22 nt, Human
cuggaguguuauggucaaguca

SEQ ID NO: 787536 - RNA, 22 nt, Human
aaagaaaccuaucagccacaug

SEQ ID NO: 787537 - RNA, 22 nt, Human
uggagcagcauucauccagcag

SEQ ID NO: 787538 - RNA, 22 nt, Human
cccuggagcuagucugagcaga

SEQ ID NO: 787539 - RNA, 17 nt, Human
uguuuuuucccuguucu

SEQ ID NO: 787540 - RNA, 22 nt, Human
uuucuacaauuuuuggcaugag

SEQ ID NO: 787541 - RNA, 22 nt, Human
ggccaaauccuccaugguggcu

SEQ ID NO: 787542 - RNA, 22 nt, Human
acaggcagguaauuuacauauu

SEQ ID NO: 787543 - RNA, 22 nt, Human
uuugucauauagacuauuguga

SEQ ID NO: 787544 - RNA, 22 nt, Human
gcugcuggccccacaugcucca

SEQ ID NO: 787545 - RNA, 22 nt, Human
acaucuuuuuggaaacggcuga

SEQ ID NO: 787546 - RNA, 22 nt, Human
aguaaacaguuucuuagaagaa

SEQ ID NO: 787547 - RNA, 22 nt, Human
caggagcagaggguggucagca

SEQ ID NO: 787548 - RNA, 22 nt, Human
gccaccugcgggccguggugga

SEQ ID NO: 787549 - RNA, 22 nt, Human
ccuggagaggcgcugcagagga

SEQ ID NO: 787550 - RNA, 22 nt, Human
ggcuccaguuugugccuucagc

SEQ ID NO: 787551 - RNA, 22 nt, Human
cagaguggagaaacgcuucguc

SEQ ID NO: 787552 - RNA, 22 nt, Human
uucauucugcaguucucagcuc

SEQ ID NO: 787553 - RNA, 17 nt, Human
ugucccaggcucaacgc

SEQ ID NO: 787554 - RNA, 22 nt, Human
ggaucaggcugaagcuaggacu

SEQ ID NO: 787555 - RNA, 22 nt, Human
auuaaauuagcaaacugugaaa

SEQ ID NO: 787556 - RNA, 22 nt, Human
ugggaagggccgauggagccuc

SEQ ID NO: 787557 - RNA, 20 nt, Human
gcucagagccugaacuucau

SEQ ID NO: 787558 - RNA, 22 nt, Human
ugaguggacaccugcuucuuua

SEQ ID NO: 787559 - RNA, 22 nt, Human
aggccaggcaacauucugaagu

SEQ ID NO: 787560 - RNA, 22 nt, Human
cuggccucucugagcagggagc

SEQ ID NO: 787561 - RNA, 22 nt, Human
cuuaaauucuuaaugcccucau

SEQ ID NO: 787562 - RNA, 22 nt, Human
ugucccaggccucauguugcca

SEQ ID NO: 787563 - RNA, 22 nt, Human
acaguuaauaaguaguaaguca

SEQ ID NO: 787564 - RNA, 22 nt, Human
uggaagagguggaaguggcuuc

SEQ ID NO: 787565 - RNA, 22 nt, Human
gaaaagaacugcaugggauuaa

SEQ ID NO: 787566 - RNA, 22 nt, Human
ugccauuugccccagcacuguc

SEQ ID NO: 787567 - RNA, 22 nt, Human
uggagaguaauuucugaagacc

SEQ ID NO: 787568 - RNA, 22 nt, Human
uaugagcagacagugguuuuac

SEQ ID NO: 787569 - RNA, 22 nt, Human
gcuggagaaacaggaggaggaa

SEQ ID NO: 787570 - RNA, 22 nt, Human
gccaagaguuuccagcugcaag

SEQ ID NO: 787571 - RNA, 22 nt, Human
gcucaggggaaugggcugccgu

SEQ ID NO: 787572 - RNA, 22 nt, Human
aagagaaggauucugagccugg

SEQ ID NO: 787573 - RNA, 22 nt, Human
cacuuuggaugccacuggucua

SEQ ID NO: 787574 - RNA, 22 nt, Human
gugaaauauuuaacguccaggu

SEQ ID NO: 787575 - RNA, 17 nt, Human
ugggccaguagaaggga

SEQ ID NO: 787576 - RNA, 22 nt, Human
auuaaauuuucacuaggcuccc

SEQ ID NO: 787577 - RNA, 22 nt, Human
acaguuaauuaacauuaagggg

SEQ ID NO: 787578 - RNA, 22 nt, Human
uauugcugacuuguucaguguu

SEQ ID NO: 787579 - RNA, 21 nt, Human
acagggcuucagggaggguua

SEQ ID NO: 787580 - RNA, 22 nt, Human
cacauguaguaagcaggcaaug

SEQ ID NO: 787581 - RNA, 22 nt, Human
cugcagagcuugucuggaugug

SEQ ID NO: 787582 - RNA, 22 nt, Human
caucuuugcacccucaaaaccu

SEQ ID NO: 787583 - RNA, 22 nt, Human
gcaucuuucuguccauucagca

SEQ ID NO: 787584 - RNA, 22 nt, Human
agcuuaaacucuuugaaguuau

SEQ ID NO: 787585 - RNA, 22 nt, Human
uccuggcugaguucccaagucg

SEQ ID NO: 787586 - RNA, 22 nt, Human
guaaauuauuucaagaucaucu

SEQ ID NO: 787587 - RNA, 22 nt, Human
acacauauguggcaacuguaga

SEQ ID NO: 787588 - RNA, 22 nt, Human
uggugaucagucaacugucuuc

SEQ ID NO: 787589 - RNA, 21 nt, Human
guucuauuuugcaaacuucug

SEQ ID NO: 787590 - RNA, 22 nt, Human
ugcugcaguguuugcugaaguu

SEQ ID NO: 787591 - RNA, 22 nt, Human
ggacaggguaaguacuagugug

SEQ ID NO: 787592 - RNA, 22 nt, Human
cagcccugcuuccccgcuaguu

SEQ ID NO: 787593 - RNA, 22 nt, Human
cauauccaauaugacuaguguu

SEQ ID NO: 787594 - RNA, 22 nt, Human
auccacaggaggguuuggaaaa

SEQ ID NO: 787595 - RNA, 22 nt, Human
cagccacucggccauaaaggcu

SEQ ID NO: 787596 - RNA, 22 nt, Human
ccagagggagccaccagggugu

SEQ ID NO: 787597 - RNA, 22 nt, Human
caucuuugaacucuguauaaac

SEQ ID NO: 787598 - RNA, 22 nt, Human
ggggugggcgugcagggacacc

SEQ ID NO: 787599 - RNA, 22 nt, Human
caucuuugguuuucuauaugcc

SEQ ID NO: 787600 - RNA, 22 nt, Human
cugcagagaugaagaagguggc

SEQ ID NO: 787601 - RNA, 22 nt, Human
ugcuggccaacaaggcuccaag

SEQ ID NO: 787602 - RNA, 22 nt, Human
ggccagaggugguacauagcuu

SEQ ID NO: 787603 - RNA, 22 nt, Human
aaggccagagcguguccugccu

SEQ ID NO: 787604 - RNA, 22 nt, Human
cagagugcauggugcuguucau

SEQ ID NO: 787605 - RNA, 22 nt, Human
aguacugucagcaggguguuga

SEQ ID NO: 787606 - RNA, 22 nt, Human
gucugcugacagagcauggacc

SEQ ID NO: 787607 - RNA, 22 nt, Human
gccacacuuauucucaugcaca

SEQ ID NO: 787608 - RNA, 22 nt, Human
guggaggucccgggcaggagca

SEQ ID NO: 787609 - RNA, 22 nt, Human
gggcuggagucuucugaaagcc

SEQ ID NO: 787610 - RNA, 22 nt, Human
gcuggcucccagaggccccagc

SEQ ID NO: 787611 - RNA, 22 nt, Human
uggagaggaaagugcaguuuug

SEQ ID NO: 787612 - RNA, 22 nt, Human
ggagagcuagugccugccagua

SEQ ID NO: 787613 - RNA, 22 nt, Human
gaaacaauacuuguccucacua

SEQ ID NO: 787614 - RNA, 22 nt, Human
ugacauuuaucaaagaaauggu

SEQ ID NO: 787615 - RNA, 17 nt, Human
aggccagaugaggcaag

SEQ ID NO: 787616 - RNA, 22 nt, Human
uuugaaacccgucacuuugagu

SEQ ID NO: 787617 - RNA, 22 nt, Human
gcuggcucuucaguggagauag

SEQ ID NO: 787618 - RNA, 22 nt, Human
cuggagugaggucugggagccu

SEQ ID NO: 787619 - RNA, 21 nt, Human
ccagcccagcugugucccagc

SEQ ID NO: 787620 - RNA, 22 nt, Human
gggccuggugcuucugacuccu

SEQ ID NO: 787621 - RNA, 22 nt, Human
gcaggccugguuuacaugguag

SEQ ID NO: 787622 - RNA, 22 nt, Human
acaguuaaucaaauggcauaug

SEQ ID NO: 787623 - RNA, 22 nt, Human
cucucgcgugugccuuuccgcu

SEQ ID NO: 787624 - RNA, 22 nt, Human
ggcaggcuuugagaaagagcau

SEQ ID NO: 787625 - RNA, 22 nt, Human
gggcuagaauccgcgucucuug

SEQ ID NO: 787626 - RNA, 22 nt, Human
gcucagggugcaguguccauga

SEQ ID NO: 787627 - RNA, 22 nt, Human
agggcuggcaucucuaaugcug

SEQ ID NO: 787628 - RNA, 22 nt, Human
acagguggccccgagggagugg

SEQ ID NO: 787629 - RNA, 22 nt, Human
gcuuucaauuaugucagccugu

SEQ ID NO: 787630 - RNA, 22 nt, Human
gcccagagagaugcuguagacc

SEQ ID NO: 787631 - RNA, 22 nt, Human
aacacuguaacagcaucauuuu

SEQ ID NO: 787632 - RNA, 22 nt, Human
gcucagggaguuucacagugua

SEQ ID NO: 787633 - RNA, 22 nt, Human
agagucaguuaugucaagugcu

SEQ ID NO: 787634 - RNA, 22 nt, Human
ggcucaggggccaggccugucc

SEQ ID NO: 787635 - RNA, 22 nt, Human
cuuaaauuuucaucuacaagaa

SEQ ID NO: 787636 - RNA, 18 nt, Human
gucuggaggucaggagcu

SEQ ID NO: 787637 - RNA, 22 nt, Human
agagugcaaccgaaacaagcag

SEQ ID NO: 787638 - RNA, 22 nt, Human
uuuaaauuauaguuaaugucug

SEQ ID NO: 787639 - RNA, 22 nt, Human
gcagagugagccgaggcugcuc

SEQ ID NO: 787640 - RNA, 22 nt, Human
ggcaggcugggagucaucagag

SEQ ID NO: 787641 - RNA, 22 nt, Human
gaggggaagacuucuggacagu

SEQ ID NO: 787642 - RNA, 22 nt, Human
auugcuggcugccaucuugccc

SEQ ID NO: 787643 - RNA, 22 nt, Human
gcaggccuaagagaaggcauug

SEQ ID NO: 787644 - RNA, 22 nt, Human
caguuaaacagauugaguguua

SEQ ID NO: 787645 - RNA, 22 nt, Human
gauccacagggcccuggcccag

SEQ ID NO: 787646 - RNA, 22 nt, Human
gcuguugcaaucaaggccaugg

SEQ ID NO: 787647 - RNA, 22 nt, Human
cagggccuuguucaggagugaa

SEQ ID NO: 787648 - RNA, 22 nt, Human
uuaaauuaggacucuaguucug

SEQ ID NO: 787649 - RNA, 22 nt, Human
gcauguuuugcaacaagugacc

SEQ ID NO: 787650 - RNA, 22 nt, Human
ccacauuuuugauacucucacu

SEQ ID NO: 787651 - RNA, 22 nt, Human
gugggaguggggaagcagagug

SEQ ID NO: 787652 - RNA, 22 nt, Human
aaaauccacaacgcucauuuca

SEQ ID NO: 787653 - RNA, 22 nt, Human
caguuaaaaugugcuauaagaa

SEQ ID NO: 787654 - RNA, 22 nt, Human
gcuccaggugaauccucucacc

SEQ ID NO: 787655 - RNA, 22 nt, Human
aaacuggauuaccaggcuggug

SEQ ID NO: 787656 - RNA, 22 nt, Human
cuggugcuggagccuagucccu

SEQ ID NO: 787657 - RNA, 22 nt, Human
acacuguucuuugcacugagaa

SEQ ID NO: 787658 - RNA, 22 nt, Human
cacuggaggucaguggagcacu

SEQ ID NO: 787659 - RNA, 22 nt, Human
ucugaaauggggcugaagcacu

SEQ ID NO: 787660 - RNA, 22 nt, Human
cccagaguggagggugcagaau

SEQ ID NO: 787661 - RNA, 22 nt, Human
agugcagcucccucaccugcuu

SEQ ID NO: 787662 - RNA, 22 nt, Human
agugggaggaaguggugauauu

SEQ ID NO: 787663 - RNA, 22 nt, Human
gcagcuuucuaagcuuuauugc

SEQ ID NO: 787664 - RNA, 22 nt, Human
guuuaagaggguuucauuccca

SEQ ID NO: 787665 - RNA, 22 nt, Human
gauccacagcugcgguaggaga

SEQ ID NO: 787666 - RNA, 22 nt, Human
gggccagaccucuucucaggga

SEQ ID NO: 787667 - RNA, 22 nt, Human
agguggagugugcagggagagc

SEQ ID NO: 787668 - RNA, 22 nt, Human
uugcugccuuuguacucugaug

SEQ ID NO: 787669 - RNA, 22 nt, Human
gaguuaaaagcccucucagcag

SEQ ID NO: 787670 - RNA, 21 nt, Human
aaguggagaagaaaagcugga

SEQ ID NO: 787671 - RNA, 22 nt, Human
gcugggcucagaccuagugaac

SEQ ID NO: 787672 - RNA, 22 nt, Human
cugcaggagggcuggggaagcc

SEQ ID NO: 787673 - RNA, 20 nt, Human
cacucugagggaguccaugu

SEQ ID NO: 787674 - RNA, 21 nt, Human
ugcaggcuguuuaagaggcaa

SEQ ID NO: 787675 - RNA, 22 nt, Human
gggccagacccuuggcgaucug

SEQ ID NO: 787676 - RNA, 22 nt, Human
auucagucaaaaaugauggaga

SEQ ID NO: 787677 - RNA, 23 nt, Human
gacagggcugacuuggcagcugc

SEQ ID NO: 787678 - RNA, 22 nt, Human
agguggcugguccaggcugcag

SEQ ID NO: 787679 - RNA, 22 nt, Human
agcccagaugguagcccuagaa

SEQ ID NO: 787680 - RNA, 22 nt, Human
gcuccaggcagcauaguggaug

SEQ ID NO: 787681 - RNA, 22 nt, Human
accugaauugauuugaccugua

SEQ ID NO: 787682 - RNA, 22 nt, Human
agguggggaaaccagcgauccc

SEQ ID NO: 787683 - RNA, 22 nt, Human
uauauccagaaaaucaguucau

SEQ ID NO: 787684 - RNA, 22 nt, Human
gggacaggccccucgcuagcuu

SEQ ID NO: 787685 - RNA, 20 nt, Human
aguaggggaaugcaagagca

SEQ ID NO: 787686 - RNA, 20 nt, Human
ggcaggcuuuauauggaggg

SEQ ID NO: 787687 - RNA, 22 nt, Human
agggccugacacccuugccagc

SEQ ID NO: 787688 - RNA, 22 nt, Human
ugggacucacucuuuuggccag

SEQ ID NO: 787689 - RNA, 22 nt, Human
ugggacaggaugaccagaaggu

SEQ ID NO: 787690 - RNA, 22 nt, Human
ccagcccaugcccuuauagcau

SEQ ID NO: 787691 - RNA, 22 nt, Human
cacauuuacauauaaaacuuuc

SEQ ID NO: 787692 - RNA, 22 nt, Human
ugagcaggacugaccggccuua

SEQ ID NO: 787693 - RNA, 20 nt, Human
agguggcuccugcugggggu

SEQ ID NO: 787694 - RNA, 22 nt, Human
cuggaguguaaagagcauagaa

SEQ ID NO: 787695 - RNA, 22 nt, Human
caucuuugggcugcauggaagg

SEQ ID NO: 787696 - RNA, 22 nt, Human
uguuaaauguuuugcuaguguc

SEQ ID NO: 787697 - RNA, 22 nt, Human
cuggcuguggauuaucacaggc

SEQ ID NO: 787698 - RNA, 22 nt, Human
aguaacaugaguuuuucuaaug

SEQ ID NO: 787699 - RNA, 18 nt, Human
gcccagaggucugggccc

SEQ ID NO: 787700 - RNA, 22 nt, Human
agaggccagguccagaguuugu

SEQ ID NO: 787701 - RNA, 22 nt, Human
caucauuucacuuagaugaagu

SEQ ID NO: 787702 - RNA, 22 nt, Human
gaggggaaagugugaggcugcg

SEQ ID NO: 787703 - RNA, 20 nt, Human
uguaaauaggcauuguaguu

SEQ ID NO: 787704 - RNA, 22 nt, Human
gcagugaaaaagugcacccugu

SEQ ID NO: 787705 - RNA, 22 nt, Human
auccugaaaauugaauggaagg

SEQ ID NO: 787706 - RNA, 22 nt, Human
ugcugcagcuaaggugaggugc

SEQ ID NO: 787707 - RNA, 22 nt, Human
gcuggcucugaugggcuccagg

SEQ ID NO: 787708 - RNA, 22 nt, Human
cuaaagaagcuagcaaucuaua

SEQ ID NO: 787709 - RNA, 17 nt, Human
uaaauacacaaggguau

SEQ ID NO: 787710 - RNA, 22 nt, Human
ucucuuugucugcucuuaguug

SEQ ID NO: 787711 - RNA, 22 nt, Human
ugcagagaaaccaguggaggac

SEQ ID NO: 787712 - RNA, 19 nt, Human
ugcugcuguccuugcaggg

SEQ ID NO: 787713 - RNA, 22 nt, Human
gcccagaguuugaagauacagu

SEQ ID NO: 787714 - RNA, 22 nt, Human
ugggaagguuagcaguuuguca

SEQ ID NO: 787715 - RNA, 22 nt, Human
cccagagucucugcucuugccu

SEQ ID NO: 787716 - RNA, 22 nt, Human
ugggacagguuggagagaagca

SEQ ID NO: 787717 - RNA, 22 nt, Human
cacauuuagagguuagcauggu

SEQ ID NO: 787718 - RNA, 22 nt, Human
ugcuggcuuccugugcacagca

SEQ ID NO: 787719 - RNA, 22 nt, Human
agaggccaugcuagaggccugg

SEQ ID NO: 787720 - RNA, 22 nt, Human
uuaggcugggcuacaacaacug

SEQ ID NO: 787721 - RNA, 19 nt, Human
guucuuucauaguaagagc

SEQ ID NO: 787722 - RNA, 22 nt, Human
cagcuguucuugggacagacag

SEQ ID NO: 787723 - RNA, 18 nt, Human
ugcugggcauuaggcuua

SEQ ID NO: 787724 - RNA, 19 nt, Human
ggcaggcuggauagagagg

SEQ ID NO: 787725 - RNA, 22 nt, Human
caaauccagaucccagucguag

SEQ ID NO: 787726 - RNA, 22 nt, Human
ugagcaggcucccacuucagug

SEQ ID NO: 787727 - RNA, 21 nt, Human
uuucuuucuggcucucacagu

SEQ ID NO: 787728 - RNA, 22 nt, Human
uaaggcagauguggaaucaauu

SEQ ID NO: 787729 - RNA, 22 nt, Human
ugcuguccuguuuuggaguaau

SEQ ID NO: 787730 - RNA, 22 nt, Human
aggcccagcugggccaggaaca

SEQ ID NO: 787731 - RNA, 22 nt, Human
acauguguguauacguauuuau

SEQ ID NO: 787732 - RNA, 22 nt, Human
cacauuuaagugcuuguucaga

SEQ ID NO: 787733 - RNA, 22 nt, Human
gagcucuauguggcuggcaugu

SEQ ID NO: 787734 - RNA, 22 nt, Human
uuucuacauuuguaaccagauu

SEQ ID NO: 787735 - RNA, 22 nt, Human
uaguuaaaccaccauucuggua

SEQ ID NO: 787736 - RNA, 22 nt, Human
uuucuuuccagagugauuggca

SEQ ID NO: 787737 - RNA, 22 nt, Human
ccagagggacguuaccaguuca

SEQ ID NO: 787738 - RNA, 22 nt, Human
cagugccacaggaauggccaau

SEQ ID NO: 787739 - RNA, 23 nt, Human
agcuguuucuugugaguugagug

SEQ ID NO: 787740 - RNA, 22 nt, Human
agcccagagccucuccuaaagg

SEQ ID NO: 787741 - RNA, 22 nt, Human
auccacagaaggaacuugaaag

SEQ ID NO: 787742 - RNA, 22 nt, Human
ugagcaggagauaaacagguag

SEQ ID NO: 787743 - RNA, 22 nt, Human
cagucuuugaugcauccuagcc

SEQ ID NO: 787744 - RNA, 20 nt, Human
accaggccccgggcccugca

SEQ ID NO: 787745 - RNA, 22 nt, Human
ucacuuuccucaucacgacuag

SEQ ID NO: 787746 - RNA, 22 nt, Human
ugcugcaggaacuuaagaagcu

SEQ ID NO: 787747 - RNA, 22 nt, Human
uccacagucuauuuuuagucua

SEQ ID NO: 787748 - RNA, 22 nt, Human
agcuggaggggccagcaggugu

SEQ ID NO: 787749 - RNA, 22 nt, Human
uggaagggagcuggaauuugga

SEQ ID NO: 787750 - RNA, 22 nt, Human
agccacaggccaugagauacca

SEQ ID NO: 787751 - RNA, 22 nt, Human
uugcuggcuugaagauagagga

SEQ ID NO: 787752 - RNA, 22 nt, Human
gcaggcuugagagaucagaugg

SEQ ID NO: 787753 - RNA, 22 nt, Human
acacaguuuuucagacagagau

SEQ ID NO: 787754 - RNA, 22 nt, Human
uaaggcagugagaagaaacagg

SEQ ID NO: 787755 - RNA, 22 nt, Human
aguaaacagaaagcaagaugau

SEQ ID NO: 787756 - RNA, 22 nt, Human
acaggugguagaguggaaagag

SEQ ID NO: 787757 - RNA, 22 nt, Human
ggccagagucuauaugcagaca

SEQ ID NO: 787758 - RNA, 22 nt, Human
caugggcuacagaagcaugcug

SEQ ID NO: 787759 - RNA, 22 nt, Human
cuuagcaaggcugccuggagaa

SEQ ID NO: 787760 - RNA, 17 nt, Human
gcuccaggcgugaguga

SEQ ID NO: 787761 - RNA, 22 nt, Human
gggcuggaggagauccagaggc

SEQ ID NO: 787762 - RNA, 22 nt, Human
caggugcucccagagaagugcu

SEQ ID NO: 787763 - RNA, 19 nt, Human
agcaggccacagggccagc

SEQ ID NO: 787764 - RNA, 22 nt, Human
ggccuauguuccugggcuaggg

SEQ ID NO: 787765 - RNA, 22 nt, Human
gucugcuguagguaggacagca

SEQ ID NO: 787766 - RNA, 22 nt, Human
aucuucccaggcuggggagagg

SEQ ID NO: 787767 - RNA, 22 nt, Human
agaggccaggcugcagagggau

SEQ ID NO: 787768 - RNA, 22 nt, Human
gauucacucauauuuuacguuu

SEQ ID NO: 787769 - RNA, 22 nt, Human
gaucuuugcaaacuuugucacu

SEQ ID NO: 787770 - RNA, 19 nt, Human
cuguugcuggggcucucuu

SEQ ID NO: 787771 - RNA, 22 nt, Human
augucccagcugagagacaacu

SEQ ID NO: 787772 - RNA, 22 nt, Human
ugcaggcuggcagugcugaaau

SEQ ID NO: 787773 - RNA, 22 nt, Human
auggagugccuguggcaguggg

SEQ ID NO: 787774 - RNA, 22 nt, Human
guggggagggagaugcugaagu

SEQ ID NO: 787775 - RNA, 22 nt, Human
agguggagugaaggaaaggcag

SEQ ID NO: 787776 - RNA, 22 nt, Human
uagagaaacagaaccaacaggg

SEQ ID NO: 787777 - RNA, 22 nt, Human
gcaucuuuagccucuccguggc

SEQ ID NO: 787778 - RNA, 22 nt, Human
ucugaaauauauuuugaguguu

SEQ ID NO: 787779 - RNA, 22 nt, Human
auuucucacugagcagauaaaa

SEQ ID NO: 787780 - RNA, 22 nt, Human
ugcugggcauuuuuauggcucc

SEQ ID NO: 787781 - RNA, 22 nt, Human
ugcuggcugucccuaccuggcu

SEQ ID NO: 787782 - RNA, 22 nt, Human
cuucuuuccuuccuccaguggc

SEQ ID NO: 787783 - RNA, 22 nt, Human
uggacaggcuccuagggguucc

SEQ ID NO: 787784 - RNA, 22 nt, Human
cugcaguagcagagcugaguag

SEQ ID NO: 787785 - RNA, 22 nt, Human
aguuggagaagaggucgggaau

SEQ ID NO: 787786 - RNA, 22 nt, Human
acagguggaggcuuuaggaggu

SEQ ID NO: 787787 - RNA, 22 nt, Human
ccagagcuccagggcuacagaa

SEQ ID NO: 787788 - RNA, 20 nt, Human
acugugugaucuggaaagcu

SEQ ID NO: 787789 - RNA, 22 nt, Human
uccuggcucuaaguccugagug

SEQ ID NO: 787790 - RNA, 22 nt, Human
gcuggccugggcucaagaccag

SEQ ID NO: 787791 - RNA, 22 nt, Human
ucaucuuuaccccuugcuucaa

SEQ ID NO: 787792 - RNA, 21 nt, Human
gcccagagggagccaagccca

SEQ ID NO: 787793 - RNA, 22 nt, Human
gggauaggagauugggaguguu

SEQ ID NO: 787794 - RNA, 22 nt, Human
gcuggcucugugguaguuggca

SEQ ID NO: 787795 - RNA, 22 nt, Human
aguaaaaucuuaagcacagugg

SEQ ID NO: 787796 - RNA, 22 nt, Human
uuagugcaaaccucagagacac

SEQ ID NO: 787797 - RNA, 22 nt, Human
cagcccaggccgacaguuccuc

SEQ ID NO: 787798 - RNA, 22 nt, Human
acaguuaacuggagagcgaguu

SEQ ID NO: 787799 - RNA, 22 nt, Human
uggaagagggagcuggguggcc

SEQ ID NO: 787800 - RNA, 19 nt, Human
ugcugcaggaugcugcugg

SEQ ID NO: 787801 - RNA, 22 nt, Human
gcagagugaagcaguauggaaa

SEQ ID NO: 787802 - RNA, 22 nt, Human
uggagagucucugagccagggc

SEQ ID NO: 787803 - RNA, 20 nt, Human
guggagaggcuggcgggacu

SEQ ID NO: 787804 - RNA, 22 nt, Human
uuccacuggcuuucagugaucu

SEQ ID NO: 787805 - RNA, 22 nt, Human
aggacagguguagugggcucug

SEQ ID NO: 787806 - RNA, 22 nt, Human
ugcuggccuguccacgggcugu

SEQ ID NO: 787807 - RNA, 22 nt, Human
cagaguggaguuuuucagcggg

SEQ ID NO: 787808 - RNA, 18 nt, Human
agcaacaggaucccaggg

SEQ ID NO: 787809 - RNA, 22 nt, Human
cagaguggcaugaaugaagccu

SEQ ID NO: 787810 - RNA, 22 nt, Human
ucagccacuucccucuggucag

SEQ ID NO: 787811 - RNA, 22 nt, Human
gccuguuuuagaugcauugaug

SEQ ID NO: 787812 - RNA, 22 nt, Human
cuucagcugcaguuauguuuag

SEQ ID NO: 787813 - RNA, 22 nt, Human
uugaucucuguugcugucuuug

SEQ ID NO: 787814 - RNA, 22 nt, Human
uucugcaggagcccuaguguau

SEQ ID NO: 787815 - RNA, 22 nt, Human
acaguuaauuguuguugggugu

SEQ ID NO: 787816 - RNA, 22 nt, Human
gccagaguugaggcaguuuauu

SEQ ID NO: 787817 - RNA, 22 nt, Human
auaaacaagacuggccaacuuu

SEQ ID NO: 787818 - RNA, 22 nt, Human
uuugcugggcucugugccagac

SEQ ID NO: 787819 - RNA, 22 nt, Human
caggcuuggcagggaggcuggu

SEQ ID NO: 787820 - RNA, 21 nt, Human
ugggcucuuuaacccaggcac

SEQ ID NO: 787821 - RNA, 22 nt, Human
agccacagucugaugccugaga

SEQ ID NO: 787822 - RNA, 22 nt, Human
cuacagcagagaccagccacau

SEQ ID NO: 787823 - RNA, 22 nt, Human
cacauuuaaagguugaagcuga

SEQ ID NO: 787824 - RNA, 22 nt, Human
uucuuucccaguagaugugaaa

SEQ ID NO: 787825 - RNA, 22 nt, Human
gugcuucacugaccuguuuuca

SEQ ID NO: 787826 - RNA, 22 nt, Human
ccagagcugauuccugggacuu

SEQ ID NO: 787827 - RNA, 22 nt, Human
aaagacagauggcaaggaugau

SEQ ID NO: 787828 - RNA, 22 nt, Human
cagggcuguuagcugcugcucu

SEQ ID NO: 787829 - RNA, 22 nt, Human
accucccagaaaguuuugcagg

SEQ ID NO: 787830 - RNA, 19 nt, Human
cccuagaguaagacugcau

SEQ ID NO: 787831 - RNA, 22 nt, Human
uuauagaaggagcauucacuua

SEQ ID NO: 787832 - RNA, 20 nt, Human
gcacagagaugagcaaagua

SEQ ID NO: 787833 - RNA, 22 nt, Human
acaggcugggcgcuuccugcgg

SEQ ID NO: 787834 - RNA, 22 nt, Human
guaaagaaggcaaccugguuau

SEQ ID NO: 787835 - RNA, 17 nt, Human
acaagcaguggccaugg

SEQ ID NO: 787836 - RNA, 22 nt, Human
ucugggccugauggcuaaagcc

SEQ ID NO: 787837 - RNA, 22 nt, Human
guuaaagaagaauaguuccuuu

SEQ ID NO: 787838 - RNA, 22 nt, Human
cccagagucacaugggguguuc

SEQ ID NO: 787839 - RNA, 22 nt, Human
aauauccauugggagcaaaugg

SEQ ID NO: 787840 - RNA, 22 nt, Human
agcaggugcauggcgagcgcgg

SEQ ID NO: 787841 - RNA, 22 nt, Human
uuuaaauucugucugccgcuua

SEQ ID NO: 787842 - RNA, 22 nt, Human
cugggcuccuaaccauccaggu

SEQ ID NO: 787843 - RNA, 23 nt, Human
cccagagucaucuguagcugugg

SEQ ID NO: 787844 - RNA, 22 nt, Human
acagguggacacagcagcaguc

SEQ ID NO: 787845 - RNA, 22 nt, Human
uagcucaaagguuaagugugga

SEQ ID NO: 787846 - RNA, 20 nt, Human
caguccugucccugcugccc

SEQ ID NO: 787847 - RNA, 22 nt, Human
ucacucugaaugguacugagga

SEQ ID NO: 787848 - RNA, 22 nt, Human
agccagggcugcagguuccuug

SEQ ID NO: 787849 - RNA, 22 nt, Human
gcugggcuguaguuugcugacc

SEQ ID NO: 787850 - RNA, 22 nt, Human
ccagcccaaagucaccccggga

SEQ ID NO: 787851 - RNA, 20 nt, Human
uggacaggggcauagguugc

SEQ ID NO: 787852 - RNA, 22 nt, Human
acagagcaguaagaacacagcu

SEQ ID NO: 787853 - RNA, 22 nt, Human
ugggacagauuauaagucugca

SEQ ID NO: 787854 - RNA, 22 nt, Human
aagagaaggcccugacccaccc

SEQ ID NO: 787855 - RNA, 22 nt, Human
agccagggaugcagcacaguga

SEQ ID NO: 787856 - RNA, 22 nt, Human
ugggaaggggagcuggaaagga

SEQ ID NO: 787857 - RNA, 22 nt, Human
gacagccaugcacuucugcugu

SEQ ID NO: 787858 - RNA, 22 nt, Human
ccagggcuccccagaaguaccc

SEQ ID NO: 787859 - RNA, 22 nt, Human
cacagcccccuugacacucugg

SEQ ID NO: 787860 - RNA, 22 nt, Human
auuuggcuguaguaacuggauc

SEQ ID NO: 787861 - RNA, 22 nt, Human
aguccuuagaacacuguaucug

SEQ ID NO: 787862 - RNA, 22 nt, Human
ugggagaacccagggucaggcu

SEQ ID NO: 787863 - RNA, 19 nt, Human
ccaggccugcgggcguugg

SEQ ID NO: 787864 - RNA, 22 nt, Human
uucuuuccucccagccuuugga

SEQ ID NO: 787865 - RNA, 22 nt, Human
agcccagauaaaguacaaccau

SEQ ID NO: 787866 - RNA, 22 nt, Human
cccagaguggacgguggccccu

SEQ ID NO: 787867 - RNA, 21 nt, Human
ugcaggcugugcgcuccugcc

SEQ ID NO: 787868 - RNA, 20 nt, Human
gcagagugugagagggugaa

SEQ ID NO: 787869 - RNA, 22 nt, Human
cagaaguggcaucauucaagag

SEQ ID NO: 787870 - RNA, 22 nt, Human
ucagcccagaccaccucauugc

SEQ ID NO: 787871 - RNA, 22 nt, Human
uggaaguggcagaggaaguggu

SEQ ID NO: 787872 - RNA, 22 nt, Human
agcugaugccauguggaacagu

SEQ ID NO: 787873 - RNA, 22 nt, Human
ugucccagguccuagaugacca

SEQ ID NO: 787874 - RNA, 23 nt, Human
ugggauagaauuucauggcugcu

SEQ ID NO: 787875 - RNA, 22 nt, Human
ggcccagaaaaaggcuuagaau

SEQ ID NO: 787876 - RNA, 22 nt, Human
cacaguuaugggaaacguaguu

SEQ ID NO: 787877 - RNA, 22 nt, Human
gauugagucugaggaugcugca

SEQ ID NO: 787878 - RNA, 22 nt, Human
agccacagagagggagcugcaa

SEQ ID NO: 787879 - RNA, 22 nt, Human
caggccugagacaucugagaua

SEQ ID NO: 787880 - RNA, 22 nt, Human
gugucccagcagcacauuggcu

SEQ ID NO: 787881 - RNA, 22 nt, Human
uggagugcaguugggaggacac

SEQ ID NO: 787882 - RNA, 22 nt, Human
ccuggcuccaaagcugugacuc

SEQ ID NO: 787883 - RNA, 22 nt, Human
uucugcagcaugaggcuggagc

SEQ ID NO: 787884 - RNA, 22 nt, Human
ugggacagugaccccagagguc

SEQ ID NO: 787885 - RNA, 22 nt, Human
ucugaaauaggaaagcaaaugg

SEQ ID NO: 787886 - RNA, 22 nt, Human
cacacuguugaggacgagaugu

SEQ ID NO: 787887 - RNA, 21 nt, Human
ccugaaauucucacuagcuua

SEQ ID NO: 787888 - RNA, 20 nt, Human
agagugggugucacaggcug

SEQ ID NO: 787889 - RNA, 22 nt, Human
cagggccaugaggcacaggguc

SEQ ID NO: 787890 - RNA, 22 nt, Human
aggccagacagcuagaaacagg

SEQ ID NO: 787891 - RNA, 22 nt, Human
ccuggcucuagaggccacuccu

SEQ ID NO: 787892 - RNA, 19 nt, Human
uucuuuccacaucuucucu

SEQ ID NO: 787893 - RNA, 19 nt, Human
cccuggagaauacccugga

SEQ ID NO: 787894 - RNA, 22 nt, Human
acaggcgcuggcagagagaaaa

SEQ ID NO: 787895 - RNA, 22 nt, Human
ccuggcucauuaugugccccca

SEQ ID NO: 787896 - RNA, 22 nt, Human
auucuuucaaggaauaguuauu

SEQ ID NO: 787897 - RNA, 21 nt, Human
gcugucuccuccuugcaccag

SEQ ID NO: 787898 - RNA, 22 nt, Human
cagcaggcuguggaaauccugg

SEQ ID NO: 787899 - RNA, 22 nt, Human
uccccuggcaccuaguccuacu

SEQ ID NO: 787900 - RNA, 22 nt, Human
augucccaagauacagcuagag

SEQ ID NO: 787901 - RNA, 22 nt, Human
acaucuuuguuucuuaguguau

SEQ ID NO: 787902 - RNA, 22 nt, Human
gccucucuccuuggcuugcagu

SEQ ID NO: 787903 - RNA, 22 nt, Human
ucagcccaguuuuaucaucugu

SEQ ID NO: 787904 - RNA, 22 nt, Human
gccuagagaagcuuacugaagc

SEQ ID NO: 787905 - RNA, 22 nt, Human
cugcaguaaccacuguaggugu

SEQ ID NO: 787906 - RNA, 22 nt, Human
ucauaaauaguugugccugaau

SEQ ID NO: 787907 - RNA, 22 nt, Human
acaggugguaaaauggacuguc

SEQ ID NO: 787908 - RNA, 19 nt, Human
uccagcagugcuugaaauc

SEQ ID NO: 787909 - RNA, 22 nt, Human
guucuauucauugcuccacgag

SEQ ID NO: 787910 - RNA, 22 nt, Human
uaggacagaguucccugauggc

SEQ ID NO: 787911 - RNA, 19 nt, Human
cagguggcgcucuacaggg

SEQ ID NO: 787912 - RNA, 22 nt, Human
aggugggguguuggauguuuau

SEQ ID NO: 787913 - RNA, 22 nt, Human
aucuuugucacucuacugucua

SEQ ID NO: 787914 - RNA, 22 nt, Human
auucuuucauauaaaggcucag

SEQ ID NO: 787915 - RNA, 22 nt, Human
ugauggccagucgcacuggagg

SEQ ID NO: 787916 - RNA, 22 nt, Human
cagguggcaaaugaguagcauu

SEQ ID NO: 787917 - RNA, 22 nt, Human
gcuggccugcugggcaccaccg

SEQ ID NO: 787918 - RNA, 22 nt, Human
gcuggcucagggggauuagcaa

SEQ ID NO: 787919 - RNA, 22 nt, Human
guuacaauguucuucaguucug

SEQ ID NO: 787920 - RNA, 22 nt, Human
gcagucuuugaaugugaaauag

SEQ ID NO: 787921 - RNA, 22 nt, Human
gcuggcucuuuuugccgggcuc

SEQ ID NO: 787922 - RNA, 22 nt, Human
uggaagaggccagaaaguggga

SEQ ID NO: 787923 - RNA, 22 nt, Human
aacaaugugauugaagcuagaa

SEQ ID NO: 787924 - RNA, 22 nt, Human
gccuggagugguccugcugccc

SEQ ID NO: 787925 - RNA, 22 nt, Human
gugggguguccagcagcgagcu

SEQ ID NO: 787926 - RNA, 22 nt, Human
gccugcagccccucugcaguag

SEQ ID NO: 787927 - RNA, 21 nt, Human
gcuggcucucugacgugcuuu

SEQ ID NO: 787928 - RNA, 22 nt, Human
cuaaagaauuuugcuugaccag

SEQ ID NO: 787929 - RNA, 22 nt, Human
aaugcuguccaauaggaacaua

SEQ ID NO: 787930 - RNA, 22 nt, Human
cagggugcuuccguggagcugu

SEQ ID NO: 787931 - RNA, 18 nt, Human
aguuagaaaugaaggcca

SEQ ID NO: 787932 - RNA, 22 nt, Human
uuuaaauuuguguuuagagggu

SEQ ID NO: 787933 - RNA, 22 nt, Human
caguggagagacuuuuacucuu

SEQ ID NO: 787934 - RNA, 22 nt, Human
gcaggcuuauggggagacagag

SEQ ID NO: 787935 - RNA, 22 nt, Human
aacaaagucguugccuagaaga

SEQ ID NO: 787936 - RNA, 22 nt, Human
aggcccagagagccaguuagug

SEQ ID NO: 787937 - RNA, 22 nt, Human
uuucuuuccauacauauugcua

SEQ ID NO: 787938 - RNA, 22 nt, Human
cuucuuucccaggcauguuuua

SEQ ID NO: 787939 - RNA, 22 nt, Human
ugugcugcucucagugacagcc

SEQ ID NO: 787940 - RNA, 20 nt, Human
gacaggugcuaaagaggggc

SEQ ID NO: 787941 - RNA, 22 nt, Human
ugcugcuguauccuuaguguca

SEQ ID NO: 787942 - RNA, 22 nt, Human
ccacagcuagggcaaucugauu

SEQ ID NO: 787943 - RNA, 22 nt, Human
cugcagauggcucaguggggca

SEQ ID NO: 787944 - RNA, 22 nt, Human
uauuccaccagagaugugaauu

SEQ ID NO: 787945 - RNA, 22 nt, Human
ccagagaugugaaaaugccgga

SEQ ID NO: 787946 - RNA, 22 nt, Human
ggcaggcugcuugggucauguc

SEQ ID NO: 787947 - RNA, 22 nt, Human
acaggggcaggcaggacccuuu

SEQ ID NO: 787948 - RNA, 22 nt, Human
uggagugggcaauguaggcaag

SEQ ID NO: 787949 - RNA, 22 nt, Human
ugagcaggcgcagcaggagguc

SEQ ID NO: 787950 - RNA, 22 nt, Human
acuguguggaccacucugaggc

SEQ ID NO: 787951 - RNA, 22 nt, Human
uuccuuccugucuuccuuacug

SEQ ID NO: 787952 - RNA, 22 nt, Human
ugagcaggauucgccucuugca

SEQ ID NO: 787953 - RNA, 22 nt, Human
uggucucccagagcagggacgc

SEQ ID NO: 787954 - RNA, 22 nt, Human
ugcugggcuaggguggagcucu

SEQ ID NO: 787955 - RNA, 22 nt, Human
cuggagugaagucuggcagcuu

SEQ ID NO: 787956 - RNA, 19 nt, Human
ccuggagucgcgcugccuc

SEQ ID NO: 787957 - RNA, 22 nt, Human
agcuuugaaguauuuggucucc

SEQ ID NO: 787958 - RNA, 22 nt, Human
gagguggaaggcaggaacaaau

SEQ ID NO: 787959 - RNA, 22 nt, Human
gccucucucuacccaguaugau

SEQ ID NO: 787960 - RNA, 22 nt, Human
ccagagauguucacauucuaau

SEQ ID NO: 787961 - RNA, 22 nt, Human
gaguggggaaagccaggacaga

SEQ ID NO: 787962 - RNA, 22 nt, Human
uugcuggcaauuuagagauuuc

SEQ ID NO: 787963 - RNA, 22 nt, Human
uguucuuuggcuucacagcucu

SEQ ID NO: 787964 - RNA, 22 nt, Human
ucccagaaucuccagugcuaca

SEQ ID NO: 787965 - RNA, 22 nt, Human
uggcugcagaucugugggacac

SEQ ID NO: 787966 - RNA, 22 nt, Human
accacugucuacacauugacuc

SEQ ID NO: 787967 - RNA, 22 nt, Human
aguugcuggcaccugugaguau

SEQ ID NO: 787968 - RNA, 22 nt, Human
aagcaggcgagggccuggagca

SEQ ID NO: 787969 - RNA, 22 nt, Human
acaguuaauaugugacagaacu

SEQ ID NO: 787970 - RNA, 22 nt, Human
agucccaguucgguucuuccuc

SEQ ID NO: 787971 - RNA, 22 nt, Human
caggcucagcucuggccagugc

SEQ ID NO: 787972 - RNA, 22 nt, Human
gcagugacauaccuggagggca

SEQ ID NO: 787973 - RNA, 22 nt, Human
acaguuaaggaaauggagguuc

SEQ ID NO: 787974 - RNA, 22 nt, Human
gaaccuguaaguauagaugugg

SEQ ID NO: 787975 - RNA, 22 nt, Human
augguuauuacugcuguuccag

SEQ ID NO: 787976 - RNA, 22 nt, Human
ucaucuuuccucaaaagaucca

SEQ ID NO: 787977 - RNA, 22 nt, Human
acagucuuuaauuucuuugugg

SEQ ID NO: 787978 - RNA, 20 nt, Human
ccagagcugauggcugcccg

SEQ ID NO: 787979 - RNA, 22 nt, Human
ggagagcugguauaugaagaca

SEQ ID NO: 787980 - RNA, 22 nt, Human
gggucaggccucaaggugggcu

SEQ ID NO: 787981 - RNA, 22 nt, Human
agugugagcuaauagcagagcc

SEQ ID NO: 787982 - RNA, 22 nt, Human
ugcaggcuggggaggcagacuu

SEQ ID NO: 787983 - RNA, 22 nt, Human
uucuaguuuccauuuuaagaca

SEQ ID NO: 787984 - RNA, 22 nt, Human
caguggcagaucaccaacugga

SEQ ID NO: 787985 - RNA, 22 nt, Human
agggacaguauccaucucacag

SEQ ID NO: 787986 - RNA, 22 nt, Human
ccagggcuggaccagugcuugg

SEQ ID NO: 787987 - RNA, 20 nt, Human
aagagaagaagucuuugaaa

SEQ ID NO: 787988 - RNA, 22 nt, Human
cacucugauuccacaaggcucc

SEQ ID NO: 787989 - RNA, 22 nt, Human
acaggcugacuuccugccaugu

SEQ ID NO: 787990 - RNA, 22 nt, Human
ccaugaguagcgauuucauuuu

SEQ ID NO: 787991 - RNA, 22 nt, Human
auugcuggaugagcucuuggau

SEQ ID NO: 787992 - RNA, 20 nt, Human
gcugggcuaccacuggcccu

SEQ ID NO: 787993 - RNA, 22 nt, Human
ccaggccucccuuuuccagcca

SEQ ID NO: 787994 - RNA, 22 nt, Human
aggccuggugaaugaaguaucu

SEQ ID NO: 787995 - RNA, 22 nt, Human
aagccagguguuuaggccagcg

SEQ ID NO: 787996 - RNA, 22 nt, Human
caucuuauuuucuucuagugcu

SEQ ID NO: 787997 - RNA, 22 nt, Human
uggaggagugugauugucugcc

SEQ ID NO: 787998 - RNA, 22 nt, Human
uagcccagcaugagcagagcug

SEQ ID NO: 787999 - RNA, 22 nt, Human
uaguggagguggucugugaacu

SEQ ID NO: 788000 - RNA, 22 nt, Human
gcagcugggacacugaggccag

SEQ ID NO: 788001 - RNA, 22 nt, Human
acguggagccacagauggagca

SEQ ID NO: 788002 - RNA, 22 nt, Human
acaggugggcuuaagagucggc

SEQ ID NO: 788003 - RNA, 22 nt, Human
ggguugaggcggaugucggcgg

SEQ ID NO: 788004 - RNA, 22 nt, Human
acagggcuccuugggcugacac

SEQ ID NO: 788005 - RNA, 22 nt, Human
aggagcaaaugaugagacagca

SEQ ID NO: 788006 - RNA, 22 nt, Human
caggggcucccugggugccagu

SEQ ID NO: 788007 - RNA, 22 nt, Human
uauugcugacugucuucugagu

SEQ ID NO: 788008 - RNA, 20 nt, Human
gacaggagaguuagguaggu

SEQ ID NO: 788009 - RNA, 22 nt, Human
ugcugcagguguguucagugag

SEQ ID NO: 788010 - RNA, 22 nt, Human
augaaacucuaacuuaacaagu

SEQ ID NO: 788011 - RNA, 22 nt, Human
cagcccugcagccauggccugu

SEQ ID NO: 788012 - RNA, 22 nt, Human
aaauacagauucugacucagag

SEQ ID NO: 788013 - RNA, 22 nt, Human
cugguguuuauuacaggugcuc

SEQ ID NO: 788014 - RNA, 22 nt, Human
cugucuguuuuguauacaggcc

SEQ ID NO: 788015 - RNA, 22 nt, Human
cuuaaauuggaugaguuaaguu

SEQ ID NO: 788016 - RNA, 17 nt, Human
gcaguuaaauuaagaug

SEQ ID NO: 788017 - RNA, 20 nt, Human
auuccacuuguuugagguac

SEQ ID NO: 788018 - RNA, 18 nt, Human
agcuguuguugacucugu

SEQ ID NO: 788019 - RNA, 19 nt, Human
cacaauuaugagacacuua

SEQ ID NO: 788020 - RNA, 22 nt, Human
auacagaagaacuauagccacu

SEQ ID NO: 788021 - RNA, 22 nt, Human
gccugcagccucagagaauuuu

SEQ ID NO: 788022 - RNA, 22 nt, Human
ugcugggcuagaagcugaggcc

SEQ ID NO: 788023 - RNA, 22 nt, Human
aggugcaggagcugugcaggga

SEQ ID NO: 788024 - RNA, 22 nt, Human
aucaucuuaucugacucauuuu

SEQ ID NO: 788025 - RNA, 22 nt, Human
uuugaaaccuaguuauaugacu

SEQ ID NO: 788026 - RNA, 22 nt, Human
gucugaaaauaugauuuugccu

SEQ ID NO: 788027 - RNA, 22 nt, Human
agggcugguauguccaugaaag

SEQ ID NO: 788028 - RNA, 22 nt, Human
auuucucagugaaaugacaggc

SEQ ID NO: 788029 - RNA, 22 nt, Human
acagguggcuuauuggcugauu

SEQ ID NO: 788030 - RNA, 22 nt, Human
uagcuguucccagcucugugua

SEQ ID NO: 788031 - RNA, 22 nt, Human
uaacaacaugcaauuuaaccuu

SEQ ID NO: 788032 - RNA, 23 nt, Human
ucagucuucccugucaguaauag

SEQ ID NO: 788033 - RNA, 22 nt, Human
caucuuuguucuguaaacuuuu

SEQ ID NO: 788034 - RNA, 22 nt, Human
agcagaugaaucccagauaaag

SEQ ID NO: 788035 - RNA, 22 nt, Human
auuaaauuggacgcugggggaa

SEQ ID NO: 788036 - RNA, 22 nt, Human
cuucuuucuuuugaucacaggu

SEQ ID NO: 788037 - RNA, 22 nt, Human
guuaaauucgaugauggauaaa

SEQ ID NO: 788038 - RNA, 22 nt, Human
caucuuuguuuuggauauaauc

SEQ ID NO: 788039 - RNA, 20 nt, Human
agaggccaguuaggagucua

SEQ ID NO: 788040 - RNA, 22 nt, Human
ugaaauaacuuuugggugaguu

SEQ ID NO: 788041 - RNA, 22 nt, Human
caguuaaaagguaugcuaccaa

SEQ ID NO: 788042 - RNA, 23 nt, Human
cuggcccaggugagagguuggug

SEQ ID NO: 788043 - RNA, 19 nt, Human
ugcugcagucaggcgaggg

SEQ ID NO: 788044 - RNA, 22 nt, Human
ugcugcugaugcauagucugcu

SEQ ID NO: 788045 - RNA, 22 nt, Human
aggcaggccccugagaauagac

SEQ ID NO: 788046 - RNA, 22 nt, Human
aggccagaagccagaaaugcuu

SEQ ID NO: 788047 - RNA, 22 nt, Human
uuucuauucuggaucuguggca

SEQ ID NO: 788048 - RNA, 22 nt, Human
aaguccagaccugaggcccuca

SEQ ID NO: 788049 - RNA, 22 nt, Human
cacugugucuggagugagcugg

SEQ ID NO: 788050 - RNA, 22 nt, Human
aagcguuggccuccccugauga

SEQ ID NO: 788051 - RNA, 22 nt, Human
gggcuagaaguuagcuagagaa

SEQ ID NO: 788052 - RNA, 22 nt, Human
uccacagacuauuaagugaucu

SEQ ID NO: 788053 - RNA, 22 nt, Human
aguggagguuacagcuguacau

SEQ ID NO: 788054 - RNA, 22 nt, Human
gcccagagugaguccugggccc

SEQ ID NO: 788055 - RNA, 22 nt, Human
ccaggcucugugugggcuagag

SEQ ID NO: 788056 - RNA, 22 nt, Human
caguuaaacgggccaugugagu

SEQ ID NO: 788057 - RNA, 22 nt, Human
uggaggagggcuggugucugua

SEQ ID NO: 788058 - RNA, 22 nt, Human
caggccaggugcucuagaauca

SEQ ID NO: 788059 - RNA, 22 nt, Human
caguuaaagcugcaugugucag

SEQ ID NO: 788060 - RNA, 22 nt, Human
gccugcagugagugcagaaggu

SEQ ID NO: 788061 - RNA, 22 nt, Human
gccuggugaaaggcagagagcg

SEQ ID NO: 788062 - RNA, 19 nt, Human
uggagaggaaaugcugcuc

SEQ ID NO: 788063 - RNA, 22 nt, Human
agcccagcuuucaccccucugg

SEQ ID NO: 788064 - RNA, 22 nt, Human
uggcugcagugcuugagauguc

SEQ ID NO: 788065 - RNA, 20 nt, Human
gucugcaguaagagggaaua

SEQ ID NO: 788066 - RNA, 22 nt, Human
uccagcccugcccauucucucg

SEQ ID NO: 788067 - RNA, 22 nt, Human
aauaagauugacacaaguaccu

SEQ ID NO: 788068 - RNA, 22 nt, Human
cagagcugguguuacaagucca

SEQ ID NO: 788069 - RNA, 22 nt, Human
acaggggcaagggcucacggcc

SEQ ID NO: 788070 - RNA, 22 nt, Human
gcuggccucuggagaagggcuu

SEQ ID NO: 788071 - RNA, 22 nt, Human
aagagaagaaagugucuacaca

SEQ ID NO: 788072 - RNA, 22 nt, Human
auggccagcucagagcacucag

SEQ ID NO: 788073 - RNA, 22 nt, Human
cacagugaauuucaaguguugu

SEQ ID NO: 788074 - RNA, 22 nt, Human
agguuauucucuaucucauccc

SEQ ID NO: 788075 - RNA, 19 nt, Human
caucuuuggucaccuaguc

SEQ ID NO: 788076 - RNA, 22 nt, Human
agguggggccaaaugcuacagu

SEQ ID NO: 788077 - RNA, 22 nt, Human
aggccagguggucaugcuugcu

SEQ ID NO: 788078 - RNA, 22 nt, Human
caucuucugggacuucucaguu

SEQ ID NO: 788079 - RNA, 22 nt, Human
cacaauuauagaagaaagcaua

SEQ ID NO: 788080 - RNA, 22 nt, Human
uuucuacaugucaguaacugau

SEQ ID NO: 788081 - RNA, 22 nt, Human
ucaggggcagccggggaagcca

SEQ ID NO: 788082 - RNA, 19 nt, Human
gagcaggccacacaugugu

SEQ ID NO: 788083 - RNA, 22 nt, Human
cuuucgaucaagggucccuuca

SEQ ID NO: 788084 - RNA, 22 nt, Human
acuguguuaaauacagagaugg

SEQ ID NO: 788085 - RNA, 22 nt, Human
uccagcccuguggcuuccaccc

SEQ ID NO: 788086 - RNA, 22 nt, Human
cuggaguggccggugcuguggc

SEQ ID NO: 788087 - RNA, 22 nt, Human
auugcuggcccagaugcuuuag

SEQ ID NO: 788088 - RNA, 22 nt, Human
gacaggccagacaggagacuga

SEQ ID NO: 788089 - RNA, 22 nt, Human
cuucagugauugcagaaagccu

SEQ ID NO: 788090 - RNA, 22 nt, Human
cuuucuuucgaagacgugauua

SEQ ID NO: 788091 - RNA, 22 nt, Human
cacaguuagagguagaguccag

SEQ ID NO: 788092 - RNA, 22 nt, Human
ucacucugggcccuacugggcu

SEQ ID NO: 788093 - RNA, 22 nt, Human
uagcccagaugauugaaccaug

SEQ ID NO: 788094 - RNA, 22 nt, Human
gggcacagagggucuugaagaa

SEQ ID NO: 788095 - RNA, 22 nt, Human
ccaggccugcauucccucucag

SEQ ID NO: 788096 - RNA, 22 nt, Human
ggacaggguuggggcauauaaa

SEQ ID NO: 788097 - RNA, 22 nt, Human
ggcccagaauacaugaaguaua

SEQ ID NO: 788098 - RNA, 22 nt, Human
uuucucugcagagccccaagga

SEQ ID NO: 788099 - RNA, 22 nt, Human
gggccacacagggcagcucccu

SEQ ID NO: 788100 - RNA, 22 nt, Human
aguugcugauucugucugugau

SEQ ID NO: 788101 - RNA, 22 nt, Human
gccuggagggauagaaugcaag

SEQ ID NO: 788102 - RNA, 22 nt, Human
agguggaacguucaggugcuag

SEQ ID NO: 788103 - RNA, 22 nt, Human
ggugaggccuguacaaagcugc

SEQ ID NO: 788104 - RNA, 22 nt, Human
cuggcucuuuccuagcuaggcu

SEQ ID NO: 788105 - RNA, 22 nt, Human
aagcuguuugcaguggauggag

SEQ ID NO: 788106 - RNA, 22 nt, Human
ccagagcuugacgugcaacgga

SEQ ID NO: 788107 - RNA, 21 nt, Human
gcuggagagccaggcaggggc

SEQ ID NO: 788108 - RNA, 22 nt, Human
aaacaauguugucuccaagagg

SEQ ID NO: 788109 - RNA, 22 nt, Human
caguuaaaagaagucuaucuua

SEQ ID NO: 788110 - RNA, 22 nt, Human
ugcuguuaguaaggaacaugac

SEQ ID NO: 788111 - RNA, 22 nt, Human
ugagcaggacucacugcagccu

SEQ ID NO: 788112 - RNA, 22 nt, Human
ugcacuuugcaggcauggaaac

SEQ ID NO: 788113 - RNA, 21 nt, Human
aggacaggaacuggcugaaua

SEQ ID NO: 788114 - RNA, 23 nt, Human
ccaggccucucagagggugugcc

SEQ ID NO: 788115 - RNA, 22 nt, Human
ugggcucugcugcguaccaguu

SEQ ID NO: 788116 - RNA, 22 nt, Human
uuaagauuuguagagaaaaagc

SEQ ID NO: 788117 - RNA, 22 nt, Human
gaguggagcaaaagagguagau

SEQ ID NO: 788118 - RNA, 22 nt, Human
auggacagguacugcagugggu

SEQ ID NO: 788119 - RNA, 22 nt, Human
cccagagucaagcuuaccauua

SEQ ID NO: 788120 - RNA, 22 nt, Human
augggccacacacgauugggug

SEQ ID NO: 788121 - RNA, 22 nt, Human
caggugcugcguggcggagcug

SEQ ID NO: 788122 - RNA, 22 nt, Human
ugcaggcugggaagagggacaa

SEQ ID NO: 788123 - RNA, 22 nt, Human
aaaguaucugaccgauuauaaa

SEQ ID NO: 788124 - RNA, 22 nt, Human
ccagggccugccacuuagcaag

SEQ ID NO: 788125 - RNA, 22 nt, Human
uccucagucucucaaaugaggc

SEQ ID NO: 788126 - RNA, 22 nt, Human
aggcaggcccucuggaaaggua

SEQ ID NO: 788127 - RNA, 22 nt, Human
acagcccaagucaccugcagga

SEQ ID NO: 788128 - RNA, 22 nt, Human
caaagcaagggcugaagacucc

SEQ ID NO: 788129 - RNA, 22 nt, Human
aucagcugaugaauggaugaau

SEQ ID NO: 788130 - RNA, 22 nt, Human
ugcuggccucggcgcugggccu

SEQ ID NO: 788131 - RNA, 22 nt, Human
uuuggugagcugcgagugagga

SEQ ID NO: 788132 - RNA, 22 nt, Human
auggauaguggugaaggcugua

SEQ ID NO: 788133 - RNA, 22 nt, Human
auccacagagaggaagaauagu

SEQ ID NO: 788134 - RNA, 22 nt, Human
ccaggccaaauucagucagcag

SEQ ID NO: 788135 - RNA, 22 nt, Human
cagagccacagccuccagauuu

SEQ ID NO: 788136 - RNA, 22 nt, Human
aggcccaguagugcugccuuua

SEQ ID NO: 788137 - RNA, 22 nt, Human
uauauccauaggcugugccuag

SEQ ID NO: 788138 - RNA, 22 nt, Human
agacagggccacucauccucac

SEQ ID NO: 788139 - RNA, 22 nt, Human
ggcaggcuuucagcaucaaguc

SEQ ID NO: 788140 - RNA, 22 nt, Human
cuuugcuguuauaaugauagcu

SEQ ID NO: 788141 - RNA, 22 nt, Human
ugcuggcuacugauggcaggcc

SEQ ID NO: 788142 - RNA, 22 nt, Human
cggcugugucuucacaggagcc

SEQ ID NO: 788143 - RNA, 22 nt, Human
uauccacacucaaggggagggg

SEQ ID NO: 788144 - RNA, 22 nt, Human
agagucagcuuaugacacaguc

SEQ ID NO: 788145 - RNA, 22 nt, Human
auauacacaucuuuuuaaauau

SEQ ID NO: 788146 - RNA, 19 nt, Human
ccagcccauaguccaucac

SEQ ID NO: 788147 - RNA, 23 nt, Human
ggggaaagaccaugcuugaggac

SEQ ID NO: 788148 - RNA, 22 nt, Human
uagcaucuguuucucuuuguga

SEQ ID NO: 788149 - RNA, 22 nt, Human
cugcaggacugaaagaugaggu

SEQ ID NO: 788150 - RNA, 22 nt, Human
cugggucccacagccugcuggg

SEQ ID NO: 788151 - RNA, 22 nt, Human
uccagugcauucagacacuugg

SEQ ID NO: 788152 - RNA, 18 nt, Human
uuucuuucugccuggggc

SEQ ID NO: 788153 - RNA, 22 nt, Human
aaauacagauuccagggucuua

SEQ ID NO: 788154 - RNA, 22 nt, Human
aauauccacuucaauacaggca

SEQ ID NO: 788155 - RNA, 22 nt, Human
gccagagucuucugacccugug

SEQ ID NO: 788156 - RNA, 22 nt, Human
uuucuauuggcgucacuguugu

SEQ ID NO: 788157 - RNA, 22 nt, Human
agugugaguuacaaagugugaa

SEQ ID NO: 788158 - RNA, 22 nt, Human
uccacagggauguugaguucuu

SEQ ID NO: 788159 - RNA, 21 nt, Human
ccaggggcaaauugucguuuc

SEQ ID NO: 788160 - RNA, 22 nt, Human
ccuggcucuguccucgcgcaaa

SEQ ID NO: 788161 - RNA, 22 nt, Human
ggacagggcucuuggcacuccu

SEQ ID NO: 788162 - RNA, 22 nt, Human
aauccagaugagcaaucauacu

SEQ ID NO: 788163 - RNA, 22 nt, Human
gaagguggcgagcggauugcug

SEQ ID NO: 788164 - RNA, 19 nt, Human
ccaggccuggcgucuccgc

SEQ ID NO: 788165 - RNA, 22 nt, Human
ugagcaggucaggaaguacauu

SEQ ID NO: 788166 - RNA, 22 nt, Human
uauugcacaugcgcuagaacca

SEQ ID NO: 788167 - RNA, 22 nt, Human
auuucucauuuugcuucaaagg

SEQ ID NO: 788168 - RNA, 22 nt, Human
ggcucaggccagaccacgacuc

SEQ ID NO: 788169 - RNA, 22 nt, Human
ggcuucagugacuggugcccuc

SEQ ID NO: 788170 - RNA, 22 nt, Human
gcuccagggaacagaauguacu

SEQ ID NO: 788171 - RNA, 22 nt, Human
gcuggccugaccugaggcuggg

SEQ ID NO: 788172 - RNA, 22 nt, Human
aaauauccauaagcacaucuau

SEQ ID NO: 788173 - RNA, 22 nt, Human
uggaagugucuacauguggagu

SEQ ID NO: 788174 - RNA, 22 nt, Human
ucugggaaguccucugucaugc

SEQ ID NO: 788175 - RNA, 22 nt, Human
gccuggugguauccuggcaaga

SEQ ID NO: 788176 - RNA, 22 nt, Human
aaggugggcagaucacaagguc

SEQ ID NO: 788177 - RNA, 22 nt, Human
uauccacacugggauguuuuga

SEQ ID NO: 788178 - RNA, 22 nt, Human
gacagcagccacagggagaggg

SEQ ID NO: 788179 - RNA, 22 nt, Human
gaguggggcgaagucggcgagu

SEQ ID NO: 788180 - RNA, 22 nt, Human
agcaggccucaugcaccagcua

SEQ ID NO: 788181 - RNA, 21 nt, Human
gcuggcucaaaugcuuguguc

SEQ ID NO: 788182 - RNA, 22 nt, Human
gccuggugugcgccgcgcagcu

SEQ ID NO: 788183 - RNA, 22 nt, Human
cuggagagaaaugacaaagcua

SEQ ID NO: 788184 - RNA, 22 nt, Human
gagcccagcccagagccauaug

SEQ ID NO: 788185 - RNA, 22 nt, Human
agguggagaucagggacuaagg

SEQ ID NO: 788186 - RNA, 22 nt, Human
ucugaaauuguuaguaaaaaug

SEQ ID NO: 788187 - RNA, 22 nt, Human
gucccauaaguagugcaacuug

SEQ ID NO: 788188 - RNA, 22 nt, Human
uucuaauuguguuugcauaucu

SEQ ID NO: 788189 - RNA, 22 nt, Human
ggagaagaggagcuggaagccu

SEQ ID NO: 788190 - RNA, 21 nt, Human
ccagcccagccuccuucucuu

SEQ ID NO: 788191 - RNA, 22 nt, Human
ugggcucuggagggccuaggau

SEQ ID NO: 788192 - RNA, 22 nt, Human
aauccacacaucuggcauguga

SEQ ID NO: 788193 - RNA, 22 nt, Human
uuucuuuccaugagccuaugua

SEQ ID NO: 788194 - RNA, 23 nt, Human
ucagucuuggcuucugauuuucc

SEQ ID NO: 788195 - RNA, 22 nt, Human
uuucuuucucguaaacuuaguu

SEQ ID NO: 788196 - RNA, 22 nt, Human
caucuuuguaacuuccacauaa

SEQ ID NO: 788197 - RNA, 20 nt, Human
cuggaguguagcaguggcug

SEQ ID NO: 788198 - RNA, 22 nt, Human
uaguggagaggauguggagaaa

SEQ ID NO: 788199 - RNA, 22 nt, Human
aucagucuguuggaauaucgcu

SEQ ID NO: 788200 - RNA, 22 nt, Human
auuucucauguacaaaaacacu

SEQ ID NO: 788201 - RNA, 22 nt, Human
acaacugucuucuucaugcucc

SEQ ID NO: 788202 - RNA, 22 nt, Human
ccuggcucugcagccacuccag

SEQ ID NO: 788203 - RNA, 20 nt, Human
uaaauuagccuugaagauua

SEQ ID NO: 788204 - RNA, 22 nt, Human
cagggccuuuuagcaucuucuc

SEQ ID NO: 788205 - RNA, 22 nt, Human
ugcuggcccaguauggacugca

SEQ ID NO: 788206 - RNA, 22 nt, Human
ccaaguccucuaccauuccugg

SEQ ID NO: 788207 - RNA, 22 nt, Human
uguuucuuacguuuuuagaggc

SEQ ID NO: 788208 - RNA, 22 nt, Human
gacagggcugugggaggagcag

SEQ ID NO: 788209 - RNA, 22 nt, Human
auugcugggaggauguguguuc

SEQ ID NO: 788210 - RNA, 22 nt, Human
acaucuuuuuucucuaauugug

SEQ ID NO: 788211 - RNA, 22 nt, Human
gggucaggcuagcccagacuuc

SEQ ID NO: 788212 - RNA, 22 nt, Human
gcucagggaaagagcuccuguc

SEQ ID NO: 788213 - RNA, 22 nt, Human
caucuaccagaauugcuauaaa

SEQ ID NO: 788214 - RNA, 22 nt, Human
cagagugauaaauauagaaauu

SEQ ID NO: 788215 - RNA, 22 nt, Human
agugccagcuccacacagcagc

SEQ ID NO: 788216 - RNA, 22 nt, Human
ucuguuuuugaggcuaucuucu

SEQ ID NO: 788217 - RNA, 22 nt, Human
acuucuaugcacagagcuugga

SEQ ID NO: 788218 - RNA, 22 nt, Human
acagggccaggugagaggugcu

SEQ ID NO: 788219 - RNA, 22 nt, Human
ccacaauuuuaugauuuaggag

SEQ ID NO: 788220 - RNA, 22 nt, Human
gcugggcugcgucggggaagcc

SEQ ID NO: 788221 - RNA, 22 nt, Human
cuucuauucacuggucacaguu

SEQ ID NO: 788222 - RNA, 22 nt, Human
gcaggccuguaaugaagggaca

SEQ ID NO: 788223 - RNA, 22 nt, Human
aaguggagcuauaggcucagau

SEQ ID NO: 788224 - RNA, 22 nt, Human
ugucuccaggggcaggccagcc

SEQ ID NO: 788225 - RNA, 22 nt, Human
uagggccaguuagggaagcuuu

SEQ ID NO: 788226 - RNA, 22 nt, Human
cccuggaguccggagcucaccu

SEQ ID NO: 788227 - RNA, 22 nt, Human
ucuccagugaaucuccuccugg

SEQ ID NO: 788228 - RNA, 22 nt, Human
aacucuauuuacccuacuaaac

SEQ ID NO: 788229 - RNA, 22 nt, Human
ccagagguggugggugcuacag

SEQ ID NO: 788230 - RNA, 22 nt, Human
ugcugcaguucacccugccguc

SEQ ID NO: 788231 - RNA, 22 nt, Human
uucuuuccuugccucagugaag

SEQ ID NO: 788232 - RNA, 23 nt, Human
caguggagacucaugcuuccuua

SEQ ID NO: 788233 - RNA, 22 nt, Human
guuuccugacccuggcccagca

SEQ ID NO: 788234 - RNA, 22 nt, Human
uggacagguugaguaggaggag

SEQ ID NO: 788235 - RNA, 22 nt, Human
acacauauaccacuguaaauga

SEQ ID NO: 788236 - RNA, 18 nt, Human
cacaauuuacagaugaca

SEQ ID NO: 788237 - RNA, 22 nt, Human
guugcuggaagcuaugguccag

SEQ ID NO: 788238 - RNA, 22 nt, Human
uauacacauaucuucuaggccu

SEQ ID NO: 788239 - RNA, 22 nt, Human
agcaggugacccaagcaggcug

SEQ ID NO: 788240 - RNA, 22 nt, Human
caguguuuagcacagugcuugg

SEQ ID NO: 788241 - RNA, 22 nt, Human
accugaauuuuggaugagcugu

SEQ ID NO: 788242 - RNA, 23 nt, Human
gcugggcuuacucuuucagugag

SEQ ID NO: 788243 - RNA, 22 nt, Human
caaggguucugugccuccugcu

SEQ ID NO: 788244 - RNA, 22 nt, Human
uucuccauuuaacuuccuuaug

SEQ ID NO: 788245 - RNA, 19 nt, Human
gcaggccucuugggaauua

SEQ ID NO: 788246 - RNA, 22 nt, Human
uguuaaaugcucagcucgggga

SEQ ID NO: 788247 - RNA, 22 nt, Human
uuacagaagagaaagaauucag

SEQ ID NO: 788248 - RNA, 22 nt, Human
cagggccuccuaaggcaucuaa

SEQ ID NO: 788249 - RNA, 22 nt, Human
gcuggagaggggucacucugag

SEQ ID NO: 788250 - RNA, 22 nt, Human
guugcugggagcagggauccug

SEQ ID NO: 788251 - RNA, 22 nt, Human
ggcccugggaugcucagcagug

SEQ ID NO: 788252 - RNA, 22 nt, Human
aucaucuugaaagucuauguuu

SEQ ID NO: 788253 - RNA, 22 nt, Human
auggacagguggauagguggau

SEQ ID NO: 788254 - RNA, 22 nt, Human
cugaauauuagucaugucugau

SEQ ID NO: 788255 - RNA, 20 nt, Human
gcccaugaggacugcagcug

SEQ ID NO: 788256 - RNA, 22 nt, Human
ucacucugagaggucacuggaa

SEQ ID NO: 788257 - RNA, 22 nt, Human
gccuagagagggagugccacac

SEQ ID NO: 788258 - RNA, 22 nt, Human
gcguggagacaacucuggggug

SEQ ID NO: 788259 - RNA, 20 nt, Human
ugucuccagggcugagugga

SEQ ID NO: 788260 - RNA, 22 nt, Human
gggauggggagcuggaaagggg

SEQ ID NO: 788261 - RNA, 22 nt, Human
ugcugcagggauuucagagaca

SEQ ID NO: 788262 - RNA, 18 nt, Human
ggugggaagccagggccu

SEQ ID NO: 788263 - RNA, 22 nt, Human
agggacagaugaaugacugagu

SEQ ID NO: 788264 - RNA, 22 nt, Human
gaguggggcccacugcugggug

SEQ ID NO: 788265 - RNA, 22 nt, Human
gcucagggagagagggcagccg

SEQ ID NO: 788266 - RNA, 22 nt, Human
cagagucaauguccaagaagcu

SEQ ID NO: 788267 - RNA, 22 nt, Human
auugccaugcucauagggucga

SEQ ID NO: 788268 - RNA, 22 nt, Human
cagggccuggagcugggccugc

SEQ ID NO: 788269 - RNA, 22 nt, Human
cuuuggauggcuguguguuuau

SEQ ID NO: 788270 - RNA, 22 nt, Human
acaaaacaguguuccugccccu

SEQ ID NO: 788271 - RNA, 22 nt, Human
gcuggccuccugcuagauggaa

SEQ ID NO: 788272 - RNA, 22 nt, Human
aaguggagagcccuggaggucu

SEQ ID NO: 788273 - RNA, 22 nt, Human
cugggcucuggggucccggugc

SEQ ID NO: 788274 - RNA, 22 nt, Human
acaaauauuuacugaauccacu

SEQ ID NO: 788275 - RNA, 22 nt, Human
aggccagaguuaaggagaacag

SEQ ID NO: 788276 - RNA, 22 nt, Human
ugucuccaaaacaaucucagau

SEQ ID NO: 788277 - RNA, 19 nt, Human
agccaggguccagacaugu

SEQ ID NO: 788278 - RNA, 22 nt, Human
caggcuuggguucucugaguua

SEQ ID NO: 788279 - RNA, 22 nt, Human
gugucccaaagauuagaaauca

SEQ ID NO: 788280 - RNA, 22 nt, Human
ccuggcucugccguaaccacca

SEQ ID NO: 788281 - RNA, 22 nt, Human
auggacagcucuuaugugggca

SEQ ID NO: 788282 - RNA, 22 nt, Human
auccacagugcagcaagggccc

SEQ ID NO: 788283 - RNA, 22 nt, Human
cugggcuccacucccacagugu

SEQ ID NO: 788284 - RNA, 22 nt, Human
agcuggagccagugugaggcuu

SEQ ID NO: 788285 - RNA, 22 nt, Human
uggcugugggaugagagccuca

SEQ ID NO: 788286 - RNA, 22 nt, Human
gucaucuucgcagagugauuuu

SEQ ID NO: 788287 - RNA, 22 nt, Human
gcagguuagauuuaauccauuc

SEQ ID NO: 788288 - RNA, 22 nt, Human
gcucagagaguuucacaaguuu

SEQ ID NO: 788289 - RNA, 22 nt, Human
ggaaggggagcuggaaagggua

SEQ ID NO: 788290 - RNA, 22 nt, Human
gagauccacuuaauuuuuuugc

SEQ ID NO: 788291 - RNA, 22 nt, Human
gggaccaggucagggcucugac

SEQ ID NO: 788292 - RNA, 22 nt, Human
gacagggcauggugcagaguuc

SEQ ID NO: 788293 - RNA, 22 nt, Human
cugcaggaauucaaagugagcu

SEQ ID NO: 788294 - RNA, 22 nt, Human
ggagaugcuuuccaguggggau

SEQ ID NO: 788295 - RNA, 17 nt, Human
agcaggcugcagaggcc

SEQ ID NO: 788296 - RNA, 22 nt, Human
cuggcugugcagucuuccagaa

SEQ ID NO: 788297 - RNA, 22 nt, Human
gugucccaaucuacuuuucccu

SEQ ID NO: 788298 - RNA, 21 nt, Human
ugagcaggagucaugggaaug

SEQ ID NO: 788299 - RNA, 22 nt, Human
gagcccagggugaaauagcagc

SEQ ID NO: 788300 - RNA, 22 nt, Human
agugccaggagcaaggagcucc

SEQ ID NO: 788301 - RNA, 22 nt, Human
uuuaaauuuagaagaaacacug

SEQ ID NO: 788302 - RNA, 21 nt, Human
agccaggguggacacuguaug

SEQ ID NO: 788303 - RNA, 21 nt, Human
gcccagaguuaagcccaccca

SEQ ID NO: 788304 - RNA, 22 nt, Human
auauccaccauucugcaccuuc

SEQ ID NO: 788305 - RNA, 16 nt, Human
ggagagugucugcaaa

SEQ ID NO: 788306 - RNA, 22 nt, Human
ugcuggccugggcugcaccuug

SEQ ID NO: 788307 - RNA, 17 nt, Human
agggacagcaguuuagg

SEQ ID NO: 788308 - RNA, 22 nt, Human
cuggcccaggcuccuggggcac

SEQ ID NO: 788309 - RNA, 22 nt, Human
uuauaauucuggcauaggcugu

SEQ ID NO: 788310 - RNA, 22 nt, Human
cagcaguuuccuaugguucagc

SEQ ID NO: 788311 - RNA, 22 nt, Human
uccacagugguugaacuaguaa

SEQ ID NO: 788312 - RNA, 22 nt, Human
gaggcuuuauaacuauuuguuc

SEQ ID NO: 788313 - RNA, 22 nt, Human
ccuggcucaaggcgaggacucc

SEQ ID NO: 788314 - RNA, 22 nt, Human
ccuggcucugaaguccacauca

SEQ ID NO: 788315 - RNA, 22 nt, Human
ggcaggcucagcagccaaggag

SEQ ID NO: 788316 - RNA, 22 nt, Human
uucaggugggccuuuugagcau

SEQ ID NO: 788317 - RNA, 22 nt, Human
cuggagugauacucagaaugug

SEQ ID NO: 788318 - RNA, 22 nt, Human
auuuaagacugacuucaccagu

SEQ ID NO: 788319 - RNA, 22 nt, Human
uggagcuggcuuguggaaguug

SEQ ID NO: 788320 - RNA, 22 nt, Human
aggggagguggcagaaaugugc

SEQ ID NO: 788321 - RNA, 22 nt, Human
agugaaauagcauuuaugaagc

SEQ ID NO: 788322 - RNA, 22 nt, Human
gugcugcaugacuugcuccuga

SEQ ID NO: 788323 - RNA, 22 nt, Human
gggccagagcuuggcagcuggg

SEQ ID NO: 788324 - RNA, 18 nt, Human
aggccugggaagcugagg

SEQ ID NO: 788325 - RNA, 21 nt, Human
uagaagcacauagguucaaag

SEQ ID NO: 788326 - RNA, 22 nt, Human
gcuggagugcuggagugcagug

SEQ ID NO: 788327 - RNA, 22 nt, Human
aaaccugucugauuauggagac

SEQ ID NO: 788328 - RNA, 22 nt, Human
aauggaauaccuagguggccca

SEQ ID NO: 788329 - RNA, 22 nt, Human
aaagacagagcuguaggggaaa

SEQ ID NO: 788330 - RNA, 22 nt, Human
ccaggggccugugaaggugccc

SEQ ID NO: 788331 - RNA, 22 nt, Human
cuccacagagaugcugauugua

SEQ ID NO: 788332 - RNA, 22 nt, Human
ggcccagaagccagaagccucc

SEQ ID NO: 788333 - RNA, 21 nt, Human
ucaggggcuguguuuuccauc

SEQ ID NO: 788334 - RNA, 19 nt, Human
gcugggcuuggguuuguag

SEQ ID NO: 788335 - RNA, 22 nt, Human
uccucacagggcaggaaggagg

SEQ ID NO: 788336 - RNA, 22 nt, Human
cacguuaacagcuaacagauga

SEQ ID NO: 788337 - RNA, 22 nt, Human
uuugaaacucugaacauguuuc

SEQ ID NO: 788338 - RNA, 22 nt, Human
ccuggcucugcgugcagcuccg

SEQ ID NO: 788339 - RNA, 22 nt, Human
gcugggcucauuugugugucug

SEQ ID NO: 788340 - RNA, 20 nt, Human
agcaggccuuggggagagga

SEQ ID NO: 788341 - RNA, 22 nt, Human
ucacuucuucccuugcacauau

SEQ ID NO: 788342 - RNA, 22 nt, Human
ugggcucucagucagacuggca

SEQ ID NO: 788343 - RNA, 22 nt, Human
cagcccagcugggaucacacuc

SEQ ID NO: 788344 - RNA, 23 nt, Human
uguaacaauuucauauacaugca

SEQ ID NO: 788345 - RNA, 22 nt, Human
ggcccagagggguugagcaucu

SEQ ID NO: 788346 - RNA, 22 nt, Human
gcacagggcugccaggcggcuu

SEQ ID NO: 788347 - RNA, 22 nt, Human
caguuaaauucuccaguuacca

SEQ ID NO: 788348 - RNA, 22 nt, Human
ggcaggcugggugucauggagu

SEQ ID NO: 788349 - RNA, 22 nt, Human
ccuggcucuucugugucagccc

SEQ ID NO: 788350 - RNA, 22 nt, Human
cuucuuucaagaauggauuagg

SEQ ID NO: 788351 - RNA, 22 nt, Human
gugucccaggagaggagacaau

SEQ ID NO: 788352 - RNA, 22 nt, Human
uauugcuggugcuguucugaau

SEQ ID NO: 788353 - RNA, 22 nt, Human
cuggagugcaguggcaugauca

SEQ ID NO: 788354 - RNA, 22 nt, Human
cagggccuccccggcagucuuu

SEQ ID NO: 788355 - RNA, 22 nt, Human
agggacagucuacuguucacug

SEQ ID NO: 788356 - RNA, 21 nt, Human
ugggauagaaauauggcugcu

SEQ ID NO: 788357 - RNA, 22 nt, Human
ccccagagugagggauugagug

SEQ ID NO: 788358 - RNA, 22 nt, Human
cugguaguuugcaaaauggugu

SEQ ID NO: 788359 - RNA, 22 nt, Human
agcuggagcuucaagcagguaa

SEQ ID NO: 788360 - RNA, 22 nt, Human
cuggagagggagcccuggcagu

SEQ ID NO: 788361 - RNA, 22 nt, Human
uagcccaggcuguagugcagug

SEQ ID NO: 788362 - RNA, 22 nt, Human
ugcuggccggccaggugcugag

SEQ ID NO: 788363 - RNA, 22 nt, Human
acaucuuuuacucugguucggg

SEQ ID NO: 788364 - RNA, 22 nt, Human
ggggcuggcucacuaagagacu

SEQ ID NO: 788365 - RNA, 22 nt, Human
auggaguguggccaggcaguaa

SEQ ID NO: 788366 - RNA, 22 nt, Human
uuccuuuucuucuaccacaugu

SEQ ID NO: 788367 - RNA, 22 nt, Human
aagacacuuucuaaauagaagu

SEQ ID NO: 788368 - RNA, 19 nt, Human
cucucagccugucuccuug

SEQ ID NO: 788369 - RNA, 22 nt, Human
uccguuuucacacugcuauaaa

SEQ ID NO: 788370 - RNA, 22 nt, Human
ugcaggaacucgaaaacuauag

SEQ ID NO: 788371 - RNA, 21 nt, Human
ucugugcuuuuuuggcuccua

SEQ ID NO: 788372 - RNA, 22 nt, Human
ccaaaauauuagugcuuaagua

SEQ ID NO: 788373 - RNA, 22 nt, Human
auguacaaucuaucacaagaag

SEQ ID NO: 788374 - RNA, 22 nt, Human
cugugcuggcagaccuggaguu

SEQ ID NO: 788375 - RNA, 22 nt, Human
acaggacagucuaguaacagua

SEQ ID NO: 788376 - RNA, 22 nt, Human
ugccagcaguagcaguaggcca

SEQ ID NO: 788377 - RNA, 22 nt, Human
cagugcugcaggcgccugcggu

SEQ ID NO: 788378 - RNA, 17 nt, Human
acuuguauugugcuuua

SEQ ID NO: 788379 - RNA, 22 nt, Human
agcaauguuggccuauauaccu

SEQ ID NO: 788380 - RNA, 22 nt, Human
ugugaagcgugugcaggggaca

SEQ ID NO: 788381 - RNA, 22 nt, Human
cguggggcggguggacacuugc

SEQ ID NO: 788382 - RNA, 22 nt, Human
uguucauucugugaccugguuc

SEQ ID NO: 788383 - RNA, 22 nt, Human
auacaugugugugcauacaugu

SEQ ID NO: 788384 - RNA, 18 nt, Human
ucaugcaaacgcuucaua

SEQ ID NO: 788385 - RNA, 19 nt, Human
acacaccagugccugugac

SEQ ID NO: 788386 - RNA, 22 nt, Human
ucacacaucucagguguuuaau

SEQ ID NO: 788387 - RNA, 22 nt, Human
uuuucaguugugcucucuaguu

SEQ ID NO: 788388 - RNA, 22 nt, Human
gaccacuggggugagggccauc

SEQ ID NO: 788389 - RNA, 22 nt, Human
auggcuguguuguuccucugaa

SEQ ID NO: 788390 - RNA, 22 nt, Human
guuuacaacaucuuguccuuca

SEQ ID NO: 788391 - RNA, 18 nt, Human
aaacauggcuuaaaggcu

SEQ ID NO: 788392 - RNA, 22 nt, Human
uuguugcaagccuggaaucugg

SEQ ID NO: 788393 - RNA, 22 nt, Human
aaggcuauaucucaauacuauu

SEQ ID NO: 788394 - RNA, 22 nt, Human
aaagcacauuacaagcucaguc

SEQ ID NO: 788395 - RNA, 22 nt, Human
ucuuauugguaaugauggcauu

SEQ ID NO: 788396 - RNA, 20 nt, Human
ucacuguaauugccuacauu

SEQ ID NO: 788397 - RNA, 22 nt, Human
acauauuuugaaagcuuucuaa

SEQ ID NO: 788398 - RNA, 23 nt, Human
aauagcugguaaugauagcacaa

SEQ ID NO: 788399 - RNA, 22 nt, Human
cuaguauuaagugugaguaaaa

SEQ ID NO: 788400 - RNA, 22 nt, Human
cauuguccucugaugccuuccc

SEQ ID NO: 788401 - RNA, 22 nt, Human
uauaagaaacaaggcaaauuuu

SEQ ID NO: 788402 - RNA, 22 nt, Human
auacacauguuauuguggaagc

SEQ ID NO: 788403 - RNA, 22 nt, Human
aaaucaugguggaagaaacaga

SEQ ID NO: 788404 - RNA, 22 nt, Human
uugcaguugcuguauuuaagga

SEQ ID NO: 788405 - RNA, 22 nt, Human
cugagcugcucccgcugcagcg

SEQ ID NO: 788406 - RNA, 22 nt, Human
ucacuaugcccagaauacaguu

SEQ ID NO: 788407 - RNA, 22 nt, Human
agauggcagggguaccuggaag

SEQ ID NO: 788408 - RNA, 22 nt, Human
ucuuauugugaugaugaagaac

SEQ ID NO: 788409 - RNA, 22 nt, Human
uuuucuuggaguggcuguccuu

SEQ ID NO: 788410 - RNA, 22 nt, Human
acagagacacggaagcuaaaga

SEQ ID NO: 788411 - RNA, 22 nt, Human
ugugacguuguucuggauuccc

SEQ ID NO: 788412 - RNA, 22 nt, Human
ucuguuauaaaucacacugcau

SEQ ID NO: 788413 - RNA, 22 nt, Human
uuuucaguuccaucucugcucu

SEQ ID NO: 788414 - RNA, 22 nt, Human
uaucuguauucugacagucacu

SEQ ID NO: 788415 - RNA, 22 nt, Human
ccuuuuggccaggucagugcag

SEQ ID NO: 788416 - RNA, 22 nt, Human
auauggcuguugcacaucuaag

SEQ ID NO: 788417 - RNA, 22 nt, Human
aaugcauacguguuuguggcaa

SEQ ID NO: 788418 - RNA, 23 nt, Human
uugcauuaauguggaggcacagg

SEQ ID NO: 788419 - RNA, 22 nt, Human
aaauacaguggcagcagauaau

SEQ ID NO: 788420 - RNA, 19 nt, Human
cuucuggauccgcagggcc

SEQ ID NO: 788421 - RNA, 22 nt, Human
ggcuggaaggcccuuuguugau

SEQ ID NO: 788422 - RNA, 22 nt, Human
ccaggacacgauuuuuagucug

SEQ ID NO: 788423 - RNA, 22 nt, Human
augcacacguacccuacaaggc

SEQ ID NO: 788424 - RNA, 19 nt, Human
ucucccaugccugugucua

SEQ ID NO: 788425 - RNA, 22 nt, Human
auacaggaugcugaacaucucu

SEQ ID NO: 788426 - RNA, 22 nt, Human
uuagcugcugauuaaauauguu

SEQ ID NO: 788427 - RNA, 22 nt, Human
uugcaucagcaggcauaauugg

SEQ ID NO: 788428 - RNA, 22 nt, Human
auagcaaaggacaauagucagu

SEQ ID NO: 788429 - RNA, 22 nt, Human
aauaucuagccuuuagcagcuu

SEQ ID NO: 788430 - RNA, 20 nt, Human
uacaauauucccacuuugcu

SEQ ID NO: 788431 - RNA, 22 nt, Human
gccuguuucuccuccuuggccc

SEQ ID NO: 788432 - RNA, 23 nt, Human
uacagccaugucgcugauuuaac

SEQ ID NO: 788433 - RNA, 22 nt, Human
uguccugugcacuguagcaugu

SEQ ID NO: 788434 - RNA, 22 nt, Human
gucugugcaguuacuagcuggu

SEQ ID NO: 788435 - RNA, 22 nt, Human
gcuguauuuauaugaaggcaug

SEQ ID NO: 788436 - RNA, 22 nt, Human
uauugccaaaugucugcuggaa

SEQ ID NO: 788437 - RNA, 21 nt, Human
ugcauauauaagugcauacac

SEQ ID NO: 788438 - RNA, 22 nt, Human
uaucuguagucucaugguuccu

SEQ ID NO: 788439 - RNA, 22 nt, Human
acaugcauaaacuacuucuuau

SEQ ID NO: 788440 - RNA, 22 nt, Human
cagaaacacuguauuuagggaa

SEQ ID NO: 788441 - RNA, 22 nt, Human
augaaacaacagacuuggucaa

SEQ ID NO: 788442 - RNA, 22 nt, Human
uacuguauacuacugcuguucu

SEQ ID NO: 788443 - RNA, 22 nt, Human
ucucugagaucagccacugacu

SEQ ID NO: 788444 - RNA, 22 nt, Human
acacacagaaggaagccccacu

SEQ ID NO: 788445 - RNA, 22 nt, Human
ccaggacaagccagagggacag

SEQ ID NO: 788446 - RNA, 22 nt, Human
guggcagcggcccaggccgucu

SEQ ID NO: 788447 - RNA, 22 nt, Human
auuagguaguauaaucuuuguu

SEQ ID NO: 788448 - RNA, 22 nt, Human
aacacuaaaggucaguuagaag

SEQ ID NO: 788449 - RNA, 18 nt, Human
ugugccucugcaggacgu

SEQ ID NO: 788450 - RNA, 22 nt, Human
acaaaugcuuaguucaccaaaa

SEQ ID NO: 788451 - RNA, 22 nt, Human
aaggaucauguauauguuuaag

SEQ ID NO: 788452 - RNA, 22 nt, Human
ucuuuuaucuguuguguaacaa

SEQ ID NO: 788453 - RNA, 22 nt, Human
cagcccuugcgacacccuggcu

SEQ ID NO: 788454 - RNA, 22 nt, Human
caauguacaaaauaauuacaca

SEQ ID NO: 788455 - RNA, 22 nt, Human
ugcaaauauuccaugcuguuca

SEQ ID NO: 788456 - RNA, 22 nt, Human
ucucugagguuguuuccagcac

SEQ ID NO: 788457 - RNA, 22 nt, Human
ccugugcuucacucaacaagcc

SEQ ID NO: 788458 - RNA, 22 nt, Human
gacauacagcccucucccuggu

SEQ ID NO: 788459 - RNA, 22 nt, Human
cuguuccuccaccucaacaaac

SEQ ID NO: 788460 - RNA, 22 nt, Human
aauacagugaaagugagcaagg

SEQ ID NO: 788461 - RNA, 20 nt, Human
ugugcccaauguccagguuc

SEQ ID NO: 788462 - RNA, 22 nt, Human
ucauuguuucugcuuuucauga

SEQ ID NO: 788463 - RNA, 22 nt, Human
auuguugacuugauuacucaac

SEQ ID NO: 788464 - RNA, 22 nt, Human
cuguauaugugcauacacacac

SEQ ID NO: 788465 - RNA, 22 nt, Human
augcaggaagagcccuggagcu

SEQ ID NO: 788466 - RNA, 18 nt, Human
uauaaacacacuuagguu

SEQ ID NO: 788467 - RNA, 22 nt, Human
caggguggcaggcaccauggcc

SEQ ID NO: 788468 - RNA, 22 nt, Human
gaccacugaaugcacuucuaau

SEQ ID NO: 788469 - RNA, 22 nt, Human
uauggcaagaugacauguucuc

SEQ ID NO: 788470 - RNA, 21 nt, Human
caggccaaaagguucaacauu

SEQ ID NO: 788471 - RNA, 22 nt, Human
augcaguggcagcuccuggugu

SEQ ID NO: 788472 - RNA, 22 nt, Human
uucuuugcccauguuuccuaag

SEQ ID NO: 788473 - RNA, 22 nt, Human
uuacuguagcuugacauauguc

SEQ ID NO: 788474 - RNA, 22 nt, Human
gggcuguaggagcuggaauggg

SEQ ID NO: 788475 - RNA, 22 nt, Human
ggcagguguggugaccagagau

SEQ ID NO: 788476 - RNA, 22 nt, Human
cagaaagcaguugucaaugggc

SEQ ID NO: 788477 - RNA, 22 nt, Human
auuauguagcuaaaaauugugu

SEQ ID NO: 788478 - RNA, 22 nt, Human
uaaaacuagugguugggacuaa

SEQ ID NO: 788479 - RNA, 22 nt, Human
aauacagauggcaugugaagau

SEQ ID NO: 788480 - RNA, 22 nt, Human
aauggcagagacuguugaaaua

SEQ ID NO: 788481 - RNA, 22 nt, Human
ugcucuguucaguguaucuugu

SEQ ID NO: 788482 - RNA, 21 nt, Human
acuguauuguuuucaaggauc

SEQ ID NO: 788483 - RNA, 22 nt, Human
gcagugacagacaacuguuuga

SEQ ID NO: 788484 - RNA, 22 nt, Human
ugucuuuagccacuugccucuu

SEQ ID NO: 788485 - RNA, 22 nt, Human
guuuuaguggguggccacugau

SEQ ID NO: 788486 - RNA, 22 nt, Human
agccugugcuguguuugcucca

SEQ ID NO: 788487 - RNA, 22 nt, Human
acaguguuucacuuaaccguuu

SEQ ID NO: 788488 - RNA, 22 nt, Human
gauguaucugagcugcuuaggu

SEQ ID NO: 788489 - RNA, 22 nt, Human
cucuggaucugcccugacgcca

SEQ ID NO: 788490 - RNA, 22 nt, Human
ucccaguggcuucauaaggcag

SEQ ID NO: 788491 - RNA, 22 nt, Human
cccugauguuuucucugccuuu

SEQ ID NO: 788492 - RNA, 22 nt, Human
ugcccauggcaggauuucugaa

SEQ ID NO: 788493 - RNA, 22 nt, Human
ggcagguguuuuuauauuaaag

SEQ ID NO: 788494 - RNA, 22 nt, Human
gugcacagaaacauacaaugug

SEQ ID NO: 788495 - RNA, 22 nt, Human
gugucccaaagauuagaaauca

SEQ ID NO: 788496 - RNA, 22 nt, Human
cacagauaaggcuuugucccca

SEQ ID NO: 788497 - RNA, 22 nt, Human
ccuuuguucacuggagagugga

SEQ ID NO: 788498 - RNA, 22 nt, Human
aagcagccagccaucaugcccg

SEQ ID NO: 788499 - RNA, 22 nt, Human
ccugugguuuacucuguggcua

SEQ ID NO: 788500 - RNA, 22 nt, Human
uguacacauuaagcucuuuaga

SEQ ID NO: 788501 - RNA, 22 nt, Human
ugcucagaauugcgcuggugga

SEQ ID NO: 788502 - RNA, 19 nt, Human
guuggcacugaaaauggcu

SEQ ID NO: 788503 - RNA, 22 nt, Human
auguauacgugcaggucacagg

SEQ ID NO: 788504 - RNA, 22 nt, Human
auguggcuuucugcguuuucuc

SEQ ID NO: 788505 - RNA, 22 nt, Human
ugucauauagaauguucuauga

SEQ ID NO: 788506 - RNA, 22 nt, Human
gccauguucuugaaucuggguc

SEQ ID NO: 788507 - RNA, 22 nt, Human
ugcauaaauauuguugggagua

SEQ ID NO: 788508 - RNA, 22 nt, Human
auggccugcagugcugccacag

SEQ ID NO: 788509 - RNA, 22 nt, Human
gugccuccaggcucgacuaguc

SEQ ID NO: 788510 - RNA, 22 nt, Human
aguggcagggacuucauauaaa

SEQ ID NO: 788511 - RNA, 22 nt, Human
ucugcuggaaaaccagggaauu

SEQ ID NO: 788512 - RNA, 22 nt, Human
aauggcaaaguguuuucauacc

SEQ ID NO: 788513 - RNA, 22 nt, Human
gcagacaucaagcacaggccca

SEQ ID NO: 788514 - RNA, 18 nt, Human
cugccuguugcugagagg

SEQ ID NO: 788515 - RNA, 22 nt, Human
uuuuccuucugauacuccauuu

SEQ ID NO: 788516 - RNA, 22 nt, Human
agucauguguucaucuuucauu

SEQ ID NO: 788517 - RNA, 22 nt, Human
uccugugccuccaccugcuccg

SEQ ID NO: 788518 - RNA, 22 nt, Human
ugcccacaggaagacaccagcg

SEQ ID NO: 788519 - RNA, 22 nt, Human
aaacacaucauucaugucguca

SEQ ID NO: 788520 - RNA, 22 nt, Human
uaaauacuuuuacuccacugau

SEQ ID NO: 788521 - RNA, 22 nt, Human
guuauguaaucuaacacucagu

SEQ ID NO: 788522 - RNA, 22 nt, Human
uuccuguucaggaaaguugugu

SEQ ID NO: 788523 - RNA, 22 nt, Human
aacaguaugugagauuuacaca

SEQ ID NO: 788524 - RNA, 22 nt, Human
ccugugucaucagcuguggcua

SEQ ID NO: 788525 - RNA, 22 nt, Human
uuccaauaaaauguuauuugca

SEQ ID NO: 788526 - RNA, 22 nt, Human
cugcugagguggagauugcagu

SEQ ID NO: 788527 - RNA, 22 nt, Human
ucuguagcauucaccagcccug

SEQ ID NO: 788528 - RNA, 22 nt, Human
ugcacacaguucucaggaaaga

SEQ ID NO: 788529 - RNA, 22 nt, Human
cccaccacgugcuuugcuggag

SEQ ID NO: 788530 - RNA, 22 nt, Human
aucaugcagcaacaagcaaggc

SEQ ID NO: 788531 - RNA, 22 nt, Human
gcugcccucuguguuuguccuu

SEQ ID NO: 788532 - RNA, 22 nt, Human
agaaacaucgcuuaguccucau

SEQ ID NO: 788533 - RNA, 17 nt, Human
aacaguuaaugggggaa

SEQ ID NO: 788534 - RNA, 22 nt, Human
uacauguacaugcauagguaga

SEQ ID NO: 788535 - RNA, 22 nt, Human
ucugccaucaagaugcucuggc

SEQ ID NO: 788536 - RNA, 19 nt, Human
uaugacaaguacuaguucu

SEQ ID NO: 788537 - RNA, 22 nt, Human
uuguacuuaaauaugcaaauag

SEQ ID NO: 788538 - RNA, 22 nt, Human
gcccuguguguuugcacugauu

SEQ ID NO: 788539 - RNA, 22 nt, Human
auacaacagaaaaugauuauuc

SEQ ID NO: 788540 - RNA, 22 nt, Human
ugcauguuuuauaccaaagcuu

SEQ ID NO: 788541 - RNA, 22 nt, Human
cuccagcucgcgagcucugcuc

SEQ ID NO: 788542 - RNA, 22 nt, Human
uguauuucugcuuucucuagua

SEQ ID NO: 788543 - RNA, 20 nt, Human
ucacuguaacauuugggggg

SEQ ID NO: 788544 - RNA, 22 nt, Human
guggccuccuccguccgccucu

SEQ ID NO: 788545 - RNA, 22 nt, Human
aaugcaaugcagcaccuccuug

SEQ ID NO: 788546 - RNA, 22 nt, Human
cacuguuuuacauguuauuuaa

SEQ ID NO: 788547 - RNA, 22 nt, Human
uacuggacacguauauauagau

SEQ ID NO: 788548 - RNA, 22 nt, Human
gcugucugcugggucgcucagg

SEQ ID NO: 788549 - RNA, 22 nt, Human
gaugggcaucaaacaugacgug

SEQ ID NO: 788550 - RNA, 22 nt, Human
cuggcugguuacuauuucuggu

SEQ ID NO: 788551 - RNA, 22 nt, Human
uggggaaaagcguuaggaguuc

SEQ ID NO: 788552 - RNA, 22 nt, Human
uccucagggguuucagguguac

SEQ ID NO: 788553 - RNA, 22 nt, Human
auauacuugauuuaacugagca

SEQ ID NO: 788554 - RNA, 22 nt, Human
uagauacucagaaaugcuuuca

SEQ ID NO: 788555 - RNA, 22 nt, Human
uauauuaacuugugauccugga

SEQ ID NO: 788556 - RNA, 22 nt, Human
ccacuggcauccagcugccauc

SEQ ID NO: 788557 - RNA, 22 nt, Human
aagguccuuuugcagugugauc

SEQ ID NO: 788558 - RNA, 22 nt, Human
agugaaaugauucugagcaaga

SEQ ID NO: 788559 - RNA, 22 nt, Human
uccucaggugacuagguaucuu

SEQ ID NO: 788560 - RNA, 22 nt, Human
cuacaacauuaugcuuucuguc

SEQ ID NO: 788561 - RNA, 22 nt, Human
uauacaauggcugaaucaucca

SEQ ID NO: 788562 - RNA, 22 nt, Human
auuauaaauauuuucuaggggu

SEQ ID NO: 788563 - RNA, 22 nt, Human
aucagucauauccaaauuagca

SEQ ID NO: 788564 - RNA, 22 nt, Human
cugugggccuagucuggccuag

SEQ ID NO: 788565 - RNA, 22 nt, Human
cuggcugguccucggggacagc

SEQ ID NO: 788566 - RNA, 22 nt, Human
uggcacagggcuuggucgcuca

SEQ ID NO: 788567 - RNA, 18 nt, Human
auauucaagaagacagag

SEQ ID NO: 788568 - RNA, 22 nt, Human
aucuaaaaugugguuaguuggu

SEQ ID NO: 788569 - RNA, 19 nt, Human
acuggcaguuucugcaugg

SEQ ID NO: 788570 - RNA, 22 nt, Human
acacaguugguggcucagucug

SEQ ID NO: 788571 - RNA, 22 nt, Human
ugucauggugcuauuuaauuag

SEQ ID NO: 788572 - RNA, 22 nt, Human
aguuuaauuggaggcguggcuc

SEQ ID NO: 788573 - RNA, 19 nt, Human
gauauaaagagauggugaa

SEQ ID NO: 788574 - RNA, 22 nt, Human
ugcuauuagaagccaugcuguu

SEQ ID NO: 788575 - RNA, 22 nt, Human
uggggaaagauaguuuucucua

SEQ ID NO: 788576 - RNA, 22 nt, Human
acuaaauacacacauuuguuca

SEQ ID NO: 788577 - RNA, 22 nt, Human
uuguauucuuccuuagcaguac

SEQ ID NO: 788578 - RNA, 22 nt, Human
aaugagucaaaacagcauauag

SEQ ID NO: 788579 - RNA, 22 nt, Human
agucaguuaaccucacagcauc

SEQ ID NO: 788580 - RNA, 22 nt, Human
acauauauguaaaguacuuugu

SEQ ID NO: 788581 - RNA, 21 nt, Human
uauagucacuugagcauuauc

SEQ ID NO: 788582 - RNA, 22 nt, Human
acaaauagguagauuugcaaca

SEQ ID NO: 788583 - RNA, 22 nt, Human
uggggaaaaugcuuguagucag

SEQ ID NO: 788584 - RNA, 22 nt, Human
aguguuaaugguguauauuagg

SEQ ID NO: 788585 - RNA, 22 nt, Human
uaaaugaguaauauagcuguuu

SEQ ID NO: 788586 - RNA, 22 nt, Human
uagucacacaauuguguacauu

SEQ ID NO: 788587 - RNA, 22 nt, Human
aaauuagaaauacuuucaaagc

SEQ ID NO: 788588 - RNA, 22 nt, Human
cagggucauggcaccugcacgg

SEQ ID NO: 788589 - RNA, 22 nt, Human
caggaagggggauccuuggaag

SEQ ID NO: 788590 - RNA, 22 nt, Human
uauuaaauguuauuuggguugu

SEQ ID NO: 788591 - RNA, 22 nt, Human
auaauaaaccaggaugggucug

SEQ ID NO: 788592 - RNA, 17 nt, Human
acacagccagguucucc

SEQ ID NO: 788593 - RNA, 22 nt, Human
caguuuaagacaagggggugua

SEQ ID NO: 788594 - RNA, 22 nt, Human
uaauaauuggcaauguugagca

SEQ ID NO: 788595 - RNA, 22 nt, Human
gagguccucuguguccgcgggc

SEQ ID NO: 788596 - RNA, 22 nt, Human
cucagggggaaucaggucacag

SEQ ID NO: 788597 - RNA, 22 nt, Human
ccucagggccaucucugucccu

SEQ ID NO: 788598 - RNA, 22 nt, Human
cacauauaugaaaugaggaauu

SEQ ID NO: 788599 - RNA, 22 nt, Human
aggaaggaagagacaccauuug

SEQ ID NO: 788600 - RNA, 23 nt, Human
auuauuaaggacauggacuuugu

SEQ ID NO: 788601 - RNA, 21 nt, Human
ugcacagccauacccuccuug

SEQ ID NO: 788602 - RNA, 22 nt, Human
uugacacagaucaauauucaac

SEQ ID NO: 788603 - RNA, 22 nt, Human
gauuaauaguacagguucuuag

SEQ ID NO: 788604 - RNA, 22 nt, Human
cgggcacacacuugacagguuc

SEQ ID NO: 788605 - RNA, 22 nt, Human
aauauuaauagaagggguucua

SEQ ID NO: 788606 - RNA, 22 nt, Human
ucauaaaucauacuccauuugc

SEQ ID NO: 788607 - RNA, 22 nt, Human
acacauucuuuaaaugucuguu

SEQ ID NO: 788608 - RNA, 22 nt, Human
uagauuuugcauuucuaacaag

SEQ ID NO: 788609 - RNA, 22 nt, Human
accaguuuaauaacugcucaag

SEQ ID NO: 788610 - RNA, 22 nt, Human
ucacagccuggucacucugccc

SEQ ID NO: 788611 - RNA, 22 nt, Human
caggggaagaugccaagggaga

SEQ ID NO: 788612 - RNA, 22 nt, Human
guuauaaauaccuaauaggauu

SEQ ID NO: 788613 - RNA, 22 nt, Human
agguccugucuuaucucuguaa

SEQ ID NO: 788614 - RNA, 20 nt, Human
aauuagauguuuaaucaaua

SEQ ID NO: 788615 - RNA, 22 nt, Human
acuggcagagacccugauggcc

SEQ ID NO: 788616 - RNA, 17 nt, Human
ccacagccuggcacuug

SEQ ID NO: 788617 - RNA, 22 nt, Human
uucacagugagcuaugucuugu

SEQ ID NO: 788618 - RNA, 22 nt, Human
acauucaaggccuucugacaca

SEQ ID NO: 788619 - RNA, 21 nt, Human
caugauaaugaagguguuauu

SEQ ID NO: 788620 - RNA, 22 nt, Human
gcacagcccugagcgcaugucu

SEQ ID NO: 788621 - RNA, 22 nt, Human
auuaaauacugcaggcuaagca

SEQ ID NO: 788622 - RNA, 22 nt, Human
cugugggcugaaagugcucccg

SEQ ID NO: 788623 - RNA, 22 nt, Human
ugucaugggguuguuuuguaca

SEQ ID NO: 788624 - RNA, 22 nt, Human
aaaugccaaggagagacuguua

SEQ ID NO: 788625 - RNA, 22 nt, Human
ccucagggacuccaugcugcag

SEQ ID NO: 788626 - RNA, 22 nt, Human
caggaaugacugcagauggggc

SEQ ID NO: 788627 - RNA, 22 nt, Human
cggcacagccgggcaaggcugg

SEQ ID NO: 788628 - RNA, 22 nt, Human
uccucaggagagcuccuaugcc

SEQ ID NO: 788629 - RNA, 22 nt, Human
ucagucacuuuugccugcuaca

SEQ ID NO: 788630 - RNA, 18 nt, Human
ggggaaaagccagguguc

SEQ ID NO: 788631 - RNA, 22 nt, Human
auauuaagaugcuauugguuuu

SEQ ID NO: 788632 - RNA, 22 nt, Human
auucacaugauguauguagggc

SEQ ID NO: 788633 - RNA, 22 nt, Human
caguuucuuagugacacaaauc

SEQ ID NO: 788634 - RNA, 22 nt, Human
acacuacaaucucagaacuaua

SEQ ID NO: 788635 - RNA, 22 nt, Human
uggggaaagggauggcucccgc

SEQ ID NO: 788636 - RNA, 22 nt, Human
uuucauauuguccagucagcgc

SEQ ID NO: 788637 - RNA, 23 nt, Human
ccucagggucuagcagagagaag

SEQ ID NO: 788638 - RNA, 22 nt, Human
uaucaauacauguuaucagugu

SEQ ID NO: 788639 - RNA, 22 nt, Human
cauggggagacaccuagggaaa

SEQ ID NO: 788640 - RNA, 22 nt, Human
ggcacagcgacuaccaucgaaa

SEQ ID NO: 788641 - RNA, 22 nt, Human
uuaaugacaucauaggugaagu

SEQ ID NO: 788642 - RNA, 22 nt, Human
ugucaugguauuugugagcugc

SEQ ID NO: 788643 - RNA, 19 nt, Human
acuggcagcuguagucugu

SEQ ID NO: 788644 - RNA, 22 nt, Human
uaauuauuaugacaacaauugc

SEQ ID NO: 788645 - RNA, 22 nt, Human
ucauauaaguuuaaaacuaucu

SEQ ID NO: 788646 - RNA, 22 nt, Human
auuugucaguggaagugauuca

SEQ ID NO: 788647 - RNA, 21 nt, Human
agaaauacagcagggaugauc

SEQ ID NO: 788648 - RNA, 18 nt, Human
uagauuaaaauugaauuc

SEQ ID NO: 788649 - RNA, 22 nt, Human
cugcauccauguugcugcaaag

SEQ ID NO: 788650 - RNA, 22 nt, Human
uuaaugacuuauauuuaaagca

SEQ ID NO: 788651 - RNA, 22 nt, Human
uccucaggcggugaggaggggc

SEQ ID NO: 788652 - RNA, 22 nt, Human
uaaaugaaaggguuuaauuuau

SEQ ID NO: 788653 - RNA, 22 nt, Human
gauuaauagacacaaccaagcu

SEQ ID NO: 788654 - RNA, 21 nt, Human
uccucagggccccagagcacu

SEQ ID NO: 788655 - RNA, 22 nt, Human
ugcaaaugaguugcagaucagg

SEQ ID NO: 788656 - RNA, 22 nt, Human
aguuuucaguaaauauuaguga

SEQ ID NO: 788657 - RNA, 18 nt, Human
ugcaaauggcuguuugau

SEQ ID NO: 788658 - RNA, 21 nt, Human
uugcuuauggcacugcuuugc

SEQ ID NO: 788659 - RNA, 22 nt, Human
uggggaaacuauuuccuugucc

SEQ ID NO: 788660 - RNA, 22 nt, Human
auauuaaugagcaaguaaguga

SEQ ID NO: 788661 - RNA, 22 nt, Human
auuaguaaaacauuguauaugu

SEQ ID NO: 788662 - RNA, 22 nt, Human
auuagacaucauaugauucagc

SEQ ID NO: 788663 - RNA, 22 nt, Human
aaauagcuuuucauaauucuca

SEQ ID NO: 788664 - RNA, 22 nt, Human
cugagacaugguuugacuggca

SEQ ID NO: 788665 - RNA, 22 nt, Human
uggcacagagggacccagcagc

SEQ ID NO: 788666 - RNA, 22 nt, Human
acuggcagggggagccccgaga

SEQ ID NO: 788667 - RNA, 22 nt, Human
auuaauauacacuguuagcaug

SEQ ID NO: 788668 - RNA, 21 nt, Human
caguuuaauaacaaagaagga

SEQ ID NO: 788669 - RNA, 22 nt, Human
uaaugacuugaaggacccaugg

SEQ ID NO: 788670 - RNA, 22 nt, Human
uuuaaugaggucucucgcuggc

SEQ ID NO: 788671 - RNA, 22 nt, Human
aaugccaacuuggauauacauu

SEQ ID NO: 788672 - RNA, 22 nt, Human
aaauagauugcugaggcauuac

SEQ ID NO: 788673 - RNA, 22 nt, Human
cucugacagguggcauuaucuc

SEQ ID NO: 788674 - RNA, 22 nt, Human
ugcaaauguguagguuuacaua

SEQ ID NO: 788675 - RNA, 23 nt, Human
ccucaggggaccugugagccuga

SEQ ID NO: 788676 - RNA, 22 nt, Human
ccucagggaaugggaggcuggg

SEQ ID NO: 788677 - RNA, 22 nt, Human
ugcaguuuuggccauugaaggc

SEQ ID NO: 788678 - RNA, 23 nt, Human
aaaugccagggagacaggaacca

SEQ ID NO: 788679 - RNA, 22 nt, Human
aauaguugugaaucaggacuag

SEQ ID NO: 788680 - RNA, 22 nt, Human
gacacuacguggcucacauuuc

SEQ ID NO: 788681 - RNA, 22 nt, Human
aaaugccaggauuauuagaggc

SEQ ID NO: 788682 - RNA, 22 nt, Human
uagaauaaguugaugauauaug

SEQ ID NO: 788683 - RNA, 22 nt, Human
acaaauagaaaaucuggauugg

SEQ ID NO: 788684 - RNA, 22 nt, Human
agagccugcaucaggcuugggg

SEQ ID NO: 788685 - RNA, 20 nt, Human
agcaguuuccuaacucagcu

SEQ ID NO: 788686 - RNA, 22 nt, Human
ccacuggcuuuuccuaggucuc

SEQ ID NO: 788687 - RNA, 22 nt, Human
aguuuaauccuccagcccaacu

SEQ ID NO: 788688 - RNA, 22 nt, Human
ggcacagcaagaagggaaauga

SEQ ID NO: 788689 - RNA, 22 nt, Human
uugaucaagugggaaauaguaa

SEQ ID NO: 788690 - RNA, 19 nt, Human
gccuaugucuucaaaucau

SEQ ID NO: 788691 - RNA, 17 nt, Human
cagucacaggucuuuuc

SEQ ID NO: 788692 - RNA, 22 nt, Human
ggcaguuucucaggcaggggua

SEQ ID NO: 788693 - RNA, 22 nt, Human
ugcuauuaccugcuggacaguc

SEQ ID NO: 788694 - RNA, 21 nt, Human
guaucacauuugcaugcuuau

SEQ ID NO: 788695 - RNA, 22 nt, Human
acuggcagugucguuuacauga

SEQ ID NO: 788696 - RNA, 22 nt, Human
caaauagacuucaaucucuuga

SEQ ID NO: 788697 - RNA, 22 nt, Human
aauucauauggauaugcuagua

SEQ ID NO: 788698 - RNA, 22 nt, Human
auuauuugacuugagaacaggu

SEQ ID NO: 788699 - RNA, 22 nt, Human
aaccaguuucaaagaaaauugc

SEQ ID NO: 788700 - RNA, 22 nt, Human
ggcacagcacagagcacaugua

SEQ ID NO: 788701 - RNA, 21 nt, Human
agcacagcauauccaauguca

SEQ ID NO: 788702 - RNA, 20 nt, Human
acuggcagccugccugcugu

SEQ ID NO: 788703 - RNA, 22 nt, Human
ugcaaaugcccauuuauuuucu

SEQ ID NO: 788704 - RNA, 22 nt, Human
ucacauucauggugcuaauaaa

SEQ ID NO: 788705 - RNA, 22 nt, Human
uauuauaauuuagggcuuggau

SEQ ID NO: 788706 - RNA, 22 nt, Human
caauuauauuuagaaugauaca

SEQ ID NO: 788707 - RNA, 22 nt, Human
uaaugacuaagcaucauuaaac

SEQ ID NO: 788708 - RNA, 22 nt, Human
ugauaaauccauguaaauggua

SEQ ID NO: 788709 - RNA, 22 nt, Human
cacuggcaucuaagggugguag

SEQ ID NO: 788710 - RNA, 22 nt, Human
ucaggggacuuaggagagaagu

SEQ ID NO: 788711 - RNA, 22 nt, Human
aaccaguuguauguccuccagc

SEQ ID NO: 788712 - RNA, 22 nt, Human
auuauaaaccuuugaggguggg

SEQ ID NO: 788713 - RNA, 22 nt, Human
uauuaaauauaucuguuaguug

SEQ ID NO: 788714 - RNA, 22 nt, Human
ccucagggaggccucuguggcu

SEQ ID NO: 788715 - RNA, 22 nt, Human
uaaugacuaagcaaucaugaau

SEQ ID NO: 788716 - RNA, 18 nt, Human
aggaagcaggaggaaggc

SEQ ID NO: 788717 - RNA, 22 nt, Human
uugacacaguuuucucauuaag

SEQ ID NO: 788718 - RNA, 22 nt, Human
aucacaguuuugugccuugugg

SEQ ID NO: 788719 - RNA, 22 nt, Human
aucacagugccuucguaaauuu

SEQ ID NO: 788720 - RNA, 22 nt, Human
uggggaaaggaaaguuaaccug

SEQ ID NO: 788721 - RNA, 22 nt, Human
uccucagggcggccuccgucuu

SEQ ID NO: 788722 - RNA, 22 nt, Human
ggcaguuuuaacagagguagua

SEQ ID NO: 788723 - RNA, 22 nt, Human
uuuaaugaauaauucaaaucug

SEQ ID NO: 788724 - RNA, 22 nt, Human
ucauauaucugcaaagcaguau

SEQ ID NO: 788725 - RNA, 22 nt, Human
agcaguuuggaaaauacuagaa

SEQ ID NO: 788726 - RNA, 22 nt, Human
cucugggcggcccaggccaacc

SEQ ID NO: 788727 - RNA, 20 nt, Human
aaaugccagugauucugcuu

SEQ ID NO: 788728 - RNA, 22 nt, Human
agaaggaguguacaggucaugc

SEQ ID NO: 788729 - RNA, 22 nt, Human
gggcacagagggucuugaagaa

SEQ ID NO: 788730 - RNA, 22 nt, Human
ucucugggaauucacaagcccu

SEQ ID NO: 788731 - RNA, 22 nt, Human
uaugaauauaccacaauuuagg

SEQ ID NO: 788732 - RNA, 22 nt, Human
ucauaaauuaucuauuuggcua

SEQ ID NO: 788733 - RNA, 21 nt, Human
uccugggggguaggugaguuu

SEQ ID NO: 788734 - RNA, 22 nt, Human
aaucacagaguccagcagauga

SEQ ID NO: 788735 - RNA, 22 nt, Human
guuuccugacccuggcccagca

SEQ ID NO: 788736 - RNA, 22 nt, Human
aggaaggacugcagcauuuggu

SEQ ID NO: 788737 - RNA, 22 nt, Human
aggggaaaugccuuggugguac

SEQ ID NO: 788738 - RNA, 22 nt, Human
agaaauucaauucuaauuagcu

SEQ ID NO: 788739 - RNA, 22 nt, Human
caggaaggcgcggcugugccug

SEQ ID NO: 788740 - RNA, 22 nt, Human
aaucacauuacagcauaucugu

SEQ ID NO: 788741 - RNA, 22 nt, Human
uuauuaaucuuaucuuuggaaa

SEQ ID NO: 788742 - RNA, 22 nt, Human
agaaauucuaagcaucaauagc

SEQ ID NO: 788743 - RNA, 22 nt, Human
gagcaguugggcucuaggaagu

SEQ ID NO: 788744 - RNA, 22 nt, Human
gggcacagccuaacuauggaga

SEQ ID NO: 788745 - RNA, 22 nt, Human
auuauaaagaacaugugugugg

SEQ ID NO: 788746 - RNA, 18 nt, Human
uugauaaacaauuucauu

SEQ ID NO: 788747 - RNA, 22 nt, Human
uagucacaguacaggauaaaga

SEQ ID NO: 788748 - RNA, 22 nt, Human
aauagcuuaguccugauucugu

SEQ ID NO: 788749 - RNA, 22 nt, Human
gcauaauuaaacaggcaagauu

SEQ ID NO: 788750 - RNA, 22 nt, Human
cgccggcuugaggcaggcggca

SEQ ID NO: 788751 - RNA, 20 nt, Human
ucacaggagggaaggcaggu

SEQ ID NO: 788752 - RNA, 22 nt, Human
acuggcaguuugagaaugcauu

SEQ ID NO: 788753 - RNA, 22 nt, Human
ugcaaaugaugaaacuaacuuu

SEQ ID NO: 788754 - RNA, 20 nt, Human
auuauucauacaugugugac

SEQ ID NO: 788755 - RNA, 22 nt, Human
cuacaacauagucuucuacaga

SEQ ID NO: 788756 - RNA, 22 nt, Human
cuauaaaucuacccagcauugg

SEQ ID NO: 788757 - RNA, 22 nt, Human
aagguccuguagccacagagcc

SEQ ID NO: 788758 - RNA, 22 nt, Human
uuucauucauuauacaguagag

SEQ ID NO: 788759 - RNA, 22 nt, Human
auuauucaacacuugagaaauu

SEQ ID NO: 788760 - RNA, 22 nt, Human
uuuuagauugggaaauguaaag

SEQ ID NO: 788761 - RNA, 20 nt, Human
acacauauagcagcauaaac

SEQ ID NO: 788762 - RNA, 22 nt, Human
augccaaauucuacuuucagca

SEQ ID NO: 788763 - RNA, 22 nt, Human
uagauuucaggagacaaaaugg

SEQ ID NO: 788764 - RNA, 22 nt, Human
uacaagagacaccagggaggcu

SEQ ID NO: 788765 - RNA, 22 nt, Human
aggcaguuuaggcagcgauuua

SEQ ID NO: 788766 - RNA, 22 nt, Human
cauggggaugaggcugagacuu

SEQ ID NO: 788767 - RNA, 22 nt, Human
uuuuucaugagacuagaaguca

SEQ ID NO: 788768 - RNA, 22 nt, Human
acuauauacacauuaucuuguu

SEQ ID NO: 788769 - RNA, 22 nt, Human
gggcacagcugcuacccagugc

SEQ ID NO: 788770 - RNA, 22 nt, Human
uucacagugcugcaccuggcuu

SEQ ID NO: 788771 - RNA, 22 nt, Human
acucacagucccuguaggagug

SEQ ID NO: 788772 - RNA, 22 nt, Human
uucaauaucucuaagaaugagg

SEQ ID NO: 788773 - RNA, 22 nt, Human
ccaguuuauaagaaagaaaacc

SEQ ID NO: 788774 - RNA, 22 nt, Human
uauuauuaaauggcagaauuuu

SEQ ID NO: 788775 - RNA, 22 nt, Human
agcacagugccugacauauaug

SEQ ID NO: 788776 - RNA, 22 nt, Human
uaaugacuguaccaaggcuuca

SEQ ID NO: 788777 - RNA, 22 nt, Human
uuaaugacaggauaggcucuga

SEQ ID NO: 788778 - RNA, 22 nt, Human
gggccggagcugggucccgcgc

SEQ ID NO: 788779 - RNA, 22 nt, Human
gcacagccuugcccugugcccu

SEQ ID NO: 788780 - RNA, 22 nt, Human
gggacacuggacccagugucca

SEQ ID NO: 788781 - RNA, 22 nt, Human
gaaauauucuugucuuguuuuc

SEQ ID NO: 788782 - RNA, 20 nt, Human
auauaauaaauuuugguuac

SEQ ID NO: 788783 - RNA, 22 nt, Human
ugcaaaugggugaggguuagga

SEQ ID NO: 788784 - RNA, 22 nt, Human
auacauuagcucauaugauuaa

SEQ ID NO: 788785 - RNA, 22 nt, Human
uaaucacagaaacagacuguuu

SEQ ID NO: 788786 - RNA, 20 nt, Human
aggaaggagaaucugagcaa

SEQ ID NO: 788787 - RNA, 22 nt, Human
uauaaaugcacuuuugaaauau

SEQ ID NO: 788788 - RNA, 22 nt, Human
uaggauuuacuuugacaauauu

SEQ ID NO: 788789 - RNA, 22 nt, Human
cugugggcauuugagugugggu

SEQ ID NO: 788790 - RNA, 22 nt, Human
agacuuuaaugugcaaaugaaa

SEQ ID NO: 788791 - RNA, 22 nt, Human
caguuuaaaugagugacugcag

SEQ ID NO: 788792 - RNA, 22 nt, Human
uggggaaaggagagcauuauuu

SEQ ID NO: 788793 - RNA, 22 nt, Human
aaauaguucagcuuguaaaccc

SEQ ID NO: 788794 - RNA, 22 nt, Human
augccaaauuucuuucuguucu

SEQ ID NO: 788795 - RNA, 22 nt, Human
uccucaggaucuaggagugcuu

SEQ ID NO: 788796 - RNA, 22 nt, Human
gcgcaagccacacagccugggg

SEQ ID NO: 788797 - RNA, 22 nt, Human
agauauuaggaggauucauaau

SEQ ID NO: 788798 - RNA, 22 nt, Human
ucuauaaaugcagauaugugug

SEQ ID NO: 788799 - RNA, 22 nt, Human
agucacagaaacccaggugugg

SEQ ID NO: 788800 - RNA, 22 nt, Human
uguacacaaccuacagucugcu

SEQ ID NO: 788801 - RNA, 22 nt, Human
ucaaaugagaggcagggcagcu

SEQ ID NO: 788802 - RNA, 22 nt, Human
aaauaguuguuuggaucaauaa

SEQ ID NO: 788803 - RNA, 22 nt, Human
ucacaguacuccccaaaguuuc

SEQ ID NO: 788804 - RNA, 22 nt, Human
caguuuaaguagaacugagaau

SEQ ID NO: 788805 - RNA, 23 nt, Human
aaauagagauaggccagcuuugc

SEQ ID NO: 788806 - RNA, 22 nt, Human
aauucauacucuauauugcuuu

SEQ ID NO: 788807 - RNA, 22 nt, Human
uggggaaaaugcagaagauuac

SEQ ID NO: 788808 - RNA, 22 nt, Human
gugaggugguacaauauuaacu

SEQ ID NO: 788809 - RNA, 22 nt, Human
ugucauggacagauuagaugag

SEQ ID NO: 788810 - RNA, 22 nt, Human
cacuggcagauuugggaucugg

SEQ ID NO: 788811 - RNA, 22 nt, Human
uggggacacagagccaaacuau

SEQ ID NO: 788812 - RNA, 22 nt, Human
acacuacagggccgggauggaa

SEQ ID NO: 788813 - RNA, 22 nt, Human
uugacacagucaacuugauuuu

SEQ ID NO: 788814 - RNA, 22 nt, Human
uggaaggaaagguagcagagaa

SEQ ID NO: 788815 - RNA, 22 nt, Human
ucuggggaccauggcaucuaaa

SEQ ID NO: 788816 - RNA, 22 nt, Human
uuaauuagagcugauguucaua

SEQ ID NO: 788817 - RNA, 22 nt, Human
uuaaaugagauguucagauauu

SEQ ID NO: 788818 - RNA, 22 nt, Human
acuggcagcuguaggaugcaug

SEQ ID NO: 788819 - RNA, 22 nt, Human
agggcacaggcuccggguccag

SEQ ID NO: 788820 - RNA, 22 nt, Human
uauauuaaccauaggguucuag

SEQ ID NO: 788821 - RNA, 22 nt, Human
aaugccaauauucauuuguguu

SEQ ID NO: 788822 - RNA, 22 nt, Human
uucacaguggcugacaggcugg

SEQ ID NO: 788823 - RNA, 22 nt, Human
agcaguuuuuauaacacuggaa

SEQ ID NO: 788824 - RNA, 22 nt, Human
augccaaauucucagccucuuu

SEQ ID NO: 788825 - RNA, 22 nt, Human
aggaaggacuccaugguccguc

SEQ ID NO: 788826 - RNA, 22 nt, Human
auaguauuuccagaaauagucu

SEQ ID NO: 788827 - RNA, 22 nt, Human
aggcaguuguugcugagcagcu

SEQ ID NO: 788828 - RNA, 22 nt, Human
agucaguugcaaacaucaggca

SEQ ID NO: 788829 - RNA, 20 nt, Human
caguuuaacuuugagcaguu

SEQ ID NO: 788830 - RNA, 22 nt, Human
aguagucagcagauaauauagg

SEQ ID NO: 788831 - RNA, 22 nt, Human
cacaggagguuaggaagugguc

SEQ ID NO: 788832 - RNA, 22 nt, Human
uuuaaugauagcuguuucacau

SEQ ID NO: 788833 - RNA, 22 nt, Human
uugacacaauguauauuuucaa

SEQ ID NO: 788834 - RNA, 22 nt, Human
ucacaguuauagucuguagaau

SEQ ID NO: 788835 - RNA, 22 nt, Human
aggggagcaacauagucacucu

SEQ ID NO: 788836 - RNA, 22 nt, Human
ugucauggagcuuauauuccag

SEQ ID NO: 788837 - RNA, 22 nt, Human
uaggauuuauucuacaauauug

SEQ ID NO: 788838 - RNA, 22 nt, Human
uauuaauaaauauguaggggcc

SEQ ID NO: 788839 - RNA, 20 nt, Human
agguccugguucucugggau

SEQ ID NO: 788840 - RNA, 22 nt, Human
gaaauucaaaaugucaguauag

SEQ ID NO: 788841 - RNA, 22 nt, Human
auuauuaaagcuuaggucuuau

SEQ ID NO: 788842 - RNA, 22 nt, Human
ugcaguuuugccaggcaaugga

SEQ ID NO: 788843 - RNA, 22 nt, Human
aaauaguuagcccugcauauau

SEQ ID NO: 788844 - RNA, 22 nt, Human
uaguaaauuaaaauauugacuu

SEQ ID NO: 788845 - RNA, 22 nt, Human
cacauauaccucuucuugaguu

SEQ ID NO: 788846 - RNA, 22 nt, Human
gcacagccacugagugagaacc

SEQ ID NO: 788847 - RNA, 22 nt, Human
agcagcuuaucuuggagaggca

SEQ ID NO: 788848 - RNA, 22 nt, Human
ccaguuuaggacacaugcccac

SEQ ID NO: 788849 - RNA, 22 nt, Human
gcacagccacguaaugugguca

SEQ ID NO: 788850 - RNA, 22 nt, Human
uuaaauaguaggucuauuuugg

SEQ ID NO: 788851 - RNA, 22 nt, Human
uucaauaugauauuagcugugg

SEQ ID NO: 788852 - RNA, 22 nt, Human
cacuggcauuagucacgaggca

SEQ ID NO: 788853 - RNA, 22 nt, Human
uaauaagucuguuguuuaauug

SEQ ID NO: 788854 - RNA, 22 nt, Human
cauauuaaggucuguaaggggu

SEQ ID NO: 788855 - RNA, 22 nt, Human
ccucaggggucacugugaggag

SEQ ID NO: 788856 - RNA, 22 nt, Human
uauauuaaagugcuuugcagug

SEQ ID NO: 788857 - RNA, 22 nt, Human
ggacacuaaauggaagugucug

SEQ ID NO: 788858 - RNA, 22 nt, Human
ugcuauuaaugaggcugcauuu

SEQ ID NO: 788859 - RNA, 22 nt, Human
uauuaacaugaacugacuuuuc

SEQ ID NO: 788860 - RNA, 22 nt, Human
auuugucauguauguaaaguug

SEQ ID NO: 788861 - RNA, 22 nt, Human
gugacagugacagcuagauagu

SEQ ID NO: 788862 - RNA, 22 nt, Human
auauucaucguguagaaauacu

SEQ ID NO: 788863 - RNA, 16 nt, Human
cacauauauuuauaug

SEQ ID NO: 788864 - RNA, 20 nt, Human
uucauucacguagcuguuga

SEQ ID NO: 788865 - RNA, 22 nt, Human
uagucacaugaucacaggaucg

SEQ ID NO: 788866 - RNA, 22 nt, Human
aauuaauauuuguggaauuaau

SEQ ID NO: 788867 - RNA, 22 nt, Human
cugagacacggagaggcugugu

SEQ ID NO: 788868 - RNA, 22 nt, Human
uaucacaucaauguuuuaaaau

SEQ ID NO: 788869 - RNA, 22 nt, Human
cuacaacaccaggcacggagug

SEQ ID NO: 788870 - RNA, 22 nt, Human
gcaguuuuauuaugauggaaau

SEQ ID NO: 788871 - RNA, 22 nt, Human
uccucagggggccaacccagcc

SEQ ID NO: 788872 - RNA, 22 nt, Human
uuagucaauagugaauauagag

SEQ ID NO: 788873 - RNA, 22 nt, Human
ucauggggugaauuaguaugcu

SEQ ID NO: 788874 - RNA, 22 nt, Human
aucauaaaauugcaccauuucu

SEQ ID NO: 788875 - RNA, 22 nt, Human
ccacuggcaaccccgccucaua

SEQ ID NO: 788876 - RNA, 22 nt, Human
gcaaaugcuaaaguguagagac

SEQ ID NO: 788877 - RNA, 22 nt, Human
agugaaauuuguuuagauaggu

SEQ ID NO: 788878 - RNA, 22 nt, Human
aaucacauuuacauugcuaauu

SEQ ID NO: 788879 - RNA, 22 nt, Human
uaggauuuaggcuuuaacaucu

SEQ ID NO: 788880 - RNA, 17 nt, Human
ucacaguuggucucagu

SEQ ID NO: 788881 - RNA, 22 nt, Human
aagucacagcuaaauagcuaag

SEQ ID NO: 788882 - RNA, 22 nt, Human
gaaggagagggucaaggauaau

SEQ ID NO: 788883 - RNA, 22 nt, Human
auaguguuacccuucuuaaagu

SEQ ID NO: 788884 - RNA, 22 nt, Human
gggcacaguacuccaaucaacu

SEQ ID NO: 788885 - RNA, 22 nt, Human
aucacauugccagugauuaccc

SEQ ID NO: 788886 - RNA, 22 nt, Human
uuguucaucaggugacacauac

SEQ ID NO: 788887 - RNA, 22 nt, Human
ugcaaaugggaaacccagcagu

SEQ ID NO: 788888 - RNA, 22 nt, Human
ugucauggggaaaauaacagac

SEQ ID NO: 788889 - RNA, 22 nt, Human
ucacaguauaaccucauauagg

SEQ ID NO: 788890 - RNA, 22 nt, Human
ugucauggcacugguaggagug

SEQ ID NO: 788891 - RNA, 22 nt, Human
ugcaaauggagcauguauaaga

SEQ ID NO: 788892 - RNA, 22 nt, Human
auagcuuucuuaaauauauaaa

SEQ ID NO: 788893 - RNA, 22 nt, Human
caaggaaguuuuaggagaggaa

SEQ ID NO: 788894 - RNA, 22 nt, Human
ucauggggugacagaagggagg

SEQ ID NO: 788895 - RNA, 20 nt, Human
ugcacagcugugaauaggau

SEQ ID NO: 788896 - RNA, 22 nt, Human
agagccuguuuugugggagaug

SEQ ID NO: 788897 - RNA, 22 nt, Human
uaauuauugucugaagaguuau

SEQ ID NO: 788898 - RNA, 22 nt, Human
caguuuaaagaaggaugggagu

SEQ ID NO: 788899 - RNA, 22 nt, Human
uaauuauucuagucacauagca

SEQ ID NO: 788900 - RNA, 23 nt, Human
acaugauacacaauuagcaaacc

SEQ ID NO: 788901 - RNA, 22 nt, Human
cacuggcaaagccuguuccuua

SEQ ID NO: 788902 - RNA, 22 nt, Human
cacaggagagcugggaggugcc

SEQ ID NO: 788903 - RNA, 22 nt, Human
aaccaguuuaagcaaauaacug

SEQ ID NO: 788904 - RNA, 22 nt, Human
uaggggaauugcagugugucca

SEQ ID NO: 788905 - RNA, 22 nt, Human
caguuuaaccuauccauuaugu

SEQ ID NO: 788906 - RNA, 22 nt, Human
agucacuguucugucaugucaa

SEQ ID NO: 788907 - RNA, 22 nt, Human
uauucaaagugcgaggucaggg

SEQ ID NO: 788908 - RNA, 22 nt, Human
cacauucuuucacaguucugaa

SEQ ID NO: 788909 - RNA, 22 nt, Human
uuuagguuaaucaacaaacauu

SEQ ID NO: 788910 - RNA, 22 nt, Human
aaauaguuuagcucucauuuca

SEQ ID NO: 788911 - RNA, 22 nt, Human
uccacauagucauuaauuucug

SEQ ID NO: 788912 - RNA, 22 nt, Human
ugaggggauacgguacacauug

SEQ ID NO: 788913 - RNA, 22 nt, Human
ggacacuagauggagaagggaa

SEQ ID NO: 788914 - RNA, 22 nt, Human
uacaacauuguguugcuucaua

SEQ ID NO: 788915 - RNA, 22 nt, Human
accaguuuguaaccuguuuuca

SEQ ID NO: 788916 - RNA, 22 nt, Human
ggcacagcucaggucccagcuc

SEQ ID NO: 788917 - RNA, 22 nt, Human
acagcaggcacacaaggauaga

SEQ ID NO: 788918 - RNA, 22 nt, Human
gcaaaugcacugcauuuagauu

SEQ ID NO: 788919 - RNA, 22 nt, Human
accaguuucugggggagguugg

SEQ ID NO: 788920 - RNA, 22 nt, Human
gggggaaagcucaggagccugu

SEQ ID NO: 788921 - RNA, 22 nt, Human
uauuaauaugugugugcaugua

SEQ ID NO: 788922 - RNA, 22 nt, Human
agucacugguucuguaauuaau

SEQ ID NO: 788923 - RNA, 22 nt, Human
uggcacagaaaaaugcuccauu

SEQ ID NO: 788924 - RNA, 22 nt, Human
ggcacagccacuuuggagaacu

SEQ ID NO: 788925 - RNA, 22 nt, Human
agcacaguaauugauauuacug

SEQ ID NO: 788926 - RNA, 22 nt, Human
ugucauggacuggauuucugcu

SEQ ID NO: 788927 - RNA, 23 nt, Human
cauggggagcagugcuccugacc

SEQ ID NO: 788928 - RNA, 22 nt, Human
ugucaugggcauuuauugaggg

SEQ ID NO: 788929 - RNA, 22 nt, Human
cacagaggacuguagcggggag

SEQ ID NO: 788930 - RNA, 19 nt, Human
uaaguagucaaauaguaac

SEQ ID NO: 788931 - RNA, 22 nt, Human
uaucacauuuggagauuuauga

SEQ ID NO: 788932 - RNA, 22 nt, Human
gggggaaaguggagguucguga

SEQ ID NO: 788933 - RNA, 22 nt, Human
uguuaauauacuaaaauccacu

SEQ ID NO: 788934 - RNA, 22 nt, Human
uaguuuuauaauguuaacaucu

SEQ ID NO: 788935 - RNA, 21 nt, Human
uauuaauaugucuaagcugau

SEQ ID NO: 788936 - RNA, 18 nt, Human
cugugggcuggugcauga

SEQ ID NO: 788937 - RNA, 22 nt, Human
ggcacagcccucucuguggaca

SEQ ID NO: 788938 - RNA, 22 nt, Human
uucacaguggcugugccauuug

SEQ ID NO: 788939 - RNA, 22 nt, Human
auagaauaugacuuuuagaucc

SEQ ID NO: 788940 - RNA, 22 nt, Human
uucauauaaauggaaucagaau

SEQ ID NO: 788941 - RNA, 22 nt, Human
ccucagggucauccuaguaaua

SEQ ID NO: 788942 - RNA, 22 nt, Human
cuggcacaucacuccuaguuua

SEQ ID NO: 788943 - RNA, 22 nt, Human
ccucagggacgggaucacuugg

SEQ ID NO: 788944 - RNA, 22 nt, Human
gaggcaguggucugaugcaagg

SEQ ID NO: 788945 - RNA, 22 nt, Human
aaacauucacauuugcuaguaa

SEQ ID NO: 788946 - RNA, 22 nt, Human
ugucaugguagcugaaggaugu

SEQ ID NO: 788947 - RNA, 21 nt, Human
uaacacauuuugguacuuugg

SEQ ID NO: 788948 - RNA, 22 nt, Human
ucaggggaaaucucucagcgaa

SEQ ID NO: 788949 - RNA, 22 nt, Human
auauuaaugggauuuagucagg

SEQ ID NO: 788950 - RNA, 22 nt, Human
aaauaacuuucuguguauaguc

SEQ ID NO: 788951 - RNA, 22 nt, Human
uucacauaaucugcagcaagcg

SEQ ID NO: 788952 - RNA, 22 nt, Human
gaaauauuacaguggaggggau

SEQ ID NO: 788953 - RNA, 19 nt, Human
gggcacagccuccccccag

SEQ ID NO: 788954 - RNA, 22 nt, Human
ggcacagcaccuuuucacauug

SEQ ID NO: 788955 - RNA, 22 nt, Human
ugucaugggucuaaacauugau

SEQ ID NO: 788956 - RNA, 22 nt, Human
uucacaguggcccucucugagu

SEQ ID NO: 788957 - RNA, 22 nt, Human
gggcacagucugcagcccccca

SEQ ID NO: 788958 - RNA, 22 nt, Human
gaggcaguuccugagugacaag

SEQ ID NO: 788959 - RNA, 21 nt, Human
cucaggggauuuugagauuag

SEQ ID NO: 788960 - RNA, 22 nt, Human
aaccaguuuagucaugcuguaa

SEQ ID NO: 788961 - RNA, 22 nt, Human
uguaaauaaugcauguaaauca

SEQ ID NO: 788962 - RNA, 22 nt, Human
uacagaaagggaugauugaucu

SEQ ID NO: 788963 - RNA, 22 nt, Human
caggggaguuuuaugcaacaga

SEQ ID NO: 788964 - RNA, 22 nt, Human
uggcacaggaucucagcggcca

SEQ ID NO: 788965 - RNA, 22 nt, Human
aaugccaaugggcagaacuaga

SEQ ID NO: 788966 - RNA, 18 nt, Human
ccucagggagagagacgc

SEQ ID NO: 788967 - RNA, 22 nt, Human
uucauuugugguuauuuacaau

SEQ ID NO: 788968 - RNA, 22 nt, Human
ccucaggggugcccacagcugc

SEQ ID NO: 788969 - RNA, 22 nt, Human
auggggaagagccagugagcug

SEQ ID NO: 788970 - RNA, 22 nt, Human
agguccuguccuuggucucuga

SEQ ID NO: 788971 - RNA, 22 nt, Human
gcacagccugucccuguccugg

SEQ ID NO: 788972 - RNA, 22 nt, Human
gggcacaggagaaggaucuggc

SEQ ID NO: 788973 - RNA, 22 nt, Human
cacuggcaucuaguggguugag

SEQ ID NO: 788974 - RNA, 22 nt, Human
accaguuuauagcgaucuguca

SEQ ID NO: 788975 - RNA, 22 nt, Human
aguugucagucaaagacauuug

SEQ ID NO: 788976 - RNA, 22 nt, Human
auauuaauuauuuacacaugag

SEQ ID NO: 788977 - RNA, 22 nt, Human
cauuaauauuguucuucuuuag

SEQ ID NO: 788978 - RNA, 22 nt, Human
uuauuaauaaaguggcauagcc

SEQ ID NO: 788979 - RNA, 22 nt, Human
acuggcagcagcagcccuuggg

SEQ ID NO: 788980 - RNA, 22 nt, Human
ggggccuuggaucugugccccg

SEQ ID NO: 788981 - RNA, 22 nt, Human
aggaaauaggaccagacaaagc

SEQ ID NO: 788982 - RNA, 17 nt, Human
uaguaaaugaguagagc

SEQ ID NO: 788983 - RNA, 22 nt, Human
uaauuagaguuugguaaacaau

SEQ ID NO: 788984 - RNA, 22 nt, Human
ggcacagcugaugcagacacac

SEQ ID NO: 788985 - RNA, 21 nt, Human
ggcacagccugaaaugccuca

SEQ ID NO: 788986 - RNA, 21 nt, Human
augccaaacuucuucugcccu

SEQ ID NO: 788987 - RNA, 23 nt, Human
uucuucauuuucagaguugagca

SEQ ID NO: 788988 - RNA, 22 nt, Human
aauauguuccacuuaaagcugg

SEQ ID NO: 788989 - RNA, 22 nt, Human
ugcaaauguguuuuaaaccaaa

SEQ ID NO: 788990 - RNA, 22 nt, Human
auuugucaaaacacagagaaca

SEQ ID NO: 788991 - RNA, 22 nt, Human
ggcaguuuggcaggauggaggg

SEQ ID NO: 788992 - RNA, 22 nt, Human
gggcacugcuggaggcucccug

SEQ ID NO: 788993 - RNA, 22 nt, Human
uucauaugugaacucagugaug

SEQ ID NO: 788994 - RNA, 22 nt, Human
ccgggccucgggacaccgggua

SEQ ID NO: 788995 - RNA, 18 nt, Human
ccucagggagauccagug

SEQ ID NO: 788996 - RNA, 22 nt, Human
gacaggaagucugaaggaggga

SEQ ID NO: 788997 - RNA, 22 nt, Human
acuggcagagguuggacaccau

SEQ ID NO: 788998 - RNA, 22 nt, Human
uggaaggaagccaaggaagguu

SEQ ID NO: 788999 - RNA, 22 nt, Human
cuggcacagccacugcaggcag

SEQ ID NO: 789000 - RNA, 19 nt, Human
gaggcaguagucaaagcuu

SEQ ID NO: 789001 - RNA, 22 nt, Human
augccaaagggagcacuuuggg

SEQ ID NO: 789002 - RNA, 22 nt, Human
auauauuacaaaagaggaagga

SEQ ID NO: 789003 - RNA, 22 nt, Human
acuggcaguagagggagcgcau

SEQ ID NO: 789004 - RNA, 22 nt, Human
ccacuggcugucagcaggacuc

SEQ ID NO: 789005 - RNA, 21 nt, Human
ugucacagauucucagcuugc

SEQ ID NO: 789006 - RNA, 22 nt, Human
uauuauuauaguuauugggaag

SEQ ID NO: 789007 - RNA, 22 nt, Human
acauuuauauaacucacuagga

SEQ ID NO: 789008 - RNA, 22 nt, Human
uucauuugucugcuauagaucc

SEQ ID NO: 789009 - RNA, 22 nt, Human
acacauauaugucgaaguccuc

SEQ ID NO: 789010 - RNA, 22 nt, Human
uaugaaauuuaaacacagauca

SEQ ID NO: 789011 - RNA, 22 nt, Human
auaaguaggaaaauuugaauau

SEQ ID NO: 789012 - RNA, 22 nt, Human
uauuaauaagugacuacuagcu

SEQ ID NO: 789013 - RNA, 22 nt, Human
ugucacagaucguuuuugagcu

SEQ ID NO: 789014 - RNA, 22 nt, Human
acuggcagaacgugaugcgggu

SEQ ID NO: 789015 - RNA, 22 nt, Human
ggucacaggggagaagagugau

SEQ ID NO: 789016 - RNA, 22 nt, Human
ggcaucaggguaggaagguauc

SEQ ID NO: 789017 - RNA, 22 nt, Human
cacuggcaugugaggcgguggc

SEQ ID NO: 789018 - RNA, 22 nt, Human
aggucucugaguacugcuggac

SEQ ID NO: 789019 - RNA, 22 nt, Human
uuccauauguauauagcuguua

SEQ ID NO: 789020 - RNA, 22 nt, Human
gggcacaggaauuugggaugug

SEQ ID NO: 789021 - RNA, 22 nt, Human
ugucauggaggccuccccuaaa

SEQ ID NO: 789022 - RNA, 22 nt, Human
aguuauaaucugcuacugauau

SEQ ID NO: 789023 - RNA, 22 nt, Human
uauucacaugaaaacaaauuuu

SEQ ID NO: 789024 - RNA, 22 nt, Human
ggcauagcggcucagcguccag

SEQ ID NO: 789025 - RNA, 22 nt, Human
agucacuguuuaaucuagcuaa

SEQ ID NO: 789026 - RNA, 22 nt, Human
ucucuggguugagaacuaggac

SEQ ID NO: 789027 - RNA, 19 nt, Human
uccucaggggcucacagac

SEQ ID NO: 789028 - RNA, 23 nt, Human
uuuaaugaccaauagaaggaaca

SEQ ID NO: 789029 - RNA, 22 nt, Human
guuuugugaggcacccacaggu

SEQ ID NO: 789030 - RNA, 22 nt, Human
accaguuuuuuauacaucuucu

SEQ ID NO: 789031 - RNA, 22 nt, Human
aaauagagcuggguuaaacuuu

SEQ ID NO: 789032 - RNA, 22 nt, Human
agucagagacccuagaucuaau

SEQ ID NO: 789033 - RNA, 22 nt, Human
cgcgguggcggccuccagcgcc

SEQ ID NO: 789034 - RNA, 22 nt, Human
cugagacauuaugacaagugga

SEQ ID NO: 789035 - RNA, 22 nt, Human
cucaggggaccuggcuccgagu

SEQ ID NO: 789036 - RNA, 22 nt, Human
uaauuauuugaagacauuagag

SEQ ID NO: 789037 - RNA, 22 nt, Human
auucauaucauagaguuauuga

SEQ ID NO: 789038 - RNA, 22 nt, Human
auucaucuguacuucaauaucu

SEQ ID NO: 789039 - RNA, 22 nt, Human
aaauagauuucucuggguuugu

SEQ ID NO: 789040 - RNA, 22 nt, Human
aggugacugguuuaucuggcag

SEQ ID NO: 789041 - RNA, 22 nt, Human
uaugaaauugccauuuuuaugg

SEQ ID NO: 789042 - RNA, 22 nt, Human
ucaugggguuuggcuggauguc

SEQ ID NO: 789043 - RNA, 21 nt, Human
accaguuuggggggcuuccug

SEQ ID NO: 789044 - RNA, 22 nt, Human
caguuuaaggcaggacauggga

SEQ ID NO: 789045 - RNA, 22 nt, Human
uagucacaggaaguuucaaugu

SEQ ID NO: 789046 - RNA, 22 nt, Human
ccucaggggcuuuucguuguug

SEQ ID NO: 789047 - RNA, 22 nt, Human
aucacaguguagaccuuuuaaa

SEQ ID NO: 789048 - RNA, 22 nt, Human
ggcacagcacaguggacccagg

SEQ ID NO: 789049 - RNA, 22 nt, Human
uaaauuagggacuuuaguuaau

SEQ ID NO: 789050 - RNA, 23 nt, Human
uuauuuggauuuuaguggaaaga

SEQ ID NO: 789051 - RNA, 17 nt, Human
uggcacagaggugcuau

SEQ ID NO: 789052 - RNA, 22 nt, Human
gcacagccggaccgaggaaaag

SEQ ID NO: 789053 - RNA, 22 nt, Human
uucauuugccaucaguguaaug

SEQ ID NO: 789054 - RNA, 22 nt, Human
agggcacaggcuggcaggaucu

SEQ ID NO: 789055 - RNA, 21 nt, Human
cauauuaaaucggugccuuua

SEQ ID NO: 789056 - RNA, 22 nt, Human
uuuaaugauagucuuacgaaaa

SEQ ID NO: 789057 - RNA, 22 nt, Human
ggcacagcaggagcuaugugaa

SEQ ID NO: 789058 - RNA, 22 nt, Human
guuauaaaggugauaaugguca

SEQ ID NO: 789059 - RNA, 23 nt, Human
cacauauagcagccacuaagguc

SEQ ID NO: 789060 - RNA, 22 nt, Human
augccaaaauguuacauuucuu

SEQ ID NO: 789061 - RNA, 22 nt, Human
caguuuaaguguguugaaggua

SEQ ID NO: 789062 - RNA, 23 nt, Human
ccaguuuaucuuuaguguagauc

SEQ ID NO: 789063 - RNA, 22 nt, Human
uauauuaaaugaccaguuuuaa

SEQ ID NO: 789064 - RNA, 22 nt, Human
cauagauucuuauuuccaucuu

SEQ ID NO: 789065 - RNA, 22 nt, Human
gcaaaugcucuccagccugggu

SEQ ID NO: 789066 - RNA, 22 nt, Human
ucaggggacagccagcuggagg

SEQ ID NO: 789067 - RNA, 22 nt, Human
augccaaagauguuugauagaa

SEQ ID NO: 789068 - RNA, 22 nt, Human
auucuuauuuaaauagagucug

SEQ ID NO: 789069 - RNA, 22 nt, Human
agauauuaaucguacauaaggu

SEQ ID NO: 789070 - RNA, 22 nt, Human
caaaugccaggaaucucugaag

SEQ ID NO: 789071 - RNA, 19 nt, Human
agucacagaccuugucucc

SEQ ID NO: 789072 - RNA, 22 nt, Human
agagcagucaggcuaggacacu

SEQ ID NO: 789073 - RNA, 22 nt, Human
ggucacagggaagggcucucaa

SEQ ID NO: 789074 - RNA, 22 nt, Human
guaucacuuuugagagugagaa

SEQ ID NO: 789075 - RNA, 22 nt, Human
uauuagauuuguuucuguagau

SEQ ID NO: 789076 - RNA, 22 nt, Human
augcauaugccguagaauaagu

SEQ ID NO: 789077 - RNA, 22 nt, Human
acuuauucugagauuaugauca

SEQ ID NO: 789078 - RNA, 22 nt, Human
aggaauuauuugucuuagucuu

SEQ ID NO: 789079 - RNA, 22 nt, Human
uuagaucauuuugaacuaauuu

SEQ ID NO: 789080 - RNA, 22 nt, Human
cuuugauucagagagaauuagc

SEQ ID NO: 789081 - RNA, 22 nt, Human
ugagcaguaacagcucacaggg

SEQ ID NO: 789082 - RNA, 22 nt, Human
aucauaaagugcuaucugauug

SEQ ID NO: 789083 - RNA, 22 nt, Human
uggaaggagacugggaagugug

SEQ ID NO: 789084 - RNA, 22 nt, Human
acuggcagguccaucgcccuuu

SEQ ID NO: 789085 - RNA, 22 nt, Human
gucaaauauaugcaaaacuauu

SEQ ID NO: 789086 - RNA, 22 nt, Human
uuaaugaccuagagcaguaauu

SEQ ID NO: 789087 - RNA, 22 nt, Human
ucacagccuggacaguugccug

SEQ ID NO: 789088 - RNA, 22 nt, Human
uugugaauagugccgcuauaaa

SEQ ID NO: 789089 - RNA, 22 nt, Human
cuugccuuugucuucaaaggcu

SEQ ID NO: 789090 - RNA, 22 nt, Human
ggaaggucgagcugcaucuggc

SEQ ID NO: 789091 - RNA, 22 nt, Human
uaaucacaauucagaugucuua

SEQ ID NO: 789092 - RNA, 22 nt, Human
ccaguuuagguacuaggcucua

SEQ ID NO: 789093 - RNA, 22 nt, Human
ccucagggucucucacagcacc

SEQ ID NO: 789094 - RNA, 22 nt, Human
auuugucacugagagaguuaga

SEQ ID NO: 789095 - RNA, 23 nt, Human
uuauaaauauuuucagguguguu

SEQ ID NO: 789096 - RNA, 18 nt, Human
gucauggguaguuuagua

SEQ ID NO: 789097 - RNA, 22 nt, Human
uccucaggaugugggguagaau

SEQ ID NO: 789098 - RNA, 22 nt, Human
ucucacaggugcacguggcugu

SEQ ID NO: 789099 - RNA, 22 nt, Human
auuauucagucuuguaaggagu

SEQ ID NO: 789100 - RNA, 22 nt, Human
uugacacauuagagcuuguaaa

SEQ ID NO: 789101 - RNA, 22 nt, Human
uauauuaaacccucucuguagg

SEQ ID NO: 789102 - RNA, 22 nt, Human
aguuuaauauccuucaacuuuc

SEQ ID NO: 789103 - RNA, 22 nt, Human
gucagcagcauguuuaaucaaa

SEQ ID NO: 789104 - RNA, 22 nt, Human
ugucacagucucgugagcaucu

SEQ ID NO: 789105 - RNA, 22 nt, Human
uagauuucgcugcaucucaauc

SEQ ID NO: 789106 - RNA, 22 nt, Human
gggcacagaagucuaagacauc

SEQ ID NO: 789107 - RNA, 22 nt, Human
aggugccuaucuggucucugca

SEQ ID NO: 789108 - RNA, 22 nt, Human
aucacaguuuacaaaccugcug

SEQ ID NO: 789109 - RNA, 22 nt, Human
auucaaauuaaguuaauucagc

SEQ ID NO: 789110 - RNA, 22 nt, Human
ccucagggucugaggagaccgu

SEQ ID NO: 789111 - RNA, 19 nt, Human
aggaaggaaccugagucug

SEQ ID NO: 789112 - RNA, 22 nt, Human
ugagugcuuuaaauguuauuuu

SEQ ID NO: 789113 - RNA, 17 nt, Human
auguuaauuucacauuu

SEQ ID NO: 789114 - RNA, 19 nt, Human
ggagccuggcaggggcgug

SEQ ID NO: 789115 - RNA, 22 nt, Human
uaauacaucauucaucuaagga

SEQ ID NO: 789116 - RNA, 22 nt, Human
agguccugggaguucuagugug

SEQ ID NO: 789117 - RNA, 22 nt, Human
uaaugacugccgucucucuuca

SEQ ID NO: 789118 - RNA, 19 nt, Human
acuggcagggcugcggugg

SEQ ID NO: 789119 - RNA, 22 nt, Human
ugggcacagaauagauggccca

SEQ ID NO: 789120 - RNA, 22 nt, Human
uuuagucauuuggauuugaucu

SEQ ID NO: 789121 - RNA, 22 nt, Human
ugucauggcguuguggggacua

SEQ ID NO: 789122 - RNA, 22 nt, Human
ccucaggguggcaucagaucuu

SEQ ID NO: 789123 - RNA, 22 nt, Human
uucauucauguauugucuaugg

SEQ ID NO: 789124 - RNA, 22 nt, Human
aggcaguuuauccccagagccu

SEQ ID NO: 789125 - RNA, 23 nt, Human
aaauauucuuuuuuaguaagugc

SEQ ID NO: 789126 - RNA, 22 nt, Human
uauuggaagugaacaccaggcu

SEQ ID NO: 789127 - RNA, 22 nt, Human
uuaauuaguagaggcauuuagu

SEQ ID NO: 789128 - RNA, 22 nt, Human
ucacauauuuaagaaaguuaaa

SEQ ID NO: 789129 - RNA, 22 nt, Human
auggggaagcaauuggauuucc

SEQ ID NO: 789130 - RNA, 22 nt, Human
caggaaggcccaccuguccugu

SEQ ID NO: 789131 - RNA, 22 nt, Human
cagguccuggcaucaggcaggu

SEQ ID NO: 789132 - RNA, 22 nt, Human
ggcaucaggaucugucuugcuu

SEQ ID NO: 789133 - RNA, 19 nt, Human
caguuuaacuaauuuuauc

SEQ ID NO: 789134 - RNA, 22 nt, Human
auauuauuuucccuggaguugu

SEQ ID NO: 789135 - RNA, 22 nt, Human
aauagauacuacuuagauguag

SEQ ID NO: 789136 - RNA, 22 nt, Human
agugaaauugcuguaagaggaa

SEQ ID NO: 789137 - RNA, 22 nt, Human
gugagggguggcugagcaguuu

SEQ ID NO: 789138 - RNA, 23 nt, Human
uuuagucaguugacagccauaua

SEQ ID NO: 789139 - RNA, 21 nt, Human
aucacauuggcuguuauuauu

SEQ ID NO: 789140 - RNA, 22 nt, Human
acacaaauuguaggauaauugc

SEQ ID NO: 789141 - RNA, 22 nt, Human
uccucaggucaaagcaggagaa

SEQ ID NO: 789142 - RNA, 22 nt, Human
uauucagaaaauaaauuggauu

SEQ ID NO: 789143 - RNA, 22 nt, Human
augccaaagcccaaguucauca

SEQ ID NO: 789144 - RNA, 22 nt, Human
ugcacagcugccuccucucugc

SEQ ID NO: 789145 - RNA, 22 nt, Human
gaaauaauucugugucugaaca

SEQ ID NO: 789146 - RNA, 22 nt, Human
cauuaauaaacauuucagaaga

SEQ ID NO: 789147 - RNA, 22 nt, Human
cucugacagccuucauuaugca

SEQ ID NO: 789148 - RNA, 22 nt, Human
uauauauucuuaaguaguguag

SEQ ID NO: 789149 - RNA, 22 nt, Human
cuaauauuuuuagaaaucacga

SEQ ID NO: 789150 - RNA, 22 nt, Human
acuggcagaauugaauaguugu

SEQ ID NO: 789151 - RNA, 22 nt, Human
uggggaaagacauucauacagu

SEQ ID NO: 789152 - RNA, 22 nt, Human
agcaguuuuagggagacacauu

SEQ ID NO: 789153 - RNA, 21 nt, Human
gcagucacucgguuggcuacc

SEQ ID NO: 789154 - RNA, 22 nt, Human
uuauuaaugaguacaaguuauu

SEQ ID NO: 789155 - RNA, 22 nt, Human
gggcacagucuaaaguugggcc

SEQ ID NO: 789156 - RNA, 22 nt, Human
ugcaaaugggcaucuccaagug

SEQ ID NO: 789157 - RNA, 22 nt, Human
uggcacaguccugggugccugc

SEQ ID NO: 789158 - RNA, 22 nt, Human
acauucaacauggcuggucuag

SEQ ID NO: 789159 - RNA, 22 nt, Human
ugggcacaggggaauggaugaa

SEQ ID NO: 789160 - RNA, 19 nt, Human
ggccuugcucuguggcagc

SEQ ID NO: 789161 - RNA, 22 nt, Human
aggcacagcacaccuggccccc

SEQ ID NO: 789162 - RNA, 22 nt, Human
auauucauugaacaccuacuac

SEQ ID NO: 789163 - RNA, 22 nt, Human
acuggcagagggaaaaccauuc

SEQ ID NO: 789164 - RNA, 22 nt, Human
auucacaguuacugcugaacca

SEQ ID NO: 789165 - RNA, 22 nt, Human
aguagucacuucuauuaauggc

SEQ ID NO: 789166 - RNA, 22 nt, Human
uuaaauauuauguugucugcaa

SEQ ID NO: 789167 - RNA, 22 nt, Human
uuauucagugcauauauuaaaa

SEQ ID NO: 789168 - RNA, 22 nt, Human
cagguccuuuaguguccagaac

SEQ ID NO: 789169 - RNA, 22 nt, Human
gaauagauccucauuuauugau

SEQ ID NO: 789170 - RNA, 22 nt, Human
uccuggggccagcacuggugga

SEQ ID NO: 789171 - RNA, 22 nt, Human
ggcacagcacuguaggccuggg

SEQ ID NO: 789172 - RNA, 22 nt, Human
aggaaggagggcagauauuaag

SEQ ID NO: 789173 - RNA, 22 nt, Human
acacauauauacauauuugugc

SEQ ID NO: 789174 - RNA, 21 nt, Human
agagccugagaucuuccagca

SEQ ID NO: 789175 - RNA, 22 nt, Human
acuggcagccacaacuggcagg

SEQ ID NO: 789176 - RNA, 22 nt, Human
auaaauagugugucauaaaguc

SEQ ID NO: 789177 - RNA, 22 nt, Human
aucauuaaauauaagcuucaca

SEQ ID NO: 789178 - RNA, 22 nt, Human
aaccaguuggcaaccagcaguu

SEQ ID NO: 789179 - RNA, 20 nt, Human
agcacagcgcgguguuccuu

SEQ ID NO: 789180 - RNA, 22 nt, Human
guccuugcuugagacaggcagu

SEQ ID NO: 789181 - RNA, 22 nt, Human
acacaguucuuucacuguuggu

SEQ ID NO: 789182 - RNA, 22 nt, Human
ucauggggcucuucaaguggag

SEQ ID NO: 789183 - RNA, 22 nt, Human
gcaggagaacaaagcaagcugc

SEQ ID NO: 789184 - RNA, 22 nt, Human
aaaauggguuucuucaaccuca

SEQ ID NO: 789185 - RNA, 22 nt, Human
acggcuucuugacuguggguug

SEQ ID NO: 789186 - RNA, 22 nt, Human
ugucauggucuguaaggagccc

SEQ ID NO: 789187 - RNA, 22 nt, Human
gaaauauuguacuggagauguu

SEQ ID NO: 789188 - RNA, 22 nt, Human
uuaauagauaugccucuagagu

SEQ ID NO: 789189 - RNA, 22 nt, Human
uggggaaauguccugccuuccc

SEQ ID NO: 789190 - RNA, 22 nt, Human
gcaaaugcucuccuuggucagg

SEQ ID NO: 789191 - RNA, 22 nt, Human
uuaaugaccuggaagaagugau

SEQ ID NO: 789192 - RNA, 22 nt, Human
guugaugaaaaugaauugcaug

SEQ ID NO: 789193 - RNA, 20 nt, Human
cuaauauucuacucuaagga

SEQ ID NO: 789194 - RNA, 22 nt, Human
augggggaaaguacgagcaugg

SEQ ID NO: 789195 - RNA, 22 nt, Human
cagucacauugcccugcauuua

SEQ ID NO: 789196 - RNA, 22 nt, Human
ucaggggagguugaaucgucuc

SEQ ID NO: 789197 - RNA, 22 nt, Human
acacagaguauuuagaaggggu

SEQ ID NO: 789198 - RNA, 22 nt, Human
uaucacauaguguuuaguaaau

SEQ ID NO: 789199 - RNA, 23 nt, Human
ucacacagcuggucagguacaga

SEQ ID NO: 789200 - RNA, 22 nt, Human
uauuaaauuauggauuuaggag

SEQ ID NO: 789201 - RNA, 22 nt, Human
uaaaugagggcugacaugauug

SEQ ID NO: 789202 - RNA, 22 nt, Human
aauaauagcagaguuuacaauc

SEQ ID NO: 789203 - RNA, 22 nt, Human
ugcuauuauugucaccacugua

SEQ ID NO: 789204 - RNA, 18 nt, Human
ccucaggggaccuggcag

SEQ ID NO: 789205 - RNA, 22 nt, Human
auauaguuuaagaaaguacagu

SEQ ID NO: 789206 - RNA, 22 nt, Human
auagaguuuuauuuuccaauaa

SEQ ID NO: 789207 - RNA, 22 nt, Human
acuggcagaggauagcacuaau

SEQ ID NO: 789208 - RNA, 22 nt, Human
cuugcuuaccuaguuagcucca

SEQ ID NO: 789209 - RNA, 22 nt, Human
gacaguaacugagagauguaau

SEQ ID NO: 789210 - RNA, 22 nt, Human
acuuuccuagacuucagugaca

SEQ ID NO: 789211 - RNA, 20 nt, Human
uauaaauucagagcuuuggu

SEQ ID NO: 789212 - RNA, 22 nt, Human
uuauuaauacaugcaccugcau

SEQ ID NO: 789213 - RNA, 22 nt, Human
cagguccugcagggagaguaaa

SEQ ID NO: 789214 - RNA, 22 nt, Human
ccaguuuaagacuuaucucaau

SEQ ID NO: 789215 - RNA, 22 nt, Human
aaauacuguugaaugaaguaag

SEQ ID NO: 789216 - RNA, 22 nt, Human
uccucaggcugccuggaagacu

SEQ ID NO: 789217 - RNA, 22 nt, Human
uggggaaaacagaggaaauuag

SEQ ID NO: 789218 - RNA, 22 nt, Human
gcacagcccuggucggggcccc

SEQ ID NO: 789219 - RNA, 22 nt, Human
aggggaaaucucucgccaucug

SEQ ID NO: 789220 - RNA, 22 nt, Human
auauuaguuuggagacuacaau

SEQ ID NO: 789221 - RNA, 22 nt, Human
uuauacauguguuuugagauga

SEQ ID NO: 789222 - RNA, 22 nt, Human
augaauaaaacauuuuaaucag

SEQ ID NO: 789223 - RNA, 22 nt, Human
caggaaggggcucacucuggcc

SEQ ID NO: 789224 - RNA, 22 nt, Human
ccacuggcaguuggcuagccuu

SEQ ID NO: 789225 - RNA, 22 nt, Human
gguccuugggucuccuguguuu

SEQ ID NO: 789226 - RNA, 19 nt, Human
ugcaaaugcuguugagaau

SEQ ID NO: 789227 - RNA, 22 nt, Human
cacagcccugcgccccaguuug

SEQ ID NO: 789228 - RNA, 22 nt, Human
ggcaguuucaucaggagaaaag

SEQ ID NO: 789229 - RNA, 22 nt, Human
aauguauaaaguguuaauaacu

SEQ ID NO: 789230 - RNA, 22 nt, Human
aauagagucaguucuacauucu

SEQ ID NO: 789231 - RNA, 22 nt, Human
gggcagcagcaggaggucucug

SEQ ID NO: 789232 - RNA, 22 nt, Human
aucacaguuacucaaauaauga

SEQ ID NO: 789233 - RNA, 22 nt, Human
cagcaggacauggaggaguaaa

SEQ ID NO: 789234 - RNA, 22 nt, Human
auuauucaaucauauuaaaagu

SEQ ID NO: 789235 - RNA, 22 nt, Human
cauauauucugguuuucacugg

SEQ ID NO: 789236 - RNA, 22 nt, Human
cugugggcgccugucagccuca

SEQ ID NO: 789237 - RNA, 22 nt, Human
uggggaaaguucuugaaaguaa

SEQ ID NO: 789238 - RNA, 22 nt, Human
uauauuaacacccacuugccuc

SEQ ID NO: 789239 - RNA, 22 nt, Human
acauaugagguguuauucuaug

SEQ ID NO: 789240 - RNA, 22 nt, Human
ccucaggguucggaugagaaca

SEQ ID NO: 789241 - RNA, 22 nt, Human
ugcaaauguguggugaggcauu

SEQ ID NO: 789242 - RNA, 22 nt, Human
cacaggagaaaggggaagcucg

SEQ ID NO: 789243 - RNA, 22 nt, Human
acacaguuuaugguauucuguu

SEQ ID NO: 789244 - RNA, 22 nt, Human
ugggcacagggguaggaaugag

SEQ ID NO: 789245 - RNA, 22 nt, Human
uuauucauuaacagggaccaaa

SEQ ID NO: 789246 - RNA, 22 nt, Human
cagucacacaaguggacuuggg

SEQ ID NO: 789247 - RNA, 22 nt, Human
acacuacagggagaagacucac

SEQ ID NO: 789248 - RNA, 22 nt, Human
aaucacaucucauucaacagcc

SEQ ID NO: 789249 - RNA, 22 nt, Human
acacauuuucaacacugucaag

SEQ ID NO: 789250 - RNA, 22 nt, Human
auaugauuguccuuagcaaauu

SEQ ID NO: 789251 - RNA, 22 nt, Human
ugucauggcugaaagugggggc

SEQ ID NO: 789252 - RNA, 22 nt, Human
gggcacagagaagguuuuagug

SEQ ID NO: 789253 - RNA, 19 nt, Human
ugcaaauguaggaagaaua

SEQ ID NO: 789254 - RNA, 22 nt, Human
auauauagagcuagauguuaaa

SEQ ID NO: 789255 - RNA, 22 nt, Human
ggccacagaacagcuacaggac

SEQ ID NO: 789256 - RNA, 22 nt, Human
gcaggagaaaugaagauugggu

SEQ ID NO: 789257 - RNA, 22 nt, Human
gaagguccagcguggccaaguc

SEQ ID NO: 789258 - RNA, 22 nt, Human
uacauauacugagugauuugcu

SEQ ID NO: 789259 - RNA, 22 nt, Human
gagggaguaacguacuacagug

SEQ ID NO: 789260 - RNA, 22 nt, Human
acauaagugcacaauaaauauu

SEQ ID NO: 789261 - RNA, 22 nt, Human
uaggggagcucgggugcaaucg

SEQ ID NO: 789262 - RNA, 22 nt, Human
gccuaauacaugaugauaggua

SEQ ID NO: 789263 - RNA, 20 nt, Human
aggaaggaaguuugcaugga

SEQ ID NO: 789264 - RNA, 22 nt, Human
cagguccucgggggaggccggc

SEQ ID NO: 789265 - RNA, 22 nt, Human
ucauauaagagcuuuagaguca

SEQ ID NO: 789266 - RNA, 20 nt, Human
uaaauuagccuugaagauua

SEQ ID NO: 789267 - RNA, 22 nt, Human
ugggcacaaacaucugccuguu

SEQ ID NO: 789268 - RNA, 22 nt, Human
agucacagaaugauggcuccag

SEQ ID NO: 789269 - RNA, 22 nt, Human
uucuucaucuguaagauaagca

SEQ ID NO: 789270 - RNA, 22 nt, Human
gugggggacccaggugcugucc

SEQ ID NO: 789271 - RNA, 22 nt, Human
cacuggcaaauggagagaaugu

SEQ ID NO: 789272 - RNA, 22 nt, Human
acuggcaggcugcuggccggcg

SEQ ID NO: 789273 - RNA, 22 nt, Human
acuggcaguggcagcagaaaga

SEQ ID NO: 789274 - RNA, 18 nt, Human
aguguuaaguaaguagca

SEQ ID NO: 789275 - RNA, 20 nt, Human
uggggaaagccaucgaugag

SEQ ID NO: 789276 - RNA, 22 nt, Human
auuaauauugguucauuagcug

SEQ ID NO: 789277 - RNA, 22 nt, Human
ucaugggguagaagcauguuua

SEQ ID NO: 789278 - RNA, 22 nt, Human
uaguuuuacuugcgaugauaau

SEQ ID NO: 789279 - RNA, 21 nt, Human
ucgugcagcagcugaggcuug

SEQ ID NO: 789280 - RNA, 22 nt, Human
caaauagugucacauugugagg

SEQ ID NO: 789281 - RNA, 22 nt, Human
uaauaguugugacuuuguaaag

SEQ ID NO: 789282 - RNA, 22 nt, Human
aauaauuagugggacagagaac

SEQ ID NO: 789283 - RNA, 18 nt, Human
ccuaauaugagggguccu

SEQ ID NO: 789284 - RNA, 22 nt, Human
uuguucauaaagacaguucaga

SEQ ID NO: 789285 - RNA, 22 nt, Human
uagucacaaccuucaaguuguc

SEQ ID NO: 789286 - RNA, 22 nt, Human
uauaagauacuuggcauagugc

SEQ ID NO: 789287 - RNA, 22 nt, Human
aucucauaaacacacauauaug

SEQ ID NO: 789288 - RNA, 22 nt, Human
augcaaauaaagcaacuauaca

SEQ ID NO: 789289 - RNA, 22 nt, Human
aauagcuuaugggauagauguu

SEQ ID NO: 789290 - RNA, 22 nt, Human
ucauggggaaagcccgcccuca

SEQ ID NO: 789291 - RNA, 22 nt, Human
gggcacagcccagugggguccc

SEQ ID NO: 789292 - RNA, 22 nt, Human
ggcacagcuacuugcucacucu

SEQ ID NO: 789293 - RNA, 22 nt, Human
ugucauggcacuagaguggggu

SEQ ID NO: 789294 - RNA, 22 nt, Human
auauauucuuaaagaaucugac

SEQ ID NO: 789295 - RNA, 22 nt, Human
auauaaguguguggcuguuagu

SEQ ID NO: 789296 - RNA, 22 nt, Human
acacuacaacagcagaggugag

SEQ ID NO: 789297 - RNA, 22 nt, Human
aggacacuuggcuauuguucca

SEQ ID NO: 789298 - RNA, 22 nt, Human
aguacaguggucauaauauaaa

SEQ ID NO: 789299 - RNA, 22 nt, Human
aaaugccagcacacgucugugg

SEQ ID NO: 789300 - RNA, 22 nt, Human
auuaaucauuucugcauuaucu

SEQ ID NO: 789301 - RNA, 22 nt, Human
ugcaaaugucaaggguuagugu

SEQ ID NO: 789302 - RNA, 22 nt, Human
auagauacauuguuauauuugu

SEQ ID NO: 789303 - RNA, 22 nt, Human
aaauagauuuccuagcauugga

SEQ ID NO: 789304 - RNA, 19 nt, Human
ccauauaaccagcaagugu

SEQ ID NO: 789305 - RNA, 22 nt, Human
augcauauugauuauagauuca

SEQ ID NO: 789306 - RNA, 23 nt, Human
aggaaggagguccuaacaguauc

SEQ ID NO: 789307 - RNA, 22 nt, Human
uuacacaugcuuuguguguaug

SEQ ID NO: 789308 - RNA, 22 nt, Human
cuucccuucugugcagggcaga

SEQ ID NO: 789309 - RNA, 22 nt, Human
uuuuagauuauaagucuaauuc

SEQ ID NO: 789310 - RNA, 22 nt, Human
gcacagccagcaucugagggau

SEQ ID NO: 789311 - RNA, 22 nt, Human
aauauaauuuuauuccuagagu

SEQ ID NO: 789312 - RNA, 22 nt, Human
ggacacuacaaucugccugcau

SEQ ID NO: 789313 - RNA, 22 nt, Human
uccucagggaagaugagccuca

SEQ ID NO: 789314 - RNA, 17 nt, Human
ugucauggcuaugguug

SEQ ID NO: 789315 - RNA, 22 nt, Human
aucacaguggcuaccucuggau

SEQ ID NO: 789316 - RNA, 22 nt, Human
acuggcagaacuggugauuguc

SEQ ID NO: 789317 - RNA, 22 nt, Human
uauugauaugcagaacugacuu

SEQ ID NO: 789318 - RNA, 23 nt, Human
ucacauaucaagaaagugguaga

SEQ ID NO: 789319 - RNA, 22 nt, Human
auuaauaaaauaccacuuuguu

SEQ ID NO: 789320 - RNA, 22 nt, Human
uccucaggauguggaguagaau

SEQ ID NO: 789321 - RNA, 22 nt, Human
uuuucugaaguuuaagacauuu

SEQ ID NO: 789322 - RNA, 22 nt, Human
cacagugaccucuuuaaaaggg

SEQ ID NO: 789323 - RNA, 22 nt, Human
ggcagcuguaagaugagugaau

SEQ ID NO: 789324 - RNA, 22 nt, Human
auggaaauggagugugcuugcu

SEQ ID NO: 789325 - RNA, 22 nt, Human
agggacccauagagagaccagu

SEQ ID NO: 789326 - RNA, 22 nt, Human
gaacaaaucccuuccugucucc

SEQ ID NO: 789327 - RNA, 22 nt, Human
guccagagaguaaaggggguaa

SEQ ID NO: 789328 - RNA, 22 nt, Human
ccagaagucaaugcagauguga

SEQ ID NO: 789329 - RNA, 22 nt, Human
uucaccauuacauacaaagaug

SEQ ID NO: 789330 - RNA, 22 nt, Human
aguggcagagucaggguuugga

SEQ ID NO: 789331 - RNA, 22 nt, Human
cacucugcagcugaagggcugg

SEQ ID NO: 789332 - RNA, 22 nt, Human
ugugcugagugaucccauuccu

SEQ ID NO: 789333 - RNA, 22 nt, Human
ucuggggaccauggcaucuaaa

SEQ ID NO: 789334 - RNA, 22 nt, Human
guucacaugcucucaugcuuuu

SEQ ID NO: 789335 - RNA, 22 nt, Human
ucucccaagggcacauucaagg

SEQ ID NO: 789336 - RNA, 22 nt, Human
agcccagguggagugugugggg

SEQ ID NO: 789337 - RNA, 22 nt, Human
gaauuuccucuaaaccccugag

SEQ ID NO: 789338 - RNA, 20 nt, Human
aauaaaagaagccuucaccc

SEQ ID NO: 789339 - RNA, 22 nt, Human
gcaggacagacccaagcagucu

SEQ ID NO: 789340 - RNA, 22 nt, Human
cugauuuucaaaauguguuaaa

SEQ ID NO: 789341 - RNA, 22 nt, Human
cuuggcugcuuuugugcacauu

SEQ ID NO: 789342 - RNA, 22 nt, Human
uuuguauuuuucccagcuagcu

SEQ ID NO: 789343 - RNA, 22 nt, Human
gccauguccugggcaucugcca

SEQ ID NO: 789344 - RNA, 22 nt, Human
ugcagcuucacucaggaagcca

SEQ ID NO: 789345 - RNA, 18 nt, Human
cccagccucuccuuucua

SEQ ID NO: 789346 - RNA, 21 nt, Human
uagagaaaagaagcuguuccu

SEQ ID NO: 789347 - RNA, 22 nt, Human
uaaguucaaaucaucccaacuu

SEQ ID NO: 789348 - RNA, 22 nt, Human
uuugcaaagugcuugcagagua

SEQ ID NO: 789349 - RNA, 17 nt, Human
gcugcagcgguaggcag

SEQ ID NO: 789350 - RNA, 22 nt, Human
ucucuuggugauagucuuucuu

SEQ ID NO: 789351 - RNA, 22 nt, Human
aggaaacauugauauugggaaa

SEQ ID NO: 789352 - RNA, 22 nt, Human
ccuggucagagcagucaggauc

SEQ ID NO: 789353 - RNA, 22 nt, Human
ucugccucuuucaggccuggca

SEQ ID NO: 789354 - RNA, 22 nt, Human
gacagcaaugacggggcagcug

SEQ ID NO: 789355 - RNA, 22 nt, Human
ucuucaggaagggaaaucaucc

SEQ ID NO: 789356 - RNA, 20 nt, Human
cugcugagagccuggcuugc

SEQ ID NO: 789357 - RNA, 22 nt, Human
gcugcuggcacuggagugagcc

SEQ ID NO: 789358 - RNA, 22 nt, Human
ggcccagcugggcggggacacg

SEQ ID NO: 789359 - RNA, 22 nt, Human
aacugucuaaggagaauaugaa

SEQ ID NO: 789360 - RNA, 22 nt, Human
ccauucuuucagugucucaugu

SEQ ID NO: 789361 - RNA, 22 nt, Human
uagaaaggagcauuuuagacua

SEQ ID NO: 789362 - RNA, 22 nt, Human
aggcuuggagguucuguagcca

SEQ ID NO: 789363 - RNA, 22 nt, Human
ggcaggugcgcauguugcauua

SEQ ID NO: 789364 - RNA, 22 nt, Human
cucugccaucuuggagcucaag

SEQ ID NO: 789365 - RNA, 22 nt, Human
gagagcuggccagcuucaguau

SEQ ID NO: 789366 - RNA, 22 nt, Human
caugaaaaauuuacuguuaaca

SEQ ID NO: 789367 - RNA, 22 nt, Human
uuuuggcuccagugguuugugc

SEQ ID NO: 789368 - RNA, 17 nt, Human
aaaauucuguaaagagg

SEQ ID NO: 789369 - RNA, 22 nt, Human
guccagccccugacucccaggc

SEQ ID NO: 789370 - RNA, 22 nt, Human
gaagagcuuagacagaaucaaa

SEQ ID NO: 789371 - RNA, 22 nt, Human
uggugagcucuuuagacuggga

SEQ ID NO: 789372 - RNA, 22 nt, Human
aaaagucuacaagcuucaacaa

SEQ ID NO: 789373 - RNA, 22 nt, Human
agcaggaggagagccuggcggu

SEQ ID NO: 789374 - RNA, 22 nt, Human
aggccagcuguuacuagagcca

SEQ ID NO: 789375 - RNA, 22 nt, Human
acagcaggauuuggcgauguug

SEQ ID NO: 789376 - RNA, 22 nt, Human
ugcagugguugagagcccagac

SEQ ID NO: 789377 - RNA, 22 nt, Human
gaagccagauuaucacaagcca

SEQ ID NO: 789378 - RNA, 22 nt, Human
ccagccuucugagcugccugga

SEQ ID NO: 789379 - RNA, 20 nt, Human
auauguguacguguauacau

SEQ ID NO: 789380 - RNA, 22 nt, Human
acacacaugccuuuccuaagua

SEQ ID NO: 789381 - RNA, 20 nt, Human
gaugaaaucacugggcagcc

SEQ ID NO: 789382 - RNA, 22 nt, Human
agugcauuccuggggaagaagc

SEQ ID NO: 789383 - RNA, 22 nt, Human
aucuggcuauugacauguuaua

SEQ ID NO: 789384 - RNA, 22 nt, Human
aagucacacaguuaacaugagg

SEQ ID NO: 789385 - RNA, 22 nt, Human
uggcucagugcauucacaguaa

SEQ ID NO: 789386 - RNA, 22 nt, Human
aaagaagagcuggaaggagucu

SEQ ID NO: 789387 - RNA, 22 nt, Human
aaaaaucacuuuuauaggcagc

SEQ ID NO: 789388 - RNA, 22 nt, Human
agugacguuuauugggugugaa

SEQ ID NO: 789389 - RNA, 22 nt, Human
acugugguuaccucuugucuua

SEQ ID NO: 789390 - RNA, 22 nt, Human
aacaguaacgagauguccuaac

SEQ ID NO: 789391 - RNA, 22 nt, Human
uaaaguauauuuuuucucaaua

SEQ ID NO: 789392 - RNA, 22 nt, Human
gagacagagaucuugcugaguc

SEQ ID NO: 789393 - RNA, 22 nt, Human
gacagugauuaguuacuauaaa

SEQ ID NO: 789394 - RNA, 17 nt, Human
ugucauggcuaugguug

SEQ ID NO: 789395 - RNA, 22 nt, Human
cuggaguugggaugugccugga

SEQ ID NO: 789396 - RNA, 22 nt, Human
ccuggggcucaagauggcgccg

SEQ ID NO: 789397 - RNA, 22 nt, Human
caucaguguggcaguucacugu

SEQ ID NO: 789398 - RNA, 22 nt, Human
agcagcaggugaccucgaugcc

SEQ ID NO: 789399 - RNA, 22 nt, Human
ccacagucuaugcaacaagguc

SEQ ID NO: 789400 - RNA, 22 nt, Human
cuuucagguucuauaggaagcc

SEQ ID NO: 789401 - RNA, 22 nt, Human
agcagcaccuguccucgcugcu

SEQ ID NO: 789402 - RNA, 22 nt, Human
aucuggcuuacgaagcacuggu

SEQ ID NO: 789403 - RNA, 22 nt, Human
uaucaggaguugacaguugcua

SEQ ID NO: 789404 - RNA, 22 nt, Human
uucaucaauguguuuaauaaug

SEQ ID NO: 789405 - RNA, 22 nt, Human
uuuaaauucugucugccgcuua

SEQ ID NO: 789406 - RNA, 22 nt, Human
ucaugaaaauagaucagaaauu

SEQ ID NO: 789407 - RNA, 22 nt, Human
ugucauuuucuaaucuguuguc

SEQ ID NO: 789408 - RNA, 22 nt, Human
gccaggagaaugcuagcagagg

SEQ ID NO: 789409 - RNA, 19 nt, Human
gugcuuuuuaagagcucag

SEQ ID NO: 789410 - RNA, 22 nt, Human
ucaaauaugugauagaagcuaa

SEQ ID NO: 789411 - RNA, 19 nt, Human
ugugggcaagggauggcag

SEQ ID NO: 789412 - RNA, 22 nt, Human
uucauugaguauagggguauac

SEQ ID NO: 789413 - RNA, 22 nt, Human
cagguguuucaaaugugaaacu

SEQ ID NO: 789414 - RNA, 22 nt, Human
agcccagcuccuccacagaaua

SEQ ID NO: 789415 - RNA, 22 nt, Human
ccuccaggcugguuaucagcug

SEQ ID NO: 789416 - RNA, 22 nt, Human
uggcuucacaauuucauaacua

SEQ ID NO: 789417 - RNA, 22 nt, Human
agucugagucuaaaggcuugag

SEQ ID NO: 789418 - RNA, 23 nt, Human
acuuucccauagcauggcuuccu

SEQ ID NO: 789419 - RNA, 22 nt, Human
aacugcaaaauaaucaaguugu

SEQ ID NO: 789420 - RNA, 22 nt, Human
ccucuggaucuuucuccacacu

SEQ ID NO: 789421 - RNA, 19 nt, Human
aucuuacagagcagaguac

SEQ ID NO: 789422 - RNA, 19 nt, Human
auauagcauuauucaauuu

SEQ ID NO: 789423 - RNA, 22 nt, Human
cccuguggaggaggagagcagu

SEQ ID NO: 789424 - RNA, 21 nt, Human
ugggagaccgccuuccuggga

SEQ ID NO: 789425 - RNA, 22 nt, Human
cucuuuccucagccacagucua

SEQ ID NO: 789426 - RNA, 22 nt, Human
ccugggcucuauccugacccag

SEQ ID NO: 789427 - RNA, 22 nt, Human
aaaaauacuucacuucugggug

SEQ ID NO: 789428 - RNA, 22 nt, Human
uugcagcugaggaaauugaagc

SEQ ID NO: 789429 - RNA, 22 nt, Human
ucaggcugcagcugucagcagc

SEQ ID NO: 789430 - RNA, 22 nt, Human
uggcagauuuugaagacagaga

SEQ ID NO: 789431 - RNA, 18 nt, Human
gggcauggaugcagcauc

SEQ ID NO: 789432 - RNA, 22 nt, Human
acugucaaaagagauuauauua

SEQ ID NO: 789433 - RNA, 22 nt, Human
ggcuuggagucauacugagaau

SEQ ID NO: 789434 - RNA, 22 nt, Human
aggcagcguagcaaggcuagua

SEQ ID NO: 789435 - RNA, 22 nt, Human
cucuguguucagccuagcagaa

SEQ ID NO: 789436 - RNA, 22 nt, Human
uguuucuaucuggaucaauaga

SEQ ID NO: 789437 - RNA, 23 nt, Human
uuguauuuuuaguagagacaggg

SEQ ID NO: 789438 - RNA, 22 nt, Human
ugaaaucaauaauuggugauug

SEQ ID NO: 789439 - RNA, 22 nt, Human
gccguuauucugcuggccccgg

SEQ ID NO: 789440 - RNA, 22 nt, Human
uuuucauuagaaugacugagaa

SEQ ID NO: 789441 - RNA, 22 nt, Human
agagugagggggcacugagacg

SEQ ID NO: 789442 - RNA, 20 nt, Human
uggccucugagaugccacgg

SEQ ID NO: 789443 - RNA, 18 nt, Human
cacaggcucccagugagg

SEQ ID NO: 789444 - RNA, 21 nt, Human
gcccacagugaggaggauccc

SEQ ID NO: 789445 - RNA, 22 nt, Human
uuaaggcacagagagguuaagu

SEQ ID NO: 789446 - RNA, 22 nt, Human
agagaggcugggcguagggcuu

SEQ ID NO: 789447 - RNA, 22 nt, Human
auuuccaugccuuagcuuaagg

SEQ ID NO: 789448 - RNA, 22 nt, Human
aaagccauugcagagcaggauu

SEQ ID NO: 789449 - RNA, 22 nt, Human
acauguaugcuuuaugaaguag

SEQ ID NO: 789450 - RNA, 21 nt, Human
gggcgaggccugauguggcuc

SEQ ID NO: 789451 - RNA, 22 nt, Human
ccuggcuguuugagcggggaau

SEQ ID NO: 789452 - RNA, 19 nt, Human
gggagccagacccuuugcu

SEQ ID NO: 789453 - RNA, 22 nt, Human
aggaagagcuggaccagaggac

SEQ ID NO: 789454 - RNA, 22 nt, Human
ggaaaccauucccgacucuccu

SEQ ID NO: 789455 - RNA, 19 nt, Human
uccaccccagccagcucug

SEQ ID NO: 789456 - RNA, 22 nt, Human
agcugcaaguguugccuccuac

SEQ ID NO: 789457 - RNA, 22 nt, Human
agcuccuggggguuccaagcag

SEQ ID NO: 789458 - RNA, 22 nt, Human
aucuggaaaacacaguguagac

SEQ ID NO: 789459 - RNA, 22 nt, Human
guccugagucaagugugggcag

SEQ ID NO: 789460 - RNA, 22 nt, Human
uggagccagcccaggccccucu

SEQ ID NO: 789461 - RNA, 21 nt, Human
ugaaugaugccccagaguugu

SEQ ID NO: 789462 - RNA, 22 nt, Human
augcauacagauuuaaaauuuu

SEQ ID NO: 789463 - RNA, 22 nt, Human
agaauauaguuaccaaauucug

SEQ ID NO: 789464 - RNA, 22 nt, Human
ccaggacacugcuucacagcag

SEQ ID NO: 789465 - RNA, 22 nt, Human
aaagaauuuguacacccuacua

SEQ ID NO: 789466 - RNA, 20 nt, Human
ggcagaugcagagcuaugca

SEQ ID NO: 789467 - RNA, 22 nt, Human
ccccauggcaacugcugggggu

SEQ ID NO: 789468 - RNA, 22 nt, Human
cugcagcuccucucugugcccc

SEQ ID NO: 789469 - RNA, 22 nt, Human
aacaucuuugauaaacuuagug

SEQ ID NO: 789470 - RNA, 22 nt, Human
agcuggcauugcagggagcugc

SEQ ID NO: 789471 - RNA, 22 nt, Human
aggcaaagaaguuggucaggag

SEQ ID NO: 789472 - RNA, 22 nt, Human
ccacacagauaaguguuuucua

SEQ ID NO: 789473 - RNA, 22 nt, Human
gagaagggauaugccacucucg

SEQ ID NO: 789474 - RNA, 22 nt, Human
ccaugcaauuucuguaaaacca

SEQ ID NO: 789475 - RNA, 22 nt, Human
cucaccccuguaauuccagcac

SEQ ID NO: 789476 - RNA, 22 nt, Human
uccuggccuuagcgaggcgguc

SEQ ID NO: 789477 - RNA, 22 nt, Human
cagaagucacccucagaauaac

SEQ ID NO: 789478 - RNA, 22 nt, Human
aaacccugcucuuauggaacuu

SEQ ID NO: 789479 - RNA, 23 nt, Human
agggagcuaaaaggcuggagcag

SEQ ID NO: 789480 - RNA, 23 nt, Human
ccaggaagaggccauccacaguc

SEQ ID NO: 789481 - RNA, 17 nt, Human
ggaaaagaagaguagga

SEQ ID NO: 789482 - RNA, 22 nt, Human
ggagccagagggaugcaguuga

SEQ ID NO: 789483 - RNA, 22 nt, Human
gccucccuuggugucucccggg

SEQ ID NO: 789484 - RNA, 22 nt, Human
cagacacagauaugcauauggc

SEQ ID NO: 789485 - RNA, 22 nt, Human
guguuuuagugcugcugagcug

SEQ ID NO: 789486 - RNA, 22 nt, Human
auuacaaaagaagggagaaggu

SEQ ID NO: 789487 - RNA, 22 nt, Human
cccagcuaccucugcuaggaga

SEQ ID NO: 789488 - RNA, 22 nt, Human
cuccuuaaagggagcagcagcu

SEQ ID NO: 789489 - RNA, 22 nt, Human
uuaagucacuggacuugccuag

SEQ ID NO: 789490 - RNA, 22 nt, Human
augucaaaucaguuuuaucaga

SEQ ID NO: 789491 - RNA, 22 nt, Human
aagagggaaauuguuggcugcu

SEQ ID NO: 789492 - RNA, 22 nt, Human
agcuccugcaccaggggccccu

SEQ ID NO: 789493 - RNA, 22 nt, Human
cugggaggcacuauucaggagg

SEQ ID NO: 789494 - RNA, 22 nt, Human
uuuauaaacaguaccacggugc

SEQ ID NO: 789495 - RNA, 18 nt, Human
ucauagaagugaaucaga

SEQ ID NO: 789496 - RNA, 22 nt, Human
aggaggccaggcccucaagccu

SEQ ID NO: 789497 - RNA, 22 nt, Human
uggcccuggguggaauguccca

SEQ ID NO: 789498 - RNA, 22 nt, Human
ucaucauccuuuuuugaagagu

SEQ ID NO: 789499 - RNA, 22 nt, Human
cuaguaaaguacucaaauagcc

SEQ ID NO: 789500 - RNA, 22 nt, Human
cugggagcccugacuagccugg

SEQ ID NO: 789501 - RNA, 22 nt, Human
aggcugugagagguggcuccca

SEQ ID NO: 789502 - RNA, 23 nt, Human
acugccugugccgaucucucuca

SEQ ID NO: 789503 - RNA, 22 nt, Human
agugucaauaauuucuuuuugg

SEQ ID NO: 789504 - RNA, 22 nt, Human
auuaauguguagccaacuuaau

SEQ ID NO: 789505 - RNA, 22 nt, Human
ccaggagcauuaagagaacaua

SEQ ID NO: 789506 - RNA, 22 nt, Human
aggcauggcacugagcagcuuc

SEQ ID NO: 789507 - RNA, 22 nt, Human
aguccugugaguuuuucuaguu

SEQ ID NO: 789508 - RNA, 17 nt, Human
caagagagaugacugga

SEQ ID NO: 789509 - RNA, 22 nt, Human
ccuuuggccgcuuuauggagga

SEQ ID NO: 789510 - RNA, 22 nt, Human
cauacaaauguguccaggcucu

SEQ ID NO: 789511 - RNA, 22 nt, Human
acagaggaaggcugagcugccc

SEQ ID NO: 789512 - RNA, 22 nt, Human
ugaggcugccuugggaagaggg

SEQ ID NO: 789513 - RNA, 22 nt, Human
gauuuauugucccuguccugcu

SEQ ID NO: 789514 - RNA, 22 nt, Human
cuguuguuccgggagcugcagc

SEQ ID NO: 789515 - RNA, 22 nt, Human
cagagaaagaagcccauucauu

SEQ ID NO: 789516 - RNA, 21 nt, Human
ucagcaggcaccagaaggcug

SEQ ID NO: 789517 - RNA, 22 nt, Human
gugcuggaacugugcuaagaga

SEQ ID NO: 789518 - RNA, 22 nt, Human
caugcuggucagccaguggaug

SEQ ID NO: 789519 - RNA, 21 nt, Human
ugcaggaguguaaugugaccc

SEQ ID NO: 789520 - RNA, 22 nt, Human
gagucagaauguccuccugcgg

SEQ ID NO: 789521 - RNA, 22 nt, Human
uuucauugccauaaggugggau

SEQ ID NO: 789522 - RNA, 22 nt, Human
ccuggcugugcauguuucuaug

SEQ ID NO: 789523 - RNA, 22 nt, Human
agaggccaccacugucagggac

SEQ ID NO: 789524 - RNA, 22 nt, Human
uuggaguccuugcugcuucacu

SEQ ID NO: 789525 - RNA, 22 nt, Human
auuuucaucauggguuuaacau

SEQ ID NO: 789526 - RNA, 22 nt, Human
guauuuuucauuccaagugaga

SEQ ID NO: 789527 - RNA, 22 nt, Human
aauucuacauugguucacauuu

SEQ ID NO: 789528 - RNA, 22 nt, Human
ggaaggaagugaccaggauauc

SEQ ID NO: 789529 - RNA, 22 nt, Human
guauacaacuauuguuggguaa

SEQ ID NO: 789530 - RNA, 21 nt, Human
uuucuaagugcuugguuuggg

SEQ ID NO: 789531 - RNA, 22 nt, Human
ggggcacacuuuugguagauau

SEQ ID NO: 789532 - RNA, 22 nt, Human
uaaguccacaggcugacagcgg

SEQ ID NO: 789533 - RNA, 22 nt, Human
gggcuuggguauugugagaggu

SEQ ID NO: 789534 - RNA, 22 nt, Human
ggacaggauaagagacacugcc

SEQ ID NO: 789535 - RNA, 22 nt, Human
uuugauuuacuggauauucuca

SEQ ID NO: 789536 - RNA, 22 nt, Human
gggucuggacggcugcaggaag

SEQ ID NO: 789537 - RNA, 17 nt, Human
ugaagaugcauggcagc

SEQ ID NO: 789538 - RNA, 22 nt, Human
ucauaaaguuguuuuaauggga

SEQ ID NO: 789539 - RNA, 22 nt, Human
uugcagcuucgagucuaucugu

SEQ ID NO: 789540 - RNA, 22 nt, Human
gugggcugcauguuuacuauuc

SEQ ID NO: 789541 - RNA, 22 nt, Human
gcacagaaccagacaugaggca

SEQ ID NO: 789542 - RNA, 22 nt, Human
ugcauacauaaucgagaccagu

SEQ ID NO: 789543 - RNA, 22 nt, Human
gaaggcccugguauucuugagg

SEQ ID NO: 789544 - RNA, 22 nt, Human
ccugcccagcuucaccucaggc

SEQ ID NO: 789545 - RNA, 20 nt, Human
acauuugaguaucaucuacu

SEQ ID NO: 789546 - RNA, 22 nt, Human
uauuauugacuauucagaaugu

SEQ ID NO: 789547 - RNA, 22 nt, Human
ccaggccugcaucugcugcgca

SEQ ID NO: 789548 - RNA, 22 nt, Human
caaaagcaguucuaucugaguu

SEQ ID NO: 789549 - RNA, 22 nt, Human
gauguguuuccaggauuuguuu

SEQ ID NO: 789550 - RNA, 17 nt, Human
uucaaagcuuaucaagg

SEQ ID NO: 789551 - RNA, 19 nt, Human
gaaggcuuuugguauguuu

SEQ ID NO: 789552 - RNA, 22 nt, Human
agcagggaggcccagggcacug

SEQ ID NO: 789553 - RNA, 22 nt, Human
gccugccuuuuggaggcacauu

SEQ ID NO: 789554 - RNA, 20 nt, Human
aaugagauuccuuaugauag

SEQ ID NO: 789555 - RNA, 22 nt, Human
cuauguuuaucuguauuucugu

SEQ ID NO: 789556 - RNA, 22 nt, Human
aaugucugaggcucaucugagg

SEQ ID NO: 789557 - RNA, 21 nt, Human
ugccagggauuuacagagccu

SEQ ID NO: 789558 - RNA, 22 nt, Human
aagccagguuccauggaggagc

SEQ ID NO: 789559 - RNA, 22 nt, Human
uucuuauauugggucauggaua

SEQ ID NO: 789560 - RNA, 22 nt, Human
aacugcauucagaaagcucacu

SEQ ID NO: 789561 - RNA, 22 nt, Human
gaaauaauacagugcucuucuc

SEQ ID NO: 789562 - RNA, 22 nt, Human
ucuuucuugguauaaagcaggg

SEQ ID NO: 789563 - RNA, 22 nt, Human
uaagaaacccaggaauuucuua

SEQ ID NO: 789564 - RNA, 19 nt, Human
ucugcagaaggcauacaug

SEQ ID NO: 789565 - RNA, 22 nt, Human
caggaagaaagaggugaggugu

SEQ ID NO: 789566 - RNA, 22 nt, Human
ucuuuguaaguuauauguagua

SEQ ID NO: 789567 - RNA, 22 nt, Human
cugggccaggaccaggguugaa

SEQ ID NO: 789568 - RNA, 22 nt, Human
caggcagcgcucguggccuggc

SEQ ID NO: 789569 - RNA, 22 nt, Human
uugaaauggcagcagcugaccu

SEQ ID NO: 789570 - RNA, 22 nt, Human
gcuggcuggaggagggagguug

SEQ ID NO: 789571 - RNA, 22 nt, Human
ccagcuggugggucuuucucug

SEQ ID NO: 789572 - RNA, 22 nt, Human
ggagagucugagccugcuggag

SEQ ID NO: 789573 - RNA, 22 nt, Human
ucagcaguccuccaggaucaag

SEQ ID NO: 789574 - RNA, 22 nt, Human
ggucucugaacuuccacugcgc

SEQ ID NO: 789575 - RNA, 22 nt, Human
aaaaaugugaccacaggguguu

SEQ ID NO: 789576 - RNA, 22 nt, Human
uucucuuuucaccaguugcuaa

SEQ ID NO: 789577 - RNA, 22 nt, Human
auguuucaccaguuuuauaaga

SEQ ID NO: 789578 - RNA, 22 nt, Human
uguguacuuuuguuucuaagcc

SEQ ID NO: 789579 - RNA, 22 nt, Human
aacaagaugggagaaggaccuc

SEQ ID NO: 789580 - RNA, 22 nt, Human
agagaagacuuacagccacagu

SEQ ID NO: 789581 - RNA, 22 nt, Human
cagccuuucuguuuccuaaggu

SEQ ID NO: 789582 - RNA, 22 nt, Human
aauagaaaggaggggcucuugu

SEQ ID NO: 789583 - RNA, 22 nt, Human
auuuucuauucugcugguuuag

SEQ ID NO: 789584 - RNA, 21 nt, Human
aauacagugaagaauuucuuu

SEQ ID NO: 789585 - RNA, 22 nt, Human
aaaaaggcuaagcaucuugugc

SEQ ID NO: 789586 - RNA, 21 nt, Human
aguaguuuagcacaggguuug

SEQ ID NO: 789587 - RNA, 22 nt, Human
ucugaagagucuugcaagaaag

SEQ ID NO: 789588 - RNA, 22 nt, Human
cugcugagagcugaaggcugua

SEQ ID NO: 789589 - RNA, 21 nt, Human
cucaggggauuuugagauuag

SEQ ID NO: 789590 - RNA, 20 nt, Human
cagcugccuggcucugggau

SEQ ID NO: 789591 - RNA, 22 nt, Human
gcugcagggagcuggaaggcuc

SEQ ID NO: 789592 - RNA, 18 nt, Human
ucaagacaucaugaaaua

SEQ ID NO: 789593 - RNA, 22 nt, Human
ucugccaguauucacggcccgu

SEQ ID NO: 789594 - RNA, 22 nt, Human
ggcuggcagaggggagucugug

SEQ ID NO: 789595 - RNA, 22 nt, Human
ugggaagggucaacagcuggaa

SEQ ID NO: 789596 - RNA, 17 nt, Human
agccagguacaagucca

SEQ ID NO: 789597 - RNA, 22 nt, Human
aggagccuggcuggcccacagg

SEQ ID NO: 789598 - RNA, 22 nt, Human
gggcuuggaguaggcugaugaa

SEQ ID NO: 789599 - RNA, 22 nt, Human
ggugcaggcgguggggcaagua

SEQ ID NO: 789600 - RNA, 20 nt, Human
cuggacuugcugcucaccug

SEQ ID NO: 789601 - RNA, 22 nt, Human
aauaguugugaaucaggacuag

SEQ ID NO: 789602 - RNA, 22 nt, Human
gaaggaggcguuagcccuagga

SEQ ID NO: 789603 - RNA, 22 nt, Human
ccccaccagcacccucucuauc

SEQ ID NO: 789604 - RNA, 22 nt, Human
ucagcagggcugggagcuguga

SEQ ID NO: 789605 - RNA, 22 nt, Human
ucugaagagcuuuggaaguaug

SEQ ID NO: 789606 - RNA, 22 nt, Human
ugcagaaauaaagauauuauca

SEQ ID NO: 789607 - RNA, 17 nt, Human
uaguaaaugaguagagc

SEQ ID NO: 789608 - RNA, 22 nt, Human
uccaagaucuacagcaguuuag

SEQ ID NO: 789609 - RNA, 22 nt, Human
ggcagggguccugguguugacu

SEQ ID NO: 789610 - RNA, 22 nt, Human
ggaggucccaggccuggcagca

SEQ ID NO: 789611 - RNA, 22 nt, Human
uucuuuggcugccagucuggag

SEQ ID NO: 789612 - RNA, 22 nt, Human
uccuuuccaugcuucuagaggc

SEQ ID NO: 789613 - RNA, 22 nt, Human
agagaaaacucauugagguguc

SEQ ID NO: 789614 - RNA, 22 nt, Human
aaaccugaaguacguuacauaa

SEQ ID NO: 789615 - RNA, 22 nt, Human
cagcaggcuguggaaauccugg

SEQ ID NO: 789616 - RNA, 22 nt, Human
uucaaacacuggcuuagccaau

SEQ ID NO: 789617 - RNA, 20 nt, Human
cuguggugagcaggagagua

SEQ ID NO: 789618 - RNA, 22 nt, Human
cacccaggcuagagugcagugg

SEQ ID NO: 789619 - RNA, 18 nt, Human
aaguccuuccuuugcuuu

SEQ ID NO: 789620 - RNA, 22 nt, Human
uaagcaggggucaaguguacaa

SEQ ID NO: 789621 - RNA, 22 nt, Human
agugucauaaggagaaauuaca

SEQ ID NO: 789622 - RNA, 22 nt, Human
acagggugaaugugacauuauc

SEQ ID NO: 789623 - RNA, 22 nt, Human
auguuuauggagcagguauuag

SEQ ID NO: 789624 - RNA, 22 nt, Human
uggccagucuuagcugugccug

SEQ ID NO: 789625 - RNA, 22 nt, Human
uucaacaacuugguucaaaugg

SEQ ID NO: 789626 - RNA, 22 nt, Human
ugucugguggguugacaggcag

SEQ ID NO: 789627 - RNA, 22 nt, Human
auuuccaugaaguuuaguuaua

SEQ ID NO: 789628 - RNA, 22 nt, Human
augucuuuuauggagaugucau

SEQ ID NO: 789629 - RNA, 22 nt, Human
uggcccugggcaucuuucguga

SEQ ID NO: 789630 - RNA, 22 nt, Human
uuuuacacuucgguugugugca

SEQ ID NO: 789631 - RNA, 21 nt, Human
gccugggauaguggccuccgg

SEQ ID NO: 789632 - RNA, 22 nt, Human
aguggcuguuccaggugaggac

SEQ ID NO: 789633 - RNA, 22 nt, Human
gcagagccagaauggccaggac

SEQ ID NO: 789634 - RNA, 23 nt, Human
ucugcuggugacacggucacauu

SEQ ID NO: 789635 - RNA, 22 nt, Human
ccagggugugggcgucggcacg

SEQ ID NO: 789636 - RNA, 22 nt, Human
aggagcucugggcagggccucc

SEQ ID NO: 789637 - RNA, 22 nt, Human
caggcagaaaguauucugugua

SEQ ID NO: 789638 - RNA, 22 nt, Human
agugcucaugcacauuuauagu

SEQ ID NO: 789639 - RNA, 22 nt, Human
gaacacaugauuauaaaugcua

SEQ ID NO: 789640 - RNA, 22 nt, Human
cacugugggucccagacuggag

SEQ ID NO: 789641 - RNA, 22 nt, Human
cugagcaggcgguggagcggcu

SEQ ID NO: 789642 - RNA, 22 nt, Human
gcagggcaugggcccugucugc

SEQ ID NO: 789643 - RNA, 22 nt, Human
cauuacaacaaucugccauggc

SEQ ID NO: 789644 - RNA, 20 nt, Human
gggcaguggcgcuaucucag

SEQ ID NO: 789645 - RNA, 20 nt, Human
uacaaauuuuccauguuucc

SEQ ID NO: 789646 - RNA, 22 nt, Human
aagccaggaccaaacucauccu

SEQ ID NO: 789647 - RNA, 22 nt, Human
cagguuucauuggcagcuucau

SEQ ID NO: 789648 - RNA, 22 nt, Human
aacauucaaguucugguuuaug

SEQ ID NO: 789649 - RNA, 19 nt, Human
gcaggcagcugggguaucc

SEQ ID NO: 789650 - RNA, 22 nt, Human
ccaaauagucuuucauugaauu

SEQ ID NO: 789651 - RNA, 22 nt, Human
gucucuuagaaucgcauauugu

SEQ ID NO: 789652 - RNA, 22 nt, Human
uuacacaaacacauuccagaua

SEQ ID NO: 789653 - RNA, 22 nt, Human
cagcaacugugccugacacaca

SEQ ID NO: 789654 - RNA, 23 nt, Human
ugggagcucaagggaggcugccc

SEQ ID NO: 789655 - RNA, 20 nt, Human
agguccugguucucugggau

SEQ ID NO: 789656 - RNA, 22 nt, Human
ccacaagacucugucagcauaa

SEQ ID NO: 789657 - RNA, 22 nt, Human
acucauuuuauaacacuguagu

SEQ ID NO: 789658 - RNA, 22 nt, Human
uuacauguggugugaagaagag

SEQ ID NO: 789659 - RNA, 22 nt, Human
acccuggagcaauaaucccugg

SEQ ID NO: 789660 - RNA, 22 nt, Human
uuacauuuugcacagauguccc

SEQ ID NO: 789661 - RNA, 22 nt, Human
aacaguuugccugaaauguauu

SEQ ID NO: 789662 - RNA, 22 nt, Human
ccugaguggccaggcagcugug

SEQ ID NO: 789663 - RNA, 22 nt, Human
uuuaugauuaauccaauucugu

SEQ ID NO: 789664 - RNA, 22 nt, Human
ccuguucuguuaauuaaacuuu

SEQ ID NO: 789665 - RNA, 21 nt, Human
gcaaggcuuuuguguuuccca

SEQ ID NO: 789666 - RNA, 23 nt, Human
ccuggaguacuaaggggauggaa

SEQ ID NO: 789667 - RNA, 22 nt, Human
agggagcucuaaguagagggac

SEQ ID NO: 789668 - RNA, 22 nt, Human
ucuuugaugcuucugaaggugu

SEQ ID NO: 789669 - RNA, 22 nt, Human
agcagcugggcucagagcuggg

SEQ ID NO: 789670 - RNA, 22 nt, Human
aagggaaauccucagcccagga

SEQ ID NO: 789671 - RNA, 22 nt, Human
uuaauguuuuaaguuauagaga

SEQ ID NO: 789672 - RNA, 22 nt, Human
ucaggcucccugcugggcucug

SEQ ID NO: 789673 - RNA, 22 nt, Human
caggguggggaaauagcgcccu

SEQ ID NO: 789674 - RNA, 22 nt, Human
cauuucacuauucacuaaaagg

SEQ ID NO: 789675 - RNA, 20 nt, Human
gaggcugcggacugcuggac

SEQ ID NO: 789676 - RNA, 22 nt, Human
acagaaauucugggacagaaaa

SEQ ID NO: 789677 - RNA, 22 nt, Human
cugccaggugagcuccaggccu

SEQ ID NO: 789678 - RNA, 22 nt, Human
agggccugaggcugacggggag

SEQ ID NO: 789679 - RNA, 22 nt, Human
agugggaggcggcugacgggcg

SEQ ID NO: 789680 - RNA, 20 nt, Human
caggcuccgcaggacuaggg

SEQ ID NO: 789681 - RNA, 22 nt, Human
gcugcagugagccaagaucgug

SEQ ID NO: 789682 - RNA, 22 nt, Human
ucaaggcacuucaugucucagu

SEQ ID NO: 789683 - RNA, 22 nt, Human
agggugagggucuggccuugag

SEQ ID NO: 789684 - RNA, 22 nt, Human
aaagcaagacaggaguuucaga

SEQ ID NO: 789685 - RNA, 22 nt, Human
gguggugacuguccuagggaug

SEQ ID NO: 789686 - RNA, 22 nt, Human
gaccacagaggugugggagaga

SEQ ID NO: 789687 - RNA, 22 nt, Human
augcuucugaagaagaaaagac

SEQ ID NO: 789688 - RNA, 22 nt, Human
ucuggaguccagauccauuugg

SEQ ID NO: 789689 - RNA, 22 nt, Human
cuuucuugcauaauuugaaacc

SEQ ID NO: 789690 - RNA, 22 nt, Human
gagcugugcuuauaccaauuca

SEQ ID NO: 789691 - RNA, 22 nt, Human
aaggcagccagauccuuugggu

SEQ ID NO: 789692 - RNA, 22 nt, Human
auggggaagagccagugagcug

SEQ ID NO: 789693 - RNA, 22 nt, Human
ucuggcaguaauaggggagaga

SEQ ID NO: 789694 - RNA, 22 nt, Human
gagugucagcagggcagagcac

SEQ ID NO: 789695 - RNA, 19 nt, Human
ggcugccuucugcucaucu

SEQ ID NO: 789696 - RNA, 21 nt, Human
cccaggagaagaaaagaugca

SEQ ID NO: 789697 - RNA, 22 nt, Human
uuuuaccacugggugacaugga

SEQ ID NO: 789698 - RNA, 22 nt, Human
auuauaaaccuuugaggguggg

SEQ ID NO: 789699 - RNA, 22 nt, Human
aucuuacaauuacaagacacuc

SEQ ID NO: 789700 - RNA, 22 nt, Human
cagaaacuagauuuagacacaa

SEQ ID NO: 789701 - RNA, 22 nt, Human
aggccuuaccauagcuguagca

SEQ ID NO: 789702 - RNA, 23 nt, Human
augucucugggcaguagggcuug

SEQ ID NO: 789703 - RNA, 22 nt, Human
ugcuuaaacacauacauacaua

SEQ ID NO: 789704 - RNA, 22 nt, Human
uugauucacaauuaccaagacu

SEQ ID NO: 789705 - RNA, 22 nt, Human
uucuuuggugggagauugaggu

SEQ ID NO: 789706 - RNA, 22 nt, Human
gucauuuugcugcauauuuaga

SEQ ID NO: 789707 - RNA, 22 nt, Human
uggccugguuguugcugccguu

SEQ ID NO: 789708 - RNA, 21 nt, Human
ggggcaucaagacagaguuag

SEQ ID NO: 789709 - RNA, 22 nt, Human
cagaagucuuucuguuucaccu

SEQ ID NO: 789710 - RNA, 22 nt, Human
gcuccuggguguggcugccccu

SEQ ID NO: 789711 - RNA, 22 nt, Human
gggcagcagagcccugccgagu

SEQ ID NO: 789712 - RNA, 22 nt, Human
augaaaacuuuagccucauuag

SEQ ID NO: 789713 - RNA, 22 nt, Human
ucaaaguacuacucaguucagc

SEQ ID NO: 789714 - RNA, 21 nt, Human
ggagaaggacaauguugagua

SEQ ID NO: 789715 - RNA, 19 nt, Human
agcacaguuuccacaugca

SEQ ID NO: 789716 - RNA, 21 nt, Human
augugauuauaugacuuuuac

SEQ ID NO: 789717 - RNA, 22 nt, Human
acagugauuucauccuucuggg

SEQ ID NO: 789718 - RNA, 22 nt, Human
ggugccagaguggcccaggggc

SEQ ID NO: 789719 - RNA, 22 nt, Human
ucauggcacuuagcacaguccu

SEQ ID NO: 789720 - RNA, 22 nt, Human
acccaggcuggaaugcaguggc

SEQ ID NO: 789721 - RNA, 22 nt, Human
acccaggcuggagugcagugac

SEQ ID NO: 789722 - RNA, 22 nt, Human
ugagaaccucgaagauuuugcc

SEQ ID NO: 789723 - RNA, 22 nt, Human
ccucaaauuggcauuaauuaag

SEQ ID NO: 789724 - RNA, 22 nt, Human
ugcccucugcaggccgccaugg

SEQ ID NO: 789725 - RNA, 22 nt, Human
aaucaaagaaugggcuaguugg

SEQ ID NO: 789726 - RNA, 22 nt, Human
ucaggacagacuagacuagcgu

SEQ ID NO: 789727 - RNA, 22 nt, Human
aaucuaaggacuuagcauugcu

SEQ ID NO: 789728 - RNA, 22 nt, Human
cccccaggggcuccgccucgug

SEQ ID NO: 789729 - RNA, 22 nt, Human
cugccucugguuuuggucccug

SEQ ID NO: 789730 - RNA, 22 nt, Human
aguguauuaugcagcggagguc

SEQ ID NO: 789731 - RNA, 22 nt, Human
uaaaacugaauacauacugagg

SEQ ID NO: 789732 - RNA, 21 nt, Human
gcaggcacucuagaggagcug

SEQ ID NO: 789733 - RNA, 22 nt, Human
aacauuucauuggaagcuaugu

SEQ ID NO: 789734 - RNA, 22 nt, Human
cacccguggagaagcaggagcg

SEQ ID NO: 789735 - RNA, 22 nt, Human
augacagugggucuugcaaaga

SEQ ID NO: 789736 - RNA, 22 nt, Human
cagugcuuugggaggcugagga

SEQ ID NO: 789737 - RNA, 22 nt, Human
agacacagguguaauuucugcu

SEQ ID NO: 789738 - RNA, 22 nt, Human
caggagcugggucuggaagcag

SEQ ID NO: 789739 - RNA, 22 nt, Human
gucagcaaaaaauuuaugugag

SEQ ID NO: 789740 - RNA, 22 nt, Human
ucauggauuaaauuauuaaguu

SEQ ID NO: 789741 - RNA, 22 nt, Human
aaugucugccugaacuuuauau

SEQ ID NO: 789742 - RNA, 22 nt, Human
agcaggguuuggggauuggcac

SEQ ID NO: 789743 - RNA, 22 nt, Human
ugguauuuccaggcuuauggua

SEQ ID NO: 789744 - RNA, 22 nt, Human
agagcaagugacagaaacaggg

SEQ ID NO: 789745 - RNA, 18 nt, Human
agagggaaagcaggcuga

SEQ ID NO: 789746 - RNA, 22 nt, Human
aaguguccucauucaacaugca

SEQ ID NO: 789747 - RNA, 22 nt, Human
gggcagggguagcauuccaagu

SEQ ID NO: 789748 - RNA, 21 nt, Human
uuguuuccucccaaaaugcca

SEQ ID NO: 789749 - RNA, 19 nt, Human
acaaugaauguguucucuu

SEQ ID NO: 789750 - RNA, 22 nt, Human
ucaagaugcauggguggcauaa

SEQ ID NO: 789751 - RNA, 22 nt, Human
uacaagaauuucuuucugguug

SEQ ID NO: 789752 - RNA, 22 nt, Human
auggcccaaacugcaauuacuu

SEQ ID NO: 789753 - RNA, 22 nt, Human
aaauuuuagacuccugggucua

SEQ ID NO: 789754 - RNA, 22 nt, Human
gacauuuagaaguuagauucaa

SEQ ID NO: 789755 - RNA, 22 nt, Human
auugauucuaccagcuacuuug

SEQ ID NO: 789756 - RNA, 22 nt, Human
agccuggcacugaggcagggcg

SEQ ID NO: 789757 - RNA, 22 nt, Human
uggcuggcuagaauggaaaugu

SEQ ID NO: 789758 - RNA, 22 nt, Human
gggguggagcuaaaugucuacu

SEQ ID NO: 789759 - RNA, 22 nt, Human
uucaagucugcccagagucagc

SEQ ID NO: 789760 - RNA, 22 nt, Human
ggacaggguaaguacuagugug

SEQ ID NO: 789761 - RNA, 22 nt, Human
ugucuuuaugcacacugacuug

SEQ ID NO: 789762 - RNA, 22 nt, Human
ggucuggacccuccuggagugg

SEQ ID NO: 789763 - RNA, 22 nt, Human
cuuggccugacauguggcaggg

SEQ ID NO: 789764 - RNA, 19 nt, Human
gggcuggagggauagagcc

SEQ ID NO: 789765 - RNA, 22 nt, Human
uccuagcuggccucucaccagc

SEQ ID NO: 789766 - RNA, 22 nt, Human
aggccucugggucuccucugac

SEQ ID NO: 789767 - RNA, 22 nt, Human
gcucagaguuaaauauagugcu

SEQ ID NO: 789768 - RNA, 22 nt, Human
aacuccagggcauugucuccug

SEQ ID NO: 789769 - RNA, 22 nt, Human
aucauaauugcuccagugauau

SEQ ID NO: 789770 - RNA, 18 nt, Human
uugaauucuucuacaugu

SEQ ID NO: 789771 - RNA, 22 nt, Human
caugcaaaugugcuaaucugaa

SEQ ID NO: 789772 - RNA, 22 nt, Human
cugccucuccccagaguggccc

SEQ ID NO: 789773 - RNA, 18 nt, Human
aaggcacaggagaacauu

SEQ ID NO: 789774 - RNA, 22 nt, Human
aacuccaggcagggaggccacu

SEQ ID NO: 789775 - RNA, 22 nt, Human
caggcagaaggaaguaccaggc

SEQ ID NO: 789776 - RNA, 22 nt, Human
ucccaggcucuucaaggaagac

SEQ ID NO: 789777 - RNA, 22 nt, Human
ucuacacaagugaguggcacaa

SEQ ID NO: 789778 - RNA, 22 nt, Human
gugacucucacuuuaccugacu

SEQ ID NO: 789779 - RNA, 19 nt, Human
acaauaacucauugauugc

SEQ ID NO: 789780 - RNA, 19 nt, Human
gcauuucucuuuacagcca

SEQ ID NO: 789781 - RNA, 22 nt, Human
uaaucacagaaacagacuguuu

SEQ ID NO: 789782 - RNA, 22 nt, Human
aaauuucuguuguuuugagcca

SEQ ID NO: 789783 - RNA, 22 nt, Human
uguccugugccaccuuccugag

SEQ ID NO: 789784 - RNA, 22 nt, Human
ggcucccaggagggccuggagg

SEQ ID NO: 789785 - RNA, 22 nt, Human
acaacaaaaucacuagucuucc

SEQ ID NO: 789786 - RNA, 22 nt, Human
aggaagaacagauaauggacgc

SEQ ID NO: 789787 - RNA, 22 nt, Human
ccuggcugugugaccuuggcaa

SEQ ID NO: 789788 - RNA, 22 nt, Human
acauauugagcucuaaaaguac

SEQ ID NO: 789789 - RNA, 22 nt, Human
ccccaggacacauggaccaagu

SEQ ID NO: 789790 - RNA, 22 nt, Human
accagagaaaacacagcaggcu

SEQ ID NO: 789791 - RNA, 22 nt, Human
aaaguugagugcugaucugauu

SEQ ID NO: 789792 - RNA, 22 nt, Human
ucucaguguuuaaaaagauuuc

SEQ ID NO: 789793 - RNA, 17 nt, Human
ugauucaacuagaaacu

SEQ ID NO: 789794 - RNA, 22 nt, Human
guucacauguguuaucuucuuu

SEQ ID NO: 789795 - RNA, 22 nt, Human
gucuccagauauccuacacaac

SEQ ID NO: 789796 - RNA, 22 nt, Human
aauuuuauuagaaggcaagggg

SEQ ID NO: 789797 - RNA, 22 nt, Human
ccagaaaauauggcuaagguga

SEQ ID NO: 789798 - RNA, 22 nt, Human
aagcagaggguauggccagguu

SEQ ID NO: 789799 - RNA, 22 nt, Human
aaagcaaugggucuaagguaaa

SEQ ID NO: 789800 - RNA, 22 nt, Human
aggcuaggggcagugccagcau

SEQ ID NO: 789801 - RNA, 22 nt, Human
uuucuuaugagcaagacucuau

SEQ ID NO: 789802 - RNA, 22 nt, Human
uuggcaauauuuacugaaguug

SEQ ID NO: 789803 - RNA, 22 nt, Human
acacaucuccagccagcaggag

SEQ ID NO: 789804 - RNA, 22 nt, Human
ucauuucuccuaagugaaauau

SEQ ID NO: 789805 - RNA, 22 nt, Human
cugcagcaagagaagugcugac

SEQ ID NO: 789806 - RNA, 22 nt, Human
gggcccucugcagcugcccagg

SEQ ID NO: 789807 - RNA, 22 nt, Human
uccccagguccugucggcuccu

SEQ ID NO: 789808 - RNA, 22 nt, Human
uuucugaagucuucuaacagau

SEQ ID NO: 789809 - RNA, 22 nt, Human
ggcuacagaggccgugagccug

SEQ ID NO: 789810 - RNA, 22 nt, Human
ucaggaugagucaucaagcugc

SEQ ID NO: 789811 - RNA, 22 nt, Human
auuauuguacuuucaauaaggu

SEQ ID NO: 789812 - RNA, 17 nt, Human
agccugccccaugcugc

SEQ ID NO: 789813 - RNA, 22 nt, Human
aagcacagacucccucugagug

SEQ ID NO: 789814 - RNA, 18 nt, Human
uuucugaaugucuauuuc

SEQ ID NO: 789815 - RNA, 22 nt, Human
cccaggagagaggggauaaagc

SEQ ID NO: 789816 - RNA, 22 nt, Human
aaguccuggauauuaaauugau

SEQ ID NO: 789817 - RNA, 22 nt, Human
cagcuggcuggucagugcacaa

SEQ ID NO: 789818 - RNA, 22 nt, Human
auguacaauucuccuugguagg

SEQ ID NO: 789819 - RNA, 22 nt, Human
ccagucagucaguugcuggcau

SEQ ID NO: 789820 - RNA, 22 nt, Human
ggaugcaggggcagcagagccu

SEQ ID NO: 789821 - RNA, 22 nt, Human
agagaugcauucagcauggaug

SEQ ID NO: 789822 - RNA, 22 nt, Human
cacagcagucuuucacuaaaua

SEQ ID NO: 789823 - RNA, 22 nt, Human
uggaaggcuuggaauacuucca

SEQ ID NO: 789824 - RNA, 22 nt, Human
cugggugccagcauggcugagu

SEQ ID NO: 789825 - RNA, 19 nt, Human
acacagggaucagaggguu

SEQ ID NO: 789826 - RNA, 22 nt, Human
cauucacaaagcugauugaugg

SEQ ID NO: 789827 - RNA, 22 nt, Human
aggcuggaucucuguugccuuc

SEQ ID NO: 789828 - RNA, 22 nt, Human
aaaucagacuugaauuuucauc

SEQ ID NO: 789829 - RNA, 22 nt, Human
augagaaagaguuguaucuaga

SEQ ID NO: 789830 - RNA, 22 nt, Human
uauuugaugaagguaaagucuu

SEQ ID NO: 789831 - RNA, 22 nt, Human
cugggagcgcagcaggcacaac

SEQ ID NO: 789832 - RNA, 22 nt, Human
gggaaggcaggccucuguugga

SEQ ID NO: 789833 - RNA, 22 nt, Human
ucagggagagugacccauccac

SEQ ID NO: 789834 - RNA, 22 nt, Human
caaugauagauuuuacaaauua

SEQ ID NO: 789835 - RNA, 22 nt, Human
agcugcuguccuaggcacugua

SEQ ID NO: 789836 - RNA, 22 nt, Human
ucuauaaaugcagauaugugug

SEQ ID NO: 789837 - RNA, 22 nt, Human
ggcaggguaugauuaccucuga

SEQ ID NO: 789838 - RNA, 21 nt, Human
cuacccucuccugcucauauc

SEQ ID NO: 789839 - RNA, 22 nt, Human
aggcugaaaacgagauggcaau

SEQ ID NO: 789840 - RNA, 22 nt, Human
ccugucaggguuugccucagaa

SEQ ID NO: 789841 - RNA, 22 nt, Human
ccagcugacgaugccuggucuc

SEQ ID NO: 789842 - RNA, 22 nt, Human
acagugucuccugguacccagu

SEQ ID NO: 789843 - RNA, 23 nt, Human
auucuucauuaucuucuagaaaa

SEQ ID NO: 789844 - RNA, 22 nt, Human
aaagccagggacagugugcaug

SEQ ID NO: 789845 - RNA, 22 nt, Human
uuuguacauccuaauucugagu

SEQ ID NO: 789846 - RNA, 22 nt, Human
uuauucuuggaucugagucucu

SEQ ID NO: 789847 - RNA, 22 nt, Human
acaaagaucuugcuuuccuacu

SEQ ID NO: 789848 - RNA, 22 nt, Human
acacaguucguuguuuucuacu

SEQ ID NO: 789849 - RNA, 20 nt, Human
aagauucauuguaauuaggg

SEQ ID NO: 789850 - RNA, 19 nt, Human
ccuggcugcugugggaugc

SEQ ID NO: 789851 - RNA, 21 nt, Human
uaaauaauaaguugcugagau

SEQ ID NO: 789852 - RNA, 20 nt, Human
uugcaaauaucgugggucag

SEQ ID NO: 789853 - RNA, 22 nt, Human
ucccuggccuggaaggauauca

SEQ ID NO: 789854 - RNA, 22 nt, Human
gcagcugccgugagcucacgcc

SEQ ID NO: 789855 - RNA, 22 nt, Human
uuucuaaggcuaggucuuaagg

SEQ ID NO: 789856 - RNA, 22 nt, Human
uccugggacaagccguggaagu

SEQ ID NO: 789857 - RNA, 19 nt, Human
aauagauuaauuauccucu

SEQ ID NO: 789858 - RNA, 22 nt, Human
ugcaaauaaauuucuguucauu

SEQ ID NO: 789859 - RNA, 22 nt, Human
caggcucacuguaaggucagcu

SEQ ID NO: 789860 - RNA, 22 nt, Human
aacgucauugauugaugguagu

SEQ ID NO: 789861 - RNA, 22 nt, Human
cacaggcugcccgcagcuggga

SEQ ID NO: 789862 - RNA, 22 nt, Human
acaaugaagauaauguugcagu

SEQ ID NO: 789863 - RNA, 22 nt, Human
aauccaugcaugcaaggaaagg

SEQ ID NO: 789864 - RNA, 22 nt, Human
ucaggaaggcaaauugcaugau

SEQ ID NO: 789865 - RNA, 22 nt, Human
uggacaggcuccuagggguucc

SEQ ID NO: 789866 - RNA, 22 nt, Human
uauuucacucaguauaccauag

SEQ ID NO: 789867 - RNA, 19 nt, Human
uccugggcugggccagguc

SEQ ID NO: 789868 - RNA, 22 nt, Human
acuguauaaggcauagguaagc

SEQ ID NO: 789869 - RNA, 22 nt, Human
uauggcuucuuuugcaacuacu

SEQ ID NO: 789870 - RNA, 22 nt, Human
cagagguguacagagggaggcc

SEQ ID NO: 789871 - RNA, 22 nt, Human
acagauauuaugguuucuccuu

SEQ ID NO: 789872 - RNA, 22 nt, Human
aguuuucaauauaugauaguga

SEQ ID NO: 789873 - RNA, 22 nt, Human
caguuauaggagccauuguaua

SEQ ID NO: 789874 - RNA, 22 nt, Human
ugcagccagacuuugugcgaaa

SEQ ID NO: 789875 - RNA, 22 nt, Human
ugucaucucuugcaggaagccu

SEQ ID NO: 789876 - RNA, 22 nt, Human
ugagccaggaguuugaggcugu

SEQ ID NO: 789877 - RNA, 21 nt, Human
ucagagaauggccuacucuca

SEQ ID NO: 789878 - RNA, 22 nt, Human
ccugugcuuuaggccucaaacu

SEQ ID NO: 789879 - RNA, 22 nt, Human
ccugcugcuaugaaggugacag

SEQ ID NO: 789880 - RNA, 22 nt, Human
ccaaauuaaaucauacagacag

SEQ ID NO: 789881 - RNA, 22 nt, Human
gagaaccucuccacaagucugg

SEQ ID NO: 789882 - RNA, 19 nt, Human
uuucugcagcccagcagca

SEQ ID NO: 789883 - RNA, 22 nt, Human
ccuagccuucggccuacccauc

SEQ ID NO: 789884 - RNA, 19 nt, Human
agcagcuggagguggagug

SEQ ID NO: 789885 - RNA, 18 nt, Human
uggcaggggcaguacgcc

SEQ ID NO: 789886 - RNA, 22 nt, Human
gguucccggaucuccgaguccc

SEQ ID NO: 789887 - RNA, 22 nt, Human
uucacauuugaaaggaaagaua

SEQ ID NO: 789888 - RNA, 22 nt, Human
aguuucauugagauguuugcua

SEQ ID NO: 789889 - RNA, 22 nt, Human
aaagguuuuuauuuauccugga

SEQ ID NO: 789890 - RNA, 22 nt, Human
uggccucuuaggacauccucua

SEQ ID NO: 789891 - RNA, 22 nt, Human
caggcuggagugaguguagugg

SEQ ID NO: 789892 - RNA, 22 nt, Human
aacacauaggcagagcaugaca

SEQ ID NO: 789893 - RNA, 22 nt, Human
cugcuuauggagaugaguaaga

SEQ ID NO: 789894 - RNA, 22 nt, Human
ggcuggccagggcccucgcugg

SEQ ID NO: 789895 - RNA, 22 nt, Human
gcagccuguuguaccagccugu

SEQ ID NO: 789896 - RNA, 21 nt, Human
ucacauuucucauggguaaau

SEQ ID NO: 789897 - RNA, 22 nt, Human
uuacaaaguucugaguucaaac

SEQ ID NO: 789898 - RNA, 22 nt, Human
gaagcaaguggccugauucaga

SEQ ID NO: 789899 - RNA, 22 nt, Human
cauacauugcucauucaguauc

SEQ ID NO: 789900 - RNA, 22 nt, Human
ccucaggggugcccacagcugc

SEQ ID NO: 789901 - RNA, 22 nt, Human
uuaaaagagcagcccagcauau

SEQ ID NO: 789902 - RNA, 22 nt, Human
aauguacaucucaguguaguac

SEQ ID NO: 789903 - RNA, 22 nt, Human
ggcaggcuugguggcaccgguu

SEQ ID NO: 789904 - RNA, 22 nt, Human
guuccaauuccaaauuccaagg

SEQ ID NO: 789905 - RNA, 22 nt, Human
caagaaucuugcagcuuagacu

SEQ ID NO: 789906 - RNA, 22 nt, Human
cccucccugugugccucauuug

SEQ ID NO: 789907 - RNA, 20 nt, Human
ggcucuggaaucuggugggc

SEQ ID NO: 789908 - RNA, 22 nt, Human
auauuguugacuauaagaguaa

SEQ ID NO: 789909 - RNA, 22 nt, Human
aguuuucaguaaauauuaguga

SEQ ID NO: 789910 - RNA, 22 nt, Human
uuuuccaccuucuagagauugu

SEQ ID NO: 789911 - RNA, 22 nt, Human
ggcucuggugcccuggcuccca

SEQ ID NO: 789912 - RNA, 18 nt, Human
ugagaaacugacacaugg

SEQ ID NO: 789913 - RNA, 22 nt, Human
agcaggcacuaugccaggaucu

SEQ ID NO: 789914 - RNA, 20 nt, Human
ucaugaagccuacaaacauc

SEQ ID NO: 789915 - RNA, 22 nt, Human
ugaguugaaagacugacuucug

SEQ ID NO: 789916 - RNA, 22 nt, Human
uuucacauaugguuguugauug

SEQ ID NO: 789917 - RNA, 20 nt, Human
ugcugaggccugaggccugg

SEQ ID NO: 789918 - RNA, 21 nt, Human
ugcagcagaguaagcagggga

SEQ ID NO: 789919 - RNA, 22 nt, Human
gcugcaggcuguggcaggggag

SEQ ID NO: 789920 - RNA, 22 nt, Human
cccuuccugggugucccggagu

SEQ ID NO: 789921 - RNA, 22 nt, Human
guggugaagcauugagaaguca

SEQ ID NO: 789922 - RNA, 22 nt, Human
caccacuguaucccuagcacuu

SEQ ID NO: 789923 - RNA, 22 nt, Human
uuuccaaaggaggaaccaguuu

SEQ ID NO: 789924 - RNA, 22 nt, Human
uggcccugccgccacgacgucu

SEQ ID NO: 789925 - RNA, 22 nt, Human
uguuucugucuguuuucuacau

SEQ ID NO: 789926 - RNA, 23 nt, Human
uagugucauccucagcuucuguu

SEQ ID NO: 789927 - RNA, 22 nt, Human
uccagagaacgaugaaagcugg

SEQ ID NO: 789928 - RNA, 22 nt, Human
caagucauuguuuagucauguu

SEQ ID NO: 789929 - RNA, 22 nt, Human
accacacuggcuagugaagaag

SEQ ID NO: 789930 - RNA, 22 nt, Human
gaggacugcagaugggugcauc

SEQ ID NO: 789931 - RNA, 22 nt, Human
caauaacugcuaaauucccugu

SEQ ID NO: 789932 - RNA, 22 nt, Human
augcaacaaaugcuacgaaucg

SEQ ID NO: 789933 - RNA, 22 nt, Human
uuuccaaaaguuuguucugugc

SEQ ID NO: 789934 - RNA, 22 nt, Human
aaaguuuauuuucccugguuag

SEQ ID NO: 789935 - RNA, 22 nt, Human
ugugcccagacugccucaguga

SEQ ID NO: 789936 - RNA, 22 nt, Human
aauugucuuuaucacaguucaa

SEQ ID NO: 789937 - RNA, 19 nt, Human
aagcaauguugugaaucua

SEQ ID NO: 789938 - RNA, 23 nt, Human
uuguuucuuuguauugucucuau

SEQ ID NO: 789939 - RNA, 22 nt, Human
gcaauaaauaacauggaagaca

SEQ ID NO: 789940 - RNA, 22 nt, Human
aucugaagggaaguggaaggca

SEQ ID NO: 789941 - RNA, 22 nt, Human
aaggauauuuggcuacagaagc

SEQ ID NO: 789942 - RNA, 19 nt, Human
uuuagcuuacguuucauug

SEQ ID NO: 789943 - RNA, 20 nt, Human
uucccuggaaggagaagcag

SEQ ID NO: 789944 - RNA, 22 nt, Human
caauuauauuuagaaugauaca

SEQ ID NO: 789945 - RNA, 22 nt, Human
cauuuauucagcucagucgguu

SEQ ID NO: 789946 - RNA, 22 nt, Human
gugaggcagggaaagaggauaa

SEQ ID NO: 789947 - RNA, 22 nt, Human
caaaagcaaagucccugaaugu

SEQ ID NO: 789948 - RNA, 22 nt, Human
auauucauugaacaccuacuac

SEQ ID NO: 789949 - RNA, 22 nt, Human
acaagcagaagguggggucuua

SEQ ID NO: 789950 - RNA, 22 nt, Human
uauagcaaggacauaauaugcu

SEQ ID NO: 789951 - RNA, 22 nt, Human
uuagugaguuaaguguccugag

SEQ ID NO: 789952 - RNA, 22 nt, Human
guguuucuugcacuccccggac

SEQ ID NO: 789953 - RNA, 22 nt, Human
cagcugagcaucacuagucugg

SEQ ID NO: 789954 - RNA, 22 nt, Human
ucccugaaucucgaacuagccu

SEQ ID NO: 789955 - RNA, 22 nt, Human
accacaguaugaaaucugaaau

SEQ ID NO: 789956 - RNA, 23 nt, Human
uggggccaagugaggaagggucu

SEQ ID NO: 789957 - RNA, 22 nt, Human
uguggcaguaaaauugggcaac

SEQ ID NO: 789958 - RNA, 22 nt, Human
uuuaauuuucugggcccagcag

SEQ ID NO: 789959 - RNA, 22 nt, Human
uuggcucugugucuccacucaa

SEQ ID NO: 789960 - RNA, 20 nt, Human
cccugagaccagagagcagc

SEQ ID NO: 789961 - RNA, 22 nt, Human
aauucacaauuauguugggaga

SEQ ID NO: 789962 - RNA, 22 nt, Human
uucuuacaucaguuuauuuugu

SEQ ID NO: 789963 - RNA, 22 nt, Human
uguauauaagcauuuacuuguu

SEQ ID NO: 789964 - RNA, 22 nt, Human
ucauacaaggaggguguucaaa

SEQ ID NO: 789965 - RNA, 22 nt, Human
gcagggacagggcagggccuuu

SEQ ID NO: 789966 - RNA, 22 nt, Human
uuggcccacaguaccaugcugu

SEQ ID NO: 789967 - RNA, 22 nt, Human
cugagcugcggcaggcaccugg

SEQ ID NO: 789968 - RNA, 22 nt, Human
aaggcuggucagauguggugaa

SEQ ID NO: 789969 - RNA, 22 nt, Human
uggagaggagcaccauggccau

SEQ ID NO: 789970 - RNA, 19 nt, Human
ggaguggguaguuaguggu

SEQ ID NO: 789971 - RNA, 22 nt, Human
uucagaguacacagagaucuuc

SEQ ID NO: 789972 - RNA, 22 nt, Human
acccagccuacaaagcucaccu

SEQ ID NO: 789973 - RNA, 22 nt, Human
ggaccaggccagccucccugcg

SEQ ID NO: 789974 - RNA, 22 nt, Human
uggggccacacaucucuuucua

SEQ ID NO: 789975 - RNA, 22 nt, Human
agccugggcaacaacacagcga

SEQ ID NO: 789976 - RNA, 22 nt, Human
agcugcuaugacaacaccagcc

SEQ ID NO: 789977 - RNA, 22 nt, Human
cacagaacauccuuagcucaug

SEQ ID NO: 789978 - RNA, 22 nt, Human
agaaaauauucauugagaggcu

SEQ ID NO: 789979 - RNA, 22 nt, Human
gggugcagcagagcuccucugu

SEQ ID NO: 789980 - RNA, 22 nt, Human
cuggggcuggugaggcaggcuc

SEQ ID NO: 789981 - RNA, 22 nt, Human
aaagucugaaagauaagaguga

SEQ ID NO: 789982 - RNA, 22 nt, Human
uggcccagugcuuaugcucuga

SEQ ID NO: 789983 - RNA, 22 nt, Human
auuauucauugguaggcaagcu

SEQ ID NO: 789984 - RNA, 22 nt, Human
guuauuaaaguauuugauguua

SEQ ID NO: 789985 - RNA, 22 nt, Human
uuauaaagauuguuauguaucu

SEQ ID NO: 789986 - RNA, 22 nt, Human
cagcccugugcggagggcccug

SEQ ID NO: 789987 - RNA, 22 nt, Human
ugugagucuaggucaggguguu

SEQ ID NO: 789988 - RNA, 22 nt, Human
aaaagacaucuauuucaggcag

SEQ ID NO: 789989 - RNA, 18 nt, Human
gaguguggcacugggccc

SEQ ID NO: 789990 - RNA, 22 nt, Human
ucaguucugcuagaaaaacagu

SEQ ID NO: 789991 - RNA, 23 nt, Human
aaagugcaguugaggaaucauag

SEQ ID NO: 789992 - RNA, 22 nt, Human
cugccaggauucugugaacccc

SEQ ID NO: 789993 - RNA, 22 nt, Human
uucauuacugaauucucacuac

SEQ ID NO: 789994 - RNA, 22 nt, Human
cagggacccgcacagguagcau

SEQ ID NO: 789995 - RNA, 22 nt, Human
aaaaggcauuuugucaaccaua

SEQ ID NO: 789996 - RNA, 22 nt, Human
aguauacauauauuagccuucg

SEQ ID NO: 789997 - RNA, 22 nt, Human
ccaccagcuucagcagccgcgg

SEQ ID NO: 789998 - RNA, 22 nt, Human
cuuugaaaaaugguuuccuaga

SEQ ID NO: 789999 - RNA, 22 nt, Human
auuugcaauuuuacuuugcagu

SEQ ID NO: 790000 - RNA, 22 nt, Human
acuggcaguagagggagcgcau

SEQ ID NO: 790001 - RNA, 21 nt, Human
gccaccccuggcacaggugcu

SEQ ID NO: 790002 - RNA, 22 nt, Human
ucuauucaggcagagugcagca

SEQ ID NO: 790003 - RNA, 22 nt, Human
auucuuacaaagcagagucugu

SEQ ID NO: 790004 - RNA, 22 nt, Human
cagugaggaguccagggcagag

SEQ ID NO: 790005 - RNA, 22 nt, Human
uuucacauauaggggaagcuac

SEQ ID NO: 790006 - RNA, 22 nt, Human
uuaugcuaguugaaauaacaca

SEQ ID NO: 790007 - RNA, 18 nt, Human
uaaaccuuucuuguggca

SEQ ID NO: 790008 - RNA, 22 nt, Human
agcauggggcaaugcaugugcu

SEQ ID NO: 790009 - RNA, 22 nt, Human
cccuccuuaccaccacagcucc

SEQ ID NO: 790010 - RNA, 22 nt, Human
aggucaagauucuacauuugua

SEQ ID NO: 790011 - RNA, 22 nt, Human
uggcucagcgguggcagcagac

SEQ ID NO: 790012 - RNA, 22 nt, Human
ucacuggguaggacaugcugau

SEQ ID NO: 790013 - RNA, 22 nt, Human
uguucucucuggcugccaguac

SEQ ID NO: 790014 - RNA, 23 nt, Human
cagaaagcccuuuccccacagua

SEQ ID NO: 790015 - RNA, 22 nt, Human
caauuucaauacaaaauacauu

SEQ ID NO: 790016 - RNA, 22 nt, Human
cuggacaggaagaauugggagc

SEQ ID NO: 790017 - RNA, 22 nt, Human
cccucugcaggcuggaccugcc

SEQ ID NO: 790018 - RNA, 22 nt, Human
cuggccuggcagggagggcaug

SEQ ID NO: 790019 - RNA, 22 nt, Human
uggcuggagcgcccuccucugc

SEQ ID NO: 790020 - RNA, 22 nt, Human
uuacaaacaagaucuuauucuu

SEQ ID NO: 790021 - RNA, 22 nt, Human
acuaggggcucaggcccaggga

SEQ ID NO: 790022 - RNA, 22 nt, Human
cacugucugcuucgacucuuca

SEQ ID NO: 790023 - RNA, 21 nt, Human
cuggagucauuuucugaguag

SEQ ID NO: 790024 - RNA, 22 nt, Human
aaucuaagccaccaguaguuuc

SEQ ID NO: 790025 - RNA, 22 nt, Human
agauaaauuccuaagauuucag

SEQ ID NO: 790026 - RNA, 22 nt, Human
aaagugcagaacuguucucacu

SEQ ID NO: 790027 - RNA, 22 nt, Human
auugagaauauugugacagugu

SEQ ID NO: 790028 - RNA, 22 nt, Human
acugggguuuaggccugggcaa

SEQ ID NO: 790029 - RNA, 22 nt, Human
cacaggaaggccuucucacaau

SEQ ID NO: 790030 - RNA, 22 nt, Human
uagucucuaggaggggaaaaga

SEQ ID NO: 790031 - RNA, 22 nt, Human
aaagauuaggcggcaacugggc

SEQ ID NO: 790032 - RNA, 22 nt, Human
uucucaggaacucagugucagc

SEQ ID NO: 790033 - RNA, 22 nt, Human
guuucugaagggauuacuuggu

SEQ ID NO: 790034 - RNA, 22 nt, Human
augcaacaccccuauggaugga

SEQ ID NO: 790035 - RNA, 22 nt, Human
auggagugucaccuuccugguu

SEQ ID NO: 790036 - RNA, 22 nt, Human
uauaucuaggaacccugagauu

SEQ ID NO: 790037 - RNA, 22 nt, Human
gggaggaggaauguuuugugua

SEQ ID NO: 790038 - RNA, 22 nt, Human
uccugggcuucacagacucugu

SEQ ID NO: 790039 - RNA, 22 nt, Human
aaucagaaauucuacaucacaa

SEQ ID NO: 790040 - RNA, 22 nt, Human
agggggcaggagagaccugcug

SEQ ID NO: 790041 - RNA, 22 nt, Human
caaugucaaggagaccaaaacg

SEQ ID NO: 790042 - RNA, 22 nt, Human
uguuuauugcugcaauugugcc

SEQ ID NO: 790043 - RNA, 22 nt, Human
gcugccuccacuggcucccagu

SEQ ID NO: 790044 - RNA, 22 nt, Human
gccaccucucucuugacucgag

SEQ ID NO: 790045 - RNA, 19 nt, Human
gcuuccagcacugcaggag

SEQ ID NO: 790046 - RNA, 22 nt, Human
acacaguugguggcucagucug

SEQ ID NO: 790047 - RNA, 22 nt, Human
uccucugccccagaugaaauuu

SEQ ID NO: 790048 - RNA, 22 nt, Human
aguuuacaacaguagcuaugga

SEQ ID NO: 790049 - RNA, 22 nt, Human
cagcugccuaugaccuagccuc

SEQ ID NO: 790050 - RNA, 22 nt, Human
caugaaugcuggguucauguaa

SEQ ID NO: 790051 - RNA, 22 nt, Human
uucaguauacauuaucuaauug

SEQ ID NO: 790052 - RNA, 22 nt, Human
aaaguucugagaagcaguuuac

SEQ ID NO: 790053 - RNA, 22 nt, Human
aagcaauuguccugucucuaca

SEQ ID NO: 790054 - RNA, 22 nt, Human
cugagggcuggagcugaggccu

SEQ ID NO: 790055 - RNA, 22 nt, Human
uuugggaagaggaaucucugga

SEQ ID NO: 790056 - RNA, 22 nt, Human
uuacaaagauuauauucaguua

SEQ ID NO: 790057 - RNA, 22 nt, Human
cuuaaaaucuggcaguuagcua

SEQ ID NO: 790058 - RNA, 22 nt, Human
uaaaggccagggccugagugcu

SEQ ID NO: 790059 - RNA, 19 nt, Human
agcacagacaagaccagca

SEQ ID NO: 790060 - RNA, 22 nt, Human
gccucugcacuguggcacacca

SEQ ID NO: 790061 - RNA, 21 nt, Human
ugucuuuggccucauucccag

SEQ ID NO: 790062 - RNA, 19 nt, Human
ccagcagguucauuucagg

SEQ ID NO: 790063 - RNA, 22 nt, Human
accaguuuaauaacugcucaag

SEQ ID NO: 790064 - RNA, 22 nt, Human
aaacacauuuuaggaaaaucua

SEQ ID NO: 790065 - RNA, 22 nt, Human
gucuccagcccacucuagauau

SEQ ID NO: 790066 - RNA, 22 nt, Human
ucacaagacugagcuugcuuga

SEQ ID NO: 790067 - RNA, 22 nt, Human
ggucauuuucacuuucaaguua

SEQ ID NO: 790068 - RNA, 22 nt, Human
agcucuuugagcaaggcagcuc

SEQ ID NO: 790069 - RNA, 22 nt, Human
aaggccagagcguguccugccu

SEQ ID NO: 790070 - RNA, 22 nt, Human
uguccaggacccuauucucacu

SEQ ID NO: 790071 - RNA, 22 nt, Human
ugggugaggaugaugaggcagc

SEQ ID NO: 790072 - RNA, 22 nt, Human
ugcuggcugccagguucccugu

SEQ ID NO: 790073 - RNA, 22 nt, Human
cuucaaaucccccugaguuuga

SEQ ID NO: 790074 - RNA, 22 nt, Human
gcccaaggucccauggcagcac

SEQ ID NO: 790075 - RNA, 21 nt, Human
cagagguggccugaccucuga

SEQ ID NO: 790076 - RNA, 22 nt, Human
auucacauucuagggcccuacu

SEQ ID NO: 790077 - RNA, 22 nt, Human
uuuccucugucaugacagcuga

SEQ ID NO: 790078 - RNA, 22 nt, Human
gugggggacccaggugcugucc

SEQ ID NO: 790079 - RNA, 22 nt, Human
gcucacaucauaguaagcucau

SEQ ID NO: 790080 - RNA, 22 nt, Human
ggcagaggaggggugaauuugc

SEQ ID NO: 790081 - RNA, 22 nt, Human
cccaaccagaaauugacagaca

SEQ ID NO: 790082 - RNA, 23 nt, Human
agucugaauugagaugugcugug

SEQ ID NO: 790083 - RNA, 22 nt, Human
aaguuuguggucauuuauuaua

SEQ ID NO: 790084 - RNA, 22 nt, Human
gauagaaagaauauagauucca

SEQ ID NO: 790085 - RNA, 22 nt, Human
ucuuuguuugccuuuaucaaga

SEQ ID NO: 790086 - RNA, 20 nt, Human
ccuggcuuugcagcaugaga

SEQ ID NO: 790087 - RNA, 22 nt, Human
ucuuuucauugagaacacacug

SEQ ID NO: 790088 - RNA, 22 nt, Human
agggcagcauugccuuucucca

SEQ ID NO: 790089 - RNA, 22 nt, Human
auggcccaggcaggcugguacu

SEQ ID NO: 790090 - RNA, 22 nt, Human
uccuagccuggugagaaacugu

SEQ ID NO: 790091 - RNA, 22 nt, Human
ugggggagccuucacaguagcu

SEQ ID NO: 790092 - RNA, 22 nt, Human
uuacauaacgguaugaaaaaug

SEQ ID NO: 790093 - RNA, 22 nt, Human
ccagcuguaggcaggggguuua

SEQ ID NO: 790094 - RNA, 22 nt, Human
aucuacagugcacaggacagcc

SEQ ID NO: 790095 - RNA, 22 nt, Human
auuguauuuccagcuugaaugu

SEQ ID NO: 790096 - RNA, 22 nt, Human
caggaugguggcaugaucagaa

SEQ ID NO: 790097 - RNA, 22 nt, Human
ccuuuggcauuuugaggaugcg

SEQ ID NO: 790098 - RNA, 22 nt, Human
aagacaauuuugaguaugcaca

SEQ ID NO: 790099 - RNA, 22 nt, Human
agacccagaaagcagcugcauu

SEQ ID NO: 790100 - RNA, 22 nt, Human
cugccuguggucugugaucuaa

SEQ ID NO: 790101 - RNA, 22 nt, Human
caggagugucuccacacagcaa

SEQ ID NO: 790102 - RNA, 22 nt, Human
agucuggguggcugagcuacag

SEQ ID NO: 790103 - RNA, 22 nt, Human
agcagggccucuggcacugguc

SEQ ID NO: 790104 - RNA, 17 nt, Human
uggcccuagacuccagc

SEQ ID NO: 790105 - RNA, 22 nt, Human
agcagcccaaacagacuaagac

SEQ ID NO: 790106 - RNA, 22 nt, Human
uucaaagauaauguagcauuuu

SEQ ID NO: 790107 - RNA, 23 nt, Human
gcugauggagacuuguggccucc

SEQ ID NO: 790108 - RNA, 22 nt, Human
aaggacagaaacagauugcugg

SEQ ID NO: 790109 - RNA, 22 nt, Human
ccuggcugacagcuuaauucca

SEQ ID NO: 790110 - RNA, 22 nt, Human
cauuaauauuguucuucuuuag

SEQ ID NO: 790111 - RNA, 22 nt, Human
acuuguguuaccaagguuuggu

SEQ ID NO: 790112 - RNA, 22 nt, Human
ccaggagcagccggcccaccug

SEQ ID NO: 790113 - RNA, 22 nt, Human
uggugggcacagugcccaggcu

SEQ ID NO: 790114 - RNA, 22 nt, Human
ugaaguuuucugguugauuaag

SEQ ID NO: 790115 - RNA, 19 nt, Human
ggcucagggcgcugccgcc

SEQ ID NO: 790116 - RNA, 22 nt, Human
caagaaacaccaaugacugcug

SEQ ID NO: 790117 - RNA, 20 nt, Human
cugcucugcuuugcaggugg

SEQ ID NO: 790118 - RNA, 22 nt, Human
auauccuuuacugugucacaga

SEQ ID NO: 790119 - RNA, 22 nt, Human
acaggcauccaggacuaggccu

SEQ ID NO: 790120 - RNA, 22 nt, Human
cuggaggaccccugccuggaag

SEQ ID NO: 790121 - RNA, 22 nt, Human
gcuuucuaaucuauuuccuuac

SEQ ID NO: 790122 - RNA, 22 nt, Human
uucaauuugugcuaaggcaccg

SEQ ID NO: 790123 - RNA, 21 nt, Human
uucaaaaugguguguuugucu

SEQ ID NO: 790124 - RNA, 22 nt, Human
aaaguacaugcaauucuucuga

SEQ ID NO: 790125 - RNA, 19 nt, Human
gagguggguccccgcagcc

SEQ ID NO: 790126 - RNA, 22 nt, Human
aaauguguuccuuugcuacaga

SEQ ID NO: 790127 - RNA, 22 nt, Human
ggccucagaccggagcuggcca

SEQ ID NO: 790128 - RNA, 22 nt, Human
aggucaaggcugcagugagcug

SEQ ID NO: 790129 - RNA, 22 nt, Human
agaaguggucugucuuccagau

SEQ ID NO: 790130 - RNA, 22 nt, Human
uugcagcuucuaccacuguuuc

SEQ ID NO: 790131 - RNA, 22 nt, Human
cccacagguggaagccucggaa

SEQ ID NO: 790132 - RNA, 22 nt, Human
ggccagggggcuucagacucca

SEQ ID NO: 790133 - RNA, 22 nt, Human
uaugcauugugagacuguggga

SEQ ID NO: 790134 - RNA, 22 nt, Human
gauauuuugagaaauccuauga

SEQ ID NO: 790135 - RNA, 22 nt, Human
uacauacauauucauacaggug

SEQ ID NO: 790136 - RNA, 22 nt, Human
gauagauaaaacuauauuuuca

SEQ ID NO: 790137 - RNA, 22 nt, Human
ggcagccuugagggaggccugg

SEQ ID NO: 790138 - RNA, 19 nt, Human
ggaaggccacggcaggcuu

SEQ ID NO: 790139 - RNA, 22 nt, Human
uucauugauuccaggcucuucu

SEQ ID NO: 790140 - RNA, 22 nt, Human
aauucauacucuauauugcuuu

SEQ ID NO: 790141 - RNA, 22 nt, Human
ccaggcuggucugaauuucuag

SEQ ID NO: 790142 - RNA, 22 nt, Human
gcaccaggcagcugagcaggcc

SEQ ID NO: 790143 - RNA, 20 nt, Human
gcugugccuccagcuggugg

SEQ ID NO: 790144 - RNA, 23 nt, Human
ucuggcugcuccuuucaaugcuc

SEQ ID NO: 790145 - RNA, 22 nt, Human
gucauugcaguggcaaaucaca

SEQ ID NO: 790146 - RNA, 23 nt, Human
gcccagagaggcucaccaggaau

SEQ ID NO: 790147 - RNA, 22 nt, Human
auuccacuuuaugucuguauga

SEQ ID NO: 790148 - RNA, 22 nt, Human
uucaugaauauauugaauuagc

SEQ ID NO: 790149 - RNA, 22 nt, Human
ccuccuggcuuuucccauugaa

SEQ ID NO: 790150 - RNA, 22 nt, Human
augcagcuuccauauuuugcug

SEQ ID NO: 790151 - RNA, 22 nt, Human
agaaucagugagcaguugugau

SEQ ID NO: 790152 - RNA, 22 nt, Human
ucccugggagaugaugaugagg

SEQ ID NO: 790153 - RNA, 21 nt, Human
caguggcacgauuucggcuca

SEQ ID NO: 790154 - RNA, 22 nt, Human
ugaaggccagggauuugcagcc

SEQ ID NO: 790155 - RNA, 22 nt, Human
agguggugaugacagaagacag

SEQ ID NO: 790156 - RNA, 18 nt, Human
uauaaacacacuuagguu

SEQ ID NO: 790157 - RNA, 22 nt, Human
acuugaauuaggccuugagaga

SEQ ID NO: 790158 - RNA, 22 nt, Human
uuucuuauacuauauugucauc

SEQ ID NO: 790159 - RNA, 22 nt, Human
gacuggaaagccuguccucaga

SEQ ID NO: 790160 - RNA, 22 nt, Human
ucaccuuagcuagaggaagaga

SEQ ID NO: 790161 - RNA, 19 nt, Human
ggcagaagguguaggggga

SEQ ID NO: 790162 - RNA, 22 nt, Human
ggccagcucaggguccuugggc

SEQ ID NO: 790163 - RNA, 22 nt, Human
agacaggagagggaacugccgg

SEQ ID NO: 790164 - RNA, 20 nt, Human
ucaggaugugcugagugaag

SEQ ID NO: 790165 - RNA, 22 nt, Human
caaagugcuaggauuacaggcc

SEQ ID NO: 790166 - RNA, 22 nt, Human
gcuggcugccugguuaugccuu

SEQ ID NO: 790167 - RNA, 22 nt, Human
cugccagggcccuacucaguuu

SEQ ID NO: 790168 - RNA, 20 nt, Human
cacaagagaauacacacugg

SEQ ID NO: 790169 - RNA, 22 nt, Human
acuggcugccuccaaagugugc

SEQ ID NO: 790170 - RNA, 22 nt, Human
gccaguggcccucuggagaagg

SEQ ID NO: 790171 - RNA, 22 nt, Human
uucacauaaugauacaaagcuu

SEQ ID NO: 790172 - RNA, 22 nt, Human
ugaagaugucagcagggguggu

SEQ ID NO: 790173 - RNA, 22 nt, Human
ccuggcagcgccgaagcuggcc

SEQ ID NO: 790174 - RNA, 22 nt, Human
cauuucugucacguucuuuuau

SEQ ID NO: 790175 - RNA, 22 nt, Human
cuagggaguggcagagcuggga

SEQ ID NO: 790176 - RNA, 22 nt, Human
augauuuaaagucauugugaac

SEQ ID NO: 790177 - RNA, 22 nt, Human
ucauuuuucacacagggucacc

SEQ ID NO: 790178 - RNA, 22 nt, Human
uuagaaaaaacgucuucuagug

SEQ ID NO: 790179 - RNA, 22 nt, Human
ugcaguggaggccgugagacag

SEQ ID NO: 790180 - RNA, 22 nt, Human
aguuuucuucauuuuguggcca

SEQ ID NO: 790181 - RNA, 22 nt, Human
auguuucagauacagaucaaau

SEQ ID NO: 790182 - RNA, 22 nt, Human
ggcagccccagaaacaguucag

SEQ ID NO: 790183 - RNA, 21 nt, Human
acaugggaccugcgaaaggaa

SEQ ID NO: 790184 - RNA, 22 nt, Human
agccaagaaucaugagcuaaua

SEQ ID NO: 790185 - RNA, 22 nt, Human
cugcccacuuggccaccuucua

SEQ ID NO: 790186 - RNA, 22 nt, Human
ggcucuuuaacuugucuaaauu

SEQ ID NO: 790187 - RNA, 22 nt, Human
ccacugccaugggcuaggcaug

SEQ ID NO: 790188 - RNA, 22 nt, Human
gcugcaaguccuucccucucuu

SEQ ID NO: 790189 - RNA, 22 nt, Human
agugucaaguacaugguaguga

SEQ ID NO: 790190 - RNA, 22 nt, Human
cagugcagaggccagggaggau

SEQ ID NO: 790191 - RNA, 22 nt, Human
aaaggccagguuggcugguauu

SEQ ID NO: 790192 - RNA, 22 nt, Human
ccagggcugcugugggacucca

SEQ ID NO: 790193 - RNA, 22 nt, Human
ucuggcauggauuugagugucu

SEQ ID NO: 790194 - RNA, 22 nt, Human
uuuucaguuugcacugcagugc

SEQ ID NO: 790195 - RNA, 22 nt, Human
ucagauaaaggagagcuuagca

SEQ ID NO: 790196 - RNA, 22 nt, Human
augcugagauaaggcuuuaguc

SEQ ID NO: 790197 - RNA, 22 nt, Human
acuggagugaguaucgaugaac

SEQ ID NO: 790198 - RNA, 22 nt, Human
cuggcagcgguuugcagccugg

SEQ ID NO: 790199 - RNA, 22 nt, Human
cuggcaggcggcagagcccagg

SEQ ID NO: 790200 - RNA, 22 nt, Human
auuuaccauauguacugaguau

SEQ ID NO: 790201 - RNA, 22 nt, Human
cugcacacaucgcacugcccgu

SEQ ID NO: 790202 - RNA, 22 nt, Human
cagcagcaaggugaggguggag

SEQ ID NO: 790203 - RNA, 21 nt, Human
uuacuuuagaaauugccuuuu

SEQ ID NO: 790204 - RNA, 22 nt, Human
gggcuggauguuugaugacgaa

SEQ ID NO: 790205 - RNA, 22 nt, Human
ccauguuggaacuucacauucu

SEQ ID NO: 790206 - RNA, 22 nt, Human
uggcccugguggcacagccugc

SEQ ID NO: 790207 - RNA, 22 nt, Human
ggaacagggauuuggccugguu

SEQ ID NO: 790208 - RNA, 22 nt, Human
guauuauugucaugaaauaaua

SEQ ID NO: 790209 - RNA, 22 nt, Human
ggagccccaauugagcaguacg

SEQ ID NO: 790210 - RNA, 19 nt, Human
ugaggccagcuggcauuuu

SEQ ID NO: 790211 - RNA, 22 nt, Human
ucuucaaaaacugcaccuugcu

SEQ ID NO: 790212 - RNA, 22 nt, Human
auccuaaagaaauauuuauuaa

SEQ ID NO: 790213 - RNA, 22 nt, Human
guguuuuaucagacaaaguaua

SEQ ID NO: 790214 - RNA, 21 nt, Human
cuggacugaggagacagucgc

SEQ ID NO: 790215 - RNA, 22 nt, Human
agcuggggcugcagagaacagg

SEQ ID NO: 790216 - RNA, 20 nt, Human
ucucuggccagaaacaacag

SEQ ID NO: 790217 - RNA, 22 nt, Human
aggacuggcagugugagggguc

SEQ ID NO: 790218 - RNA, 22 nt, Human
auugagaaucugagagccuagg

SEQ ID NO: 790219 - RNA, 18 nt, Human
ucaggagacacagacgca

SEQ ID NO: 790220 - RNA, 22 nt, Human
acaggcagggaccuuggcuaag

SEQ ID NO: 790221 - RNA, 22 nt, Human
aggcugccucuuuugagagggu

SEQ ID NO: 790222 - RNA, 17 nt, Human
ugaggccauggcaccau

SEQ ID NO: 790223 - RNA, 22 nt, Human
gucccuggggaaucagcuggag

SEQ ID NO: 790224 - RNA, 22 nt, Human
aauaacagaaacuugagcauca

SEQ ID NO: 790225 - RNA, 22 nt, Human
aucauucuagcuguuguguuga

SEQ ID NO: 790226 - RNA, 22 nt, Human
aaaucagacacagugaaaguua

SEQ ID NO: 790227 - RNA, 22 nt, Human
cccagacauaacagcagagagg

SEQ ID NO: 790228 - RNA, 22 nt, Human
uaacagugaccugaaugucaau

SEQ ID NO: 790229 - RNA, 22 nt, Human
gaggcucccaaggggcuaggcc

SEQ ID NO: 790230 - RNA, 22 nt, Human
cccaggaaauagccaggaggug

SEQ ID NO: 790231 - RNA, 19 nt, Human
uccagccugcuguuucucu

SEQ ID NO: 790232 - RNA, 22 nt, Human
agugcauugcaucucugcuuca

SEQ ID NO: 790233 - RNA, 22 nt, Human
cucuugcaucuguuguauuggu

SEQ ID NO: 790234 - RNA, 22 nt, Human
ugucucuucugccuccagcugu

SEQ ID NO: 790235 - RNA, 22 nt, Human
uggagugggcaauguaggcaag

SEQ ID NO: 790236 - RNA, 22 nt, Human
caggcccaggggucuggcccac

SEQ ID NO: 790237 - RNA, 22 nt, Human
uagcuuaauaugaaacacauaa

SEQ ID NO: 790238 - RNA, 22 nt, Human
cugggagaucuccugagggcag

SEQ ID NO: 790239 - RNA, 22 nt, Human
cuccaguggugauggggaagaa

SEQ ID NO: 790240 - RNA, 22 nt, Human
uagagucagagaaucauuacag

SEQ ID NO: 790241 - RNA, 22 nt, Human
cacucccucuaguugcauucug

SEQ ID NO: 790242 - RNA, 22 nt, Human
acuggcagccacaacuggcagg

SEQ ID NO: 790243 - RNA, 20 nt, Human
acuggcugccuggaaugcgc

SEQ ID NO: 790244 - RNA, 22 nt, Human
ccucuggccuaggccgggagag

SEQ ID NO: 790245 - RNA, 22 nt, Human
aagaaaccaacccugccagcac

SEQ ID NO: 790246 - RNA, 22 nt, Human
ccucagacgcaggccuaugggc

SEQ ID NO: 790247 - RNA, 22 nt, Human
gaauuuuagaauaugugggcuu

SEQ ID NO: 790248 - RNA, 22 nt, Human
uuagucaauagugaauauagag

SEQ ID NO: 790249 - RNA, 22 nt, Human
gcuggcagugugaaugacaagc

SEQ ID NO: 790250 - RNA, 22 nt, Human
gaaaauuuaauucucuucugug

SEQ ID NO: 790251 - RNA, 18 nt, Human
cugucuuuuuucucucca

SEQ ID NO: 790252 - RNA, 22 nt, Human
ucauaaagauacuaagugaguu

SEQ ID NO: 790253 - RNA, 22 nt, Human
cuggcagcuuccuuugcaucug

SEQ ID NO: 790254 - RNA, 22 nt, Human
aaacaccagcacuguuuacaaa

SEQ ID NO: 790255 - RNA, 23 nt, Human
augcaagaguuucucaaacugga

SEQ ID NO: 790256 - RNA, 22 nt, Human
gaggccagggaugcaaugagag

SEQ ID NO: 790257 - RNA, 22 nt, Human
gacagacaggaggcauucaggg

SEQ ID NO: 790258 - RNA, 22 nt, Human
uuuuccagauggauacuagaau

SEQ ID NO: 790259 - RNA, 22 nt, Human
aauaaacaaaucuuuccugugg

SEQ ID NO: 790260 - RNA, 22 nt, Human
gcagggcggcccagagcaggcc

SEQ ID NO: 790261 - RNA, 19 nt, Human
uggcagggagaguuugaag

SEQ ID NO: 790262 - RNA, 22 nt, Human
caggcccaggugucgauguucc

SEQ ID NO: 790263 - RNA, 22 nt, Human
cucucaguuuccucaacuguaa

SEQ ID NO: 790264 - RNA, 22 nt, Human
gauauacagagcauucuuugau

SEQ ID NO: 790265 - RNA, 22 nt, Human
cugcagcugccagugauuucag

SEQ ID NO: 790266 - RNA, 22 nt, Human
cugaggcucccucgggucugcu

SEQ ID NO: 790267 - RNA, 18 nt, Human
uggcagguccagcugugg

SEQ ID NO: 790268 - RNA, 22 nt, Human
aggcagugcagaguccucuucu

SEQ ID NO: 790269 - RNA, 22 nt, Human
ccagcccucacugaggccucuc

SEQ ID NO: 790270 - RNA, 22 nt, Human
uucacagugcugcaccuggcuu

SEQ ID NO: 790271 - RNA, 22 nt, Human
agguuagugcugaaaugacaug

SEQ ID NO: 790272 - RNA, 22 nt, Human
gcugaggcuccucgggaggaca

SEQ ID NO: 790273 - RNA, 22 nt, Human
cccaggguggaugcaagcagca

SEQ ID NO: 790274 - RNA, 22 nt, Human
accagcugaguaggggagggcc

SEQ ID NO: 790275 - RNA, 22 nt, Human
ucacagaaucucugauaagucu

SEQ ID NO: 790276 - RNA, 22 nt, Human
uucaauuuagugauguuguugg

SEQ ID NO: 790277 - RNA, 22 nt, Human
ucacaguucaucugauaaacua

SEQ ID NO: 790278 - RNA, 22 nt, Human
ugcacacaccgugcuucacuga

SEQ ID NO: 790279 - RNA, 22 nt, Human
cucauaaugugacuguauuuga

SEQ ID NO: 790280 - RNA, 23 nt, Human
agcuuccuagugaccuggagucu

SEQ ID NO: 790281 - RNA, 22 nt, Human
ugagauggagccacugcacucu

SEQ ID NO: 790282 - RNA, 22 nt, Human
caguaaaugcagauauagauac

SEQ ID NO: 790283 - RNA, 22 nt, Human
accagccccaccgggacugcag

SEQ ID NO: 790284 - RNA, 22 nt, Human
caggaacccccacucucagcuc

SEQ ID NO: 790285 - RNA, 22 nt, Human
agagcccagucuuugugugaag

SEQ ID NO: 790286 - RNA, 22 nt, Human
auuacaagaugcauccauauuu

SEQ ID NO: 790287 - RNA, 22 nt, Human
uuucccaaugaguccuugagca

SEQ ID NO: 790288 - RNA, 22 nt, Human
ccucucuccuuccuuugccaaa

SEQ ID NO: 790289 - RNA, 22 nt, Human
aacauucuaugugcauucagaa

SEQ ID NO: 790290 - RNA, 20 nt, Human
uaaaugcaugaauguaaggc

SEQ ID NO: 790291 - RNA, 22 nt, Human
gggaagcaucugaggguccacu

SEQ ID NO: 790292 - RNA, 22 nt, Human
ggagccaguuuagaccucaguu

SEQ ID NO: 790293 - RNA, 22 nt, Human
ccuggcugccuuguguugaucu

SEQ ID NO: 790294 - RNA, 22 nt, Human
ccaaggagcaaggcucaacaag

SEQ ID NO: 790295 - RNA, 22 nt, Human
agguuggccucagggaggcucu

SEQ ID NO: 790296 - RNA, 22 nt, Human
uuuggcuugcacuggcaccaac

SEQ ID NO: 790297 - RNA, 22 nt, Human
gcuggggaggcagcagagaaca

SEQ ID NO: 790298 - RNA, 22 nt, Human
gugccuuccccgguggucuguu

SEQ ID NO: 790299 - RNA, 22 nt, Human
uccaggccucuagcccucucuu

SEQ ID NO: 790300 - RNA, 22 nt, Human
ugaggcucugcuucuguggcuc

SEQ ID NO: 790301 - RNA, 22 nt, Human
uggcuuccagaacugagcaaca

SEQ ID NO: 790302 - RNA, 22 nt, Human
ugugugcauguuaaugagaaaa

SEQ ID NO: 790303 - RNA, 22 nt, Human
ucccagggcucuagagugcugg

SEQ ID NO: 790304 - RNA, 22 nt, Human
uucagagaaagcagauuuacuc

SEQ ID NO: 790305 - RNA, 22 nt, Human
gggaggagggugcuggcuaaac

SEQ ID NO: 790306 - RNA, 22 nt, Human
augauacaucuucaugucagug

SEQ ID NO: 790307 - RNA, 22 nt, Human
ccucuggccacaugggacauag

SEQ ID NO: 790308 - RNA, 22 nt, Human
uguuaaaaccacaggugaggac

SEQ ID NO: 790309 - RNA, 22 nt, Human
acaaagcuagagaagagaauug

SEQ ID NO: 790310 - RNA, 22 nt, Human
cauuggaaugaucguuuugcug

SEQ ID NO: 790311 - RNA, 22 nt, Human
aggcuccauaccaucuccggag

SEQ ID NO: 790312 - RNA, 22 nt, Human
guugaugaaaaugaauugcaug

SEQ ID NO: 790313 - RNA, 22 nt, Human
uggcccugcccucuucaucuuu

SEQ ID NO: 790314 - RNA, 22 nt, Human
ugguagggacacuaugcagaaa

SEQ ID NO: 790315 - RNA, 22 nt, Human
auaugcuuacagcuuaaaaucc

SEQ ID NO: 790316 - RNA, 22 nt, Human
uguuaauauacuaaaauccacu

SEQ ID NO: 790317 - RNA, 23 nt, Human
agguagguuauugcugcuaccug

SEQ ID NO: 790318 - RNA, 22 nt, Human
uugcaaauugcaagaguuggau

SEQ ID NO: 790319 - RNA, 22 nt, Human
guucaguguuuuuauugacagg

SEQ ID NO: 790320 - RNA, 22 nt, Human
aggcuuggcuggcagcccuggg

SEQ ID NO: 790321 - RNA, 22 nt, Human
acagcauucaauaaauaauaac

SEQ ID NO: 790322 - RNA, 22 nt, Human
ggagaugcuuuccaguggggau

SEQ ID NO: 790323 - RNA, 22 nt, Human
ccacaggacggaggucuggccg

SEQ ID NO: 790324 - RNA, 22 nt, Human
cuggggccagugaggaggcuuu

SEQ ID NO: 790325 - RNA, 22 nt, Human
ucuccuggcccugucgccaucu

SEQ ID NO: 790326 - RNA, 22 nt, Human
aaacuacugauuugugaauuga

SEQ ID NO: 790327 - RNA, 22 nt, Human
ccugggaguggcacucacagca

SEQ ID NO: 790328 - RNA, 22 nt, Human
ggcucaggggccaggccugucc

SEQ ID NO: 790329 - RNA, 22 nt, Human
auguauuuacugagaaggaaac

SEQ ID NO: 790330 - RNA, 22 nt, Human
cucagugugaaugcucaguaaa

SEQ ID NO: 790331 - RNA, 22 nt, Human
agggccucugagccaguucugg

SEQ ID NO: 790332 - RNA, 22 nt, Human
auacaguaaccacauucuauag

SEQ ID NO: 790333 - RNA, 22 nt, Human
cugcacuguguauuccuuggcu

SEQ ID NO: 790334 - RNA, 22 nt, Human
ucugcagaaggaaucagcugag

SEQ ID NO: 790335 - RNA, 22 nt, Human
auuguauuagcacaauacaauu

SEQ ID NO: 790336 - RNA, 22 nt, Human
aauauuucuggugcuucucacu

SEQ ID NO: 790337 - RNA, 22 nt, Human
gcaccugcuggguguagaggcu

SEQ ID NO: 790338 - RNA, 22 nt, Human
aggccagagaggggaccagccu

SEQ ID NO: 790339 - RNA, 22 nt, Human
cuuuccaaugucacuaugaauc

SEQ ID NO: 790340 - RNA, 22 nt, Human
aaugagauggaauucccgccua

SEQ ID NO: 790341 - RNA, 22 nt, Human
ucuggaguggagcugaucauuu

SEQ ID NO: 790342 - RNA, 22 nt, Human
uggccacacugcccccacuggg

SEQ ID NO: 790343 - RNA, 22 nt, Human
ccucagggacuccaugcugcag

SEQ ID NO: 790344 - RNA, 22 nt, Human
acuggaguagaucugacugagu

SEQ ID NO: 790345 - RNA, 22 nt, Human
cagucccacuagugccaauacc

SEQ ID NO: 790346 - RNA, 22 nt, Human
cugccagguuggcgcucgcucu

SEQ ID NO: 790347 - RNA, 18 nt, Human
ggacacagauagguacag

SEQ ID NO: 790348 - RNA, 22 nt, Human
ccagcuuguuugaagcucguca

SEQ ID NO: 790349 - RNA, 22 nt, Human
auaauaacaaugccagaugccu

SEQ ID NO: 790350 - RNA, 22 nt, Human
gcugaugcaggguugagaggag

SEQ ID NO: 790351 - RNA, 22 nt, Human
uucuggaaggguggaguagcuu

SEQ ID NO: 790352 - RNA, 22 nt, Human
uguaacaguaagccugugagcu

SEQ ID NO: 790353 - RNA, 22 nt, Human
aagaaaacaaugacuugccagc

SEQ ID NO: 790354 - RNA, 22 nt, Human
uguggacauacuaggccuaggc

SEQ ID NO: 790355 - RNA, 22 nt, Human
guggcccagcccuacagaggac

SEQ ID NO: 790356 - RNA, 22 nt, Human
cauuuagaaacuguuuuuaaca

SEQ ID NO: 790357 - RNA, 22 nt, Human
ucacauuuuaguaccaugauuu

SEQ ID NO: 790358 - RNA, 22 nt, Human
uggcugugucaucauagcugug

SEQ ID NO: 790359 - RNA, 22 nt, Human
agaaucacuggaauuguuuuuu

SEQ ID NO: 790360 - RNA, 22 nt, Human
cagcugguuaucagagaggccu

SEQ ID NO: 790361 - RNA, 22 nt, Human
gauggcaccuugaacgcugcgu

SEQ ID NO: 790362 - RNA, 22 nt, Human
gcacggcuaauuuuuguauuuu

SEQ ID NO: 790363 - RNA, 22 nt, Human
uaaugcaguacugauauaaaca

SEQ ID NO: 790364 - RNA, 22 nt, Human
aggcuggcccaccucuugucuu

SEQ ID NO: 790365 - RNA, 22 nt, Human
aaagccaguuugucucuuuaaa

SEQ ID NO: 790366 - RNA, 22 nt, Human
aauaugcaaagcguguuaucug

SEQ ID NO: 790367 - RNA, 22 nt, Human
cugagaguuaagagauggggcu

SEQ ID NO: 790368 - RNA, 22 nt, Human
ggccagcugagcugcugcacag

SEQ ID NO: 790369 - RNA, 22 nt, Human
gccuggucucugggguugggua

SEQ ID NO: 790370 - RNA, 22 nt, Human
ugcccagcacccagcaugaugc

SEQ ID NO: 790371 - RNA, 22 nt, Human
uccagggacagcgcuggagcua

SEQ ID NO: 790372 - RNA, 22 nt, Human
auacuacaaucauaauuguaca

SEQ ID NO: 790373 - RNA, 22 nt, Human
uucauuuggccucugcuuaaaa

SEQ ID NO: 790374 - RNA, 19 nt, Human
aggcagcacccaguccuug

SEQ ID NO: 790375 - RNA, 22 nt, Human
uucagcacuguuauggauuugc

SEQ ID NO: 790376 - RNA, 22 nt, Human
uuuucaguggcuugcauauguu

SEQ ID NO: 790377 - RNA, 22 nt, Human
aggugaaguuaaaaaccagucu

SEQ ID NO: 790378 - RNA, 19 nt, Human
uguuucuuccuccaucuga

SEQ ID NO: 790379 - RNA, 22 nt, Human
caagcagauauuuuagucaaga

SEQ ID NO: 790380 - RNA, 22 nt, Human
gucucccaucguuugugaggaa

SEQ ID NO: 790381 - RNA, 23 nt, Human
ugaaugauuguacugagcuuuua

SEQ ID NO: 790382 - RNA, 22 nt, Human
ucaugcaaauacuguuccagaa

SEQ ID NO: 790383 - RNA, 22 nt, Human
guagaggggugauucugugaga

SEQ ID NO: 790384 - RNA, 22 nt, Human
uccaggcuagguuuacaggaca

SEQ ID NO: 790385 - RNA, 22 nt, Human
gaguccugaauccuguggcaac

SEQ ID NO: 790386 - RNA, 22 nt, Human
aaggaggaauguagccagcucc

SEQ ID NO: 790387 - RNA, 22 nt, Human
ucuggcugacauccuguaugag

SEQ ID NO: 790388 - RNA, 22 nt, Human
acagaagcagcgcggcucuucu

SEQ ID NO: 790389 - RNA, 22 nt, Human
uacaaaguuugagaaugcuuuc

SEQ ID NO: 790390 - RNA, 22 nt, Human
uguuuuccuccugguuucugcc

SEQ ID NO: 790391 - RNA, 22 nt, Human
ugcaggcaggggaugagcagcc

SEQ ID NO: 790392 - RNA, 22 nt, Human
uccucccugggagcuucugagu

SEQ ID NO: 790393 - RNA, 20 nt, Human
gagcugaguguggucauggg

SEQ ID NO: 790394 - RNA, 22 nt, Human
ugcaaaugucaaggguuagugu

SEQ ID NO: 790395 - RNA, 22 nt, Human
aggacuguuuuuucuucuaggg

SEQ ID NO: 790396 - RNA, 22 nt, Human
ccaggcacaggugggccucaga

SEQ ID NO: 790397 - RNA, 22 nt, Human
ucugcacauagguaggcuggaa

SEQ ID NO: 790398 - RNA, 22 nt, Human
guacaaguugccuaccuuaagu

SEQ ID NO: 790399 - RNA, 17 nt, Human
caucuuuaaaauccuga

SEQ ID NO: 790400 - RNA, 22 nt, Human
ggcgagggagcagugcgguggg

SEQ ID NO: 790401 - RNA, 21 nt, Human
ccgugcucggcuauggaccac

SEQ ID NO: 790402 - RNA, 22 nt, Human
aacaaaucuuaaaguaauucaa

SEQ ID NO: 790403 - RNA, 22 nt, Human
ggcaggcucagcagccaaggag

SEQ ID NO: 790404 - RNA, 22 nt, Human
ucccaggcuggggccaggugac

SEQ ID NO: 790405 - RNA, 20 nt, Human
auguccagugacuggaccau

SEQ ID NO: 790406 - RNA, 22 nt, Human
cauacuuuugcccugacauucu

SEQ ID NO: 790407 - RNA, 22 nt, Human
ggcaagauccaaggggcuagga

SEQ ID NO: 790408 - RNA, 22 nt, Human
uuccaaagugcuggaauuacau

SEQ ID NO: 790409 - RNA, 22 nt, Human
caacacagguucugcaaaggaa

SEQ ID NO: 790410 - RNA, 22 nt, Human
uuaauuuauacauaaucacagg

SEQ ID NO: 790411 - RNA, 22 nt, Human
uuucuaaaauagauuuuauggu

SEQ ID NO: 790412 - RNA, 22 nt, Human
aauccugaccugggcaugcuug

SEQ ID NO: 790413 - RNA, 22 nt, Human
cacaggccaguaagacuguguu

SEQ ID NO: 790414 - RNA, 22 nt, Human
cucccuggucuuucccaucauu

SEQ ID NO: 790415 - RNA, 22 nt, Human
acugggacuguaugugcuggac

SEQ ID NO: 790416 - RNA, 22 nt, Human
caggcuggagugcaauggugcu

SEQ ID NO: 790417 - RNA, 21 nt, Human
auacagaagguggcaaaguac

SEQ ID NO: 790418 - RNA, 22 nt, Human
ggcaggaggaagaguuagcacc

SEQ ID NO: 790419 - RNA, 22 nt, Human
uacuugcuggguguaauuuucu

SEQ ID NO: 790420 - RNA, 22 nt, Human
uggcccugcuaugauccugcaa

SEQ ID NO: 790421 - RNA, 22 nt, Human
agugcauucuggcagaacaggu

SEQ ID NO: 790422 - RNA, 22 nt, Human
ugacagccaugauccuuacugu

SEQ ID NO: 790423 - RNA, 22 nt, Human
gagggaagaaagaauugaugcg

SEQ ID NO: 790424 - RNA, 22 nt, Human
cagagcugggaucccaugggcg

SEQ ID NO: 790425 - RNA, 22 nt, Human
caagaaauucuguucagauagc

SEQ ID NO: 790426 - RNA, 22 nt, Human
gcacccagagggcagggucucc

SEQ ID NO: 790427 - RNA, 22 nt, Human
gggcuaggucugaucagagaag

SEQ ID NO: 790428 - RNA, 22 nt, Human
ccccagcagacucagggcaggu

SEQ ID NO: 790429 - RNA, 22 nt, Human
ugggagcaccuugagggcagaa

SEQ ID NO: 790430 - RNA, 22 nt, Human
uugcagcuggugguggccgugu

SEQ ID NO: 790431 - RNA, 22 nt, Human
ugcuuauucuuuccacaauuca

SEQ ID NO: 790432 - RNA, 22 nt, Human
auuuuacuuugugaauauugac

SEQ ID NO: 790433 - RNA, 18 nt, Human
cugcacuguggguagcuc

SEQ ID NO: 790434 - RNA, 22 nt, Human
agggcagccugagugcuggccc

SEQ ID NO: 790435 - RNA, 22 nt, Human
uagacacaucaaggaucaguuu

SEQ ID NO: 790436 - RNA, 22 nt, Human
gugcaaaauuuggccaauaaca

SEQ ID NO: 790437 - RNA, 22 nt, Human
gaaauauuacaguggaggggau

SEQ ID NO: 790438 - RNA, 22 nt, Human
cugcaagggaucuucagguagc

SEQ ID NO: 790439 - RNA, 22 nt, Human
gcuaaucaauguuaaggcugug

SEQ ID NO: 790440 - RNA, 22 nt, Human
accauacauuaaaugacuuuca

SEQ ID NO: 790441 - RNA, 22 nt, Human
gcucagagcaucccagugaaug

SEQ ID NO: 790442 - RNA, 22 nt, Human
guucacauguggucaugcuguc

SEQ ID NO: 790443 - RNA, 22 nt, Human
ucaaauuaguggaauaauaaug

SEQ ID NO: 790444 - RNA, 22 nt, Human
agggaagcaggaauagcucuga

SEQ ID NO: 790445 - RNA, 22 nt, Human
uagcaguauauuuuaaggaagc

SEQ ID NO: 790446 - RNA, 22 nt, Human
guccuuggagguguggaaucug

SEQ ID NO: 790447 - RNA, 22 nt, Human
aaggagaaggcaucauucaagu

SEQ ID NO: 790448 - RNA, 22 nt, Human
agcagggguaacagaaggaaag

SEQ ID NO: 790449 - RNA, 22 nt, Human
uucuuucucagugggcagauac

SEQ ID NO: 790450 - RNA, 22 nt, Human
aagcauuuuucacagcaacagc

SEQ ID NO: 790451 - RNA, 22 nt, Human
uacucaaaaaguuaugaaucau

SEQ ID NO: 790452 - RNA, 22 nt, Human
ggccagagagcagccaggauuc

SEQ ID NO: 790453 - RNA, 22 nt, Human
gccuuggagaucacugcucaug

SEQ ID NO: 790454 - RNA, 21 nt, Human
uaagugcaaagagacagauac

SEQ ID NO: 790455 - RNA, 23 nt, Human
uccaggcacgcauuucuucuagc

SEQ ID NO: 790456 - RNA, 22 nt, Human
gucaguguagcaggugcaagcc

SEQ ID NO: 790457 - RNA, 22 nt, Human
cagcgucucguugugggccucg

SEQ ID NO: 790458 - RNA, 22 nt, Human
uuauuacaaugcagaaaauaga

SEQ ID NO: 790459 - RNA, 22 nt, Human
caggcagcaucagucugcugua

SEQ ID NO: 790460 - RNA, 22 nt, Human
auccugucaucauaguacuuga

SEQ ID NO: 790461 - RNA, 22 nt, Human
gugcuggcuggacauggagcac

SEQ ID NO: 790462 - RNA, 22 nt, Human
acacagggcagagagcuggcuc

SEQ ID NO: 790463 - RNA, 22 nt, Human
cagagccaggccugcccucuuu

SEQ ID NO: 790464 - RNA, 19 nt, Human
gccaggaaagaaucaggcg

SEQ ID NO: 790465 - RNA, 22 nt, Human
ugcagaagcagagccgguggcc

SEQ ID NO: 790466 - RNA, 22 nt, Human
uaggaacaguccuagaaaucug

SEQ ID NO: 790467 - RNA, 22 nt, Human
uucauguaguguaaugucuuca

SEQ ID NO: 790468 - RNA, 22 nt, Human
gagccugaugaaacaggcagac

SEQ ID NO: 790469 - RNA, 22 nt, Human
cugcaucaggccaauuaagaau

SEQ ID NO: 790470 - RNA, 22 nt, Human
uccagccuucucaaggcuggcu

SEQ ID NO: 790471 - RNA, 21 nt, Human
uggaagucuugaguagggggc

SEQ ID NO: 790472 - RNA, 22 nt, Human
agcccagccggauucccaguuc

SEQ ID NO: 790473 - RNA, 22 nt, Human
accccuucuccuggcuguucca

SEQ ID NO: 790474 - RNA, 22 nt, Human
uggcucagugacauuccuccca

SEQ ID NO: 790475 - RNA, 22 nt, Human
gcuccagcuccggcuccgaagc

SEQ ID NO: 790476 - RNA, 22 nt, Human
aguggugaugacagcaguuucu

SEQ ID NO: 790477 - RNA, 18 nt, Human
caaauucucauugauuuc

SEQ ID NO: 790478 - RNA, 22 nt, Human
aggugcagcugacaccaugugg

SEQ ID NO: 790479 - RNA, 22 nt, Human
ccucagggucugaggagaccgu

SEQ ID NO: 790480 - RNA, 22 nt, Human
aagcuguuaucuucuggcggac

SEQ ID NO: 790481 - RNA, 22 nt, Human
gagcuuggugaugccuccuggu

SEQ ID NO: 790482 - RNA, 22 nt, Human
gaggagaggcuggacgcgguga

SEQ ID NO: 790483 - RNA, 22 nt, Human
uucaggcccaacgcacagcuuc

SEQ ID NO: 790484 - RNA, 22 nt, Human
gccagggugagggcugagaggu

SEQ ID NO: 790485 - RNA, 22 nt, Human
aguggcaguagaugagcugguu

SEQ ID NO: 790486 - RNA, 19 nt, Human
ccugggaggcggagguugc

SEQ ID NO: 790487 - RNA, 22 nt, Human
cugaggaagacagcagcugugu

SEQ ID NO: 790488 - RNA, 22 nt, Human
aaacaauguacacaugaauguu

SEQ ID NO: 790489 - RNA, 22 nt, Human
agcuuuaucagaggagucucua

SEQ ID NO: 790490 - RNA, 22 nt, Human
aaguuacuggcaagggcugcag

SEQ ID NO: 790491 - RNA, 22 nt, Human
cauuagcuaucuguuuacauua

SEQ ID NO: 790492 - RNA, 22 nt, Human
ggcuccaggagggccuuggcca

SEQ ID NO: 790493 - RNA, 22 nt, Human
ugcuccaugcgcucggccggcg

SEQ ID NO: 790494 - RNA, 17 nt, Human
gcugagaggcagcacag

SEQ ID NO: 790495 - RNA, 22 nt, Human
ugggccacugcugcggaaggcg

SEQ ID NO: 790496 - RNA, 22 nt, Human
uuucagaggugcuuggaaugcu

SEQ ID NO: 790497 - RNA, 22 nt, Human
ccaggcagcaaauuuucugaau

SEQ ID NO: 790498 - RNA, 22 nt, Human
ggguggcacaggugcagagggu

SEQ ID NO: 790499 - RNA, 22 nt, Human
caggagcaugcugaugccagaa

SEQ ID NO: 790500 - RNA, 22 nt, Human
cuguggaguggggaguacuggu

SEQ ID NO: 790501 - RNA, 22 nt, Human
aaggcccagggauuggagguca

SEQ ID NO: 790502 - RNA, 20 nt, Human
ugguaucaauuacuagauug

SEQ ID NO: 790503 - RNA, 22 nt, Human
ucaguguccugugcggugcagc

SEQ ID NO: 790504 - RNA, 22 nt, Human
uuuccaaaaugaaucuaaugca

SEQ ID NO: 790505 - RNA, 22 nt, Human
gcagcuggacccacacggcuua

SEQ ID NO: 790506 - RNA, 22 nt, Human
cagaaaauaaacauuuguggaa

SEQ ID NO: 790507 - RNA, 22 nt, Human
acacuuuuguuugaagucucca

SEQ ID NO: 790508 - RNA, 22 nt, Human
ugucacauugaauaugauuuau

SEQ ID NO: 790509 - RNA, 22 nt, Human
ugggaaggcguggaaguagaag

SEQ ID NO: 790510 - RNA, 22 nt, Human
uaguauucagcuucucaggcaa

SEQ ID NO: 790511 - RNA, 22 nt, Human
uugagaacaggaguguucuuuu

SEQ ID NO: 790512 - RNA, 17 nt, Human
cuguggccaccuggaug

SEQ ID NO: 790513 - RNA, 22 nt, Human
ugccucgugucugagucuguuc

SEQ ID NO: 790514 - RNA, 22 nt, Human
ggggauggugggaaggcaaucu

SEQ ID NO: 790515 - RNA, 22 nt, Human
uuucaaacauagaucugaauau

SEQ ID NO: 790516 - RNA, 22 nt, Human
ucaggcugcuggccagcaggcu

SEQ ID NO: 790517 - RNA, 22 nt, Human
uaucaacugagauuaaauauuu

SEQ ID NO: 790518 - RNA, 22 nt, Human
ucaggcacuggcugagugaugg

SEQ ID NO: 790519 - RNA, 22 nt, Human
agauucuacucuagauccaugg

SEQ ID NO: 790520 - RNA, 22 nt, Human
uauauauucuuaaguaguguag

SEQ ID NO: 790521 - RNA, 22 nt, Human
agagagcccgggccagggcaca

SEQ ID NO: 790522 - RNA, 22 nt, Human
uucacagucacccuucuccaug

SEQ ID NO: 790523 - RNA, 21 nt, Human
auuucagagcacacaaguaaa

SEQ ID NO: 790524 - RNA, 22 nt, Human
gccagaggggcucgaaggcgcg

SEQ ID NO: 790525 - RNA, 19 nt, Human
ggccagcacagggcucugu

SEQ ID NO: 790526 - RNA, 22 nt, Human
aaacaucuugcucugauuggua

SEQ ID NO: 790527 - RNA, 22 nt, Human
gaugcagggcuggcaggagcuu

SEQ ID NO: 790528 - RNA, 22 nt, Human
uguucuaggcaaaagcugauuu

SEQ ID NO: 790529 - RNA, 22 nt, Human
aagagcaggcugcuguggagua

SEQ ID NO: 790530 - RNA, 22 nt, Human
ucccaggcaaaggcagcucauu

SEQ ID NO: 790531 - RNA, 22 nt, Human
ucagugucagucuuuuagauau

SEQ ID NO: 790532 - RNA, 22 nt, Human
ugaaguuucuugaaucuuggag

SEQ ID NO: 790533 - RNA, 22 nt, Human
uuccuuuucuucuaccacaugu

SEQ ID NO: 790534 - RNA, 22 nt, Human
aucacaauguacguuaaaaugu

SEQ ID NO: 790535 - RNA, 18 nt, Human
aaaguucagggagaguug

SEQ ID NO: 790536 - RNA, 20 nt, Human
acuggcagccugccugcugu

SEQ ID NO: 790537 - RNA, 22 nt, Human
cucuccaggagagcacuuugag

SEQ ID NO: 790538 - RNA, 22 nt, Human
guuuuuacagcagcaaaauacu

SEQ ID NO: 790539 - RNA, 19 nt, Human
ggcaggcuggauagagagg

SEQ ID NO: 790540 - RNA, 22 nt, Human
gcggugggggaaaggagcgguu

SEQ ID NO: 790541 - RNA, 22 nt, Human
gacagcaacacaugcuuagugc

SEQ ID NO: 790542 - RNA, 22 nt, Human
aggaauucaagaccagcugggc

SEQ ID NO: 790543 - RNA, 22 nt, Human
cagaggccaggcugccugacug

SEQ ID NO: 790544 - RNA, 22 nt, Human
aucuagaaagccaggggccugc

SEQ ID NO: 790545 - RNA, 22 nt, Human
aauaacaggguugauuugcaau

SEQ ID NO: 790546 - RNA, 22 nt, Human
gggugggccacugagcagcgug

SEQ ID NO: 790547 - RNA, 22 nt, Human
acccugccgugggcugcuugug

SEQ ID NO: 790548 - RNA, 21 nt, Human
gagauggcccaguagcgggcc

SEQ ID NO: 790549 - RNA, 22 nt, Human
uaagaaacugucacaguacuau

SEQ ID NO: 790550 - RNA, 22 nt, Human
ugggcugaguguggaacuaguu

SEQ ID NO: 790551 - RNA, 22 nt, Human
gggucuucugauauagguccag

SEQ ID NO: 790552 - RNA, 22 nt, Human
agcucaggccggagcuacaggc

SEQ ID NO: 790553 - RNA, 22 nt, Human
aagauucuguauuucuaacaau

SEQ ID NO: 790554 - RNA, 19 nt, Human
aagcugagggcuguccacc

SEQ ID NO: 790555 - RNA, 22 nt, Human
agcagggcagguaaggaucaga

SEQ ID NO: 790556 - RNA, 23 nt, Human
uccagccucuugcucucacaugc

SEQ ID NO: 790557 - RNA, 22 nt, Human
uaauguauaacaaauacucauc

SEQ ID NO: 790558 - RNA, 23 nt, Human
uccagggcaguggcugggucugc

SEQ ID NO: 790559 - RNA, 22 nt, Human
cauucauucagcaacuguuauu

SEQ ID NO: 790560 - RNA, 22 nt, Human
acacagagggcagaagauacau

SEQ ID NO: 790561 - RNA, 22 nt, Human
caaaacauucagagagcucacu

SEQ ID NO: 790562 - RNA, 22 nt, Human
aguacaguggucauaauauaaa

SEQ ID NO: 790563 - RNA, 22 nt, Human
gggcauggccaggugagggguc

SEQ ID NO: 790564 - RNA, 22 nt, Human
gggagccaugcuggucuucuuu

SEQ ID NO: 790565 - RNA, 22 nt, Human
uggccuggcccugaggcccugu

SEQ ID NO: 790566 - RNA, 22 nt, Human
uguuucaaagaaagaaaauaua

SEQ ID NO: 790567 - RNA, 22 nt, Human
caguggugaagagcaggggcuc

SEQ ID NO: 790568 - RNA, 22 nt, Human
uacuuacagaaggaagcaauug

SEQ ID NO: 790569 - RNA, 22 nt, Human
ucccagggugcgccugcccucg

SEQ ID NO: 790570 - RNA, 22 nt, Human
aaguuucaaauguugauuaugc

SEQ ID NO: 790571 - RNA, 22 nt, Human
aaggcuggagaugguuggaaug

SEQ ID NO: 790572 - RNA, 22 nt, Human
aggaagcuuagugaaaggacca

SEQ ID NO: 790573 - RNA, 22 nt, Human
ugugacuuuucacaggcugguc

SEQ ID NO: 790574 - RNA, 22 nt, Human
agcuaggauaagcagagacugg

SEQ ID NO: 790575 - RNA, 19 nt, Human
aucagcaagguaggaugug

SEQ ID NO: 790576 - RNA, 22 nt, Human
acucugccuuucagcagaugaa

SEQ ID NO: 790577 - RNA, 22 nt, Human
acaguacaccacuguguacagu

SEQ ID NO: 790578 - RNA, 22 nt, Human
gcuguauuccugcacuguauag

SEQ ID NO: 790579 - RNA, 22 nt, Human
uucaaagagaaauuguauuuuc

SEQ ID NO: 790580 - RNA, 22 nt, Human
caguuuuaaauuguuagauaau

SEQ ID NO: 790581 - RNA, 22 nt, Human
aguuuuauggcucaaccuaaua

SEQ ID NO: 790582 - RNA, 22 nt, Human
uugaaugaagggaugaccgaag

SEQ ID NO: 790583 - RNA, 22 nt, Human
uagcauuuggcaccaguuauuu

SEQ ID NO: 790584 - RNA, 22 nt, Human
augacuuuguuguuuuccagcg

SEQ ID NO: 790585 - RNA, 21 nt, Human
agacagagugcagucuacaua

SEQ ID NO: 790586 - RNA, 22 nt, Human
auugagaauugugaguuuggag

SEQ ID NO: 790587 - RNA, 22 nt, Human
aggagcugugaaugggaggggu

SEQ ID NO: 790588 - RNA, 20 nt, Human
gcugggcuuugacugacaca

SEQ ID NO: 790589 - RNA, 23 nt, Human
ugagugugaaaauccuggagaug

SEQ ID NO: 790590 - RNA, 22 nt, Human
gaugugacuaacuugguaccag

SEQ ID NO: 790591 - RNA, 22 nt, Human
agguaaggcuguaagcuaagcc

SEQ ID NO: 790592 - RNA, 22 nt, Human
aacacuuuguugccuaugaacg

SEQ ID NO: 790593 - RNA, 22 nt, Human
uaaaacagcagggcagagaagu

SEQ ID NO: 790594 - RNA, 22 nt, Human
cugccuccugccgugcagcuuc

SEQ ID NO: 790595 - RNA, 22 nt, Human
uuuccaggagaaagagagccuu

SEQ ID NO: 790596 - RNA, 22 nt, Human
auucuauuaauauuucuaggaa

SEQ ID NO: 790597 - RNA, 22 nt, Human
aacgcccgugguugccaaggua

SEQ ID NO: 790598 - RNA, 22 nt, Human
ccgggccucgggacaccgggua

SEQ ID NO: 790599 - RNA, 22 nt, Human
aggcaggaaaaucgcuugaacc

SEQ ID NO: 790600 - RNA, 22 nt, Human
gucaaguuaagauaaggucaug

SEQ ID NO: 790601 - RNA, 22 nt, Human
ccucuaaauuguuugaaguugg

SEQ ID NO: 790602 - RNA, 22 nt, Human
ugaaugauauauugggaauaau

SEQ ID NO: 790603 - RNA, 22 nt, Human
gcauguggauauguuaggguga

SEQ ID NO: 790604 - RNA, 22 nt, Human
aggcuaggcugaugccucuucc

SEQ ID NO: 790605 - RNA, 22 nt, Human
aaguuucucaauggcaacuggg

SEQ ID NO: 790606 - RNA, 22 nt, Human
ccuggccagcuaauugcccauc

SEQ ID NO: 790607 - RNA, 19 nt, Human
gagaggccugugcuugaag

SEQ ID NO: 790608 - RNA, 22 nt, Human
aggcacuuaauaaggauucaau

SEQ ID NO: 790609 - RNA, 22 nt, Human
gugcacugucuggucaagagca

SEQ ID NO: 790610 - RNA, 22 nt, Human
acucagaguagaaaauagguuc

SEQ ID NO: 790611 - RNA, 22 nt, Human
aaacugcacacgaugugccuga

SEQ ID NO: 790612 - RNA, 22 nt, Human
cugagcagugcuuugcaguggg

SEQ ID NO: 790613 - RNA, 22 nt, Human
gcugcaggagcuggagcugugg

SEQ ID NO: 790614 - RNA, 22 nt, Human
uucauugaagcacaagugaucu

SEQ ID NO: 790615 - RNA, 21 nt, Human
cuggagucuggggguggcagu

SEQ ID NO: 790616 - RNA, 22 nt, Human
ccugcccccgucagaggugaug

SEQ ID NO: 790617 - RNA, 22 nt, Human
cugcagcuuucgcuccaucagc

SEQ ID NO: 790618 - RNA, 22 nt, Human
uccagcucccacucucacugcu

SEQ ID NO: 790619 - RNA, 22 nt, Human
ccucuggcuuacuguuggguuu

SEQ ID NO: 790620 - RNA, 22 nt, Human
ugggagcaagcuacuuagggaa

SEQ ID NO: 790621 - RNA, 22 nt, Human
aggcuggcugagcugcagccug

SEQ ID NO: 790622 - RNA, 22 nt, Human
cuauuuggccaagcugcccaca

SEQ ID NO: 790623 - RNA, 22 nt, Human
caaagggcauggccugagcacu

SEQ ID NO: 790624 - RNA, 22 nt, Human
gcuggagaguaguaagcaguua

SEQ ID NO: 790625 - RNA, 22 nt, Human
ugaauggauauaacaacagugu

SEQ ID NO: 790626 - RNA, 22 nt, Human
gguggcagcgucuaucugacau

SEQ ID NO: 790627 - RNA, 22 nt, Human
caggaagcugagcugcacugca

SEQ ID NO: 790628 - RNA, 22 nt, Human
aggcuucaaggaccugagggaa

SEQ ID NO: 790629 - RNA, 22 nt, Human
ugagaggcgcucacucucaggu

SEQ ID NO: 790630 - RNA, 22 nt, Human
agucccagcuucccccaugcag

SEQ ID NO: 790631 - RNA, 22 nt, Human
cugagccaaaaagcagagcuug

SEQ ID NO: 790632 - RNA, 22 nt, Human
agacacaggauucugcauuucu

SEQ ID NO: 790633 - RNA, 22 nt, Human
ucaggcuuccaacaaugauguu

SEQ ID NO: 790634 - RNA, 22 nt, Human
cuguauuuuuuaagaauaucuc

SEQ ID NO: 790635 - RNA, 22 nt, Human
cacuugaacuguuugaaugaga

SEQ ID NO: 790636 - RNA, 22 nt, Human
gugcagugagcagugcagcacc

SEQ ID NO: 790637 - RNA, 18 nt, Human
ggccagccccaggccagc

SEQ ID NO: 790638 - RNA, 23 nt, Human
uggccugcagaguuucugcuggg

SEQ ID NO: 790639 - RNA, 22 nt, Human
acagcugcuuucucuuacuaug

SEQ ID NO: 790640 - RNA, 22 nt, Human
acucuacuguaguaugggcacu

SEQ ID NO: 790641 - RNA, 22 nt, Human
uucagagugguaugaagugaug

SEQ ID NO: 790642 - RNA, 22 nt, Human
uuguguuucuggccaagaugga

SEQ ID NO: 790643 - RNA, 22 nt, Human
accuccugaugagaguaaagga

SEQ ID NO: 790644 - RNA, 22 nt, Human
agggggcugccaaggaauguaa

SEQ ID NO: 790645 - RNA, 22 nt, Human
agaagagaacugccaaacacuu

SEQ ID NO: 790646 - RNA, 22 nt, Human
ugcacacacucugcauauacuu

SEQ ID NO: 790647 - RNA, 22 nt, Human
cagagggaaaaggggaguaaua

SEQ ID NO: 790648 - RNA, 22 nt, Human
uucuuauucuugaaauguggga

SEQ ID NO: 790649 - RNA, 22 nt, Human
acaaagauaagucagaaaguca

SEQ ID NO: 790650 - RNA, 22 nt, Human
gucagcucagcaggugggagug

SEQ ID NO: 790651 - RNA, 22 nt, Human
agccucugcuggcccuggcacu

SEQ ID NO: 790652 - RNA, 22 nt, Human
ucuuuuaguaauaaauauuugu

SEQ ID NO: 790653 - RNA, 23 nt, Human
uggcccugugcaugcugcuuccc

SEQ ID NO: 790654 - RNA, 22 nt, Human
ugugcccuguuaaaugcacagu

SEQ ID NO: 790655 - RNA, 22 nt, Human
agagcuuguaauugagucaggu

SEQ ID NO: 790656 - RNA, 22 nt, Human
uagcagcacagaaagccuggag

SEQ ID NO: 790657 - RNA, 22 nt, Human
aggcaagauuaggaccagaaga

SEQ ID NO: 790658 - RNA, 22 nt, Human
ucuacaaagccauucaggaucu

SEQ ID NO: 790659 - RNA, 22 nt, Human
uucuaaaauaaguuuaucuggu

SEQ ID NO: 790660 - RNA, 22 nt, Human
gccugcuguugagggaagagcu

SEQ ID NO: 790661 - RNA, 22 nt, Human
aaacaauguuccuauauuagag

SEQ ID NO: 790662 - RNA, 22 nt, Human
ggccucagugggccgcugcagg

SEQ ID NO: 790663 - RNA, 22 nt, Human
ggcuccaggguaccccuggaug

SEQ ID NO: 790664 - RNA, 22 nt, Human
uggucgaccaguuggaaaguaa

SEQ ID NO: 790665 - RNA, 22 nt, Human
gcagagcugcagcgaggccugg

SEQ ID NO: 790666 - RNA, 22 nt, Human
auuguuucugcuuuauuuaggg

SEQ ID NO: 790667 - RNA, 22 nt, Human
gcaugcaauguaucagugauag

SEQ ID NO: 790668 - RNA, 22 nt, Human
agauggaguggagaugaguaaa

SEQ ID NO: 790669 - RNA, 22 nt, Human
ucaucugggagcuuguuagaaa

SEQ ID NO: 790670 - RNA, 22 nt, Human
caguccugggcacagcccuggg

SEQ ID NO: 790671 - RNA, 23 nt, Human
ugcaaauuaggccgggacucagc

SEQ ID NO: 790672 - RNA, 22 nt, Human
ucacaucuguugauacagcauc

SEQ ID NO: 790673 - RNA, 22 nt, Human
uggcucagcgcggccuggucuu

SEQ ID NO: 790674 - RNA, 22 nt, Human
gcugccacucugagcuugcuuc

SEQ ID NO: 790675 - RNA, 21 nt, Human
ccugggagaucagcugccuuc

SEQ ID NO: 790676 - RNA, 20 nt, Human
ccucaagcagacugacagcu

SEQ ID NO: 790677 - RNA, 20 nt, Human
agaaacagcacaauucuguu

SEQ ID NO: 790678 - RNA, 22 nt, Human
uuauaacaucaaucagaguuaa

SEQ ID NO: 790679 - RNA, 23 nt, Human
uugcacugaucaauuugauaagc

SEQ ID NO: 790680 - RNA, 22 nt, Human
cagccucugagccuuggcagau

SEQ ID NO: 790681 - RNA, 22 nt, Human
agccugagccccauccagcuga

SEQ ID NO: 790682 - RNA, 22 nt, Human
uuauucagugcauauauuaaaa

SEQ ID NO: 790683 - RNA, 22 nt, Human
ucaccccuugugaaugcugcuc

SEQ ID NO: 790684 - RNA, 22 nt, Human
cagagcugcucaugguggccag

SEQ ID NO: 790685 - RNA, 23 nt, Human
uuuaaugaccaauagaaggaaca

SEQ ID NO: 790686 - RNA, 22 nt, Human
aagagagaagucucucugguuc

SEQ ID NO: 790687 - RNA, 22 nt, Human
ugcauuaaaaccaucgaccauc

SEQ ID NO: 790688 - RNA, 22 nt, Human
ugucauaucuauuaaaugucua

SEQ ID NO: 790689 - RNA, 22 nt, Human
ccucaggguucggaugagaaca

SEQ ID NO: 790690 - RNA, 19 nt, Human
acaaagcugugagcagcuu

SEQ ID NO: 790691 - RNA, 22 nt, Human
caucaucaccugcuauacgauc

SEQ ID NO: 790692 - RNA, 22 nt, Human
aaguccugaaacuucuuucuga

SEQ ID NO: 790693 - RNA, 22 nt, Human
accccaggagcugugccuaguc

SEQ ID NO: 790694 - RNA, 22 nt, Human
cguccugggucugggaaggcau

SEQ ID NO: 790695 - RNA, 22 nt, Human
uguacauacauagauauacaca

SEQ ID NO: 790696 - RNA, 22 nt, Human
agccuggcccugcugaacucug

SEQ ID NO: 790697 - RNA, 22 nt, Human
uugacacaauguauauuuucaa

SEQ ID NO: 790698 - RNA, 22 nt, Human
guucauuuuuacuuugaucuac

SEQ ID NO: 790699 - RNA, 22 nt, Human
uaucagaaaugccuuaaauugg

SEQ ID NO: 790700 - RNA, 22 nt, Human
gguuagagggcaugcgaucuuu

SEQ ID NO: 790701 - RNA, 22 nt, Human
cucccaagggguaagggagcug

SEQ ID NO: 790702 - RNA, 22 nt, Human
aguccauuaacuguguuaacag

SEQ ID NO: 790703 - RNA, 22 nt, Human
gagagcugaggggccuggcacu

SEQ ID NO: 790704 - RNA, 22 nt, Human
aagaaaccuagucuggagcagc

SEQ ID NO: 790705 - RNA, 22 nt, Human
uugucugaggguuugagagaau

SEQ ID NO: 790706 - RNA, 22 nt, Human
cuugaaugggccauaagacggu

SEQ ID NO: 790707 - RNA, 22 nt, Human
agccaacuaauuaaacaacuuu

SEQ ID NO: 790708 - RNA, 22 nt, Human
caguccuggggaccaggcugag

SEQ ID NO: 790709 - RNA, 22 nt, Human
aauucacaauguguagucaugc

SEQ ID NO: 790710 - RNA, 23 nt, Human
ucucuuaccugagacauuuccua

SEQ ID NO: 790711 - RNA, 22 nt, Human
uaucaaauugaggcagcugggg

SEQ ID NO: 790712 - RNA, 22 nt, Human
ccuggucaccccucucucugca

SEQ ID NO: 790713 - RNA, 22 nt, Human
aaugagaaccuugaaaggaacu

SEQ ID NO: 790714 - RNA, 22 nt, Human
aucuaggauuugaaugcacagu

SEQ ID NO: 790715 - RNA, 22 nt, Human
augugacuucagucuucuuaca

SEQ ID NO: 790716 - RNA, 22 nt, Human
gcccagcccugaggucacagcu

SEQ ID NO: 790717 - RNA, 22 nt, Human
uuauuauugugguugcauuauc

SEQ ID NO: 790718 - RNA, 22 nt, Human
aauucacauguugaaguccuaa

SEQ ID NO: 790719 - RNA, 22 nt, Human
aauguacagcugcugcugaagg

SEQ ID NO: 790720 - RNA, 18 nt, Human
ggugagggagcuggaagc

SEQ ID NO: 790721 - RNA, 22 nt, Human
gccagcugcuggaacagcgcga

SEQ ID NO: 790722 - RNA, 22 nt, Human
gucugucuguuguugagaagca

SEQ ID NO: 790723 - RNA, 22 nt, Human
cacagggcuaaaugaaggguug

SEQ ID NO: 790724 - RNA, 22 nt, Human
ggcaggugaggcaugugccugg

SEQ ID NO: 790725 - RNA, 20 nt, Human
cagcaggcuauggggcaccc

SEQ ID NO: 790726 - RNA, 22 nt, Human
ggaguggcacucugaggcgggg

SEQ ID NO: 790727 - RNA, 20 nt, Human
aggcaguguagagaugagua

SEQ ID NO: 790728 - RNA, 22 nt, Human
aaaaggaucagauuuugagcag

SEQ ID NO: 790729 - RNA, 22 nt, Human
cagccagcuggugcggcagagc

SEQ ID NO: 790730 - RNA, 22 nt, Human
uacucaauuucuuauggguuuc

SEQ ID NO: 790731 - RNA, 22 nt, Human
caggguggcaggcaccauggcc

SEQ ID NO: 790732 - RNA, 22 nt, Human
ggcagcgcccgaguccgcagcu

SEQ ID NO: 790733 - RNA, 22 nt, Human
gaauacauaucagauguguuuc

SEQ ID NO: 790734 - RNA, 22 nt, Human
caggaaaugcuaucauagcuga

SEQ ID NO: 790735 - RNA, 22 nt, Human
ggaugggagcagaggacgacca

SEQ ID NO: 790736 - RNA, 22 nt, Human
uggaagcaucacuucuugccug

SEQ ID NO: 790737 - RNA, 22 nt, Human
ccauguggcuagcgugccugca

SEQ ID NO: 790738 - RNA, 18 nt, Human
ugacauuuccagagugua

SEQ ID NO: 790739 - RNA, 22 nt, Human
cacacaguggaguauuacucag

SEQ ID NO: 790740 - RNA, 21 nt, Human
acuggcugucuuccuacuggu

SEQ ID NO: 790741 - RNA, 22 nt, Human
uuucagagaugcagaauucagg

SEQ ID NO: 790742 - RNA, 22 nt, Human
agcucuuuuaucaugaggagag

SEQ ID NO: 790743 - RNA, 22 nt, Human
ccaggaguuugaggcugcagug

SEQ ID NO: 790744 - RNA, 23 nt, Human
gccuggcuuccaagguaggggag

SEQ ID NO: 790745 - RNA, 22 nt, Human
uagugucaugaaaaguacacua

SEQ ID NO: 790746 - RNA, 17 nt, Human
guaauauaauaagccuu

SEQ ID NO: 790747 - RNA, 22 nt, Human
gggcagcccagaacugcugcag

SEQ ID NO: 790748 - RNA, 21 nt, Human
cauuuacaugacagauugguu

SEQ ID NO: 790749 - RNA, 21 nt, Human
ugggagacacagccuugagcu

SEQ ID NO: 790750 - RNA, 22 nt, Human
gaaggccaagaggcuccaagau

SEQ ID NO: 790751 - RNA, 22 nt, Human
uuuaagugaugaaaugcagaua

SEQ ID NO: 790752 - RNA, 22 nt, Human
acaugcaagcagccgugcagau

SEQ ID NO: 790753 - RNA, 22 nt, Human
acaggcugcugagccauuugcu

SEQ ID NO: 790754 - RNA, 22 nt, Human
aggaaauaggaccagacaaagc

SEQ ID NO: 790755 - RNA, 22 nt, Human
acugugaguuuauuuaucugau

SEQ ID NO: 790756 - RNA, 22 nt, Human
gcaauaaaguagcagcucauca

SEQ ID NO: 790757 - RNA, 22 nt, Human
aagcugaaucugaaauagaauu

SEQ ID NO: 790758 - RNA, 22 nt, Human
gcaaacaagcugccugaagauu

SEQ ID NO: 790759 - RNA, 20 nt, Human
caguccaggcuagaaaacaa

SEQ ID NO: 790760 - RNA, 22 nt, Human
caaggcucuggaccaaauccca

SEQ ID NO: 790761 - RNA, 18 nt, Human
uuguuuuaagacucuguc

SEQ ID NO: 790762 - RNA, 22 nt, Human
ugaaaauucaucucauagcaga

SEQ ID NO: 790763 - RNA, 22 nt, Human
cauggcccucuucuggagcaau

SEQ ID NO: 790764 - RNA, 22 nt, Human
uccagcuggggccgaaguggau

SEQ ID NO: 790765 - RNA, 22 nt, Human
acaugucuacacauucugcaau

SEQ ID NO: 790766 - RNA, 22 nt, Human
gccaggcucucagugacugccc

SEQ ID NO: 790767 - RNA, 22 nt, Human
auccccuucacacccucugcau

SEQ ID NO: 790768 - RNA, 22 nt, Human
aaaauucugucauuaaauugug

SEQ ID NO: 790769 - RNA, 20 nt, Human
cacccucccagcaccuaugc

SEQ ID NO: 790770 - RNA, 22 nt, Human
ucucccaaggcacagaaagagu

SEQ ID NO: 790771 - RNA, 22 nt, Human
aaaaagacuuccaacucaggag

SEQ ID NO: 790772 - RNA, 22 nt, Human
uggcaggguacaccuuaacacc

SEQ ID NO: 790773 - RNA, 18 nt, Human
ugaggcugaggguagagg

SEQ ID NO: 790774 - RNA, 22 nt, Human
gcgcagcucagugagggaacuu

SEQ ID NO: 790775 - RNA, 22 nt, Human
cucuuuggauagaauuacaaag

SEQ ID NO: 790776 - RNA, 22 nt, Human
agcccaggagccuuuggagggu

SEQ ID NO: 790777 - RNA, 22 nt, Human
gcauggcagaacaccucgcccg

SEQ ID NO: 790778 - RNA, 22 nt, Human
gaggaggguuggccuuagguag

SEQ ID NO: 790779 - RNA, 22 nt, Human
ccuccagggcagacggggagca

SEQ ID NO: 790780 - RNA, 22 nt, Human
uuauaugaguaucauaucacuu

SEQ ID NO: 790781 - RNA, 22 nt, Human
cgagaggcuggacagggcuggg

SEQ ID NO: 790782 - RNA, 22 nt, Human
ugaucaggucugaacagggagg

SEQ ID NO: 790783 - RNA, 22 nt, Human
ccaugggagaugauggggagug

SEQ ID NO: 790784 - RNA, 22 nt, Human
ugcaggguauccuugucucugc

SEQ ID NO: 790785 - RNA, 22 nt, Human
uaugcauuauacauuaauuucu

SEQ ID NO: 790786 - RNA, 22 nt, Human
gcuagaaaucgacuucagaauu

SEQ ID NO: 790787 - RNA, 17 nt, Human
uagagcugguucaggag

SEQ ID NO: 790788 - RNA, 22 nt, Human
gguggcagagaggagguaguuu

SEQ ID NO: 790789 - RNA, 22 nt, Human
agccaagguaucaugagaggca

SEQ ID NO: 790790 - RNA, 22 nt, Human
ugccgcagugcggggagggccc

SEQ ID NO: 790791 - RNA, 18 nt, Human
ucucaaaaauaauggcuu

SEQ ID NO: 790792 - RNA, 22 nt, Human
ucuguuuuagauaagaaaggcu

SEQ ID NO: 790793 - RNA, 22 nt, Human
gaaacagugagaacuuuuccug

SEQ ID NO: 790794 - RNA, 22 nt, Human
uggcuuccgccgcgggccucgg

SEQ ID NO: 790795 - RNA, 22 nt, Human
aucaaauaaagguaccuagcuu

SEQ ID NO: 790796 - RNA, 22 nt, Human
gcugccugguuucucagcugca

SEQ ID NO: 790797 - RNA, 22 nt, Human
aagaaauuaaggaaugcaacga

SEQ ID NO: 790798 - RNA, 22 nt, Human
ugaaugaugguguguucuugcc

SEQ ID NO: 790799 - RNA, 23 nt, Human
ugcuggcugaaacagccaaagga

SEQ ID NO: 790800 - RNA, 22 nt, Human
ugccaggcgugguggugcgcac

SEQ ID NO: 790801 - RNA, 22 nt, Human
ucuccugggaggacaaggaagg

SEQ ID NO: 790802 - RNA, 22 nt, Human
uuaauuaauuaguuaagcaugu

SEQ ID NO: 790803 - RNA, 22 nt, Human
agaggcccucucugcucagucu

SEQ ID NO: 790804 - RNA, 17 nt, Human
uguaugcauaugcuuuu

SEQ ID NO: 790805 - RNA, 22 nt, Human
aggcagcucuguggccucccag

SEQ ID NO: 790806 - RNA, 22 nt, Human
uuucugaaacauggucuuugua

SEQ ID NO: 790807 - RNA, 22 nt, Human
ggccuugggcgagucccucagu

SEQ ID NO: 790808 - RNA, 22 nt, Human
uuugcaaauacagaggucuugc

SEQ ID NO: 790809 - RNA, 22 nt, Human
caucacauuuaauuaaaauguc

SEQ ID NO: 790810 - RNA, 22 nt, Human
cuucaggaguaguuaccuagca

SEQ ID NO: 790811 - RNA, 22 nt, Human
aacagcaagggcggggucaaga

SEQ ID NO: 790812 - RNA, 22 nt, Human
aggcauggauguagcagugacc

SEQ ID NO: 790813 - RNA, 22 nt, Human
uguuuacaaggaguuuauauug

SEQ ID NO: 790814 - RNA, 22 nt, Human
acacugcucacuucuucccuug

SEQ ID NO: 790815 - RNA, 23 nt, Human
uccagcucccuucaauggcacug

SEQ ID NO: 790816 - RNA, 22 nt, Human
uucuccaguuucucccuucagu

SEQ ID NO: 790817 - RNA, 22 nt, Human
cugaagaggacgcagcagcaag

SEQ ID NO: 790818 - RNA, 22 nt, Human
gagggaggggagcuccacccuc

SEQ ID NO: 790819 - RNA, 22 nt, Human
uuaaaaccaucagcuguaagau

SEQ ID NO: 790820 - RNA, 20 nt, Human
aaaugcaguucugccuuggc

SEQ ID NO: 790821 - RNA, 22 nt, Human
ugccagcuagucacauauuaga

SEQ ID NO: 790822 - RNA, 22 nt, Human
gggccccugggaauucugugau

SEQ ID NO: 790823 - RNA, 22 nt, Human
uaaaggcaugcaggugaaugua

SEQ ID NO: 790824 - RNA, 22 nt, Human
ggugagaggcagaggacagcuu

SEQ ID NO: 790825 - RNA, 17 nt, Human
aggcaggagauuggaga

SEQ ID NO: 790826 - RNA, 22 nt, Human
ccucucugucacaccaguggcc

SEQ ID NO: 790827 - RNA, 22 nt, Human
cagacuuuugggaggucugugg

SEQ ID NO: 790828 - RNA, 20 nt, Human
gguccuguacucucauugaa

SEQ ID NO: 790829 - RNA, 22 nt, Human
auuaauauugguucauuagcug

SEQ ID NO: 790830 - RNA, 22 nt, Human
caugagugugccagucugauau

SEQ ID NO: 790831 - RNA, 19 nt, Human
ggcaaauugaggccaguca

SEQ ID NO: 790832 - RNA, 22 nt, Human
cagucucacccuggaggcccca

SEQ ID NO: 790833 - RNA, 22 nt, Human
ucagagaauccguaagucacaa

SEQ ID NO: 790834 - RNA, 22 nt, Human
gaaaaggcagaguuccggggaa

SEQ ID NO: 790835 - RNA, 22 nt, Human
acauuugaggauguuaagaaug

SEQ ID NO: 790836 - RNA, 22 nt, Human
aucaggaucugggagccugaaa

SEQ ID NO: 790837 - RNA, 22 nt, Human
ucugucuuagcaucuuugcuca

SEQ ID NO: 790838 - RNA, 22 nt, Human
cuaaagaagcuagcaaucuaua

SEQ ID NO: 790839 - RNA, 22 nt, Human
ucucagcagccagauccagagc

SEQ ID NO: 790840 - RNA, 22 nt, Human
agucugaguaucucugagccag

SEQ ID NO: 790841 - RNA, 23 nt, Human
ucagagaaugguaugcuuuuccu

SEQ ID NO: 790842 - RNA, 21 nt, Human
uaggcagaggagcagguaucu

SEQ ID NO: 790843 - RNA, 22 nt, Human
ucccugcagacguccugcgggu

SEQ ID NO: 790844 - RNA, 22 nt, Human
uguccugggccggcgacugguc

SEQ ID NO: 790845 - RNA, 22 nt, Human
cacagaggauuuuuagggcagu

SEQ ID NO: 790846 - RNA, 22 nt, Human
aaaauccucuaauucuagaaua

SEQ ID NO: 790847 - RNA, 23 nt, Human
aaugacaggcaauguaauugugu

SEQ ID NO: 790848 - RNA, 22 nt, Human
cauaaucagauguguacauaag

SEQ ID NO: 790849 - RNA, 22 nt, Human
gagggccagaucccaggaggaa

SEQ ID NO: 790850 - RNA, 22 nt, Human
acuggcagagguuggacaccau

SEQ ID NO: 790851 - RNA, 22 nt, Human
gcaggagcaaacugcagugugg

SEQ ID NO: 790852 - RNA, 22 nt, Human
aaaauacuguggaguguugaaa

SEQ ID NO: 790853 - RNA, 21 nt, Human
gcccuaggcuaccuggagcgc

SEQ ID NO: 790854 - RNA, 22 nt, Human
cagcauagcugauuaaggcaaa

SEQ ID NO: 790855 - RNA, 22 nt, Human
cugugcugguccagggagcugg

SEQ ID NO: 790856 - RNA, 22 nt, Human
ccucaggccagggggcggccag

SEQ ID NO: 790857 - RNA, 22 nt, Human
ggaggccaucagggagggcauu

SEQ ID NO: 790858 - RNA, 22 nt, Human
ugccacagcagugcuuugacag

SEQ ID NO: 790859 - RNA, 22 nt, Human
uagcucuagcacuggauaaucc

SEQ ID NO: 790860 - RNA, 22 nt, Human
cacauuggcaaacgggguugca

SEQ ID NO: 790861 - RNA, 22 nt, Human
aguuuacaguucucaucgcaac

SEQ ID NO: 790862 - RNA, 22 nt, Human
aucaucuugaaagucuauguuu

SEQ ID NO: 790863 - RNA, 22 nt, Human
aauacagaggggucacaauuca

SEQ ID NO: 790864 - RNA, 22 nt, Human
gccagagguaucaaagauagua

SEQ ID NO: 790865 - RNA, 22 nt, Human
cuuugaucuacucacuaaacaa

SEQ ID NO: 790866 - RNA, 22 nt, Human
cucuuacauucuuuuacuagca

SEQ ID NO: 790867 - RNA, 22 nt, Human
acuuucccacuuaauguauuua

SEQ ID NO: 790868 - RNA, 22 nt, Human
acuggcuggccgcgcucuucgc

SEQ ID NO: 790869 - RNA, 22 nt, Human
aaggcccaggcugcccugggca

SEQ ID NO: 790870 - RNA, 22 nt, Human
uuauuuucuccucagaaagugg

SEQ ID NO: 790871 - RNA, 22 nt, Human
ggcagguagccuagaggagguu

SEQ ID NO: 790872 - RNA, 22 nt, Human
ugacaggaggguuguggcaggg

SEQ ID NO: 790873 - RNA, 22 nt, Human
gccuggugaaaggcagagagcg

SEQ ID NO: 790874 - RNA, 22 nt, Human
guccagagauggacgagcagau

SEQ ID NO: 790875 - RNA, 22 nt, Human
aagaaauaagacuucucugucc

SEQ ID NO: 790876 - RNA, 22 nt, Human
aauuauauguuaaucuucaauu

SEQ ID NO: 790877 - RNA, 22 nt, Human
uuacaagcagcuacauaucaca

SEQ ID NO: 790878 - RNA, 22 nt, Human
auaggaaagaaaauuauguagg

SEQ ID NO: 790879 - RNA, 22 nt, Human
cccagagcuccgguccugccca

SEQ ID NO: 790880 - RNA, 22 nt, Human
uucuucccagccagcacagccc

SEQ ID NO: 790881 - RNA, 22 nt, Human
uaguugacaucaucagccugga

SEQ ID NO: 790882 - RNA, 22 nt, Human
auucauguaacauuagagaaau

SEQ ID NO: 790883 - RNA, 22 nt, Human
aguuccaugucuggguuuguga

SEQ ID NO: 790884 - RNA, 22 nt, Human
cccacucuggcucccuucuagu

SEQ ID NO: 790885 - RNA, 22 nt, Human
gagcagcugugggguugaccau

SEQ ID NO: 790886 - RNA, 22 nt, Human
caugcacacugcaacaaggacu

SEQ ID NO: 790887 - RNA, 22 nt, Human
aaucuagauucggaucaaaggg

SEQ ID NO: 790888 - RNA, 22 nt, Human
augcaacagaaaauugccuggg

SEQ ID NO: 790889 - RNA, 22 nt, Human
uuucccuuugcacucuacaauu

SEQ ID NO: 790890 - RNA, 22 nt, Human
uauuucagcacaugggauaggu

SEQ ID NO: 790891 - RNA, 22 nt, Human
acaggacauguaccaggugguc

SEQ ID NO: 790892 - RNA, 22 nt, Human
ucugggggcgaccagggacugc

SEQ ID NO: 790893 - RNA, 22 nt, Human
aaucuggacuugucugugaaga

SEQ ID NO: 790894 - RNA, 22 nt, Human
aaauaguaaagugguagccauc

SEQ ID NO: 790895 - RNA, 22 nt, Human
cuauuuuaagaggccauuaggu

SEQ ID NO: 790896 - RNA, 21 nt, Human
ugggagagggcucagcuaccc

SEQ ID NO: 790897 - RNA, 22 nt, Human
gggaagauaguguugagggccc

SEQ ID NO: 790898 - RNA, 22 nt, Human
uccucaggcggugaggaggggc

SEQ ID NO: 790899 - RNA, 22 nt, Human
ggaggggucucuagcgaggaga

SEQ ID NO: 790900 - RNA, 22 nt, Human
uccugccugcaaucccagcacu

SEQ ID NO: 790901 - RNA, 22 nt, Human
cuggcucccucucccugaguca

SEQ ID NO: 790902 - RNA, 22 nt, Human
ugccacaguuucauggauucug

SEQ ID NO: 790903 - RNA, 22 nt, Human
gucuuuggauguaagauaaagu

SEQ ID NO: 790904 - RNA, 22 nt, Human
aaaaaauuaucauaguuccuga

SEQ ID NO: 790905 - RNA, 22 nt, Human
ccugagucuuucccauugcgcu

SEQ ID NO: 790906 - RNA, 23 nt, Human
ggccucagcgcacagaaacugcu

SEQ ID NO: 790907 - RNA, 22 nt, Human
acauggaaaguacuccacaauu

SEQ ID NO: 790908 - RNA, 22 nt, Human
aguggcaagagggucuauuguu

SEQ ID NO: 790909 - RNA, 22 nt, Human
agugaccgaggcacuuggcaac

SEQ ID NO: 790910 - RNA, 22 nt, Human
uaaaugaguaauauagcuguuu

SEQ ID NO: 790911 - RNA, 20 nt, Human
acuccagguggcaugaggac

SEQ ID NO: 790912 - RNA, 22 nt, Human
uuuucuguauuauugugcuuca

SEQ ID NO: 790913 - RNA, 22 nt, Human
cccaggccuggucugggccagu

SEQ ID NO: 790914 - RNA, 23 nt, Human
uucauugagcuguucuugaggau

SEQ ID NO: 790915 - RNA, 22 nt, Human
agccaggcuacuccuugcugac

SEQ ID NO: 790916 - RNA, 22 nt, Human
cagcaagauggugaaugagacg

SEQ ID NO: 790917 - RNA, 22 nt, Human
ugucauggcugaaagugggggc

SEQ ID NO: 790918 - RNA, 22 nt, Human
uucaagaagcccaaagacuagc

SEQ ID NO: 790919 - RNA, 23 nt, Human
gacagagugagaccuugucuuac

SEQ ID NO: 790920 - RNA, 22 nt, Human
auuuaucaccaguuagcugacu

SEQ ID NO: 790921 - RNA, 22 nt, Human
ucacauuuucuacuacuguacg

SEQ ID NO: 790922 - RNA, 22 nt, Human
acugucacugacagaaucaaca

SEQ ID NO: 790923 - RNA, 22 nt, Human
uggccacucagggaugcaggaa

SEQ ID NO: 790924 - RNA, 22 nt, Human
ucuuuggaucucaagguggcag

SEQ ID NO: 790925 - RNA, 22 nt, Human
aggcuaggcaugugcuaccaca

SEQ ID NO: 790926 - RNA, 22 nt, Human
aucauucugauggucaaugcua

SEQ ID NO: 790927 - RNA, 22 nt, Human
ucagcuccagaguugcacagug

SEQ ID NO: 790928 - RNA, 22 nt, Human
uguaauuuccugauguuagaac

SEQ ID NO: 790929 - RNA, 22 nt, Human
uuuuaucaaucauuaagacauu

SEQ ID NO: 790930 - RNA, 22 nt, Human
gggccaagggugcguggcagga

SEQ ID NO: 790931 - RNA, 22 nt, Human
ugaaacauuaggaaaucauuau

SEQ ID NO: 790932 - RNA, 22 nt, Human
gggagagaauuauugccagacc

SEQ ID NO: 790933 - RNA, 22 nt, Human
ccaggagcgcgugaacaggcug

SEQ ID NO: 790934 - RNA, 22 nt, Human
ggcagcuuguccuucaggagag

SEQ ID NO: 790935 - RNA, 22 nt, Human
uggauucaugcugggauuuuuc

SEQ ID NO: 790936 - RNA, 21 nt, Human
gccucuccaaauccugccuuc

SEQ ID NO: 790937 - RNA, 22 nt, Human
gggaggcacgaggcgcgcagug

SEQ ID NO: 790938 - RNA, 22 nt, Human
aggcugagugcuccccuagaug

SEQ ID NO: 790939 - RNA, 22 nt, Human
gagcucaggagcaucagaagaa

SEQ ID NO: 790940 - RNA, 21 nt, Human
ugucagagcuuguaggacauu

SEQ ID NO: 790941 - RNA, 22 nt, Human
agggccugucuguagaacugaa

SEQ ID NO: 790942 - RNA, 22 nt, Human
ccuggguuggagagcaauggug

SEQ ID NO: 790943 - RNA, 22 nt, Human
auguggcauucuuggucauuuc

SEQ ID NO: 790944 - RNA, 22 nt, Human
agccacaccuguccugccagcu

SEQ ID NO: 790945 - RNA, 22 nt, Human
ccagcuguuucugaugcuaggc

SEQ ID NO: 790946 - RNA, 22 nt, Human
uucauguucaugcuuaggaaaa

SEQ ID NO: 790947 - RNA, 22 nt, Human
gcagauggcugagccugcagau

SEQ ID NO: 790948 - RNA, 22 nt, Human
acaguguccccagcucugugag

SEQ ID NO: 790949 - RNA, 22 nt, Human
uaauuuuaauaguauguggcau

SEQ ID NO: 790950 - RNA, 22 nt, Human
auuucuguugcuuauaaauuac

SEQ ID NO: 790951 - RNA, 18 nt, Human
gacuuuaaaacacugcuc

SEQ ID NO: 790952 - RNA, 22 nt, Human
gggcccuggggauguggacgcg

SEQ ID NO: 790953 - RNA, 22 nt, Human
ucuuugauggagagauagauau

SEQ ID NO: 790954 - RNA, 22 nt, Human
agaggcucugccgccucaggua

SEQ ID NO: 790955 - RNA, 22 nt, Human
ccugcucugguuuagucagucu

SEQ ID NO: 790956 - RNA, 23 nt, Human
aucauucuccaaucuggagcagg

SEQ ID NO: 790957 - RNA, 22 nt, Human
aucacaguguagaccuuuuaaa

SEQ ID NO: 790958 - RNA, 22 nt, Human
gcauucuucacaguauuccucc

SEQ ID NO: 790959 - RNA, 22 nt, Human
cugaaugucgaucagcuugggu

SEQ ID NO: 790960 - RNA, 22 nt, Human
uugauuugauuguaauggcucu

SEQ ID NO: 790961 - RNA, 22 nt, Human
caguuucuucaucugcagaauc

SEQ ID NO: 790962 - RNA, 22 nt, Human
cagagccacuuggagaugagaa

SEQ ID NO: 790963 - RNA, 22 nt, Human
ggcuggcuugccaagcucaggg

SEQ ID NO: 790964 - RNA, 22 nt, Human
uuucuaucugagaagauaucua

SEQ ID NO: 790965 - RNA, 22 nt, Human
uauacacauuuuuaccuauagu

SEQ ID NO: 790966 - RNA, 22 nt, Human
ucccaagcaaugagucagggcc

SEQ ID NO: 790967 - RNA, 22 nt, Human
ugccagcaguagcaguaggcca

SEQ ID NO: 790968 - RNA, 22 nt, Human
uagaggccugaaagaaugauca

SEQ ID NO: 790969 - RNA, 22 nt, Human
uugggagauauuguucuuuaca

SEQ ID NO: 790970 - RNA, 22 nt, Human
uugcaaaugugaauaauuacac

SEQ ID NO: 790971 - RNA, 22 nt, Human
auccuaaaauuguucaauuucu

SEQ ID NO: 790972 - RNA, 22 nt, Human
ucaggcugcaguggcaaaagac

SEQ ID NO: 790973 - RNA, 22 nt, Human
cauucacaucuuguuccaucac

SEQ ID NO: 790974 - RNA, 22 nt, Human
agucuuuauacagaaauauaug

SEQ ID NO: 790975 - RNA, 22 nt, Human
gcucugcccaaagcuguggcug

SEQ ID NO: 790976 - RNA, 20 nt, Human
acaggaugccugccauuuca

SEQ ID NO: 790977 - RNA, 22 nt, Human
uuucuucuugauuuaaacaggg

SEQ ID NO: 790978 - RNA, 22 nt, Human
gcucuuccauuucucuugaacu

SEQ ID NO: 790979 - RNA, 23 nt, Human
ugcacaggacggccuuauaagua

SEQ ID NO: 790980 - RNA, 22 nt, Human
gcuggcugaaucuucugcaaua

SEQ ID NO: 790981 - RNA, 22 nt, Human
uucauguauugcauuguguccu

SEQ ID NO: 790982 - RNA, 22 nt, Human
aaggcaguuugggccaccaucu

SEQ ID NO: 790983 - RNA, 22 nt, Human
uucacauaaaagcuccaaagaa

SEQ ID NO: 790984 - RNA, 22 nt, Human
cucugcagaauuugagcugcuc

SEQ ID NO: 790985 - RNA, 22 nt, Human
caguugccuguuuccuugugug

SEQ ID NO: 790986 - RNA, 22 nt, Human
cuuuaaauaauacaagguccag

SEQ ID NO: 790987 - RNA, 22 nt, Human
aggaccagugagucuggcaagu

SEQ ID NO: 790988 - RNA, 22 nt, Human
ccaggcucugacauagauggga

SEQ ID NO: 790989 - RNA, 22 nt, Human
aaaagucucucugaguaaaagu

SEQ ID NO: 790990 - RNA, 17 nt, Human
uuauuuuuugggcugag

SEQ ID NO: 790991 - RNA, 22 nt, Human
gccuggcuaagcagaaggaccc

SEQ ID NO: 790992 - RNA, 22 nt, Human
acauucuuggacuccacucuag

SEQ ID NO: 790993 - RNA, 19 nt, Human
ccaguccucuuugggccug

SEQ ID NO: 790994 - RNA, 22 nt, Human
aauuugacccaucuuggaauuu

SEQ ID NO: 790995 - RNA, 22 nt, Human
cccaggggagguccucagggaa

SEQ ID NO: 790996 - RNA, 22 nt, Human
gcaggaugagugaguacauuua

SEQ ID NO: 790997 - RNA, 22 nt, Human
ucagaaguuucaaucccagcug

SEQ ID NO: 790998 - RNA, 22 nt, Human
gaaaaggcucucacucccuccg

SEQ ID NO: 790999 - RNA, 22 nt, Human
uccacagguauuucuccuugcu

SEQ ID NO: 791000 - RNA, 22 nt, Human
guuacaaaggaagcuucacugc

SEQ ID NO: 791001 - RNA, 22 nt, Human
uggggcuggggaucuugagccu

SEQ ID NO: 791002 - RNA, 22 nt, Human
cacagggccuggggcagcugcu

SEQ ID NO: 791003 - RNA, 22 nt, Human
ggcuggcacgaagcccugcugg

SEQ ID NO: 791004 - RNA, 22 nt, Human
ucccugccuccuggcagugcca

SEQ ID NO: 791005 - RNA, 22 nt, Human
aaacugcacuuuauuuugucaa

SEQ ID NO: 791006 - RNA, 22 nt, Human
gcuuccucccugcugcucacua

SEQ ID NO: 791007 - RNA, 22 nt, Human
gcugauuuugagaagcacaguc

SEQ ID NO: 791008 - RNA, 22 nt, Human
ugagaucacuuacguggcugca

SEQ ID NO: 791009 - RNA, 22 nt, Human
ugaaggcugggcucagccagcu

SEQ ID NO: 791010 - RNA, 22 nt, Human
ucuucaggcucuggcugccuuu

SEQ ID NO: 791011 - RNA, 22 nt, Human
cuucagugcauguuuauaauca

SEQ ID NO: 791012 - RNA, 22 nt, Human
ggcuccuggaaagcccucgcuc

SEQ ID NO: 791013 - RNA, 22 nt, Human
agggugguauuuaacaacugga

SEQ ID NO: 791014 - RNA, 22 nt, Human
uggcagauuuaacauuggaacu

SEQ ID NO: 791015 - RNA, 22 nt, Human
cagcucucacacccuccuccca

SEQ ID NO: 791016 - RNA, 21 nt, Human
uagaaucacuaauaagaugua

SEQ ID NO: 791017 - RNA, 22 nt, Human
uaggcagaauucauugugcugc

SEQ ID NO: 791018 - RNA, 22 nt, Human
cugccaggccuggggugcuguc

SEQ ID NO: 791019 - RNA, 22 nt, Human
agccuggcugggaagagccucu

SEQ ID NO: 791020 - RNA, 22 nt, Human
agagcuguggauaguccuggau

SEQ ID NO: 791021 - RNA, 22 nt, Human
caggaaaugaacaggaaugaac

SEQ ID NO: 791022 - RNA, 22 nt, Human
aacagucugggaguuccuuaua

SEQ ID NO: 791023 - RNA, 22 nt, Human
agucugaaccagauggcaaggu

SEQ ID NO: 791024 - RNA, 22 nt, Human
cugggaaguagaaucagaugag

SEQ ID NO: 791025 - RNA, 22 nt, Human
acagaaguguguguguaggaau

SEQ ID NO: 791026 - RNA, 22 nt, Human
aaauguguauaugaaacaugau

SEQ ID NO: 791027 - RNA, 22 nt, Human
aaaugccaggauuauuagaggc

SEQ ID NO: 791028 - RNA, 22 nt, Human
ugggcccugacuucaagcaucc

SEQ ID NO: 791029 - RNA, 22 nt, Human
uacagaguauuuuuaauauggu

SEQ ID NO: 791030 - RNA, 22 nt, Human
guugaaaauacagauuccuagg

SEQ ID NO: 791031 - RNA, 22 nt, Human
ggcaggcuagcacugauguccu

SEQ ID NO: 791032 - RNA, 20 nt, Human
cuggaauggguguggguuag

SEQ ID NO: 791033 - RNA, 22 nt, Human
uugcauguuguuuaauuucgag

SEQ ID NO: 791034 - RNA, 22 nt, Human
ucaggauguuaauauagcauua

SEQ ID NO: 791035 - RNA, 22 nt, Human
aucuucaauugaaaacuagccu

SEQ ID NO: 791036 - RNA, 22 nt, Human
auccagucaaaauuaguaaggu

SEQ ID NO: 791037 - RNA, 22 nt, Human
ucagaugguacuaauuuaagga

SEQ ID NO: 791038 - RNA, 22 nt, Human
uggucccuagcacagcuguccu

SEQ ID NO: 791039 - RNA, 22 nt, Human
agaaaacuugcucgagccuguu

SEQ ID NO: 791040 - RNA, 22 nt, Human
acuggcugaguuuauguucaca

SEQ ID NO: 791041 - RNA, 22 nt, Human
gcagaugguggaggcaagaggc

SEQ ID NO: 791042 - RNA, 22 nt, Human
uggcuggcauagccauugcucc

SEQ ID NO: 791043 - RNA, 22 nt, Human
agcaggcaggcccagcggcugg

SEQ ID NO: 791044 - RNA, 22 nt, Human
ccucccacauccuagcucugcu

SEQ ID NO: 791045 - RNA, 22 nt, Human
uaaagcuuguauugcaauauuu

SEQ ID NO: 791046 - RNA, 22 nt, Human
gggcucaguucugcuucaugcu

SEQ ID NO: 791047 - RNA, 22 nt, Human
cagacagaaggcuccuugaggu

SEQ ID NO: 791048 - RNA, 18 nt, Human
aagaggaggagcagguug

SEQ ID NO: 791049 - RNA, 22 nt, Human
ugcaucaaccuaauaucagcuc

SEQ ID NO: 791050 - RNA, 22 nt, Human
gcuccuggucuggagcuucaag

SEQ ID NO: 791051 - RNA, 22 nt, Human
gggagccagccuuugccuauaa

SEQ ID NO: 791052 - RNA, 22 nt, Human
agcaucugcauauugggagacc

SEQ ID NO: 791053 - RNA, 22 nt, Human
cugcuucuaagaaccugcagcu

SEQ ID NO: 791054 - RNA, 22 nt, Human
acaauagaguucucauaggaca

SEQ ID NO: 791055 - RNA, 22 nt, Human
uuuucaguuacuguuuauguga

SEQ ID NO: 791056 - RNA, 22 nt, Human
uccagggaagagcagaggcuac

SEQ ID NO: 791057 - RNA, 22 nt, Human
ugcugagauagcugacuaggca

SEQ ID NO: 791058 - RNA, 22 nt, Human
gcccaagccgccuuccagagac

SEQ ID NO: 791059 - RNA, 22 nt, Human
acagcagggguggaauaaacgu

SEQ ID NO: 791060 - RNA, 22 nt, Human
auuuucaaaacaucugcugugu

SEQ ID NO: 791061 - RNA, 22 nt, Human
cccagcagaaucugaugagggc

SEQ ID NO: 791062 - RNA, 19 nt, Human
uggcuuccugacucucauc

SEQ ID NO: 791063 - RNA, 22 nt, Human
gggaaggcaccaugguguucca

SEQ ID NO: 791064 - RNA, 22 nt, Human
guaaacauuuucaucugugccc

SEQ ID NO: 791065 - RNA, 22 nt, Human
ugcaggugugggcaggggagca

SEQ ID NO: 791066 - RNA, 22 nt, Human
ucagaaguauuaugcuaaagga

SEQ ID NO: 791067 - RNA, 22 nt, Human
cugagguggcauccuagcucua

SEQ ID NO: 791068 - RNA, 22 nt, Human
aggacagggauucaaacuccca

SEQ ID NO: 791069 - RNA, 20 nt, Human
gccaggcacuguucucaaua

SEQ ID NO: 791070 - RNA, 22 nt, Human
gagaggcuggcagugccagguu

SEQ ID NO: 791071 - RNA, 20 nt, Human
caguccugcaggcgggagaa

SEQ ID NO: 791072 - RNA, 22 nt, Human
ucauucuugaucacuaguuagu

SEQ ID NO: 791073 - RNA, 22 nt, Human
aaguccugugcuagagacaccu

SEQ ID NO: 791074 - RNA, 21 nt, Human
cuacccucacucccauuccuc

SEQ ID NO: 791075 - RNA, 22 nt, Human
caggcucccuaagucagcagcc

SEQ ID NO: 791076 - RNA, 22 nt, Human
gucugagggguuucccaggaca

SEQ ID NO: 791077 - RNA, 22 nt, Human
uggggccagcggggaggacuca

SEQ ID NO: 791078 - RNA, 22 nt, Human
aaaugucugagacuucugaacu

SEQ ID NO: 791079 - RNA, 22 nt, Human
gaugggcacggcagucugagag

SEQ ID NO: 791080 - RNA, 22 nt, Human
ucugagccccuagaacugagcg

SEQ ID NO: 791081 - RNA, 20 nt, Human
aagaaaacgucuucagggga

SEQ ID NO: 791082 - RNA, 22 nt, Human
uugcaaaaacugcaauuacuuu

SEQ ID NO: 791083 - RNA, 22 nt, Human
gucuggcacauaagaggagcuc

SEQ ID NO: 791084 - RNA, 22 nt, Human
cuaaacaagggauuauaauuga

SEQ ID NO: 791085 - RNA, 20 nt, Human
uaccacuuauuugaauaauu

SEQ ID NO: 791086 - RNA, 22 nt, Human
uuugcaaacauucagggcucca

SEQ ID NO: 791087 - RNA, 22 nt, Human
gcacauuucucaaagaauuguc

SEQ ID NO: 791088 - RNA, 22 nt, Human
uuuauacuucauaaugucuauu

SEQ ID NO: 791089 - RNA, 20 nt, Human
ccuggcaggcggguuacuua

SEQ ID NO: 791090 - RNA, 22 nt, Human
aacuucuggauguuucaaaugu

SEQ ID NO: 791091 - RNA, 22 nt, Human
agcaguccuucuuuagagagcc

SEQ ID NO: 791092 - RNA, 22 nt, Human
auuugcuuuaagguauaaaagg

SEQ ID NO: 791093 - RNA, 20 nt, Human
aggccugagagaugacuggg

SEQ ID NO: 791094 - RNA, 22 nt, Human
uaauagaauaguggaaacauug

SEQ ID NO: 791095 - RNA, 22 nt, Human
ccuggcugugcauugccggccc

SEQ ID NO: 791096 - RNA, 22 nt, Human
aguguuacugguucaugaaucu

SEQ ID NO: 791097 - RNA, 22 nt, Human
ggguggugagauguagcugaug

SEQ ID NO: 791098 - RNA, 20 nt, Human
gugcagaggcagccuguggg

SEQ ID NO: 791099 - RNA, 22 nt, Human
cagggagcuuugucuucucauu

SEQ ID NO: 791100 - RNA, 22 nt, Human
caggguggcacucagcgcaucu

SEQ ID NO: 791101 - RNA, 22 nt, Human
ucaggaggcucaagaccuggca

SEQ ID NO: 791102 - RNA, 22 nt, Human
ggcugccuucagacuccagcuu

SEQ ID NO: 791103 - RNA, 22 nt, Human
ucucuuccaguaagagucuuua

SEQ ID NO: 791104 - RNA, 22 nt, Human
aacugcaacuuguuugauucuu

SEQ ID NO: 791105 - RNA, 22 nt, Human
aagagcccuuguucauaauuau

SEQ ID NO: 791106 - RNA, 22 nt, Human
aauuuacacuucauuuggaggg

SEQ ID NO: 791107 - RNA, 22 nt, Human
uucuauuguaccuuuucucuca

SEQ ID NO: 791108 - RNA, 22 nt, Human
gccuggcugguagagggggcuc

SEQ ID NO: 791109 - RNA, 22 nt, Human
uuacaaguauuuaagaugcugu

SEQ ID NO: 791110 - RNA, 22 nt, Human
cauuuguaguuaaaaaugucuc

SEQ ID NO: 791111 - RNA, 22 nt, Human
uguucuuagcaggagcaucuau

SEQ ID NO: 791112 - RNA, 22 nt, Human
acagaacugggggcacagauag

SEQ ID NO: 791113 - RNA, 22 nt, Human
gcugccucugcgacucugggcg

SEQ ID NO: 791114 - RNA, 22 nt, Human
guuuacauguuuuucucuuaca

SEQ ID NO: 791115 - RNA, 22 nt, Human
aagggcagcugacagaugcuua

SEQ ID NO: 791116 - RNA, 22 nt, Human
aacuugaaugagaacuuuugcc

SEQ ID NO: 791117 - RNA, 22 nt, Human
ucccaggcugggggccugaagu

SEQ ID NO: 791118 - RNA, 22 nt, Human
uguguucaaugacuucaucuuu

SEQ ID NO: 791119 - RNA, 23 nt, Human
ucucagugaaucucagaauucgc

SEQ ID NO: 791120 - RNA, 22 nt, Human
guguuucuggggcauucauagu

SEQ ID NO: 791121 - RNA, 22 nt, Human
cccugcagagggaugggggcag

SEQ ID NO: 791122 - RNA, 22 nt, Human
ucauggcacaugcccuccaggg

SEQ ID NO: 791123 - RNA, 22 nt, Human
augugacuuugugucuuccauc

SEQ ID NO: 791124 - RNA, 21 nt, Human
guucuauuuugcaaacuucug

SEQ ID NO: 791125 - RNA, 22 nt, Human
gaggcucagagaagucauggua

SEQ ID NO: 791126 - RNA, 22 nt, Human
gggcuggagccuggcggugguu

SEQ ID NO: 791127 - RNA, 22 nt, Human
cuggcugcgucugcucugacag

SEQ ID NO: 791128 - RNA, 22 nt, Human
aagucaaaccuugcucacagga

SEQ ID NO: 791129 - RNA, 22 nt, Human
caugaaauguuagaauuagaca

SEQ ID NO: 791130 - RNA, 22 nt, Human
ccuggcagguggcgcccucggc

SEQ ID NO: 791131 - RNA, 22 nt, Human
gagcaggcaaagaugaaaggag

SEQ ID NO: 791132 - RNA, 22 nt, Human
aaaggaggccacauggcuagga

SEQ ID NO: 791133 - RNA, 22 nt, Human
gggacccagguaauccugugcu

SEQ ID NO: 791134 - RNA, 22 nt, Human
gcaggcaggcuuccuugaacug

SEQ ID NO: 791135 - RNA, 22 nt, Human
guuccagggaagggaaggcaga

SEQ ID NO: 791136 - RNA, 22 nt, Human
gucugagacugggcacauaccu

SEQ ID NO: 791137 - RNA, 22 nt, Human
ucugggaguaaggccuaggcau

SEQ ID NO: 791138 - RNA, 22 nt, Human
aucauggaaagguucagcaagc

SEQ ID NO: 791139 - RNA, 22 nt, Human
gagcauaggacacagaggugug

SEQ ID NO: 791140 - RNA, 22 nt, Human
cggccaagccggggccccgaag

SEQ ID NO: 791141 - RNA, 22 nt, Human
ccuccuggagcauuggugagga

SEQ ID NO: 791142 - RNA, 22 nt, Human
auggcagaauccauaguaggug

SEQ ID NO: 791143 - RNA, 22 nt, Human
caagaaauuucuuaagaacuaa

SEQ ID NO: 791144 - RNA, 22 nt, Human
aaaauagguacggauuagaaug

SEQ ID NO: 791145 - RNA, 22 nt, Human
cacugagggggugguuucagga

SEQ ID NO: 791146 - RNA, 22 nt, Human
ugacagcccaccucacaggauu

SEQ ID NO: 791147 - RNA, 22 nt, Human
ugucugcuaaauuacuauuaca

SEQ ID NO: 791148 - RNA, 22 nt, Human
augccacauaaccaguucacuu

SEQ ID NO: 791149 - RNA, 22 nt, Human
acaaacuuauguuucauaugua

SEQ ID NO: 791150 - RNA, 22 nt, Human
uuaauacaagcauaugcacaca

SEQ ID NO: 791151 - RNA, 22 nt, Human
aaagcucugggaaugcuuaucu

SEQ ID NO: 791152 - RNA, 22 nt, Human
uuugcauccugugugugaaagu

SEQ ID NO: 791153 - RNA, 22 nt, Human
caguagaauuauuauaaaacau

SEQ ID NO: 791154 - RNA, 22 nt, Human
ugcuggagaucauuaauguuca

SEQ ID NO: 791155 - RNA, 22 nt, Human
gaaaucaguucugaaauuuaca

SEQ ID NO: 791156 - RNA, 22 nt, Human
ccaggcucugagaggaauguga

SEQ ID NO: 791157 - RNA, 22 nt, Human
gcagagaacccagcagauuggc

SEQ ID NO: 791158 - RNA, 22 nt, Human
cugggccacuuccucaggggaa

SEQ ID NO: 791159 - RNA, 22 nt, Human
uauacacaccuccaaagcagga

SEQ ID NO: 791160 - RNA, 22 nt, Human
cuccucagcugggaggaguccc

SEQ ID NO: 791161 - RNA, 22 nt, Human
aagaggaguagaugugguuggu

SEQ ID NO: 791162 - RNA, 22 nt, Human
ccaaaggcggaacugagucucu

SEQ ID NO: 791163 - RNA, 22 nt, Human
gccacaggugggcucugggaaa

SEQ ID NO: 791164 - RNA, 22 nt, Human
gaggaggggacaguacuugugc

SEQ ID NO: 791165 - RNA, 20 nt, Human
ccaggcacugucccaugcag

SEQ ID NO: 791166 - RNA, 22 nt, Human
ugcagaauuauggugcuggcuu

SEQ ID NO: 791167 - RNA, 22 nt, Human
gaaagugcagucagacaaggca

SEQ ID NO: 791168 - RNA, 22 nt, Human
aaggaggaauuucagggugaau

SEQ ID NO: 791169 - RNA, 22 nt, Human
acauacuugaagcaagugauca

SEQ ID NO: 791170 - RNA, 22 nt, Human
ucacaauuguuuuuaggaucaa

SEQ ID NO: 791171 - RNA, 22 nt, Human
gagaaggacuacggaaaacaga

SEQ ID NO: 791172 - RNA, 22 nt, Human
agccucagcacgcagcucugug

SEQ ID NO: 791173 - RNA, 22 nt, Human
agagaauuggagcagugacagg

SEQ ID NO: 791174 - RNA, 20 nt, Human
uuucagagugucuuuccauu

SEQ ID NO: 791175 - RNA, 22 nt, Human
augcaauaguaauucuagucug

SEQ ID NO: 791176 - RNA, 22 nt, Human
gcgagggcacgcgguugaaggc

SEQ ID NO: 791177 - RNA, 22 nt, Human
uuucagaaccaagagagacauc

SEQ ID NO: 791178 - RNA, 22 nt, Human
ggcccagguccagcgaguaccu

SEQ ID NO: 791179 - RNA, 20 nt, Human
ggugcagguaacgcugugcu

SEQ ID NO: 791180 - RNA, 23 nt, Human
agcacagacuagaaaggucuuuc

SEQ ID NO: 791181 - RNA, 18 nt, Human
gagaaaccugugaaugcu

SEQ ID NO: 791182 - RNA, 22 nt, Human
cauggccaaggaugcucaacca

SEQ ID NO: 791183 - RNA, 22 nt, Human
acagggcagaaauguugcaucu

SEQ ID NO: 791184 - RNA, 18 nt, Human
ucucucagggaaacagaa

SEQ ID NO: 791185 - RNA, 22 nt, Human
caaauguuaaauguguuaagac

SEQ ID NO: 791186 - RNA, 22 nt, Human
ggcugccucaaagcucaagcuc

SEQ ID NO: 791187 - RNA, 23 nt, Human
agagcaaggaaaugaggugugau

SEQ ID NO: 791188 - RNA, 22 nt, Human
caggaggcccggccacagccca

SEQ ID NO: 791189 - RNA, 22 nt, Human
guccugcacauggagggcaaug

SEQ ID NO: 791190 - RNA, 22 nt, Human
acugaacauaugcaagaccauu

SEQ ID NO: 791191 - RNA, 22 nt, Human
acacauuuauggaucgcagaaa

SEQ ID NO: 791192 - RNA, 22 nt, Human
uccagcuuauagguagauuuaa

SEQ ID NO: 791193 - RNA, 22 nt, Human
gugcccaggugucccugagaag

SEQ ID NO: 791194 - RNA, 22 nt, Human
auacaagguggagucaggaaaa

SEQ ID NO: 791195 - RNA, 22 nt, Human
uggcccaggggcucuugguguu

SEQ ID NO: 791196 - RNA, 22 nt, Human
uuuguacugaagauuguaaacu

SEQ ID NO: 791197 - RNA, 22 nt, Human
uuuucucaggugcuuaucuaag

SEQ ID NO: 791198 - RNA, 22 nt, Human
gaugaugacagugauuagacug

SEQ ID NO: 791199 - RNA, 20 nt, Human
agaaaauguuuucagcugga

SEQ ID NO: 791200 - RNA, 22 nt, Human
uugcauguccaggguauugugg

SEQ ID NO: 791201 - RNA, 22 nt, Human
acauguaaaagauaaauuaaca

SEQ ID NO: 791202 - RNA, 22 nt, Human
aauagauggguuaaacagcaaa

SEQ ID NO: 791203 - RNA, 22 nt, Human
aucauaaaauugcaccauuucu

SEQ ID NO: 791204 - RNA, 22 nt, Human
ucuggcuguuguuagguuccug

SEQ ID NO: 791205 - RNA, 22 nt, Human
gcugggagaggcagcuuucgga

SEQ ID NO: 791206 - RNA, 22 nt, Human
guauuuuuaguagagucggggu

SEQ ID NO: 791207 - RNA, 22 nt, Human
aaacuugugagcuaaauaaaug

SEQ ID NO: 791208 - RNA, 22 nt, Human
gccucugccaagggggcugcgg

SEQ ID NO: 791209 - RNA, 22 nt, Human
acacaguuuaugguauucuguu

SEQ ID NO: 791210 - RNA, 22 nt, Human
aagacuuucuguaaagcuacag

SEQ ID NO: 791211 - RNA, 22 nt, Human
uugaggaggacagaaacauuua

SEQ ID NO: 791212 - RNA, 22 nt, Human
agagcuggauggucaagauggc

SEQ ID NO: 791213 - RNA, 22 nt, Human
uucauaaucaccaaaaacugga

SEQ ID NO: 791214 - RNA, 22 nt, Human
aguaaaacagagaaaucacuca

SEQ ID NO: 791215 - RNA, 22 nt, Human
gugggguagaucuuucucagga

SEQ ID NO: 791216 - RNA, 17 nt, Human
auacaaagccauaaacc

SEQ ID NO: 791217 - RNA, 22 nt, Human
cagcucaguuucaauaccaggu

SEQ ID NO: 791218 - RNA, 22 nt, Human
ccagcccucgguagucccauag

SEQ ID NO: 791219 - RNA, 22 nt, Human
ucugacuugcaucuuaaaggag

SEQ ID NO: 791220 - RNA, 22 nt, Human
cacagggcagugcugcccacuc

SEQ ID NO: 791221 - RNA, 22 nt, Human
gaggguggggaauagacugcua

SEQ ID NO: 791222 - RNA, 22 nt, Human
gcugaaaugggcacugaaggcc

SEQ ID NO: 791223 - RNA, 22 nt, Human
ucacugggagaugugggaaggg

SEQ ID NO: 791224 - RNA, 22 nt, Human
uaaggcagccgcucagagaggu

SEQ ID NO: 791225 - RNA, 22 nt, Human
gcaauaaacucucucaagccac

SEQ ID NO: 791226 - RNA, 21 nt, Human
uggcagggguaguaguacagc

SEQ ID NO: 791227 - RNA, 22 nt, Human
ggcagggacuauguuucaugga

SEQ ID NO: 791228 - RNA, 22 nt, Human
gcagguguucucagaggaggcu

SEQ ID NO: 791229 - RNA, 22 nt, Human
gagaggcccugaagcccacaga

SEQ ID NO: 791230 - RNA, 22 nt, Human
ugcaauuugacgucagcacagu

SEQ ID NO: 791231 - RNA, 22 nt, Human
caggcuuggcagggaggcuggu

SEQ ID NO: 791232 - RNA, 22 nt, Human
cugggagugucccucugguaau

SEQ ID NO: 791233 - RNA, 22 nt, Human
uuuggcggacugagaacgcggg

SEQ ID NO: 791234 - RNA, 19 nt, Human
ucugaagaauuagagagca

SEQ ID NO: 791235 - RNA, 22 nt, Human
agcugauuccacuuuuucccca

SEQ ID NO: 791236 - RNA, 22 nt, Human
agcuguccuggcucaggcugug

SEQ ID NO: 791237 - RNA, 22 nt, Human
acauacauauguuuaaaugcau

SEQ ID NO: 791238 - RNA, 22 nt, Human
gugcccaggggccagcugccgg

SEQ ID NO: 791239 - RNA, 22 nt, Human
uccaggagaggccugaccaggu

SEQ ID NO: 791240 - RNA, 22 nt, Human
ccacagugauucacuuuugaag

SEQ ID NO: 791241 - RNA, 22 nt, Human
gaggggagaggcuuauggauca

SEQ ID NO: 791242 - RNA, 22 nt, Human
gaugaggcaagccagaggacug

SEQ ID NO: 791243 - RNA, 22 nt, Human
aaggcagaggaaggucuaguuu

SEQ ID NO: 791244 - RNA, 22 nt, Human
ccuucugauacugacaucauuu

SEQ ID NO: 791245 - RNA, 22 nt, Human
agccccaggcccggacgccucu

SEQ ID NO: 791246 - RNA, 22 nt, Human
uuuccuuuuauaaggcuugagg

SEQ ID NO: 791247 - RNA, 22 nt, Human
ucauacauucagcagauauuug

SEQ ID NO: 791248 - RNA, 22 nt, Human
uucuauuuccaguccuucagag

SEQ ID NO: 791249 - RNA, 22 nt, Human
caggugaguaacaaugggugau

SEQ ID NO: 791250 - RNA, 22 nt, Human
acacagugugugcagucggacg

SEQ ID NO: 791251 - RNA, 22 nt, Human
cugcaaauaggggugugaauaa

SEQ ID NO: 791252 - RNA, 19 nt, Human
ucuaaacucuauacuggua

SEQ ID NO: 791253 - RNA, 22 nt, Human
cagacaaggccaucuuucauuu

SEQ ID NO: 791254 - RNA, 22 nt, Human
gggggcugaucauuuacugggc

SEQ ID NO: 791255 - RNA, 22 nt, Human
acacauaugucauugaaaaauc

SEQ ID NO: 791256 - RNA, 22 nt, Human
aaguaugcuaauuaacuagcac

SEQ ID NO: 791257 - RNA, 21 nt, Human
gcagaugggaagagacgaggc

SEQ ID NO: 791258 - RNA, 22 nt, Human
gaggcugggaaguccaagacca

SEQ ID NO: 791259 - RNA, 21 nt, Human
aaccagagccaggcucucagc

SEQ ID NO: 791260 - RNA, 22 nt, Human
caagagcauuuaguuagcuggu

SEQ ID NO: 791261 - RNA, 21 nt, Human
ugcagauaauugaaagcugac

SEQ ID NO: 791262 - RNA, 22 nt, Human
uuuugcaaaguacauuaucagg

SEQ ID NO: 791263 - RNA, 22 nt, Human
uggaagugauuacaauguagua

SEQ ID NO: 791264 - RNA, 22 nt, Human
cugguguggacuccgcgcggag

SEQ ID NO: 791265 - RNA, 22 nt, Human
ugagcucauagcucuuauuaug

SEQ ID NO: 791266 - RNA, 22 nt, Human
ucaggagcucaggcugauggaa

SEQ ID NO: 791267 - RNA, 22 nt, Human
caggacaguauaggcuuuagga

SEQ ID NO: 791268 - RNA, 22 nt, Human
ucaagaugaaccaggacauuca

SEQ ID NO: 791269 - RNA, 20 nt, Human
ucacaggagggaaggcaggu

SEQ ID NO: 791270 - RNA, 22 nt, Human
ucagggaagacuucuuagagga

SEQ ID NO: 791271 - RNA, 23 nt, Human
cacugggggcugcuacagagagg

SEQ ID NO: 791272 - RNA, 22 nt, Human
agucuaauguuuguaaaaucau

SEQ ID NO: 791273 - RNA, 22 nt, Human
ccugagagcccuagccaggcgc

SEQ ID NO: 791274 - RNA, 22 nt, Human
acagguagcauuuuuccucuuu

SEQ ID NO: 791275 - RNA, 22 nt, Human
cagcauggacagggguggcguu

SEQ ID NO: 791276 - RNA, 20 nt, Human
agagugcuggacugaggagc

SEQ ID NO: 791277 - RNA, 22 nt, Human
ugcauuaagaauuucugaggau

SEQ ID NO: 791278 - RNA, 22 nt, Human
agugaaaacacuaguucuugcc

SEQ ID NO: 791279 - RNA, 22 nt, Human
gcaggugggggucggugcaucu

SEQ ID NO: 791280 - RNA, 22 nt, Human
uggucccuaggaaagcaguguu

SEQ ID NO: 791281 - RNA, 22 nt, Human
ccaguguauuuuugggaccugc

SEQ ID NO: 791282 - RNA, 21 nt, Human
agagcugguagguagguaggu

SEQ ID NO: 791283 - RNA, 22 nt, Human
gugccugggguugagcuaugaa

SEQ ID NO: 791284 - RNA, 22 nt, Human
acuuaaaguaguuuuacugugg

SEQ ID NO: 791285 - RNA, 19 nt, Human
cuucuugauaagguucuuu

SEQ ID NO: 791286 - RNA, 22 nt, Human
ucuagauuuuugugcaccuuug

SEQ ID NO: 791287 - RNA, 22 nt, Human
cauugagaggcugccugccuga

SEQ ID NO: 791288 - RNA, 22 nt, Human
ggucaaguaacaaaucaggagc

SEQ ID NO: 791289 - RNA, 19 nt, Human
gcacaggacaucugaugga

SEQ ID NO: 791290 - RNA, 19 nt, Human
uccucccuuugguguccug

SEQ ID NO: 791291 - RNA, 20 nt, Human
cuaauauucuacucuaagga

SEQ ID NO: 791292 - RNA, 22 nt, Human
agcaauaacagaaaacuuuccu

SEQ ID NO: 791293 - RNA, 22 nt, Human
ccugcuggcagaggggguuacu

SEQ ID NO: 791294 - RNA, 22 nt, Human
ggccagcucuuguccacggagg

SEQ ID NO: 791295 - RNA, 22 nt, Human
ucagaaucucuggaggcuuggc

SEQ ID NO: 791296 - RNA, 22 nt, Human
agagauggccuuaggugggaau

SEQ ID NO: 791297 - RNA, 22 nt, Human
ugggagcaguucagguguggcu

SEQ ID NO: 791298 - RNA, 22 nt, Human
aaggccugcucagcugucugug

SEQ ID NO: 791299 - RNA, 22 nt, Human
aaagcauuucaugucuagaaag

SEQ ID NO: 791300 - RNA, 22 nt, Human
gccugcugcauccaggcuauug

SEQ ID NO: 791301 - RNA, 22 nt, Human
uuaauauguugaaauuuauuag

SEQ ID NO: 791302 - RNA, 22 nt, Human
uuacaaagaguguucuuuucca

SEQ ID NO: 791303 - RNA, 22 nt, Human
ggggaagggaguccaaguguua

SEQ ID NO: 791304 - RNA, 19 nt, Human
cucagcacuuuuacacagg

SEQ ID NO: 791305 - RNA, 22 nt, Human
uucauucuuugaaucugaggua

SEQ ID NO: 791306 - RNA, 21 nt, Human
ugggggagaauugguugcuuu

SEQ ID NO: 791307 - RNA, 22 nt, Human
agucucuuccuucaaggcuggu

SEQ ID NO: 791308 - RNA, 22 nt, Human
gugcagcugcccaagccugagc

SEQ ID NO: 791309 - RNA, 20 nt, Human
aaaaugaugggcagggcagg

SEQ ID NO: 791310 - RNA, 22 nt, Human
auacugaugaugugaagaaaca

SEQ ID NO: 791311 - RNA, 17 nt, Human
uccaggagaggcaaugg

SEQ ID NO: 791312 - RNA, 22 nt, Human
uccaggccgcaggggcagcccc

SEQ ID NO: 791313 - RNA, 22 nt, Human
augcagaucugugaaaggaaua

SEQ ID NO: 791314 - RNA, 22 nt, Human
cuggcagcaggucacacgcaga

SEQ ID NO: 791315 - RNA, 22 nt, Human
cagccaggcccagaucaugcug

SEQ ID NO: 791316 - RNA, 22 nt, Human
ccuggucagguaacugggcuga

SEQ ID NO: 791317 - RNA, 22 nt, Human
acaggacuguggaaggaucucu

SEQ ID NO: 791318 - RNA, 22 nt, Human
gaagcuuugagagcagaagccc

SEQ ID NO: 791319 - RNA, 22 nt, Human
ugugauuacugaauagaaaaua

SEQ ID NO: 791320 - RNA, 22 nt, Human
aggcagugagcagggugucaug

SEQ ID NO: 791321 - RNA, 22 nt, Human
ugaacaugcuguugauggccug

SEQ ID NO: 791322 - RNA, 22 nt, Human
ucuguauaaggacaaacauuua

SEQ ID NO: 791323 - RNA, 22 nt, Human
guucuggguagauguaucuuuu

SEQ ID NO: 791324 - RNA, 22 nt, Human
agguauguauguguguauauuu

SEQ ID NO: 791325 - RNA, 22 nt, Human
uuaaguauauccauuugacugg

SEQ ID NO: 791326 - RNA, 23 nt, Human
gcaugcaacuugcaguaguauuc

SEQ ID NO: 791327 - RNA, 22 nt, Human
ggcuggcuccaccuagguagcu

SEQ ID NO: 791328 - RNA, 22 nt, Human
gaauuuaaggaccaagcauuuu

SEQ ID NO: 791329 - RNA, 22 nt, Human
gccaggcauguccucugcagaa

SEQ ID NO: 791330 - RNA, 22 nt, Human
ucuggcuggcucggccgggagu

SEQ ID NO: 791331 - RNA, 22 nt, Human
uacaacauuguguugcuucaua

SEQ ID NO: 791332 - RNA, 22 nt, Human
ucagagucuuaacuauucagag

SEQ ID NO: 791333 - RNA, 20 nt, Human
ugugcccagcagaggcugcc

SEQ ID NO: 791334 - RNA, 22 nt, Human
uuuuuuauagcaaugaacccac

SEQ ID NO: 791335 - RNA, 20 nt, Human
cagaggcauuuucagacucu

SEQ ID NO: 791336 - RNA, 22 nt, Human
aauucacaggagguauuugucc

SEQ ID NO: 791337 - RNA, 22 nt, Human
uccugccugagcguggaggagg

SEQ ID NO: 791338 - RNA, 22 nt, Human
acauugauauuucaaauacagg

SEQ ID NO: 791339 - RNA, 22 nt, Human
aggcagauauuucaguucacau

SEQ ID NO: 791340 - RNA, 22 nt, Human
cucuggcuuugcucaugcaucc

SEQ ID NO: 791341 - RNA, 22 nt, Human
agaaauuaugcaguaguuuuau

SEQ ID NO: 791342 - RNA, 22 nt, Human
ggucccaguccucucccugcua

SEQ ID NO: 791343 - RNA, 22 nt, Human
uugucacacccuuuuuuauacc

SEQ ID NO: 791344 - RNA, 22 nt, Human
acaauguaggcugaaaaagcuu

SEQ ID NO: 791345 - RNA, 22 nt, Human
uagacaauauuugaaaguagug

SEQ ID NO: 791346 - RNA, 22 nt, Human
gggccagcucugugauguaggg

SEQ ID NO: 791347 - RNA, 22 nt, Human
cuuccagcugauuacaggcuau

SEQ ID NO: 791348 - RNA, 22 nt, Human
aauauucaaguuauucuuucuu

SEQ ID NO: 791349 - RNA, 22 nt, Human
ucaauaaauagcuuggcucagc

SEQ ID NO: 791350 - RNA, 17 nt, Human
uggaugugggaucugga

SEQ ID NO: 791351 - RNA, 22 nt, Human
aaacacuagcaggaagcacuga

SEQ ID NO: 791352 - RNA, 22 nt, Human
gcaggagccagggauuccagga

SEQ ID NO: 791353 - RNA, 22 nt, Human
acuggauucucuuacacagaug

SEQ ID NO: 791354 - RNA, 22 nt, Human
guuguuuugcaggauccuuaca

SEQ ID NO: 791355 - RNA, 22 nt, Human
agcugagagguggcaagcugua

SEQ ID NO: 791356 - RNA, 22 nt, Human
gcccuggagggccagcgacugg

SEQ ID NO: 791357 - RNA, 22 nt, Human
gggaacuguuuaacagggguuu

SEQ ID NO: 791358 - RNA, 18 nt, Human
ucauuuguuuugcaugaa

SEQ ID NO: 791359 - RNA, 22 nt, Human
uuuaaggcuucacuggaguggg

SEQ ID NO: 791360 - RNA, 22 nt, Human
acugcugauuuuaggacuguua

SEQ ID NO: 791361 - RNA, 22 nt, Human
gaagcagagccuaaggcagaca

SEQ ID NO: 791362 - RNA, 22 nt, Human
gcuucuacccacgagaugcaaa

SEQ ID NO: 791363 - RNA, 22 nt, Human
aaugggaagucacuacuguuac

SEQ ID NO: 791364 - RNA, 22 nt, Human
aauuaacagagggcuuauuacu

SEQ ID NO: 791365 - RNA, 22 nt, Human
cuuuugcaccuuuuaaguaaug

SEQ ID NO: 791366 - RNA, 22 nt, Human
aguggucuagucugaggauuau

SEQ ID NO: 791367 - RNA, 22 nt, Human
acaggacaaaaaucuggauggc

SEQ ID NO: 791368 - RNA, 22 nt, Human
aagugcauauuuuuguuguaga

SEQ ID NO: 791369 - RNA, 22 nt, Human
uggcagauaaccugcugugccc

SEQ ID NO: 791370 - RNA, 18 nt, Human
accuggcugugugagcug

SEQ ID NO: 791371 - RNA, 22 nt, Human
aaaguuuacagugcacaugggu

SEQ ID NO: 791372 - RNA, 22 nt, Human
cuggaaggcggagguuguagug

SEQ ID NO: 791373 - RNA, 22 nt, Human
ccuggcuccugccucugcaggg

SEQ ID NO: 791374 - RNA, 20 nt, Human
gcuuuuucuaauagcagucc

SEQ ID NO: 791375 - RNA, 22 nt, Human
guuuacaugcagaaaaucaaug

SEQ ID NO: 791376 - RNA, 22 nt, Human
gauuuaguggcccuugguacac

SEQ ID NO: 791377 - RNA, 22 nt, Human
ggaggagguggguuaaguugua

SEQ ID NO: 791378 - RNA, 22 nt, Human
ucucuugauauauuacauagag

SEQ ID NO: 791379 - RNA, 22 nt, Human
ugagccagcaggccuccagugg

SEQ ID NO: 791380 - RNA, 22 nt, Human
cacagcagacagggaggcggcu

SEQ ID NO: 791381 - RNA, 22 nt, Human
gggaaggcauaccugagggaga

SEQ ID NO: 791382 - RNA, 22 nt, Human
cacuggcagauuugggaucugg

SEQ ID NO: 791383 - RNA, 22 nt, Human
cagggcuguuagcugcugcucu

SEQ ID NO: 791384 - RNA, 22 nt, Human
acaggagccaaacacaugccag

SEQ ID NO: 791385 - RNA, 22 nt, Human
aagugcauuagauagaaugaug

SEQ ID NO: 791386 - RNA, 23 nt, Human
auccagccuggggguuuaaccac

SEQ ID NO: 791387 - RNA, 22 nt, Human
ugcaaaugaguugcagaucagg

SEQ ID NO: 791388 - RNA, 22 nt, Human
ugcccagcgcccacauucuguc

SEQ ID NO: 791389 - RNA, 22 nt, Human
gcagagggcagggguguuuguu

SEQ ID NO: 791390 - RNA, 21 nt, Human
uggcugcaagcagcugccucc

SEQ ID NO: 791391 - RNA, 22 nt, Human
agcagccagagaaugaugcagu

SEQ ID NO: 791392 - RNA, 22 nt, Human
gucaggggaugugcugguggcc

SEQ ID NO: 791393 - RNA, 22 nt, Human
aagacauugcugcuuuuaauug

SEQ ID NO: 791394 - RNA, 22 nt, Human
acaaugcaccuauuuuaaaacu

SEQ ID NO: 791395 - RNA, 22 nt, Human
gguccaaggcucgguggcgggg

SEQ ID NO: 791396 - RNA, 22 nt, Human
ugaggaaguugaucucaucagu

SEQ ID NO: 791397 - RNA, 22 nt, Human
uggggugacagugcagugguca

SEQ ID NO: 791398 - RNA, 22 nt, Human
ucaauucugguccucaggaacu

SEQ ID NO: 791399 - RNA, 22 nt, Human
acucacugcacuuugaaaugug

SEQ ID NO: 791400 - RNA, 22 nt, Human
uuugcuuuguuuaaaaguggua

SEQ ID NO: 791401 - RNA, 22 nt, Human
ucugcagcuuuccccugauuua

SEQ ID NO: 791402 - RNA, 22 nt, Human
gcacugcuuuuaccuaggugag

SEQ ID NO: 791403 - RNA, 22 nt, Human
gcaagcugugccuucucaggau

SEQ ID NO: 791404 - RNA, 23 nt, Human
ugauuuuaaaaaguaaguuauca

SEQ ID NO: 791405 - RNA, 22 nt, Human
ucagaacuuaaagccgauuggg

SEQ ID NO: 791406 - RNA, 22 nt, Human
guagcgguuaugucugcaggga

SEQ ID NO: 791407 - RNA, 22 nt, Human
uuucuuaugggguaguccuuua

SEQ ID NO: 791408 - RNA, 17 nt, Human
ggcaggugcggggccgc

SEQ ID NO: 791409 - RNA, 22 nt, Human
caggacugauguuccuccagcc

SEQ ID NO: 791410 - RNA, 22 nt, Human
aagcagguuaugaaauauagaa

SEQ ID NO: 791411 - RNA, 23 nt, Human
aagcagggagauucuuagcugag

SEQ ID NO: 791412 - RNA, 23 nt, Human
ucucagaggauuccugggccuug

SEQ ID NO: 791413 - RNA, 21 nt, Human
ggcugggucaugcagcuggcc

SEQ ID NO: 791414 - RNA, 22 nt, Human
auauacuugauuuaacugagca

SEQ ID NO: 791415 - RNA, 22 nt, Human
uugaaaugcaucaucauuuaga

SEQ ID NO: 791416 - RNA, 22 nt, Human
cuguggugagcaacugacugaa

SEQ ID NO: 791417 - RNA, 22 nt, Human
cugggagagaagcgaagcuggg

SEQ ID NO: 791418 - RNA, 22 nt, Human
aagcacuugcuuagaugugguu

SEQ ID NO: 791419 - RNA, 18 nt, Human
ugcugggguagaauccac

SEQ ID NO: 791420 - RNA, 22 nt, Human
guuucaaagggaagacgcugga

SEQ ID NO: 791421 - RNA, 22 nt, Human
uaggauuuaggcuuuaacaucu

SEQ ID NO: 791422 - RNA, 21 nt, Human
uucuucaggccaaugcucauu

SEQ ID NO: 791423 - RNA, 22 nt, Human
gaauucugggagagaucugaca

SEQ ID NO: 791424 - RNA, 22 nt, Human
aaucaggaacucaagugcauug

SEQ ID NO: 791425 - RNA, 22 nt, Human
gcccagccuccaagcuccaagg

SEQ ID NO: 791426 - RNA, 20 nt, Human
ggcagaccugcugagagccc

SEQ ID NO: 791427 - RNA, 22 nt, Human
aggcagugaugagucaugaaua

SEQ ID NO: 791428 - RNA, 22 nt, Human
aaaccuguuaauagagcgaugc

SEQ ID NO: 791429 - RNA, 22 nt, Human
aaaugacacucauucaguguca

SEQ ID NO: 791430 - RNA, 22 nt, Human
aaagaaaccuaucagccacaug

SEQ ID NO: 791431 - RNA, 23 nt, Human
aaggccagagagaggcuaguguc

SEQ ID NO: 791432 - RNA, 22 nt, Human
cuucccuuucuggugacuucuc

SEQ ID NO: 791433 - RNA, 22 nt, Human
caggaggcgucuucaguuuguu

SEQ ID NO: 791434 - RNA, 21 nt, Human
gcuccuggugcugcguggcgc

SEQ ID NO: 791435 - RNA, 22 nt, Human
acacagagcaaaucaugacaga

SEQ ID NO: 791436 - RNA, 19 nt, Human
ugacauagcaagacaaaac

SEQ ID NO: 791437 - RNA, 22 nt, Human
ggugggagagcucugucuccag

SEQ ID NO: 791438 - RNA, 22 nt, Human
ggcagaugacagaccaguaugu

SEQ ID NO: 791439 - RNA, 22 nt, Human
cacccagggcugugccugccca

SEQ ID NO: 791440 - RNA, 22 nt, Human
ccagggucuuggagaggagugc

SEQ ID NO: 791441 - RNA, 22 nt, Human
ugggcagggaucucuuuugcaa

SEQ ID NO: 791442 - RNA, 22 nt, Human
ggugaggccuguacaaagcugc

SEQ ID NO: 791443 - RNA, 22 nt, Human
ugccaucacugaacuucugaaa

SEQ ID NO: 791444 - RNA, 22 nt, Human
ugcaggcugugucauuuaguga

SEQ ID NO: 791445 - RNA, 22 nt, Human
guccuggaguggcauggcaugg

SEQ ID NO: 791446 - RNA, 22 nt, Human
caggaagauuagaccaagagcu

SEQ ID NO: 791447 - RNA, 22 nt, Human
aagagguugucugugaugaguu

SEQ ID NO: 791448 - RNA, 18 nt, Human
gcugagguggugucagag

SEQ ID NO: 791449 - RNA, 22 nt, Human
uuuaccaaaguacucugaggca

SEQ ID NO: 791450 - RNA, 22 nt, Human
ccagccuccauguagauagcug

SEQ ID NO: 791451 - RNA, 21 nt, Human
cacacagcugcccuuagguag

SEQ ID NO: 791452 - RNA, 22 nt, Human
cauucacauucuucuuacuguu

SEQ ID NO: 791453 - RNA, 22 nt, Human
cugcugugugaccauggacagg

SEQ ID NO: 791454 - RNA, 23 nt, Human
agaauuucaaaguccagcacauu

SEQ ID NO: 791455 - RNA, 22 nt, Human
uagccaggcgaggucagugucg

SEQ ID NO: 791456 - RNA, 22 nt, Human
ucaagagaagugcuccacagua

SEQ ID NO: 791457 - RNA, 22 nt, Human
ucuggaguuugaggacaagcuu

SEQ ID NO: 791458 - RNA, 22 nt, Human
uggcuauugagugaucucuaga

SEQ ID NO: 791459 - RNA, 22 nt, Human
cagcuucagaagaagccgugag

SEQ ID NO: 791460 - RNA, 22 nt, Human
ugacaauugugggcaguuugug

SEQ ID NO: 791461 - RNA, 22 nt, Human
ggcuggcuaucugugguugccu

SEQ ID NO: 791462 - RNA, 22 nt, Human
uuucuuuaggcuguguugccaa

SEQ ID NO: 791463 - RNA, 22 nt, Human
guaggcagguggaggagugaag

SEQ ID NO: 791464 - RNA, 22 nt, Human
uacuguuuuuaaaauugcaucc

SEQ ID NO: 791465 - RNA, 22 nt, Human
uucaauaucucuaagaaugagg

SEQ ID NO: 791466 - RNA, 22 nt, Human
augguggugaagagcacaguga

SEQ ID NO: 791467 - RNA, 22 nt, Human
aggagaaggaggccccucacac

SEQ ID NO: 791468 - RNA, 22 nt, Human
acauuuuuggguugaugucuga

SEQ ID NO: 791469 - RNA, 22 nt, Human
cauguguguggcugacaauuuu

SEQ ID NO: 791470 - RNA, 22 nt, Human
cgccaggcuugguagcucaugc

SEQ ID NO: 791471 - RNA, 22 nt, Human
uguaauauauauaacugugugc

SEQ ID NO: 791472 - RNA, 22 nt, Human
caggagagauaugaguccccac

SEQ ID NO: 791473 - RNA, 22 nt, Human
accagcuggucaccugggcacu

SEQ ID NO: 791474 - RNA, 20 nt, Human
agugaguuaucagcuacagu

SEQ ID NO: 791475 - RNA, 21 nt, Human
uccagcugcacaagcaugggg

SEQ ID NO: 791476 - RNA, 22 nt, Human
accuucauauucucugauaccu

SEQ ID NO: 791477 - RNA, 22 nt, Human
caaaguggcuggccgggagauc

SEQ ID NO: 791478 - RNA, 22 nt, Human
auauguauguacgcacauauuc

SEQ ID NO: 791479 - RNA, 22 nt, Human
agggccucucugggccuuuccu

SEQ ID NO: 791480 - RNA, 22 nt, Human
gccaggcagacaggucaucagg

SEQ ID NO: 791481 - RNA, 22 nt, Human
uucaagucagagcaagccaagu

SEQ ID NO: 791482 - RNA, 22 nt, Human
gcucaggaaauaguuuaguguu

SEQ ID NO: 791483 - RNA, 22 nt, Human
uauauuaaacccucucuguagg

SEQ ID NO: 791484 - RNA, 22 nt, Human
ugugggagaaggaagcaagcug

SEQ ID NO: 791485 - RNA, 22 nt, Human
uagggggcuguccugugcauua

SEQ ID NO: 791486 - RNA, 20 nt, Human
caggaggcaaggucaagguc

SEQ ID NO: 791487 - RNA, 22 nt, Human
gcugugauccuugagagaaggu

SEQ ID NO: 791488 - RNA, 22 nt, Human
ggccacuguuuccugggcaguu

SEQ ID NO: 791489 - RNA, 22 nt, Human
uuaccaaugugcuuuugcuaca

SEQ ID NO: 791490 - RNA, 22 nt, Human
cacaguaacuccugaccccucg

SEQ ID NO: 791491 - RNA, 22 nt, Human
ugagcugcaagaaaauuucagu

SEQ ID NO: 791492 - RNA, 22 nt, Human
aucaacuuguccuugauguuaa

SEQ ID NO: 791493 - RNA, 23 nt, Human
uccugagaugagacagugcugcc

SEQ ID NO: 791494 - RNA, 22 nt, Human
ccuccuggugggcgcuucuggc

SEQ ID NO: 791495 - RNA, 22 nt, Human
aggagauaagaggcuggugugg

SEQ ID NO: 791496 - RNA, 22 nt, Human
auuguauaagucuauuuacaau

SEQ ID NO: 791497 - RNA, 22 nt, Human
uuauucuuuaaacauauauguu

SEQ ID NO: 791498 - RNA, 22 nt, Human
guggggagcagccuuagccccu

SEQ ID NO: 791499 - RNA, 22 nt, Human
accuccccgggagcagccuccu

SEQ ID NO: 791500 - RNA, 22 nt, Human
uucugcuuuuagcuaaacuaua

SEQ ID NO: 791501 - RNA, 22 nt, Human
gugugcugcccaacucgcagau

SEQ ID NO: 791502 - RNA, 19 nt, Human
cccucuugcacaaagcaaa

SEQ ID NO: 791503 - RNA, 22 nt, Human
uugccaggagcucaucugaggg

SEQ ID NO: 791504 - RNA, 22 nt, Human
aagaagaaguguuauuuuuaga

SEQ ID NO: 791505 - RNA, 22 nt, Human
gaggcuggaggucaaagaugaa

SEQ ID NO: 791506 - RNA, 22 nt, Human
uaacauugaguccacuaaacag

SEQ ID NO: 791507 - RNA, 22 nt, Human
uuccgagggcucggcggccgcc

SEQ ID NO: 791508 - RNA, 22 nt, Human
cauuuggauuuugaagagagua

SEQ ID NO: 791509 - RNA, 22 nt, Human
ucacuucuucagcuuuccuuga

SEQ ID NO: 791510 - RNA, 22 nt, Human
gcagaggacucaaucaagguau

SEQ ID NO: 791511 - RNA, 22 nt, Human
uacaagagacaccagggaggcu

SEQ ID NO: 791512 - RNA, 22 nt, Human
ugccaggcccugugcuggaugc

SEQ ID NO: 791513 - RNA, 22 nt, Human
uggccacccagcugacgccuuc

SEQ ID NO: 791514 - RNA, 22 nt, Human
cagcagcugguugaauccuucu

SEQ ID NO: 791515 - RNA, 22 nt, Human
aggaggguacaauggguggaaa

SEQ ID NO: 791516 - RNA, 22 nt, Human
gcugggcugagaaguuaagcaa

SEQ ID NO: 791517 - RNA, 22 nt, Human
uggguagcagggcugagcugug

SEQ ID NO: 791518 - RNA, 22 nt, Human
aagccaggcaugcuuggacagu

SEQ ID NO: 791519 - RNA, 22 nt, Human
ucuuuggcuuugccacacccaa

SEQ ID NO: 791520 - RNA, 22 nt, Human
ccucugcaucuggcugcugcag

SEQ ID NO: 791521 - RNA, 22 nt, Human
uacaaaacagugcucugguccu

SEQ ID NO: 791522 - RNA, 22 nt, Human
aguagcagaaggucuugaaggg

SEQ ID NO: 791523 - RNA, 22 nt, Human
cauggcuucgucacagagggca

SEQ ID NO: 791524 - RNA, 22 nt, Human
aggagaaagacuggacagccaa

SEQ ID NO: 791525 - RNA, 22 nt, Human
aaggccaggucccugcagugca

SEQ ID NO: 791526 - RNA, 22 nt, Human
ugggccuggcccuguggaggag

SEQ ID NO: 791527 - RNA, 22 nt, Human
gcaguggccacauggaggagga

SEQ ID NO: 791528 - RNA, 22 nt, Human
gaauaauuuugaucagaaggga

SEQ ID NO: 791529 - RNA, 22 nt, Human
cuggcaggaagaggaaagguca

SEQ ID NO: 791530 - RNA, 22 nt, Human
ggaggguccccagcagcaugaa

SEQ ID NO: 791531 - RNA, 22 nt, Human
aaggcagcaagaauuccagguu

SEQ ID NO: 791532 - RNA, 22 nt, Human
ugauaugcauguaagggagaca

SEQ ID NO: 791533 - RNA, 22 nt, Human
aguuucuuuagauagaaaguuc

SEQ ID NO: 791534 - RNA, 22 nt, Human
ugaggucaccuggaggcagccu

SEQ ID NO: 791535 - RNA, 22 nt, Human
aacccaggagauggagguugug

SEQ ID NO: 791536 - RNA, 22 nt, Human
uuacagagccucauuuuagaga

SEQ ID NO: 791537 - RNA, 22 nt, Human
ccaguuuaagacuuaucucaau

SEQ ID NO: 791538 - RNA, 22 nt, Human
guuuacugucuugcacagugca

SEQ ID NO: 791539 - RNA, 22 nt, Human
uggcuggcaguaggcuaguggc

SEQ ID NO: 791540 - RNA, 22 nt, Human
uugggaaacaguauagcuaaca

SEQ ID NO: 791541 - RNA, 20 nt, Human
agcaagaguaaggacagcga

SEQ ID NO: 791542 - RNA, 22 nt, Human
ugcaaaucauaaacaauagugu

SEQ ID NO: 791543 - RNA, 22 nt, Human
guuucugauucuagaggcaggc

SEQ ID NO: 791544 - RNA, 22 nt, Human
aggcagcccugugcuggaugcu

SEQ ID NO: 791545 - RNA, 22 nt, Human
acuaaauacacacauuuguuca

SEQ ID NO: 791546 - RNA, 22 nt, Human
uacacugugagguuuccaaggg

SEQ ID NO: 791547 - RNA, 19 nt, Human
gcacacccugcaccaccau

SEQ ID NO: 791548 - RNA, 19 nt, Human
acuaaaaaugauguuugag

SEQ ID NO: 791549 - RNA, 22 nt, Human
aaaugucuguuagucauaucau

SEQ ID NO: 791550 - RNA, 18 nt, Human
gcacugaggaaaaccucu

SEQ ID NO: 791551 - RNA, 22 nt, Human
uuguuuuuaaacaugugacuga

SEQ ID NO: 791552 - RNA, 22 nt, Human
gcuggagucuggaggugugcca

SEQ ID NO: 791553 - RNA, 22 nt, Human
gucaggagagaccuguucuccu

SEQ ID NO: 791554 - RNA, 22 nt, Human
ugcaaacuagcaucaacuagua

SEQ ID NO: 791555 - RNA, 22 nt, Human
aggcuccguccagucucaggcc

SEQ ID NO: 791556 - RNA, 22 nt, Human
ccuggagaggcgcugcagagga

SEQ ID NO: 791557 - RNA, 22 nt, Human
guaaauguuugcugaugauucu

SEQ ID NO: 791558 - RNA, 22 nt, Human
gagggcucugucuggaagggaa

SEQ ID NO: 791559 - RNA, 22 nt, Human
aacuuacaauguuagagucuca

SEQ ID NO: 791560 - RNA, 22 nt, Human
uugucugauguucccucaugau

SEQ ID NO: 791561 - RNA, 22 nt, Human
ucauucucagacucuuggccuc

SEQ ID NO: 791562 - RNA, 22 nt, Human
aggcccaguagugcugccuuua

SEQ ID NO: 791563 - RNA, 22 nt, Human
gaggcauggccugaggcuagga

SEQ ID NO: 791564 - RNA, 22 nt, Human
aagucagaaauaucugccauca

SEQ ID NO: 791565 - RNA, 22 nt, Human
aaagccagagcaagcugucaca

SEQ ID NO: 791566 - RNA, 22 nt, Human
uuacaacagacacauauucuaa

SEQ ID NO: 791567 - RNA, 23 nt, Human
aggcugagcucucccagcuucag

SEQ ID NO: 791568 - RNA, 21 nt, Human
augccaaacuucuucugcccu

SEQ ID NO: 791569 - RNA, 20 nt, Human
gcccaagcgccggccgcaga

SEQ ID NO: 791570 - RNA, 22 nt, Human
gcagccagccccucugaccucu

SEQ ID NO: 791571 - RNA, 22 nt, Human
ucagaaguccccagucaaggag

SEQ ID NO: 791572 - RNA, 22 nt, Human
uacuuucauggguuuucuuuau

SEQ ID NO: 791573 - RNA, 22 nt, Human
uccagcagugcucuagagcgug

SEQ ID NO: 791574 - RNA, 22 nt, Human
uggcuucaggagcaccuggcuu

SEQ ID NO: 791575 - RNA, 22 nt, Human
ccagcugagaaguguaaaguga

SEQ ID NO: 791576 - RNA, 22 nt, Human
uuccaggaccaggaagagggga

SEQ ID NO: 791577 - RNA, 22 nt, Human
uauaauuuaucaugucacaguu

SEQ ID NO: 791578 - RNA, 22 nt, Human
cugcccccaggcugcauggcug

SEQ ID NO: 791579 - RNA, 22 nt, Human
accugccuaguugguucugccc

SEQ ID NO: 791580 - RNA, 22 nt, Human
uguuuacaugcauaagcuuaag

SEQ ID NO: 791581 - RNA, 22 nt, Human
cacacaggaugaagcagcagaa

SEQ ID NO: 791582 - RNA, 22 nt, Human
uucuuacagaguuuacagagcc

SEQ ID NO: 791583 - RNA, 22 nt, Human
ggcaguguuuauggguaacaca

SEQ ID NO: 791584 - RNA, 22 nt, Human
acauauauguaaaguacuuugu

SEQ ID NO: 791585 - RNA, 22 nt, Human
uugaggagucaggggcacggaa

SEQ ID NO: 791586 - RNA, 22 nt, Human
aggcagguagaaggaucuuuau

SEQ ID NO: 791587 - RNA, 21 nt, Human
cagaaguaaggguaacuucuc

SEQ ID NO: 791588 - RNA, 20 nt, Human
gcuggaagggcuagagggcu

SEQ ID NO: 791589 - RNA, 22 nt, Human
uggcccugugacugaguucuag

SEQ ID NO: 791590 - RNA, 22 nt, Human
augcaagacauaaauaaucuuu

SEQ ID NO: 791591 - RNA, 22 nt, Human
uccucuucuaagcucauucagg

SEQ ID NO: 791592 - RNA, 22 nt, Human
uuuguacacaggauguuauaau

SEQ ID NO: 791593 - RNA, 22 nt, Human
ugggaggaucucuugaggccag

SEQ ID NO: 791594 - RNA, 22 nt, Human
uggugggacaucugaggagagg

SEQ ID NO: 791595 - RNA, 22 nt, Human
ugaaaagucuuauauugucuga

SEQ ID NO: 791596 - RNA, 22 nt, Human
uuuggacaaaugucugacuuuc

SEQ ID NO: 791597 - RNA, 19 nt, Human
cauaaauguacaagauaca

SEQ ID NO: 791598 - RNA, 22 nt, Human
cggcagggcuccaugcauuucu

SEQ ID NO: 791599 - RNA, 22 nt, Human
ugcaagagguuggauuuuaaga

SEQ ID NO: 791600 - RNA, 22 nt, Human
aaagcucucccacuguaugaag

SEQ ID NO: 791601 - RNA, 22 nt, Human
aggcuggaaagggaccagagug

SEQ ID NO: 791602 - RNA, 22 nt, Human
aacaaucaaguuucuaaaugac

SEQ ID NO: 791603 - RNA, 22 nt, Human
ucuucagagugagcagugucau

SEQ ID NO: 791604 - RNA, 20 nt, Human
gcagagcuguucugugggga

SEQ ID NO: 791605 - RNA, 22 nt, Human
ugaaagcacucacuucugcucu

SEQ ID NO: 791606 - RNA, 22 nt, Human
aauauuucuguagcuauguucu

SEQ ID NO: 791607 - RNA, 22 nt, Human
gcagggcuccacuguggccaag

SEQ ID NO: 791608 - RNA, 22 nt, Human
uagugucaaacagggauuagaa

SEQ ID NO: 791609 - RNA, 22 nt, Human
ugguggaggugcauuucggagc

SEQ ID NO: 791610 - RNA, 22 nt, Human
gcugggcaggccucgugagggc

SEQ ID NO: 791611 - RNA, 22 nt, Human
agucucuuccucaugcauaugu

SEQ ID NO: 791612 - RNA, 22 nt, Human
cccuguccuuggcugugaggcu

SEQ ID NO: 791613 - RNA, 22 nt, Human
aagcagaauuucccacuaguug

SEQ ID NO: 791614 - RNA, 22 nt, Human
gcuuuggagggcaagagcuguu

SEQ ID NO: 791615 - RNA, 22 nt, Human
cugugagauuuuuaaauaacuu

SEQ ID NO: 791616 - RNA, 22 nt, Human
gcaggcuccaaggccugggaga

SEQ ID NO: 791617 - RNA, 22 nt, Human
agcccggcuuccccgguugcua

SEQ ID NO: 791618 - RNA, 22 nt, Human
cuggcuucccugucuuauggaa

SEQ ID NO: 791619 - RNA, 22 nt, Human
ggaccaggacuggugguaucuc

SEQ ID NO: 791620 - RNA, 22 nt, Human
acagaggccaugagcugccacc

SEQ ID NO: 791621 - RNA, 22 nt, Human
gaggugggagggcagucccuaa

SEQ ID NO: 791622 - RNA, 22 nt, Human
agugucugcucagacagcuaca

SEQ ID NO: 791623 - RNA, 19 nt, Human
acauagcuggcuacacugu

SEQ ID NO: 791624 - RNA, 22 nt, Human
agggaaagguagugaggucaca

SEQ ID NO: 791625 - RNA, 22 nt, Human
ucaagauaagucaguauaucaa

SEQ ID NO: 791626 - RNA, 22 nt, Human
ccugggguauauaggugaauau

SEQ ID NO: 791627 - RNA, 22 nt, Human
uucaaguuaccuuuaaacagcu

SEQ ID NO: 791628 - RNA, 22 nt, Human
aggucuggugagagcaggugcu

SEQ ID NO: 791629 - RNA, 22 nt, Human
gggggagaagauucugcugcuu

SEQ ID NO: 791630 - RNA, 22 nt, Human
gcacagggcccugugcguaggu

SEQ ID NO: 791631 - RNA, 20 nt, Human
acauagcuauagaaagucga

SEQ ID NO: 791632 - RNA, 22 nt, Human
aguuuuauuccaaugugcagca

SEQ ID NO: 791633 - RNA, 20 nt, Human
uuuauucagccuacccucuu

SEQ ID NO: 791634 - RNA, 22 nt, Human
guucacagucuacauaguaaag

SEQ ID NO: 791635 - RNA, 22 nt, Human
acaugcaaaugugcaugcaugu

SEQ ID NO: 791636 - RNA, 22 nt, Human
cucuuugguuaaucacacagau

SEQ ID NO: 791637 - RNA, 22 nt, Human
caagauaauuuauucugaguuu

SEQ ID NO: 791638 - RNA, 22 nt, Human
aguggcuuaucugggacagcua

SEQ ID NO: 791639 - RNA, 20 nt, Human
acucuguagguaaugagacu

SEQ ID NO: 791640 - RNA, 22 nt, Human
aaagucuucacggcacuagugu

SEQ ID NO: 791641 - RNA, 22 nt, Human
caggcuggaguuaccuuuaggg

SEQ ID NO: 791642 - RNA, 22 nt, Human
ugcagggucucugcaaaugagg

SEQ ID NO: 791643 - RNA, 22 nt, Human
ugcaggagcccuugggcucugg

SEQ ID NO: 791644 - RNA, 22 nt, Human
uguaauauuguagugacaguac

SEQ ID NO: 791645 - RNA, 23 nt, Human
uagggcagcugggagggacaugc

SEQ ID NO: 791646 - RNA, 22 nt, Human
gcacugagcaccagccacagau

SEQ ID NO: 791647 - RNA, 22 nt, Human
uugaaugaauucuacuuccaga

SEQ ID NO: 791648 - RNA, 22 nt, Human
uuagcuuuucacuugcauuauc

SEQ ID NO: 791649 - RNA, 22 nt, Human
gcagguggaagcagcagacuca

SEQ ID NO: 791650 - RNA, 22 nt, Human
gccaggcagauaugugagcuua

SEQ ID NO: 791651 - RNA, 22 nt, Human
acugccugcuccuggcuccaca

SEQ ID NO: 791652 - RNA, 22 nt, Human
acaacaguaggaaaacaugucu

SEQ ID NO: 791653 - RNA, 22 nt, Human
agaaacauuuagauuauauguc

SEQ ID NO: 791654 - RNA, 22 nt, Human
aagcaggcauuccagagacaau

SEQ ID NO: 791655 - RNA, 22 nt, Human
uggcuugguaaggaccagcagg

SEQ ID NO: 791656 - RNA, 22 nt, Human
gaggcugcuguuagcccugggc

SEQ ID NO: 791657 - RNA, 22 nt, Human
gugggggcuggaaaucuugcca

SEQ ID NO: 791658 - RNA, 22 nt, Human
aacauuuguuuggcuucaauua

SEQ ID NO: 791659 - RNA, 22 nt, Human
gacccaggagagaggguugcau

SEQ ID NO: 791660 - RNA, 22 nt, Human
ccuuggcuaggcagcggcuguc

SEQ ID NO: 791661 - RNA, 22 nt, Human
auauucacugagcauaaagcca

SEQ ID NO: 791662 - RNA, 22 nt, Human
agucuagcuuaggagccuagcu

SEQ ID NO: 791663 - RNA, 22 nt, Human
auuuauuaugggauuuggcuca

SEQ ID NO: 791664 - RNA, 22 nt, Human
cauggcagaaaccugagcugcu

SEQ ID NO: 791665 - RNA, 22 nt, Human
uuggcauaccuuagugguggag

SEQ ID NO: 791666 - RNA, 19 nt, Human
ccauggcaaugaucugaug

SEQ ID NO: 791667 - RNA, 22 nt, Human
ccaauuuuauucuucugcaagu

SEQ ID NO: 791668 - RNA, 22 nt, Human
cagcuucuccagaugacccuca

SEQ ID NO: 791669 - RNA, 22 nt, Human
caggcugucugaauggaggccc

SEQ ID NO: 791670 - RNA, 22 nt, Human
aagcuuugacuacugccucuug

SEQ ID NO: 791671 - RNA, 22 nt, Human
ggcugccugcuccuccugcacg

SEQ ID NO: 791672 - RNA, 22 nt, Human
aguuucuauguaagcuacguga

SEQ ID NO: 791673 - RNA, 22 nt, Human
uuuacagcuucuauacuaugug

SEQ ID NO: 791674 - RNA, 22 nt, Human
uuaacacagggggagacaaagu

SEQ ID NO: 791675 - RNA, 22 nt, Human
uucugggcccaacccuagagug

SEQ ID NO: 791676 - RNA, 22 nt, Human
uucuggauguuguagucugaga

SEQ ID NO: 791677 - RNA, 22 nt, Human
ugggccaggucugugucagcug

SEQ ID NO: 791678 - RNA, 22 nt, Human
uucacagugagcuaugucuugu

SEQ ID NO: 791679 - RNA, 22 nt, Human
gagcuaagagucuagaaaggcu

SEQ ID NO: 791680 - RNA, 22 nt, Human
caggccugucugcacaugaggc

SEQ ID NO: 791681 - RNA, 18 nt, Human
uccugccugugccccagg

SEQ ID NO: 791682 - RNA, 22 nt, Human
uuuggaaucauagauauauuca

SEQ ID NO: 791683 - RNA, 22 nt, Human
ucauggcacuuagugucucaaa

SEQ ID NO: 791684 - RNA, 22 nt, Human
aacuauguuaauaaguuucauu

SEQ ID NO: 791685 - RNA, 22 nt, Human
accuucaaguaugugggcugaa

SEQ ID NO: 791686 - RNA, 22 nt, Human
guggucagagaugacagugggu

SEQ ID NO: 791687 - RNA, 22 nt, Human
aaauaauugaguuggucaauau

SEQ ID NO: 791688 - RNA, 20 nt, Human
gagagcuggggaugaggcug

SEQ ID NO: 791689 - RNA, 22 nt, Human
ucagagaaaugcugagcucaug

SEQ ID NO: 791690 - RNA, 22 nt, Human
ugcaaauuugacuucacacauc

SEQ ID NO: 791691 - RNA, 22 nt, Human
ugucauggcacuagaguggggu

SEQ ID NO: 791692 - RNA, 22 nt, Human
ucagucuucuagcaaauccagg

SEQ ID NO: 791693 - RNA, 22 nt, Human
cuaaauguucacaugcaauuuu

SEQ ID NO: 791694 - RNA, 22 nt, Human
auuauuaugguugcucuuuucc

SEQ ID NO: 791695 - RNA, 22 nt, Human
cuuguggccaauguuuguuaua

SEQ ID NO: 791696 - RNA, 22 nt, Human
cccacagguccccaugaacucg

SEQ ID NO: 791697 - RNA, 22 nt, Human
uaugagaagaacaggugacuuu

SEQ ID NO: 791698 - RNA, 22 nt, Human
guuguuuugcugucugucuuag

SEQ ID NO: 791699 - RNA, 22 nt, Human
gggguagggugauugugaagua

SEQ ID NO: 791700 - RNA, 22 nt, Human
uuucacaauuuuaaggagcaaa

SEQ ID NO: 791701 - RNA, 22 nt, Human
guuuacuggagaagaugaccug

SEQ ID NO: 791702 - RNA, 22 nt, Human
uuucuuccaaaggcacguucuc

SEQ ID NO: 791703 - RNA, 22 nt, Human
gaacaaagacauggaggaggau

SEQ ID NO: 791704 - RNA, 19 nt, Human
ucuaaacuagucccauaac

SEQ ID NO: 791705 - RNA, 22 nt, Human
uaguuuguagaaaucuagaaau

SEQ ID NO: 791706 - RNA, 22 nt, Human
aagcugugugcagaugaucuca

SEQ ID NO: 791707 - RNA, 22 nt, Human
acaugagaggcuguggaguaca

SEQ ID NO: 791708 - RNA, 22 nt, Human
guuuacauuaaguauuagcauc

SEQ ID NO: 791709 - RNA, 22 nt, Human
aaauaagugugggccagucaaa

SEQ ID NO: 791710 - RNA, 22 nt, Human
uucuauugcacacaaauaauua

SEQ ID NO: 791711 - RNA, 22 nt, Human
uuuacacugcuugaacaaucuc

SEQ ID NO: 791712 - RNA, 22 nt, Human
uuauugagcaccuacuaugugu

SEQ ID NO: 791713 - RNA, 22 nt, Human
agaaaaggauugauggaucaga

SEQ ID NO: 791714 - RNA, 22 nt, Human
aguauuugaucagaugauagua

SEQ ID NO: 791715 - RNA, 20 nt, Human
auacacauauucuugcaacu

SEQ ID NO: 791716 - RNA, 22 nt, Human
cccagcaucccagugggcagca

SEQ ID NO: 791717 - RNA, 22 nt, Human
ccauccagaccaguccaugggu

SEQ ID NO: 791718 - RNA, 22 nt, Human
gcagcuucaguaggugaagaca

SEQ ID NO: 791719 - RNA, 22 nt, Human
uucuggaauucuugcagccacu

SEQ ID NO: 791720 - RNA, 22 nt, Human
auaguuuucuaugcacuguuau

SEQ ID NO: 791721 - RNA, 22 nt, Human
uauucacaggcuggagugaugu

SEQ ID NO: 791722 - RNA, 19 nt, Human
uaaaaugucuguggucagu

SEQ ID NO: 791723 - RNA, 22 nt, Human
aacaagcagaugcaaugcacuu

SEQ ID NO: 791724 - RNA, 22 nt, Human
ugugugaggugguucugagaag

SEQ ID NO: 791725 - RNA, 22 nt, Human
uuucuuccuuaccuuacuagag

SEQ ID NO: 791726 - RNA, 22 nt, Human
acccuggagcuuuucuggcccu

SEQ ID NO: 791727 - RNA, 22 nt, Human
cuggcccagucucagaguguca

SEQ ID NO: 791728 - RNA, 22 nt, Human
cugaggcuuugugugcaugccu

SEQ ID NO: 791729 - RNA, 22 nt, Human
ggugggagugggcacaguuacg

SEQ ID NO: 791730 - RNA, 19 nt, Human
uuucuaagcuaaaugcuuc

SEQ ID NO: 791731 - RNA, 22 nt, Human
uaucauuuguuauuauuagugg

SEQ ID NO: 791732 - RNA, 22 nt, Human
ccugcagcccuucaaaggcuga

SEQ ID NO: 791733 - RNA, 22 nt, Human
aucaaaguaggcauauguuuuu

SEQ ID NO: 791734 - RNA, 21 nt, Human
aaaaggaaggucuguuugggg

SEQ ID NO: 791735 - RNA, 22 nt, Human
aggcccagagagccaguuagug

SEQ ID NO: 791736 - RNA, 22 nt, Human
acaaaauuguguuaaacuuuau

SEQ ID NO: 791737 - RNA, 22 nt, Human
uuuaaaauuuagaccucuccac

SEQ ID NO: 791738 - RNA, 22 nt, Human
gaggccaggaagcccaagauca

SEQ ID NO: 791739 - RNA, 22 nt, Human
cuggcuccauccuugagcucug

SEQ ID NO: 791740 - RNA, 21 nt, Human
ugugccagggauggggagccc

SEQ ID NO: 791741 - RNA, 21 nt, Human
uaucaagauguuaugguugaa

SEQ ID NO: 791742 - RNA, 22 nt, Human
uuggaacaugccgggguccagg

SEQ ID NO: 791743 - RNA, 22 nt, Human
gccagagagagucccugggccu

SEQ ID NO: 791744 - RNA, 22 nt, Human
agcuggcauacuuugcuaggaa

SEQ ID NO: 791745 - RNA, 22 nt, Human
uacuguucaugccuucauaaag

SEQ ID NO: 791746 - RNA, 22 nt, Human
gcugcuggcgcugggcguccgg

SEQ ID NO: 791747 - RNA, 22 nt, Human
agggucucuggagagcugagga

SEQ ID NO: 791748 - RNA, 22 nt, Human
uuauucagcauuuagaggaagg

SEQ ID NO: 791749 - RNA, 22 nt, Human
ugcaggcucucugcugccagau

SEQ ID NO: 791750 - RNA, 22 nt, Human
acuuggccuuauuuccacagaa

SEQ ID NO: 791751 - RNA, 22 nt, Human
aaagaagauggagaccugacua

SEQ ID NO: 791752 - RNA, 22 nt, Human
uaggguggagacuggaagcagg

SEQ ID NO: 791753 - RNA, 22 nt, Human
auauuuucacugaaccaaagua

SEQ ID NO: 791754 - RNA, 22 nt, Human
caggcagcugcuggguucagcc

SEQ ID NO: 791755 - RNA, 22 nt, Human
aagucaauuaguaaacuuggaa

SEQ ID NO: 791756 - RNA, 22 nt, Human
uagugucaucguugcagcugag

SEQ ID NO: 791757 - RNA, 22 nt, Human
gucuuuauuugagauugucauu

SEQ ID NO: 791758 - RNA, 22 nt, Human
acacagaguuugacacauggga

SEQ ID NO: 791759 - RNA, 19 nt, Human
cagaggccagaagcacagg

SEQ ID NO: 791760 - RNA, 22 nt, Human
ggcacagcacaguggacccagg

SEQ ID NO: 791761 - RNA, 22 nt, Human
caaggcugagaaauucugcccu

SEQ ID NO: 791762 - RNA, 22 nt, Human
agacuguaauugacaugucagc

SEQ ID NO: 791763 - RNA, 22 nt, Human
agaaauucaauucuaauuagcu

SEQ ID NO: 791764 - RNA, 22 nt, Human
auguuuuccccaaaugaucuuc

SEQ ID NO: 791765 - RNA, 22 nt, Human
uaucacaucaauguuuuaaaau

SEQ ID NO: 791766 - RNA, 22 nt, Human
acuggcuggaguugccaaggcu

SEQ ID NO: 791767 - RNA, 22 nt, Human
cuucuucagcacaauauugaug

SEQ ID NO: 791768 - RNA, 22 nt, Human
uuucuagacauuucuauguaca

SEQ ID NO: 791769 - RNA, 22 nt, Human
gggaggagcuuggagauucacu

SEQ ID NO: 791770 - RNA, 22 nt, Human
uuuuggcucugucuguaucuuu

SEQ ID NO: 791771 - RNA, 22 nt, Human
agaagcaaggucugucaguaua

SEQ ID NO: 791772 - RNA, 18 nt, Human
ugggcugccuggccucug

SEQ ID NO: 791773 - RNA, 20 nt, Human
cucaguguauucugggugcu

SEQ ID NO: 791774 - RNA, 22 nt, Human
acccagcaugacaccugcacau

SEQ ID NO: 791775 - RNA, 21 nt, Human
cagagggccggcauguggucu

SEQ ID NO: 791776 - RNA, 22 nt, Human
ggccagcuggaugugggugacg

SEQ ID NO: 791777 - RNA, 22 nt, Human
agguggcugguccaggcugcag

SEQ ID NO: 791778 - RNA, 22 nt, Human
ucaguguuuauucaauguuauu

SEQ ID NO: 791779 - RNA, 22 nt, Human
guggcgaggggagguccuggcg

SEQ ID NO: 791780 - RNA, 22 nt, Human
caggccugguugagcccugaga

SEQ ID NO: 791781 - RNA, 19 nt, Human
uuuggacagaguguccagg

SEQ ID NO: 791782 - RNA, 23 nt, Human
ggucacuggcaagcagugcagag

SEQ ID NO: 791783 - RNA, 22 nt, Human
ucaaagauugaaacuaaggaga

SEQ ID NO: 791784 - RNA, 22 nt, Human
gagagcaauggggacgggcagg

SEQ ID NO: 791785 - RNA, 22 nt, Human
cuucucucggugcaucccucac

SEQ ID NO: 791786 - RNA, 22 nt, Human
ggcaaacagacuugaccaucuu

SEQ ID NO: 791787 - RNA, 22 nt, Human
uauuaacauuuuaugaaaauaa

SEQ ID NO: 791788 - RNA, 22 nt, Human
acagcaggaauuaacauauaag

SEQ ID NO: 791789 - RNA, 22 nt, Human
aggcagagcugauguucuguga

SEQ ID NO: 791790 - RNA, 22 nt, Human
gccaggcuggaaagaacagaca

SEQ ID NO: 791791 - RNA, 21 nt, Human
aaggcagaagcauggaaugag

SEQ ID NO: 791792 - RNA, 22 nt, Human
uggccagucuguggaagccagg

SEQ ID NO: 791793 - RNA, 22 nt, Human
cuuaaauccaucauuucuaauc

SEQ ID NO: 791794 - RNA, 22 nt, Human
cuggccuggagccucugggugg

SEQ ID NO: 791795 - RNA, 22 nt, Human
cucacagguuaguuguguggau

SEQ ID NO: 791796 - RNA, 22 nt, Human
agcugcugcgccucacccuggc

SEQ ID NO: 791797 - RNA, 21 nt, Human
ucccacagaaacugcgaaauu

SEQ ID NO: 791798 - RNA, 22 nt, Human
ggaggguggcagcguccugggc

SEQ ID NO: 791799 - RNA, 22 nt, Human
acuuucaaaagagaagucauga

SEQ ID NO: 791800 - RNA, 22 nt, Human
caacacauugaagcuaugauga

SEQ ID NO: 791801 - RNA, 22 nt, Human
cagagcuggcucugcauguaca

SEQ ID NO: 791802 - RNA, 22 nt, Human
ucacaguagccauuucaugagu

SEQ ID NO: 791803 - RNA, 22 nt, Human
gccccaggugguaaaccuaaga

SEQ ID NO: 791804 - RNA, 22 nt, Human
caggaaacggcuauucuuuugu

SEQ ID NO: 791805 - RNA, 22 nt, Human
gacacaggaaaagcuccagccc

SEQ ID NO: 791806 - RNA, 22 nt, Human
aggcuguggugcugaaggaggg

SEQ ID NO: 791807 - RNA, 22 nt, Human
ugagaggugaggcaugaggcau

SEQ ID NO: 791808 - RNA, 21 nt, Human
cuguuucuugugaagugacac

SEQ ID NO: 791809 - RNA, 22 nt, Human
aggcucugcuuuucuggauaua

SEQ ID NO: 791810 - RNA, 22 nt, Human
ucacagcuauucucauguauuu

SEQ ID NO: 791811 - RNA, 22 nt, Human
agaggaaguaaucaggaccugc

SEQ ID NO: 791812 - RNA, 22 nt, Human
ggacacuacaaucugccugcau

SEQ ID NO: 791813 - RNA, 22 nt, Human
gcacagaauaacacucugggcu

SEQ ID NO: 791814 - RNA, 22 nt, Human
caguugagucugcuagcuagga

SEQ ID NO: 791815 - RNA, 22 nt, Human
cugcagcuuaagggagggguug

SEQ ID NO: 791816 - RNA, 20 nt, Human
ccuccuggucaggugugcag

SEQ ID NO: 791817 - RNA, 22 nt, Human
ccaucuguaucugacaaauucu

SEQ ID NO: 791818 - RNA, 21 nt, Human
uccacaaguuagaaggaaauu

SEQ ID NO: 791819 - RNA, 22 nt, Human
uugguuuugaaauagcuuauug

SEQ ID NO: 791820 - RNA, 22 nt, Human
agaagggagagaaaguugguua

SEQ ID NO: 791821 - RNA, 22 nt, Human
ugccagcuagagaagcuagaaa

SEQ ID NO: 791822 - RNA, 22 nt, Human
uguucuuuagcagaccauguug

SEQ ID NO: 791823 - RNA, 22 nt, Human
cagucccagacccagaaggugg

SEQ ID NO: 791824 - RNA, 22 nt, Human
acaaauuuauugaagggcauau

SEQ ID NO: 791825 - RNA, 22 nt, Human
aaacagcuacuucuguauaaug

SEQ ID NO: 791826 - RNA, 22 nt, Human
gcaggugguggcgcgcgcccug

SEQ ID NO: 791827 - RNA, 22 nt, Human
gagcuugggugccaugcugagc

SEQ ID NO: 791828 - RNA, 20 nt, Human
cagaugggacguggaggagu

SEQ ID NO: 791829 - RNA, 23 nt, Human
gagugcagaauagacaugcagug

SEQ ID NO: 791830 - RNA, 22 nt, Human
acagcuggaggccccauugucc

SEQ ID NO: 791831 - RNA, 22 nt, Human
aggcacagggaugcggagccag

SEQ ID NO: 791832 - RNA, 22 nt, Human
ccaucccugggccauguccccu

SEQ ID NO: 791833 - RNA, 22 nt, Human
cugagccaaccacagcaggagc

SEQ ID NO: 791834 - RNA, 22 nt, Human
acauuguuugagaauacagaug

SEQ ID NO: 791835 - RNA, 22 nt, Human
gucuuucucuggaacaguaaaa

SEQ ID NO: 791836 - RNA, 22 nt, Human
gcuccuggcauccugcuuuuaa

SEQ ID NO: 791837 - RNA, 22 nt, Human
cuggcagugacauugcaggugc

SEQ ID NO: 791838 - RNA, 22 nt, Human
cagugcugccaaagggaccuug

SEQ ID NO: 791839 - RNA, 22 nt, Human
auguuucaugacugagcaaaau

SEQ ID NO: 791840 - RNA, 22 nt, Human
agggagaguuugauguuuccuc

SEQ ID NO: 791841 - RNA, 17 nt, Human
ccuggcugggaaucuga

SEQ ID NO: 791842 - RNA, 22 nt, Human
aaaagucugcuuucuauuauca

SEQ ID NO: 791843 - RNA, 22 nt, Human
gccagcaguccugcugugugcc

SEQ ID NO: 791844 - RNA, 22 nt, Human
cuuaaauucuuaaugcccucau

SEQ ID NO: 791845 - RNA, 21 nt, Human
aguguuaauggaaauuauauu

SEQ ID NO: 791846 - RNA, 22 nt, Human
aagcaugggaggccuggaggag

SEQ ID NO: 791847 - RNA, 22 nt, Human
aauaagaacaacuaagguuuau

SEQ ID NO: 791848 - RNA, 22 nt, Human
aaagucauuggaauauuaauga

SEQ ID NO: 791849 - RNA, 22 nt, Human
ucuacaaagaagaauuaauguc

SEQ ID NO: 791850 - RNA, 19 nt, Human
uuuauucaccuuuaccuug

SEQ ID NO: 791851 - RNA, 22 nt, Human
uguuugucaucauugugagaga

SEQ ID NO: 791852 - RNA, 22 nt, Human
gcagcuguucagcuggccagau

SEQ ID NO: 791853 - RNA, 22 nt, Human
caucaaauaggaauauuuggca

SEQ ID NO: 791854 - RNA, 22 nt, Human
agaagcagacucugaggcaagg

SEQ ID NO: 791855 - RNA, 22 nt, Human
gggccucaccucuccaccgccu

SEQ ID NO: 791856 - RNA, 22 nt, Human
gcagguuauccaacuacaaugu

SEQ ID NO: 791857 - RNA, 22 nt, Human
ucagagaacugcagcccuuccu

SEQ ID NO: 791858 - RNA, 22 nt, Human
cagcuuuguccugcaaaccuga

SEQ ID NO: 791859 - RNA, 22 nt, Human
gguggcagcauggucccagugu

SEQ ID NO: 791860 - RNA, 22 nt, Human
ucaauuauuuuggcuaugcuaa

SEQ ID NO: 791861 - RNA, 22 nt, Human
uuguuuaaugccucauacaucu

SEQ ID NO: 791862 - RNA, 22 nt, Human
agaaguuugaaauuaggagaaa

SEQ ID NO: 791863 - RNA, 22 nt, Human
ucaggccaggagaucagauuga

SEQ ID NO: 791864 - RNA, 22 nt, Human
caaguccaagaucaagaagcca

SEQ ID NO: 791865 - RNA, 19 nt, Human
gaggcaaggaguuuaagcc

SEQ ID NO: 791866 - RNA, 22 nt, Human
aagaaaugugaauauugaauag

SEQ ID NO: 791867 - RNA, 22 nt, Human
ucccagcagagccagcaagccg

SEQ ID NO: 791868 - RNA, 22 nt, Human
gcaugcaaucuauccuuaggaa

SEQ ID NO: 791869 - RNA, 22 nt, Human
agggcagcaaugcagcugcugc

SEQ ID NO: 791870 - RNA, 22 nt, Human
cuuugcaugggucugaaggcuu

SEQ ID NO: 791871 - RNA, 22 nt, Human
auccugggcagugugucacucu

SEQ ID NO: 791872 - RNA, 22 nt, Human
cucuuaaagaauguuccagcug

SEQ ID NO: 791873 - RNA, 22 nt, Human
ucucuucuagcuucuugugguu

SEQ ID NO: 791874 - RNA, 22 nt, Human
auguuucuguccuacgagauaa

SEQ ID NO: 791875 - RNA, 22 nt, Human
uggcccugcuuaugucucucuu

SEQ ID NO: 791876 - RNA, 22 nt, Human
augcaaaucuuaaguaugugug

SEQ ID NO: 791877 - RNA, 21 nt, Human
ugcaggcugugcgcuccugcc

SEQ ID NO: 791878 - RNA, 22 nt, Human
cugagggccugaggaccuagau

SEQ ID NO: 791879 - RNA, 21 nt, Human
ccaggcuggccaugguauuga

SEQ ID NO: 791880 - RNA, 22 nt, Human
aagaauauagauuuuuugaagu

SEQ ID NO: 791881 - RNA, 22 nt, Human
ccugagucccauaauguugcca

SEQ ID NO: 791882 - RNA, 22 nt, Human
uacaguaaagcugcuaugaauu

SEQ ID NO: 791883 - RNA, 22 nt, Human
acuuccuagauacgagauugaa

SEQ ID NO: 791884 - RNA, 22 nt, Human
cacccuuugcugcucuuccucc

SEQ ID NO: 791885 - RNA, 22 nt, Human
aagauuuacuagcauaauagcu

SEQ ID NO: 791886 - RNA, 20 nt, Human
agucacaugcauacacaagu

SEQ ID NO: 791887 - RNA, 22 nt, Human
uucaguguaucuugucagggag

SEQ ID NO: 791888 - RNA, 16 nt, Human
acuuccaggggagccc

SEQ ID NO: 791889 - RNA, 20 nt, Human
gcucagggccugggucugga

SEQ ID NO: 791890 - RNA, 22 nt, Human
ucuauucugauaaaugcaugga

SEQ ID NO: 791891 - RNA, 22 nt, Human
gucaaaaaguagucauuucugu

SEQ ID NO: 791892 - RNA, 22 nt, Human
aacacugcuccaaaaaaggcuu

SEQ ID NO: 791893 - RNA, 22 nt, Human
agggccagccgacuuccagccu

SEQ ID NO: 791894 - RNA, 22 nt, Human
uuucaggaaacauuuaauggca

SEQ ID NO: 791895 - RNA, 22 nt, Human
ugaguucugacugugaugccag

SEQ ID NO: 791896 - RNA, 22 nt, Human
aaaauacuacugucuucuuccc

SEQ ID NO: 791897 - RNA, 22 nt, Human
acuuuacacaucuuuucucauu

SEQ ID NO: 791898 - RNA, 22 nt, Human
cuuggcugaacuccaggaugca

SEQ ID NO: 791899 - RNA, 22 nt, Human
ccagcugggauuaagggaaaau

SEQ ID NO: 791900 - RNA, 22 nt, Human
gauuuacagguuagguccugua

SEQ ID NO: 791901 - RNA, 22 nt, Human
aaaugucaaggugauagaugca

SEQ ID NO: 791902 - RNA, 22 nt, Human
cacagguguaugaauaugucca

SEQ ID NO: 791903 - RNA, 22 nt, Human
uccagcuuucacgcuccugccu

SEQ ID NO: 791904 - RNA, 22 nt, Human
cuucacauugggcuugauauga

SEQ ID NO: 791905 - RNA, 22 nt, Human
aucuccgccaucgcgaacgccu

SEQ ID NO: 791906 - RNA, 22 nt, Human
acucauuuaaacauuuacugaa

SEQ ID NO: 791907 - RNA, 22 nt, Human
uacauccaaaguugaggugccu

SEQ ID NO: 791908 - RNA, 22 nt, Human
ccagcagcugcaaagccugggu

SEQ ID NO: 791909 - RNA, 22 nt, Human
uugcugaaguugcucagcucca

SEQ ID NO: 791910 - RNA, 22 nt, Human
cugccugugauuuuucucuagu

SEQ ID NO: 791911 - RNA, 22 nt, Human
cagagcucagagcugccaggca

SEQ ID NO: 791912 - RNA, 22 nt, Human
aaccugcuuucucagagaaggg

SEQ ID NO: 791913 - RNA, 22 nt, Human
cagauaaauagacuuggucaga

SEQ ID NO: 791914 - RNA, 22 nt, Human
ucaaacagcaggucuuucauag

SEQ ID NO: 791915 - RNA, 22 nt, Human
uaaagacauaggaucagggaga

SEQ ID NO: 791916 - RNA, 22 nt, Human
uggccugcaaagucuucuugcu

SEQ ID NO: 791917 - RNA, 22 nt, Human
ggcaggggugaggccacucuga

SEQ ID NO: 791918 - RNA, 22 nt, Human
accucagagggauguuacaggc

SEQ ID NO: 791919 - RNA, 22 nt, Human
ugcguugcgcuccugcagcagg

SEQ ID NO: 791920 - RNA, 22 nt, Human
gucaccauugcccacuccaugg

SEQ ID NO: 791921 - RNA, 22 nt, Human
cacuugaaguuugggggacucu

SEQ ID NO: 791922 - RNA, 22 nt, Human
cauggccccaaaucccaugcau

SEQ ID NO: 791923 - RNA, 22 nt, Human
agagauugcuagcuggcuuuaa

SEQ ID NO: 791924 - RNA, 22 nt, Human
uucauucuuuuacaugugaaua

SEQ ID NO: 791925 - RNA, 22 nt, Human
acuuucauguucauuuggaacc

SEQ ID NO: 791926 - RNA, 22 nt, Human
cugagccauaagggaggcuggg

SEQ ID NO: 791927 - RNA, 22 nt, Human
cagugaguaaguagacagcuua

SEQ ID NO: 791928 - RNA, 22 nt, Human
uuacagagguauguaugucucu

SEQ ID NO: 791929 - RNA, 22 nt, Human
cugugggaaaggaugagauugc

SEQ ID NO: 791930 - RNA, 22 nt, Human
auacagaaaaugaugcagaguu

SEQ ID NO: 791931 - RNA, 22 nt, Human
guggagggaaugaaucuucucu

SEQ ID NO: 791932 - RNA, 22 nt, Human
acagagcugggaucugaaccca

SEQ ID NO: 791933 - RNA, 18 nt, Human
uauaaccuguuuugaugg

SEQ ID NO: 791934 - RNA, 22 nt, Human
gaggaaaauaacaacuaagggc

SEQ ID NO: 791935 - RNA, 22 nt, Human
ucacauuugauaaugcccauug

SEQ ID NO: 791936 - RNA, 22 nt, Human
ugcuagcacugugcagucuacg

SEQ ID NO: 791937 - RNA, 22 nt, Human
uuaaaugaggcugauguagauu

SEQ ID NO: 791938 - RNA, 22 nt, Human
agucaucauguacagagagcaa

SEQ ID NO: 791939 - RNA, 23 nt, Human
gcucccugucccugcacuuaggc

SEQ ID NO: 791940 - RNA, 22 nt, Human
acccaggccauuggcaagaguc

SEQ ID NO: 791941 - RNA, 22 nt, Human
auucacauguugaagcccuaac

SEQ ID NO: 791942 - RNA, 22 nt, Human
gcaaaugcacugcauuuagauu

SEQ ID NO: 791943 - RNA, 22 nt, Human
aauaagaugugcuugaguuugg

SEQ ID NO: 791944 - RNA, 22 nt, Human
aucuagaaaaggugacuaaaau

SEQ ID NO: 791945 - RNA, 18 nt, Human
gccaggcaggguggggaa

SEQ ID NO: 791946 - RNA, 22 nt, Human
aaaagcagagacucuggagcua

SEQ ID NO: 791947 - RNA, 22 nt, Human
auauuaguuuggagacuacaau

SEQ ID NO: 791948 - RNA, 22 nt, Human
uagcugguccucagcuccagcc

SEQ ID NO: 791949 - RNA, 22 nt, Human
cugaagcaauugagagauguuu

SEQ ID NO: 791950 - RNA, 22 nt, Human
cugggaagcuucgagcaggaaa

SEQ ID NO: 791951 - RNA, 22 nt, Human
cagccugcucucagauguugag

SEQ ID NO: 791952 - RNA, 22 nt, Human
ggcagccaguagggccagccug

SEQ ID NO: 791953 - RNA, 22 nt, Human
augaaugcagcacuguuuuucu

SEQ ID NO: 791954 - RNA, 22 nt, Human
cuucagaaccagccagaagagg

SEQ ID NO: 791955 - RNA, 22 nt, Human
caguguuuguugagaaaggcaa

SEQ ID NO: 791956 - RNA, 22 nt, Human
ucccaggauguuuauggcuggu

SEQ ID NO: 791957 - RNA, 22 nt, Human
uggcaggugccuguaaucucag

SEQ ID NO: 791958 - RNA, 22 nt, Human
augucuuucuaguuaagagcua

SEQ ID NO: 791959 - RNA, 23 nt, Human
gcuuguguauacaggaggccacc

SEQ ID NO: 791960 - RNA, 22 nt, Human
ucuaaagccuuccauauaacgc

SEQ ID NO: 791961 - RNA, 22 nt, Human
ugggccaggcaugugaucagca

SEQ ID NO: 791962 - RNA, 19 nt, Human
agaaucaggucaggugaca

SEQ ID NO: 791963 - RNA, 22 nt, Human
uaauaccuggccuugauacagu

SEQ ID NO: 791964 - RNA, 22 nt, Human
uuccuaaguccugccagcaguc

SEQ ID NO: 791965 - RNA, 22 nt, Human
ucauuauccuaguaucuugaau

SEQ ID NO: 791966 - RNA, 22 nt, Human
aaaggcccacagucagucuacc

SEQ ID NO: 791967 - RNA, 22 nt, Human
aacugcaaucacuuuugcacca

SEQ ID NO: 791968 - RNA, 22 nt, Human
caccagcuccaccagggcaggu

SEQ ID NO: 791969 - RNA, 22 nt, Human
ucccagcacgucugcuguuucu

SEQ ID NO: 791970 - RNA, 22 nt, Human
augcagcugugggcaagaaaug

SEQ ID NO: 791971 - RNA, 22 nt, Human
cacuuaaaacuccuggaauugu

SEQ ID NO: 791972 - RNA, 22 nt, Human
aguuucauccgaucuggucuca

SEQ ID NO: 791973 - RNA, 22 nt, Human
uaauaaaugaaagugcuggcau

SEQ ID NO: 791974 - RNA, 22 nt, Human
cucuggggaagcagccagcugg

SEQ ID NO: 791975 - RNA, 22 nt, Human
aaaggcaaaauucuuagcagga

SEQ ID NO: 791976 - RNA, 22 nt, Human
uugcaaauguuauacugccagu

SEQ ID NO: 791977 - RNA, 22 nt, Human
acaaagcucuggaaggcucguc

SEQ ID NO: 791978 - RNA, 22 nt, Human
agaacuauacauuacucauuga

SEQ ID NO: 791979 - RNA, 22 nt, Human
ccaggccuagccccugagggua

SEQ ID NO: 791980 - RNA, 18 nt, Human
uccagcuugcacuuaaau

SEQ ID NO: 791981 - RNA, 22 nt, Human
ucucccaggugggugccuggag

SEQ ID NO: 791982 - RNA, 22 nt, Human
aacccgagggccccaggcucgg

SEQ ID NO: 791983 - RNA, 22 nt, Human
auucuacauuuggagugauguc

SEQ ID NO: 791984 - RNA, 22 nt, Human
ccucaggggcuuuucguuguug

SEQ ID NO: 791985 - RNA, 22 nt, Human
cccagcagugguucucaaacuu

SEQ ID NO: 791986 - RNA, 22 nt, Human
augcuucugcucauauuucauu

SEQ ID NO: 791987 - RNA, 22 nt, Human
uaauuuuaacugugcuguuugg

SEQ ID NO: 791988 - RNA, 21 nt, Human
gcucccugcucagcuccuggg

SEQ ID NO: 791989 - RNA, 22 nt, Human
aacuuccuucuaguucauaugu

SEQ ID NO: 791990 - RNA, 22 nt, Human
aaauuguaggaucacaugaccu

SEQ ID NO: 791991 - RNA, 22 nt, Human
ccgucugcagccuccaggaguu

SEQ ID NO: 791992 - RNA, 22 nt, Human
auaaauaucacuguugucccuc

SEQ ID NO: 791993 - RNA, 22 nt, Human
ccucccaucccugcaagagagc

SEQ ID NO: 791994 - RNA, 22 nt, Human
ggccagaaguuggaaaagagcc

SEQ ID NO: 791995 - RNA, 22 nt, Human
cagaggcaaaagagguggaggu

SEQ ID NO: 791996 - RNA, 22 nt, Human
aaagcagcuguuugacuuucca

SEQ ID NO: 791997 - RNA, 22 nt, Human
aacccaggagacagguugcagu

SEQ ID NO: 791998 - RNA, 22 nt, Human
acugaaaaugaauuagaaacag

SEQ ID NO: 791999 - RNA, 22 nt, Human
aaugcaguugaauuuggguaug

SEQ ID NO: 792000 - RNA, 22 nt, Human
gugcuuuuucaaucagaaggga

SEQ ID NO: 792001 - RNA, 22 nt, Human
gcagggccagggcucaggcugu

SEQ ID NO: 792002 - RNA, 22 nt, Human
auuguuuuccaaagaugcugcu

SEQ ID NO: 792003 - RNA, 22 nt, Human
caguaaguauucgagucuccau

SEQ ID NO: 792004 - RNA, 22 nt, Human
acaguuaccacuuagcaguuac

SEQ ID NO: 792005 - RNA, 22 nt, Human
uucuucaucuguaagauaagca

SEQ ID NO: 792006 - RNA, 22 nt, Human
auagcaaauucuuuaggugcuu

SEQ ID NO: 792007 - RNA, 22 nt, Human
uuugauuuucagcaauaguggc

SEQ ID NO: 792008 - RNA, 22 nt, Human
gacaauuucucaauauagaaac

SEQ ID NO: 792009 - RNA, 22 nt, Human
cacacaggaaaauuggaauuaa

SEQ ID NO: 792010 - RNA, 22 nt, Human
cuguuuucccuggaguucagca

SEQ ID NO: 792011 - RNA, 22 nt, Human
gcauuccuguaccucucugcua

SEQ ID NO: 792012 - RNA, 22 nt, Human
uggagaaaagguugaauccauc

SEQ ID NO: 792013 - RNA, 22 nt, Human
ucuucagaagaucacaucagug

SEQ ID NO: 792014 - RNA, 22 nt, Human
uaaauucuacaacuucaaagau

SEQ ID NO: 792015 - RNA, 22 nt, Human
agugaaaugauucugagcaaga

SEQ ID NO: 792016 - RNA, 17 nt, Human
ccaggagcgugggucuc

SEQ ID NO: 792017 - RNA, 22 nt, Human
gaggauggaggcaguuagggcc

SEQ ID NO: 792018 - RNA, 22 nt, Human
aguauguugacuuauucuugga

SEQ ID NO: 792019 - RNA, 22 nt, Human
aauguucagugccuuuaaacau

SEQ ID NO: 792020 - RNA, 22 nt, Human
cccauggcaauaaggucacagg

SEQ ID NO: 792021 - RNA, 22 nt, Human
ccugugggcccuggacagagac

SEQ ID NO: 792022 - RNA, 22 nt, Human
uaucuuacagacugaauguugg

SEQ ID NO: 792023 - RNA, 22 nt, Human
cagaaaccugucuggaguggga

SEQ ID NO: 792024 - RNA, 22 nt, Human
aggcuggcucggcuuuucuguc

SEQ ID NO: 792025 - RNA, 22 nt, Human
aggagcuggguuccuuuggugg

SEQ ID NO: 792026 - RNA, 22 nt, Human
uucuuuauguuaaugaaucuau

SEQ ID NO: 792027 - RNA, 22 nt, Human
ugggcagacgcuguuggaaggc

SEQ ID NO: 792028 - RNA, 15 nt, Human
caggaaaugaaucug

SEQ ID NO: 792029 - RNA, 22 nt, Human
aaaaguauggugguccuuuuua

SEQ ID NO: 792030 - RNA, 23 nt, Human
uggcuggcgccugccucacccug

SEQ ID NO: 792031 - RNA, 22 nt, Human
ucagggaaaccuaaggaagcca

SEQ ID NO: 792032 - RNA, 22 nt, Human
ccuuucccgcuuugagggcaag

SEQ ID NO: 792033 - RNA, 22 nt, Human
acacccagauuaugcacacaaa

SEQ ID NO: 792034 - RNA, 22 nt, Human
ugcuggagacucacucaggugc

SEQ ID NO: 792035 - RNA, 22 nt, Human
cuuaaagucuauccuuucuaga

SEQ ID NO: 792036 - RNA, 22 nt, Human
ugcaggcucugugugugccugg

SEQ ID NO: 792037 - RNA, 22 nt, Human
uucuuuaccacuacucuuccaa

SEQ ID NO: 792038 - RNA, 22 nt, Human
ugcaaauggagcauguauaaga

SEQ ID NO: 792039 - RNA, 22 nt, Human
gagcugggagcugggauuugga

SEQ ID NO: 792040 - RNA, 22 nt, Human
aauauugagaaccagcauguuu

SEQ ID NO: 792041 - RNA, 22 nt, Human
auauuauuuucccuggaguugu

SEQ ID NO: 792042 - RNA, 17 nt, Human
ccuuucucuuucaucuc

SEQ ID NO: 792043 - RNA, 22 nt, Human
cuguggcuguauuuggccagag

SEQ ID NO: 792044 - RNA, 19 nt, Human
gagcugagaguagcacugg

SEQ ID NO: 792045 - RNA, 22 nt, Human
aauaacuucauguaacauuuaa

SEQ ID NO: 792046 - RNA, 22 nt, Human
ccuccuggccugugcagagccc

SEQ ID NO: 792047 - RNA, 22 nt, Human
ggaagugguagagccaugagug

SEQ ID NO: 792048 - RNA, 22 nt, Human
gcuuuggucuucuagcugugag

SEQ ID NO: 792049 - RNA, 22 nt, Human
aacaguaauggcauugccauga

SEQ ID NO: 792050 - RNA, 22 nt, Human
ucaggggcagccggggaagcca

SEQ ID NO: 792051 - RNA, 22 nt, Human
agcuguguccugaagacacugc

SEQ ID NO: 792052 - RNA, 22 nt, Human
augucuuuggcuuugacauggc

SEQ ID NO: 792053 - RNA, 22 nt, Human
aggaccugaaauucuugcuuuu

SEQ ID NO: 792054 - RNA, 22 nt, Human
agccuggccacucagggccuga

SEQ ID NO: 792055 - RNA, 22 nt, Human
caggagccgccaggcacguugg

SEQ ID NO: 792056 - RNA, 20 nt, Human
aaguuucugguuuauaucuu

SEQ ID NO: 792057 - RNA, 22 nt, Human
gcaagcuggcuguuagaggaug

SEQ ID NO: 792058 - RNA, 22 nt, Human
caaaucauggcucuagcuuaca

SEQ ID NO: 792059 - RNA, 22 nt, Human
gccccagguugccugucccagg

SEQ ID NO: 792060 - RNA, 22 nt, Human
uggggcuggcuauugucucccu

SEQ ID NO: 792061 - RNA, 17 nt, Human
uucugagccacuuccuu

SEQ ID NO: 792062 - RNA, 22 nt, Human
cugcaaauaggaaaagggcaua

SEQ ID NO: 792063 - RNA, 21 nt, Human
ucauaaacuaguaucaaaguu

SEQ ID NO: 792064 - RNA, 22 nt, Human
agcuggauuccagugcagucac

SEQ ID NO: 792065 - RNA, 22 nt, Human
uaagaaucgauguuuauuuaga

SEQ ID NO: 792066 - RNA, 21 nt, Human
aggacaggaacuggcugaaua

SEQ ID NO: 792067 - RNA, 22 nt, Human
cugagcagucuagccagguguu

SEQ ID NO: 792068 - RNA, 22 nt, Human
ugaaaugauuauaugguguuug

SEQ ID NO: 792069 - RNA, 22 nt, Human
gcugagagaaaagugagguucu

SEQ ID NO: 792070 - RNA, 22 nt, Human
gaucccuugggccaaggaguug

SEQ ID NO: 792071 - RNA, 22 nt, Human
cugcuggcaagcccaguuggag

SEQ ID NO: 792072 - RNA, 22 nt, Human
uacacuaauguuuuugcaaagc

SEQ ID NO: 792073 - RNA, 22 nt, Human
aaagccaguucuuagagaaagc

SEQ ID NO: 792074 - RNA, 22 nt, Human
aagauacacguuguauugaaua

SEQ ID NO: 792075 - RNA, 22 nt, Human
gugaccauaauagauuaugagu

SEQ ID NO: 792076 - RNA, 22 nt, Human
uacacagggagagauuggaaac

SEQ ID NO: 792077 - RNA, 22 nt, Human
aggcccugggcaguucuguagc

SEQ ID NO: 792078 - RNA, 22 nt, Human
auaaaggauaauccauuagacu

SEQ ID NO: 792079 - RNA, 22 nt, Human
cagggccagagagggcuggcug

SEQ ID NO: 792080 - RNA, 22 nt, Human
aagcuguucuccagugacucag

SEQ ID NO: 792081 - RNA, 22 nt, Human
uuccagaggcuucagggaagaa

SEQ ID NO: 792082 - RNA, 21 nt, Human
cagaggguuucucagguguuu

SEQ ID NO: 792083 - RNA, 19 nt, Human
aagagggaaagugcuaugc

SEQ ID NO: 792084 - RNA, 22 nt, Human
aaaaagcuuaaaugagcaguuc

SEQ ID NO: 792085 - RNA, 22 nt, Human
cugggaggcggagguuguagug

SEQ ID NO: 792086 - RNA, 22 nt, Human
uaaggcagauguggaaucaauu

SEQ ID NO: 792087 - RNA, 22 nt, Human
aaaaugaugcuguaauuuggca

SEQ ID NO: 792088 - RNA, 22 nt, Human
augauguuaccaguacuuagag

SEQ ID NO: 792089 - RNA, 22 nt, Human
guggauggauugaggcaguggg

SEQ ID NO: 792090 - RNA, 22 nt, Human
gucaaauauacuaagagguaaa

SEQ ID NO: 792091 - RNA, 22 nt, Human
ugaaagcuuguuggaaauguag

SEQ ID NO: 792092 - RNA, 20 nt, Human
auaugcauguguuuucacuu

SEQ ID NO: 792093 - RNA, 22 nt, Human
gaucugggagccucauggagac

SEQ ID NO: 792094 - RNA, 22 nt, Human
uggcagcuugaaugcagucuuu

SEQ ID NO: 792095 - RNA, 22 nt, Human
uucuccauuuaacuuccuuaug

SEQ ID NO: 792096 - RNA, 22 nt, Human
uuuaggaacuuagguuuaugga

SEQ ID NO: 792097 - RNA, 20 nt, Human
aggauggcaagcaagugcau

SEQ ID NO: 792098 - RNA, 22 nt, Human
aggggugauuugggacaggaca

SEQ ID NO: 792099 - RNA, 22 nt, Human
ccuggcagcaggugggcccgug

SEQ ID NO: 792100 - RNA, 22 nt, Human
agccuggauccuaggcucagcu

SEQ ID NO: 792101 - RNA, 22 nt, Human
cgcccagggcaggaggccgcuc

SEQ ID NO: 792102 - RNA, 22 nt, Human
agaguucugaaauuaucuuuac

SEQ ID NO: 792103 - RNA, 22 nt, Human
ugcaaaaauugcuggaaucuuu

SEQ ID NO: 792104 - RNA, 22 nt, Human
cuucagaaauaacaacaauuac

SEQ ID NO: 792105 - RNA, 22 nt, Human
agcccaaggcuucccugcuggc

SEQ ID NO: 792106 - RNA, 22 nt, Human
acuggcugcgaucuuggcgcuu

SEQ ID NO: 792107 - RNA, 23 nt, Human
ggccuguguuuugucugaaguac

SEQ ID NO: 792108 - RNA, 22 nt, Human
uacauuugggacaauaagagaa

SEQ ID NO: 792109 - RNA, 22 nt, Human
uuacuuuagaucauacugugug

SEQ ID NO: 792110 - RNA, 22 nt, Human
gggcuggcaucgguugcugaga

SEQ ID NO: 792111 - RNA, 19 nt, Human
uuucccagcccuugcugug

SEQ ID NO: 792112 - RNA, 22 nt, Human
gggcugagacgauggggucuuc

SEQ ID NO: 792113 - RNA, 22 nt, Human
agauauuguuuguuucaccaau

SEQ ID NO: 792114 - RNA, 18 nt, Human
gcuuugcagaaauacaga

SEQ ID NO: 792115 - RNA, 22 nt, Human
ucagaauaugcuaaugacauuu

SEQ ID NO: 792116 - RNA, 22 nt, Human
cuggacacacuggagucuggca

SEQ ID NO: 792117 - RNA, 23 nt, Human
agcuuuuagguggaaauggcacu

SEQ ID NO: 792118 - RNA, 22 nt, Human
cccagagccucauucuguuggg

SEQ ID NO: 792119 - RNA, 22 nt, Human
uggggacauucaugcagguugu

SEQ ID NO: 792120 - RNA, 22 nt, Human
cacaugagacaauuaaagacuu

SEQ ID NO: 792121 - RNA, 22 nt, Human
gcuugucucucagccccaguca

SEQ ID NO: 792122 - RNA, 22 nt, Human
cucuccagggcaugaguuccac

SEQ ID NO: 792123 - RNA, 22 nt, Human
acaggcacaggugugccccacc

SEQ ID NO: 792124 - RNA, 22 nt, Human
cauuucaccuuagagaauuauu

SEQ ID NO: 792125 - RNA, 22 nt, Human
caucuacacugauuaggugaac

SEQ ID NO: 792126 - RNA, 22 nt, Human
agugacaagguaguuaguugga

SEQ ID NO: 792127 - RNA, 22 nt, Human
acaauauuugggggcaguuugu

SEQ ID NO: 792128 - RNA, 22 nt, Human
caaguuaauugguauuuugauc

SEQ ID NO: 792129 - RNA, 22 nt, Human
caaguauucuguaaaaagucaa

SEQ ID NO: 792130 - RNA, 21 nt, Human
auuuacaaaacagucccuucc

SEQ ID NO: 792131 - RNA, 22 nt, Human
ugcuucugcaggagcuccugau

SEQ ID NO: 792132 - RNA, 22 nt, Human
ucagagugaccuuacauggucu

SEQ ID NO: 792133 - RNA, 22 nt, Human
agugguucaguuuuggucuggc

SEQ ID NO: 792134 - RNA, 22 nt, Human
acagggcucugacaccaaggua

SEQ ID NO: 792135 - RNA, 22 nt, Human
cuucuuuaauguauacaaaaga

SEQ ID NO: 792136 - RNA, 21 nt, Human
gaguccuggcuaggguggcag

SEQ ID NO: 792137 - RNA, 22 nt, Human
agaaauagaggaaagguuugac

SEQ ID NO: 792138 - RNA, 22 nt, Human
uacaagaaacuacaugaaugca

SEQ ID NO: 792139 - RNA, 22 nt, Human
auaccauuuccauguuacauua

SEQ ID NO: 792140 - RNA, 21 nt, Human
cucuuugggaucuuuggaaag

SEQ ID NO: 792141 - RNA, 21 nt, Human
uuucucaguugugugagcagc

SEQ ID NO: 792142 - RNA, 22 nt, Human
acauaacacucuucucuaguga

SEQ ID NO: 792143 - RNA, 22 nt, Human
cagcaggacguccaagugcuau

SEQ ID NO: 792144 - RNA, 22 nt, Human
uccugccucuuuucuuauucca

SEQ ID NO: 792145 - RNA, 22 nt, Human
cgcagagggagccgcgggcugc

SEQ ID NO: 792146 - RNA, 19 nt, Human
cccuggcaggcaagccugg

SEQ ID NO: 792147 - RNA, 20 nt, Human
agccaauacagcaaaauuug

SEQ ID NO: 792148 - RNA, 22 nt, Human
guccccagagcugguggugguu

SEQ ID NO: 792149 - RNA, 22 nt, Human
uaguccaguaaaacagcuaacg

SEQ ID NO: 792150 - RNA, 22 nt, Human
uuuuuccaggguuagauguuua

SEQ ID NO: 792151 - RNA, 22 nt, Human
uggauggcuggggaagagcagg

SEQ ID NO: 792152 - RNA, 20 nt, Human
uucagagucagcaaaugcag

SEQ ID NO: 792153 - RNA, 22 nt, Human
ggccucugguucguggugaccu

SEQ ID NO: 792154 - RNA, 22 nt, Human
cacaugagguggagaugaauga

SEQ ID NO: 792155 - RNA, 22 nt, Human
guuuuuauuguguaaauguggg

SEQ ID NO: 792156 - RNA, 22 nt, Human
auucuaaaucagagagcucugu

SEQ ID NO: 792157 - RNA, 22 nt, Human
cccucccaggaguggccagaga

SEQ ID NO: 792158 - RNA, 22 nt, Human
uaacuacaagggcggucucugu

SEQ ID NO: 792159 - RNA, 22 nt, Human
uaaacagugauacguuccagcu

SEQ ID NO: 792160 - RNA, 22 nt, Human
uccacagggccuuucuggugug

SEQ ID NO: 792161 - RNA, 22 nt, Human
augaaaugcuauuuuggcuaga

SEQ ID NO: 792162 - RNA, 22 nt, Human
acuggcuggacucugaccucuu

SEQ ID NO: 792163 - RNA, 19 nt, Human
uccuucuccggccaccccg

SEQ ID NO: 792164 - RNA, 22 nt, Human
acauuuguuucucuagaguagg

SEQ ID NO: 792165 - RNA, 22 nt, Human
aacauuguuuucccuauaucca

SEQ ID NO: 792166 - RNA, 22 nt, Human
uauuuacccuggcagcuguagc

SEQ ID NO: 792167 - RNA, 22 nt, Human
gauuuuaucgucauccuucugg

SEQ ID NO: 792168 - RNA, 22 nt, Human
uuggagucauauggaauucaca

SEQ ID NO: 792169 - RNA, 22 nt, Human
agcaggacacgaugcggcagga

SEQ ID NO: 792170 - RNA, 22 nt, Human
aggcuauuuccacucuucucau

SEQ ID NO: 792171 - RNA, 22 nt, Human
ccuagaggcugcaaggagaggc

SEQ ID NO: 792172 - RNA, 22 nt, Human
uggcuacagcaagaggaaagaa

SEQ ID NO: 792173 - RNA, 22 nt, Human
ucuaguguuaaggcaaaguaaa

SEQ ID NO: 792174 - RNA, 22 nt, Human
cucucccccacagcagccuucu

SEQ ID NO: 792175 - RNA, 22 nt, Human
ugcaaacaauuuccuauaaagu

SEQ ID NO: 792176 - RNA, 22 nt, Human
uuguuucuucauuuagaagcuu

SEQ ID NO: 792177 - RNA, 22 nt, Human
cagauauauuuuauuuggucaa

SEQ ID NO: 792178 - RNA, 22 nt, Human
uggcccugugugcaggcugcac

SEQ ID NO: 792179 - RNA, 22 nt, Human
uucuucaauuauuggaaagaaa

SEQ ID NO: 792180 - RNA, 22 nt, Human
uaacaacuggacaauguugcuc

SEQ ID NO: 792181 - RNA, 22 nt, Human
ccccagcccacaagcauauuaa

SEQ ID NO: 792182 - RNA, 22 nt, Human
uuuaauuuguauuucuagaggg

SEQ ID NO: 792183 - RNA, 22 nt, Human
caugcaaaauguauuuuauuag

SEQ ID NO: 792184 - RNA, 22 nt, Human
ugucauuuggugccaggaaaga

SEQ ID NO: 792185 - RNA, 22 nt, Human
cucuuuggcguuggcagagcca

SEQ ID NO: 792186 - RNA, 18 nt, Human
ccuggagcuccacagcaa

SEQ ID NO: 792187 - RNA, 22 nt, Human
aggccuguaguuccucuuucca

SEQ ID NO: 792188 - RNA, 22 nt, Human
gcagauaggguauuaggaguaa

SEQ ID NO: 792189 - RNA, 22 nt, Human
cagcaggaccauugaggcauca

SEQ ID NO: 792190 - RNA, 17 nt, Human
gggugggcacugcuggc

SEQ ID NO: 792191 - RNA, 22 nt, Human
uccuuaaauccuucagagauua

SEQ ID NO: 792192 - RNA, 22 nt, Human
uguguuuagagagcacauucag

SEQ ID NO: 792193 - RNA, 20 nt, Human
ucccaggcuccacccuagac

SEQ ID NO: 792194 - RNA, 22 nt, Human
uuccaggaagacaucucaggaa

SEQ ID NO: 792195 - RNA, 22 nt, Human
uuucuucuuaauacuggcugcu

SEQ ID NO: 792196 - RNA, 21 nt, Human
aguuucaggaaguucagcugc

SEQ ID NO: 792197 - RNA, 22 nt, Human
gccugccuuugugaggaagcgg

SEQ ID NO: 792198 - RNA, 20 nt, Human
cccugcagccaugggagugg

SEQ ID NO: 792199 - RNA, 22 nt, Human
ucacaguauagaguuauuuugg

SEQ ID NO: 792200 - RNA, 22 nt, Human
aaggcugguggauuaugagguc

SEQ ID NO: 792201 - RNA, 22 nt, Human
cugggggucuugaaagggagag

SEQ ID NO: 792202 - RNA, 22 nt, Human
cacagucacauaucuaugugug

SEQ ID NO: 792203 - RNA, 22 nt, Human
aauuacaaauguagacucucau

SEQ ID NO: 792204 - RNA, 22 nt, Human
uggcucaggauaauuuucccaa

SEQ ID NO: 792205 - RNA, 22 nt, Human
auauacuuggagacuaucauug

SEQ ID NO: 792206 - RNA, 22 nt, Human
ugacaggaguggcuagugggag

SEQ ID NO: 792207 - RNA, 20 nt, Human
ucugcacuccugcaugugcc

SEQ ID NO: 792208 - RNA, 22 nt, Human
gccucugcucggacuuugccuc

SEQ ID NO: 792209 - RNA, 22 nt, Human
gaaauauucuugucuuguuuuc

SEQ ID NO: 792210 - RNA, 22 nt, Human
caggauggugugagugugagga

SEQ ID NO: 792211 - RNA, 22 nt, Human
cuagcuuagggaaacugacaga

SEQ ID NO: 792212 - RNA, 22 nt, Human
aauaacuugaagaucucuucca

SEQ ID NO: 792213 - RNA, 22 nt, Human
ucuucccagaccuuacauguga

SEQ ID NO: 792214 - RNA, 22 nt, Human
agcaggcuuucaagagucuucu

SEQ ID NO: 792215 - RNA, 22 nt, Human
gucaggagaggccaucagcuuu

SEQ ID NO: 792216 - RNA, 22 nt, Human
aaaaggcuaauuaaguuuugga

SEQ ID NO: 792217 - RNA, 22 nt, Human
uucaguuugaauucuguagaac

SEQ ID NO: 792218 - RNA, 22 nt, Human
uaugcaaaugacugguauguuu

SEQ ID NO: 792219 - RNA, 22 nt, Human
acauggcagcugaugauuggaa

SEQ ID NO: 792220 - RNA, 22 nt, Human
ccacagcaugcaggccugacac

SEQ ID NO: 792221 - RNA, 22 nt, Human
gcuuggcuggagaaaguuaccu

SEQ ID NO: 792222 - RNA, 22 nt, Human
cagugguggaaugaggaauugu

SEQ ID NO: 792223 - RNA, 21 nt, Human
gcuggcugucucuuacacggu

SEQ ID NO: 792224 - RNA, 22 nt, Human
cagggagcuuucccaggacccu

SEQ ID NO: 792225 - RNA, 22 nt, Human
uuugaacaugcugcaugauaau

SEQ ID NO: 792226 - RNA, 22 nt, Human
uccuggcagcccgcaggugcug

SEQ ID NO: 792227 - RNA, 22 nt, Human
uacagaggcuggguuuucaggg

SEQ ID NO: 792228 - RNA, 22 nt, Human
guggugaagccccaucucugcu

SEQ ID NO: 792229 - RNA, 22 nt, Human
uggcugggagcuggaacugggc

SEQ ID NO: 792230 - RNA, 22 nt, Human
caggcagccugcggucugcaca

SEQ ID NO: 792231 - RNA, 22 nt, Human
gugcagcugggcgcugaccuuc

SEQ ID NO: 792232 - RNA, 22 nt, Human
gggcuggcgggaaaggcaauuc

SEQ ID NO: 792233 - RNA, 22 nt, Human
cuacugaugauguugguugugg

SEQ ID NO: 792234 - RNA, 22 nt, Human
cagggcucgcucuugcccuucg

SEQ ID NO: 792235 - RNA, 22 nt, Human
aacauuguuuugcacaacucuu

SEQ ID NO: 792236 - RNA, 18 nt, Human
cagggcuguggggucacu

SEQ ID NO: 792237 - RNA, 21 nt, Human
aacugcaaaucuuagacugca

SEQ ID NO: 792238 - RNA, 22 nt, Human
uaaugucuccaggguugaccua

SEQ ID NO: 792239 - RNA, 22 nt, Human
aacaaacaaacauuuugucauc

SEQ ID NO: 792240 - RNA, 21 nt, Human
auauuguagguaaagugcagg

SEQ ID NO: 792241 - RNA, 22 nt, Human
cagcccugcugguuuugggcaa

SEQ ID NO: 792242 - RNA, 22 nt, Human
uuaauacagaagcaagacacug

SEQ ID NO: 792243 - RNA, 22 nt, Human
ggcaggcuuugagaaagagcau

SEQ ID NO: 792244 - RNA, 22 nt, Human
ucuccuggauagauacuaucca

SEQ ID NO: 792245 - RNA, 22 nt, Human
gaacauaacuauugugaauagu

SEQ ID NO: 792246 - RNA, 22 nt, Human
aauagaauguaaucuaauacau

SEQ ID NO: 792247 - RNA, 22 nt, Human
gcucagggaguuucacagugua

SEQ ID NO: 792248 - RNA, 22 nt, Human
ggaggugguggcagugacaauu

SEQ ID NO: 792249 - RNA, 22 nt, Human
gcuccuggcuucacugacauca

SEQ ID NO: 792250 - RNA, 22 nt, Human
uuacauuuugggguaaggauaa

SEQ ID NO: 792251 - RNA, 22 nt, Human
agggaccagggguagcugagau

SEQ ID NO: 792252 - RNA, 22 nt, Human
caggccugcaggaaaggcuccc

SEQ ID NO: 792253 - RNA, 22 nt, Human
gaaggcugcugggaaguguggu

SEQ ID NO: 792254 - RNA, 22 nt, Human
ggcuguagguuggugcuggaca

SEQ ID NO: 792255 - RNA, 22 nt, Human
aaauuauuacaagcuaguuggc

SEQ ID NO: 792256 - RNA, 22 nt, Human
aaagccaggguccaggccugcc

SEQ ID NO: 792257 - RNA, 22 nt, Human
aggaguggugcaggaccugcca

SEQ ID NO: 792258 - RNA, 22 nt, Human
gggccaccuggauuccaugugu

SEQ ID NO: 792259 - RNA, 21 nt, Human
uugcuuauggcacugcuuugc

SEQ ID NO: 792260 - RNA, 22 nt, Human
ugcauuuaagaaaacaugaguc

SEQ ID NO: 792261 - RNA, 22 nt, Human
ccaagcaaggcuaauucacuug

SEQ ID NO: 792262 - RNA, 22 nt, Human
aggcccauguucacuugcucag

SEQ ID NO: 792263 - RNA, 22 nt, Human
uauuguaucuucuguuuagaag

SEQ ID NO: 792264 - RNA, 19 nt, Human
ggcuccuggggcucagccc

SEQ ID NO: 792265 - RNA, 22 nt, Human
ucaaaaauaagauauucuggac

SEQ ID NO: 792266 - RNA, 22 nt, Human
ccagauaucacugccguguugu

SEQ ID NO: 792267 - RNA, 22 nt, Human
ccuguucuguggcucucaaagg

SEQ ID NO: 792268 - RNA, 22 nt, Human
gucuuagauuucaccgauaaug

SEQ ID NO: 792269 - RNA, 22 nt, Human
ccagggccuacagcuuaagucc

SEQ ID NO: 792270 - RNA, 22 nt, Human
cuccuggaucuuagccagauuc

SEQ ID NO: 792271 - RNA, 22 nt, Human
ccuggccaggcuccaaguacug

SEQ ID NO: 792272 - RNA, 22 nt, Human
ucauuuacuucuaugacaacau

SEQ ID NO: 792273 - RNA, 22 nt, Human
ggcagacacaaaaacauaaggu

SEQ ID NO: 792274 - RNA, 22 nt, Human
cugccaggggccucacaggcca

SEQ ID NO: 792275 - RNA, 22 nt, Human
ccuggccagggucugggcugcu

SEQ ID NO: 792276 - RNA, 22 nt, Human
gcccuggauggcaggagccauc

SEQ ID NO: 792277 - RNA, 22 nt, Human
cagcccugcuuccccgcuaguu

SEQ ID NO: 792278 - RNA, 22 nt, Human
gugcucuccuggcugcccugac

SEQ ID NO: 792279 - RNA, 17 nt, Human
acagaggcaggagugga

SEQ ID NO: 792280 - RNA, 22 nt, Human
uuucugcacauuucuaaaguug

SEQ ID NO: 792281 - RNA, 22 nt, Human
ccugcagagggacuggcaggaa

SEQ ID NO: 792282 - RNA, 22 nt, Human
ugcagagggaaaaggugcuccu

SEQ ID NO: 792283 - RNA, 22 nt, Human
aucuucaucaaguucacagugg

SEQ ID NO: 792284 - RNA, 22 nt, Human
aucuagaaaguguugaagauca

SEQ ID NO: 792285 - RNA, 22 nt, Human
ugggccaguccagccccaggga

SEQ ID NO: 792286 - RNA, 22 nt, Human
cuagagaaaauguuaauacagu

SEQ ID NO: 792287 - RNA, 21 nt, Human
acuagcuuucuggagaagugu

SEQ ID NO: 792288 - RNA, 22 nt, Human
ugaaagcuguccacuaggcugu

SEQ ID NO: 792289 - RNA, 22 nt, Human
ugucucuagggcaaugugaacu

SEQ ID NO: 792290 - RNA, 22 nt, Human
ugguucauugagaagacugaag

SEQ ID NO: 792291 - RNA, 22 nt, Human
cagucccaugagcccagaacau

SEQ ID NO: 792292 - RNA, 22 nt, Human
caaggcagugggcuaggaaccu

SEQ ID NO: 792293 - RNA, 22 nt, Human
aaccaguuuaagcaaauaacug

SEQ ID NO: 792294 - RNA, 22 nt, Human
uaaaugugcacuuuacuuuuca

SEQ ID NO: 792295 - RNA, 22 nt, Human
uauuuccaggccccacucuaga

SEQ ID NO: 792296 - RNA, 22 nt, Human
uacaacaguaaucaagguuuuu

SEQ ID NO: 792297 - RNA, 22 nt, Human
ggcuccagggucucuccuugug

SEQ ID NO: 792298 - RNA, 22 nt, Human
uggcuggcuguccagcugggca

SEQ ID NO: 792299 - RNA, 22 nt, Human
uucacuguccugcaacucuaga

SEQ ID NO: 792300 - RNA, 22 nt, Human
uguuuucuggguggaagguacu

SEQ ID NO: 792301 - RNA, 22 nt, Human
cauagaaaagaguagguaaugu

SEQ ID NO: 792302 - RNA, 22 nt, Human
ugauugauggaggugauuuacc

SEQ ID NO: 792303 - RNA, 22 nt, Human
uggcuuccacugugugcccccu

SEQ ID NO: 792304 - RNA, 18 nt, Human
cuuggcugaugggggugu

SEQ ID NO: 792305 - RNA, 22 nt, Human
ccacaguccgggcuggcaggac

SEQ ID NO: 792306 - RNA, 18 nt, Human
auaucugugggauggaga

SEQ ID NO: 792307 - RNA, 22 nt, Human
ccugccugauuccaggauggcu

SEQ ID NO: 792308 - RNA, 23 nt, Human
gcucuaucaggaacaagccaggu

SEQ ID NO: 792309 - RNA, 19 nt, Human
guauuucaggacaagacgu

SEQ ID NO: 792310 - RNA, 17 nt, Human
cugcagcuggagggcca

SEQ ID NO: 792311 - RNA, 22 nt, Human
gaccucagugaauggucaugua

SEQ ID NO: 792312 - RNA, 23 nt, Human
ucaauaacucggguuaaaauaga

SEQ ID NO: 792313 - RNA, 22 nt, Human
gcagauggcagcccaggcuggg

SEQ ID NO: 792314 - RNA, 23 nt, Human
ggccuggcccagggcccugauga

SEQ ID NO: 792315 - RNA, 22 nt, Human
ucaggcugguggucagauggcu

SEQ ID NO: 792316 - RNA, 22 nt, Human
guggcagagaacaaggagaggu

SEQ ID NO: 792317 - RNA, 18 nt, Human
ugccugccccguaagggu

SEQ ID NO: 792318 - RNA, 22 nt, Human
ggcuggacuuucugcugggcuc

SEQ ID NO: 792319 - RNA, 22 nt, Human
augcuauuccagaauguaaauu

SEQ ID NO: 792320 - RNA, 22 nt, Human
accuuuuuguucuguucucagc

SEQ ID NO: 792321 - RNA, 22 nt, Human
cugggaccuccucacuguucua

SEQ ID NO: 792322 - RNA, 22 nt, Human
gccugccugcugugugcaaguu

SEQ ID NO: 792323 - RNA, 22 nt, Human
gugcagcuacuccuugguccua

SEQ ID NO: 792324 - RNA, 22 nt, Human
cuuuggcuugcccuggcaguac

SEQ ID NO: 792325 - RNA, 22 nt, Human
cucaggaggccauucucaaggu

SEQ ID NO: 792326 - RNA, 21 nt, Human
aggcuuggaucuagacaggcc

SEQ ID NO: 792327 - RNA, 22 nt, Human
aaaaguuuaagacucauucuag

SEQ ID NO: 792328 - RNA, 22 nt, Human
ccuggccagcgccggcugcucg

SEQ ID NO: 792329 - RNA, 22 nt, Human
uuccugguccuauuauauacac

SEQ ID NO: 792330 - RNA, 22 nt, Human
aagucacagcuaaauagcuaag

SEQ ID NO: 792331 - RNA, 22 nt, Human
uauuauuaaauggcagaauuuu

SEQ ID NO: 792332 - RNA, 22 nt, Human
agcccuggauucugagguccaa

SEQ ID NO: 792333 - RNA, 22 nt, Human
cuaaaugugcuaauagcaugaa

SEQ ID NO: 792334 - RNA, 19 nt, Human
cuucacaucugugagggga

SEQ ID NO: 792335 - RNA, 22 nt, Human
agccaggccuuagggagaggca

SEQ ID NO: 792336 - RNA, 22 nt, Human
cagaauguauaugaucuaaggu

SEQ ID NO: 792337 - RNA, 19 nt, Human
acuggcaaaaaagguuaau

SEQ ID NO: 792338 - RNA, 22 nt, Human
agaggcucagaggccugguccu

SEQ ID NO: 792339 - RNA, 22 nt, Human
agggcuggcaucucuaaugcug

SEQ ID NO: 792340 - RNA, 17 nt, Human
ggacacagcucauggcu

SEQ ID NO: 792341 - RNA, 22 nt, Human
uugucugugaaauggaaauagu

SEQ ID NO: 792342 - RNA, 22 nt, Human
uacacaggggagcaugguugac

SEQ ID NO: 792343 - RNA, 22 nt, Human
augacaaauucagaccauagca

SEQ ID NO: 792344 - RNA, 19 nt, Human
uccaggcugagagucagcu

SEQ ID NO: 792345 - RNA, 22 nt, Human
ugcaauaaggaguaauaguaaa

SEQ ID NO: 792346 - RNA, 22 nt, Human
aggccagcucacccuggcuccu

SEQ ID NO: 792347 - RNA, 19 nt, Human
gauuuaaacguggcucuau

SEQ ID NO: 792348 - RNA, 22 nt, Human
acaagagacaagagguucuucu

SEQ ID NO: 792349 - RNA, 22 nt, Human
aauaauuagugggacagagaac

SEQ ID NO: 792350 - RNA, 22 nt, Human
gcaguggauggccagcaggggc

SEQ ID NO: 792351 - RNA, 21 nt, Human
agagcuggccugccaggcccu

SEQ ID NO: 792352 - RNA, 22 nt, Human
gaggagcugggacccugucauc

SEQ ID NO: 792353 - RNA, 22 nt, Human
cauauacugcauacauaugugu

SEQ ID NO: 792354 - RNA, 22 nt, Human
gacauuuaaauugcaggcagcc

SEQ ID NO: 792355 - RNA, 22 nt, Human
acaaagaaggaauuggucuuua

SEQ ID NO: 792356 - RNA, 22 nt, Human
aagccaguaaguuuuugucauu

SEQ ID NO: 792357 - RNA, 22 nt, Human
gaauacauggcagggagucauc

SEQ ID NO: 792358 - RNA, 22 nt, Human
cuccuggugcuggggcugccgc

SEQ ID NO: 792359 - RNA, 22 nt, Human
uuauauuucugguagccuucag

SEQ ID NO: 792360 - RNA, 22 nt, Human
ugcuggaggcaguggaggugcc

SEQ ID NO: 792361 - RNA, 21 nt, Human
gaaaagcaagggaguagaaca

SEQ ID NO: 792362 - RNA, 22 nt, Human
gagcccagcuguccuuggcaaa

SEQ ID NO: 792363 - RNA, 22 nt, Human
agagcagauggagcuggaagag

SEQ ID NO: 792364 - RNA, 19 nt, Human
ccagugucuagcgcacagc

SEQ ID NO: 792365 - RNA, 22 nt, Human
aucaguguuccuugagacugcc

SEQ ID NO: 792366 - RNA, 22 nt, Human
uguauguuucuaaaugauugcu

SEQ ID NO: 792367 - RNA, 22 nt, Human
cauggcuuaccccaggagcagc

SEQ ID NO: 792368 - RNA, 22 nt, Human
uggcccaggaggccagagggca

SEQ ID NO: 792369 - RNA, 22 nt, Human
ccugggagaacugcuggguugg

SEQ ID NO: 792370 - RNA, 22 nt, Human
aggaggaaagaaggcccccagc

SEQ ID NO: 792371 - RNA, 22 nt, Human
ucagcaggguuugacuucuaau

SEQ ID NO: 792372 - RNA, 22 nt, Human
ugcucuggacgcugagugguuu

SEQ ID NO: 792373 - RNA, 22 nt, Human
gccucaggugcaucucucauuc

SEQ ID NO: 792374 - RNA, 22 nt, Human
ugcagcccuuccuuccucuggg

SEQ ID NO: 792375 - RNA, 22 nt, Human
ggagguucugauuugucacaac

SEQ ID NO: 792376 - RNA, 22 nt, Human
agggaaauuaaugugagcaaug

SEQ ID NO: 792377 - RNA, 22 nt, Human
aaauuucaguuggaaugagcuc

SEQ ID NO: 792378 - RNA, 22 nt, Human
aggcaguuggucauugcucuuu

SEQ ID NO: 792379 - RNA, 22 nt, Human
ucacauuuuccuugguaucugu

SEQ ID NO: 792380 - RNA, 22 nt, Human
aaaguuuaucauagccggggac

SEQ ID NO: 792381 - RNA, 21 nt, Human
ugggacagugauggcuccucc

SEQ ID NO: 792382 - RNA, 19 nt, Human
gggagacagcucugggcug

SEQ ID NO: 792383 - RNA, 22 nt, Human
ugggaaaguaauugucauccuu

SEQ ID NO: 792384 - RNA, 22 nt, Human
gggcuggcucccagguguugaa

SEQ ID NO: 792385 - RNA, 22 nt, Human
uuucuaaaggguagauuuggcc

SEQ ID NO: 792386 - RNA, 22 nt, Human
uuauauauauguagaggucacg

SEQ ID NO: 792387 - RNA, 22 nt, Human
caacaacaugggauucauuucu

SEQ ID NO: 792388 - RNA, 22 nt, Human
aggcugucuuccucccucuugg

SEQ ID NO: 792389 - RNA, 22 nt, Human
cugcaagguccaccugcuacau

SEQ ID NO: 792390 - RNA, 21 nt, Human
agaggucuaagauucuagcuu

SEQ ID NO: 792391 - RNA, 22 nt, Human
ucaugcaacaacacauucuggc

SEQ ID NO: 792392 - RNA, 22 nt, Human
uacugaaaaagaauccagaccu

SEQ ID NO: 792393 - RNA, 22 nt, Human
uaauaacaauuguaggacauga

SEQ ID NO: 792394 - RNA, 22 nt, Human
auaaggcuuaaaccuuguugcc

SEQ ID NO: 792395 - RNA, 22 nt, Human
ucaguguccauaaauaaaguuu

SEQ ID NO: 792396 - RNA, 22 nt, Human
caacuauagaucaaaugaguuu

SEQ ID NO: 792397 - RNA, 22 nt, Human
acuggcagaauugaauaguugu

SEQ ID NO: 792398 - RNA, 22 nt, Human
accagcucagaagccagaaaga

SEQ ID NO: 792399 - RNA, 22 nt, Human
ugccagcccaccuuggggccuc

SEQ ID NO: 792400 - RNA, 22 nt, Human
gggagucagagagguaauggga

SEQ ID NO: 792401 - RNA, 22 nt, Human
aaugcaaacuucuuguuacuug

SEQ ID NO: 792402 - RNA, 22 nt, Human
uggaguucucaggugagggcuu

SEQ ID NO: 792403 - RNA, 18 nt, Human
acucacagcagaagaagg

SEQ ID NO: 792404 - RNA, 22 nt, Human
caggugcugcguggcggagcug

SEQ ID NO: 792405 - RNA, 22 nt, Human
aggcaugugcuguuugucucca

SEQ ID NO: 792406 - RNA, 22 nt, Human
ugcaaaaacugcaauugcuuuu

SEQ ID NO: 792407 - RNA, 22 nt, Human
cagugagcuccugucugucccu

SEQ ID NO: 792408 - RNA, 22 nt, Human
uuuauauuguaaaaaugguucu

SEQ ID NO: 792409 - RNA, 22 nt, Human
uuugaagacuacugggagugaa

SEQ ID NO: 792410 - RNA, 19 nt, Human
guauauuuauauggcugua

SEQ ID NO: 792411 - RNA, 20 nt, Human
aacuccuagccucaagugau

SEQ ID NO: 792412 - RNA, 22 nt, Human
agcaauaauuuaggccuuuccu

SEQ ID NO: 792413 - RNA, 22 nt, Human
acagugucaucaguuucucaac

SEQ ID NO: 792414 - RNA, 22 nt, Human
uccuggcagaaauggggcugug

SEQ ID NO: 792415 - RNA, 22 nt, Human
ucuggcuccuggcuccacugcc

SEQ ID NO: 792416 - RNA, 22 nt, Human
uggggaaaacagaggaaauuag

SEQ ID NO: 792417 - RNA, 22 nt, Human
gucacuggggccacaugcagaa

SEQ ID NO: 792418 - RNA, 22 nt, Human
gccagggugugcagggacagga

SEQ ID NO: 792419 - RNA, 22 nt, Human
agaggccagggacacugcucaa

SEQ ID NO: 792420 - RNA, 22 nt, Human
uuuacacauaaauguguagaca

SEQ ID NO: 792421 - RNA, 22 nt, Human
gggccagagcuuggcagcuggg

SEQ ID NO: 792422 - RNA, 22 nt, Human
uacauaguguuuugaagaauua

SEQ ID NO: 792423 - RNA, 22 nt, Human
cagagcugcagauugaaggcau

SEQ ID NO: 792424 - RNA, 22 nt, Human
uaaagugcugggauuauaggcc

SEQ ID NO: 792425 - RNA, 22 nt, Human
uaagccugcaugaaccaugaga

SEQ ID NO: 792426 - RNA, 22 nt, Human
uaaacuaucuguguuugaaguu

SEQ ID NO: 792427 - RNA, 22 nt, Human
gcuuucaaauccuaauuccaac

SEQ ID NO: 792428 - RNA, 22 nt, Human
cagcagccacuagagggcucac

SEQ ID NO: 792429 - RNA, 22 nt, Human
ggugggcaggcgaggcccaggu

SEQ ID NO: 792430 - RNA, 22 nt, Human
uagucuuuugagaaguauaucu

SEQ ID NO: 792431 - RNA, 22 nt, Human
gcacacagaaucagugggcaua

SEQ ID NO: 792432 - RNA, 22 nt, Human
auaaaaguuuccaaucaugccu

SEQ ID NO: 792433 - RNA, 22 nt, Human
uucaaacauucaaauaaaccgg

SEQ ID NO: 792434 - RNA, 22 nt, Human
uuugcuuucuguugaacagagu

SEQ ID NO: 792435 - RNA, 22 nt, Human
auuugucauguauguaaaguug

SEQ ID NO: 792436 - RNA, 22 nt, Human
cugcaggauuucaugggcugac

SEQ ID NO: 792437 - RNA, 22 nt, Human
acaggcugaaaguuaaguucug

SEQ ID NO: 792438 - RNA, 22 nt, Human
gcugggauggagacugcaguga

SEQ ID NO: 792439 - RNA, 17 nt, Human
uuucccuccuuccacuc

SEQ ID NO: 792440 - RNA, 22 nt, Human
uuauugucaaaaacaggacacu

SEQ ID NO: 792441 - RNA, 21 nt, Human
ugcuggugagcucauguggcu

SEQ ID NO: 792442 - RNA, 22 nt, Human
uccuuuuugguccaaggugacc

SEQ ID NO: 792443 - RNA, 22 nt, Human
uagaauaugugguguauacuuu

SEQ ID NO: 792444 - RNA, 20 nt, Human
uugcaaauaucuauugauug

SEQ ID NO: 792445 - RNA, 22 nt, Human
uaggcagauuccauauuuuggc

SEQ ID NO: 792446 - RNA, 22 nt, Human
ccugggagagcugcccggguga

SEQ ID NO: 792447 - RNA, 22 nt, Human
gcuggcaguaaaggguuuggca

SEQ ID NO: 792448 - RNA, 22 nt, Human
aaaauuuugcccuauccuucau

SEQ ID NO: 792449 - RNA, 22 nt, Human
gugagggguggcugagcaguuu

SEQ ID NO: 792450 - RNA, 22 nt, Human
ucaucagucagaacuuaagcuu

SEQ ID NO: 792451 - RNA, 22 nt, Human
aguagcaugugcacaguaauuu

SEQ ID NO: 792452 - RNA, 22 nt, Human
uuugucugccuugcuggacugu

SEQ ID NO: 792453 - RNA, 22 nt, Human
aguccuggacuuggagucaggg

SEQ ID NO: 792454 - RNA, 22 nt, Human
cccaggcucagacuggcuuguu

SEQ ID NO: 792455 - RNA, 22 nt, Human
ugggccucaucuucaaugaguc

SEQ ID NO: 792456 - RNA, 22 nt, Human
aguguauucugcaugggagacu

SEQ ID NO: 792457 - RNA, 22 nt, Human
uccagccuuucuacucacugag

SEQ ID NO: 792458 - RNA, 22 nt, Human
ugacuuccagcaacuuccucca

SEQ ID NO: 792459 - RNA, 22 nt, Human
caggcaggucagugaagaagga

SEQ ID NO: 792460 - RNA, 22 nt, Human
aguccuaggcccugcuccagau

SEQ ID NO: 792461 - RNA, 22 nt, Human
uacaugcuucuauaugugaagu

SEQ ID NO: 792462 - RNA, 22 nt, Human
uuucagagcugagaugccacag

SEQ ID NO: 792463 - RNA, 18 nt, Human
cuagggcuguggcucuca

SEQ ID NO: 792464 - RNA, 22 nt, Human
ugaucaaagugcuggaauuaca

SEQ ID NO: 792465 - RNA, 22 nt, Human
gggcacaggagaaggaucuggc

SEQ ID NO: 792466 - RNA, 22 nt, Human
gacaaaacugagaucacacugu

SEQ ID NO: 792467 - RNA, 18 nt, Human
gggaggccccagcaggag

SEQ ID NO: 792468 - RNA, 19 nt, Human
ucaaggcucccugagggau

SEQ ID NO: 792469 - RNA, 22 nt, Human
aggcaguggagcuggaauaggc

SEQ ID NO: 792470 - RNA, 22 nt, Human
cacccaggcaaggauucugcaa

SEQ ID NO: 792471 - RNA, 22 nt, Human
ggcuacaguggcacugggcuuu

SEQ ID NO: 792472 - RNA, 22 nt, Human
uaagcaaauaaugcaucaaggg

SEQ ID NO: 792473 - RNA, 22 nt, Human
caguugccuuauuuccuugcug

SEQ ID NO: 792474 - RNA, 22 nt, Human
uugagaugacuuaaauuuggga

SEQ ID NO: 792475 - RNA, 21 nt, Human
ccuagccucuuacccagcuuu

SEQ ID NO: 792476 - RNA, 22 nt, Human
gccuggccgcuccgagcuccgc

SEQ ID NO: 792477 - RNA, 22 nt, Human
augacucuaagaauucuagaug

SEQ ID NO: 792478 - RNA, 22 nt, Human
auggcagaagucaagaugaguu

SEQ ID NO: 792479 - RNA, 22 nt, Human
aggccaagugcugggacaggug

SEQ ID NO: 792480 - RNA, 19 nt, Human
caggacaguuugccaagaa

SEQ ID NO: 792481 - RNA, 23 nt, Human
ccagggaaggccaucuucaacug

SEQ ID NO: 792482 - RNA, 22 nt, Human
augggcagcugcagcaguggug

SEQ ID NO: 792483 - RNA, 22 nt, Human
auccugggccucagaggugugu

SEQ ID NO: 792484 - RNA, 22 nt, Human
aggagggagcacuauaugggga

SEQ ID NO: 792485 - RNA, 20 nt, Human
cccuggccuguuucaugccc

SEQ ID NO: 792486 - RNA, 22 nt, Human
ugcacuuuaaaaaauggugaug

SEQ ID NO: 792487 - RNA, 22 nt, Human
aagacaauccuggacagucagc

SEQ ID NO: 792488 - RNA, 22 nt, Human
uggcuucuuagaccaguggccu

SEQ ID NO: 792489 - RNA, 22 nt, Human
auuuuucucuuuccacugagau

SEQ ID NO: 792490 - RNA, 22 nt, Human
guacacacuguuugaucauuuc

SEQ ID NO: 792491 - RNA, 23 nt, Human
uucauauguugcugaaaacagca

SEQ ID NO: 792492 - RNA, 22 nt, Human
accccuuuuauagaagaacaga

SEQ ID NO: 792493 - RNA, 23 nt, Human
ugagcccaggaggucaaggcugc

SEQ ID NO: 792494 - RNA, 22 nt, Human
acagcagagccaguggcucuag

SEQ ID NO: 792495 - RNA, 22 nt, Human
acugcuauuuuauaacagaaga

SEQ ID NO: 792496 - RNA, 22 nt, Human
uggcccgccggaagaagauguc

SEQ ID NO: 792497 - RNA, 22 nt, Human
gcuucugaggaaggcucagccu

SEQ ID NO: 792498 - RNA, 22 nt, Human
ugccaggcuaaguggaggacuu

SEQ ID NO: 792499 - RNA, 22 nt, Human
uuccucagcucagcgagagaga

SEQ ID NO: 792500 - RNA, 22 nt, Human
ggucagaauuaggucuagagua

SEQ ID NO: 792501 - RNA, 20 nt, Human
caaagacaugcuaggggugg

SEQ ID NO: 792502 - RNA, 22 nt, Human
guuucauauauaguaacugaaa

SEQ ID NO: 792503 - RNA, 22 nt, Human
gggcagcucuggcugugggaag

SEQ ID NO: 792504 - RNA, 22 nt, Human
cagcugaguuacucugaggucu

SEQ ID NO: 792505 - RNA, 17 nt, Human
ugccagccugucccagg

SEQ ID NO: 792506 - RNA, 20 nt, Human
ugcuggcaugcaagagggaa

SEQ ID NO: 792507 - RNA, 17 nt, Human
auuucccagcagugcua

SEQ ID NO: 792508 - RNA, 22 nt, Human
gccacccuuaucccaugcuucu

SEQ ID NO: 792509 - RNA, 22 nt, Human
uacaacaauuuccacauuagaa

SEQ ID NO: 792510 - RNA, 23 nt, Human
gggaaaggauaugauccuagggg

SEQ ID NO: 792511 - RNA, 22 nt, Human
ugcuccugagguuggagaucca

SEQ ID NO: 792512 - RNA, 22 nt, Human
cugaaaugacgguuuggggcaa

SEQ ID NO: 792513 - RNA, 22 nt, Human
uagaaaguaaacacgaagucuc

SEQ ID NO: 792514 - RNA, 22 nt, Human
cugcagcuccugagcucagaga

SEQ ID NO: 792515 - RNA, 22 nt, Human
ugaggggagguuggggcacauc

SEQ ID NO: 792516 - RNA, 22 nt, Human
acugagguugaaauagugaugu

SEQ ID NO: 792517 - RNA, 22 nt, Human
uuuauuccaugugucuaugacc

SEQ ID NO: 792518 - RNA, 22 nt, Human
guuucauaauucaaucaaauga

SEQ ID NO: 792519 - RNA, 22 nt, Human
agaagggaacucagagaugauu

SEQ ID NO: 792520 - RNA, 22 nt, Human
acaauauacacauccuaauggg

SEQ ID NO: 792521 - RNA, 22 nt, Human
cacuguggugugagggcugaug

SEQ ID NO: 792522 - RNA, 22 nt, Human
auguuuaugcaaacaugugagu

SEQ ID NO: 792523 - RNA, 22 nt, Human
gauguacuugccuuaucuaucc

SEQ ID NO: 792524 - RNA, 22 nt, Human
gcuggccucgcaggcaggaugu

SEQ ID NO: 792525 - RNA, 22 nt, Human
aacagcaugcuggguaacauug

SEQ ID NO: 792526 - RNA, 22 nt, Human
guuauaaaaugcacaguuguuu

SEQ ID NO: 792527 - RNA, 22 nt, Human
aguaauagugaaucgacuauga

SEQ ID NO: 792528 - RNA, 22 nt, Human
agcaggagagcagugcgugguc

SEQ ID NO: 792529 - RNA, 21 nt, Human
agcugagcccagaagacuggu

SEQ ID NO: 792530 - RNA, 22 nt, Human
uucuuuggcauuuccuguaugu

SEQ ID NO: 792531 - RNA, 17 nt, Human
uacaggagagcaggaac

SEQ ID NO: 792532 - RNA, 22 nt, Human
augaaaugauugaaaucuuuac

SEQ ID NO: 792533 - RNA, 22 nt, Human
auauauuuacucuccuguugca

SEQ ID NO: 792534 - RNA, 22 nt, Human
ggcuggcugauaaaggguugag

SEQ ID NO: 792535 - RNA, 22 nt, Human
gagucucuggaggggucagacc

SEQ ID NO: 792536 - RNA, 20 nt, Human
aggcucacucaccuugugga

SEQ ID NO: 792537 - RNA, 22 nt, Human
agagccuguacuuuucugugaa

SEQ ID NO: 792538 - RNA, 22 nt, Human
acuuaaaguuauaauuugcuaa

SEQ ID NO: 792539 - RNA, 22 nt, Human
uuuaaugauagcuguuucacau

SEQ ID NO: 792540 - RNA, 22 nt, Human
agcucuuuggcacugagcagca

SEQ ID NO: 792541 - RNA, 22 nt, Human
ggcagcccaccagcccacgucu

SEQ ID NO: 792542 - RNA, 23 nt, Human
uaagaacagacaagcauuuacau

SEQ ID NO: 792543 - RNA, 22 nt, Human
ggcuggauguacuuuggggcug

SEQ ID NO: 792544 - RNA, 22 nt, Human
ugaauacuauuucauaaugugg

SEQ ID NO: 792545 - RNA, 22 nt, Human
gaaaucaggaugauguuccaga

SEQ ID NO: 792546 - RNA, 22 nt, Human
ucacuggggccaugugagggac

SEQ ID NO: 792547 - RNA, 22 nt, Human
acagcaaaagacaagaacuuaa

SEQ ID NO: 792548 - RNA, 22 nt, Human
aaacauguaauucugcuuaaga

SEQ ID NO: 792549 - RNA, 20 nt, Human
ugagaaggggucagcuguac

SEQ ID NO: 792550 - RNA, 22 nt, Human
cuacaaaaguaauugugguuuu

SEQ ID NO: 792551 - RNA, 22 nt, Human
ccagugucugugguauagaaag

SEQ ID NO: 792552 - RNA, 22 nt, Human
aaacaguucucauuuguuuaga

SEQ ID NO: 792553 - RNA, 22 nt, Human
gggacgagaucuuggcagugug

SEQ ID NO: 792554 - RNA, 22 nt, Human
ucauaaacacacuaguaugauu

SEQ ID NO: 792555 - RNA, 22 nt, Human
uuuccucuucuggcaggcaggg

SEQ ID NO: 792556 - RNA, 20 nt, Human
uaaauuagccuugaagauua

SEQ ID NO: 792557 - RNA, 22 nt, Human
aauuuuguucuuggaaaucagg

SEQ ID NO: 792558 - RNA, 22 nt, Human
aacaugaaacccaaacagaaua

SEQ ID NO: 792559 - RNA, 22 nt, Human
agguaggguuaauggagauaua

SEQ ID NO: 792560 - RNA, 22 nt, Human
gggaagagaccguacccuggcc

SEQ ID NO: 792561 - RNA, 22 nt, Human
aucuacaaugucuggcugcacu

SEQ ID NO: 792562 - RNA, 22 nt, Human
cugaaaauguuacacaggaaga

SEQ ID NO: 792563 - RNA, 22 nt, Human
aagcaggagaugcaggaaugua

SEQ ID NO: 792564 - RNA, 22 nt, Human
cacagugcgaaagaaacccagc

SEQ ID NO: 792565 - RNA, 22 nt, Human
caguccugggagacuuacccag

SEQ ID NO: 792566 - RNA, 21 nt, Human
agcagaggcagaauguaugca

SEQ ID NO: 792567 - RNA, 22 nt, Human
ucuccugguauguaugcaccug

SEQ ID NO: 792568 - RNA, 19 nt, Human
aaacucauagacucauauu

SEQ ID NO: 792569 - RNA, 22 nt, Human
uaguaaaaguuuaguugaaagu

SEQ ID NO: 792570 - RNA, 22 nt, Human
cugccucugcgucccacagagu

SEQ ID NO: 792571 - RNA, 22 nt, Human
cucaaggaaagucuggagaaga

SEQ ID NO: 792572 - RNA, 22 nt, Human
ccaggaaguaugacccaacaga

SEQ ID NO: 792573 - RNA, 22 nt, Human
ugagggagagggcgaaaaugaa

SEQ ID NO: 792574 - RNA, 22 nt, Human
ggccuuggccuagcccuccagg

SEQ ID NO: 792575 - RNA, 22 nt, Human
cuggaggcaguugccccaguca

SEQ ID NO: 792576 - RNA, 22 nt, Human
caggguggugaauagcuauagu

SEQ ID NO: 792577 - RNA, 22 nt, Human
ccacaguguuuugucacauuag

SEQ ID NO: 792578 - RNA, 19 nt, Human
cugacagcgccugauaaga

SEQ ID NO: 792579 - RNA, 23 nt, Human
uggaggaaacacaucagaagacc

SEQ ID NO: 792580 - RNA, 19 nt, Human
acagaaauguaagugagac

SEQ ID NO: 792581 - RNA, 22 nt, Human
aggccucuggagguggcagugu

SEQ ID NO: 792582 - RNA, 22 nt, Human
ugaucauuaucaaacuggucau

SEQ ID NO: 792583 - RNA, 22 nt, Human
uacaaaggaaacuucuuuuccc

SEQ ID NO: 792584 - RNA, 22 nt, Human
cagacagaaggaaggccaacau

SEQ ID NO: 792585 - RNA, 22 nt, Human
aauuucaccuaucacuuaagcc

SEQ ID NO: 792586 - RNA, 22 nt, Human
ugccaggaggaggugggacaga

SEQ ID NO: 792587 - RNA, 22 nt, Human
aagugauucauugaugaugagg

SEQ ID NO: 792588 - RNA, 20 nt, Human
acaaaguauugaggacaagu

SEQ ID NO: 792589 - RNA, 22 nt, Human
auuacaauaauacaugcucauu

SEQ ID NO: 792590 - RNA, 22 nt, Human
cagcagcagcuuaguggucccc

SEQ ID NO: 792591 - RNA, 22 nt, Human
gcucaaaugucauggggagccu

SEQ ID NO: 792592 - RNA, 22 nt, Human
accagagagccuaggcugggca

SEQ ID NO: 792593 - RNA, 22 nt, Human
aaauaaagguccacuuuagggc

SEQ ID NO: 792594 - RNA, 22 nt, Human
aguaaugaauacgguauuugaa

SEQ ID NO: 792595 - RNA, 22 nt, Human
acagugcugucaaauauguuuu

SEQ ID NO: 792596 - RNA, 22 nt, Human
ugcaaaaagagcgaggagcccu

SEQ ID NO: 792597 - RNA, 22 nt, Human
auuucccaggacuagaaauaua

SEQ ID NO: 792598 - RNA, 21 nt, Human
cuggagcuuggugagaagugu

SEQ ID NO: 792599 - RNA, 22 nt, Human
acaaacaucuugaccucagauu

SEQ ID NO: 792600 - RNA, 22 nt, Human
agccucugauggcucccaagga

SEQ ID NO: 792601 - RNA, 19 nt, Human
agcuguggggccuagcacc

SEQ ID NO: 792602 - RNA, 18 nt, Human
ccagcccugcagcaccug

SEQ ID NO: 792603 - RNA, 22 nt, Human
cuucauuuccauccaacuggga

SEQ ID NO: 792604 - RNA, 23 nt, Human
aaauaggaguaucuggaucauga

SEQ ID NO: 792605 - RNA, 22 nt, Human
uggauucugggcuguuugcauu

SEQ ID NO: 792606 - RNA, 22 nt, Human
cucaggacccgguccagguggg

SEQ ID NO: 792607 - RNA, 22 nt, Human
caagauuacuauccacugcugg

SEQ ID NO: 792608 - RNA, 22 nt, Human
aagcacagugccaaguucuauu

SEQ ID NO: 792609 - RNA, 22 nt, Human
uggcagcugucuguggggucuc

SEQ ID NO: 792610 - RNA, 22 nt, Human
caggcauggagaggcagagacu

SEQ ID NO: 792611 - RNA, 22 nt, Human
ccaggccagggcugcagcgagc

SEQ ID NO: 792612 - RNA, 20 nt, Human
caccaggcgcucugagaaca

SEQ ID NO: 792613 - RNA, 22 nt, Human
uauacagaacugcacgugcacg

SEQ ID NO: 792614 - RNA, 22 nt, Human
cagcugaauucuucagacucca

SEQ ID NO: 792615 - RNA, 22 nt, Human
cauggcagcuuugggaggagga

SEQ ID NO: 792616 - RNA, 22 nt, Human
uuucacaacguuguggugagag

SEQ ID NO: 792617 - RNA, 20 nt, Human
uucuuuacgaccuuucugca

SEQ ID NO: 792618 - RNA, 22 nt, Human
ggcugcugaguuggccaggaga

SEQ ID NO: 792619 - RNA, 22 nt, Human
aggagggagcuuaagccaggca

SEQ ID NO: 792620 - RNA, 22 nt, Human
agccccaggaugggccgcagga

SEQ ID NO: 792621 - RNA, 22 nt, Human
ccuggccacagggcucugcauu

SEQ ID NO: 792622 - RNA, 22 nt, Human
uggcucagaaggcugccuucac

SEQ ID NO: 792623 - RNA, 22 nt, Human
ugggccaguagcuacucgcaag

SEQ ID NO: 792624 - RNA, 22 nt, Human
cugagcuguuacucuguccucg

SEQ ID NO: 792625 - RNA, 22 nt, Human
aaacccauggcugauaucacua

SEQ ID NO: 792626 - RNA, 22 nt, Human
aguggccagugcugcucugggg

SEQ ID NO: 792627 - RNA, 22 nt, Human
ucucuggcagaggcccuauccc

SEQ ID NO: 792628 - RNA, 22 nt, Human
aaaauuuucagcuugacuugau

SEQ ID NO: 792629 - RNA, 22 nt, Human
cuucugaauggcuguguaugcu

SEQ ID NO: 792630 - RNA, 22 nt, Human
ugagauggagucuugcucuguu

SEQ ID NO: 792631 - RNA, 22 nt, Human
aacagaaaucauuuagggcucu

SEQ ID NO: 792632 - RNA, 22 nt, Human
uggggaaagggauggcucccgc

SEQ ID NO: 792633 - RNA, 22 nt, Human
auuauuaaagcuuaggucuuau

SEQ ID NO: 792634 - RNA, 22 nt, Human
cucuuuggggcuggaagccuag

SEQ ID NO: 792635 - RNA, 20 nt, Human
auacaaagagauugauguau

SEQ ID NO: 792636 - RNA, 22 nt, Human
ggcagccacccugggaggcaga

SEQ ID NO: 792637 - RNA, 22 nt, Human
aaguccuuuccaguccugugau

SEQ ID NO: 792638 - RNA, 22 nt, Human
aauaccuuuucagugcacaaaa

SEQ ID NO: 792639 - RNA, 22 nt, Human
uaaagacaaacccacuaggguu

SEQ ID NO: 792640 - RNA, 22 nt, Human
gugcaaaugauucuaaugggua

SEQ ID NO: 792641 - RNA, 22 nt, Human
gcaggagagucugugccagguu

SEQ ID NO: 792642 - RNA, 22 nt, Human
aacuaaaacugguuuguucucu

SEQ ID NO: 792643 - RNA, 22 nt, Human
agguggggaggagugucucuuu

SEQ ID NO: 792644 - RNA, 22 nt, Human
ccagcuggugacauccccaacc

SEQ ID NO: 792645 - RNA, 22 nt, Human
gucuuuggagaggugccauuuc

SEQ ID NO: 792646 - RNA, 22 nt, Human
cugguucacaucuguuuaucug

SEQ ID NO: 792647 - RNA, 23 nt, Human
cagagcuggcucagagcugccug

SEQ ID NO: 792648 - RNA, 22 nt, Human
gugcuuccuguauugauuccau

SEQ ID NO: 792649 - RNA, 22 nt, Human
gccaggcuggucuugaacuccu

SEQ ID NO: 792650 - RNA, 21 nt, Human
cucugcugucuaccagcuguu

SEQ ID NO: 792651 - RNA, 23 nt, Human
uucauguucccuccuucugguga

SEQ ID NO: 792652 - RNA, 22 nt, Human
gcugccuggagcucagccugcc

SEQ ID NO: 792653 - RNA, 22 nt, Human
ccaggccucccuuuuccagcca

SEQ ID NO: 792654 - RNA, 22 nt, Human
aaacauucaaagcaggaugugu

SEQ ID NO: 792655 - RNA, 22 nt, Human
uuccaggaauucagcucucagu

SEQ ID NO: 792656 - RNA, 21 nt, Human
ccacaggggcuccccugucag

SEQ ID NO: 792657 - RNA, 22 nt, Human
cuggcuggaacgccgaggcggc

SEQ ID NO: 792658 - RNA, 22 nt, Human
agcuggggguuggauaagggua

SEQ ID NO: 792659 - RNA, 22 nt, Human
cagaggcccagugagagggcug

SEQ ID NO: 792660 - RNA, 22 nt, Human
gagccagccgcaagagcuguga

SEQ ID NO: 792661 - RNA, 22 nt, Human
cugccuggagcauucugaaggu

SEQ ID NO: 792662 - RNA, 22 nt, Human
cagcuugggucaggugccugcu

SEQ ID NO: 792663 - RNA, 22 nt, Human
ccagggugggaggcugaaggcg

SEQ ID NO: 792664 - RNA, 22 nt, Human
aggccaagugaacaaugcuagu

SEQ ID NO: 792665 - RNA, 22 nt, Human
gggcugggauggcuugaagauu

SEQ ID NO: 792666 - RNA, 22 nt, Human
acugggaggcaucuggagcuga

SEQ ID NO: 792667 - RNA, 22 nt, Human
aaaagcagguacucagcuuggg

SEQ ID NO: 792668 - RNA, 22 nt, Human
acauacauugccucauugguaa

SEQ ID NO: 792669 - RNA, 23 nt, Human
ggccacuuugugucaguaugugc

SEQ ID NO: 792670 - RNA, 22 nt, Human
ccugucuacauaacugugugaa

SEQ ID NO: 792671 - RNA, 22 nt, Human
augcauucaugaagauugcaca

SEQ ID NO: 792672 - RNA, 22 nt, Human
aaagugcagcugaaaacauccu

SEQ ID NO: 792673 - RNA, 22 nt, Human
gccugagagaacugaccaagag

SEQ ID NO: 792674 - RNA, 22 nt, Human
ggucagccuuggauuugguagc

SEQ ID NO: 792675 - RNA, 22 nt, Human
aucucacacuggguuugagggu

SEQ ID NO: 792676 - RNA, 22 nt, Human
uggcagugaaccaaggcuccaa

SEQ ID NO: 792677 - RNA, 22 nt, Human
gguggcaguuacaggggcaaau

SEQ ID NO: 792678 - RNA, 22 nt, Human
auaugccagcuccaaguaagag

SEQ ID NO: 792679 - RNA, 22 nt, Human
acagucuuuaauuucuuugugg

SEQ ID NO: 792680 - RNA, 22 nt, Human
auacagaaguuuuccacuuauu

SEQ ID NO: 792681 - RNA, 22 nt, Human
uaucaggaggaaauuuccauug

SEQ ID NO: 792682 - RNA, 18 nt, Human
uguuuauuuuucucuuac

SEQ ID NO: 792683 - RNA, 22 nt, Human
gagaggcugguaaagucugaac

SEQ ID NO: 792684 - RNA, 22 nt, Human
aggaaacaggcagccuuugaac

SEQ ID NO: 792685 - RNA, 22 nt, Human
guuuauuccagcaaucugcuua

SEQ ID NO: 792686 - RNA, 22 nt, Human
ccagccuggagggcaguggugg

SEQ ID NO: 792687 - RNA, 22 nt, Human
gauacaaaauauaaauggagag

SEQ ID NO: 792688 - RNA, 22 nt, Human
ccuccuuccugggacagagcug

SEQ ID NO: 792689 - RNA, 22 nt, Human
ucagaaggaaacgaugccagcu

SEQ ID NO: 792690 - RNA, 22 nt, Human
caugcaaacacguaaacauuca

SEQ ID NO: 792691 - RNA, 21 nt, Human
agguggcugcauccucagaag

SEQ ID NO: 792692 - RNA, 22 nt, Human
uguuuacaagccacuuguuaag

SEQ ID NO: 792693 - RNA, 22 nt, Human
uccuggggccagcacuggugga

SEQ ID NO: 792694 - RNA, 22 nt, Human
gccaggguccugaagaccaagu

SEQ ID NO: 792695 - RNA, 22 nt, Human
uaacaugagagcuaagacauua

SEQ ID NO: 792696 - RNA, 22 nt, Human
cccagggcccuggacagcuaca

SEQ ID NO: 792697 - RNA, 22 nt, Human
aaauagcacagcagcugaggcu

SEQ ID NO: 792698 - RNA, 22 nt, Human
auagaauguauuauaguacaga

SEQ ID NO: 792699 - RNA, 22 nt, Human
cauugcuuugugcauauuuaaa

SEQ ID NO: 792700 - RNA, 22 nt, Human
cuggcagcauggagccugugcu

SEQ ID NO: 792701 - RNA, 22 nt, Human
aggcugagggcuccugagggca

SEQ ID NO: 792702 - RNA, 22 nt, Human
gcauuccuacaggcugcuauga

SEQ ID NO: 792703 - RNA, 22 nt, Human
cugccuggaaugccagcuucuc

SEQ ID NO: 792704 - RNA, 22 nt, Human
ugauucaacuuucuugaaugca

SEQ ID NO: 792705 - RNA, 22 nt, Human
ugacaaagaggaacagcagggg

SEQ ID NO: 792706 - RNA, 19 nt, Human
uacaauuggcuuuccauug

SEQ ID NO: 792707 - RNA, 22 nt, Human
aggagccaggccccauggggcu

SEQ ID NO: 792708 - RNA, 22 nt, Human
uaguuucucagggaggaaagaa

SEQ ID NO: 792709 - RNA, 22 nt, Human
cugggcugcgggcgccccucca

SEQ ID NO: 792710 - RNA, 22 nt, Human
agaaacugacaggaaaugaauu

SEQ ID NO: 792711 - RNA, 22 nt, Human
gaaauauuguacuggagauguu

SEQ ID NO: 792712 - RNA, 22 nt, Human
gccuccggagucacagugucuu

SEQ ID NO: 792713 - RNA, 22 nt, Human
uccucaggcugccuggaagacu

SEQ ID NO: 792714 - RNA, 22 nt, Human
agugcagugguuaggagccagg

SEQ ID NO: 792715 - RNA, 22 nt, Human
ccucucccagggagagccugag

SEQ ID NO: 792716 - RNA, 18 nt, Human
gcuggcugcacuucugcu

SEQ ID NO: 792717 - RNA, 22 nt, Human
uagaaacccugccuuaguagcu

SEQ ID NO: 792718 - RNA, 22 nt, Human
guacauauuauaaaauacagcu

SEQ ID NO: 792719 - RNA, 22 nt, Human
uucucuuuuugcaucucaaccu

SEQ ID NO: 792720 - RNA, 22 nt, Human
uagauacauacauuuuaaaaug

SEQ ID NO: 792721 - RNA, 22 nt, Human
uguguaaaaucugauuaauacu

SEQ ID NO: 792722 - RNA, 23 nt, Human
cugggcugcuugagucccuggcu

SEQ ID NO: 792723 - RNA, 22 nt, Human
cugcugggcagaggcugcauga

SEQ ID NO: 792724 - RNA, 22 nt, Human
cugggcacaaguggcccuggau

SEQ ID NO: 792725 - RNA, 22 nt, Human
aggaaagguagcgugccagcag

SEQ ID NO: 792726 - RNA, 22 nt, Human
ccuccugguaauuagcgaaagg

SEQ ID NO: 792727 - RNA, 22 nt, Human
ucagaagguggagguugcagug

SEQ ID NO: 792728 - RNA, 22 nt, Human
gaaagugcuuagagugugguau

SEQ ID NO: 792729 - RNA, 22 nt, Human
auggaguucugccagcgcugcu

SEQ ID NO: 792730 - RNA, 22 nt, Human
guggcaguguggagggaggagu

SEQ ID NO: 792731 - RNA, 22 nt, Human
ucagugucuucucuuuccuacc

SEQ ID NO: 792732 - RNA, 21 nt, Human
acagaacuguauagugauaaa

SEQ ID NO: 792733 - RNA, 22 nt, Human
uaggaaauuuuacuggucuggg

SEQ ID NO: 792734 - RNA, 22 nt, Human
ugaugcuucacgcugaauaugc

SEQ ID NO: 792735 - RNA, 22 nt, Human
gcugcaggcagaaucucccaau

SEQ ID NO: 792736 - RNA, 22 nt, Human
ugucuugacuuuagagccagga

SEQ ID NO: 792737 - RNA, 22 nt, Human
uauuacauccacuuuuauugca

SEQ ID NO: 792738 - RNA, 18 nt, Human
ugggugguuuuucucucc

SEQ ID NO: 792739 - RNA, 22 nt, Human
cagcuuuggcccagucgggagg

SEQ ID NO: 792740 - RNA, 22 nt, Human
uuucacaaagcauagcacuuua

SEQ ID NO: 792741 - RNA, 22 nt, Human
ucccagggugaaaugcaguagg

SEQ ID NO: 792742 - RNA, 22 nt, Human
ccucugagccugugugcggcac

SEQ ID NO: 792743 - RNA, 22 nt, Human
gagccaagggcgugcuggagag

SEQ ID NO: 792744 - RNA, 22 nt, Human
ggcugagggucccagacccuaa

SEQ ID NO: 792745 - RNA, 22 nt, Human
agaaauguggaucguuuuaaaa

SEQ ID NO: 792746 - RNA, 22 nt, Human
uucuauuuuuguggaacuguag

SEQ ID NO: 792747 - RNA, 22 nt, Human
uccaggcccugggaugggagca

SEQ ID NO: 792748 - RNA, 19 nt, Human
cuggccuguguccugugcu

SEQ ID NO: 792749 - RNA, 19 nt, Human
uggcagggagugauauuag

SEQ ID NO: 792750 - RNA, 22 nt, Human
uuugucauuucccugauuaaag

SEQ ID NO: 792751 - RNA, 22 nt, Human
cuaaacaaugaacaaagcacug

SEQ ID NO: 792752 - RNA, 22 nt, Human
ucugcagcccaaagucucuuag

SEQ ID NO: 792753 - RNA, 22 nt, Human
acuauacaccaaaauauuaagg

SEQ ID NO: 792754 - RNA, 22 nt, Human
uuugcaaaguuauuuagacuca

SEQ ID NO: 792755 - RNA, 22 nt, Human
ggcacacagauggagcacuagc

SEQ ID NO: 792756 - RNA, 22 nt, Human
ugcagagguguugcugagauaa

SEQ ID NO: 792757 - RNA, 18 nt, Human
gcuccugguuggaaagaa

SEQ ID NO: 792758 - RNA, 22 nt, Human
aucuucaacuuuggggcugccu

SEQ ID NO: 792759 - RNA, 22 nt, Human
agugcauucaguauucauaggc

SEQ ID NO: 792760 - RNA, 22 nt, Human
gacauucuaaaaaauauggaag

SEQ ID NO: 792761 - RNA, 22 nt, Human
uaugacaagaaauacagaggua

SEQ ID NO: 792762 - RNA, 22 nt, Human
cacaauaaauguuugcugauga

SEQ ID NO: 792763 - RNA, 22 nt, Human
cagggcaguuugugccuaugag

SEQ ID NO: 792764 - RNA, 22 nt, Human
agaaauacugccuaagacugua

SEQ ID NO: 792765 - RNA, 22 nt, Human
cuugccugcuggagcagggcuc

SEQ ID NO: 792766 - RNA, 22 nt, Human
guccucugucccuggggcacgg

SEQ ID NO: 792767 - RNA, 22 nt, Human
acaggcagcaaaaucagccuca

SEQ ID NO: 792768 - RNA, 22 nt, Human
auugauuugaacaaagauauua

SEQ ID NO: 792769 - RNA, 22 nt, Human
aaggcagauaagaauucagcaa

SEQ ID NO: 792770 - RNA, 22 nt, Human
gaauuuaucuacguuaaguaug

SEQ ID NO: 792771 - RNA, 22 nt, Human
ucuuaaugcuagccaauagaga

SEQ ID NO: 792772 - RNA, 22 nt, Human
accccagcgcauauggucugcg

SEQ ID NO: 792773 - RNA, 22 nt, Human
auuuuuccugggugcuuuaguu

SEQ ID NO: 792774 - RNA, 22 nt, Human
uggcuuccccuaccuuccaauu

SEQ ID NO: 792775 - RNA, 22 nt, Human
uugaaugagaaguuauugccau

SEQ ID NO: 792776 - RNA, 22 nt, Human
agaauaaaugcuaccuaucaca

SEQ ID NO: 792777 - RNA, 22 nt, Human
ugcuggagcuccgggcuguagg

SEQ ID NO: 792778 - RNA, 22 nt, Human
agcuucuugaccaagccuguaa

SEQ ID NO: 792779 - RNA, 22 nt, Human
accucaggauguggacacagaa

SEQ ID NO: 792780 - RNA, 22 nt, Human
aguccuggccccaaggaaggau

SEQ ID NO: 792781 - RNA, 22 nt, Human
ggcaguguccagcuuccuggag

SEQ ID NO: 792782 - RNA, 19 nt, Human
gcagaugaugaggcugguc

SEQ ID NO: 792783 - RNA, 22 nt, Human
gguggggcccaggcaucugaug

SEQ ID NO: 792784 - RNA, 22 nt, Human
auuuccaguacccagaacagag

SEQ ID NO: 792785 - RNA, 22 nt, Human
uagugucauuucaguggaguuu

SEQ ID NO: 792786 - RNA, 22 nt, Human
caggacagcugggccaccacca

SEQ ID NO: 792787 - RNA, 22 nt, Human
ccuucugagcuucaauuucagu

SEQ ID NO: 792788 - RNA, 22 nt, Human
cucucucaguguaauacaggau

SEQ ID NO: 792789 - RNA, 22 nt, Human
aggucaagguucacaggggauc

SEQ ID NO: 792790 - RNA, 22 nt, Human
ccaggagcaaagaucacuggga

SEQ ID NO: 792791 - RNA, 22 nt, Human
auguucuuggauguuguguaua

SEQ ID NO: 792792 - RNA, 22 nt, Human
auuugucaaaacacagagaaca

SEQ ID NO: 792793 - RNA, 22 nt, Human
uaaagugaguacaaaaugaggg

SEQ ID NO: 792794 - RNA, 22 nt, Human
acaggaaauuggcauaucaguu

SEQ ID NO: 792795 - RNA, 22 nt, Human
gaaaacauccagagauagaccu

SEQ ID NO: 792796 - RNA, 22 nt, Human
aaaggcauguggucaaggcuca

SEQ ID NO: 792797 - RNA, 22 nt, Human
aacauucugguucuaaaaaccu

SEQ ID NO: 792798 - RNA, 22 nt, Human
cacagggaaccaaggcugggcc

SEQ ID NO: 792799 - RNA, 22 nt, Human
ucaguucuuauuuucaugaaua

SEQ ID NO: 792800 - RNA, 17 nt, Human
aauugucagcaguagcu

SEQ ID NO: 792801 - RNA, 22 nt, Human
auguauuugcguauggacauac

SEQ ID NO: 792802 - RNA, 22 nt, Human
uuccucagcuguguccuggcga

SEQ ID NO: 792803 - RNA, 22 nt, Human
uauacaguuaaguuucuucagu

SEQ ID NO: 792804 - RNA, 22 nt, Human
acagcagggaauaugggaauug

SEQ ID NO: 792805 - RNA, 20 nt, Human
ggggggcuucagggccugug

SEQ ID NO: 792806 - RNA, 22 nt, Human
cugagcagcaauugcuggccca

SEQ ID NO: 792807 - RNA, 22 nt, Human
aaagcuauagggucaagcauuu

SEQ ID NO: 792808 - RNA, 20 nt, Human
cccuggagagaagcuccacg

SEQ ID NO: 792809 - RNA, 22 nt, Human
aggccagguggucaugcuugcu

SEQ ID NO: 792810 - RNA, 22 nt, Human
auguacaaaauguuuugaaaug

SEQ ID NO: 792811 - RNA, 22 nt, Human
cugcccuguggcucugagucau

SEQ ID NO: 792812 - RNA, 22 nt, Human
ugcaggcucaccugccagggcc

SEQ ID NO: 792813 - RNA, 17 nt, Human
ugggccaguagaaggga

SEQ ID NO: 792814 - RNA, 22 nt, Human
augacacaagagcagaagccau

SEQ ID NO: 792815 - RNA, 22 nt, Human
caggcccacugcuugucuaguc

SEQ ID NO: 792816 - RNA, 22 nt, Human
ucacaauuuggauacagcuaug

SEQ ID NO: 792817 - RNA, 22 nt, Human
ggccuagggaguggccaugccu

SEQ ID NO: 792818 - RNA, 22 nt, Human
cauggcagagccugcagguggg

SEQ ID NO: 792819 - RNA, 22 nt, Human
gagcugagcagggagccucacu

SEQ ID NO: 792820 - RNA, 22 nt, Human
gaauuacauaguuucuagguuc

SEQ ID NO: 792821 - RNA, 22 nt, Human
uuccagaguauugguagcuaua

SEQ ID NO: 792822 - RNA, 22 nt, Human
aagcaauagcaacaacuuuaca

SEQ ID NO: 792823 - RNA, 22 nt, Human
uagcuuugcuggcaagcauguc

SEQ ID NO: 792824 - RNA, 22 nt, Human
gcagcugaaagggaucucuaca

SEQ ID NO: 792825 - RNA, 20 nt, Human
caccagcagcagcugccacc

SEQ ID NO: 792826 - RNA, 22 nt, Human
agaaauuauuagugaauagucu

SEQ ID NO: 792827 - RNA, 22 nt, Human
aggccugggucucgugccuacc

SEQ ID NO: 792828 - RNA, 18 nt, Human
aagcugggaaggagacag

SEQ ID NO: 792829 - RNA, 22 nt, Human
caaggcaguuccccagagggcu

SEQ ID NO: 792830 - RNA, 22 nt, Human
cuggcucccgaagcccucagug

SEQ ID NO: 792831 - RNA, 22 nt, Human
ugccuggcugaggugacagguu

SEQ ID NO: 792832 - RNA, 22 nt, Human
auccauuuccuccacuauaaag

SEQ ID NO: 792833 - RNA, 22 nt, Human
ugggaccacacuuugaacaaca

SEQ ID NO: 792834 - RNA, 22 nt, Human
ugggccugccccaggcuucagc

SEQ ID NO: 792835 - RNA, 22 nt, Human
gucagcaaggaaaaugugucac

SEQ ID NO: 792836 - RNA, 21 nt, Human
aucaacauugaaagagcugga

SEQ ID NO: 792837 - RNA, 22 nt, Human
acgaauaaaucuauuucacaca

SEQ ID NO: 792838 - RNA, 22 nt, Human
cugcuggcaccgaugaaagaca

SEQ ID NO: 792839 - RNA, 22 nt, Human
ggaggcugagaaguccaagauc

SEQ ID NO: 792840 - RNA, 22 nt, Human
gaguccaggcuggucaaauagc

SEQ ID NO: 792841 - RNA, 22 nt, Human
gaggagcaugggaaggcucugg

SEQ ID NO: 792842 - RNA, 22 nt, Human
agugagucaaacauauccugac

SEQ ID NO: 792843 - RNA, 22 nt, Human
augcacaucacucugaagaaaa

SEQ ID NO: 792844 - RNA, 20 nt, Human
aaaugcuuuugacacauauu

SEQ ID NO: 792845 - RNA, 22 nt, Human
cuaaaauuaccuaccaguuuag

SEQ ID NO: 792846 - RNA, 22 nt, Human
ugggaagggaguuucuuggagu

SEQ ID NO: 792847 - RNA, 22 nt, Human
accacaggaggauggcugcugg

SEQ ID NO: 792848 - RNA, 22 nt, Human
ccuuggcuugugggcugcagcc

SEQ ID NO: 792849 - RNA, 20 nt, Human
agucucugcaacauagugca

SEQ ID NO: 792850 - RNA, 22 nt, Human
caaagucagcugccagucccaa

SEQ ID NO: 792851 - RNA, 22 nt, Human
agccucucacugucacccuccc

SEQ ID NO: 792852 - RNA, 22 nt, Human
ucuugggagucccaggacauag

SEQ ID NO: 792853 - RNA, 22 nt, Human
gcagcugcgcugguguggggca

SEQ ID NO: 792854 - RNA, 22 nt, Human
gugaggugggcuggccagagac

SEQ ID NO: 792855 - RNA, 22 nt, Human
uucuuacauuacuuuacaugug

SEQ ID NO: 792856 - RNA, 22 nt, Human
uacacauacauugcuuacaagg

SEQ ID NO: 792857 - RNA, 20 nt, Human
gagcacaguaaugacugcua

SEQ ID NO: 792858 - RNA, 22 nt, Human
caggcuguguuccuggaacccc

SEQ ID NO: 792859 - RNA, 22 nt, Human
agccucugaugaucacaggggg

SEQ ID NO: 792860 - RNA, 22 nt, Human
cuucuugugcacucucuaugua

SEQ ID NO: 792861 - RNA, 22 nt, Human
cugggcagaauuuuaggauggc

SEQ ID NO: 792862 - RNA, 22 nt, Human
uaguacaguuuacuuucagcgc

SEQ ID NO: 792863 - RNA, 22 nt, Human
acuuauucugagauuaugauca

SEQ ID NO: 792864 - RNA, 22 nt, Human
uggcccugacagguccugggca

SEQ ID NO: 792865 - RNA, 22 nt, Human
ggagccugacagugcccagcau

SEQ ID NO: 792866 - RNA, 22 nt, Human
gccuccccaggggugucaugag

SEQ ID NO: 792867 - RNA, 22 nt, Human
cacagagacagaucuauuuugc

SEQ ID NO: 792868 - RNA, 22 nt, Human
cuguggcugaacucugaagagg

SEQ ID NO: 792869 - RNA, 22 nt, Human
cggacaggcuccuggagcuccu

SEQ ID NO: 792870 - RNA, 22 nt, Human
cccaggagguggagguugcggu

SEQ ID NO: 792871 - RNA, 23 nt, Human
agaaaagcuuggacacauggccu

SEQ ID NO: 792872 - RNA, 22 nt, Human
aggccuggcaugagaccugaga

SEQ ID NO: 792873 - RNA, 22 nt, Human
acccagagauggaccuggcugc

SEQ ID NO: 792874 - RNA, 22 nt, Human
agcacagaugcaugaucaccag

SEQ ID NO: 792875 - RNA, 22 nt, Human
ugcagcugcucauucucucagu

SEQ ID NO: 792876 - RNA, 22 nt, Human
aaauggauguugaguuaaaugu

SEQ ID NO: 792877 - RNA, 22 nt, Human
uagaaaugauugagcuguaaua

SEQ ID NO: 792878 - RNA, 20 nt, Human
cucucccagcacagcuuccu

SEQ ID NO: 792879 - RNA, 22 nt, Human
uguaacaucacagugauguuug

SEQ ID NO: 792880 - RNA, 19 nt, Human
ugcugcuguccuugcaggg

SEQ ID NO: 792881 - RNA, 23 nt, Human
ggagugcaauggcgccaucucgg

SEQ ID NO: 792882 - RNA, 22 nt, Human
cugugacuuuugcccuguacca

SEQ ID NO: 792883 - RNA, 23 nt, Human
agcagcccaauggcaagcucugg

SEQ ID NO: 792884 - RNA, 22 nt, Human
uggcuccaggggacacgcagua

SEQ ID NO: 792885 - RNA, 22 nt, Human
cuggagggaggaggcugcuauu

SEQ ID NO: 792886 - RNA, 23 nt, Human
gcuggcuggcaguaaagguuguu

SEQ ID NO: 792887 - RNA, 19 nt, Human
uuugauaucugaauuaugc

SEQ ID NO: 792888 - RNA, 22 nt, Human
aaaagucugcucucauuucaga

SEQ ID NO: 792889 - RNA, 22 nt, Human
acuauauacacauuaucuuguu

SEQ ID NO: 792890 - RNA, 22 nt, Human
caggcugggaacgccacccgcu

SEQ ID NO: 792891 - RNA, 22 nt, Human
cuuuacaaauagggagggagug

SEQ ID NO: 792892 - RNA, 22 nt, Human
aauguacagcugucuuuccucc

SEQ ID NO: 792893 - RNA, 22 nt, Human
agaaaggucacuuagccucagc

SEQ ID NO: 792894 - RNA, 22 nt, Human
gccggggcuggggagagacaug

SEQ ID NO: 792895 - RNA, 22 nt, Human
uucaacaaggcugucaaaaguu

SEQ ID NO: 792896 - RNA, 22 nt, Human
uauguuacaaaguuuuucuaaa

SEQ ID NO: 792897 - RNA, 22 nt, Human
uuuggagagaugaaguucugug

SEQ ID NO: 792898 - RNA, 22 nt, Human
uggagagguuuaaacaaaaguu

SEQ ID NO: 792899 - RNA, 23 nt, Human
aggaaacugaaggggcccucuau

SEQ ID NO: 792900 - RNA, 22 nt, Human
uggugggaguccgcugugcugc

SEQ ID NO: 792901 - RNA, 22 nt, Human
cacaguuugcauaggaaaaaca

SEQ ID NO: 792902 - RNA, 22 nt, Human
cauucucaauaguagaugagua

SEQ ID NO: 792903 - RNA, 20 nt, Human
uacaaagagccccucucuuc

SEQ ID NO: 792904 - RNA, 22 nt, Human
uucaaacuguguaauuuauaaa

SEQ ID NO: 792905 - RNA, 22 nt, Human
aggacaguccgggguccuccac

SEQ ID NO: 792906 - RNA, 20 nt, Human
aacacaggguuaccaucaga

SEQ ID NO: 792907 - RNA, 22 nt, Human
ccaggcuccccaggaggcccuu

SEQ ID NO: 792908 - RNA, 22 nt, Human
ccugcuggccaguggagggcug

SEQ ID NO: 792909 - RNA, 22 nt, Human
acaaucacacaugcaauuauac

SEQ ID NO: 792910 - RNA, 22 nt, Human
ucauagaaugaguuaaugaacu

SEQ ID NO: 792911 - RNA, 22 nt, Human
ggcagaggaagcuggaaguggg

SEQ ID NO: 792912 - RNA, 22 nt, Human
ggcaggacagucccaguucaaa

SEQ ID NO: 792913 - RNA, 22 nt, Human
uaaguucaaugaacucaguucu

SEQ ID NO: 792914 - RNA, 23 nt, Human
aacauuuguaaggugauuuuguu

SEQ ID NO: 792915 - RNA, 22 nt, Human
gccaccaguagcuaacaacagu

SEQ ID NO: 792916 - RNA, 22 nt, Human
gcacacaguacuauaugcuaca

SEQ ID NO: 792917 - RNA, 22 nt, Human
aaauaauuauagcgagucuauc

SEQ ID NO: 792918 - RNA, 22 nt, Human
cagcugggccuccugagcccug

SEQ ID NO: 792919 - RNA, 22 nt, Human
agccagggauggcagugcccag

SEQ ID NO: 792920 - RNA, 22 nt, Human
ucagcacugaaauucuucacau

SEQ ID NO: 792921 - RNA, 22 nt, Human
gaccuucuguuggaggcauuua

SEQ ID NO: 792922 - RNA, 22 nt, Human
uuucacaugugcuguugucaau

SEQ ID NO: 792923 - RNA, 22 nt, Human
aaauaaaggaacuguuuuccca

SEQ ID NO: 792924 - RNA, 22 nt, Human
aggcucagcccaagguggagag

SEQ ID NO: 792925 - RNA, 22 nt, Human
uuugcauuaucucacuuauaua

SEQ ID NO: 792926 - RNA, 22 nt, Human
caaaugcaugagaaauaagagg

SEQ ID NO: 792927 - RNA, 22 nt, Human
uuucucauggaacauagcuccu

SEQ ID NO: 792928 - RNA, 22 nt, Human
ucccagcagggccgaccagccu

SEQ ID NO: 792929 - RNA, 20 nt, Human
cuggcuucgggaacuaguuu

SEQ ID NO: 792930 - RNA, 22 nt, Human
acuggcagugucguuuacauga

SEQ ID NO: 792931 - RNA, 22 nt, Human
cuggaaugaagcuauguacauu

SEQ ID NO: 792932 - RNA, 22 nt, Human
uuauuuuuaaaaguucacacag

SEQ ID NO: 792933 - RNA, 22 nt, Human
uccuagaaugcaccucugcugu

SEQ ID NO: 792934 - RNA, 22 nt, Human
uggcagcuccuggggccagcac

SEQ ID NO: 792935 - RNA, 22 nt, Human
uaggaaauuucauuugaggucu

SEQ ID NO: 792936 - RNA, 22 nt, Human
gagcccaggcagagguugcagu

SEQ ID NO: 792937 - RNA, 22 nt, Human
cacaugcaucugucauguuugg

SEQ ID NO: 792938 - RNA, 22 nt, Human
gaagcaagugcaaggaagaggc

SEQ ID NO: 792939 - RNA, 22 nt, Human
cacuuuacuaucuauaaaauaa

SEQ ID NO: 792940 - RNA, 22 nt, Human
agcaaauuaggucaaggagaug

SEQ ID NO: 792941 - RNA, 22 nt, Human
gggggugagccugccaggccca

SEQ ID NO: 792942 - RNA, 22 nt, Human
aggcacuuuccuugaggaguuu

SEQ ID NO: 792943 - RNA, 19 nt, Human
ugaggggaggagaggccug

SEQ ID NO: 792944 - RNA, 22 nt, Human
cagucuggaggucagcuggcuu

SEQ ID NO: 792945 - RNA, 22 nt, Human
caucacaggcauuuugaguguc

SEQ ID NO: 792946 - RNA, 22 nt, Human
aaguaaggccuucuugagcaug

SEQ ID NO: 792947 - RNA, 22 nt, Human
uucuaugugaacguuauaguuu

SEQ ID NO: 792948 - RNA, 22 nt, Human
cuccugguuccugucuuaaaua

SEQ ID NO: 792949 - RNA, 22 nt, Human
gcugccucaggcaccuccuggc

SEQ ID NO: 792950 - RNA, 22 nt, Human
guggcccucagcaguugccaag

SEQ ID NO: 792951 - RNA, 22 nt, Human
guacauuucucuuguucuuauu

SEQ ID NO: 792952 - RNA, 22 nt, Human
ucaauagauaaagcuacauaaa

SEQ ID NO: 792953 - RNA, 22 nt, Human
uuacaaaguuuaagguggcacu

SEQ ID NO: 792954 - RNA, 22 nt, Human
uuuccuugggucucuuaguggc

SEQ ID NO: 792955 - RNA, 22 nt, Human
uagcuuuguuuaucaaggggca

SEQ ID NO: 792956 - RNA, 22 nt, Human
agaaguuuguuauguaaacaaa

SEQ ID NO: 792957 - RNA, 22 nt, Human
aaugucaacacaagagaaaugc

SEQ ID NO: 792958 - RNA, 22 nt, Human
aucaucuucgaaaaaagucaga

SEQ ID NO: 792959 - RNA, 22 nt, Human
ccuucucucugaagaccccaaa

SEQ ID NO: 792960 - RNA, 22 nt, Human
ccugggcuuugagggcaggaug

SEQ ID NO: 792961 - RNA, 22 nt, Human
ucaaaucucacucugcauuucu

SEQ ID NO: 792962 - RNA, 22 nt, Human
acaacauucuuaaauacacuga

SEQ ID NO: 792963 - RNA, 19 nt, Human
acagaagcauagaaaagga

SEQ ID NO: 792964 - RNA, 22 nt, Human
acugaaauacugcucuuggauu

SEQ ID NO: 792965 - RNA, 22 nt, Human
ccuggcugcuuucacuauggag

SEQ ID NO: 792966 - RNA, 22 nt, Human
gggugggccccagguaucugua

SEQ ID NO: 792967 - RNA, 22 nt, Human
cacccaggacaggccagaugug

SEQ ID NO: 792968 - RNA, 22 nt, Human
gcacccagaggucagcagugcu

SEQ ID NO: 792969 - RNA, 22 nt, Human
aggagccauuuuccaagggcga

SEQ ID NO: 792970 - RNA, 18 nt, Human
ucuacccucucagagucu

SEQ ID NO: 792971 - RNA, 22 nt, Human
gccagugccucgccgcgcuccu

SEQ ID NO: 792972 - RNA, 20 nt, Human
gaggccucagccucagcucc

SEQ ID NO: 792973 - RNA, 22 nt, Human
acauguaaaaggaacaugcaug

SEQ ID NO: 792974 - RNA, 22 nt, Human
cugggcagagcuaacaccugag

SEQ ID NO: 792975 - RNA, 22 nt, Human
cagucucucugaaguauuaaga

SEQ ID NO: 792976 - RNA, 22 nt, Human
uuaauacagucuccagaaguaa

SEQ ID NO: 792977 - RNA, 22 nt, Human
aaacauguuuagaaagcagcug

SEQ ID NO: 792978 - RNA, 22 nt, Human
accuccccugacucgaaaccca

SEQ ID NO: 792979 - RNA, 22 nt, Human
augccagguacagggguagggu

SEQ ID NO: 792980 - RNA, 22 nt, Human
caaauagacuucaaucucuuga

SEQ ID NO: 792981 - RNA, 22 nt, Human
ggaaaaaugacacauaucucaa

SEQ ID NO: 792982 - RNA, 22 nt, Human
uggcuagauuuauugcugagca

SEQ ID NO: 792983 - RNA, 22 nt, Human
uuacacaauuuuauugaccuaa

SEQ ID NO: 792984 - RNA, 22 nt, Human
acagcaggcacacaaggauaga

SEQ ID NO: 792985 - RNA, 22 nt, Human
ugucuuuaguugcuuagauuug

SEQ ID NO: 792986 - RNA, 20 nt, Human
cacagcuugccuuuuaugac

SEQ ID NO: 792987 - RNA, 22 nt, Human
agcaggguucucaguuggugcu

SEQ ID NO: 792988 - RNA, 22 nt, Human
gccucugcucucagguagccuc

SEQ ID NO: 792989 - RNA, 22 nt, Human
cugccuggaccggcagcccucc

SEQ ID NO: 792990 - RNA, 22 nt, Human
aauguacaaggguuccaguuuu

SEQ ID NO: 792991 - RNA, 22 nt, Human
agccugggcaugggacgggagg

SEQ ID NO: 792992 - RNA, 22 nt, Human
uaguaaauuaaaauauugacuu

SEQ ID NO: 792993 - RNA, 19 nt, Human
ucucugcagcgcgcccggc

SEQ ID NO: 792994 - RNA, 22 nt, Human
uauugauuccugcuuucugcuc

SEQ ID NO: 792995 - RNA, 22 nt, Human
cuccuggcucgcccccagcuga

SEQ ID NO: 792996 - RNA, 22 nt, Human
auguuucaucaguaagguuuug

SEQ ID NO: 792997 - RNA, 22 nt, Human
uugauuuuuuucuacuaugcgc

SEQ ID NO: 792998 - RNA, 22 nt, Human
agacaauggagggaaauacuuc

SEQ ID NO: 792999 - RNA, 22 nt, Human
ugcaauuucaaauaucagaaag

SEQ ID NO: 793000 - RNA, 23 nt, Human
aagaacuuugguccugcagaguc

SEQ ID NO: 793001 - RNA, 22 nt, Human
cagcccugcuggcaaugaugag

SEQ ID NO: 793002 - RNA, 22 nt, Human
aaacuucaaggauuugcaaauc

SEQ ID NO: 793003 - RNA, 22 nt, Human
uuccuauuuccaugaaacacaa

SEQ ID NO: 793004 - RNA, 22 nt, Human
caggguggaauggaaugcuggc

SEQ ID NO: 793005 - RNA, 22 nt, Human
uuugacaaauaggggaauaagg

SEQ ID NO: 793006 - RNA, 22 nt, Human
guuuuauaggugaaauauuacu

SEQ ID NO: 793007 - RNA, 22 nt, Human
cccugcacagccuggcucucuu

SEQ ID NO: 793008 - RNA, 22 nt, Human
uacuuguuuuguguuccuaaac

SEQ ID NO: 793009 - RNA, 19 nt, Human
cuuuucaagccaucaguuu

SEQ ID NO: 793010 - RNA, 22 nt, Human
gggcccugccuaaggaacacac

SEQ ID NO: 793011 - RNA, 22 nt, Human
cagcaggugggcuuugcggaug

SEQ ID NO: 793012 - RNA, 22 nt, Human
cugagcagcacagggcgccagg

SEQ ID NO: 793013 - RNA, 22 nt, Human
uuuucaaagacuggaggcugau

SEQ ID NO: 793014 - RNA, 22 nt, Human
ggacaggaugcugaagaugaag

SEQ ID NO: 793015 - RNA, 22 nt, Human
cuggcuggagcaggcaucuugu

SEQ ID NO: 793016 - RNA, 22 nt, Human
uuaagacaugugagcauaacuu

SEQ ID NO: 793017 - RNA, 22 nt, Human
agaugaagacucaggagcaggu

SEQ ID NO: 793018 - RNA, 22 nt, Human
accagagagagacaggguugug

SEQ ID NO: 793019 - RNA, 22 nt, Human
aaucaggagcugagguuuagcc

SEQ ID NO: 793020 - RNA, 22 nt, Human
auuacaaucgagagaaacaaau

SEQ ID NO: 793021 - RNA, 22 nt, Human
cuuaaaaguugcuucccuaacu

SEQ ID NO: 793022 - RNA, 22 nt, Human
aauguaugugcaucauuuacau

SEQ ID NO: 793023 - RNA, 22 nt, Human
ugguucuaaaggacuauacaga

SEQ ID NO: 793024 - RNA, 21 nt, Human
aaggucuguaaagugacagga

SEQ ID NO: 793025 - RNA, 22 nt, Human
gcccagcuggcuuccagcacau

SEQ ID NO: 793026 - RNA, 22 nt, Human
ucaggccugagaaaaauccuuu

SEQ ID NO: 793027 - RNA, 22 nt, Human
cguguacagucuaucuuuuuuc

SEQ ID NO: 793028 - RNA, 21 nt, Human
gcuggcuggcugaccggccuu

SEQ ID NO: 793029 - RNA, 22 nt, Human
ggguaggaaauccagagguggc

SEQ ID NO: 793030 - RNA, 22 nt, Human
uacaaacuaacaugucucaucc

SEQ ID NO: 793031 - RNA, 22 nt, Human
ggugcaggacgaaguggggguu

SEQ ID NO: 793032 - RNA, 22 nt, Human
ugguccagucguuccuuuccuu

SEQ ID NO: 793033 - RNA, 22 nt, Human
gugucucuuccuuucaaguggg

SEQ ID NO: 793034 - RNA, 22 nt, Human
agucacuguuuaaucuagcuaa

SEQ ID NO: 793035 - RNA, 22 nt, Human
acauucaagaugcauucacuua

SEQ ID NO: 793036 - RNA, 22 nt, Human
aaaaugaauaaguuaacccagg

SEQ ID NO: 793037 - RNA, 22 nt, Human
uaaagucaucuuuaaacaugcc

SEQ ID NO: 793038 - RNA, 19 nt, Human
ucccuucuauaguaauaaa

SEQ ID NO: 793039 - RNA, 22 nt, Human
uuugucuucauccuucgagcug

SEQ ID NO: 793040 - RNA, 22 nt, Human
cucuccagccaggggcuuccug

SEQ ID NO: 793041 - RNA, 22 nt, Human
uguguucaguaugacauucaca

SEQ ID NO: 793042 - RNA, 22 nt, Human
ggugccagccuagugcaguggu

SEQ ID NO: 793043 - RNA, 22 nt, Human
ucagcuuggacagcuugguuga

SEQ ID NO: 793044 - RNA, 22 nt, Human
uucauugacugguucguuaagu

SEQ ID NO: 793045 - RNA, 22 nt, Human
caacuacaggaaaagucauuca

SEQ ID NO: 793046 - RNA, 22 nt, Human
cccugaggaccaggaaggaggg

SEQ ID NO: 793047 - RNA, 22 nt, Human
uguuaaaaauucagcucuagau

SEQ ID NO: 793048 - RNA, 20 nt, Human
gaauuuuaugaacacuacca

SEQ ID NO: 793049 - RNA, 23 nt, Human
uuuaaaaguuguaauguaggcuu

SEQ ID NO: 793050 - RNA, 22 nt, Human
aagaaauacaugguuuuugagu

SEQ ID NO: 793051 - RNA, 22 nt, Human
gugacaggcccagugggaugca

SEQ ID NO: 793052 - RNA, 22 nt, Human
caaaggaagcuccuugauggcg

SEQ ID NO: 793053 - RNA, 22 nt, Human
aaggcuggggugcagacggccu

SEQ ID NO: 793054 - RNA, 22 nt, Human
gguuaaaaucuaaaaugugacu

SEQ ID NO: 793055 - RNA, 22 nt, Human
gcagggcuguggacacuuuggu

SEQ ID NO: 793056 - RNA, 23 nt, Human
auuaccagccugacaccaacaaa

SEQ ID NO: 793057 - RNA, 22 nt, Human
ucacaggacccugaggguggcg

SEQ ID NO: 793058 - RNA, 23 nt, Human
acugcagccuccgccugccgggu

SEQ ID NO: 793059 - RNA, 22 nt, Human
auccugggaagcugacauugaa

SEQ ID NO: 793060 - RNA, 22 nt, Human
caggccucuuccaugcagcagc

SEQ ID NO: 793061 - RNA, 22 nt, Human
cagagggcguccggguuaacuu

SEQ ID NO: 793062 - RNA, 22 nt, Human
auugucauuggcuucuaugucu

SEQ ID NO: 793063 - RNA, 20 nt, Human
guggcaggcagugaaggagc

SEQ ID NO: 793064 - RNA, 22 nt, Human
gaaugcuuugggaauucagaau

SEQ ID NO: 793065 - RNA, 22 nt, Human
acaugcaacuaaagggugccac

SEQ ID NO: 793066 - RNA, 22 nt, Human
ugucuuuaguuuuacugucugg

SEQ ID NO: 793067 - RNA, 22 nt, Human
aagccaguuagcacaucauugc

SEQ ID NO: 793068 - RNA, 19 nt, Human
augucuguugaauuucaua

SEQ ID NO: 793069 - RNA, 22 nt, Human
agcccaggcagagggaugcuug

SEQ ID NO: 793070 - RNA, 19 nt, Human
uugguucauggaugcccaa

SEQ ID NO: 793071 - RNA, 22 nt, Human
cuggcacacagaggcccucggg

SEQ ID NO: 793072 - RNA, 22 nt, Human
acuucucuucauagguggcaau

SEQ ID NO: 793073 - RNA, 22 nt, Human
agggggcauuaugaggcuuuuc

SEQ ID NO: 793074 - RNA, 22 nt, Human
gggcacugugcuaggugcugag

SEQ ID NO: 793075 - RNA, 22 nt, Human
gccuggagacaaggacaaaggg

SEQ ID NO: 793076 - RNA, 22 nt, Human
aaaacaguuuaggcaucacagu

SEQ ID NO: 793077 - RNA, 22 nt, Human
cuuuuuguuguauaagcccuuu

SEQ ID NO: 793078 - RNA, 22 nt, Human
cccugcugucaggugcugggag

SEQ ID NO: 793079 - RNA, 22 nt, Human
gggagcugagcuggaagagaau

SEQ ID NO: 793080 - RNA, 22 nt, Human
caagccagugacagccagggaa

SEQ ID NO: 793081 - RNA, 22 nt, Human
gcggaaggcugccuggcuugag

SEQ ID NO: 793082 - RNA, 22 nt, Human
acaaacuuccaucaugaauuuu

SEQ ID NO: 793083 - RNA, 22 nt, Human
aguuucauguagccauauuuac

SEQ ID NO: 793084 - RNA, 21 nt, Human
ccugugcuaucagcuuggguu

SEQ ID NO: 793085 - RNA, 22 nt, Human
auucuaagucuuguucacauuc

SEQ ID NO: 793086 - RNA, 17 nt, Human
uggcuucccugggccac

SEQ ID NO: 793087 - RNA, 22 nt, Human
ccauggcaacuggcguccaggg

SEQ ID NO: 793088 - RNA, 22 nt, Human
gacaauaaaaugaucuuacagu

SEQ ID NO: 793089 - RNA, 22 nt, Human
cuuggauuccgugaacuuaacc

SEQ ID NO: 793090 - RNA, 22 nt, Human
uggcuccagauuuccugcugca

SEQ ID NO: 793091 - RNA, 22 nt, Human
aaagucacuuccuucugucagc

SEQ ID NO: 793092 - RNA, 22 nt, Human
ucuauuuuguuuccagcucuac

SEQ ID NO: 793093 - RNA, 19 nt, Human
accaggagacagugagcuu

SEQ ID NO: 793094 - RNA, 22 nt, Human
ccuggggcuccagagcagcgga

SEQ ID NO: 793095 - RNA, 22 nt, Human
uuccaggaugcugcugcuuuuu

SEQ ID NO: 793096 - RNA, 22 nt, Human
uccuggccaaguagauguggcg

SEQ ID NO: 793097 - RNA, 22 nt, Human
ucaggcuguggcuuugaccgca

SEQ ID NO: 793098 - RNA, 22 nt, Human
gaagcaaagagcuagugccgcu

SEQ ID NO: 793099 - RNA, 22 nt, Human
agaaacuauccugaguagcaaa

SEQ ID NO: 793100 - RNA, 21 nt, Human
uauuuauuaauuuguaaggcu

SEQ ID NO: 793101 - RNA, 22 nt, Human
uucagaaucuaugugccagcuc

SEQ ID NO: 793102 - RNA, 22 nt, Human
gagacagaugcugcuggagcau

SEQ ID NO: 793103 - RNA, 22 nt, Human
acaaagagaccaugagccaaac

SEQ ID NO: 793104 - RNA, 22 nt, Human
gccaggcuaagaaaggugugau

SEQ ID NO: 793105 - RNA, 22 nt, Human
uauaccuuccacaaaacagcuu

SEQ ID NO: 793106 - RNA, 22 nt, Human
caucaguguucacuauuccuuc

SEQ ID NO: 793107 - RNA, 22 nt, Human
uggcuuccugcauggauccucu

SEQ ID NO: 793108 - RNA, 22 nt, Human
agagagagggaaacugcuaaac

SEQ ID NO: 793109 - RNA, 23 nt, Human
uucuggaagauuuacuugagaca

SEQ ID NO: 793110 - RNA, 22 nt, Human
gguggguaaaacugcuggcacu

SEQ ID NO: 793111 - RNA, 22 nt, Human
guaggcugugugaggcuagaga

SEQ ID NO: 793112 - RNA, 22 nt, Human
uacugaaaguggucaacagugg

SEQ ID NO: 793113 - RNA, 22 nt, Human
aucaagcagugaaaaaugcuag

SEQ ID NO: 793114 - RNA, 22 nt, Human
uuugucauucuguguauuuaaa

SEQ ID NO: 793115 - RNA, 22 nt, Human
ccaccccuguagagggacagac

SEQ ID NO: 793116 - RNA, 22 nt, Human
caugcuaagucauaaaagagua

SEQ ID NO: 793117 - RNA, 22 nt, Human
uacaagaaugucuuaaaagcuc

SEQ ID NO: 793118 - RNA, 22 nt, Human
agggggugaaugucugucuaca

SEQ ID NO: 793119 - RNA, 22 nt, Human
ugcugagcgcauccggcggccg

SEQ ID NO: 793120 - RNA, 22 nt, Human
gaaaggaaauauucuaagcacu

SEQ ID NO: 793121 - RNA, 21 nt, Human
ugcuggcugaaaggcacagag

SEQ ID NO: 793122 - RNA, 22 nt, Human
cugggggccuuacggaacucca

SEQ ID NO: 793123 - RNA, 22 nt, Human
gcugcagguuugucuagucugg

SEQ ID NO: 793124 - RNA, 21 nt, Human
ccaggcuccugaggcugguca

SEQ ID NO: 793125 - RNA, 22 nt, Human
aaugcaaagugaggugaguggc

SEQ ID NO: 793126 - RNA, 22 nt, Human
ugauguucuguauaucauauag

SEQ ID NO: 793127 - RNA, 22 nt, Human
ccugugccaaaaucuaggcagu

SEQ ID NO: 793128 - RNA, 21 nt, Human
ucagaauuaccccuggaucug

SEQ ID NO: 793129 - RNA, 20 nt, Human
ucagggcaugggacagcccc

SEQ ID NO: 793130 - RNA, 22 nt, Human
ucccugaaacauaauagaugcc

SEQ ID NO: 793131 - RNA, 22 nt, Human
ccagagcugagggagccugagc

SEQ ID NO: 793132 - RNA, 22 nt, Human
aaauauguuuuccaguugucau

SEQ ID NO: 793133 - RNA, 22 nt, Human
acuggcuggccacacccuggua

SEQ ID NO: 793134 - RNA, 22 nt, Human
ugcagucuuccagcugcacaaa

SEQ ID NO: 793135 - RNA, 20 nt, Human
agcaggccuuggggagagga

SEQ ID NO: 793136 - RNA, 22 nt, Human
cccugggcucagagcagguagc

SEQ ID NO: 793137 - RNA, 22 nt, Human
guggcccaggcuuggcgcuggc

SEQ ID NO: 793138 - RNA, 22 nt, Human
agcagggcuugccgcuuguccu

SEQ ID NO: 793139 - RNA, 22 nt, Human
agcccaggucucaaaguacagg

SEQ ID NO: 793140 - RNA, 22 nt, Human
cagugcaguugguggcaggggu

SEQ ID NO: 793141 - RNA, 22 nt, Human
uuucccaagugaagugaagcca

SEQ ID NO: 793142 - RNA, 22 nt, Human
ccccugccauagucaaaucuaa

SEQ ID NO: 793143 - RNA, 22 nt, Human
ugccagcuguucccacccaaaa

SEQ ID NO: 793144 - RNA, 22 nt, Human
agucucugggcaugguugugac

SEQ ID NO: 793145 - RNA, 22 nt, Human
ccucccaccauuuagagagagc

SEQ ID NO: 793146 - RNA, 22 nt, Human
caaagcagagaacugucucauu

SEQ ID NO: 793147 - RNA, 20 nt, Human
agcaggaaugaugcuuucau

SEQ ID NO: 793148 - RNA, 22 nt, Human
auaugacagaauguguguguau

SEQ ID NO: 793149 - RNA, 22 nt, Human
gcucagagauggggaaugaaaa

SEQ ID NO: 793150 - RNA, 22 nt, Human
uggcuggcaguuaucuuuggau

SEQ ID NO: 793151 - RNA, 22 nt, Human
ucagaaggaagaagucauggga

SEQ ID NO: 793152 - RNA, 22 nt, Human
cugggaguguucuaggucacau

SEQ ID NO: 793153 - RNA, 17 nt, Human
uggaaggcuucaauauu

SEQ ID NO: 793154 - RNA, 22 nt, Human
gcaggccuguaaugaagggaca

SEQ ID NO: 793155 - RNA, 22 nt, Human
auauagaaggugcuauuuacau

SEQ ID NO: 793156 - RNA, 22 nt, Human
uauguuaagugggauaaucaaa

SEQ ID NO: 793157 - RNA, 22 nt, Human
aaggagauuguuaaagcuauau

SEQ ID NO: 793158 - RNA, 22 nt, Human
acaggacaauuuauaaugggca

SEQ ID NO: 793159 - RNA, 22 nt, Human
agucuuuccuuuuggaagaaaa

SEQ ID NO: 793160 - RNA, 19 nt, Human
cgcaggagccgaggugacc

SEQ ID NO: 793161 - RNA, 22 nt, Human
ucaggagcagcaugggugagag

SEQ ID NO: 793162 - RNA, 22 nt, Human
ugccugccugcauagucccacg

SEQ ID NO: 793163 - RNA, 22 nt, Human
ugaggcuuccaacaugugagaa

SEQ ID NO: 793164 - RNA, 22 nt, Human
ugccccugaccucaggcgaagg

SEQ ID NO: 793165 - RNA, 22 nt, Human
agagggugggcacgugauggau

SEQ ID NO: 793166 - RNA, 20 nt, Human
guauccccgcguggggaagg

SEQ ID NO: 793167 - RNA, 22 nt, Human
ggccacaugaauucuuggacag

SEQ ID NO: 793168 - RNA, 19 nt, Human
auguuuuaugcugauggga

SEQ ID NO: 793169 - RNA, 22 nt, Human
ggccuugguacuguaaaccgag

SEQ ID NO: 793170 - RNA, 21 nt, Human
gcagaggaaugguauacauaa

SEQ ID NO: 793171 - RNA, 22 nt, Human
cagcucugaggaacacuccuuu

SEQ ID NO: 793172 - RNA, 22 nt, Human
uggcucaggguccccaaauggu

SEQ ID NO: 793173 - RNA, 22 nt, Human
aggcaguggaugucaggaaugg

SEQ ID NO: 793174 - RNA, 22 nt, Human
guggcagucaucaaggacagau

SEQ ID NO: 793175 - RNA, 22 nt, Human
aagcacagacacaaaaggcuuu

SEQ ID NO: 793176 - RNA, 22 nt, Human
caguuauuaugaggucauuagg

SEQ ID NO: 793177 - RNA, 22 nt, Human
ccacauucaguccaggcuugga

SEQ ID NO: 793178 - RNA, 22 nt, Human
gagggaggugauacugaacgua

SEQ ID NO: 793179 - RNA, 22 nt, Human
caugaaauggccaaccuucggc

SEQ ID NO: 793180 - RNA, 22 nt, Human
uaguaauaaguugugcuuugau

SEQ ID NO: 793181 - RNA, 22 nt, Human
gacaggaacauaaauguaggag

SEQ ID NO: 793182 - RNA, 21 nt, Human
uauugauucaauuucuugagu

SEQ ID NO: 793183 - RNA, 22 nt, Human
agugaguggauguaggaauugg

SEQ ID NO: 793184 - RNA, 22 nt, Human
uagggagaggaagcaggccgcu

SEQ ID NO: 793185 - RNA, 18 nt, Human
cagaagcaggcagugcag

SEQ ID NO: 793186 - RNA, 22 nt, Human
gagcucugacugcugggugaca

SEQ ID NO: 793187 - RNA, 22 nt, Human
cagagggcccccuggccacagu

SEQ ID NO: 793188 - RNA, 22 nt, Human
ucaaaguagccggauggaauuu

SEQ ID NO: 793189 - RNA, 22 nt, Human
uucacaauaauguccauccucu

SEQ ID NO: 793190 - RNA, 22 nt, Human
caguuugucuugauucagaaca

SEQ ID NO: 793191 - RNA, 22 nt, Human
gaucaggaauauuggaaaguac

SEQ ID NO: 793192 - RNA, 22 nt, Human
acccaggcuggagugcaguguc

SEQ ID NO: 793193 - RNA, 22 nt, Human
ggcucuuuggcgggccuugaac

SEQ ID NO: 793194 - RNA, 19 nt, Human
uagugucaaggaggagggu

SEQ ID NO: 793195 - RNA, 22 nt, Human
gugaggagggcuggucccaggc

SEQ ID NO: 793196 - RNA, 22 nt, Human
gcaauguuuuuccuuccauauu

SEQ ID NO: 793197 - RNA, 22 nt, Human
ucucuuagucuuauauguaaaa

SEQ ID NO: 793198 - RNA, 22 nt, Human
cugaggugagaggaggccaugu

SEQ ID NO: 793199 - RNA, 22 nt, Human
caggccugcuucuuacccuuca

SEQ ID NO: 793200 - RNA, 22 nt, Human
aauaagauaagauuucugcucu

SEQ ID NO: 793201 - RNA, 22 nt, Human
auggcccaggccuccuguggcu

SEQ ID NO: 793202 - RNA, 22 nt, Human
accagcaguuaugaggccagga

SEQ ID NO: 793203 - RNA, 22 nt, Human
aaggccagcuggagggaugagg

SEQ ID NO: 793204 - RNA, 22 nt, Human
gacaauaagaaaagaggaggca

SEQ ID NO: 793205 - RNA, 22 nt, Human
gcccagcagcugguggagaagg

SEQ ID NO: 793206 - RNA, 22 nt, Human
uagaaaauguuccacugccauu

SEQ ID NO: 793207 - RNA, 22 nt, Human
uccugcuucuucgagcuucugg

SEQ ID NO: 793208 - RNA, 21 nt, Human
gcuuucuguggacucugcacc

SEQ ID NO: 793209 - RNA, 22 nt, Human
uucaguguuaaauucaaagagu

SEQ ID NO: 793210 - RNA, 22 nt, Human
uucauagaaagugcuuagauug

SEQ ID NO: 793211 - RNA, 22 nt, Human
acagugucucacugcugaaauc

SEQ ID NO: 793212 - RNA, 22 nt, Human
auuucagugagaaagcaaucaa

SEQ ID NO: 793213 - RNA, 22 nt, Human
gcaccugcuggggcugaugaga

SEQ ID NO: 793214 - RNA, 22 nt, Human
accccaagacaguagaagagaa

SEQ ID NO: 793215 - RNA, 22 nt, Human
auaugcauucauacuuagugga

SEQ ID NO: 793216 - RNA, 22 nt, Human
ucccuagucgcaucuguggaga

SEQ ID NO: 793217 - RNA, 22 nt, Human
uccagggaaggugugaggcugg

SEQ ID NO: 793218 - RNA, 22 nt, Human
uuuguuugaaagucucuacagc

SEQ ID NO: 793219 - RNA, 22 nt, Human
uggggaaggcggagcuugcagc

SEQ ID NO: 793220 - RNA, 22 nt, Human
uuuuucuuaaauguggguuggc

SEQ ID NO: 793221 - RNA, 22 nt, Human
acagcagguuauuguuauggca

SEQ ID NO: 793222 - RNA, 22 nt, Human
uccaguguggucaaaggggaau

SEQ ID NO: 793223 - RNA, 22 nt, Human
acacagugguguuuacaaaauu

SEQ ID NO: 793224 - RNA, 22 nt, Human
uaggcugggccugccuuccagg

SEQ ID NO: 793225 - RNA, 22 nt, Human
uggaaaaugugacuauucuaaa

SEQ ID NO: 793226 - RNA, 23 nt, Human
aaacaugcagcacaugaaugcua

SEQ ID NO: 793227 - RNA, 22 nt, Human
ucuaaacauaacuuugugugau

SEQ ID NO: 793228 - RNA, 22 nt, Human
acauacauggugcuuucuuggu

SEQ ID NO: 793229 - RNA, 22 nt, Human
ugccuccaggaggggcagcucu

SEQ ID NO: 793230 - RNA, 22 nt, Human
ucccagccaggcucuaccacuu

SEQ ID NO: 793231 - RNA, 22 nt, Human
ccacguccagcuaauuuucgua

SEQ ID NO: 793232 - RNA, 22 nt, Human
acaauuucuaauauagaucuua

SEQ ID NO: 793233 - RNA, 22 nt, Human
cagugcaguggcugagcuggag

SEQ ID NO: 793234 - RNA, 22 nt, Human
auggagggugucagagagcgaa

SEQ ID NO: 793235 - RNA, 22 nt, Human
cuggaaugagagcccggggauc

SEQ ID NO: 793236 - RNA, 16 nt, Human
aggagcuggguaggag

SEQ ID NO: 793237 - RNA, 22 nt, Human
ucuaaacugcgagcaugccccc

SEQ ID NO: 793238 - RNA, 22 nt, Human
gaaggcuuccuggaggaggugg

SEQ ID NO: 793239 - RNA, 22 nt, Human
gcuggccauauauuuugcuguu

SEQ ID NO: 793240 - RNA, 22 nt, Human
agugcaaaauucagaagcaauu

SEQ ID NO: 793241 - RNA, 22 nt, Human
gccacacuuauucucaugcaca

SEQ ID NO: 793242 - RNA, 22 nt, Human
ugggugagugggaaaagcccag

SEQ ID NO: 793243 - RNA, 22 nt, Human
ugcaggugauucugaugcaguu

SEQ ID NO: 793244 - RNA, 22 nt, Human
uagaaaugugauaauagcuuaa

SEQ ID NO: 793245 - RNA, 22 nt, Human
gcagauggugccaugucuugug

SEQ ID NO: 793246 - RNA, 22 nt, Human
ucaaauaaggagucaugaccau

SEQ ID NO: 793247 - RNA, 22 nt, Human
uugcauguguaauuuuucuaaa

SEQ ID NO: 793248 - RNA, 22 nt, Human
aagcacauuauagcuaucuagg

SEQ ID NO: 793249 - RNA, 21 nt, Human
ugcauauauaagugcauacac

SEQ ID NO: 793250 - RNA, 22 nt, Human
uccuggcagagagcaugaggcc

SEQ ID NO: 793251 - RNA, 20 nt, Human
cuggggagccucgcgguggc

SEQ ID NO: 793252 - RNA, 22 nt, Human
uaaacagagugcuaguucacgg

SEQ ID NO: 793253 - RNA, 22 nt, Human
ucauaaauucuggugcugugag

SEQ ID NO: 793254 - RNA, 22 nt, Human
ccugacagcgugucccuggccc

SEQ ID NO: 793255 - RNA, 22 nt, Human
cagaggccucacuuccagccag

SEQ ID NO: 793256 - RNA, 22 nt, Human
gccaggaaggcugaagccagaa

SEQ ID NO: 793257 - RNA, 22 nt, Human
gccaggguugccaaugggggca

SEQ ID NO: 793258 - RNA, 22 nt, Human
ggccaccaguccucuggcaggg

SEQ ID NO: 793259 - RNA, 22 nt, Human
agcagcuuagggaauucucccu

SEQ ID NO: 793260 - RNA, 22 nt, Human
cagcugugcugauugcucagua

SEQ ID NO: 793261 - RNA, 22 nt, Human
caaggcagaauucagacucagg

SEQ ID NO: 793262 - RNA, 22 nt, Human
uccuggggcucuuugaugugau

SEQ ID NO: 793263 - RNA, 22 nt, Human
agaaagcuggagucaagcagag

SEQ ID NO: 793264 - RNA, 22 nt, Human
gucugcugugccuuggggaaaa

SEQ ID NO: 793265 - RNA, 22 nt, Human
caauaguucgguccugaaggcc

SEQ ID NO: 793266 - RNA, 22 nt, Human
auuuacagccuugaaaacagca

SEQ ID NO: 793267 - RNA, 22 nt, Human
cuuuccuuaauaagcagguaua

SEQ ID NO: 793268 - RNA, 19 nt, Human
ggagaggcuggagggaugc

SEQ ID NO: 793269 - RNA, 22 nt, Human
gaggcucaccuagggagcacug

SEQ ID NO: 793270 - RNA, 20 nt, Human
ggaccagguggggcgguggc

SEQ ID NO: 793271 - RNA, 22 nt, Human
agaggccagcagugccuaucug

SEQ ID NO: 793272 - RNA, 22 nt, Human
auucacaguuacugcugaacca

SEQ ID NO: 793273 - RNA, 22 nt, Human
aauuuuaagcauaugacugguu

SEQ ID NO: 793274 - RNA, 22 nt, Human
uggacccaggcaggucuguccu

SEQ ID NO: 793275 - RNA, 22 nt, Human
ggcagggcaggaaagucaggaa

SEQ ID NO: 793276 - RNA, 22 nt, Human
ggagaggaaaugccagcacuuc

SEQ ID NO: 793277 - RNA, 22 nt, Human
uggccucuuaaggaugacacaa

SEQ ID NO: 793278 - RNA, 22 nt, Human
uggagcaagcuggagagaacau

SEQ ID NO: 793279 - RNA, 22 nt, Human
uggagggcaucuguggucaggc

SEQ ID NO: 793280 - RNA, 22 nt, Human
cuuuauggaaucaaagacugga

SEQ ID NO: 793281 - RNA, 22 nt, Human
uggacucuaugaugcgccagca

SEQ ID NO: 793282 - RNA, 22 nt, Human
uggccaguugaagacaaugcuc

SEQ ID NO: 793283 - RNA, 22 nt, Human
agaagcaggccucacagaucug

SEQ ID NO: 793284 - RNA, 22 nt, Human
uuaguugaucauucaacauggg

SEQ ID NO: 793285 - RNA, 22 nt, Human
acaugaaugaagacuuuacaau

SEQ ID NO: 793286 - RNA, 22 nt, Human
ugucgcagcugaaaaucucaau

SEQ ID NO: 793287 - RNA, 22 nt, Human
cuuucuuuguccaccaacaaug

SEQ ID NO: 793288 - RNA, 22 nt, Human
ucugcagccagaggcaugaaaa

SEQ ID NO: 793289 - RNA, 22 nt, Human
acauuugaaauaaacucaagug

SEQ ID NO: 793290 - RNA, 22 nt, Human
ccuggggucagggacgcugugc

SEQ ID NO: 793291 - RNA, 22 nt, Human
uuucucaaauugcaugaguagc

SEQ ID NO: 793292 - RNA, 22 nt, Human
uguuuacacaauagucucucuc

SEQ ID NO: 793293 - RNA, 22 nt, Human
cugccucuauaggaguccacca

SEQ ID NO: 793294 - RNA, 22 nt, Human
uggaaaccuacugauacaggag

SEQ ID NO: 793295 - RNA, 22 nt, Human
aaaggcagaguuguuggaggca

SEQ ID NO: 793296 - RNA, 22 nt, Human
aaagguaacaguuauaaccagg

SEQ ID NO: 793297 - RNA, 22 nt, Human
gagggucccugcucagggccag

SEQ ID NO: 793298 - RNA, 22 nt, Human
cauguacaugccuacuaucaau

SEQ ID NO: 793299 - RNA, 22 nt, Human
aaggacagagagccauuccaga

SEQ ID NO: 793300 - RNA, 22 nt, Human
gcuggcuguggcuuaagcaaac

SEQ ID NO: 793301 - RNA, 22 nt, Human
aagcacauuuuccagcagcucu

SEQ ID NO: 793302 - RNA, 22 nt, Human
uucaaagauuuucccaaagcuc

SEQ ID NO: 793303 - RNA, 22 nt, Human
uauuucuuguuauucucguuga

SEQ ID NO: 793304 - RNA, 22 nt, Human
cagccugagccuucuguagcaa

SEQ ID NO: 793305 - RNA, 22 nt, Human
agcagccauccuuagagaaaga

SEQ ID NO: 793306 - RNA, 22 nt, Human
gagcuaagaacugugccaggug

SEQ ID NO: 793307 - RNA, 22 nt, Human
aagaaacaaccacugcucuccu

SEQ ID NO: 793308 - RNA, 22 nt, Human
uggcagauguauaucacagcuu

SEQ ID NO: 793309 - RNA, 22 nt, Human
aaucaggacccacucuacaguu

SEQ ID NO: 793310 - RNA, 22 nt, Human
uagcuuaaggcaggcccuuguc

SEQ ID NO: 793311 - RNA, 22 nt, Human
uuucucccuuuauaagacugua

SEQ ID NO: 793312 - RNA, 22 nt, Human
uggagccaggcuggcccugcca

SEQ ID NO: 793313 - RNA, 20 nt, Human
gaucaggaagcggcuuggga

SEQ ID NO: 793314 - RNA, 22 nt, Human
ucaggacacccugugcuuccuu

SEQ ID NO: 793315 - RNA, 22 nt, Human
uuucugaauaacucuaugauau

SEQ ID NO: 793316 - RNA, 22 nt, Human
auauucacacuguuuaguuaca

SEQ ID NO: 793317 - RNA, 22 nt, Human
uaggaacaguuucaggauguuu

SEQ ID NO: 793318 - RNA, 22 nt, Human
aggcagcaugcucugcuucuac

SEQ ID NO: 793319 - RNA, 22 nt, Human
cuggcuguuucaggcagugucc

SEQ ID NO: 793320 - RNA, 22 nt, Human
acucagaggaaaguugagauug

SEQ ID NO: 793321 - RNA, 22 nt, Human
cacaccuguaauaccagcuacu

SEQ ID NO: 793322 - RNA, 22 nt, Human
uaaacauuuguuauucuuguuu

SEQ ID NO: 793323 - RNA, 22 nt, Human
aacaggcaaacugugggauccc

SEQ ID NO: 793324 - RNA, 22 nt, Human
ccaggcuguaaacaccuucaaa

SEQ ID NO: 793325 - RNA, 22 nt, Human
gcucccuccaugaggcagaccg

SEQ ID NO: 793326 - RNA, 22 nt, Human
ugcccagcacugugccagucac

SEQ ID NO: 793327 - RNA, 22 nt, Human
gccugcuggaggagccucaggg

SEQ ID NO: 793328 - RNA, 22 nt, Human
uaggcuggggguaggaauugag

SEQ ID NO: 793329 - RNA, 22 nt, Human
augaacaaugacuacauauuga

SEQ ID NO: 793330 - RNA, 22 nt, Human
uagaaaacuaauacaugcuuga

SEQ ID NO: 793331 - RNA, 22 nt, Human
cuggaaaucacuacuagucaau

SEQ ID NO: 793332 - RNA, 22 nt, Human
caguuuucuaugguagaagcau

SEQ ID NO: 793333 - RNA, 22 nt, Human
auacaugacagcauagcauccu

SEQ ID NO: 793334 - RNA, 22 nt, Human
acaggacaggcugggcuagacu

SEQ ID NO: 793335 - RNA, 22 nt, Human
ucagugucauaucaagaagaug

SEQ ID NO: 793336 - RNA, 22 nt, Human
cugucaggggcggguggagcgg

SEQ ID NO: 793337 - RNA, 20 nt, Human
cagggccacgcuccaaggca

SEQ ID NO: 793338 - RNA, 22 nt, Human
ggccagcugggccaccaggugc

SEQ ID NO: 793339 - RNA, 22 nt, Human
cauuuauucauuugcuagggcu

SEQ ID NO: 793340 - RNA, 22 nt, Human
uuauauaaagauaacuuuucuu

SEQ ID NO: 793341 - RNA, 22 nt, Human
ggcaggcuugauauggggggac

SEQ ID NO: 793342 - RNA, 22 nt, Human
auuauaaagaacaugugugugg

SEQ ID NO: 793343 - RNA, 22 nt, Human
aagaaguuagguguaacaauau

SEQ ID NO: 793344 - RNA, 22 nt, Human
cugagaggaugcugcaguggag

SEQ ID NO: 793345 - RNA, 22 nt, Human
cugcuggugcagaguggggcug

SEQ ID NO: 793346 - RNA, 22 nt, Human
aacaaguuagauuuugugucuu

SEQ ID NO: 793347 - RNA, 21 nt, Human
gacaaacauuucauagcuuua

SEQ ID NO: 793348 - RNA, 22 nt, Human
aggcaggccccugagaauagac

SEQ ID NO: 793349 - RNA, 23 nt, Human
uuauaaauauuuucagguguguu

SEQ ID NO: 793350 - RNA, 22 nt, Human
gauuaguauccuuauuaagaga

SEQ ID NO: 793351 - RNA, 20 nt, Human
uucuggaggcuacaagucug

SEQ ID NO: 793352 - RNA, 22 nt, Human
gcagugucuuugaccuccaccc

SEQ ID NO: 793353 - RNA, 22 nt, Human
ucugcagguguuggaaggguca

SEQ ID NO: 793354 - RNA, 22 nt, Human
agccaggggagucagcugcugg

SEQ ID NO: 793355 - RNA, 22 nt, Human
aaguuucaaauauaaaauuaca

SEQ ID NO: 793356 - RNA, 22 nt, Human
uaugccuggggugcucaggcca

SEQ ID NO: 793357 - RNA, 22 nt, Human
ucucuugacugcuaaaauuaga

SEQ ID NO: 793358 - RNA, 22 nt, Human
gcuggaguccaguggcaugauc

SEQ ID NO: 793359 - RNA, 22 nt, Human
guucugaaugugccuguacucu

SEQ ID NO: 793360 - RNA, 22 nt, Human
uucacaguggcccucucugagu

SEQ ID NO: 793361 - RNA, 22 nt, Human
gaugccugcauuucaggagagu

SEQ ID NO: 793362 - RNA, 18 nt, Human
aacaugcauuagaacugc

SEQ ID NO: 793363 - RNA, 22 nt, Human
ugcaggugcuccgggggugccc

SEQ ID NO: 793364 - RNA, 22 nt, Human
agccaggucagcucacccugcu

SEQ ID NO: 793365 - RNA, 22 nt, Human
uguggcagggauacugaggcag

SEQ ID NO: 793366 - RNA, 22 nt, Human
ggcuggcuacauuggaggaagg

SEQ ID NO: 793367 - RNA, 22 nt, Human
ggccugugcacaugugcaggaa

SEQ ID NO: 793368 - RNA, 22 nt, Human
cugguucauccccuuccaggaa

SEQ ID NO: 793369 - RNA, 22 nt, Human
ggugagugucaaugguuagagu

SEQ ID NO: 793370 - RNA, 22 nt, Human
uaugcuuuaacauuaaacaaca

SEQ ID NO: 793371 - RNA, 22 nt, Human
aggcagcagggccacuggcuga

SEQ ID NO: 793372 - RNA, 22 nt, Human
gccugagaucagccaagccccu

SEQ ID NO: 793373 - RNA, 22 nt, Human
ucaacacuaaagaauaaucuuu

SEQ ID NO: 793374 - RNA, 22 nt, Human
gcacccugcucuauccuugcua

SEQ ID NO: 793375 - RNA, 22 nt, Human
gagaggcucugaggacuggggu

SEQ ID NO: 793376 - RNA, 22 nt, Human
uucauugaugugguuuaaugua

SEQ ID NO: 793377 - RNA, 22 nt, Human
gcugggccagagcagcagcacu

SEQ ID NO: 793378 - RNA, 22 nt, Human
uauguacauaacaugaaaugca

SEQ ID NO: 793379 - RNA, 22 nt, Human
cauucauuugcccaguaaguca

SEQ ID NO: 793380 - RNA, 22 nt, Human
agagccagccuucucagcuuac

SEQ ID NO: 793381 - RNA, 22 nt, Human
ucccuguguccaugccaggagg

SEQ ID NO: 793382 - RNA, 22 nt, Human
gauggcaggcaggugaguagag

SEQ ID NO: 793383 - RNA, 22 nt, Human
ucuuggacucaaaauugccuua

SEQ ID NO: 793384 - RNA, 21 nt, Human
ugcagcuggguucugguuugc

SEQ ID NO: 793385 - RNA, 22 nt, Human
uuuccacagcuguauaaaauaa

SEQ ID NO: 793386 - RNA, 22 nt, Human
uucugcaguguuaacaauguca

SEQ ID NO: 793387 - RNA, 22 nt, Human
aacaguaaugugguguuggguu

SEQ ID NO: 793388 - RNA, 18 nt, Human
ugacagaaccuggagccu

SEQ ID NO: 793389 - RNA, 23 nt, Human
aaaugccagggagacaggaacca

SEQ ID NO: 793390 - RNA, 22 nt, Human
ggguccagauggugagaguuaa

SEQ ID NO: 793391 - RNA, 22 nt, Human
aagcagggucuuccucaguugg

SEQ ID NO: 793392 - RNA, 19 nt, Human
ccaugcagccugggggcag

SEQ ID NO: 793393 - RNA, 22 nt, Human
uuuacuaagcccaguuauaugc

SEQ ID NO: 793394 - RNA, 20 nt, Human
ugcagguguuggagaaggua

SEQ ID NO: 793395 - RNA, 22 nt, Human
aggcugaggugugcugugaucg

SEQ ID NO: 793396 - RNA, 22 nt, Human
ggccaagguguucugauaugcc

SEQ ID NO: 793397 - RNA, 22 nt, Human
gcaugaugaaggaggaggaguc

SEQ ID NO: 793398 - RNA, 22 nt, Human
aacugcuuagugauggaugacc

SEQ ID NO: 793399 - RNA, 22 nt, Human
agagaagcagggagucaucugu

SEQ ID NO: 793400 - RNA, 22 nt, Human
uggcucagucauggaugaguaa

SEQ ID NO: 793401 - RNA, 22 nt, Human
aggcuucuaggguuggcagcgg

SEQ ID NO: 793402 - RNA, 22 nt, Human
agggugggcuagacucuucccc

SEQ ID NO: 793403 - RNA, 22 nt, Human
uggagaugcacgagcaggugga

SEQ ID NO: 793404 - RNA, 22 nt, Human
ucuuuaagccaagauauauuua

SEQ ID NO: 793405 - RNA, 22 nt, Human
uaugagauauucccagcgucua

SEQ ID NO: 793406 - RNA, 18 nt, Human
cagccucugauugguugc

SEQ ID NO: 793407 - RNA, 22 nt, Human
agugaaaaccuaaucaugcagu

SEQ ID NO: 793408 - RNA, 22 nt, Human
caucaaauacuacauggguugg

SEQ ID NO: 793409 - RNA, 22 nt, Human
uguggcagaaagcauguggaca

SEQ ID NO: 793410 - RNA, 22 nt, Human
ucuggaguuacugcuggcuuug

SEQ ID NO: 793411 - RNA, 21 nt, Human
gugcccuguucccacaugccc

SEQ ID NO: 793412 - RNA, 23 nt, Human
ucaagcaauaauugguaauagug

SEQ ID NO: 793413 - RNA, 22 nt, Human
uuuaaacaucuuguugccuuaa

SEQ ID NO: 793414 - RNA, 22 nt, Human
ucucucagaaagcccaugucug

SEQ ID NO: 793415 - RNA, 22 nt, Human
caggaaauucccagaaggacug

SEQ ID NO: 793416 - RNA, 22 nt, Human
gggcugagugucccaggccgaa

SEQ ID NO: 793417 - RNA, 16 nt, Human
ugcuggggcgccgucc

SEQ ID NO: 793418 - RNA, 22 nt, Human
uaacuuuaggaauagguaaucu

SEQ ID NO: 793419 - RNA, 22 nt, Human
uuuauuuauccuucuggauugc

SEQ ID NO: 793420 - RNA, 22 nt, Human
ggggaggcaagaugaagugagg

SEQ ID NO: 793421 - RNA, 22 nt, Human
caggauccuggcugcauggacg

SEQ ID NO: 793422 - RNA, 22 nt, Human
gccugccuggagcuugagguga

SEQ ID NO: 793423 - RNA, 22 nt, Human
aacaguugauguagcuuuggag

SEQ ID NO: 793424 - RNA, 22 nt, Human
cucccaggcagggcugcccacu

SEQ ID NO: 793425 - RNA, 22 nt, Human
ccugugggcgcagcuggaguca

SEQ ID NO: 793426 - RNA, 22 nt, Human
ucucccacugcaagcccaggcu

SEQ ID NO: 793427 - RNA, 22 nt, Human
gaaagcaauuuguguaaucugu

SEQ ID NO: 793428 - RNA, 22 nt, Human
uggcccugaggacccagugugg

SEQ ID NO: 793429 - RNA, 22 nt, Human
auguuuucaaaguaaacuugua

SEQ ID NO: 793430 - RNA, 22 nt, Human
auacuucuuuagcauauugaac

SEQ ID NO: 793431 - RNA, 22 nt, Human
acaaggaacaagcauguaguuu

SEQ ID NO: 793432 - RNA, 22 nt, Human
uggugagauguauggaggguug

SEQ ID NO: 793433 - RNA, 18 nt, Human
uggcuucuugagcuaaca

SEQ ID NO: 793434 - RNA, 22 nt, Human
caaggcagcuuaauagaauuug

SEQ ID NO: 793435 - RNA, 18 nt, Human
uaggcugggggcuguagu

SEQ ID NO: 793436 - RNA, 22 nt, Human
caguccagcccccugcuaaaag

SEQ ID NO: 793437 - RNA, 18 nt, Human
gauguaaaauaguagcuu

SEQ ID NO: 793438 - RNA, 22 nt, Human
acauuuauauaacucacuagga

SEQ ID NO: 793439 - RNA, 22 nt, Human
auauuauagacagagucuucug

SEQ ID NO: 793440 - RNA, 22 nt, Human
uguccaggcggccuugccuguu

SEQ ID NO: 793441 - RNA, 22 nt, Human
uacuuugagaugaugcugaucg

SEQ ID NO: 793442 - RNA, 22 nt, Human
gccagcugaauuuccaacuguu

SEQ ID NO: 793443 - RNA, 19 nt, Human
ugcagcuguaugagcuuaa

SEQ ID NO: 793444 - RNA, 22 nt, Human
agcaagcuggaggggcucauga

SEQ ID NO: 793445 - RNA, 22 nt, Human
aucugcuuccugggcuccauga

SEQ ID NO: 793446 - RNA, 22 nt, Human
ugagggagcugaccuuucugug

SEQ ID NO: 793447 - RNA, 22 nt, Human
ccuggagcuuuuccauccugga

SEQ ID NO: 793448 - RNA, 22 nt, Human
cuguuuaaugagguguaacaac

SEQ ID NO: 793449 - RNA, 22 nt, Human
uugaaaaaauugguagaggaug

SEQ ID NO: 793450 - RNA, 22 nt, Human
uagggcagauucgguggaguuu

SEQ ID NO: 793451 - RNA, 22 nt, Human
uaaauguauaggcacuaaaccu

SEQ ID NO: 793452 - RNA, 19 nt, Human
gcugugccccugccgcuug

SEQ ID NO: 793453 - RNA, 22 nt, Human
gcuuugcuuccuguucuagccu

SEQ ID NO: 793454 - RNA, 22 nt, Human
aggaauuaacaauauauuuagg

SEQ ID NO: 793455 - RNA, 22 nt, Human
uggcuggaguauaggaguagga

SEQ ID NO: 793456 - RNA, 22 nt, Human
ggcugccugugcccaggcacac

SEQ ID NO: 793457 - RNA, 19 nt, Human
uguucuagcggcaccaggc

SEQ ID NO: 793458 - RNA, 22 nt, Human
acagugauauuuuuacucaaau

SEQ ID NO: 793459 - RNA, 22 nt, Human
aaaauaguuaacguucagagua

SEQ ID NO: 793460 - RNA, 22 nt, Human
cagaggcaggauaagaacugcg

SEQ ID NO: 793461 - RNA, 20 nt, Human
aucuuuggcucagaagccuu

SEQ ID NO: 793462 - RNA, 22 nt, Human
gaaggcuuaugugugacuuucg

SEQ ID NO: 793463 - RNA, 22 nt, Human
ucugaagcagaaaauggggaua

SEQ ID NO: 793464 - RNA, 22 nt, Human
aagcuuuggaagggcaggguug

SEQ ID NO: 793465 - RNA, 22 nt, Human
aaaugucuuuaucucauguaac

SEQ ID NO: 793466 - RNA, 22 nt, Human
ccaggacauguugcaaguuuau

SEQ ID NO: 793467 - RNA, 18 nt, Human
gcucugcccaggcugccc

SEQ ID NO: 793468 - RNA, 22 nt, Human
aacaguaauuugcgguuuuugc

SEQ ID NO: 793469 - RNA, 22 nt, Human
cuggugcccuguguggcaggag

SEQ ID NO: 793470 - RNA, 22 nt, Human
guuguuuauaaaaauaucuagc

SEQ ID NO: 793471 - RNA, 22 nt, Human
agcagccaaccuuacauucauc

SEQ ID NO: 793472 - RNA, 22 nt, Human
aaaguuugcaauuuauguuaau

SEQ ID NO: 793473 - RNA, 22 nt, Human
ggacaagccugugaguggguuu

SEQ ID NO: 793474 - RNA, 22 nt, Human
ucacauuucgcaucaguccgau

SEQ ID NO: 793475 - RNA, 22 nt, Human
gcuguggcuugcagcuggggcu

SEQ ID NO: 793476 - RNA, 22 nt, Human
cauggcaggaaggacaugcacu

SEQ ID NO: 793477 - RNA, 22 nt, Human
uggaaauguuucuugagcucag

SEQ ID NO: 793478 - RNA, 22 nt, Human
uaauagcugugggaaauaaaag

SEQ ID NO: 793479 - RNA, 22 nt, Human
uaaggcaguagugucuguaggg

SEQ ID NO: 793480 - RNA, 22 nt, Human
cugcugggucccccugcugauu

SEQ ID NO: 793481 - RNA, 22 nt, Human
ggaagcugaacuuagcaaggaa

SEQ ID NO: 793482 - RNA, 22 nt, Human
gccaggcacaguucuaggugcu

SEQ ID NO: 793483 - RNA, 22 nt, Human
uguugagacugagggagucagc

SEQ ID NO: 793484 - RNA, 22 nt, Human
gcuggaguaucuggggaaggag

SEQ ID NO: 793485 - RNA, 22 nt, Human
gugcccagugcaggcccgcagg

SEQ ID NO: 793486 - RNA, 22 nt, Human
aaugauaagacaugaguagagg

SEQ ID NO: 793487 - RNA, 22 nt, Human
ccaggagcagggcuggcugcac

SEQ ID NO: 793488 - RNA, 22 nt, Human
agagaugguagaacagucauaa

SEQ ID NO: 793489 - RNA, 22 nt, Human
ucaggccugcaaggagaguccc

SEQ ID NO: 793490 - RNA, 22 nt, Human
uaacauccacauuagaugauuc

SEQ ID NO: 793491 - RNA, 22 nt, Human
ggccacugcccuggcuacaccg

SEQ ID NO: 793492 - RNA, 22 nt, Human
aggcuuggaaaauuuacagugu

SEQ ID NO: 793493 - RNA, 20 nt, Human
aggaaggcuguuggccuugc

SEQ ID NO: 793494 - RNA, 21 nt, Human
uggacauuauggagagaguag

SEQ ID NO: 793495 - RNA, 22 nt, Human
cuucauuaaccaaaaugcaaua

SEQ ID NO: 793496 - RNA, 22 nt, Human
ggcacuguguacacacagagac

SEQ ID NO: 793497 - RNA, 23 nt, Human
uugcauguagcccaugaguaacu

SEQ ID NO: 793498 - RNA, 22 nt, Human
aaggcugugguucuauacagaa

SEQ ID NO: 793499 - RNA, 22 nt, Human
ugcaaauagccugaugaaagaa

SEQ ID NO: 793500 - RNA, 22 nt, Human
cagagaacuuagcuaguuuucc

SEQ ID NO: 793501 - RNA, 22 nt, Human
cagcugccugucuggaggcaau

SEQ ID NO: 793502 - RNA, 22 nt, Human
acuccuggguucuaaauuugaa

SEQ ID NO: 793503 - RNA, 22 nt, Human
uugcaaauucauggaucugaau

SEQ ID NO: 793504 - RNA, 22 nt, Human
aguaaaugauuauuuugccaac

SEQ ID NO: 793505 - RNA, 22 nt, Human
uucugaaaccacugaccaacua

SEQ ID NO: 793506 - RNA, 22 nt, Human
cgaggaggaaacgcggagaacu

SEQ ID NO: 793507 - RNA, 22 nt, Human
ccugccuggcuuccagaagaga

SEQ ID NO: 793508 - RNA, 22 nt, Human
uuucccuucuuuccugaguaau

SEQ ID NO: 793509 - RNA, 22 nt, Human
aacagacauauuuuuaauaugc

SEQ ID NO: 793510 - RNA, 20 nt, Human
ccacauuuuacuguuugcca

SEQ ID NO: 793511 - RNA, 22 nt, Human
cugaggcuuguccucucagcuu

SEQ ID NO: 793512 - RNA, 22 nt, Human
aggcuucugucuuuaggaguug

SEQ ID NO: 793513 - RNA, 22 nt, Human
ugacaagcuuuacagaauugaa

SEQ ID NO: 793514 - RNA, 22 nt, Human
agcugccagcaaguuucaaaca

SEQ ID NO: 793515 - RNA, 22 nt, Human
caaauguaauaaggaguuuccc

SEQ ID NO: 793516 - RNA, 22 nt, Human
uguggcagaacugggacucaaa

SEQ ID NO: 793517 - RNA, 18 nt, Human
ccucagggagagagacgc

SEQ ID NO: 793518 - RNA, 21 nt, Human
gcagaugggagucaucaggcu

SEQ ID NO: 793519 - RNA, 22 nt, Human
ccaggccuuucuucuuggucug

SEQ ID NO: 793520 - RNA, 22 nt, Human
gacaauaaagugauacauggga

SEQ ID NO: 793521 - RNA, 21 nt, Human
ucuccuggguccaacccaugc

SEQ ID NO: 793522 - RNA, 21 nt, Human
cagcuucuucugugaccuggu

SEQ ID NO: 793523 - RNA, 22 nt, Human
uuucauuggcucccugaugaau

SEQ ID NO: 793524 - RNA, 22 nt, Human
ucaggagggugacaggcccugg

SEQ ID NO: 793525 - RNA, 22 nt, Human
uccaggccuggcuccauucagu

SEQ ID NO: 793526 - RNA, 22 nt, Human
cuccugggggacagcggcaggg

SEQ ID NO: 793527 - RNA, 22 nt, Human
cuguccuccagacgacaguccc

SEQ ID NO: 793528 - RNA, 22 nt, Human
acacauuaucucauuaaauacu

SEQ ID NO: 793529 - RNA, 22 nt, Human
aggccuccuggcuccaggccuu

SEQ ID NO: 793530 - RNA, 22 nt, Human
gcagcagggugccagcuuugca

SEQ ID NO: 793531 - RNA, 22 nt, Human
ccucuuuaaucccauccaugug

SEQ ID NO: 793532 - RNA, 22 nt, Human
aggcagggugaugauaaugauu

SEQ ID NO: 793533 - RNA, 22 nt, Human
cucacuguccaacaggcuuuac

SEQ ID NO: 793534 - RNA, 20 nt, Human
gucucaaguaucucacaguc

SEQ ID NO: 793535 - RNA, 22 nt, Human
auggcucucuccuuacugcugc

SEQ ID NO: 793536 - RNA, 22 nt, Human
aauaguacaaucuacagacaua

SEQ ID NO: 793537 - RNA, 22 nt, Human
aggcaguggaaggagaaagcaa

SEQ ID NO: 793538 - RNA, 22 nt, Human
gcccagucucuucuggcccugu

SEQ ID NO: 793539 - RNA, 22 nt, Human
guucuuggaccagcagcauuga

SEQ ID NO: 793540 - RNA, 22 nt, Human
cucaggcacgggucagugagcg

SEQ ID NO: 793541 - RNA, 22 nt, Human
aaaacauucugugaacucucaa

SEQ ID NO: 793542 - RNA, 22 nt, Human
uccagcuggcccggccaugaau

SEQ ID NO: 793543 - RNA, 22 nt, Human
uaaaacuucucauuuuuauggu

SEQ ID NO: 793544 - RNA, 22 nt, Human
caggaggcagaggaugcccagu

SEQ ID NO: 793545 - RNA, 22 nt, Human
augcuucuuguauuuggcugac

SEQ ID NO: 793546 - RNA, 22 nt, Human
aaagucaaaaugcucuccuguc

SEQ ID NO: 793547 - RNA, 22 nt, Human
acagugauuggcacugauucag

SEQ ID NO: 793548 - RNA, 21 nt, Human
ucuuuucucugcaggauuccu

SEQ ID NO: 793549 - RNA, 22 nt, Human
aaacuucagggaauaaaagagu

SEQ ID NO: 793550 - RNA, 22 nt, Human
ggugcaggaaaauuaccuggag

SEQ ID NO: 793551 - RNA, 19 nt, Human
ucaugcaaucagugaacug

SEQ ID NO: 793552 - RNA, 22 nt, Human
cuggcuguggucacagguaacu

SEQ ID NO: 793553 - RNA, 22 nt, Human
cuguucugaccagugcagggau

SEQ ID NO: 793554 - RNA, 20 nt, Human
agaggcuuucuuguagucag

SEQ ID NO: 793555 - RNA, 22 nt, Human
cuuggaggaugugcggcugccc

SEQ ID NO: 793556 - RNA, 22 nt, Human
aaaaugugaucuacaaaugcaa

SEQ ID NO: 793557 - RNA, 22 nt, Human
aaucaggauagaaccucacgug

SEQ ID NO: 793558 - RNA, 22 nt, Human
aaugucaaucucagagaacaca

SEQ ID NO: 793559 - RNA, 22 nt, Human
ucugcuggaaaaccagggaauu

SEQ ID NO: 793560 - RNA, 22 nt, Human
uccaggaguccugggagugauu

SEQ ID NO: 793561 - RNA, 22 nt, Human
gaagaauauucuugaucuuaga

SEQ ID NO: 793562 - RNA, 22 nt, Human
gccaggcagcuagcaaccccug

SEQ ID NO: 793563 - RNA, 22 nt, Human
aaguaaauaucuguagucuuua

SEQ ID NO: 793564 - RNA, 22 nt, Human
ccccuccuggccacacugucag

SEQ ID NO: 793565 - RNA, 22 nt, Human
gcccuggauguacaggcauguu

SEQ ID NO: 793566 - RNA, 22 nt, Human
augggggaaaguacgagcaugg

SEQ ID NO: 793567 - RNA, 22 nt, Human
uucaccaugggaugacaacagu

SEQ ID NO: 793568 - RNA, 22 nt, Human
uaccaauucuauuuuggauuga

SEQ ID NO: 793569 - RNA, 22 nt, Human
cuuuguaucuaaauaucuugaa

SEQ ID NO: 793570 - RNA, 22 nt, Human
caagaauuaagaauuuugaugu

SEQ ID NO: 793571 - RNA, 22 nt, Human
aaaaccuucagguuuggaguuu

SEQ ID NO: 793572 - RNA, 22 nt, Human
aaucauaauucaaauaagcuua

SEQ ID NO: 793573 - RNA, 22 nt, Human
guucuaggcuaggggaguaaga

SEQ ID NO: 793574 - RNA, 22 nt, Human
cccaggcagcggggucuccuug

SEQ ID NO: 793575 - RNA, 22 nt, Human
acuuucugucaucuagacaagu

SEQ ID NO: 793576 - RNA, 22 nt, Human
cugcacagcugggcaagauaua

SEQ ID NO: 793577 - RNA, 22 nt, Human
ucuuuacaagucacauuuucug

SEQ ID NO: 793578 - RNA, 22 nt, Human
ccugggcagguguggcuucccc

SEQ ID NO: 793579 - RNA, 22 nt, Human
uggccuagagaagccaaaagau

SEQ ID NO: 793580 - RNA, 22 nt, Human
agaaauguugaauacacaaaau

SEQ ID NO: 793581 - RNA, 22 nt, Human
uagcuuugccugaaguaaucag

SEQ ID NO: 793582 - RNA, 22 nt, Human
aggcagccaucugcaggaagga

SEQ ID NO: 793583 - RNA, 22 nt, Human
uccacugcagcuucugauggaa

SEQ ID NO: 793584 - RNA, 22 nt, Human
cuggccuggggccucagcugcu

SEQ ID NO: 793585 - RNA, 22 nt, Human
gaggucaggggagaggcugaug

SEQ ID NO: 793586 - RNA, 22 nt, Human
gaggcaagaaaggacuuucuag

SEQ ID NO: 793587 - RNA, 22 nt, Human
acuggcagaggauagcacuaau

SEQ ID NO: 793588 - RNA, 22 nt, Human
aucaagaauugggagcuauuga

SEQ ID NO: 793589 - RNA, 22 nt, Human
auacaaguugcccaaaugauua

SEQ ID NO: 793590 - RNA, 20 nt, Human
agggcccaggaagagaguua

SEQ ID NO: 793591 - RNA, 22 nt, Human
cuggggagacgaucgauguucu

SEQ ID NO: 793592 - RNA, 22 nt, Human
acauuguauaaugauuaucaca

SEQ ID NO: 793593 - RNA, 20 nt, Human
cagcaggaaaagugccucag

SEQ ID NO: 793594 - RNA, 22 nt, Human
ucucccacuggccuuguaugau

SEQ ID NO: 793595 - RNA, 22 nt, Human
cccaggagacauauagaaggac

SEQ ID NO: 793596 - RNA, 22 nt, Human
uucagauaaacuacaaauaauu

SEQ ID NO: 793597 - RNA, 22 nt, Human
cacaugaguguaggaagaggga

SEQ ID NO: 793598 - RNA, 22 nt, Human
agguggagugugcagggagagc

SEQ ID NO: 793599 - RNA, 22 nt, Human
gcagggcauagaggcacggagg

SEQ ID NO: 793600 - RNA, 20 nt, Human
ggaaacauuuuuauuuccau

SEQ ID NO: 793601 - RNA, 22 nt, Human
caaauucucacccuguuugauu

SEQ ID NO: 793602 - RNA, 22 nt, Human
cagcugucagccggugcaggcu

SEQ ID NO: 793603 - RNA, 18 nt, Human
cagcugcaggcucaggac

SEQ ID NO: 793604 - RNA, 17 nt, Human
gcccacccuuaggagcu

SEQ ID NO: 793605 - RNA, 22 nt, Human
guuuuuccuugcugaggacccg

SEQ ID NO: 793606 - RNA, 22 nt, Human
aucacaguuacucaaauaauga

SEQ ID NO: 793607 - RNA, 22 nt, Human
cuuuggaggucauagccaagag

SEQ ID NO: 793608 - RNA, 22 nt, Human
gggugggcccagcccagagaag

SEQ ID NO: 793609 - RNA, 22 nt, Human
acaggcugcccgcuccccaccu

SEQ ID NO: 793610 - RNA, 22 nt, Human
ugcagguggacacgggagacgg

SEQ ID NO: 793611 - RNA, 22 nt, Human
uggcccagcacuccaaguaggg

SEQ ID NO: 793612 - RNA, 22 nt, Human
cacauuucucuaccucacacaa

SEQ ID NO: 793613 - RNA, 18 nt, Human
aucucccauuggccaagg

SEQ ID NO: 793614 - RNA, 22 nt, Human
ccugugucugaccaugcacaug

SEQ ID NO: 793615 - RNA, 22 nt, Human
gcucagggagagagggcagccg

SEQ ID NO: 793616 - RNA, 22 nt, Human
gaugagcauuguuucauguguu

SEQ ID NO: 793617 - RNA, 22 nt, Human
aggucaagggcaagagugaggu

SEQ ID NO: 793618 - RNA, 22 nt, Human
aguaaauaacagagaaaauggg

SEQ ID NO: 793619 - RNA, 22 nt, Human
auagauauuagcaaaauuuuau

SEQ ID NO: 793620 - RNA, 19 nt, Human
ccuugccugucccugcagc

SEQ ID NO: 793621 - RNA, 22 nt, Human
caggagaggaggcuacuucuua

SEQ ID NO: 793622 - RNA, 22 nt, Human
acuuguuucaacuguacucucc

SEQ ID NO: 793623 - RNA, 22 nt, Human
uuuauucuagcucagaauaguu

SEQ ID NO: 793624 - RNA, 22 nt, Human
uucugagauuguuaggcacuaa

SEQ ID NO: 793625 - RNA, 23 nt, Human
aucuagaaaccugaugacucugu

SEQ ID NO: 793626 - RNA, 22 nt, Human
gccccuccgggcgcgucauagc

SEQ ID NO: 793627 - RNA, 22 nt, Human
ccaguaaaaagcgacaggaagu

SEQ ID NO: 793628 - RNA, 22 nt, Human
cuggcagggcagggguuugugc

SEQ ID NO: 793629 - RNA, 22 nt, Human
agcaaauacuugaauaaaaaga

SEQ ID NO: 793630 - RNA, 22 nt, Human
auuaaucauuucugcauuaucu

SEQ ID NO: 793631 - RNA, 22 nt, Human
gcagcuggagccagccagacac

SEQ ID NO: 793632 - RNA, 20 nt, Human
uuguuucugcuauuuucuaa

SEQ ID NO: 793633 - RNA, 22 nt, Human
agggggcucagcaggcucugga

SEQ ID NO: 793634 - RNA, 23 nt, Human
auauaaacaccagauagauugua

SEQ ID NO: 793635 - RNA, 22 nt, Human
gagcuaaguuucuggaggcaga

SEQ ID NO: 793636 - RNA, 22 nt, Human
ggaagggguuaggggucccuga

SEQ ID NO: 793637 - RNA, 22 nt, Human
ccagcaggagagaacauuuccc

SEQ ID NO: 793638 - RNA, 22 nt, Human
ugggugguuuaugaguggguuu

SEQ ID NO: 793639 - RNA, 22 nt, Human
ucugugguggagugggcaugag

SEQ ID NO: 793640 - RNA, 22 nt, Human
auguuauuuuggaaaauacaaa

SEQ ID NO: 793641 - RNA, 22 nt, Human
aggcugcccugccgccaguggg

SEQ ID NO: 793642 - RNA, 22 nt, Human
acagggccuuauauccagaagg

SEQ ID NO: 793643 - RNA, 22 nt, Human
caucagcucuucauucuugauu

SEQ ID NO: 793644 - RNA, 22 nt, Human
aaggaaaucuuuguaacaucuu

SEQ ID NO: 793645 - RNA, 22 nt, Human
uaaugacugccgucucucuuca

SEQ ID NO: 793646 - RNA, 23 nt, Human
gggugggccaaauuagguagccu

SEQ ID NO: 793647 - RNA, 22 nt, Human
caggcuugggagcagagccacu

SEQ ID NO: 793648 - RNA, 21 nt, Human
gaaggagaaagcaagugcugc

SEQ ID NO: 793649 - RNA, 22 nt, Human
cuuguauucuuguaccuuucaa

SEQ ID NO: 793650 - RNA, 22 nt, Human
aaggcacaugaccuaggccugg

SEQ ID NO: 793651 - RNA, 22 nt, Human
ggguaggcucugcaggcugggu

SEQ ID NO: 793652 - RNA, 22 nt, Human
cugugagagugguggccuaggc

SEQ ID NO: 793653 - RNA, 22 nt, Human
ucaaaguauaauugcuuuuuug

SEQ ID NO: 793654 - RNA, 22 nt, Human
ccaggagccugggccaggcugg

SEQ ID NO: 793655 - RNA, 22 nt, Human
ucccugcaggugugcaagcuga

SEQ ID NO: 793656 - RNA, 22 nt, Human
ugcacacauguuuacaagcauc

SEQ ID NO: 793657 - RNA, 22 nt, Human
acuaaagcucacagaguugaac

SEQ ID NO: 793658 - RNA, 22 nt, Human
uucacauuguuuuaaugugaau

SEQ ID NO: 793659 - RNA, 22 nt, Human
uguagacuuucuuuguguuagu

SEQ ID NO: 793660 - RNA, 22 nt, Human
gcccagugguaaaagcaggccu

SEQ ID NO: 793661 - RNA, 22 nt, Human
ccugugcuggacagggcugggc

SEQ ID NO: 793662 - RNA, 22 nt, Human
cuuaaagaaauugaggagagga

SEQ ID NO: 793663 - RNA, 22 nt, Human
aauuugauucccugcaccuguu

SEQ ID NO: 793664 - RNA, 22 nt, Human
gggcaccagcggccgcacugcc

SEQ ID NO: 793665 - RNA, 22 nt, Human
cucagggacuuggauccuggcc

SEQ ID NO: 793666 - RNA, 22 nt, Human
gucucccaauccgggacagccu

SEQ ID NO: 793667 - RNA, 22 nt, Human
ugggacaguuguccuccacucu

SEQ ID NO: 793668 - RNA, 22 nt, Human
ugcacacacacguagagaaaag

SEQ ID NO: 793669 - RNA, 19 nt, Human
agauggcaaaaugcaaaga

SEQ ID NO: 793670 - RNA, 22 nt, Human
uacauucuggaaaggcacagac

SEQ ID NO: 793671 - RNA, 22 nt, Human
guggcagaaacuggcagaggag

SEQ ID NO: 793672 - RNA, 22 nt, Human
caccaggcacauaguaggcacu

SEQ ID NO: 793673 - RNA, 22 nt, Human
ugucuccacaggugucagcuca

SEQ ID NO: 793674 - RNA, 22 nt, Human
auucaagguuuauucaguuuag

SEQ ID NO: 793675 - RNA, 22 nt, Human
cagggcuggauuucauuucuag

SEQ ID NO: 793676 - RNA, 23 nt, Human
uuuauauuccuaaugucuugagc

SEQ ID NO: 793677 - RNA, 22 nt, Human
aaggcccagccuggagcuuguu

SEQ ID NO: 793678 - RNA, 22 nt, Human
cauacaguuuucccuagaugug

SEQ ID NO: 793679 - RNA, 22 nt, Human
agccuauuccaggaugagcuca

SEQ ID NO: 793680 - RNA, 22 nt, Human
caggcagagcugaagauagaug

SEQ ID NO: 793681 - RNA, 22 nt, Human
agaguggcccguuggccugaac

SEQ ID NO: 793682 - RNA, 22 nt, Human
cuggggcccgagccuugggcca

SEQ ID NO: 793683 - RNA, 22 nt, Human
uggcacugaaaaaggagagguu

SEQ ID NO: 793684 - RNA, 22 nt, Human
aggccaguuuuuggagggaaac

SEQ ID NO: 793685 - RNA, 22 nt, Human
agugaucuuuuaaaaagaagug

SEQ ID NO: 793686 - RNA, 22 nt, Human
gcagcugcaggcaggcuugcug

SEQ ID NO: 793687 - RNA, 22 nt, Human
gcugcugggucccucugugcca

SEQ ID NO: 793688 - RNA, 22 nt, Human
aggcagggucuugcuauguugc

SEQ ID NO: 793689 - RNA, 22 nt, Human
guggccagccagggugcugaug

SEQ ID NO: 793690 - RNA, 22 nt, Human
ugugucaacaacagccuuggau

SEQ ID NO: 793691 - RNA, 22 nt, Human
uccccaggaguuuuacuuugca

SEQ ID NO: 793692 - RNA, 21 nt, Human
aggaggcugucucuuucagcu

SEQ ID NO: 793693 - RNA, 22 nt, Human
agcagcuuccuguuugcaggca

SEQ ID NO: 793694 - RNA, 22 nt, Human
caucaggacagcuucuuuucac

SEQ ID NO: 793695 - RNA, 22 nt, Human
uucugggacaucuggacaguuu

SEQ ID NO: 793696 - RNA, 23 nt, Human
cugguucauagucaagagauuga

SEQ ID NO: 793697 - RNA, 22 nt, Human
uuucauguuacaguguaaaagu

SEQ ID NO: 793698 - RNA, 22 nt, Human
ggcccagcaucuugugaaguuu

SEQ ID NO: 793699 - RNA, 20 nt, Human
aggcaugggaugcccagauu

SEQ ID NO: 793700 - RNA, 22 nt, Human
guauuauuaaguguauuugacc

SEQ ID NO: 793701 - RNA, 22 nt, Human
gucuccaguguucaggugacug

SEQ ID NO: 793702 - RNA, 22 nt, Human
cagauuaagugcucaacagugu

SEQ ID NO: 793703 - RNA, 22 nt, Human
uggcaggcagugugggagcugg

SEQ ID NO: 793704 - RNA, 17 nt, Human
ugggauccgucucugug

SEQ ID NO: 793705 - RNA, 22 nt, Human
agucauaugacccuucacaaac

SEQ ID NO: 793706 - RNA, 22 nt, Human
cccacagggcugcugauggcag

SEQ ID NO: 793707 - RNA, 22 nt, Human
uugcaaauggaggccuggcagc

SEQ ID NO: 793708 - RNA, 22 nt, Human
ugcuauuuggcacuuuugaccu

SEQ ID NO: 793709 - RNA, 22 nt, Human
agcagugcuauggccaggcuaa

SEQ ID NO: 793710 - RNA, 22 nt, Human
acauacauggauucauggauuc

SEQ ID NO: 793711 - RNA, 22 nt, Human
ucccagccggugccuggguccc

SEQ ID NO: 793712 - RNA, 22 nt, Human
cccagggagguagcaggagaaa

SEQ ID NO: 793713 - RNA, 19 nt, Human
agcccccagacagcaggcc

SEQ ID NO: 793714 - RNA, 22 nt, Human
gaaggugcaguggcuggaggcu

SEQ ID NO: 793715 - RNA, 22 nt, Human
agggagacaaaagcagcugcca

SEQ ID NO: 793716 - RNA, 22 nt, Human
auaauuaauuucaguaaucucc

SEQ ID NO: 793717 - RNA, 22 nt, Human
ugcaauauuuggcacugagaug

SEQ ID NO: 793718 - RNA, 22 nt, Human
uagggcaggggaggaaucugaa

SEQ ID NO: 793719 - RNA, 22 nt, Human
uugaucaucuaagaguaauagu

SEQ ID NO: 793720 - RNA, 22 nt, Human
uacagaauaaagcgugaagcuu

SEQ ID NO: 793721 - RNA, 22 nt, Human
ugcuagggauauaguggcgagu

SEQ ID NO: 793722 - RNA, 22 nt, Human
gugcaaauuccacuggaaagcu

SEQ ID NO: 793723 - RNA, 22 nt, Human
cagucauuuuauuugaaaauua

SEQ ID NO: 793724 - RNA, 22 nt, Human
uccagcuggggacaugggcuuc

SEQ ID NO: 793725 - RNA, 22 nt, Human
ggcugagggccagggcuagucu

SEQ ID NO: 793726 - RNA, 18 nt, Human
ucuggggugugcugugua

SEQ ID NO: 793727 - RNA, 22 nt, Human
gaaggcagguuuuucaaaacug

SEQ ID NO: 793728 - RNA, 22 nt, Human
gcagggcagcucacugugguuc

SEQ ID NO: 793729 - RNA, 22 nt, Human
cuuuuuccucguagagccuaau

SEQ ID NO: 793730 - RNA, 22 nt, Human
uuacauuucccccuuggaggcu

SEQ ID NO: 793731 - RNA, 22 nt, Human
aagagaauucugguuuuccuau

SEQ ID NO: 793732 - RNA, 22 nt, Human
cccugaggaaaggguggagggc

SEQ ID NO: 793733 - RNA, 16 nt, Human
cgccucccucccucgc

SEQ ID NO: 793734 - RNA, 22 nt, Human
ugcuggcucuaggcugagacag

SEQ ID NO: 793735 - RNA, 21 nt, Human
auuuccaaggguaccuaagau

SEQ ID NO: 793736 - RNA, 22 nt, Human
ucauuuuggccaugauacagac

SEQ ID NO: 793737 - RNA, 22 nt, Human
aaagaccugaaauauaaucuag

SEQ ID NO: 793738 - RNA, 22 nt, Human
gcagaggacacaggagggcaag

SEQ ID NO: 793739 - RNA, 22 nt, Human
ccugggucccaucccagaguga

SEQ ID NO: 793740 - RNA, 22 nt, Human
ggaguucacugugcaggcucug

SEQ ID NO: 793741 - RNA, 22 nt, Human
ggagggcucccugggaguggau

SEQ ID NO: 793742 - RNA, 21 nt, Human
cacagaggcgcuguauggcug

SEQ ID NO: 793743 - RNA, 22 nt, Human
aauaaaugaacaaagcagguug

SEQ ID NO: 793744 - RNA, 22 nt, Human
agaaaacugggaggagagcuuc

SEQ ID NO: 793745 - RNA, 22 nt, Human
cuggaggggccauccacagucu

SEQ ID NO: 793746 - RNA, 22 nt, Human
uaaggcagaaauaugagcaggg

SEQ ID NO: 793747 - RNA, 22 nt, Human
ccacagcuucgcagucugcugc

SEQ ID NO: 793748 - RNA, 22 nt, Human
uucugaaagucuuuuuaaguua

SEQ ID NO: 793749 - RNA, 22 nt, Human
ccccaggccuguuggauggcgc

SEQ ID NO: 793750 - RNA, 19 nt, Human
ucagggcaguccggucccc

SEQ ID NO: 793751 - RNA, 18 nt, Human
uuugcaaaggaaguaugg

SEQ ID NO: 793752 - RNA, 22 nt, Human
gggaaacuguccaguucucccc

SEQ ID NO: 793753 - RNA, 22 nt, Human
uucauaugugaacucagugaug

SEQ ID NO: 793754 - RNA, 22 nt, Human
ucuaaacauuaugauaguagag

SEQ ID NO: 793755 - RNA, 22 nt, Human
gccaccagcagaaaaggggcca

SEQ ID NO: 793756 - RNA, 22 nt, Human
ugggcuuaggucggaggcggcc

SEQ ID NO: 793757 - RNA, 22 nt, Human
cugugggagaggugccuggauu

SEQ ID NO: 793758 - RNA, 22 nt, Human
gccugagagucuccagaccuug

SEQ ID NO: 793759 - RNA, 22 nt, Human
aagaacuagucuuacagccuca

SEQ ID NO: 793760 - RNA, 22 nt, Human
uugcagcuucaagcagguugac

SEQ ID NO: 793761 - RNA, 22 nt, Human
ucucuugggaggaaagagagaa

SEQ ID NO: 793762 - RNA, 22 nt, Human
auguucuuaucauucuuucgga

SEQ ID NO: 793763 - RNA, 20 nt, Human
ggcccagugaaccaggacgg

SEQ ID NO: 793764 - RNA, 22 nt, Human
aaagcuuuguaaauaaacaggu

SEQ ID NO: 793765 - RNA, 22 nt, Human
uauuuucaccauguaucccugu

SEQ ID NO: 793766 - RNA, 22 nt, Human
augguggaagagcaucagaaag

SEQ ID NO: 793767 - RNA, 21 nt, Human
ugggccaguagaaaggaaggc

SEQ ID NO: 793768 - RNA, 22 nt, Human
aaaugacacuaggcuuuuugca

SEQ ID NO: 793769 - RNA, 22 nt, Human
cuucacauguuggaguccuuug

SEQ ID NO: 793770 - RNA, 22 nt, Human
agacaaugucaaggugaucauc

SEQ ID NO: 793771 - RNA, 22 nt, Human
ccacauuuuugauacucucacu

SEQ ID NO: 793772 - RNA, 22 nt, Human
uggcuuccagagcugcuccacc

SEQ ID NO: 793773 - RNA, 22 nt, Human
gugccagaggccccaaacaagu

SEQ ID NO: 793774 - RNA, 22 nt, Human
cuccugugcaccuccagcggca

SEQ ID NO: 793775 - RNA, 22 nt, Human
ugagaaccaccuggaggugacu

SEQ ID NO: 793776 - RNA, 20 nt, Human
aaaaacaguaaugcugaaga

SEQ ID NO: 793777 - RNA, 22 nt, Human
uauguuucugggcuugauauuu

SEQ ID NO: 793778 - RNA, 22 nt, Human
uuauugagcacauaguaugugg

SEQ ID NO: 793779 - RNA, 22 nt, Human
agcccagcugcuauguaccugg

SEQ ID NO: 793780 - RNA, 22 nt, Human
uaagaaauuuaguuauagaaug

SEQ ID NO: 793781 - RNA, 22 nt, Human
ucaggcuguagggccccuggag

SEQ ID NO: 793782 - RNA, 22 nt, Human
ccaguguucccucggguucaug

SEQ ID NO: 793783 - RNA, 22 nt, Human
acuuuaaaacugaucaucagag

SEQ ID NO: 793784 - RNA, 22 nt, Human
gagcaggcucugccuguguguc

SEQ ID NO: 793785 - RNA, 22 nt, Human
caguguuuagcacagugcuugg

SEQ ID NO: 793786 - RNA, 22 nt, Human
cauagaaacugagacaaggauu

SEQ ID NO: 793787 - RNA, 22 nt, Human
gauggagucugaagcugggaac

SEQ ID NO: 793788 - RNA, 22 nt, Human
uccuggcccacuaugccagcau

SEQ ID NO: 793789 - RNA, 22 nt, Human
uucauucuuauuugugaucugg

SEQ ID NO: 793790 - RNA, 22 nt, Human
uguuucuguaugaucaauauug

SEQ ID NO: 793791 - RNA, 23 nt, Human
uguuucuagaaucauugaugucu

SEQ ID NO: 793792 - RNA, 22 nt, Human
uuuacuuugugucaagucaaga

SEQ ID NO: 793793 - RNA, 22 nt, Human
ggcugccugccuccaagccggg

SEQ ID NO: 793794 - RNA, 22 nt, Human
aauauucauuugcagaagaagu

SEQ ID NO: 793795 - RNA, 22 nt, Human
cugcacugagcucucccagccc

SEQ ID NO: 793796 - RNA, 22 nt, Human
uucuucagugccccucuaguag

SEQ ID NO: 793797 - RNA, 22 nt, Human
uauaaaguuucgaaagauguau

SEQ ID NO: 793798 - RNA, 22 nt, Human
cuggguggcgucuggggccagu

SEQ ID NO: 793799 - RNA, 22 nt, Human
agaaguuugguccuauaaacuc

SEQ ID NO: 793800 - RNA, 22 nt, Human
uuucaucugugcugccaagacu

SEQ ID NO: 793801 - RNA, 22 nt, Human
gcucagggccuggcugcggacu

SEQ ID NO: 793802 - RNA, 22 nt, Human
gcugcuggggccuucccucggg

SEQ ID NO: 793803 - RNA, 22 nt, Human
aaacucaaggauuuagacgaag

SEQ ID NO: 793804 - RNA, 22 nt, Human
ccugggcuggaguacagcagug

SEQ ID NO: 793805 - RNA, 22 nt, Human
acaggcugggcgcuuccugcgg

SEQ ID NO: 793806 - RNA, 22 nt, Human
caauggccucccaagcaggggg

SEQ ID NO: 793807 - RNA, 22 nt, Human
aaucaggaugacugucauuuca

SEQ ID NO: 793808 - RNA, 22 nt, Human
uuugccugggaauucuagugua

SEQ ID NO: 793809 - RNA, 22 nt, Human
gaugcuggccuggccaucuggg

SEQ ID NO: 793810 - RNA, 22 nt, Human
acagaaacccagaaaaccucuc

SEQ ID NO: 793811 - RNA, 22 nt, Human
agguaggauggguggagaugau

SEQ ID NO: 793812 - RNA, 22 nt, Human
gaggcugggaaguccaauauca

SEQ ID NO: 793813 - RNA, 22 nt, Human
ggggcagcuaccggaaguaggg

SEQ ID NO: 793814 - RNA, 22 nt, Human
cucuccaggcgagguccuacug

SEQ ID NO: 793815 - RNA, 22 nt, Human
aaagacaugacacauuggagag

SEQ ID NO: 793816 - RNA, 22 nt, Human
agugucugugaugaggucagga

SEQ ID NO: 793817 - RNA, 22 nt, Human
gcuguuggggccagcaggucau

SEQ ID NO: 793818 - RNA, 22 nt, Human
guacccuguggccagccagcca

SEQ ID NO: 793819 - RNA, 22 nt, Human
auauacacauuugcuuaugugu

SEQ ID NO: 793820 - RNA, 22 nt, Human
agccacagggggugagggacaa

SEQ ID NO: 793821 - RNA, 22 nt, Human
agcccagcaaagggagguucag

SEQ ID NO: 793822 - RNA, 22 nt, Human
ccugcagccguccuguuugucu

SEQ ID NO: 793823 - RNA, 22 nt, Human
uaggccugguacuguguuaaua

SEQ ID NO: 793824 - RNA, 22 nt, Human
gggacgacaggcucugugguag

SEQ ID NO: 793825 - RNA, 22 nt, Human
ccucaaauugucaaauaagaau

SEQ ID NO: 793826 - RNA, 22 nt, Human
ugucauauguugaugaaagaga

SEQ ID NO: 793827 - RNA, 22 nt, Human
cccugagaugccucacccuagu

SEQ ID NO: 793828 - RNA, 22 nt, Human
gaggagagagggacugucugca

SEQ ID NO: 793829 - RNA, 22 nt, Human
gaaauaauucugugucugaaca

SEQ ID NO: 793830 - RNA, 22 nt, Human
aggcuggaugugccucaccgag

SEQ ID NO: 793831 - RNA, 23 nt, Human
uucuuauuuacuuuggaaucucc

SEQ ID NO: 793832 - RNA, 19 nt, Human
aaacuaaggggaaauguuu

SEQ ID NO: 793833 - RNA, 22 nt, Human
uuacaauaguuccuucuuuugu

SEQ ID NO: 793834 - RNA, 22 nt, Human
accugaggccuccccagcagac

SEQ ID NO: 793835 - RNA, 22 nt, Human
agaagaauuucucucaugauuu

SEQ ID NO: 793836 - RNA, 23 nt, Human
gcuaggugcuuccacacgugcug

SEQ ID NO: 793837 - RNA, 22 nt, Human
uggcagggugggcuucagcccc

SEQ ID NO: 793838 - RNA, 21 nt, Human
uauguuagugauguuuguagg

SEQ ID NO: 793839 - RNA, 22 nt, Human
ugggaaaguguagccugcaggc

SEQ ID NO: 793840 - RNA, 22 nt, Human
ucaaagauggguuuuguuugau

SEQ ID NO: 793841 - RNA, 22 nt, Human
aggccaaguagcuagcauugaa

SEQ ID NO: 793842 - RNA, 22 nt, Human
auagcuuucuuaaauauauaaa

SEQ ID NO: 793843 - RNA, 22 nt, Human
aagagucagcuucuguaugggu

SEQ ID NO: 793844 - RNA, 22 nt, Human
auccaauucuaauauuguguuu

SEQ ID NO: 793845 - RNA, 22 nt, Human
uguucuaugcucuuuaagguga

SEQ ID NO: 793846 - RNA, 22 nt, Human
caaguccaucagauaagcaaga

SEQ ID NO: 793847 - RNA, 22 nt, Human
uuugccaggcuugcaugaauuu

SEQ ID NO: 793848 - RNA, 22 nt, Human
aaauccaugguaaucuguuaca

SEQ ID NO: 793849 - RNA, 22 nt, Human
uugaucauuuuucugguaaaau

SEQ ID NO: 793850 - RNA, 22 nt, Human
cuucaugaggguaaucuacaaa

SEQ ID NO: 793851 - RNA, 22 nt, Human
ggaagggccucgggcgugggac

SEQ ID NO: 793852 - RNA, 22 nt, Human
ccagggucacaaauaacugcag

SEQ ID NO: 793853 - RNA, 22 nt, Human
auugagaauaugauuuaguaua

SEQ ID NO: 793854 - RNA, 22 nt, Human
aguuuacagaugcuacaggagc

SEQ ID NO: 793855 - RNA, 23 nt, Human
aaaaucuucugccuaugaagaaa

SEQ ID NO: 793856 - RNA, 22 nt, Human
ccuccaggauaagucagggccu

SEQ ID NO: 793857 - RNA, 22 nt, Human
gcaggagaacaaagcaagcugc

SEQ ID NO: 793858 - RNA, 22 nt, Human
ugaacuuuguaguaauggagau

SEQ ID NO: 793859 - RNA, 22 nt, Human
cacauacaaugguguuauuugg

SEQ ID NO: 793860 - RNA, 22 nt, Human
gagaugagugggggaucucuca

SEQ ID NO: 793861 - RNA, 22 nt, Human
cacacagcucaggggcacugcc

SEQ ID NO: 793862 - RNA, 22 nt, Human
gugcugggauuacaggugugag

SEQ ID NO: 793863 - RNA, 23 nt, Human
ugaaggcccuggagccacgaggc

SEQ ID NO: 793864 - RNA, 22 nt, Human
cagcauugaucccaggcugugg

SEQ ID NO: 793865 - RNA, 22 nt, Human
uuucacaucaugggauggaagc

SEQ ID NO: 793866 - RNA, 22 nt, Human
gcagagccaggagcccaggauc

SEQ ID NO: 793867 - RNA, 22 nt, Human
cccagagccgguggugcucaca

SEQ ID NO: 793868 - RNA, 22 nt, Human
acaggcugauagaccauaaaua

SEQ ID NO: 793869 - RNA, 22 nt, Human
auaaacucugccucagaagagc

SEQ ID NO: 793870 - RNA, 22 nt, Human
aggcuggcuuugguagcauggu

SEQ ID NO: 793871 - RNA, 22 nt, Human
ccugggaccucgcgggaagcgg

SEQ ID NO: 793872 - RNA, 22 nt, Human
agcugcugcaaguggugcuaac

SEQ ID NO: 793873 - RNA, 22 nt, Human
aaaauggguuucuucaaccuca

SEQ ID NO: 793874 - RNA, 22 nt, Human
auagauauuugaguuguuucca

SEQ ID NO: 793875 - RNA, 20 nt, Human
uggcugcacaccaggacagg

SEQ ID NO: 793876 - RNA, 22 nt, Human
cuucaguguucccaucuguaaa

SEQ ID NO: 793877 - RNA, 22 nt, Human
ucacagaagcuugaagauuuuc

SEQ ID NO: 793878 - RNA, 22 nt, Human
acagcaggcaugaagaaauguu

SEQ ID NO: 793879 - RNA, 22 nt, Human
gcuggaguuaggugggcuugaa

SEQ ID NO: 793880 - RNA, 22 nt, Human
cuguuucuccacacucuuccca

SEQ ID NO: 793881 - RNA, 22 nt, Human
cgucuaggccgugcccugaggu

SEQ ID NO: 793882 - RNA, 22 nt, Human
cagggcagccaggccccguggg

SEQ ID NO: 793883 - RNA, 21 nt, Human
uggagagcccuugccugaguc

SEQ ID NO: 793884 - RNA, 22 nt, Human
ucagagucauugcaaguagaag

SEQ ID NO: 793885 - RNA, 22 nt, Human
ugcugcucaagcugcagcaaaa

SEQ ID NO: 793886 - RNA, 17 nt, Human
ugcagcugauggggaaa

SEQ ID NO: 793887 - RNA, 22 nt, Human
caucacauuagucucaagagaa

SEQ ID NO: 793888 - RNA, 22 nt, Human
caaaacauucucugcagcaggg

SEQ ID NO: 793889 - RNA, 22 nt, Human
aagccaggcugcacuugcuggg

SEQ ID NO: 793890 - RNA, 22 nt, Human
cuuccagaguugcguucucggu

SEQ ID NO: 793891 - RNA, 21 nt, Human
uucaucagccagaaaucaagc

SEQ ID NO: 793892 - RNA, 22 nt, Human
gaguaaaaguuggauuacaaag

SEQ ID NO: 793893 - RNA, 22 nt, Human
caucagcacuaugauuaaagua

SEQ ID NO: 793894 - RNA, 22 nt, Human
gugaggcuacucagcuguccga

SEQ ID NO: 793895 - RNA, 22 nt, Human
gccugggagugcacagugaggu

SEQ ID NO: 793896 - RNA, 22 nt, Human
uauguauauguguguugacaac

SEQ ID NO: 793897 - RNA, 22 nt, Human
ucuuugguuucugucucuguaa

SEQ ID NO: 793898 - RNA, 22 nt, Human
aaacauuguaauuuuagcaugg

SEQ ID NO: 793899 - RNA, 22 nt, Human
aauauaugugguauugaccagc

SEQ ID NO: 793900 - RNA, 20 nt, Human
uguuucugacgguaggagag

SEQ ID NO: 793901 - RNA, 22 nt, Human
acaggguggggauggugagcuu

SEQ ID NO: 793902 - RNA, 22 nt, Human
gcugccaucuccugaggacagg

SEQ ID NO: 793903 - RNA, 22 nt, Human
ucagaauuguggagaaagggga

SEQ ID NO: 793904 - RNA, 22 nt, Human
agcagggcagcugaugcgcacg

SEQ ID NO: 793905 - RNA, 22 nt, Human
cucugacagccuucauuaugca

SEQ ID NO: 793906 - RNA, 22 nt, Human
gccuggcugagguggggaggca

SEQ ID NO: 793907 - RNA, 22 nt, Human
ucaagucucaauguauuauggu

SEQ ID NO: 793908 - RNA, 22 nt, Human
augcaauaaauacuuuccagcu

SEQ ID NO: 793909 - RNA, 22 nt, Human
gccugguggacacugggcauca

SEQ ID NO: 793910 - RNA, 22 nt, Human
ugguucaggcaggguguugcug

SEQ ID NO: 793911 - RNA, 22 nt, Human
ggucuccugaggcugccacacc

SEQ ID NO: 793912 - RNA, 22 nt, Human
cccagcacucagcaggcucaua

SEQ ID NO: 793913 - RNA, 18 nt, Human
aguguuaaguaaguagca

SEQ ID NO: 793914 - RNA, 22 nt, Human
ucacaguuucuuuucugauaaa

SEQ ID NO: 793915 - RNA, 22 nt, Human
cuagggagggauguuggcauga

SEQ ID NO: 793916 - RNA, 20 nt, Human
cccugagacaaaggaggggc

SEQ ID NO: 793917 - RNA, 22 nt, Human
gaagccucaacaucucugcguc

SEQ ID NO: 793918 - RNA, 22 nt, Human
aucuuuggugcuuggugcuccc

SEQ ID NO: 793919 - RNA, 20 nt, Human
cuucaggacccauccucccc

SEQ ID NO: 793920 - RNA, 22 nt, Human
ugcuggaguggcacuguguggc

SEQ ID NO: 793921 - RNA, 22 nt, Human
aagcagugcgcucaucuaaggg

SEQ ID NO: 793922 - RNA, 17 nt, Human
aagucccagcuaacaca

SEQ ID NO: 793923 - RNA, 22 nt, Human
uuucccuugaauaaagauaucu

SEQ ID NO: 793924 - RNA, 22 nt, Human
uccuuuggcaagcucugcucuu

SEQ ID NO: 793925 - RNA, 22 nt, Human
ugaaaauuaagcagaugaauga

SEQ ID NO: 793926 - RNA, 22 nt, Human
ugcauuuaguuuuaauaaagga

SEQ ID NO: 793927 - RNA, 22 nt, Human
gauuuguuucaaguuagcaucu

SEQ ID NO: 793928 - RNA, 22 nt, Human
uuaagucauuucugauuauaga

SEQ ID NO: 793929 - RNA, 22 nt, Human
guuucaugguuguuugauggca

SEQ ID NO: 793930 - RNA, 22 nt, Human
uccagagauccaaagaauauga

SEQ ID NO: 793931 - RNA, 22 nt, Human
ugcaggguggagcggaagcgga

SEQ ID NO: 793932 - RNA, 22 nt, Human
agugucuguugaguuucaaaag

SEQ ID NO: 793933 - RNA, 22 nt, Human
gaauagauccucauuuauugau

SEQ ID NO: 793934 - RNA, 22 nt, Human
agcuccagggaaagaguggauc

SEQ ID NO: 793935 - RNA, 22 nt, Human
acugcuauugaugucacacuuu

SEQ ID NO: 793936 - RNA, 22 nt, Human
agcaagcauugcugguuagguc

SEQ ID NO: 793937 - RNA, 22 nt, Human
uagacucugcauuuaccuccca

SEQ ID NO: 793938 - RNA, 22 nt, Human
aaaugacuaaugauccugggca

SEQ ID NO: 793939 - RNA, 22 nt, Human
ucuuuguuuguacuguuagaau

SEQ ID NO: 793940 - RNA, 22 nt, Human
aggcuagcugauugccuuagaa

SEQ ID NO: 793941 - RNA, 22 nt, Human
ugcccuccacaguggcuccacc

SEQ ID NO: 793942 - RNA, 22 nt, Human
auuuuucucuccacuccauuaa

SEQ ID NO: 793943 - RNA, 22 nt, Human
ugagcagaaaagaaugcugagc

SEQ ID NO: 793944 - RNA, 22 nt, Human
ggggauggaauguaguagugau

SEQ ID NO: 793945 - RNA, 22 nt, Human
gccugcugagggaaguugggca

SEQ ID NO: 793946 - RNA, 22 nt, Human
ccuucuuaaacaucauuuuggc

SEQ ID NO: 793947 - RNA, 22 nt, Human
ucuauuuucuugccaaaacugc

SEQ ID NO: 793948 - RNA, 22 nt, Human
cucagaauuaauaaccacaagg

SEQ ID NO: 793949 - RNA, 22 nt, Human
cugcaaaugccucggugugcgg

SEQ ID NO: 793950 - RNA, 22 nt, Human
uuucuaaucuuuaguuacaaaa

SEQ ID NO: 793951 - RNA, 22 nt, Human
caagagcacgugcccuccauaa

SEQ ID NO: 793952 - RNA, 22 nt, Human
acauggcacccagaucucaaaa

SEQ ID NO: 793953 - RNA, 22 nt, Human
agcagaaagcuuauuuugacug

SEQ ID NO: 793954 - RNA, 22 nt, Human
ucucaguggaucucagaauuuu

SEQ ID NO: 793955 - RNA, 22 nt, Human
agaggcuggguacgggccaccu

SEQ ID NO: 793956 - RNA, 22 nt, Human
uucaacuuuaugcauauguauu

SEQ ID NO: 793957 - RNA, 22 nt, Human
agggaagccccgaggaggcacc

SEQ ID NO: 793958 - RNA, 22 nt, Human
gccucugcggagcuguacauca

SEQ ID NO: 793959 - RNA, 22 nt, Human
ggcugucuugggagcucccccg

SEQ ID NO: 793960 - RNA, 22 nt, Human
aggcuuggcucuccuaugagaa

SEQ ID NO: 793961 - RNA, 22 nt, Human
gcuaggaagcuggggagaaguc

SEQ ID NO: 793962 - RNA, 19 nt, Human
ugagcugcugcugcccauc

SEQ ID NO: 793963 - RNA, 22 nt, Human
gcuggcaggauaacuucuaagc

SEQ ID NO: 793964 - RNA, 22 nt, Human
gagaaagggauaauuugaagag

SEQ ID NO: 793965 - RNA, 22 nt, Human
gccugcuguuaacugcaggaau

SEQ ID NO: 793966 - RNA, 22 nt, Human
agcaaagaaggguucuucauua

SEQ ID NO: 793967 - RNA, 22 nt, Human
acuuguuuuaucugucaauaga

SEQ ID NO: 793968 - RNA, 23 nt, Human
gcugccucuguuggucuucaguu

SEQ ID NO: 793969 - RNA, 22 nt, Human
gcucagagauguucaguagcuu

SEQ ID NO: 793970 - RNA, 22 nt, Human
gcugagggcauguguggcgacu

SEQ ID NO: 793971 - RNA, 23 nt, Human
gcugccuccuacaaaagcccagc

SEQ ID NO: 793972 - RNA, 22 nt, Human
uccagggagcaagucaggccgg

SEQ ID NO: 793973 - RNA, 22 nt, Human
uaaguaauugcagcaauuugcc

SEQ ID NO: 793974 - RNA, 22 nt, Human
augcaaauaaacagucuaguug

SEQ ID NO: 793975 - RNA, 23 nt, Human
cccuggagcuagucugagcagag

SEQ ID NO: 793976 - RNA, 17 nt, Human
gaggagcuccaguaggu

SEQ ID NO: 793977 - RNA, 22 nt, Human
ggaguggccucuccugugcagg

SEQ ID NO: 793978 - RNA, 22 nt, Human
uaaccaaagggccuaaggaaug

SEQ ID NO: 793979 - RNA, 22 nt, Human
aaagugcaucaaaugacuuccc

SEQ ID NO: 793980 - RNA, 22 nt, Human
acaaaguaggaagauuagcuga

SEQ ID NO: 793981 - RNA, 22 nt, Human
guauauuuugaucacccucuau

SEQ ID NO: 793982 - RNA, 22 nt, Human
ccucugggugggaggccgggcg

SEQ ID NO: 793983 - RNA, 22 nt, Human
gcucugccagacacuguggcca

SEQ ID NO: 793984 - RNA, 22 nt, Human
ugcagaaaccaauucaaguaag

SEQ ID NO: 793985 - RNA, 23 nt, Human
ugaaugauggugcuccucaucuu

SEQ ID NO: 793986 - RNA, 22 nt, Human
aguccacagagucucuccugaa

SEQ ID NO: 793987 - RNA, 22 nt, Human
cugagggcaccgacagagugga

SEQ ID NO: 793988 - RNA, 22 nt, Human
cccaacacucaccuccggauua

SEQ ID NO: 793989 - RNA, 22 nt, Human
cgcauccagggcgcaggaucug

SEQ ID NO: 793990 - RNA, 22 nt, Human
uccaggagaaaacugacggugg

SEQ ID NO: 793991 - RNA, 22 nt, Human
uuuguguuuguacaaugcacua

SEQ ID NO: 793992 - RNA, 22 nt, Human
cucagggaguagcacaugugga

SEQ ID NO: 793993 - RNA, 22 nt, Human
agaacaaaucgauggaagccug

SEQ ID NO: 793994 - RNA, 23 nt, Human
ggcuccuggauucaaauccugcc

SEQ ID NO: 793995 - RNA, 22 nt, Human
acagucuugagcaucagccaga

SEQ ID NO: 793996 - RNA, 22 nt, Human
ccacagggaacaugacagccuu

SEQ ID NO: 793997 - RNA, 22 nt, Human
agccaacuuagaagaaauuuga

SEQ ID NO: 793998 - RNA, 22 nt, Human
cccaggagauggugcguggucu

SEQ ID NO: 793999 - RNA, 22 nt, Human
auguauuugcuuguuauggauu

SEQ ID NO: 794000 - RNA, 22 nt, Human
uacuuuaaagagguguaaugag

SEQ ID NO: 794001 - RNA, 21 nt, Human
cagcccagcuucuuccccagu

SEQ ID NO: 794002 - RNA, 22 nt, Human
cauuuauugguuaggccagcag

SEQ ID NO: 794003 - RNA, 23 nt, Human
gcucaucaggcuuagagucaagg

SEQ ID NO: 794004 - RNA, 22 nt, Human
ucauccuuuugcaugggaaggc

SEQ ID NO: 794005 - RNA, 22 nt, Human
auaauuuuuguuugauguccaa

SEQ ID NO: 794006 - RNA, 22 nt, Human
cccgcuccuuaccuguccaacc

SEQ ID NO: 794007 - RNA, 17 nt, Human
ugcagcugcucccaggc

SEQ ID NO: 794008 - RNA, 22 nt, Human
ugauaaacuuagaaagaauguu

SEQ ID NO: 794009 - RNA, 22 nt, Human
uagggcagcugcaucaggcacu

SEQ ID NO: 794010 - RNA, 22 nt, Human
gaguccuggagaaacgcaggug

SEQ ID NO: 794011 - RNA, 22 nt, Human
auucuggacaaggcaagcuccu

SEQ ID NO: 794012 - RNA, 22 nt, Human
gcucuguccagcgugcacagaa

SEQ ID NO: 794013 - RNA, 22 nt, Human
ucacagaaauaagauaguuauu

SEQ ID NO: 794014 - RNA, 22 nt, Human
agcugcaguaaagcucuccagg

SEQ ID NO: 794015 - RNA, 22 nt, Human
uauaaagaaggcacagcaagac

SEQ ID NO: 794016 - RNA, 22 nt, Human
aagcacagagaugggcacgccu

SEQ ID NO: 794017 - RNA, 22 nt, Human
uggggugugcucagagcagggg

SEQ ID NO: 794018 - RNA, 22 nt, Human
ccagggagccuggugugucagc

SEQ ID NO: 794019 - RNA, 22 nt, Human
ugggggcauggaccagccuggc

SEQ ID NO: 794020 - RNA, 22 nt, Human
gggacaggccccucgcuagcuu

SEQ ID NO: 794021 - RNA, 22 nt, Human
ggcuguggggccggguacagug

SEQ ID NO: 794022 - RNA, 22 nt, Human
agacauuuauguuucucuagga

SEQ ID NO: 794023 - RNA, 20 nt, Human
uggagggauuguuggcaaau

SEQ ID NO: 794024 - RNA, 22 nt, Human
auucacauugagcuucacugug

SEQ ID NO: 794025 - RNA, 22 nt, Human
aaguacagaaauagcaggugca

SEQ ID NO: 794026 - RNA, 18 nt, Human
cugaggcuggcaggagcc

SEQ ID NO: 794027 - RNA, 22 nt, Human
cuucuggcguuggaggucugag

SEQ ID NO: 794028 - RNA, 22 nt, Human
aggcucuggaguguggugcugg

SEQ ID NO: 794029 - RNA, 19 nt, Human
ugggaguggggaagguccu

SEQ ID NO: 794030 - RNA, 22 nt, Human
cgccccagucuguaggugcccc

SEQ ID NO: 794031 - RNA, 22 nt, Human
caacauauaauauuugaguucu

SEQ ID NO: 794032 - RNA, 22 nt, Human
uucaacaaacuguucacgaaug

SEQ ID NO: 794033 - RNA, 22 nt, Human
ugcaagaggcaucuuuuaaaaa

SEQ ID NO: 794034 - RNA, 22 nt, Human
aaggaaaugugccugacacugc

SEQ ID NO: 794035 - RNA, 22 nt, Human
aggcuucaggaagucuccuggg

SEQ ID NO: 794036 - RNA, 22 nt, Human
cgggucaccuaucaauuuugug

SEQ ID NO: 794037 - RNA, 22 nt, Human
gaaagcaguaaaugggucccau

SEQ ID NO: 794038 - RNA, 22 nt, Human
cagauaaaggcuuacuaguagu

SEQ ID NO: 794039 - RNA, 22 nt, Human
uggagagcuguugaaaugcaga

SEQ ID NO: 794040 - RNA, 22 nt, Human
ccaugccauacuggccacccgg

SEQ ID NO: 794041 - RNA, 22 nt, Human
auaaacugaagggaacacugag

SEQ ID NO: 794042 - RNA, 22 nt, Human
uugguucaguaggcaugccugg

SEQ ID NO: 794043 - RNA, 22 nt, Human
ugcagcugaugauacccccaug

SEQ ID NO: 794044 - RNA, 22 nt, Human
ugucuuuaauucuacauaucuc

SEQ ID NO: 794045 - RNA, 22 nt, Human
gcagacugcgagcgugcuggug

SEQ ID NO: 794046 - RNA, 22 nt, Human
uuuuauucucaagacaauggga

SEQ ID NO: 794047 - RNA, 22 nt, Human
uucauucucuuagcauaguccu

SEQ ID NO: 794048 - RNA, 22 nt, Human
cugagacauuaugacaagugga

SEQ ID NO: 794049 - RNA, 22 nt, Human
ugggaaugggccuagaaggcug

SEQ ID NO: 794050 - RNA, 22 nt, Human
auuucugauaaacguaagcugc

SEQ ID NO: 794051 - RNA, 20 nt, Human
augauucaugaugaugucuc

SEQ ID NO: 794052 - RNA, 22 nt, Human
uggggccagguggcugcagguc

SEQ ID NO: 794053 - RNA, 22 nt, Human
gcugugcaucuucauucuggac

SEQ ID NO: 794054 - RNA, 23 nt, Human
aaagcaaggaauuggcaacagag

SEQ ID NO: 794055 - RNA, 22 nt, Human
cagaggcagaggucaucucugg

SEQ ID NO: 794056 - RNA, 22 nt, Human
auuuccaugucgguauuuuaua

SEQ ID NO: 794057 - RNA, 22 nt, Human
ugaagaggccgugugcagguga

SEQ ID NO: 794058 - RNA, 22 nt, Human
acuauaaccuguuagaauagau

SEQ ID NO: 794059 - RNA, 22 nt, Human
cuggggcuucaaugcuucggug

SEQ ID NO: 794060 - RNA, 22 nt, Human
aaguuauugcagcaauccaagu

SEQ ID NO: 794061 - RNA, 22 nt, Human
gccucugcaucaucacuccagc

SEQ ID NO: 794062 - RNA, 22 nt, Human
ugcuggagugcaguggcuuaac

SEQ ID NO: 794063 - RNA, 22 nt, Human
uuuauauuaccuggaauagcuu

SEQ ID NO: 794064 - RNA, 22 nt, Human
ggagcagcuugcaugcucaggg

SEQ ID NO: 794065 - RNA, 22 nt, Human
uuauuuauggcacuguuggugg

SEQ ID NO: 794066 - RNA, 22 nt, Human
uguucuuaacuuuuguguauau

SEQ ID NO: 794067 - RNA, 22 nt, Human
gcaacauuaaaccaauaauugu

SEQ ID NO: 794068 - RNA, 22 nt, Human
aaaggcagagugcucagcuggc

SEQ ID NO: 794069 - RNA, 22 nt, Human
augcuaaacuaugaucauuuuc

SEQ ID NO: 794070 - RNA, 22 nt, Human
aggagccaugagcaggaggcaa

SEQ ID NO: 794071 - RNA, 22 nt, Human
auuguaacauguucagaucacu

SEQ ID NO: 794072 - RNA, 22 nt, Human
uacagaaggaaguuuagcuaaa

SEQ ID NO: 794073 - RNA, 22 nt, Human
ucccuccccacuucugagcuuu

SEQ ID NO: 794074 - RNA, 17 nt, Human
cacuugcuggucuaccu

SEQ ID NO: 794075 - RNA, 22 nt, Human
uaaauuagggacuuuaguuaau

SEQ ID NO: 794076 - RNA, 22 nt, Human
agaagccacaggaaagcagcuu

SEQ ID NO: 794077 - RNA, 22 nt, Human
uaaggcagcauaauuaggccac

SEQ ID NO: 794078 - RNA, 22 nt, Human
uuccucagggaggcuagcagua

SEQ ID NO: 794079 - RNA, 22 nt, Human
acaguguaauaugggagucagu

SEQ ID NO: 794080 - RNA, 22 nt, Human
cccugaggauagggcaggaccc

SEQ ID NO: 794081 - RNA, 23 nt, Human
ccucagcauggcaggagcccagc

SEQ ID NO: 794082 - RNA, 22 nt, Human
auggcccaggccaggauccagc

SEQ ID NO: 794083 - RNA, 22 nt, Human
gucuccacagcccagcugccac

SEQ ID NO: 794084 - RNA, 18 nt, Human
gccacccuccucgucucc

SEQ ID NO: 794085 - RNA, 22 nt, Human
ccuggcugcaguuuuugcagaa

SEQ ID NO: 794086 - RNA, 22 nt, Human
gugcagagaaggagcaguaguu

SEQ ID NO: 794087 - RNA, 22 nt, Human
uggcuucaaaaucuaguggucu

SEQ ID NO: 794088 - RNA, 22 nt, Human
ugcagcccaggcgucagguggu

SEQ ID NO: 794089 - RNA, 22 nt, Human
cacuuagauacuagaucacaaa

SEQ ID NO: 794090 - RNA, 22 nt, Human
aaaguucuauguaauguuuuuu

SEQ ID NO: 794091 - RNA, 22 nt, Human
ccagcuccaaguuugggcauca

SEQ ID NO: 794092 - RNA, 22 nt, Human
aagccuguguuucugcuagucu

SEQ ID NO: 794093 - RNA, 22 nt, Human
cagccuggagccacagcccagg

SEQ ID NO: 794094 - RNA, 22 nt, Human
gcuggcuuuauggggcuugugg

SEQ ID NO: 794095 - RNA, 19 nt, Human
cccagucuagguccuagga

SEQ ID NO: 794096 - RNA, 22 nt, Human
uauaacacucagaaagaaucau

SEQ ID NO: 794097 - RNA, 22 nt, Human
gggcaagaagcuggaagcauuc

SEQ ID NO: 794098 - RNA, 19 nt, Human
ugagcuggcugagccucuc

SEQ ID NO: 794099 - RNA, 17 nt, Human
aacaguaagcccuguuu

SEQ ID NO: 794100 - RNA, 22 nt, Human
uggccagugggguugagcagga

SEQ ID NO: 794101 - RNA, 22 nt, Human
uuaauagauaugccucuagagu

SEQ ID NO: 794102 - RNA, 22 nt, Human
acaacaguuuagguauuuguag

SEQ ID NO: 794103 - RNA, 22 nt, Human
uagauacucagaaaugcuuuca

SEQ ID NO: 794104 - RNA, 22 nt, Human
agaacauaucuguuuucuaacu

SEQ ID NO: 794105 - RNA, 22 nt, Human
aagucaagauaaaggugcuggc

SEQ ID NO: 794106 - RNA, 22 nt, Human
gcuggcuggagugagcuacccu

SEQ ID NO: 794107 - RNA, 22 nt, Human
caguugccuacuacauggcagg

SEQ ID NO: 794108 - RNA, 22 nt, Human
ugggccaggggccucuucugau

SEQ ID NO: 794109 - RNA, 22 nt, Human
gaugaaauagcaaaggcauuug

SEQ ID NO: 794110 - RNA, 22 nt, Human
acaaggcugaacagugaagccg

SEQ ID NO: 794111 - RNA, 22 nt, Human
gccaggcugacucccccggccu

SEQ ID NO: 794112 - RNA, 22 nt, Human
auuuuucaacuuuggaaauggc

SEQ ID NO: 794113 - RNA, 22 nt, Human
cuggauggucccaugagcagcu

SEQ ID NO: 794114 - RNA, 22 nt, Human
cuguuguauuauucaauauuau

SEQ ID NO: 794115 - RNA, 22 nt, Human
uuucauugucaauaaacuguau

SEQ ID NO: 794116 - RNA, 22 nt, Human
gagguccacugaggcaacaggg

SEQ ID NO: 794117 - RNA, 19 nt, Human
agcccagcuuauuugucag

SEQ ID NO: 794118 - RNA, 17 nt, Human
ccugcccagagacagau

SEQ ID NO: 794119 - RNA, 20 nt, Human
ugcuggggacauacagggug

SEQ ID NO: 794120 - RNA, 22 nt, Human
cagcauggagacaaagugggca

SEQ ID NO: 794121 - RNA, 22 nt, Human
gcaugcaaggaccaagggagca

SEQ ID NO: 794122 - RNA, 22 nt, Human
cuagcagggauugggcacuggg

SEQ ID NO: 794123 - RNA, 23 nt, Human
uuucaacaaugcuuagagaaaac

SEQ ID NO: 794124 - RNA, 22 nt, Human
cagcuuugcccuuugcccaauc

SEQ ID NO: 794125 - RNA, 21 nt, Human
auguuuacacugacuacugug

SEQ ID NO: 794126 - RNA, 22 nt, Human
cuggaagggagcacuguagaga

SEQ ID NO: 794127 - RNA, 22 nt, Human
aggcucaguucuguggugagcc

SEQ ID NO: 794128 - RNA, 22 nt, Human
gagccacagaaggaaauugggg

SEQ ID NO: 794129 - RNA, 22 nt, Human
gggagcugagcucugagccacg

SEQ ID NO: 794130 - RNA, 22 nt, Human
uuuacaaccucauauucugaug

SEQ ID NO: 794131 - RNA, 22 nt, Human
caggucagagguagaugagaug

SEQ ID NO: 794132 - RNA, 22 nt, Human
ucauaauuguauacauuuaugg

SEQ ID NO: 794133 - RNA, 22 nt, Human
cagcagcacucugcgggucccc

SEQ ID NO: 794134 - RNA, 22 nt, Human
cagaaaaggaagagcuauguaa

SEQ ID NO: 794135 - RNA, 22 nt, Human
caccagcccccucacgcuguca

SEQ ID NO: 794136 - RNA, 22 nt, Human
uuuuugaaggcugaugugauua

SEQ ID NO: 794137 - RNA, 22 nt, Human
ugagaaauggcagcauuacugg

SEQ ID NO: 794138 - RNA, 22 nt, Human
aggccagcccugggcugagaga

SEQ ID NO: 794139 - RNA, 22 nt, Human
ugagcuagguccugugucagcu

SEQ ID NO: 794140 - RNA, 22 nt, Human
agucucaaguguuaguauuauu

SEQ ID NO: 794141 - RNA, 22 nt, Human
cugaggcuucucuaguucagcu

SEQ ID NO: 794142 - RNA, 22 nt, Human
cugucuuugguccugucuguua

SEQ ID NO: 794143 - RNA, 22 nt, Human
agcugugguguuuucaagcccu

SEQ ID NO: 794144 - RNA, 22 nt, Human
cuuaaauuuucaucuacaagaa

SEQ ID NO: 794145 - RNA, 22 nt, Human
agaggccaauaguagguggcau

SEQ ID NO: 794146 - RNA, 22 nt, Human
uuccagccaugguuucccuaug

SEQ ID NO: 794147 - RNA, 22 nt, Human
cugggagauugcuagagaugca

SEQ ID NO: 794148 - RNA, 22 nt, Human
agguggaaauggcuuuccuagg

SEQ ID NO: 794149 - RNA, 22 nt, Human
gugcaucugaauuugaaaaucu

SEQ ID NO: 794150 - RNA, 22 nt, Human
gcagggcagugugucugugggg

SEQ ID NO: 794151 - RNA, 22 nt, Human
uuccucuccucccaccagguga

SEQ ID NO: 794152 - RNA, 19 nt, Human
cuaaggcaagaaacuggac

SEQ ID NO: 794153 - RNA, 22 nt, Human
gcuguggcccuuggcaucugcg

SEQ ID NO: 794154 - RNA, 22 nt, Human
acauacauaugacaacuuuccu

SEQ ID NO: 794155 - RNA, 22 nt, Human
aauguuuuaaaagagauugaga

SEQ ID NO: 794156 - RNA, 22 nt, Human
uguuucuuacguuuuuagaggc

SEQ ID NO: 794157 - RNA, 21 nt, Human
uagggcucuauuuuuauuuca

SEQ ID NO: 794158 - RNA, 22 nt, Human
uaagacaaauacuauuucaaga

SEQ ID NO: 794159 - RNA, 22 nt, Human
gaggugagaagggggucagaug

SEQ ID NO: 794160 - RNA, 22 nt, Human
gggcccugccccguggcucuga

SEQ ID NO: 794161 - RNA, 19 nt, Human
uagucuuuauucuuaauuu

SEQ ID NO: 794162 - RNA, 22 nt, Human
cuccaggaccagggcuccugga

SEQ ID NO: 794163 - RNA, 22 nt, Human
uugcacuccagcccgagcaaca

SEQ ID NO: 794164 - RNA, 22 nt, Human
aguuucaguguugacagauggu

SEQ ID NO: 794165 - RNA, 22 nt, Human
aacaaugaggaucuguucugag

SEQ ID NO: 794166 - RNA, 22 nt, Human
acagucuuaugcauacacuauu

SEQ ID NO: 794167 - RNA, 22 nt, Human
aagucuuucauaagucucuuau

SEQ ID NO: 794168 - RNA, 22 nt, Human
gcgcaagccacacagccugggg

SEQ ID NO: 794169 - RNA, 22 nt, Human
aaacaaacauagguuugaaagu

SEQ ID NO: 794170 - RNA, 22 nt, Human
uaagucauuuggagccacugga

SEQ ID NO: 794171 - RNA, 22 nt, Human
cauugagagugacuuggacaau

SEQ ID NO: 794172 - RNA, 22 nt, Human
caucuucagguucauggucaua

SEQ ID NO: 794173 - RNA, 22 nt, Human
agaggcaaguucagagcuagga

SEQ ID NO: 794174 - RNA, 22 nt, Human
cagaaaauaaaguuucuacgca

SEQ ID NO: 794175 - RNA, 22 nt, Human
ugccaggcccagcuccagagcu

SEQ ID NO: 794176 - RNA, 22 nt, Human
cugaagccacgauagcuuccua

SEQ ID NO: 794177 - RNA, 22 nt, Human
auuacaugagagaauguaaaua

SEQ ID NO: 794178 - RNA, 22 nt, Human
aacccaggaggcagaggcugca

SEQ ID NO: 794179 - RNA, 22 nt, Human
cauuaaauuccuuguucucaaa

SEQ ID NO: 794180 - RNA, 22 nt, Human
gagccacagcaaccucaaagga

SEQ ID NO: 794181 - RNA, 22 nt, Human
guucaaguuucugagcuuuaau

SEQ ID NO: 794182 - RNA, 22 nt, Human
cuuuuucauuggcuuuaggaca

SEQ ID NO: 794183 - RNA, 22 nt, Human
ucacagagagaauauuguguuu

SEQ ID NO: 794184 - RNA, 22 nt, Human
uuccagaggccugggcacacuc

SEQ ID NO: 794185 - RNA, 22 nt, Human
acaauacaggcuucuggacuua

SEQ ID NO: 794186 - RNA, 22 nt, Human
uuauuaagugccuacaauaaag

SEQ ID NO: 794187 - RNA, 17 nt, Human
uauacacagacagacug

SEQ ID NO: 794188 - RNA, 22 nt, Human
cagcacugugauaacugagcca

SEQ ID NO: 794189 - RNA, 22 nt, Human
auggggugaccaugagcauuua

SEQ ID NO: 794190 - RNA, 21 nt, Human
uacaaguugcuuuugaagucc

SEQ ID NO: 794191 - RNA, 22 nt, Human
gugcagcucaguugaaaugcag

SEQ ID NO: 794192 - RNA, 22 nt, Human
acagcagguagcuuugugccuc

SEQ ID NO: 794193 - RNA, 22 nt, Human
auccagagacuggggcugggau

SEQ ID NO: 794194 - RNA, 22 nt, Human
agaggcccugggcuggugugcu

SEQ ID NO: 794195 - RNA, 22 nt, Human
ccugcuggacguggaggagggg

SEQ ID NO: 794196 - RNA, 22 nt, Human
uuaaaugaacgagauaugcaac

SEQ ID NO: 794197 - RNA, 20 nt, Human
ucagagaagggacugagauu

SEQ ID NO: 794198 - RNA, 22 nt, Human
uuguuacaucuuauguaagugg

SEQ ID NO: 794199 - RNA, 22 nt, Human
aaggaagguucauagucaaaga

SEQ ID NO: 794200 - RNA, 22 nt, Human
cugggugcgugagcgcaugcgu

SEQ ID NO: 794201 - RNA, 22 nt, Human
aggcuugucucagaagaugcug

SEQ ID NO: 794202 - RNA, 22 nt, Human
ucaugcaaacucuaguccuuua

SEQ ID NO: 794203 - RNA, 22 nt, Human
gcugcaggaugaggcucugcuc

SEQ ID NO: 794204 - RNA, 20 nt, Human
ucaauguaaucauaucauca

SEQ ID NO: 794205 - RNA, 20 nt, Human
aggcucagagcaguaguaca

SEQ ID NO: 794206 - RNA, 22 nt, Human
uguaaauaaugcauguaaauca

SEQ ID NO: 794207 - RNA, 22 nt, Human
gccaggcauuuguuaggugcug

SEQ ID NO: 794208 - RNA, 22 nt, Human
ugaaugagaacacugaaagagg

SEQ ID NO: 794209 - RNA, 22 nt, Human
aaauuaguacauugcaaagucc

SEQ ID NO: 794210 - RNA, 22 nt, Human
gaguucauauucagagaucgcu

SEQ ID NO: 794211 - RNA, 22 nt, Human
uuucaggauuuuaugagauagu

SEQ ID NO: 794212 - RNA, 22 nt, Human
cugagacaugguuugacuggca

SEQ ID NO: 794213 - RNA, 22 nt, Human
auguuuuacccuuugcacaaac

SEQ ID NO: 794214 - RNA, 21 nt, Human
aguacaaaaauuccuuucuca

SEQ ID NO: 794215 - RNA, 22 nt, Human
ugaggggauacgguacacauug

SEQ ID NO: 794216 - RNA, 21 nt, Human
cagccugcugcuccagggcca

SEQ ID NO: 794217 - RNA, 22 nt, Human
uuuuaagaaauguaugacuguc

SEQ ID NO: 794218 - RNA, 21 nt, Human
uuacaacauuuguguucuaug

SEQ ID NO: 794219 - RNA, 22 nt, Human
auaccaauuagaguuuguugca

SEQ ID NO: 794220 - RNA, 22 nt, Human
ugucuuuggggcuguaccuguu

SEQ ID NO: 794221 - RNA, 19 nt, Human
ggcacuggggccaggacca

SEQ ID NO: 794222 - RNA, 22 nt, Human
augcuggcagccgagugcucca

SEQ ID NO: 794223 - RNA, 22 nt, Human
gcccagcacaucuggccuugaa

SEQ ID NO: 794224 - RNA, 22 nt, Human
accuucaauuauuuuuguucca

SEQ ID NO: 794225 - RNA, 22 nt, Human
acuucccauuucucugcuuuag

SEQ ID NO: 794226 - RNA, 22 nt, Human
caugugggaagaggccagcugg

SEQ ID NO: 794227 - RNA, 22 nt, Human
caggcuucgcucugugggcagg

SEQ ID NO: 794228 - RNA, 22 nt, Human
ugaggaagcaaaggcuugugug

SEQ ID NO: 794229 - RNA, 22 nt, Human
aaggacugaauaauucucuuuc

SEQ ID NO: 794230 - RNA, 18 nt, Human
acaaaggaucaugaggga

SEQ ID NO: 794231 - RNA, 22 nt, Human
uaggcuggaacuuaggcagagg

SEQ ID NO: 794232 - RNA, 21 nt, Human
cucccagggugacuguucaac

SEQ ID NO: 794233 - RNA, 22 nt, Human
uucaucuggaaguucccaaggc

SEQ ID NO: 794234 - RNA, 22 nt, Human
gcuggagugaguauguguaguc

SEQ ID NO: 794235 - RNA, 22 nt, Human
uuguuucuuugaaguuucuaga

SEQ ID NO: 794236 - RNA, 22 nt, Human
guacauuuaggauucauugaaa

SEQ ID NO: 794237 - RNA, 22 nt, Human
ugauacuuuggagacuugagua

SEQ ID NO: 794238 - RNA, 22 nt, Human
acuugaauuauauuucuagaga

SEQ ID NO: 794239 - RNA, 22 nt, Human
uggccccugaggagcgucagcc

SEQ ID NO: 794240 - RNA, 22 nt, Human
agagaugaaucuugagacucug

SEQ ID NO: 794241 - RNA, 22 nt, Human
caucuuuaaaggggagacaccc

SEQ ID NO: 794242 - RNA, 22 nt, Human
cagugcaguuucccagaugcug

SEQ ID NO: 794243 - RNA, 22 nt, Human
ccugucugaaggcagggggaug

SEQ ID NO: 794244 - RNA, 22 nt, Human
aaacacaagaggcaggguacag

SEQ ID NO: 794245 - RNA, 22 nt, Human
uuccaagugcccauauuucauc

SEQ ID NO: 794246 - RNA, 22 nt, Human
aguuauuuuggaaaaugaguca

SEQ ID NO: 794247 - RNA, 22 nt, Human
ucaaauuuuaacaugcauuaga

SEQ ID NO: 794248 - RNA, 22 nt, Human
uuugcagagugcagaagcaucu

SEQ ID NO: 794249 - RNA, 22 nt, Human
acuauucauguuuccuaacuau

SEQ ID NO: 794250 - RNA, 22 nt, Human
gugcagugacccuggagagcug

SEQ ID NO: 794251 - RNA, 22 nt, Human
aaaauuaagugucugggaagcc

SEQ ID NO: 794252 - RNA, 22 nt, Human
guacauuucauuuaaaugaugu

SEQ ID NO: 794253 - RNA, 22 nt, Human
uugcccagagucacccagcuca

SEQ ID NO: 794254 - RNA, 22 nt, Human
ugggggcagccaggcugucaag

SEQ ID NO: 794255 - RNA, 22 nt, Human
ucacaguacugugugacuugag

SEQ ID NO: 794256 - RNA, 22 nt, Human
ggcccagcuuucauuccuugcu

SEQ ID NO: 794257 - RNA, 22 nt, Human
uguauuaucaaguaaauacaug

SEQ ID NO: 794258 - RNA, 22 nt, Human
uaggaaauggcucaguuacugc

SEQ ID NO: 794259 - RNA, 20 nt, Human
aggguggggacguucugacu

SEQ ID NO: 794260 - RNA, 22 nt, Human
acagaauuaucaggaaauguua

SEQ ID NO: 794261 - RNA, 22 nt, Human
cugggccauggaagucucugcc

SEQ ID NO: 794262 - RNA, 22 nt, Human
ugccugcccuuuccacacagcc

SEQ ID NO: 794263 - RNA, 22 nt, Human
ccaguuuauaagaaagaaaacc

SEQ ID NO: 794264 - RNA, 22 nt, Human
cuccuaggugcucacugggguc

SEQ ID NO: 794265 - RNA, 22 nt, Human
acuaaacacaugagauuccugc

SEQ ID NO: 794266 - RNA, 22 nt, Human
ugcaggaaaaauaaauaguguu

SEQ ID NO: 794267 - RNA, 22 nt, Human
acacauuaaccuuugaaauucu

SEQ ID NO: 794268 - RNA, 22 nt, Human
ccuucucuaccaugugaggaaa

SEQ ID NO: 794269 - RNA, 22 nt, Human
agccucucuuucugguggcuaa

SEQ ID NO: 794270 - RNA, 22 nt, Human
gcagcaggucugucaaugucau

SEQ ID NO: 794271 - RNA, 22 nt, Human
aaacacagauuucuuuguccca

SEQ ID NO: 794272 - RNA, 22 nt, Human
ggcagaagauaggacagggaau

SEQ ID NO: 794273 - RNA, 22 nt, Human
agcaccugcuaugugucaggga

SEQ ID NO: 794274 - RNA, 22 nt, Human
ugauuuuauugaaacuucacuu

SEQ ID NO: 794275 - RNA, 22 nt, Human
acaggcacuuugacaugccauc

SEQ ID NO: 794276 - RNA, 20 nt, Human
guucaugucucaaauagaaa

SEQ ID NO: 794277 - RNA, 21 nt, Human
aucuuaaaaggucuuaacuuu

SEQ ID NO: 794278 - RNA, 22 nt, Human
uuuuuggcccuuagcucuguau

SEQ ID NO: 794279 - RNA, 22 nt, Human
uguggcacuuacauccuaguuu

SEQ ID NO: 794280 - RNA, 22 nt, Human
uugcuuuagaaucugcuucugg

SEQ ID NO: 794281 - RNA, 22 nt, Human
guucuuaagaccacaauaaaaa

SEQ ID NO: 794282 - RNA, 22 nt, Human
ucugcacccugugguccucuag

SEQ ID NO: 794283 - RNA, 20 nt, Human
cagaggcaaggagacuugga

SEQ ID NO: 794284 - RNA, 22 nt, Human
aggaacaucuaucacauaaacg

SEQ ID NO: 794285 - RNA, 22 nt, Human
cauaacauguacauauaaaugc

SEQ ID NO: 794286 - RNA, 22 nt, Human
cagaguggugcaagggcagugu

SEQ ID NO: 794287 - RNA, 22 nt, Human
ccuccugggccuugcucuguga

SEQ ID NO: 794288 - RNA, 22 nt, Human
acaaauuuguguaguuauggca

SEQ ID NO: 794289 - RNA, 22 nt, Human
uuugaggacauuuuagaaaguu

SEQ ID NO: 794290 - RNA, 22 nt, Human
aaauauagcaauuaugccuacu

SEQ ID NO: 794291 - RNA, 22 nt, Human
ggagccuggcccggcccuuggc

SEQ ID NO: 794292 - RNA, 22 nt, Human
gagggccaauggauuucaacug

SEQ ID NO: 794293 - RNA, 22 nt, Human
gugcugggcccugagaccaggg

SEQ ID NO: 794294 - RNA, 19 nt, Human
aggccugggguuuugcacu

SEQ ID NO: 794295 - RNA, 22 nt, Human
cuucauuucaggcugaagaaua

SEQ ID NO: 794296 - RNA, 22 nt, Human
uuuugcaaugagaugcuuguca

SEQ ID NO: 794297 - RNA, 22 nt, Human
uggugguccacaaauggguaca

SEQ ID NO: 794298 - RNA, 22 nt, Human
gcacagggagacagccguggcc

SEQ ID NO: 794299 - RNA, 22 nt, Human
guuguuuuugaacggugguggc

SEQ ID NO: 794300 - RNA, 22 nt, Human
cuacaacauuaugcuuucuguc

SEQ ID NO: 794301 - RNA, 22 nt, Human
guaggaagcucugaggcuaguu

SEQ ID NO: 794302 - RNA, 22 nt, Human
augcauauaaggcacauguauu

SEQ ID NO: 794303 - RNA, 22 nt, Human
ugcacagagggaggcauaaaau

SEQ ID NO: 794304 - RNA, 22 nt, Human
acccacgaagaugagcggcaug

SEQ ID NO: 794305 - RNA, 22 nt, Human
auucuuacuccauagaaugaau

SEQ ID NO: 794306 - RNA, 22 nt, Human
guagaaaauuaggaugaggcuu

SEQ ID NO: 794307 - RNA, 22 nt, Human
uagcauuagagauagaaauagu

SEQ ID NO: 794308 - RNA, 22 nt, Human
auucuugauauagauaguuaau

SEQ ID NO: 794309 - RNA, 22 nt, Human
cuuuggauggcuguguguuuau

SEQ ID NO: 794310 - RNA, 22 nt, Human
cucagaagaacaaaggcucuac

SEQ ID NO: 794311 - RNA, 22 nt, Human
aacaugcauguuauuuaucagu

SEQ ID NO: 794312 - RNA, 22 nt, Human
uuaauggcagggcagaauauua

SEQ ID NO: 794313 - RNA, 22 nt, Human
gcaggcugaaacucggggucua

SEQ ID NO: 794314 - RNA, 22 nt, Human
aagagcagauuccuaguggagc

SEQ ID NO: 794315 - RNA, 22 nt, Human
ugcacacagaugguacaugcau

SEQ ID NO: 794316 - RNA, 22 nt, Human
uuugaucuaugcgugguuuccc

SEQ ID NO: 794317 - RNA, 22 nt, Human
acaauuagcugugugucuaucu

SEQ ID NO: 794318 - RNA, 23 nt, Human
uuucccacccucucucauugcug

SEQ ID NO: 794319 - RNA, 22 nt, Human
ggcaggugugagaucgaggcca

SEQ ID NO: 794320 - RNA, 22 nt, Human
cuauucaauuuugcuauuguag

SEQ ID NO: 794321 - RNA, 22 nt, Human
cagggggcagcguagaaaauga

SEQ ID NO: 794322 - RNA, 22 nt, Human
agcagggcuggggcacgagcca

SEQ ID NO: 794323 - RNA, 22 nt, Human
gcagcccuggccuggccuacuu

SEQ ID NO: 794324 - RNA, 22 nt, Human
uacagucucugauaacugucag

SEQ ID NO: 794325 - RNA, 22 nt, Human
caugagauaauuuuucuccagu

SEQ ID NO: 794326 - RNA, 22 nt, Human
gcagcagcucugaaugggcccc

SEQ ID NO: 794327 - RNA, 22 nt, Human
gugcagcugcuugccugguuag

SEQ ID NO: 794328 - RNA, 22 nt, Human
aauaacuucaguucuuacauua

SEQ ID NO: 794329 - RNA, 22 nt, Human
uucauugaaauuaagcccaacu

SEQ ID NO: 794330 - RNA, 22 nt, Human
ggucagagccguuagcauucag

SEQ ID NO: 794331 - RNA, 22 nt, Human
aauucacagcauuugcccaucu

SEQ ID NO: 794332 - RNA, 22 nt, Human
aaaaugaggaacggaucauggc

SEQ ID NO: 794333 - RNA, 22 nt, Human
ucacagagcacacaagaauugc

SEQ ID NO: 794334 - RNA, 19 nt, Human
gaucaggagccgacaacug

SEQ ID NO: 794335 - RNA, 22 nt, Human
gccagaagacuggagucagcug

SEQ ID NO: 794336 - RNA, 22 nt, Human
ugggagcacucuuugggaagca

SEQ ID NO: 794337 - RNA, 22 nt, Human
uugugcuaagugcuaugaaggc

SEQ ID NO: 794338 - RNA, 22 nt, Human
aggaggccuacgcacaugucua

SEQ ID NO: 794339 - RNA, 22 nt, Human
aucuuugggcaaugaugaggga

SEQ ID NO: 794340 - RNA, 22 nt, Human
aagccaagugcuggccaugggc

SEQ ID NO: 794341 - RNA, 22 nt, Human
aaaagcaaguugccuagguuga

SEQ ID NO: 794342 - RNA, 22 nt, Human
uacaugaauguuucaauauugu

SEQ ID NO: 794343 - RNA, 22 nt, Human
ucaucaucacucuggcaagcau

SEQ ID NO: 794344 - RNA, 22 nt, Human
aagaguuuccaguuguggcuca

SEQ ID NO: 794345 - RNA, 22 nt, Human
uggugagauaacuuucggcaag

SEQ ID NO: 794346 - RNA, 19 nt, Human
ucaggcaguuauucacaaa

SEQ ID NO: 794347 - RNA, 21 nt, Human
ggaagcaguggcggcaacucc

SEQ ID NO: 794348 - RNA, 22 nt, Human
cagcagcagagauacugguuuc

SEQ ID NO: 794349 - RNA, 22 nt, Human
ucacaagaguaaguucaugccu

SEQ ID NO: 794350 - RNA, 22 nt, Human
gugcauuauucuuaccuuucuu

SEQ ID NO: 794351 - RNA, 22 nt, Human
ucaggucccacugcuaguaagu

SEQ ID NO: 794352 - RNA, 22 nt, Human
aggcagauuuucuuuacucagu

SEQ ID NO: 794353 - RNA, 22 nt, Human
ggcuggcuugcggagucacaga

SEQ ID NO: 794354 - RNA, 22 nt, Human
caucacaugccuaucaugagcu

SEQ ID NO: 794355 - RNA, 22 nt, Human
gaacaucaugaagaaaacauau

SEQ ID NO: 794356 - RNA, 20 nt, Human
gcuguggcaaagcuuugugu

SEQ ID NO: 794357 - RNA, 22 nt, Human
caggcugcagcagcaguggccc

SEQ ID NO: 794358 - RNA, 20 nt, Human
ccagcugagccaaggggaga

SEQ ID NO: 794359 - RNA, 22 nt, Human
ccaaggaggccccaggucagcu

SEQ ID NO: 794360 - RNA, 22 nt, Human
aggaggccccuccuggguugcu

SEQ ID NO: 794361 - RNA, 22 nt, Human
caacauaugauuuuguauauaa

SEQ ID NO: 794362 - RNA, 22 nt, Human
uggcccagagcacugcugggca

SEQ ID NO: 794363 - RNA, 22 nt, Human
aggccucuucagggagcaugga

SEQ ID NO: 794364 - RNA, 22 nt, Human
uuuucagagagcuuuuaugucc

SEQ ID NO: 794365 - RNA, 22 nt, Human
ucugugcugagcucugagaugu

SEQ ID NO: 794366 - RNA, 22 nt, Human
gagcagcuagauaaagcccuuc

SEQ ID NO: 794367 - RNA, 19 nt, Human
uucagugugcuggcuccug

SEQ ID NO: 794368 - RNA, 22 nt, Human
uuagaggggcugcugaauggga

SEQ ID NO: 794369 - RNA, 22 nt, Human
uaggaggguuagagggaaauau

SEQ ID NO: 794370 - RNA, 22 nt, Human
cccaggauggggcugcaguuau

SEQ ID NO: 794371 - RNA, 22 nt, Human
ugcacaguaaacaugacuggag

SEQ ID NO: 794372 - RNA, 22 nt, Human
ggcaugggguguauguggcacg

SEQ ID NO: 794373 - RNA, 22 nt, Human
gcauccuggcucuaggugucau

SEQ ID NO: 794374 - RNA, 22 nt, Human
gaggacaggagacucacuguuu

SEQ ID NO: 794375 - RNA, 22 nt, Human
guucuagguuagaaggacagau

SEQ ID NO: 794376 - RNA, 22 nt, Human
aaucaggagcuagggggcaaug

SEQ ID NO: 794377 - RNA, 22 nt, Human
caagcagccccaacaugaggau

SEQ ID NO: 794378 - RNA, 22 nt, Human
gcauggcaagaucaggagacca

SEQ ID NO: 794379 - RNA, 22 nt, Human
cugugacuguguuggaugcaca

SEQ ID NO: 794380 - RNA, 22 nt, Human
ucuacuuuucccuauacaguuu

SEQ ID NO: 794381 - RNA, 22 nt, Human
ucccugaaacaucucuguggau

SEQ ID NO: 794382 - RNA, 22 nt, Human
uuccucagagagacagaaacua

SEQ ID NO: 794383 - RNA, 23 nt, Human
aggcugcagaagaauagggucau

SEQ ID NO: 794384 - RNA, 22 nt, Human
aagccaggauaaaguuguuuua

SEQ ID NO: 794385 - RNA, 22 nt, Human
uucaguguggcccaugaagagg

SEQ ID NO: 794386 - RNA, 22 nt, Human
aaagugcaaucaguuagaccau

SEQ ID NO: 794387 - RNA, 23 nt, Human
agccuuggagguugaggcugcag

SEQ ID NO: 794388 - RNA, 22 nt, Human
uagugucagagaaucuugguuu

SEQ ID NO: 794389 - RNA, 22 nt, Human
ggaggccagggacccagucagc

SEQ ID NO: 794390 - RNA, 22 nt, Human
gcucagcugcaccuggagagcc

SEQ ID NO: 794391 - RNA, 22 nt, Human
cuggaaguauaggggagaugau

SEQ ID NO: 794392 - RNA, 22 nt, Human
aaaauauuuuagggccaggaga

SEQ ID NO: 794393 - RNA, 22 nt, Human
gcuucuccucccgcucccaggc

SEQ ID NO: 794394 - RNA, 22 nt, Human
ggcagcuucuuaauauggagac

SEQ ID NO: 794395 - RNA, 18 nt, Human
acacaggcugacagcacc

SEQ ID NO: 794396 - RNA, 22 nt, Human
ugcuagggaagaacgagggaau

SEQ ID NO: 794397 - RNA, 22 nt, Human
agcucugggggaaagucugcuc

SEQ ID NO: 794398 - RNA, 22 nt, Human
cuggacauuucgcacccuucca

SEQ ID NO: 794399 - RNA, 22 nt, Human
aggagcugucagagugccagag

SEQ ID NO: 794400 - RNA, 22 nt, Human
auauauaugcugauggcugcca

SEQ ID NO: 794401 - RNA, 22 nt, Human
cacaggaaucagcauuaauggc

SEQ ID NO: 794402 - RNA, 16 nt, Human
ucagugucagcuccug

SEQ ID NO: 794403 - RNA, 22 nt, Human
uucauagugacaugcauucugg

SEQ ID NO: 794404 - RNA, 22 nt, Human
uuugcuuugggagguugucugg

SEQ ID NO: 794405 - RNA, 22 nt, Human
uagcuuuagaaauauucucaga

SEQ ID NO: 794406 - RNA, 22 nt, Human
agcuuucagucucugaaggaac

SEQ ID NO: 794407 - RNA, 22 nt, Human
gaaggcucuugaggccagguaa

SEQ ID NO: 794408 - RNA, 20 nt, Human
agucucucccagaaugagca

SEQ ID NO: 794409 - RNA, 22 nt, Human
uggcucagcugacucggcuucu

SEQ ID NO: 794410 - RNA, 22 nt, Human
ugcuugucaggauaagcucugg

SEQ ID NO: 794411 - RNA, 22 nt, Human
uuccagccuuuauccauccaga

SEQ ID NO: 794412 - RNA, 22 nt, Human
gaggagaggggcucccaagagc

SEQ ID NO: 794413 - RNA, 22 nt, Human
aucacaguuuugugccuugugg

SEQ ID NO: 794414 - RNA, 22 nt, Human
ugcaggaacuugguuuuacuca

SEQ ID NO: 794415 - RNA, 22 nt, Human
ggcaaaaaccauaauuacuuuu

SEQ ID NO: 794416 - RNA, 22 nt, Human
agauuauuuaagacaggaacca

SEQ ID NO: 794417 - RNA, 22 nt, Human
uaggcagauguuaacaggaaaa

SEQ ID NO: 794418 - RNA, 22 nt, Human
gugugcccgggggaagcaggug

SEQ ID NO: 794419 - RNA, 22 nt, Human
gccaggcuccccggaucccugg

SEQ ID NO: 794420 - RNA, 19 nt, Human
aggaggccaugccacuaga

SEQ ID NO: 794421 - RNA, 22 nt, Human
ucucucagggggaaggcugaag

SEQ ID NO: 794422 - RNA, 22 nt, Human
uuauuauugugaccugagaaug

SEQ ID NO: 794423 - RNA, 22 nt, Human
gggcaugguggcaggcaccugu

SEQ ID NO: 794424 - RNA, 22 nt, Human
acuuccagaauuagaauuuaag

SEQ ID NO: 794425 - RNA, 22 nt, Human
ucagagcuaaggggagagcaaa

SEQ ID NO: 794426 - RNA, 22 nt, Human
auuucugauacccggucacccu

SEQ ID NO: 794427 - RNA, 22 nt, Human
acugguugaagaaaagcuagua

SEQ ID NO: 794428 - RNA, 22 nt, Human
auugagaaaauucgagcaaguu

SEQ ID NO: 794429 - RNA, 22 nt, Human
ccagcugauucgguggugguug

SEQ ID NO: 794430 - RNA, 22 nt, Human
cugugcuggauucugaggcuac

SEQ ID NO: 794431 - RNA, 22 nt, Human
gcaccccuggacgguagggcca

SEQ ID NO: 794432 - RNA, 22 nt, Human
auguucuuguucaaaugucagu

SEQ ID NO: 794433 - RNA, 22 nt, Human
uggcgaggccaggccagggccu

SEQ ID NO: 794434 - RNA, 22 nt, Human
aagauacaucauucaggaguga

SEQ ID NO: 794435 - RNA, 22 nt, Human
gaaacauaguugagacacugcu

SEQ ID NO: 794436 - RNA, 22 nt, Human
auguaugucugaugcacaugca

SEQ ID NO: 794437 - RNA, 23 nt, Human
gaauacagagauaaauagaacac

SEQ ID NO: 794438 - RNA, 22 nt, Human
acuuuguuuucaugaaacagcu

SEQ ID NO: 794439 - RNA, 22 nt, Human
aguggggacaaugagagcaggu

SEQ ID NO: 794440 - RNA, 22 nt, Human
uguacuguauucaucuuuaacu

SEQ ID NO: 794441 - RNA, 22 nt, Human
aagugcaucacuacucauuaca

SEQ ID NO: 794442 - RNA, 22 nt, Human
aaaucagagugguuggucaucc

SEQ ID NO: 794443 - RNA, 22 nt, Human
ucucuuggagguucuuccuguu

SEQ ID NO: 794444 - RNA, 22 nt, Human
ucacucuggaguccgcuaccag

SEQ ID NO: 794445 - RNA, 22 nt, Human
uugccugugaacgcugaguccu

SEQ ID NO: 794446 - RNA, 22 nt, Human
gauucacaacugcccugaaggg

SEQ ID NO: 794447 - RNA, 22 nt, Human
cuguuuuauaaaguccaaaagu

SEQ ID NO: 794448 - RNA, 18 nt, Human
cuauuacaaugcaguggu

SEQ ID NO: 794449 - RNA, 22 nt, Human
uaugcacaacaugcagguuugu

SEQ ID NO: 794450 - RNA, 22 nt, Human
ccugugcugggugugagggaca

SEQ ID NO: 794451 - RNA, 22 nt, Human
agguccugaugaucucugagag

SEQ ID NO: 794452 - RNA, 22 nt, Human
cuggacuuuggcccaucugcca

SEQ ID NO: 794453 - RNA, 22 nt, Human
aacaugagugauaaaauuaccu

SEQ ID NO: 794454 - RNA, 22 nt, Human
aagacagagacucugcaacagg

SEQ ID NO: 794455 - RNA, 22 nt, Human
aauucacauccgaccaggucaa

SEQ ID NO: 794456 - RNA, 22 nt, Human
uccaggaggcagggcugugccc

SEQ ID NO: 794457 - RNA, 22 nt, Human
gccaguggagcacauggugaag

SEQ ID NO: 794458 - RNA, 22 nt, Human
gcaggcagagguggaggagaca

SEQ ID NO: 794459 - RNA, 22 nt, Human
gaauuuuaucuuauuacuugca

SEQ ID NO: 794460 - RNA, 22 nt, Human
gccuaggagacaagcgugaaag

SEQ ID NO: 794461 - RNA, 22 nt, Human
cuggggcucacuccagcccugg

SEQ ID NO: 794462 - RNA, 22 nt, Human
ugagcugggcugggcugagcug

SEQ ID NO: 794463 - RNA, 22 nt, Human
gaauaauugugaugcuugaagu

SEQ ID NO: 794464 - RNA, 22 nt, Human
gcugagagugggugcagugcuu

SEQ ID NO: 794465 - RNA, 22 nt, Human
aggggagccagggcugcgaguu

SEQ ID NO: 794466 - RNA, 22 nt, Human
cagcuccccucuguggggcagu

SEQ ID NO: 794467 - RNA, 22 nt, Human
agcuccaggauaagacaggugc

SEQ ID NO: 794468 - RNA, 21 nt, Human
auuuucucuggaugaugguca

SEQ ID NO: 794469 - RNA, 22 nt, Human
gguggcaggcuggcauuggcaa

SEQ ID NO: 794470 - RNA, 22 nt, Human
uaacaguguguccagucaguuu

SEQ ID NO: 794471 - RNA, 22 nt, Human
aggcaguguguagcuggaagag

SEQ ID NO: 794472 - RNA, 22 nt, Human
caggagcuacucagguuggguu

SEQ ID NO: 794473 - RNA, 20 nt, Human
guccagaguaaugugcugac

SEQ ID NO: 794474 - RNA, 22 nt, Human
aauacauauggaauuccauguu

SEQ ID NO: 794475 - RNA, 22 nt, Human
uucaagaugcacaguggcauuc

SEQ ID NO: 794476 - RNA, 22 nt, Human
agccagcuaagggaagcaugau

SEQ ID NO: 794477 - RNA, 22 nt, Human
cagcuggccccacaguagaggc

SEQ ID NO: 794478 - RNA, 22 nt, Human
cuggucaccagguagcauugua

SEQ ID NO: 794479 - RNA, 22 nt, Human
ccacuguaaguuugaaaauaac

SEQ ID NO: 794480 - RNA, 22 nt, Human
cccuaggaauucuauggccaag

SEQ ID NO: 794481 - RNA, 22 nt, Human
aacugcaauuacuuuugcgcca

SEQ ID NO: 794482 - RNA, 22 nt, Human
cacugugggguuuggcuggaac

SEQ ID NO: 794483 - RNA, 22 nt, Human
uauaccaaaaaaauucuugucu

SEQ ID NO: 794484 - RNA, 22 nt, Human
aggaagcugccugggaugggaa

SEQ ID NO: 794485 - RNA, 21 nt, Human
gggcuggaggaugggaagccc

SEQ ID NO: 794486 - RNA, 22 nt, Human
auugucuucuggucuuaucuuu

SEQ ID NO: 794487 - RNA, 22 nt, Human
uccuggcccuguggccugcagu

SEQ ID NO: 794488 - RNA, 22 nt, Human
ugucauuuugucucacugcuau

SEQ ID NO: 794489 - RNA, 22 nt, Human
uugcugcucccaagaggcagcu

SEQ ID NO: 794490 - RNA, 22 nt, Human
agaaggcuggcccuggguggcc

SEQ ID NO: 794491 - RNA, 22 nt, Human
cucuccagucauauucucaguc

SEQ ID NO: 794492 - RNA, 22 nt, Human
ccagggcauguaacuaauggug

SEQ ID NO: 794493 - RNA, 22 nt, Human
uuccuuuuuacauaaucacauu

SEQ ID NO: 794494 - RNA, 22 nt, Human
cucaggaugcaauuccaucaag

SEQ ID NO: 794495 - RNA, 22 nt, Human
aaugucaaaggcuauacauuca

SEQ ID NO: 794496 - RNA, 22 nt, Human
aauagcaccugagguaguuugu

SEQ ID NO: 794497 - RNA, 22 nt, Human
gggagccacucagcugagaguu

SEQ ID NO: 794498 - RNA, 22 nt, Human
guuguuuuauugugagucccau

SEQ ID NO: 794499 - RNA, 22 nt, Human
ucgaaauaauuuagaauauaga

SEQ ID NO: 794500 - RNA, 22 nt, Human
gcagcaccaaccagggccuguu

SEQ ID NO: 794501 - RNA, 22 nt, Human
aggcugcucaguagauggagcu

SEQ ID NO: 794502 - RNA, 22 nt, Human
uggcaaugaggucagaugucuu

SEQ ID NO: 794503 - RNA, 22 nt, Human
gcagaaguuaaucgaaggccau

SEQ ID NO: 794504 - RNA, 17 nt, Human
uugggagagaaagguau

SEQ ID NO: 794505 - RNA, 22 nt, Human
ccagagcuccagggcuacagaa

SEQ ID NO: 794506 - RNA, 22 nt, Human
agccacagucugaugccugaga

SEQ ID NO: 794507 - RNA, 22 nt, Human
cugggaccugugugccugggcc

SEQ ID NO: 794508 - RNA, 22 nt, Human
cagaagugauguugagcuaguc

SEQ ID NO: 794509 - RNA, 22 nt, Human
caaaauguucuggcaccuuuaa

SEQ ID NO: 794510 - RNA, 19 nt, Human
cucuggagaacaauagugc

SEQ ID NO: 794511 - RNA, 22 nt, Human
uaccauaacguaaugaacuuga

SEQ ID NO: 794512 - RNA, 22 nt, Human
cugggagcuagcucugagcuga

SEQ ID NO: 794513 - RNA, 19 nt, Human
ccucacccugcagaggagg

SEQ ID NO: 794514 - RNA, 22 nt, Human
auagacacauguuauuauacuu

SEQ ID NO: 794515 - RNA, 22 nt, Human
ugaucccaaucuuuccugcucc

SEQ ID NO: 794516 - RNA, 22 nt, Human
caggguucuggaauauaaugug

SEQ ID NO: 794517 - RNA, 22 nt, Human
ugaaauguuuggguccagaagu

SEQ ID NO: 794518 - RNA, 22 nt, Human
uagccucucuccuccacaaccu

SEQ ID NO: 794519 - RNA, 22 nt, Human
gcagauggcgcaguggaaguuc

SEQ ID NO: 794520 - RNA, 22 nt, Human
gaaaugaacugauuaucauugc

SEQ ID NO: 794521 - RNA, 22 nt, Human
cuggagcugucuucacaggccu

SEQ ID NO: 794522 - RNA, 22 nt, Human
agguggagaagagaugggcagu

SEQ ID NO: 794523 - RNA, 22 nt, Human
aguuuuaugcaguguucugaua

SEQ ID NO: 794524 - RNA, 22 nt, Human
caugauuauguguuagaguuug

SEQ ID NO: 794525 - RNA, 22 nt, Human
cugaagcaggaacagcgagauu

SEQ ID NO: 794526 - RNA, 22 nt, Human
acccagccauguucaguucucu

SEQ ID NO: 794527 - RNA, 22 nt, Human
ugagaguacuuauaugaacauu

SEQ ID NO: 794528 - RNA, 22 nt, Human
agcaagcugucaagagagcuga

SEQ ID NO: 794529 - RNA, 22 nt, Human
cauguuggugugcugcacccau

SEQ ID NO: 794530 - RNA, 22 nt, Human
gcauaugaucacgugugucggu

SEQ ID NO: 794531 - RNA, 18 nt, Human
aaugcaauguauuugcag

SEQ ID NO: 794532 - RNA, 23 nt, Human
gacacaggagcacccagcugagc

SEQ ID NO: 794533 - RNA, 22 nt, Human
ucaaaucuuuaacaugugcaaa

SEQ ID NO: 794534 - RNA, 22 nt, Human
ucccaggcgccugguggggagc

SEQ ID NO: 794535 - RNA, 22 nt, Human
uuccuuccacuucaggauuuug

SEQ ID NO: 794536 - RNA, 22 nt, Human
ucuuccuuucauucauguguua

SEQ ID NO: 794537 - RNA, 22 nt, Human
cuggguugcaaagcgcuggcug

SEQ ID NO: 794538 - RNA, 22 nt, Human
aaugucagccugaaagcuauuc

SEQ ID NO: 794539 - RNA, 22 nt, Human
agguccagagguugaacggugg

SEQ ID NO: 794540 - RNA, 22 nt, Human
uuauuauagauuaugcaagauu

SEQ ID NO: 794541 - RNA, 20 nt, Human
augcagcuggaguuggggug

SEQ ID NO: 794542 - RNA, 22 nt, Human
ugucauuucacaauaucacuca

SEQ ID NO: 794543 - RNA, 17 nt, Human
cugcuggcuggggcuug

SEQ ID NO: 794544 - RNA, 22 nt, Human
agugcauuauauguuucaaugg

SEQ ID NO: 794545 - RNA, 22 nt, Human
uggggaccagauuagaccaugg

SEQ ID NO: 794546 - RNA, 22 nt, Human
ugagcugggaagagcagccaga

SEQ ID NO: 794547 - RNA, 22 nt, Human
acaguacaagcaugauacauaa

SEQ ID NO: 794548 - RNA, 22 nt, Human
aacaacaacggagaaaggguug

SEQ ID NO: 794549 - RNA, 22 nt, Human
auuugucaguggaagugauuca

SEQ ID NO: 794550 - RNA, 22 nt, Human
aauaauagcagaguuuacaauc

SEQ ID NO: 794551 - RNA, 17 nt, Human
cugauuuauuagcagac

SEQ ID NO: 794552 - RNA, 22 nt, Human
gcggucggcagaggggcucugc

SEQ ID NO: 794553 - RNA, 22 nt, Human
gccauccucugagcacuaggca

SEQ ID NO: 794554 - RNA, 22 nt, Human
agcaggugagcacagccaggcu

SEQ ID NO: 794555 - RNA, 19 nt, Human
uuuuccuucuccucuuaau

SEQ ID NO: 794556 - RNA, 22 nt, Human
uugcauaugaagcugacuuaaa

SEQ ID NO: 794557 - RNA, 22 nt, Human
uuuucauuuuuguagaugcaag

SEQ ID NO: 794558 - RNA, 22 nt, Human
cuguucuucugggaauggcccu

SEQ ID NO: 794559 - RNA, 22 nt, Human
ucagggcauacucuucaagguc

SEQ ID NO: 794560 - RNA, 22 nt, Human
ucuuucccuguguuagccugua

SEQ ID NO: 794561 - RNA, 22 nt, Human
cuucaaggcuuauuccaguugu

SEQ ID NO: 794562 - RNA, 22 nt, Human
gaaaaggcugcccacuuauuga

SEQ ID NO: 794563 - RNA, 23 nt, Human
cagaagcaccuguugacugcugc

SEQ ID NO: 794564 - RNA, 22 nt, Human
ucaggcugagaaaaucuggacc

SEQ ID NO: 794565 - RNA, 22 nt, Human
guaaaacauguuuuaacuagga

SEQ ID NO: 794566 - RNA, 22 nt, Human
aguucaaagucaaggaaacugu

SEQ ID NO: 794567 - RNA, 22 nt, Human
aaucaggauaugaacccaggua

SEQ ID NO: 794568 - RNA, 22 nt, Human
uggcccugaggggcugugcccc

SEQ ID NO: 794569 - RNA, 22 nt, Human
auucuuauuauaguaaaacagu

SEQ ID NO: 794570 - RNA, 23 nt, Human
uaaaguggcgcuguuacugccag

SEQ ID NO: 794571 - RNA, 22 nt, Human
gacaguaagucagagacuuggu

SEQ ID NO: 794572 - RNA, 22 nt, Human
aguaaaauuguauuggaaaaca

SEQ ID NO: 794573 - RNA, 22 nt, Human
aaguuugugguuauacuugauu

SEQ ID NO: 794574 - RNA, 20 nt, Human
ucugggcagggcacauggaa

SEQ ID NO: 794575 - RNA, 22 nt, Human
ccagugucuagucacagguacu

SEQ ID NO: 794576 - RNA, 22 nt, Human
uggaaggggccaggcgcggagu

SEQ ID NO: 794577 - RNA, 22 nt, Human
ugauguucaacaaguacauauu

SEQ ID NO: 794578 - RNA, 22 nt, Human
aaaauagcaugaaaggccuuug

SEQ ID NO: 794579 - RNA, 21 nt, Human
ccauugagaccauggaggagu

SEQ ID NO: 794580 - RNA, 22 nt, Human
agucuuaugguuaaauagaugc

SEQ ID NO: 794581 - RNA, 22 nt, Human
ccagaggagggcucugaugagg

SEQ ID NO: 794582 - RNA, 22 nt, Human
uaggaaauuggaaacucuucac

SEQ ID NO: 794583 - RNA, 22 nt, Human
ugggccacggggguggagagcu

SEQ ID NO: 794584 - RNA, 21 nt, Human
augggcagaggcagagaggcu

SEQ ID NO: 794585 - RNA, 22 nt, Human
ucauuuauuugacuuuggagug

SEQ ID NO: 794586 - RNA, 21 nt, Human
uggggaggggaccugauuaug

SEQ ID NO: 794587 - RNA, 22 nt, Human
uuguguuaaggugcaucuagug

SEQ ID NO: 794588 - RNA, 22 nt, Human
aggcucugggaagcagugaguu

SEQ ID NO: 794589 - RNA, 20 nt, Human
ucacaucuggcagcugauga

SEQ ID NO: 794590 - RNA, 22 nt, Human
uucaaagaccuuacuuggcaaa

SEQ ID NO: 794591 - RNA, 22 nt, Human
uuuucaagagaguguucuaugu

SEQ ID NO: 794592 - RNA, 22 nt, Human
acaaaguccugguguauggcca

SEQ ID NO: 794593 - RNA, 22 nt, Human
uacaaagucacauugaaaugaa

SEQ ID NO: 794594 - RNA, 22 nt, Human
uuugucuuguaaguuaaauuca

SEQ ID NO: 794595 - RNA, 22 nt, Human
aggaggcaggaagucuauggga

SEQ ID NO: 794596 - RNA, 22 nt, Human
aaaggaaugagcuucuguuagg

SEQ ID NO: 794597 - RNA, 22 nt, Human
ucuuccagcaaugugaaaucac

SEQ ID NO: 794598 - RNA, 17 nt, Human
uccuggcaguccccugg

SEQ ID NO: 794599 - RNA, 22 nt, Human
ucaggggagguugaaucgucuc

SEQ ID NO: 794600 - RNA, 22 nt, Human
caagaaaugggauuugacugcc

SEQ ID NO: 794601 - RNA, 21 nt, Human
ggugggcacaggagagcagag

SEQ ID NO: 794602 - RNA, 22 nt, Human
uauuucuuuucgugacuuauug

SEQ ID NO: 794603 - RNA, 22 nt, Human
acagaauuaacauuugaugaau

SEQ ID NO: 794604 - RNA, 22 nt, Human
caggcuccacuguaggcagcuc

SEQ ID NO: 794605 - RNA, 22 nt, Human
uccuggggaggguucuggcucc

SEQ ID NO: 794606 - RNA, 22 nt, Human
gccugcccugaaagaggugaag

SEQ ID NO: 794607 - RNA, 22 nt, Human
uccccaccccagaacuacuagg

SEQ ID NO: 794608 - RNA, 22 nt, Human
cacagcugaaguagccaugugg

SEQ ID NO: 794609 - RNA, 22 nt, Human
acaguagauggcucagagacag

SEQ ID NO: 794610 - RNA, 22 nt, Human
ggccugaggcgucccagcugug

SEQ ID NO: 794611 - RNA, 17 nt, Human
ccucccacaccgcccug

SEQ ID NO: 794612 - RNA, 20 nt, Human
cuccaguguucaggggagug

SEQ ID NO: 794613 - RNA, 23 nt, Human
cuguuaaauuccuuaagagcagg

SEQ ID NO: 794614 - RNA, 22 nt, Human
ugcuuaauauugugauguaaua

SEQ ID NO: 794615 - RNA, 22 nt, Human
uuucuuugagucucaguuugcu

SEQ ID NO: 794616 - RNA, 20 nt, Human
uuucauugucagaaucuuau

SEQ ID NO: 794617 - RNA, 22 nt, Human
guacauuuacugaugaaaagua

SEQ ID NO: 794618 - RNA, 22 nt, Human
aagcucauuaauuagaagcuaa

SEQ ID NO: 794619 - RNA, 23 nt, Human
agaggccagccuuuggagacacc

SEQ ID NO: 794620 - RNA, 17 nt, Human
caaauccuaggaugucu

SEQ ID NO: 794621 - RNA, 22 nt, Human
aucauacauguaacuaaguaaa

SEQ ID NO: 794622 - RNA, 22 nt, Human
agcauuccacacugaagucugc

SEQ ID NO: 794623 - RNA, 22 nt, Human
uucagagguagagaggaucuug

SEQ ID NO: 794624 - RNA, 22 nt, Human
aacacagaguauuugaagcauu

SEQ ID NO: 794625 - RNA, 22 nt, Human
ggagcccugcccuaggcagcuc

SEQ ID NO: 794626 - RNA, 22 nt, Human
aguauacuccccauccuagaaa

SEQ ID NO: 794627 - RNA, 20 nt, Human
ugagggaguauugauuuccc

SEQ ID NO: 794628 - RNA, 22 nt, Human
auucugaguuagagucagccag

SEQ ID NO: 794629 - RNA, 22 nt, Human
gagcuggaggaccaggacuggg

SEQ ID NO: 794630 - RNA, 22 nt, Human
gaggcugggggcugccuuccuc

SEQ ID NO: 794631 - RNA, 22 nt, Human
uuugagaagaguuugagguauu

SEQ ID NO: 794632 - RNA, 22 nt, Human
ucuauuacuuaccacuaauuca

SEQ ID NO: 794633 - RNA, 22 nt, Human
ugcuggcugucccuaccuggcu

SEQ ID NO: 794634 - RNA, 22 nt, Human
ugaaggaaugagggaguggguc

SEQ ID NO: 794635 - RNA, 22 nt, Human
cagcagccuggccccuccucgg

SEQ ID NO: 794636 - RNA, 22 nt, Human
aaacaagucacuuuaucuugaa

SEQ ID NO: 794637 - RNA, 22 nt, Human
ugucuuuauauauuuggaaaau

SEQ ID NO: 794638 - RNA, 22 nt, Human
aagagucacuccauaaauccca

SEQ ID NO: 794639 - RNA, 22 nt, Human
uuacacagugguuaagucuggg

SEQ ID NO: 794640 - RNA, 22 nt, Human
cacaggagauugaucuauuggu

SEQ ID NO: 794641 - RNA, 22 nt, Human
uggcaccuggugcaggguggcc

SEQ ID NO: 794642 - RNA, 22 nt, Human
uucucaggucaccagggugcca

SEQ ID NO: 794643 - RNA, 22 nt, Human
ucauugaguugcacuuuuacua

SEQ ID NO: 794644 - RNA, 22 nt, Human
gccaggcaggccacgcuguguu

SEQ ID NO: 794645 - RNA, 22 nt, Human
ugucacagggauaccauggggc

SEQ ID NO: 794646 - RNA, 22 nt, Human
uucauguaacuuuucuucucca

SEQ ID NO: 794647 - RNA, 22 nt, Human
gcaagcuguccuuuugcauggc

SEQ ID NO: 794648 - RNA, 22 nt, Human
gcagcuuuguggagaggcccau

SEQ ID NO: 794649 - RNA, 22 nt, Human
gguauaaaugaucagaucgcug

SEQ ID NO: 794650 - RNA, 22 nt, Human
aggcuuugcaaaaaagcucaua

SEQ ID NO: 794651 - RNA, 22 nt, Human
gucugaggguugugcuggagga

SEQ ID NO: 794652 - RNA, 22 nt, Human
acuuuacaagcuuauagccuag

SEQ ID NO: 794653 - RNA, 22 nt, Human
uauagacuagcagcagaauuua

SEQ ID NO: 794654 - RNA, 22 nt, Human
ccugggucuguauugguaggua

SEQ ID NO: 794655 - RNA, 22 nt, Human
caaaguacagugcuuccuggga

SEQ ID NO: 794656 - RNA, 23 nt, Human
ucacauaauccuucauccacagg

SEQ ID NO: 794657 - RNA, 22 nt, Human
ccugccuggaucagccauccug

SEQ ID NO: 794658 - RNA, 22 nt, Human
aaaugccaaggagagacuguua

SEQ ID NO: 794659 - RNA, 22 nt, Human
agucugggagggaugccagugu

SEQ ID NO: 794660 - RNA, 22 nt, Human
cugcaaaucaaguucuuauaau

SEQ ID NO: 794661 - RNA, 22 nt, Human
agccagcuaccggggcuccugg

SEQ ID NO: 794662 - RNA, 22 nt, Human
ccagaggugagggggauucuug

SEQ ID NO: 794663 - RNA, 22 nt, Human
uauacagucuuuugcuauauuc

SEQ ID NO: 794664 - RNA, 22 nt, Human
cagagcaggcccacugcccucc

SEQ ID NO: 794665 - RNA, 22 nt, Human
auuugcauuuacauagcauaga

SEQ ID NO: 794666 - RNA, 22 nt, Human
ccugaccuauuuuucucagcug

SEQ ID NO: 794667 - RNA, 22 nt, Human
aguucaguaguccuucauugua

SEQ ID NO: 794668 - RNA, 22 nt, Human
acacauuugcuaaaaugagcuc

SEQ ID NO: 794669 - RNA, 22 nt, Human
ggggagcaggcugggcugucug

SEQ ID NO: 794670 - RNA, 22 nt, Human
augcagaauugcuaaguaucug

SEQ ID NO: 794671 - RNA, 22 nt, Human
cuggcuccaaggaagagguuuu

SEQ ID NO: 794672 - RNA, 18 nt, Human
auguuccugaggagaggu

SEQ ID NO: 794673 - RNA, 20 nt, Human
ggcugcugugggcagagagg

SEQ ID NO: 794674 - RNA, 22 nt, Human
ggugggcaacauuuggccugag

SEQ ID NO: 794675 - RNA, 22 nt, Human
guggaagggucacagccccuac

SEQ ID NO: 794676 - RNA, 22 nt, Human
uguacaaaguuaaaccuauaua

SEQ ID NO: 794677 - RNA, 21 nt, Human
caugauaaugaagguguuauu

SEQ ID NO: 794678 - RNA, 21 nt, Human
ugggccagaucugaguuucua

SEQ ID NO: 794679 - RNA, 22 nt, Human
gccaggcuggccagcaccuucu

SEQ ID NO: 794680 - RNA, 22 nt, Human
agccagggugggugaaugcuau

SEQ ID NO: 794681 - RNA, 22 nt, Human
aggcuuuacugccucaggacuc

SEQ ID NO: 794682 - RNA, 22 nt, Human
agcugccgaugcccagcugcau

SEQ ID NO: 794683 - RNA, 22 nt, Human
uuuuuuccugagccuugugguc

SEQ ID NO: 794684 - RNA, 22 nt, Human
aauauuaucaaaagcuuuuuca

SEQ ID NO: 794685 - RNA, 22 nt, Human
gccucugcaccaguacugugcc

SEQ ID NO: 794686 - RNA, 22 nt, Human
ugucugaacgaaguagguccac

SEQ ID NO: 794687 - RNA, 22 nt, Human
ucauaaauuaucuauuuggcua

SEQ ID NO: 794688 - RNA, 18 nt, Human
gcugccugcauuccucac

SEQ ID NO: 794689 - RNA, 22 nt, Human
cuuuggaggaaaauugagguca

SEQ ID NO: 794690 - RNA, 22 nt, Human
ugacaauuguugugaauucuuc

SEQ ID NO: 794691 - RNA, 22 nt, Human
caggguggaaaagcuaguugga

SEQ ID NO: 794692 - RNA, 18 nt, Human
caguggugcugggaugug

SEQ ID NO: 794693 - RNA, 22 nt, Human
cuggcacaugcucccugagugg

SEQ ID NO: 794694 - RNA, 22 nt, Human
ucagcaggcaccggaaguguuu

SEQ ID NO: 794695 - RNA, 22 nt, Human
gccacagcagggcccucucagg

SEQ ID NO: 794696 - RNA, 22 nt, Human
caaaugcaaaauauaacccugu

SEQ ID NO: 794697 - RNA, 22 nt, Human
aaguaucuuucuagcaacuaaa

SEQ ID NO: 794698 - RNA, 22 nt, Human
uauucacaaaaugagguccuca

SEQ ID NO: 794699 - RNA, 22 nt, Human
uuucacauccugaagccccacu

SEQ ID NO: 794700 - RNA, 22 nt, Human
gccuuggcuguuggagcuugau

SEQ ID NO: 794701 - RNA, 22 nt, Human
gaaugcuuggaaccugaaguuc

SEQ ID NO: 794702 - RNA, 22 nt, Human
uggccaggccucuuggugccca

SEQ ID NO: 794703 - RNA, 20 nt, Human
caaaagcaaugaaguuauga

SEQ ID NO: 794704 - RNA, 22 nt, Human
caggcuggcaaugcgucaagca

SEQ ID NO: 794705 - RNA, 21 nt, Human
cagcagaagcaucuauggaag

SEQ ID NO: 794706 - RNA, 22 nt, Human
gccaggccacucccggguccug

SEQ ID NO: 794707 - RNA, 22 nt, Human
auuauucuuaugucaucauggc

SEQ ID NO: 794708 - RNA, 22 nt, Human
aggaagggauacauaggauagu

SEQ ID NO: 794709 - RNA, 19 nt, Human
guuguuuuucuuauuaugg

SEQ ID NO: 794710 - RNA, 22 nt, Human
ugggcugcggauaggccucgga

SEQ ID NO: 794711 - RNA, 22 nt, Human
cccuggccagcucaugucugag

SEQ ID NO: 794712 - RNA, 19 nt, Human
ccagggcuccaagcugagu

SEQ ID NO: 794713 - RNA, 22 nt, Human
cagucagaaggaagaugcuuaa

SEQ ID NO: 794714 - RNA, 22 nt, Human
cuggcucccagcuuucagggag

SEQ ID NO: 794715 - RNA, 19 nt, Human
uagcccagagccuggcuac

SEQ ID NO: 794716 - RNA, 22 nt, Human
aaugauaccgccaauauuacca

SEQ ID NO: 794717 - RNA, 22 nt, Human
gaaagugccagaauaggaggcc

SEQ ID NO: 794718 - RNA, 22 nt, Human
ccagccagcaagcucccaguuc

SEQ ID NO: 794719 - RNA, 22 nt, Human
uuucuuuaaaggaacucuguuu

SEQ ID NO: 794720 - RNA, 22 nt, Human
aacacuuaaggagagaucaaau

SEQ ID NO: 794721 - RNA, 22 nt, Human
acgagguuggagaguuguuugg

SEQ ID NO: 794722 - RNA, 22 nt, Human
uggcuggcuuguucacugacug

SEQ ID NO: 794723 - RNA, 22 nt, Human
agaucagaaauguaauggcagu

SEQ ID NO: 794724 - RNA, 22 nt, Human
ucaggcagaaaaaucacuaauu

SEQ ID NO: 794725 - RNA, 22 nt, Human
auaaacucaugccaagaaauga

SEQ ID NO: 794726 - RNA, 22 nt, Human
cagcagccuacaaugcacagaa

SEQ ID NO: 794727 - RNA, 20 nt, Human
ggcuuccccgccaucuuccg

SEQ ID NO: 794728 - RNA, 22 nt, Human
gagucuuucugggcuuguucuu

SEQ ID NO: 794729 - RNA, 22 nt, Human
ugugaaccuuggugagucagua

SEQ ID NO: 794730 - RNA, 22 nt, Human
aggugaaguugaggaggcagaa

SEQ ID NO: 794731 - RNA, 19 nt, Human
accuucugggaaacauucc

SEQ ID NO: 794732 - RNA, 20 nt, Human
cccaggagcugugccccauc

SEQ ID NO: 794733 - RNA, 22 nt, Human
cagggugccucccgcucgccgg

SEQ ID NO: 794734 - RNA, 23 nt, Human
ugcugguguuuuugggaccaggg

SEQ ID NO: 794735 - RNA, 22 nt, Human
caggaaauagacacuguaugau

SEQ ID NO: 794736 - RNA, 22 nt, Human
cugcuaggguucagcagugccu

SEQ ID NO: 794737 - RNA, 21 nt, Human
agguaccaaaagccugcauga

SEQ ID NO: 794738 - RNA, 22 nt, Human
gccaagcuggaugaagagguug

SEQ ID NO: 794739 - RNA, 22 nt, Human
aggugcuguuggcagcgggcag

SEQ ID NO: 794740 - RNA, 22 nt, Human
gcuggcugagaucuguuuuccu

SEQ ID NO: 794741 - RNA, 22 nt, Human
uuguguuucccuugcauauucc

SEQ ID NO: 794742 - RNA, 22 nt, Human
uggagggcgcuuagauggaggg

SEQ ID NO: 794743 - RNA, 21 nt, Human
uuagaguugccauuauaugua

SEQ ID NO: 794744 - RNA, 22 nt, Human
augcuauacucaaagaaauuca

SEQ ID NO: 794745 - RNA, 22 nt, Human
cagccucuaagcacagccucuc

SEQ ID NO: 794746 - RNA, 18 nt, Human
cuccagggaacucaguca

SEQ ID NO: 794747 - RNA, 22 nt, Human
aucauuuugugacaaugccugu

SEQ ID NO: 794748 - RNA, 22 nt, Human
uaggauuuauucuacaauauug

SEQ ID NO: 794749 - RNA, 22 nt, Human
cacgcacgcuggguggaggcgc

SEQ ID NO: 794750 - RNA, 22 nt, Human
ugcugugguucccagaguggau

SEQ ID NO: 794751 - RNA, 22 nt, Human
cagugauuuucucagaacuuga

SEQ ID NO: 794752 - RNA, 22 nt, Human
gaggcagugcauugucuagggg

SEQ ID NO: 794753 - RNA, 22 nt, Human
gcugagacuuccacugccaucu

SEQ ID NO: 794754 - RNA, 22 nt, Human
gccaggcaugggcuucugggcg

SEQ ID NO: 794755 - RNA, 22 nt, Human
caguaacugaugugaucaaacg

SEQ ID NO: 794756 - RNA, 22 nt, Human
uuucauaaacaguagaagacua

SEQ ID NO: 794757 - RNA, 22 nt, Human
ugaguggagacuguguguagag

SEQ ID NO: 794758 - RNA, 22 nt, Human
aggcacagaauggcauucagug

SEQ ID NO: 794759 - RNA, 22 nt, Human
gacaggccaggggcugaggugg

SEQ ID NO: 794760 - RNA, 22 nt, Human
ugugggcaaaggguagcugggu

SEQ ID NO: 794761 - RNA, 22 nt, Human
ucccaucaucuguucuggcuac

SEQ ID NO: 794762 - RNA, 22 nt, Human
augucacaguugcaacaugaau

SEQ ID NO: 794763 - RNA, 21 nt, Human
uuccuggggaaggagcugccu

SEQ ID NO: 794764 - RNA, 19 nt, Human
agggccugcagcucaagcu

SEQ ID NO: 794765 - RNA, 22 nt, Human
ucaaaugagaggcagggcagcu

SEQ ID NO: 794766 - RNA, 22 nt, Human
ggcaguagccagggacuggcag

SEQ ID NO: 794767 - RNA, 22 nt, Human
agcccagcuuugaaccauauca

SEQ ID NO: 794768 - RNA, 22 nt, Human
augaaauuaaucaacacauaca

SEQ ID NO: 794769 - RNA, 22 nt, Human
aggccaggccuuucuccauucc

SEQ ID NO: 794770 - RNA, 22 nt, Human
uggcccagcugcagauggugga

SEQ ID NO: 794771 - RNA, 22 nt, Human
uacuuuucauaaugaagcagca

SEQ ID NO: 794772 - RNA, 22 nt, Human
uaucuuaaaugcaugauagaca

SEQ ID NO: 794773 - RNA, 23 nt, Human
aggcuggcuucaggagccucucc

SEQ ID NO: 794774 - RNA, 22 nt, Human
ccucagcuugauuucugcagag

SEQ ID NO: 794775 - RNA, 22 nt, Human
uuuuaaugugcucugcaaugau

SEQ ID NO: 794776 - RNA, 22 nt, Human
aggcugagaaagugggaagaug

SEQ ID NO: 794777 - RNA, 22 nt, Human
aaggcagugguugugauacugu

SEQ ID NO: 794778 - RNA, 22 nt, Human
ccuggcucuagaggccacuccu

SEQ ID NO: 794779 - RNA, 22 nt, Human
cuccacagguguacuguaccuu

SEQ ID NO: 794780 - RNA, 22 nt, Human
ccugaggacaucagcaucaccu

SEQ ID NO: 794781 - RNA, 22 nt, Human
aguguuuugcuaauccuauuaa

SEQ ID NO: 794782 - RNA, 22 nt, Human
cacccaguaagcaugaggcccu

SEQ ID NO: 794783 - RNA, 22 nt, Human
cuggaggucuacagugguagcu

SEQ ID NO: 794784 - RNA, 22 nt, Human
ucaggagcuauggacugucaaa

SEQ ID NO: 794785 - RNA, 22 nt, Human
ugggcugcacccucagccucug

SEQ ID NO: 794786 - RNA, 22 nt, Human
gcacucugccaggucuccugau

SEQ ID NO: 794787 - RNA, 22 nt, Human
ggcuuaaaacuuugaaaguguu

SEQ ID NO: 794788 - RNA, 22 nt, Human
ccugcucugccaaguccucuuu

SEQ ID NO: 794789 - RNA, 22 nt, Human
cugaggagcaaccccgugcccu

SEQ ID NO: 794790 - RNA, 22 nt, Human
cagcagagcugugugggaaggg

SEQ ID NO: 794791 - RNA, 22 nt, Human
uggcuuccaaauuaucccuaga

SEQ ID NO: 794792 - RNA, 22 nt, Human
cugagaagcacugucugcaaga

SEQ ID NO: 794793 - RNA, 22 nt, Human
ucaggcacccucuauuuucauc

SEQ ID NO: 794794 - RNA, 22 nt, Human
cuugaauguaaauaauguacag

SEQ ID NO: 794795 - RNA, 22 nt, Human
gagaagcaaucaguggccaccc

SEQ ID NO: 794796 - RNA, 22 nt, Human
gcaggagcuggaaagugauguu

SEQ ID NO: 794797 - RNA, 22 nt, Human
cuggaaggagaaggaggcugug

SEQ ID NO: 794798 - RNA, 22 nt, Human
ggggugagaucaaggaagcccu

SEQ ID NO: 794799 - RNA, 18 nt, Human
uccagcaggucugaggug

SEQ ID NO: 794800 - RNA, 22 nt, Human
uuucauagccuucuaaugaguu

SEQ ID NO: 794801 - RNA, 22 nt, Human
ugcaagaggauuguaucaauaa

SEQ ID NO: 794802 - RNA, 22 nt, Human
gggcaggggucaguggccccaa

SEQ ID NO: 794803 - RNA, 21 nt, Human
agccaggguggacacuguaug

SEQ ID NO: 794804 - RNA, 22 nt, Human
ucucaaguuauguaacagcugu

SEQ ID NO: 794805 - RNA, 18 nt, Human
auuuuucccagauggaua

SEQ ID NO: 794806 - RNA, 22 nt, Human
aaagcagcaaguauuuguuacu

SEQ ID NO: 794807 - RNA, 22 nt, Human
aaaaaccuuucccauacuaaga

SEQ ID NO: 794808 - RNA, 22 nt, Human
uucaacucuucaagaucacauc

SEQ ID NO: 794809 - RNA, 22 nt, Human
ccuuguuucucucccagauaag

SEQ ID NO: 794810 - RNA, 22 nt, Human
gaauuuuaauaaagguuuauca

SEQ ID NO: 794811 - RNA, 22 nt, Human
agaaagacgugaugaagaagua

SEQ ID NO: 794812 - RNA, 21 nt, Human
caggcucugcuagaggagccu

SEQ ID NO: 794813 - RNA, 22 nt, Human
ccugggcuuucaaaaccagccu

SEQ ID NO: 794814 - RNA, 22 nt, Human
cuggagucuucagcuugcugcc

SEQ ID NO: 794815 - RNA, 22 nt, Human
gguucaguuuacauuaaaaucu

SEQ ID NO: 794816 - RNA, 22 nt, Human
agggcagcugugagccacugug

SEQ ID NO: 794817 - RNA, 22 nt, Human
uacacaggguauggcuugagga

SEQ ID NO: 794818 - RNA, 17 nt, Human
gcagccucuugguagug

SEQ ID NO: 794819 - RNA, 22 nt, Human
agccacaggccaugagauacca

SEQ ID NO: 794820 - RNA, 22 nt, Human
uggcacuugauauuugauuugc

SEQ ID NO: 794821 - RNA, 22 nt, Human
ggaacauaccgaaaauacuuaa

SEQ ID NO: 794822 - RNA, 22 nt, Human
gagcaaauggagcuugucuacu

SEQ ID NO: 794823 - RNA, 22 nt, Human
uagaaaguacuaaauuuaacug

SEQ ID NO: 794824 - RNA, 22 nt, Human
aucuuucuuauuugaagaaaga

SEQ ID NO: 794825 - RNA, 22 nt, Human
ccccagcacaggcuccucagau

SEQ ID NO: 794826 - RNA, 22 nt, Human
aguauacugaaaguaaauauga

SEQ ID NO: 794827 - RNA, 15 nt, Human
uggugguguugagac

SEQ ID NO: 794828 - RNA, 22 nt, Human
cucaaauaccucuccaugugac

SEQ ID NO: 794829 - RNA, 22 nt, Human
cuagaaaucucuguuuacauca

SEQ ID NO: 794830 - RNA, 22 nt, Human
uuacuugauuguggagucugag

SEQ ID NO: 794831 - RNA, 22 nt, Human
ucuggguguagggccuggcaac

SEQ ID NO: 794832 - RNA, 22 nt, Human
aaaacaguuauaaacagaguca

SEQ ID NO: 794833 - RNA, 22 nt, Human
caggaucccuggccuccgccca

SEQ ID NO: 794834 - RNA, 22 nt, Human
ucccaggcaggugacaggggga

SEQ ID NO: 794835 - RNA, 22 nt, Human
ucaggcugaaucauccuagcuu

SEQ ID NO: 794836 - RNA, 22 nt, Human
cuggugccuccucucccagguc

SEQ ID NO: 794837 - RNA, 22 nt, Human
aacauuucuucugaaacugagu

SEQ ID NO: 794838 - RNA, 22 nt, Human
auuucccuccagggaaagcuua

SEQ ID NO: 794839 - RNA, 22 nt, Human
agaugcagugguuaacaauaca

SEQ ID NO: 794840 - RNA, 22 nt, Human
ggcccagccuggcaacaaugac

SEQ ID NO: 794841 - RNA, 22 nt, Human
ccuggcucgcugaccucagggg

SEQ ID NO: 794842 - RNA, 22 nt, Human
cugucuguugaccauaguuugc

SEQ ID NO: 794843 - RNA, 22 nt, Human
ggucagugacuuuuuucugugg

SEQ ID NO: 794844 - RNA, 22 nt, Human
ucaggagggaguguggauagag

SEQ ID NO: 794845 - RNA, 23 nt, Human
aggcccagguauguuuguuuugg

SEQ ID NO: 794846 - RNA, 22 nt, Human
aucucacauccucaguagugca

SEQ ID NO: 794847 - RNA, 22 nt, Human
uaggaagguguuuuuaaggagc

SEQ ID NO: 794848 - RNA, 19 nt, Human
ucuuuagccagagcucugg

SEQ ID NO: 794849 - RNA, 22 nt, Human
cagguggguacaucacagagac

SEQ ID NO: 794850 - RNA, 23 nt, Human
acacugucucauggauagacugc

SEQ ID NO: 794851 - RNA, 22 nt, Human
gcugcuguugauuuaguccaau

SEQ ID NO: 794852 - RNA, 22 nt, Human
caggcagaguuagugauuuagg

SEQ ID NO: 794853 - RNA, 22 nt, Human
caauauauaggaacaacuuagg

SEQ ID NO: 794854 - RNA, 22 nt, Human
agcuuguuauaaaugcagaaug

SEQ ID NO: 794855 - RNA, 22 nt, Human
agcaggaccaagaaggggaaaa

SEQ ID NO: 794856 - RNA, 22 nt, Human
ggcaguguggcauaacauguag

SEQ ID NO: 794857 - RNA, 22 nt, Human
aggcuggagugugcaguggcgc

SEQ ID NO: 794858 - RNA, 22 nt, Human
acagcagggggagcuguuggac

SEQ ID NO: 794859 - RNA, 22 nt, Human
aaauauacuagaugaugaccca

SEQ ID NO: 794860 - RNA, 20 nt, Human
aacaaacuacaaaauuaugu

SEQ ID NO: 794861 - RNA, 22 nt, Human
cccagagagcacaggugguggg

SEQ ID NO: 794862 - RNA, 22 nt, Human
gaggguggcuccucccugggcc

SEQ ID NO: 794863 - RNA, 22 nt, Human
uggcagaaguucacuaguagcu

SEQ ID NO: 794864 - RNA, 23 nt, Human
ugcaugcuaacacagugcacagg

SEQ ID NO: 794865 - RNA, 22 nt, Human
uggacagcuugcagagccaccc

SEQ ID NO: 794866 - RNA, 22 nt, Human
auauuauucuagcucuugugug

SEQ ID NO: 794867 - RNA, 22 nt, Human
ugcagcugccuccuucccuugu

SEQ ID NO: 794868 - RNA, 22 nt, Human
agcagccuuagguauugugauu

SEQ ID NO: 794869 - RNA, 22 nt, Human
agcuguaugcccaagaugcuau

SEQ ID NO: 794870 - RNA, 19 nt, Human
ucagaaggcaggagaggcc

SEQ ID NO: 794871 - RNA, 22 nt, Human
uggcugugugccaggcugucug

SEQ ID NO: 794872 - RNA, 22 nt, Human
uaagacagggagggcucucagc

SEQ ID NO: 794873 - RNA, 22 nt, Human
gcucugaggcugggagcacucu

SEQ ID NO: 794874 - RNA, 22 nt, Human
aagcaggcaggguggagaguuu

SEQ ID NO: 794875 - RNA, 22 nt, Human
ggucagugcgauuucccacucc

SEQ ID NO: 794876 - RNA, 22 nt, Human
uguguucauguauguauacaua

SEQ ID NO: 794877 - RNA, 22 nt, Human
aagggggcccagcacuaaguug

SEQ ID NO: 794878 - RNA, 22 nt, Human
gcaggaaaaccuucccauguuu

SEQ ID NO: 794879 - RNA, 22 nt, Human
ggcagcuggguuggccagaaac

SEQ ID NO: 794880 - RNA, 22 nt, Human
aggcuuguuuuacuaaaagcaa

SEQ ID NO: 794881 - RNA, 21 nt, Human
ggcaugagggcagugagcaga

SEQ ID NO: 794882 - RNA, 20 nt, Human
caggcacacucauuccugcu

SEQ ID NO: 794883 - RNA, 22 nt, Human
ggcuccagauguccccuggcaa

SEQ ID NO: 794884 - RNA, 22 nt, Human
cuguauguuucuaugaauguga

SEQ ID NO: 794885 - RNA, 22 nt, Human
ucccugggcuucuccagacuug

SEQ ID NO: 794886 - RNA, 22 nt, Human
cuauuugggguagaagauggau

SEQ ID NO: 794887 - RNA, 22 nt, Human
uuuuaaguuaauauaauugagg

SEQ ID NO: 794888 - RNA, 22 nt, Human
agcugcuccuuggcugugguuc

SEQ ID NO: 794889 - RNA, 20 nt, Human
acccuccacuguucacugug

SEQ ID NO: 794890 - RNA, 22 nt, Human
cuuugcuucuccaaccugcuca

SEQ ID NO: 794891 - RNA, 22 nt, Human
cacagugauugauuuuuacuuu

SEQ ID NO: 794892 - RNA, 22 nt, Human
ccccuggguccaggcuucucug

SEQ ID NO: 794893 - RNA, 22 nt, Human
ggguugaggcggaugucggcgg

SEQ ID NO: 794894 - RNA, 22 nt, Human
acuggcaguuugagaaugcauu

SEQ ID NO: 794895 - RNA, 22 nt, Human
uauguauuauucaucaguggga

SEQ ID NO: 794896 - RNA, 22 nt, Human
cauucauucacauuuugucuau

SEQ ID NO: 794897 - RNA, 22 nt, Human
gccagcuguaucuuuggccagc

SEQ ID NO: 794898 - RNA, 22 nt, Human
acacagagcuggaacugcuuca

SEQ ID NO: 794899 - RNA, 22 nt, Human
gaaggcuuagaaacaagggagc

SEQ ID NO: 794900 - RNA, 22 nt, Human
cucagcagugacaagagaguau

SEQ ID NO: 794901 - RNA, 22 nt, Human
gagugucagugcuuggggcuac

SEQ ID NO: 794902 - RNA, 22 nt, Human
uaggguccugccuacagagaca

SEQ ID NO: 794903 - RNA, 22 nt, Human
uuuaaagagaaugugaaggagu

SEQ ID NO: 794904 - RNA, 22 nt, Human
acuuuaaagcagaauggcuaug

SEQ ID NO: 794905 - RNA, 22 nt, Human
cuggcugcaggaaggagugggc

SEQ ID NO: 794906 - RNA, 20 nt, Human
cgcccaggagggcccaugug

SEQ ID NO: 794907 - RNA, 22 nt, Human
uugccugcuacggucuucacug

SEQ ID NO: 794908 - RNA, 22 nt, Human
uuauucaccaguguaaaacacu

SEQ ID NO: 794909 - RNA, 22 nt, Human
gggcccagcacuggcugggauc

SEQ ID NO: 794910 - RNA, 22 nt, Human
aaaguuuaggcuuugaaaccag

SEQ ID NO: 794911 - RNA, 22 nt, Human
uggcagaauuucuagcagauuc

SEQ ID NO: 794912 - RNA, 22 nt, Human
ucaguaaaauuacagaucuaca

SEQ ID NO: 794913 - RNA, 22 nt, Human
aagggcagggaguuugugucua

SEQ ID NO: 794914 - RNA, 23 nt, Human
ugcuggaguuuacucaggccagc

SEQ ID NO: 794915 - RNA, 22 nt, Human
ugcacagaugggcuuguucaua

SEQ ID NO: 794916 - RNA, 22 nt, Human
ccugggagugucagacuugcuu

SEQ ID NO: 794917 - RNA, 22 nt, Human
ucagugucugugggcaggaugg

SEQ ID NO: 794918 - RNA, 22 nt, Human
gaguccucagauagaaagugcg

SEQ ID NO: 794919 - RNA, 22 nt, Human
auagcaaauauuuuaaugagca

SEQ ID NO: 794920 - RNA, 22 nt, Human
gguggguggaaacagcauguac

SEQ ID NO: 794921 - RNA, 22 nt, Human
uucacaguggcugacaggcugg

SEQ ID NO: 794922 - RNA, 22 nt, Human
caccucauggauaagauaaacu

SEQ ID NO: 794923 - RNA, 22 nt, Human
uucucuuuuagaggcuccauga

SEQ ID NO: 794924 - RNA, 20 nt, Human
uaaugcuuaacacauccccu

SEQ ID NO: 794925 - RNA, 22 nt, Human
acaauaguaagguauauuguca

SEQ ID NO: 794926 - RNA, 22 nt, Human
ugccccaggugcugagguugga

SEQ ID NO: 794927 - RNA, 22 nt, Human
gaggagcuucagaggaaucuua

SEQ ID NO: 794928 - RNA, 22 nt, Human
uucauuuaaucagaaucucuaa

SEQ ID NO: 794929 - RNA, 22 nt, Human
cagagcuguugcggggcuuggc

SEQ ID NO: 794930 - RNA, 22 nt, Human
ucauacaauucaaucucugauu

SEQ ID NO: 794931 - RNA, 22 nt, Human
uaaugcaguagguauuaaagaa

SEQ ID NO: 794932 - RNA, 22 nt, Human
ugcaaauguguggugaggcauu

SEQ ID NO: 794933 - RNA, 20 nt, Human
agacaaugagugacagaguu

SEQ ID NO: 794934 - RNA, 23 nt, Human
gaaaucuagucauuuuuagucug

SEQ ID NO: 794935 - RNA, 22 nt, Human
ucucauuugugugcaauucaga

SEQ ID NO: 794936 - RNA, 22 nt, Human
uaaauuaugucacaugacucug

SEQ ID NO: 794937 - RNA, 23 nt, Human
aggcuccacaugggcacuuugca

SEQ ID NO: 794938 - RNA, 22 nt, Human
ucagcaggcucugguugaccau

SEQ ID NO: 794939 - RNA, 22 nt, Human
uuucaugcucauggaacacagc

SEQ ID NO: 794940 - RNA, 22 nt, Human
acagccagucaucucagcaggg

SEQ ID NO: 794941 - RNA, 22 nt, Human
cagcucagcuuccugggugugu

SEQ ID NO: 794942 - RNA, 22 nt, Human
ugcaggaaacagaggcucaaau

SEQ ID NO: 794943 - RNA, 22 nt, Human
uggacucugaacuggcacugac

SEQ ID NO: 794944 - RNA, 23 nt, Human
uucauugauugcaaggagauugg

SEQ ID NO: 794945 - RNA, 22 nt, Human
uagaaaguaaaucaguuuuauu

SEQ ID NO: 794946 - RNA, 22 nt, Human
auacauuagcucauaugauuaa

SEQ ID NO: 794947 - RNA, 22 nt, Human
aagggcaggcagagaucauaua

SEQ ID NO: 794948 - RNA, 17 nt, Human
uguucucuucagaaauc

SEQ ID NO: 794949 - RNA, 22 nt, Human
ccugcugugugacgggauguua

SEQ ID NO: 794950 - RNA, 22 nt, Human
cugcugucuaguaucuuaaaaa

SEQ ID NO: 794951 - RNA, 22 nt, Human
aaauagacaggcuuaaauagga

SEQ ID NO: 794952 - RNA, 22 nt, Human
cgaaacaucuaugaucauuaau

SEQ ID NO: 794953 - RNA, 20 nt, Human
cuggggagcugcucccacga

SEQ ID NO: 794954 - RNA, 22 nt, Human
ugcaaggguagaagugauggca

SEQ ID NO: 794955 - RNA, 22 nt, Human
ggcaggcagccuccauccacag

SEQ ID NO: 794956 - RNA, 22 nt, Human
ugagccaguggaagauggcagu

SEQ ID NO: 794957 - RNA, 22 nt, Human
ccagggcuucaguuagugguga

SEQ ID NO: 794958 - RNA, 22 nt, Human
acuugaauucaaagcgaaagca

SEQ ID NO: 794959 - RNA, 22 nt, Human
uuaaauaguaggucuauuuugg

SEQ ID NO: 794960 - RNA, 22 nt, Human
cucccagggccaucgagucacu

SEQ ID NO: 794961 - RNA, 22 nt, Human
uuguaccagcucauuucagaac

SEQ ID NO: 794962 - RNA, 22 nt, Human
aauaccuuccacagugaccuug

SEQ ID NO: 794963 - RNA, 22 nt, Human
accuuuccuggcugaccgagga

SEQ ID NO: 794964 - RNA, 22 nt, Human
ucugagaauagugccacugugg

SEQ ID NO: 794965 - RNA, 22 nt, Human
gggcugggcaugguguucccuc

SEQ ID NO: 794966 - RNA, 23 nt, Human
uggcuggcagaaacugaagcaug

SEQ ID NO: 794967 - RNA, 22 nt, Human
acacacagaguuuauacaggca

SEQ ID NO: 794968 - RNA, 22 nt, Human
gaagccaagggcugcuuuuccu

SEQ ID NO: 794969 - RNA, 22 nt, Human
cagucccaguuugagacucugg

SEQ ID NO: 794970 - RNA, 22 nt, Human
uuuuaaacugcagaauuuagaa

SEQ ID NO: 794971 - RNA, 22 nt, Human
uaaguaaauuuauaaugugauu

SEQ ID NO: 794972 - RNA, 20 nt, Human
acacacuuugaucuugagcc

SEQ ID NO: 794973 - RNA, 22 nt, Human
cagacacacaagcaaucuaagu

SEQ ID NO: 794974 - RNA, 17 nt, Human
agcugccucucccacca

SEQ ID NO: 794975 - RNA, 22 nt, Human
ucagugucucauaugagguuuc

SEQ ID NO: 794976 - RNA, 22 nt, Human
ggcagcuuucaauaggguuaug

SEQ ID NO: 794977 - RNA, 22 nt, Human
ccaggcccugcuccucacacca

SEQ ID NO: 794978 - RNA, 22 nt, Human
gugagccaauaccaugcuguuc

SEQ ID NO: 794979 - RNA, 22 nt, Human
gccagugcuuguggagcuggca

SEQ ID NO: 794980 - RNA, 22 nt, Human
uggacaggauagugcaguacgc

SEQ ID NO: 794981 - RNA, 22 nt, Human
ccccagcagcaccuggggcagu

SEQ ID NO: 794982 - RNA, 22 nt, Human
aaaugcagaucccugaaucuca

SEQ ID NO: 794983 - RNA, 22 nt, Human
cgcagcugcacggggcugagcc

SEQ ID NO: 794984 - RNA, 22 nt, Human
uuuguggaacucucuucuugca

SEQ ID NO: 794985 - RNA, 22 nt, Human
aacaugcaaugucugaaaaucc

SEQ ID NO: 794986 - RNA, 22 nt, Human
aauaaagaauggaugagaucgu

SEQ ID NO: 794987 - RNA, 22 nt, Human
gagcagcuggcuguauugguuu

SEQ ID NO: 794988 - RNA, 22 nt, Human
auuaaauacugcaggcuaagca

SEQ ID NO: 794989 - RNA, 22 nt, Human
ucagaauuuucuggaauggagc

SEQ ID NO: 794990 - RNA, 22 nt, Human
caauuucauuaauagauauaga

SEQ ID NO: 794991 - RNA, 22 nt, Human
cagcaugguuggguucugggga

SEQ ID NO: 794992 - RNA, 17 nt, Human
cacuuuguugcuguggg

SEQ ID NO: 794993 - RNA, 22 nt, Human
uguaaaauaccauuccuuguca

SEQ ID NO: 794994 - RNA, 22 nt, Human
uuauauaucuugauuuguucca

SEQ ID NO: 794995 - RNA, 22 nt, Human
gacaguaacugagagauguaau

SEQ ID NO: 794996 - RNA, 22 nt, Human
cagcaaaauuugaggauugccu

SEQ ID NO: 794997 - RNA, 22 nt, Human
aaacagcaauggagaagccagg

SEQ ID NO: 794998 - RNA, 23 nt, Human
aaacugcaucucugagccucagc

SEQ ID NO: 794999 - RNA, 22 nt, Human
agaagccaacagggcaggagag

SEQ ID NO: 795000 - RNA, 22 nt, Human
cugcacauaguaaguacucaau

SEQ ID NO: 795001 - RNA, 22 nt, Human
agaaauguugaauacaucagga

SEQ ID NO: 795002 - RNA, 22 nt, Human
aaggcuccagugaaugcuggca

SEQ ID NO: 795003 - RNA, 22 nt, Human
aggaggaggugggacacaguga

SEQ ID NO: 795004 - RNA, 23 nt, Human
gcccacccucagcguccucacgg

SEQ ID NO: 795005 - RNA, 22 nt, Human
uguuucauuaguacugacaaua

SEQ ID NO: 795006 - RNA, 22 nt, Human
cgggugguuuucaucaagaugg

SEQ ID NO: 795007 - RNA, 22 nt, Human
auguuaaaugguuuauuauuaa

SEQ ID NO: 795008 - RNA, 18 nt, Human
cuacauucauaggaaagg

SEQ ID NO: 795009 - RNA, 22 nt, Human
auaguacaaucaguuaauuagu

SEQ ID NO: 795010 - RNA, 22 nt, Human
uucuggaaaugcacaacuaauu

SEQ ID NO: 795011 - RNA, 22 nt, Human
gggugaggagcugccagucaug

SEQ ID NO: 795012 - RNA, 22 nt, Human
ugccuucuucucccuggcucag

SEQ ID NO: 795013 - RNA, 22 nt, Human
agucaucaucugcccucacugg

SEQ ID NO: 795014 - RNA, 22 nt, Human
ugucuaggucuagguuggcaau

SEQ ID NO: 795015 - RNA, 23 nt, Human
uggacccugcacaccagcucuac

SEQ ID NO: 795016 - RNA, 22 nt, Human
ggcaggcucuuggccuuaugag

SEQ ID NO: 795017 - RNA, 22 nt, Human
gucugggcaccuggccugggaa

SEQ ID NO: 795018 - RNA, 22 nt, Human
ugucauggacuggauuucugcu

SEQ ID NO: 795019 - RNA, 22 nt, Human
agaaacaucauuggaacacaag

SEQ ID NO: 795020 - RNA, 21 nt, Human
ucugggcccaugcugccucac

SEQ ID NO: 795021 - RNA, 22 nt, Human
gucaggauuauaauccccaugg

SEQ ID NO: 795022 - RNA, 22 nt, Human
gaauauaggaccucugggaaca

SEQ ID NO: 795023 - RNA, 22 nt, Human
uuagauaacaguagaauaucaa

SEQ ID NO: 795024 - RNA, 22 nt, Human
ugcaaauauuccaugcuguuca

SEQ ID NO: 795025 - RNA, 22 nt, Human
agucucugcugguugugccuau

SEQ ID NO: 795026 - RNA, 22 nt, Human
auuuuuuagaaccuggccugau

SEQ ID NO: 795027 - RNA, 22 nt, Human
ggacccuggagacccacuggga

SEQ ID NO: 795028 - RNA, 22 nt, Human
uggcugaggagggucuucuggu

SEQ ID NO: 795029 - RNA, 22 nt, Human
cugccccugccaggcagcuguc

SEQ ID NO: 795030 - RNA, 22 nt, Human
cuggccgguauuugccucuggg

SEQ ID NO: 795031 - RNA, 17 nt, Human
agucugggaccugcgug

SEQ ID NO: 795032 - RNA, 22 nt, Human
uaagaacuuuguagccuguucu

SEQ ID NO: 795033 - RNA, 22 nt, Human
aggacaguuaaaaauagauggc

SEQ ID NO: 795034 - RNA, 22 nt, Human
aaaaacacaacugucuuucucu

SEQ ID NO: 795035 - RNA, 22 nt, Human
agcccagccacuauuaaauguu

SEQ ID NO: 795036 - RNA, 22 nt, Human
aagggucuuagagguucauuuu

SEQ ID NO: 795037 - RNA, 22 nt, Human
uuucaagcauaacugggaagag

SEQ ID NO: 795038 - RNA, 19 nt, Human
uguggccaugguucagcug

SEQ ID NO: 795039 - RNA, 22 nt, Human
ccugagugaccugaggucuagu

SEQ ID NO: 795040 - RNA, 22 nt, Human
gaggccuggguuggaggugcau

SEQ ID NO: 795041 - RNA, 22 nt, Human
uuucacauaaauggaguaaaga

SEQ ID NO: 795042 - RNA, 22 nt, Human
aacuccagcaggaaggugagaa

SEQ ID NO: 795043 - RNA, 22 nt, Human
uggcccuauuuggaaauagagc

SEQ ID NO: 795044 - RNA, 23 nt, Human
ccaguucuccuuugaacagugac

SEQ ID NO: 795045 - RNA, 22 nt, Human
gaagccacguuaaauuggcugu

SEQ ID NO: 795046 - RNA, 18 nt, Human
cacccuccgcggcugccc

SEQ ID NO: 795047 - RNA, 22 nt, Human
uggaagugucuacauguggagu

SEQ ID NO: 795048 - RNA, 22 nt, Human
cucugcccgcggaugccacguc

SEQ ID NO: 795049 - RNA, 22 nt, Human
auuuauucuccagauggcgaga

SEQ ID NO: 795050 - RNA, 22 nt, Human
gccuggcugggcaccaggggag

SEQ ID NO: 795051 - RNA, 22 nt, Human
uccaagaguaagaggacucuuu

SEQ ID NO: 795052 - RNA, 22 nt, Human
ccagcagggcagugcccuggac

SEQ ID NO: 795053 - RNA, 22 nt, Human
ucucaagagggaggcaaucaug

SEQ ID NO: 795054 - RNA, 22 nt, Human
auucacauuuagacaucaggua

SEQ ID NO: 795055 - RNA, 22 nt, Human
aauugcauguuaaugacuaagu

SEQ ID NO: 795056 - RNA, 22 nt, Human
ugggagcagcauugccaugugc

SEQ ID NO: 795057 - RNA, 22 nt, Human
uagccaguuucuuuaacagcaa

SEQ ID NO: 795058 - RNA, 22 nt, Human
auagacaaacacgaagaugaca

SEQ ID NO: 795059 - RNA, 22 nt, Human
ucaauuucaacagcugauaaga

SEQ ID NO: 795060 - RNA, 22 nt, Human
ucuggcauuuuggcugggaaac

SEQ ID NO: 795061 - RNA, 22 nt, Human
uucccugguuaaccauuuucug

SEQ ID NO: 795062 - RNA, 22 nt, Human
aacaauuaucauauacauugca

SEQ ID NO: 795063 - RNA, 22 nt, Human
uuucacagaaaggauaacauua

SEQ ID NO: 795064 - RNA, 22 nt, Human
cacccugucaguugcaggauag

SEQ ID NO: 795065 - RNA, 22 nt, Human
aagcuuugcaccgguggcugga

SEQ ID NO: 795066 - RNA, 22 nt, Human
agcuuugaaaauccaaauuaca

SEQ ID NO: 795067 - RNA, 22 nt, Human
gucucuuagucucauuuucugc

SEQ ID NO: 795068 - RNA, 22 nt, Human
uggggccuggucagagcugcac

SEQ ID NO: 795069 - RNA, 22 nt, Human
gauucaaagacagacucauuuc

SEQ ID NO: 795070 - RNA, 22 nt, Human
uuucagaaagcugaacauauga

SEQ ID NO: 795071 - RNA, 22 nt, Human
gacuucugaauuccuaucaggu

SEQ ID NO: 795072 - RNA, 22 nt, Human
cucuccagggguagaugccuuc

SEQ ID NO: 795073 - RNA, 19 nt, Human
ucccucccuguaaucucac

SEQ ID NO: 795074 - RNA, 22 nt, Human
ccucacaugaauguaagcucca

SEQ ID NO: 795075 - RNA, 21 nt, Human
aggcuguccuuugccagcccu

SEQ ID NO: 795076 - RNA, 22 nt, Human
aaaagguaguugccaaauaagg

SEQ ID NO: 795077 - RNA, 22 nt, Human
ggguccaggucuucaggcagag

SEQ ID NO: 795078 - RNA, 22 nt, Human
cagcacugcugcuguacacaca

SEQ ID NO: 795079 - RNA, 22 nt, Human
uacaaagucagaauaacaggug

SEQ ID NO: 795080 - RNA, 22 nt, Human
auacuuugcuacauuguacauu

SEQ ID NO: 795081 - RNA, 20 nt, Human
gcaaaauaggcucuguuggu

SEQ ID NO: 795082 - RNA, 21 nt, Human
agccagcuaucacacagcauu

SEQ ID NO: 795083 - RNA, 23 nt, Human
ccucaaauguagccuuuuuccca

SEQ ID NO: 795084 - RNA, 22 nt, Human
aggagaaguaaggcuagaugau

SEQ ID NO: 795085 - RNA, 22 nt, Human
uagauuucgcugcaucucaauc

SEQ ID NO: 795086 - RNA, 18 nt, Human
ggguccccagcugcaggg

SEQ ID NO: 795087 - RNA, 22 nt, Human
ucauuauaaacauaugcuaaag

SEQ ID NO: 795088 - RNA, 22 nt, Human
cacacagggagaaagaaagccu

SEQ ID NO: 795089 - RNA, 21 nt, Human
ccuggcugcacaguugcuggu

SEQ ID NO: 795090 - RNA, 22 nt, Human
augcaugcauuguuuaucaugg

SEQ ID NO: 795091 - RNA, 22 nt, Human
caggaaugccaaccagugcaug

SEQ ID NO: 795092 - RNA, 22 nt, Human
aaugaacgguguccaucuguuu

SEQ ID NO: 795093 - RNA, 22 nt, Human
uucucaacucucaagagaagcu

SEQ ID NO: 795094 - RNA, 22 nt, Human
aggcuucagccuagagcuggag

SEQ ID NO: 795095 - RNA, 22 nt, Human
gcaggcuguagacaccaaacua

SEQ ID NO: 795096 - RNA, 22 nt, Human
cacaguaaccccaggacuggga

SEQ ID NO: 795097 - RNA, 22 nt, Human
cagaggccagggggcucacaaa

SEQ ID NO: 795098 - RNA, 21 nt, Human
ugcagugucccuaacaguggu

SEQ ID NO: 795099 - RNA, 22 nt, Human
ugcacacaguggacaagucuug

SEQ ID NO: 795100 - RNA, 22 nt, Human
auacaucaccuauauauucaca

SEQ ID NO: 795101 - RNA, 22 nt, Human
auaacauggaguuugucauuua

SEQ ID NO: 795102 - RNA, 22 nt, Human
uagcauuuauuccagauuugga

SEQ ID NO: 795103 - RNA, 22 nt, Human
uuauuucauguaaaauuuaugu

SEQ ID NO: 795104 - RNA, 22 nt, Human
gcuggccacacugcugauggag

SEQ ID NO: 795105 - RNA, 22 nt, Human
ugcagaggagcuggaaggcugg

SEQ ID NO: 795106 - RNA, 22 nt, Human
aguguuuuuggguagggugagu

SEQ ID NO: 795107 - RNA, 22 nt, Human
uccucagggguuucagguguac

SEQ ID NO: 795108 - RNA, 22 nt, Human
aaugccuugccugcuacaacuu

SEQ ID NO: 795109 - RNA, 22 nt, Human
uuucuaaguaaacacagcauac

SEQ ID NO: 795110 - RNA, 22 nt, Human
aagcaagaguuggagugauguu

SEQ ID NO: 795111 - RNA, 22 nt, Human
uuggagggucuuccacagccau

SEQ ID NO: 795112 - RNA, 22 nt, Human
cagagaagagucuggccucucu

SEQ ID NO: 795113 - RNA, 22 nt, Human
gaagcagucagcagcaccuuug

SEQ ID NO: 795114 - RNA, 22 nt, Human
gacccagcuaaccaggugggga

SEQ ID NO: 795115 - RNA, 22 nt, Human
agagaggauuuguuuuucuccu

SEQ ID NO: 795116 - RNA, 22 nt, Human
gcagcugguuaaugggagaauu

SEQ ID NO: 795117 - RNA, 22 nt, Human
cuagggucaggggccugcgucg

SEQ ID NO: 795118 - RNA, 22 nt, Human
uaaugacuguaccaaggcuuca

SEQ ID NO: 795119 - RNA, 22 nt, Human
aucaucuggguuaaugugcuca

SEQ ID NO: 795120 - RNA, 22 nt, Human
caguuuaaguagaacugagaau

SEQ ID NO: 795121 - RNA, 22 nt, Human
uggccuggcucacagugagauu

SEQ ID NO: 795122 - RNA, 22 nt, Human
caggacacuuguucuucucugc

SEQ ID NO: 795123 - RNA, 20 nt, Human
aggcugccuaaggcucugca

SEQ ID NO: 795124 - RNA, 22 nt, Human
ccugggagcuguggaaaggcug

SEQ ID NO: 795125 - RNA, 22 nt, Human
auguuuucuagaguuuaaaauc

SEQ ID NO: 795126 - RNA, 22 nt, Human
cagaggccuauccaguguccau

SEQ ID NO: 795127 - RNA, 22 nt, Human
uuccagccacuuuauacugcua

SEQ ID NO: 795128 - RNA, 22 nt, Human
augaauguaccugaaauagccu

SEQ ID NO: 795129 - RNA, 22 nt, Human
uugcaaauuauauaagggaugc

SEQ ID NO: 795130 - RNA, 22 nt, Human
uguuuuuaaaauguccugguua

SEQ ID NO: 795131 - RNA, 22 nt, Human
aagauacauuuucuucagagaa

SEQ ID NO: 795132 - RNA, 22 nt, Human
uaaaagagaauggauaacagag

SEQ ID NO: 795133 - RNA, 22 nt, Human
ucagugcuguaaacaaaaggaa

SEQ ID NO: 795134 - RNA, 22 nt, Human
caaauacaaauacgggcagcuu

SEQ ID NO: 795135 - RNA, 22 nt, Human
gggggcuggaauauccaucaac

SEQ ID NO: 795136 - RNA, 22 nt, Human
agggaagccaagccuuagagaa

SEQ ID NO: 795137 - RNA, 22 nt, Human
ugguggagagacaguguauugg

SEQ ID NO: 795138 - RNA, 22 nt, Human
gagggagugcuuucugauaguu

SEQ ID NO: 795139 - RNA, 22 nt, Human
ggcugcaagcaugcacagauac

SEQ ID NO: 795140 - RNA, 22 nt, Human
gcugugauaaaugcagauguca

SEQ ID NO: 795141 - RNA, 22 nt, Human
aacauauaaacucuuaaguuca

SEQ ID NO: 795142 - RNA, 21 nt, Human
ucuguuggaggccucucuucc

SEQ ID NO: 795143 - RNA, 22 nt, Human
uaggaaaugccagccuuccucc

SEQ ID NO: 795144 - RNA, 22 nt, Human
agcugggccugagcuggaagcu

SEQ ID NO: 795145 - RNA, 22 nt, Human
cccuccucucccuaagagucac

SEQ ID NO: 795146 - RNA, 22 nt, Human
agcaggcugcuggcguugaagu

SEQ ID NO: 795147 - RNA, 22 nt, Human
caauacaauuaccaguuaauca

SEQ ID NO: 795148 - RNA, 22 nt, Human
cagccagggagggcaaaugaga

SEQ ID NO: 795149 - RNA, 18 nt, Human
uggauugaauugagaggu

SEQ ID NO: 795150 - RNA, 22 nt, Human
ugcaggcuuuagccccauggcu

SEQ ID NO: 795151 - RNA, 22 nt, Human
ucuggagaaaguugaguuugug

SEQ ID NO: 795152 - RNA, 22 nt, Human
uggcuucugggguggccugcau

SEQ ID NO: 795153 - RNA, 22 nt, Human
ggaggugggcuaaggacucucu

SEQ ID NO: 795154 - RNA, 22 nt, Human
cagucucucuccuugcaggcgu

SEQ ID NO: 795155 - RNA, 22 nt, Human
cucucaaauguaauuugagguu

SEQ ID NO: 795156 - RNA, 22 nt, Human
agcaggcacgcucccugcgcga

SEQ ID NO: 795157 - RNA, 22 nt, Human
uaggaaaugaggccaacaugug

SEQ ID NO: 795158 - RNA, 22 nt, Human
cuuuacaaauuagcucucggga

SEQ ID NO: 795159 - RNA, 18 nt, Human
cuguugagauguggcuga

SEQ ID NO: 795160 - RNA, 22 nt, Human
aggcugagacugugcauuagug

SEQ ID NO: 795161 - RNA, 22 nt, Human
acaggaacgaauguacauuguu

SEQ ID NO: 795162 - RNA, 22 nt, Human
aggacagagggaccagagccca

SEQ ID NO: 795163 - RNA, 22 nt, Human
auuuauuauugugguuacuucu

SEQ ID NO: 795164 - RNA, 22 nt, Human
gaccugcuccacgacaaguggu

SEQ ID NO: 795165 - RNA, 22 nt, Human
ggagggcugccagguggagcgg

SEQ ID NO: 795166 - RNA, 22 nt, Human
uaauuauuugaagacauuagag

SEQ ID NO: 795167 - RNA, 22 nt, Human
ucaggaaggcuucacacgagug

SEQ ID NO: 795168 - RNA, 22 nt, Human
agucucuugcacauuguauuaa

SEQ ID NO: 795169 - RNA, 22 nt, Human
cagggacaauggcagagccuga

SEQ ID NO: 795170 - RNA, 22 nt, Human
ugcuggcuggaucagagauugg

SEQ ID NO: 795171 - RNA, 22 nt, Human
cuggcagaggauggggacccag

SEQ ID NO: 795172 - RNA, 22 nt, Human
gacaaacugaaguauauuuaga

SEQ ID NO: 795173 - RNA, 22 nt, Human
auuauaggcuugagccaccgug

SEQ ID NO: 795174 - RNA, 22 nt, Human
gcagaagcugggcagcgaggug

SEQ ID NO: 795175 - RNA, 22 nt, Human
auuuuccucugguuuccccaga

SEQ ID NO: 795176 - RNA, 22 nt, Human
ggagagcugguauaugaagaca

SEQ ID NO: 795177 - RNA, 22 nt, Human
ucugcagcacuuaauguuucgu

SEQ ID NO: 795178 - RNA, 22 nt, Human
aguuggagugaacaugagauug

SEQ ID NO: 795179 - RNA, 22 nt, Human
aaaugucuguaggggcugcagg

SEQ ID NO: 795180 - RNA, 22 nt, Human
auacaaaguauugauccugagu

SEQ ID NO: 795181 - RNA, 22 nt, Human
guccucugggcuuugagcaguc

SEQ ID NO: 795182 - RNA, 22 nt, Human
uuguuuacaaguuacucagucu

SEQ ID NO: 795183 - RNA, 22 nt, Human
aggcagugugggccaagcuucc

SEQ ID NO: 795184 - RNA, 22 nt, Human
uucuuugcccuuaaugaaauaa

SEQ ID NO: 795185 - RNA, 22 nt, Human
gucugcucaugcuaccgcgggc

SEQ ID NO: 795186 - RNA, 22 nt, Human
agggcuggccacaugauuuggu

SEQ ID NO: 795187 - RNA, 22 nt, Human
acagcagaccccagugccaugg

SEQ ID NO: 795188 - RNA, 22 nt, Human
uuuuagauugggaaauguaaag

SEQ ID NO: 795189 - RNA, 22 nt, Human
aaauaucauuuauaacuuuuaa

SEQ ID NO: 795190 - RNA, 22 nt, Human
cagcaaggguuauaucaaagau

SEQ ID NO: 795191 - RNA, 22 nt, Human
gaggcggcggccgagccuggcu

SEQ ID NO: 795192 - RNA, 22 nt, Human
cugcacugcugaucccaggucu

SEQ ID NO: 795193 - RNA, 22 nt, Human
ucccuagguccuagucacagua

SEQ ID NO: 795194 - RNA, 22 nt, Human
auuauucaaucauauuaaaagu

SEQ ID NO: 795195 - RNA, 22 nt, Human
aaauuagucauguuguauuacu

SEQ ID NO: 795196 - RNA, 22 nt, Human
uccaggauugucagccagaagg

SEQ ID NO: 795197 - RNA, 22 nt, Human
gagcugggaguuauagcauguu

SEQ ID NO: 795198 - RNA, 16 nt, Human
ggcacuggcagguccu

SEQ ID NO: 795199 - RNA, 22 nt, Human
aucuuugggauccugauuuacu

SEQ ID NO: 795200 - RNA, 22 nt, Human
gcugggagucgcgucuguggcc

SEQ ID NO: 795201 - RNA, 22 nt, Human
gcagaagcugggagaagggauu

SEQ ID NO: 795202 - RNA, 21 nt, Human
uuguacacccacagaucagcc

SEQ ID NO: 795203 - RNA, 22 nt, Human
aaaucagaaaauauggagagga

SEQ ID NO: 795204 - RNA, 22 nt, Human
caauuucauggauaaaagaugu

SEQ ID NO: 795205 - RNA, 22 nt, Human
acugccaaugguaguuugaugg

SEQ ID NO: 795206 - RNA, 22 nt, Human
uuugaucucccagacuaaggag

SEQ ID NO: 795207 - RNA, 22 nt, Human
gcccugacacuuugcagcugag

SEQ ID NO: 795208 - RNA, 22 nt, Human
cuucuaauucuuauguaagcuu

SEQ ID NO: 795209 - RNA, 22 nt, Human
aggccacaguugaggccagcaa

SEQ ID NO: 795210 - RNA, 22 nt, Human
aggccucaguucuugccaggug

SEQ ID NO: 795211 - RNA, 22 nt, Human
cagcccacuucccagcaccuac

SEQ ID NO: 795212 - RNA, 22 nt, Human
accacaggggaggaaugaugcc

SEQ ID NO: 795213 - RNA, 22 nt, Human
cagggagaggcaucauagggaa

SEQ ID NO: 795214 - RNA, 22 nt, Human
uuuaauaucucacacuuccaug

SEQ ID NO: 795215 - RNA, 22 nt, Human
auuuacugagcagcuaccaugu

SEQ ID NO: 795216 - RNA, 23 nt, Human
ugcuggagaagcaaaguucugag

SEQ ID NO: 795217 - RNA, 22 nt, Human
aagccaggagcgaggccucggc

SEQ ID NO: 795218 - RNA, 22 nt, Human
cuuuuuauagcuauguccuaug

SEQ ID NO: 795219 - RNA, 18 nt, Human
cugcugugucgucugggc

SEQ ID NO: 795220 - RNA, 22 nt, Human
uuuggugagcugcgagugagga

SEQ ID NO: 795221 - RNA, 22 nt, Human
cugcacaguaagcuucagagau

SEQ ID NO: 795222 - RNA, 22 nt, Human
acuauacauugaauguuaaggu

SEQ ID NO: 795223 - RNA, 22 nt, Human
gagucagaagaaacuauuuaca

SEQ ID NO: 795224 - RNA, 22 nt, Human
cagcagggcccccgggugcgcc

SEQ ID NO: 795225 - RNA, 22 nt, Human
gagaauacaaccagaagcugag

SEQ ID NO: 795226 - RNA, 22 nt, Human
caucaggaauaaaugaggcugu

SEQ ID NO: 795227 - RNA, 22 nt, Human
ucuggggucaccuggggugcuu

SEQ ID NO: 795228 - RNA, 22 nt, Human
acugcagcuggugguggcucug

SEQ ID NO: 795229 - RNA, 22 nt, Human
ggcagggagagcaugcugauaa

SEQ ID NO: 795230 - RNA, 22 nt, Human
uauuaaauauaucuguuaguug

SEQ ID NO: 795231 - RNA, 20 nt, Human
caaauucuguugaauacacc

SEQ ID NO: 795232 - RNA, 19 nt, Human
gagaaaccccgucuuuagg

SEQ ID NO: 795233 - RNA, 19 nt, Human
cagucccaaauucuuguca

SEQ ID NO: 795234 - RNA, 21 nt, Human
uagaaagucaaagcuaucagc

SEQ ID NO: 795235 - RNA, 22 nt, Human
cucuucaggauggcuugugaug

SEQ ID NO: 795236 - RNA, 18 nt, Human
ucaguauuaccucaggca

SEQ ID NO: 795237 - RNA, 21 nt, Human
uagggcaggcauuggaagaga

SEQ ID NO: 795238 - RNA, 22 nt, Human
aggagugcaaauaguccagaga

SEQ ID NO: 795239 - RNA, 22 nt, Human
cugggagcugaggcugacgcug

SEQ ID NO: 795240 - RNA, 22 nt, Human
ccuggccucuccgaguaaccug

SEQ ID NO: 795241 - RNA, 22 nt, Human
gggugcaugguguaugacugga

SEQ ID NO: 795242 - RNA, 22 nt, Human
augcagaaagagaauguaaugu

SEQ ID NO: 795243 - RNA, 22 nt, Human
gcugcuuccuuuccugcugacc

SEQ ID NO: 795244 - RNA, 22 nt, Human
cagcugaacauguagagcaucu

SEQ ID NO: 795245 - RNA, 22 nt, Human
aagcuuugggcagaagaggauu

SEQ ID NO: 795246 - RNA, 22 nt, Human
aggcugaggggcgagggacccu

SEQ ID NO: 795247 - RNA, 22 nt, Human
cacuuaaaucuguugagaaaaa

SEQ ID NO: 795248 - RNA, 22 nt, Human
augcaacaggucagccaggaag

SEQ ID NO: 795249 - RNA, 22 nt, Human
agugaggggcagcugagugggc

SEQ ID NO: 795250 - RNA, 22 nt, Human
uagcuucuaauacuuaccaauu

SEQ ID NO: 795251 - RNA, 22 nt, Human
acagcaaaggacgaacacucug

SEQ ID NO: 795252 - RNA, 22 nt, Human
auucucauuuuuauagaugaga

SEQ ID NO: 795253 - RNA, 22 nt, Human
ggagcccaagucugcacucggc

SEQ ID NO: 795254 - RNA, 21 nt, Human
uuucauugaaugagauaaggu

SEQ ID NO: 795255 - RNA, 22 nt, Human
ccugccagauccccugagcuga

SEQ ID NO: 795256 - RNA, 22 nt, Human
aaagaacaucggagugggcggg

SEQ ID NO: 795257 - RNA, 22 nt, Human
guuuucauuacugcugugauuu

SEQ ID NO: 795258 - RNA, 22 nt, Human
aggcuacagauacagaggcuac

SEQ ID NO: 795259 - RNA, 22 nt, Human
ucaccuuaacaaucugaccauc

SEQ ID NO: 795260 - RNA, 22 nt, Human
aagcaauaaucccaaagugcug

SEQ ID NO: 795261 - RNA, 22 nt, Human
ugcauuaagcacacuuuugaau

SEQ ID NO: 795262 - RNA, 22 nt, Human
ucuuugggagaaggggucccag

SEQ ID NO: 795263 - RNA, 22 nt, Human
uuucaucuuauuugucuacauc

SEQ ID NO: 795264 - RNA, 22 nt, Human
gcccuugacaguggcagaagca

SEQ ID NO: 795265 - RNA, 22 nt, Human
uucauuguagcuugacuaauua

SEQ ID NO: 795266 - RNA, 22 nt, Human
uuuacaagaaaucaugaugcua

SEQ ID NO: 795267 - RNA, 22 nt, Human
auauuuucacagaacuugcaaa

SEQ ID NO: 795268 - RNA, 15 nt, Human
ccaggcugggugagc

SEQ ID NO: 795269 - RNA, 22 nt, Human
ucccugaagccagggaaggaag

SEQ ID NO: 795270 - RNA, 22 nt, Human
uucauugauuuccuuggaauaa

SEQ ID NO: 795271 - RNA, 22 nt, Human
uaggacaguuuacuuugguuac

SEQ ID NO: 795272 - RNA, 22 nt, Human
agccacagucaaccuguccaua

SEQ ID NO: 795273 - RNA, 21 nt, Human
ccugccaggaaacugaguguc

SEQ ID NO: 795274 - RNA, 22 nt, Human
ccucaggggucacugugaggag

SEQ ID NO: 795275 - RNA, 22 nt, Human
cucaagucuauugauaagugca

SEQ ID NO: 795276 - RNA, 21 nt, Human
gcugccaccgcgugcuccagg

SEQ ID NO: 795277 - RNA, 22 nt, Human
uagaaaguagggaagguaggau

SEQ ID NO: 795278 - RNA, 22 nt, Human
auuucuuucuggccacgguuuu

SEQ ID NO: 795279 - RNA, 20 nt, Human
auacacauucauagaaaaau

SEQ ID NO: 795280 - RNA, 21 nt, Human
aaagagcuuuugugcuaguua

SEQ ID NO: 795281 - RNA, 22 nt, Human
uccugccuagcaggugaccuau

SEQ ID NO: 795282 - RNA, 22 nt, Human
uuauuuccaaacuggauauacc

SEQ ID NO: 795283 - RNA, 22 nt, Human
acacaucuauauugcaucugca

SEQ ID NO: 795284 - RNA, 22 nt, Human
caggaaaugcguaguugaacuu

SEQ ID NO: 795285 - RNA, 19 nt, Human
agcaggcagguggcccagg

SEQ ID NO: 795286 - RNA, 19 nt, Human
uuggaugcuaccagguacc

SEQ ID NO: 795287 - RNA, 22 nt, Human
uccagcugacaguucaaaauga

SEQ ID NO: 795288 - RNA, 22 nt, Human
uuccuggggcuuagcaauggag

SEQ ID NO: 795289 - RNA, 22 nt, Human
aggacaggauugagcugaacug

SEQ ID NO: 795290 - RNA, 20 nt, Human
ucaaagacaagcucucaucc

SEQ ID NO: 795291 - RNA, 22 nt, Human
auaguguuacccuucuuaaagu

SEQ ID NO: 795292 - RNA, 22 nt, Human
uaaugacuaagcaaucaugaau

SEQ ID NO: 795293 - RNA, 19 nt, Human
cgccuggcaggcccugcgc

SEQ ID NO: 795294 - RNA, 22 nt, Human
cacacaugucucuccaugcucu

SEQ ID NO: 795295 - RNA, 22 nt, Human
uaggcugggcauucuggccagg

SEQ ID NO: 795296 - RNA, 22 nt, Human
acggaaugagucuugaaaagug

SEQ ID NO: 795297 - RNA, 22 nt, Human
ccuuucuacagaugccucuugc

SEQ ID NO: 795298 - RNA, 22 nt, Human
ucaggcucagguuaggggccaa

SEQ ID NO: 795299 - RNA, 19 nt, Human
ucagugucccuguuaauau

SEQ ID NO: 795300 - RNA, 22 nt, Human
guuguuuucagcaguuuaugac

SEQ ID NO: 795301 - RNA, 22 nt, Human
aaaagcaaggcagucugucuga

SEQ ID NO: 795302 - RNA, 22 nt, Human
ugcuggcugggcugcuggagac

SEQ ID NO: 795303 - RNA, 22 nt, Human
uuugaugaaagcuacuauuuac

SEQ ID NO: 795304 - RNA, 22 nt, Human
acauucuguuuccccaaagaga

SEQ ID NO: 795305 - RNA, 23 nt, Human
uacagcaaggacaacauaggugg

SEQ ID NO: 795306 - RNA, 22 nt, Human
uacuacaagggcccuaaaaggu

SEQ ID NO: 795307 - RNA, 22 nt, Human
ccaggagucaauaaaggaagcu

SEQ ID NO: 795308 - RNA, 22 nt, Human
cucucagggcagguggccuuuc

SEQ ID NO: 795309 - RNA, 22 nt, Human
aaacugcagccuugaguucagg

SEQ ID NO: 795310 - RNA, 22 nt, Human
aaagaacuaccuguaugauauu

SEQ ID NO: 795311 - RNA, 22 nt, Human
uaggaaauaauucacucuggcu

SEQ ID NO: 795312 - RNA, 22 nt, Human
cuggucaccuccuucccagcua

SEQ ID NO: 795313 - RNA, 20 nt, Human
uccagcugggaacagcugau

SEQ ID NO: 795314 - RNA, 22 nt, Human
ggaugggaacuugguagggcau

SEQ ID NO: 795315 - RNA, 22 nt, Human
cagcucagucuggagagaugca

SEQ ID NO: 795316 - RNA, 22 nt, Human
cuuccucuauguucagguagaa

SEQ ID NO: 795317 - RNA, 22 nt, Human
gagccugggacugggggucaug

SEQ ID NO: 795318 - RNA, 22 nt, Human
aagggggcgaagacgugauuga

SEQ ID NO: 795319 - RNA, 22 nt, Human
gugcaaauguaauugcaguuuu

SEQ ID NO: 795320 - RNA, 22 nt, Human
uacagaggagaccaaggcucag

SEQ ID NO: 795321 - RNA, 22 nt, Human
ucucugcccauccucaguccac

SEQ ID NO: 795322 - RNA, 22 nt, Human
gugacucuuaaagcaaaucuug

SEQ ID NO: 795323 - RNA, 22 nt, Human
cuggucagcugaagccccacac

SEQ ID NO: 795324 - RNA, 22 nt, Human
gcaguuugaaaguaugagucca

SEQ ID NO: 795325 - RNA, 22 nt, Human
cagccagccucucaaccaugca

SEQ ID NO: 795326 - RNA, 22 nt, Human
aaugagaagccuagguguacug

SEQ ID NO: 795327 - RNA, 18 nt, Human
agcccagcggagugaauc

SEQ ID NO: 795328 - RNA, 22 nt, Human
aaaaucuugacuguuuuuagaa

SEQ ID NO: 795329 - RNA, 22 nt, Human
accugagggcccaaacuuggua

SEQ ID NO: 795330 - RNA, 22 nt, Human
caauguuugugaucuacugacu

SEQ ID NO: 795331 - RNA, 22 nt, Human
acacauuuuguuaaacccugug

SEQ ID NO: 795332 - RNA, 22 nt, Human
cagcugcccaggccaccuggag

SEQ ID NO: 795333 - RNA, 22 nt, Human
cagggccauuggaacaaagagg

SEQ ID NO: 795334 - RNA, 22 nt, Human
aacaaguucuaagugucuacuu

SEQ ID NO: 795335 - RNA, 22 nt, Human
aagaacuaucucuggcuguagg

SEQ ID NO: 795336 - RNA, 22 nt, Human
gcugagggcuguaacagcagag

SEQ ID NO: 795337 - RNA, 22 nt, Human
uacauacaguggaugcuuuagg

SEQ ID NO: 795338 - RNA, 22 nt, Human
ugggccacaagccaugggacca

SEQ ID NO: 795339 - RNA, 21 nt, Human
uuucuuaucuguaaaguggga

SEQ ID NO: 795340 - RNA, 22 nt, Human
cacauucuuucacaguucugaa

SEQ ID NO: 795341 - RNA, 22 nt, Human
aggggagccgaggggcaucugu

SEQ ID NO: 795342 - RNA, 22 nt, Human
ugaugaaacugagguuccaaga

SEQ ID NO: 795343 - RNA, 22 nt, Human
gccuggcuccuaaggacuggcu

SEQ ID NO: 795344 - RNA, 22 nt, Human
uaagucauaagucaugauguua

SEQ ID NO: 795345 - RNA, 22 nt, Human
uauucacauguacauaugcuca

SEQ ID NO: 795346 - RNA, 22 nt, Human
acaaaguaggucaucaaagcuc

SEQ ID NO: 795347 - RNA, 22 nt, Human
acaggugaccugcucauaugaa

SEQ ID NO: 795348 - RNA, 22 nt, Human
aaagcuggccucucaggcuuua

SEQ ID NO: 795349 - RNA, 21 nt, Human
gaugguagccucauagaagua

SEQ ID NO: 795350 - RNA, 22 nt, Human
caggcagaaugagauuacuuca

SEQ ID NO: 795351 - RNA, 22 nt, Human
uguguucugaaggagaagagug

SEQ ID NO: 795352 - RNA, 22 nt, Human
caggaaccauuuucucuuuaua

SEQ ID NO: 795353 - RNA, 22 nt, Human
agaggcugugcagagggagugc

SEQ ID NO: 795354 - RNA, 22 nt, Human
gccuuuccugcucuggcauuca

SEQ ID NO: 795355 - RNA, 21 nt, Human
gcagucacucgguuggcuacc

SEQ ID NO: 795356 - RNA, 22 nt, Human
guugaguggguuaggaugcuga

SEQ ID NO: 795357 - RNA, 22 nt, Human
uggggccacagccuccuagcuu

SEQ ID NO: 795358 - RNA, 22 nt, Human
gugcagagugucuguggacuga

SEQ ID NO: 795359 - RNA, 22 nt, Human
caaggcaggaagccugucuuau

SEQ ID NO: 795360 - RNA, 22 nt, Human
ggcccugggcccucuagcuugu

SEQ ID NO: 795361 - RNA, 22 nt, Human
gagcacagcugucuugcaagcu

SEQ ID NO: 795362 - RNA, 22 nt, Human
cugaagagaaagggagcucuuc

SEQ ID NO: 795363 - RNA, 22 nt, Human
ucccaggguccucuucuggaau

SEQ ID NO: 795364 - RNA, 22 nt, Human
ggugaagggccuuaggagacag

SEQ ID NO: 795365 - RNA, 22 nt, Human
ccuuccccagugauucucucag

SEQ ID NO: 795366 - RNA, 22 nt, Human
ggagccagcagggugacacuga

SEQ ID NO: 795367 - RNA, 22 nt, Human
ugaaaucaguaugucuuucuca

SEQ ID NO: 795368 - RNA, 22 nt, Human
aggaaaacagaccaaggagcuc

SEQ ID NO: 795369 - RNA, 19 nt, Human
ccuccccuuggaccagcaa

SEQ ID NO: 795370 - RNA, 22 nt, Human
uuucugcaaguguagauaccca

SEQ ID NO: 795371 - RNA, 22 nt, Human
ugaggagccacucuagcaguca

SEQ ID NO: 795372 - RNA, 22 nt, Human
uucuuaagacugcaaaucaacc

SEQ ID NO: 795373 - RNA, 22 nt, Human
ugcuagugugugagauguucaa

SEQ ID NO: 795374 - RNA, 22 nt, Human
gccuggaggggccaggguggua

SEQ ID NO: 795375 - RNA, 22 nt, Human
auauauuuugaauagccucugu

SEQ ID NO: 795376 - RNA, 22 nt, Human
aggaaagcucccaguagggcuc

SEQ ID NO: 795377 - RNA, 21 nt, Human
cacucaauaaaugucauaugc

SEQ ID NO: 795378 - RNA, 22 nt, Human
aucagaauacuaucaacaguga

SEQ ID NO: 795379 - RNA, 22 nt, Human
agcuuuaccugccuuggggcac

SEQ ID NO: 795380 - RNA, 22 nt, Human
cccugaaauccugugcucugug

SEQ ID NO: 795381 - RNA, 22 nt, Human
cuccuggaggcuccaagggaga

SEQ ID NO: 795382 - RNA, 22 nt, Human
ugauccuauuucaguguauguu

SEQ ID NO: 795383 - RNA, 22 nt, Human
ugggggugguucuugccuccag

SEQ ID NO: 795384 - RNA, 21 nt, Human
agcugagguaaggcaagagag

SEQ ID NO: 795385 - RNA, 22 nt, Human
aucaaagugguuuucugugcuu

SEQ ID NO: 795386 - RNA, 22 nt, Human
gcaggccacaguggagucucug

SEQ ID NO: 795387 - RNA, 22 nt, Human
agaggcugucccuugcuauucc

SEQ ID NO: 795388 - RNA, 22 nt, Human
ugaaauauuuagagaguaaguu

SEQ ID NO: 795389 - RNA, 22 nt, Human
gccaagccuguagacacaagcu

SEQ ID NO: 795390 - RNA, 22 nt, Human
gcugccucugcacagcucacuc

SEQ ID NO: 795391 - RNA, 22 nt, Human
cucuggucagugaauuccuagu

SEQ ID NO: 795392 - RNA, 22 nt, Human
cugccuuccaaccccagacucc

SEQ ID NO: 795393 - RNA, 22 nt, Human
cuuuggaggaccuaugugcaau

SEQ ID NO: 795394 - RNA, 18 nt, Human
aguaggcacugugggguu

SEQ ID NO: 795395 - RNA, 22 nt, Human
gcuuaaauuguuuguggauagu

SEQ ID NO: 795396 - RNA, 22 nt, Human
uucugaagcucccuuuuguagu

SEQ ID NO: 795397 - RNA, 22 nt, Human
cagugcuuuucaaaguucuaug

SEQ ID NO: 795398 - RNA, 22 nt, Human
aaagccaggcuggccugggguu

SEQ ID NO: 795399 - RNA, 22 nt, Human
ggggccagagaggacccaggug

SEQ ID NO: 795400 - RNA, 22 nt, Human
guauauaugugugaacauguau

SEQ ID NO: 795401 - RNA, 22 nt, Human
ucuagaacuucucuaaaaugaa

SEQ ID NO: 795402 - RNA, 22 nt, Human
caggguggcacaucacagcauu

SEQ ID NO: 795403 - RNA, 22 nt, Human
ugccuucuugaauaugguucuu

SEQ ID NO: 795404 - RNA, 22 nt, Human
ccagcugucuugagaggaggca

SEQ ID NO: 795405 - RNA, 22 nt, Human
auaugcuuacacuacaagauga

SEQ ID NO: 795406 - RNA, 22 nt, Human
aucaaaaugcuccagugauggu

SEQ ID NO: 795407 - RNA, 22 nt, Human
gcaggucucaaucugagcaggc

SEQ ID NO: 795408 - RNA, 22 nt, Human
uggcagagcccagacuccaguc

SEQ ID NO: 795409 - RNA, 22 nt, Human
aaucauaauuuugugaauguag

SEQ ID NO: 795410 - RNA, 22 nt, Human
cccaggcacauccacucuguga

SEQ ID NO: 795411 - RNA, 22 nt, Human
ucucccuagggccgcuggcuaa

SEQ ID NO: 795412 - RNA, 22 nt, Human
ucuggcugaauuagccuugggu

SEQ ID NO: 795413 - RNA, 22 nt, Human
cacugcagccucgcucuccuga

SEQ ID NO: 795414 - RNA, 22 nt, Human
uggacaggcaagcaagacauac

SEQ ID NO: 795415 - RNA, 22 nt, Human
cagcuguucacauuuccaaaac

SEQ ID NO: 795416 - RNA, 22 nt, Human
gugagcauauauguaaucguuu

SEQ ID NO: 795417 - RNA, 22 nt, Human
cauguaaagaauuucacacaag

SEQ ID NO: 795418 - RNA, 22 nt, Human
agaugugggcaauggaauggag

SEQ ID NO: 795419 - RNA, 22 nt, Human
aagcagcuuaaauuagagccug

SEQ ID NO: 795420 - RNA, 22 nt, Human
aagccacagaucguucugucac

SEQ ID NO: 795421 - RNA, 22 nt, Human
augguggacucuugauucaggc

SEQ ID NO: 795422 - RNA, 22 nt, Human
uggcagggaguucguucacaac

SEQ ID NO: 795423 - RNA, 20 nt, Human
ugcauuaaguggcauugagc

SEQ ID NO: 795424 - RNA, 22 nt, Human
aacagcagggaugggguggcca

SEQ ID NO: 795425 - RNA, 22 nt, Human
ugucaugguagcugaaggaugu

SEQ ID NO: 795426 - RNA, 22 nt, Human
aauauauuugaaucaggaacaa

SEQ ID NO: 795427 - RNA, 22 nt, Human
ggaucuucagccagcaggugcc

SEQ ID NO: 795428 - RNA, 22 nt, Human
uacuacuuucccccacauauuu

SEQ ID NO: 795429 - RNA, 22 nt, Human
ccaggcuuucccagccucucca

SEQ ID NO: 795430 - RNA, 20 nt, Human
aaucacaguuaacucuuucu

SEQ ID NO: 795431 - RNA, 22 nt, Human
uucauugaaauacagucuugac

SEQ ID NO: 795432 - RNA, 22 nt, Human
cugcagcuuuuugugcuuguaa

SEQ ID NO: 795433 - RNA, 22 nt, Human
ugccugggacaugcuguggacu

SEQ ID NO: 795434 - RNA, 22 nt, Human
ucagauguugaaaaggaaaagu

SEQ ID NO: 795435 - RNA, 22 nt, Human
cauucagagcuuucuuaucaua

SEQ ID NO: 795436 - RNA, 22 nt, Human
acagugucaugucguguucccc

SEQ ID NO: 795437 - RNA, 22 nt, Human
ccugguggagaggggcggagcg

SEQ ID NO: 795438 - RNA, 22 nt, Human
gcccagcaggacagagugguuu

SEQ ID NO: 795439 - RNA, 21 nt, Human
caguccugcaaauaauucuuu

SEQ ID NO: 795440 - RNA, 22 nt, Human
uggccaggaggcugcuucugac

SEQ ID NO: 795441 - RNA, 22 nt, Human
aaacaugcuggauuuagaauau

SEQ ID NO: 795442 - RNA, 22 nt, Human
ugggcuccguugccuggggcag

SEQ ID NO: 795443 - RNA, 22 nt, Human
agugugagaugauugaggagca

SEQ ID NO: 795444 - RNA, 22 nt, Human
gcccagccagagcugugugaug

SEQ ID NO: 795445 - RNA, 22 nt, Human
caggcuugcugcuagagcacuu

SEQ ID NO: 795446 - RNA, 22 nt, Human
aucacaguggcuaccucuggau

SEQ ID NO: 795447 - RNA, 19 nt, Human
agcaggccaggcagguggc

SEQ ID NO: 795448 - RNA, 20 nt, Human
aguaccuuuuguauguuacc

SEQ ID NO: 795449 - RNA, 21 nt, Human
uuacuaaacaaaacaugcagg

SEQ ID NO: 795450 - RNA, 23 nt, Human
uuucacauuuacuguuagauggc

SEQ ID NO: 795451 - RNA, 22 nt, Human
cuccucuccaucagcgccaccc

SEQ ID NO: 795452 - RNA, 22 nt, Human
ugcuuaaucaagaagccuauuu

SEQ ID NO: 795453 - RNA, 19 nt, Human
acagcagggauuuuuggag

SEQ ID NO: 795454 - RNA, 22 nt, Human
uggcagauuuucucuggaggag

SEQ ID NO: 795455 - RNA, 22 nt, Human
uacaauguuaaggaaagagaga

SEQ ID NO: 795456 - RNA, 22 nt, Human
acauucuuaacaguuaaaaacu

SEQ ID NO: 795457 - RNA, 22 nt, Human
gccugccuuuguaugacccuga

SEQ ID NO: 795458 - RNA, 23 nt, Human
cugcaagguacaagaugcuggau

SEQ ID NO: 795459 - RNA, 22 nt, Human
guggcucuugcauggggucucu

SEQ ID NO: 795460 - RNA, 22 nt, Human
aaguuucaugauguaauuauug

SEQ ID NO: 795461 - RNA, 22 nt, Human
cuucuuaaaguugucacagcug

SEQ ID NO: 795462 - RNA, 22 nt, Human
cugugucucuccuuacaagacu

SEQ ID NO: 795463 - RNA, 15 nt, Human
cagucccagggaccc

SEQ ID NO: 795464 - RNA, 22 nt, Human
gcuucccauuauggaaacucuu

SEQ ID NO: 795465 - RNA, 22 nt, Human
gcaauaaagauuuuacugucag

SEQ ID NO: 795466 - RNA, 22 nt, Human
ugaggugguuacuguggugcuc

SEQ ID NO: 795467 - RNA, 22 nt, Human
aaggggccucacagaugggcuu

SEQ ID NO: 795468 - RNA, 22 nt, Human
ucuuauuuuuuaaugacagaga

SEQ ID NO: 795469 - RNA, 21 nt, Human
acagaugggaugagcacacug

SEQ ID NO: 795470 - RNA, 22 nt, Human
agcccuuuccaauuugauuuau

SEQ ID NO: 795471 - RNA, 22 nt, Human
ccccagagaaagucagcagcau

SEQ ID NO: 795472 - RNA, 22 nt, Human
uggcagcuacagacagagguga

SEQ ID NO: 795473 - RNA, 22 nt, Human
acagaggcugcgcuugggaacg

SEQ ID NO: 795474 - RNA, 22 nt, Human
uucagcagugcagacacccagu

SEQ ID NO: 795475 - RNA, 22 nt, Human
cagcccugcagagggcgcuccu

SEQ ID NO: 795476 - RNA, 23 nt, Human
gaggagggucugacaaguguagc

SEQ ID NO: 795477 - RNA, 23 nt, Human
agucaagaugcaucugugaggaa

SEQ ID NO: 795478 - RNA, 22 nt, Human
cugccucucagccugaccgcca

SEQ ID NO: 795479 - RNA, 22 nt, Human
accuccuggugcccaaguguuu

SEQ ID NO: 795480 - RNA, 22 nt, Human
ucagcccugggcuuccucaugg

SEQ ID NO: 795481 - RNA, 22 nt, Human
cccaggcugucuguccuuugcu

SEQ ID NO: 795482 - RNA, 22 nt, Human
gacccuccacucacugcugugu

SEQ ID NO: 795483 - RNA, 22 nt, Human
acaacacagcuuuccucaaguu

SEQ ID NO: 795484 - RNA, 22 nt, Human
uuccugguuuauggaaagcaug

SEQ ID NO: 795485 - RNA, 22 nt, Human
cugcagcuaaggaaugugguug

SEQ ID NO: 795486 - RNA, 22 nt, Human
agagcugggugguggugacuca

SEQ ID NO: 795487 - RNA, 22 nt, Human
uugcaaaucuuugccagaaggc

SEQ ID NO: 795488 - RNA, 22 nt, Human
uagcaggcucgcaauaaaaugu

SEQ ID NO: 795489 - RNA, 22 nt, Human
acauuugagcaucuacuaagug

SEQ ID NO: 795490 - RNA, 22 nt, Human
ucaggagcagccuuggagagcg

SEQ ID NO: 795491 - RNA, 22 nt, Human
agagggagcccagucauagcug

SEQ ID NO: 795492 - RNA, 20 nt, Human
ugccccaggccugcaccugc

SEQ ID NO: 795493 - RNA, 20 nt, Human
gccacaguuuucucacugca

SEQ ID NO: 795494 - RNA, 22 nt, Human
ugccagcuccgaggagcugcag

SEQ ID NO: 795495 - RNA, 22 nt, Human
ugagcagacuugaugaggcagc

SEQ ID NO: 795496 - RNA, 22 nt, Human
uuguuuuaucuuucuacagacu

SEQ ID NO: 795497 - RNA, 22 nt, Human
ugcuuaaacauacuauuuauau

SEQ ID NO: 795498 - RNA, 22 nt, Human
ugagccaggcuccaugccaccu

SEQ ID NO: 795499 - RNA, 22 nt, Human
uagcuuugaccaacgacugguc

SEQ ID NO: 795500 - RNA, 22 nt, Human
auuuccuugcaaguuucuguaa

SEQ ID NO: 795501 - RNA, 20 nt, Human
aggcccagugaauauauugc

SEQ ID NO: 795502 - RNA, 22 nt, Human
uaaaggccuaguaaguugagac

SEQ ID NO: 795503 - RNA, 22 nt, Human
agaaguuaccacauacuucucu

SEQ ID NO: 795504 - RNA, 22 nt, Human
acaagauagcuuagaagauuca

SEQ ID NO: 795505 - RNA, 22 nt, Human
uuucauugugaugcuuuuauca

SEQ ID NO: 795506 - RNA, 22 nt, Human
agaaggcuaaagaaacagauug

SEQ ID NO: 795507 - RNA, 22 nt, Human
uguuuuguagcuaauagcuauu

SEQ ID NO: 795508 - RNA, 22 nt, Human
gaggcccaaggacucugucccg

SEQ ID NO: 795509 - RNA, 22 nt, Human
aaggcuucuuuaguguccuaau

SEQ ID NO: 795510 - RNA, 22 nt, Human
uuugcauuuugauaagaucacu

SEQ ID NO: 795511 - RNA, 22 nt, Human
ucaggacaacaagacuuguuua

SEQ ID NO: 795512 - RNA, 22 nt, Human
acagacaucaucaacaucuucc

SEQ ID NO: 795513 - RNA, 22 nt, Human
gcuuccaguccucagaggcugg

SEQ ID NO: 795514 - RNA, 22 nt, Human
aguucucauugcaugagacaga

SEQ ID NO: 795515 - RNA, 22 nt, Human
uuuuggcucugcagguuugcac

SEQ ID NO: 795516 - RNA, 22 nt, Human
ugagcccagaagcccacucggc

SEQ ID NO: 795517 - RNA, 22 nt, Human
agcacuuugugcauuucugaag

SEQ ID NO: 795518 - RNA, 22 nt, Human
cccagcaggcauguugggagga

SEQ ID NO: 795519 - RNA, 22 nt, Human
ugaggccaggacccccagcagg

SEQ ID NO: 795520 - RNA, 22 nt, Human
uuggcugguuucaagaaggcau

SEQ ID NO: 795521 - RNA, 22 nt, Human
cuucuggaggacacuggcccca

SEQ ID NO: 795522 - RNA, 22 nt, Human
caggcagagguaccaagauuga

SEQ ID NO: 795523 - RNA, 22 nt, Human
caggcagaaauuuuguuucauu

SEQ ID NO: 795524 - RNA, 22 nt, Human
ugcagaugaaugcugagacacu

SEQ ID NO: 795525 - RNA, 22 nt, Human
gcugucuggcauggcguggcug

SEQ ID NO: 795526 - RNA, 22 nt, Human
cuagagaauugucuugagaguu

SEQ ID NO: 795527 - RNA, 22 nt, Human
cugugcugucuugggagccuua

SEQ ID NO: 795528 - RNA, 22 nt, Human
ucccugggaccggcagcucaca

SEQ ID NO: 795529 - RNA, 22 nt, Human
cucucuucccgugaguguugca

SEQ ID NO: 795530 - RNA, 22 nt, Human
ggagggcccugggugcagcucu

SEQ ID NO: 795531 - RNA, 22 nt, Human
uccagcagguuggucaggugca

SEQ ID NO: 795532 - RNA, 22 nt, Human
uggcagcugcaggccuccugag

SEQ ID NO: 795533 - RNA, 22 nt, Human
uaugccuggaaccuuucucuuu

SEQ ID NO: 795534 - RNA, 22 nt, Human
cugacucuccucaagcauaaau

SEQ ID NO: 795535 - RNA, 22 nt, Human
auuuaauggguagacauuguua

SEQ ID NO: 795536 - RNA, 22 nt, Human
agccugagugcuuaggacuguu

SEQ ID NO: 795537 - RNA, 22 nt, Human
gaggacagcucuaacuaaaguc

SEQ ID NO: 795538 - RNA, 22 nt, Human
acaugcuuguuuuucacaaccu

SEQ ID NO: 795539 - RNA, 22 nt, Human
uacaaaguagaaauucaguaaa

SEQ ID NO: 795540 - RNA, 22 nt, Human
ggagcaggcucugugguuucca

SEQ ID NO: 795541 - RNA, 22 nt, Human
aaggccaaggcugcagugagcc

SEQ ID NO: 795542 - RNA, 21 nt, Human
cagcuuugucugucuucgggg

SEQ ID NO: 795543 - RNA, 22 nt, Human
ucagagaaggcaauuuuauggu

SEQ ID NO: 795544 - RNA, 21 nt, Human
ccugcagcaccagaaggagau

SEQ ID NO: 795545 - RNA, 22 nt, Human
acaggggcuccgaaggugaggg

SEQ ID NO: 795546 - RNA, 22 nt, Human
augggaggcaaagaucgcagaa

SEQ ID NO: 795547 - RNA, 22 nt, Human
ucaaaggcuugugguucuggga

SEQ ID NO: 795548 - RNA, 22 nt, Human
caugaugguucuuacaaaggug

SEQ ID NO: 795549 - RNA, 22 nt, Human
ucaggccaaagaaacagcauga

SEQ ID NO: 795550 - RNA, 22 nt, Human
ggguaggagaggugucugugug

SEQ ID NO: 795551 - RNA, 21 nt, Human
cagagggcuuuucucuguucu

SEQ ID NO: 795552 - RNA, 22 nt, Human
agucacaggcaagagggcucca

SEQ ID NO: 795553 - RNA, 21 nt, Human
auguaggguuugccuucucua

SEQ ID NO: 795554 - RNA, 22 nt, Human
agggaagcaaugauuauuauuc

SEQ ID NO: 795555 - RNA, 22 nt, Human
uuuuucuggauaacuguaucuc

SEQ ID NO: 795556 - RNA, 22 nt, Human
aggaacaauugauaaacucaca

SEQ ID NO: 795557 - RNA, 22 nt, Human
ccugggucacucaggcaggcgg

SEQ ID NO: 795558 - RNA, 22 nt, Human
gcucccugcacucugcagcccu

SEQ ID NO: 795559 - RNA, 22 nt, Human
cagcugugucuaauuauggcug

SEQ ID NO: 795560 - RNA, 22 nt, Human
ggucugagugccagggagagaa

SEQ ID NO: 795561 - RNA, 22 nt, Human
gaguauuccucagucauuuugu

SEQ ID NO: 795562 - RNA, 20 nt, Human
agcuggcccccgguggccug

SEQ ID NO: 795563 - RNA, 22 nt, Human
guacauauggcacaugcuauuu

SEQ ID NO: 795564 - RNA, 22 nt, Human
cccuugggccccagcucagggc

SEQ ID NO: 795565 - RNA, 22 nt, Human
uaaacauggcuguuucaguuau

SEQ ID NO: 795566 - RNA, 22 nt, Human
agagccuggagguucugcugaa

SEQ ID NO: 795567 - RNA, 22 nt, Human
cuuuggcugggcaaagggaggu

SEQ ID NO: 795568 - RNA, 22 nt, Human
uccuuucccuuuccauccuggc

SEQ ID NO: 795569 - RNA, 22 nt, Human
uuauugcagauggugugagaga

SEQ ID NO: 795570 - RNA, 22 nt, Human
aaacuacacuuugggaccagca

SEQ ID NO: 795571 - RNA, 22 nt, Human
uuuauucagcagcagcaguggu

SEQ ID NO: 795572 - RNA, 22 nt, Human
agauuucccacuccauguauug

SEQ ID NO: 795573 - RNA, 22 nt, Human
ccacccaugugacuaccucaug

SEQ ID NO: 795574 - RNA, 22 nt, Human
gggaagagugucgguugaagug

SEQ ID NO: 795575 - RNA, 22 nt, Human
gcugccucuccugaguugacag

SEQ ID NO: 795576 - RNA, 22 nt, Human
uaaaggcagccuaggaaguguu

SEQ ID NO: 795577 - RNA, 20 nt, Human
ucuaaaguacaguuugugug

SEQ ID NO: 795578 - RNA, 22 nt, Human
caggcaugaugggaagugccug

SEQ ID NO: 795579 - RNA, 22 nt, Human
acagcaggcccauacuggaagg

SEQ ID NO: 795580 - RNA, 22 nt, Human
accccaggaaguggaggucaug

SEQ ID NO: 795581 - RNA, 22 nt, Human
gcagcaaacuuccacaaguaga

SEQ ID NO: 795582 - RNA, 22 nt, Human
aacugcaaguggggcuugucau

SEQ ID NO: 795583 - RNA, 22 nt, Human
uauuugcaggacauagauaugg

SEQ ID NO: 795584 - RNA, 21 nt, Human
ugcuuuaugggaaaaauguca

SEQ ID NO: 795585 - RNA, 22 nt, Human
ccugggccaggcuugggaaugc

SEQ ID NO: 795586 - RNA, 22 nt, Human
gacugaggccuuuauugagaca

SEQ ID NO: 795587 - RNA, 22 nt, Human
ucucaaacuacacuguaaauug

SEQ ID NO: 795588 - RNA, 17 nt, Human
uggucuggaagaacuga

SEQ ID NO: 795589 - RNA, 22 nt, Human
aggcaaauugugagaaaaugaa

SEQ ID NO: 795590 - RNA, 22 nt, Human
caaugaaauugagauccagaga

SEQ ID NO: 795591 - RNA, 22 nt, Human
ccuuucaaaacagaacacuagc

SEQ ID NO: 795592 - RNA, 22 nt, Human
ccucacccagucaccuaggugg

SEQ ID NO: 795593 - RNA, 22 nt, Human
aaacuagguucugauuuccaag

SEQ ID NO: 795594 - RNA, 20 nt, Human
uggcccagcacgacgaggac

SEQ ID NO: 795595 - RNA, 22 nt, Human
ucaggccacuucacaggugauu

SEQ ID NO: 795596 - RNA, 22 nt, Human
aaacuuugguauguagcaaaac

SEQ ID NO: 795597 - RNA, 22 nt, Human
augcuggauugagagcaagggg

SEQ ID NO: 795598 - RNA, 22 nt, Human
uggaagugcuaaacuggagugu

SEQ ID NO: 795599 - RNA, 16 nt, Human
auuguuuucaauuaga

SEQ ID NO: 795600 - RNA, 22 nt, Human
uuggagggacagauggcuaggc

SEQ ID NO: 795601 - RNA, 22 nt, Human
auuuaaaugcuuaagaggguuu

SEQ ID NO: 795602 - RNA, 22 nt, Human
ccaugcaaggagaacucucacu

SEQ ID NO: 795603 - RNA, 22 nt, Human
aaggcagagggcuggaucagag

SEQ ID NO: 795604 - RNA, 22 nt, Human
uaaaaguauacuuucaaaggag

SEQ ID NO: 795605 - RNA, 22 nt, Human
uccagggaccucccugagagcu

SEQ ID NO: 795606 - RNA, 21 nt, Human
aagcuguguuccacugauagc

SEQ ID NO: 795607 - RNA, 23 nt, Human
gcccucccucccagguggguguu

SEQ ID NO: 795608 - RNA, 21 nt, Human
ccccugggagcccugucagua

SEQ ID NO: 795609 - RNA, 22 nt, Human
uauucacaguugauuuacaguu

SEQ ID NO: 795610 - RNA, 22 nt, Human
aaugaaaugaagauaugaucag

SEQ ID NO: 795611 - RNA, 22 nt, Human
ggcaggugcucugugggccugg

SEQ ID NO: 795612 - RNA, 22 nt, Human
aauaaauguuaagauugucuca

SEQ ID NO: 795613 - RNA, 22 nt, Human
ucccccaacucuuagcacugua

SEQ ID NO: 795614 - RNA, 22 nt, Human
cucccaggccaugcucuagcca

SEQ ID NO: 795615 - RNA, 22 nt, Human
agcagagaagacacaggcuuca

SEQ ID NO: 795616 - RNA, 22 nt, Human
aaauuccauuaugauaauuucg

SEQ ID NO: 795617 - RNA, 22 nt, Human
uguuuuaugagccauauaaccu

SEQ ID NO: 795618 - RNA, 22 nt, Human
gaggaagccccauugaagccag

SEQ ID NO: 795619 - RNA, 22 nt, Human
uggaagagcaggcagacaaugc

SEQ ID NO: 795620 - RNA, 22 nt, Human
accuuuuuucagaacucuaaag

SEQ ID NO: 795621 - RNA, 22 nt, Human
cagggugggcacccagccucca

SEQ ID NO: 795622 - RNA, 21 nt, Human
ggcagcccgcccucuccuggc

SEQ ID NO: 795623 - RNA, 20 nt, Human
ucuguaggcaaguuagcagg

SEQ ID NO: 795624 - RNA, 22 nt, Human
ccaggcugcuuagccuuaucuu

SEQ ID NO: 795625 - RNA, 22 nt, Human
agauuagguaugguuuaaguag

SEQ ID NO: 795626 - RNA, 22 nt, Human
auuucuguggcuucauucuccu

SEQ ID NO: 795627 - RNA, 21 nt, Human
gccugccugcgugacccucuu

SEQ ID NO: 795628 - RNA, 22 nt, Human
gaccuuccuucuuugcuccggg

SEQ ID NO: 795629 - RNA, 22 nt, Human
guccagggaaauagcgacaggg

SEQ ID NO: 795630 - RNA, 22 nt, Human
ggcccucuggcuuccgcauggg

SEQ ID NO: 795631 - RNA, 22 nt, Human
agacaauuucaaaguaauauua

SEQ ID NO: 795632 - RNA, 22 nt, Human
uuuuggcacugcgucuacaugg

SEQ ID NO: 795633 - RNA, 22 nt, Human
cacagugcuguuuguaaagaga

SEQ ID NO: 795634 - RNA, 22 nt, Human
auuaaauuaaguggcuaauuua

SEQ ID NO: 795635 - RNA, 22 nt, Human
cuccagccucaucuccuggcug

SEQ ID NO: 795636 - RNA, 22 nt, Human
gaaaggaacuugugagugggag

SEQ ID NO: 795637 - RNA, 22 nt, Human
gcacaggcaauagauacagcua

SEQ ID NO: 795638 - RNA, 20 nt, Human
ccaauaaagcucuauaggga

SEQ ID NO: 795639 - RNA, 22 nt, Human
ccuccccacagcccaggagacu

SEQ ID NO: 795640 - RNA, 22 nt, Human
cugaaugaggaaaagagugagg

SEQ ID NO: 795641 - RNA, 22 nt, Human
aacaaauuuagcucugagugcu

SEQ ID NO: 795642 - RNA, 22 nt, Human
acagucuuucaguaauaauacu

SEQ ID NO: 795643 - RNA, 22 nt, Human
gccagcaguauguccuggcagu

SEQ ID NO: 795644 - RNA, 22 nt, Human
uggccccauuuuacagaugaaa

SEQ ID NO: 795645 - RNA, 22 nt, Human
aauucaaucuaagaaaugauca

SEQ ID NO: 795646 - RNA, 22 nt, Human
uaucaguccaggguuuugugac

SEQ ID NO: 795647 - RNA, 22 nt, Human
ucagcagggccuccuugugcag

SEQ ID NO: 795648 - RNA, 22 nt, Human
acaagaauaaggauaagagauu

SEQ ID NO: 795649 - RNA, 22 nt, Human
gcugccuguccugaggaguccg

SEQ ID NO: 795650 - RNA, 22 nt, Human
agaaggccagauggacggggcu

SEQ ID NO: 795651 - RNA, 22 nt, Human
agugcaggagccuggccagagc

SEQ ID NO: 795652 - RNA, 22 nt, Human
uuucaauuuccaggcuagaauu

SEQ ID NO: 795653 - RNA, 22 nt, Human
ggcagguggaaguuggcagagc

SEQ ID NO: 795654 - RNA, 22 nt, Human
caucaggaaaaaacuggagcca

SEQ ID NO: 795655 - RNA, 22 nt, Human
gguucacacuaagcuuaagugg

SEQ ID NO: 795656 - RNA, 22 nt, Human
aguuuucugauguguagugaga

SEQ ID NO: 795657 - RNA, 23 nt, Human
auuguuuuuggcucucagggaau

SEQ ID NO: 795658 - RNA, 23 nt, Human
augaaaugauacuuuauucacug

SEQ ID NO: 795659 - RNA, 22 nt, Human
gaaaggggcauguagggaucac

SEQ ID NO: 795660 - RNA, 20 nt, Human
aagcacauuucuacaauaau

SEQ ID NO: 795661 - RNA, 22 nt, Human
agccaaugcguaaaaagaucua

SEQ ID NO: 795662 - RNA, 22 nt, Human
uuucaugucauuccauuucaga

SEQ ID NO: 795663 - RNA, 22 nt, Human
auguuccuuccagagagcagaa

SEQ ID NO: 795664 - RNA, 20 nt, Human
uggcucucacccugugcgau

SEQ ID NO: 795665 - RNA, 22 nt, Human
ucuuuaaaguuggagcuugcaa

SEQ ID NO: 795666 - RNA, 22 nt, Human
uaggacaggcuaaaagggauaa

SEQ ID NO: 795667 - RNA, 22 nt, Human
gcccagccccuggguggacgug

SEQ ID NO: 795668 - RNA, 17 nt, Human
ggccacagagcuugggg

SEQ ID NO: 795669 - RNA, 22 nt, Human
gcuggcauggagacucuggguc

SEQ ID NO: 795670 - RNA, 22 nt, Human
uggaggugggagggacuguccu

SEQ ID NO: 795671 - RNA, 22 nt, Human
guauuuuacugcucaaagcucu

SEQ ID NO: 795672 - RNA, 22 nt, Human
cucuggaggccuaaggaagugg

SEQ ID NO: 795673 - RNA, 20 nt, Human
gaggaaccacugggaggaga

SEQ ID NO: 795674 - RNA, 20 nt, Human
aggaaggaaguuugcaugga

SEQ ID NO: 795675 - RNA, 22 nt, Human
augaacauccuaggaggcauuu

SEQ ID NO: 795676 - RNA, 22 nt, Human
gaauuuaagaggaugaaucugu

SEQ ID NO: 795677 - RNA, 20 nt, Human
guggcagugguggcagcagu

SEQ ID NO: 795678 - RNA, 22 nt, Human
ggaauacuaaaggaagcaauug

SEQ ID NO: 795679 - RNA, 22 nt, Human
agggccuggaacugugggcagg

SEQ ID NO: 795680 - RNA, 23 nt, Human
cagaaaguuugagaagauacauc

SEQ ID NO: 795681 - RNA, 22 nt, Human
ccagcugcaggggagcagugga

SEQ ID NO: 795682 - RNA, 22 nt, Human
gcagaggccuagguggaaggcc

SEQ ID NO: 795683 - RNA, 22 nt, Human
caaaguaugaaccaguuucucu

SEQ ID NO: 795684 - RNA, 22 nt, Human
uguucucuaagaaaagaagcau

SEQ ID NO: 795685 - RNA, 22 nt, Human
gggcacaccuugucugagcaca

SEQ ID NO: 795686 - RNA, 22 nt, Human
cgcuggcuuccuccuggggcca

SEQ ID NO: 795687 - RNA, 22 nt, Human
aaccaguuucaaagaaaauugc

SEQ ID NO: 795688 - RNA, 22 nt, Human
caggcugugaaacugagaugcg

SEQ ID NO: 795689 - RNA, 22 nt, Human
aaacacacagaaaugaaugagg

SEQ ID NO: 795690 - RNA, 22 nt, Human
gaaggcuggggcaucagugaaa

SEQ ID NO: 795691 - RNA, 22 nt, Human
cuuggccucuucucaggguggg

SEQ ID NO: 795692 - RNA, 22 nt, Human
ggcucaggccagaccacgacuc

SEQ ID NO: 795693 - RNA, 22 nt, Human
uaaauuauguuccauguccuuu

SEQ ID NO: 795694 - RNA, 22 nt, Human
uucaacaagucuuuuuucacug

SEQ ID NO: 795695 - RNA, 21 nt, Human
aggcccaggaauaugcauuuu

SEQ ID NO: 795696 - RNA, 22 nt, Human
auggagugccuguggcaguggg

SEQ ID NO: 795697 - RNA, 22 nt, Human
uuuauucugugcuacaugaaga

SEQ ID NO: 795698 - RNA, 22 nt, Human
ucaaaguauuuuaacuguaucc

SEQ ID NO: 795699 - RNA, 22 nt, Human
aguucaaaaagguaaaguuuau

SEQ ID NO: 795700 - RNA, 22 nt, Human
auuuuucagcuucauugaggca

SEQ ID NO: 795701 - RNA, 22 nt, Human
uucuggaaguggaauuuuugua

SEQ ID NO: 795702 - RNA, 22 nt, Human
uggagguggcacaagggagguc

SEQ ID NO: 795703 - RNA, 22 nt, Human
augcaaaauaaggcagaaacau

SEQ ID NO: 795704 - RNA, 22 nt, Human
auauuuacugcuguggugaagg

SEQ ID NO: 795705 - RNA, 22 nt, Human
guuguuuuaaaauacuccagaa

SEQ ID NO: 795706 - RNA, 22 nt, Human
agugggagagaagcaaguagua

SEQ ID NO: 795707 - RNA, 22 nt, Human
uuggcagggccaggcucucucu

SEQ ID NO: 795708 - RNA, 22 nt, Human
ugagccaaggccucaagaauuu

SEQ ID NO: 795709 - RNA, 22 nt, Human
agauuuccucuuuuguaaagug

SEQ ID NO: 795710 - RNA, 22 nt, Human
aggcuuggaaguggcagaacug

SEQ ID NO: 795711 - RNA, 22 nt, Human
ccuggcucauuaugugccccca

SEQ ID NO: 795712 - RNA, 22 nt, Human
gucauucucuggugugguuguu

SEQ ID NO: 795713 - RNA, 22 nt, Human
agacaaaugguaauuaugucua

SEQ ID NO: 795714 - RNA, 19 nt, Human
acagucuuacaaaugucca

SEQ ID NO: 795715 - RNA, 22 nt, Human
gggcccuggggccugauuugca

SEQ ID NO: 795716 - RNA, 22 nt, Human
ccucaaauugcucagcgucuag

SEQ ID NO: 795717 - RNA, 22 nt, Human
aaauauacggucccuaacaguc

SEQ ID NO: 795718 - RNA, 22 nt, Human
ucauaaaaauagacucuaaagu

SEQ ID NO: 795719 - RNA, 22 nt, Human
aagcagcauucagugaaaugug

SEQ ID NO: 795720 - RNA, 22 nt, Human
cugccuagaaaaccaggcuccu

SEQ ID NO: 795721 - RNA, 17 nt, Human
agcuagggccuagaauc

SEQ ID NO: 795722 - RNA, 22 nt, Human
cccaggaggcgcagguugcggu

SEQ ID NO: 795723 - RNA, 22 nt, Human
agguuuggguucauugcuggcu

SEQ ID NO: 795724 - RNA, 22 nt, Human
uucaccauuucccacuaaacca

SEQ ID NO: 795725 - RNA, 22 nt, Human
ggcgccagcacugcagcgccuc

SEQ ID NO: 795726 - RNA, 21 nt, Human
gccucugcugucuuauuguga

SEQ ID NO: 795727 - RNA, 22 nt, Human
ccacagcaccugcagccaguug

SEQ ID NO: 795728 - RNA, 22 nt, Human
acacacagguaaaggagccugg

SEQ ID NO: 795729 - RNA, 22 nt, Human
ggcccugcaagguacccaggcc

SEQ ID NO: 795730 - RNA, 22 nt, Human
ggcugaggcucaugccaucuug

SEQ ID NO: 795731 - RNA, 22 nt, Human
acaauauaguccaugagcaugc

SEQ ID NO: 795732 - RNA, 22 nt, Human
cuacacaguucugccuaauggc

SEQ ID NO: 795733 - RNA, 22 nt, Human
ccauuuguuguguauuaauauu

SEQ ID NO: 795734 - RNA, 22 nt, Human
agccacagagagggagcugcaa

SEQ ID NO: 795735 - RNA, 22 nt, Human
ucccaggguuacagccagggca

SEQ ID NO: 795736 - RNA, 22 nt, Human
cucuuuggggugccccacuggu

SEQ ID NO: 795737 - RNA, 22 nt, Human
uaggcagugcucugugcuucag

SEQ ID NO: 795738 - RNA, 22 nt, Human
aaauagaauuaacuagcuacug

SEQ ID NO: 795739 - RNA, 22 nt, Human
aagcuguuuuuagguggaggua

SEQ ID NO: 795740 - RNA, 22 nt, Human
cuugaauugggggaagaucacu

SEQ ID NO: 795741 - RNA, 22 nt, Human
gcugcagcagcugcaggguugu

SEQ ID NO: 795742 - RNA, 22 nt, Human
cugccaugcucaagaagucuuu

SEQ ID NO: 795743 - RNA, 22 nt, Human
ucaggacagaaggcugccaggg

SEQ ID NO: 795744 - RNA, 21 nt, Human
ucagaacuggugcagaugaau

SEQ ID NO: 795745 - RNA, 22 nt, Human
ugccagcucccuuuucuccucc

SEQ ID NO: 795746 - RNA, 22 nt, Human
ugccaggccucaggagucucca

SEQ ID NO: 795747 - RNA, 22 nt, Human
aucaaagagcuugacaauccua

SEQ ID NO: 795748 - RNA, 22 nt, Human
ggcagauggaagaggcuggguc

SEQ ID NO: 795749 - RNA, 22 nt, Human
ugcuggcucugggccaagcagg

SEQ ID NO: 795750 - RNA, 22 nt, Human
aagccagggucaggggccuccu

SEQ ID NO: 795751 - RNA, 22 nt, Human
uacagaaagggaugauugaucu

SEQ ID NO: 795752 - RNA, 22 nt, Human
ugcagcaccacaccuggcuaau

SEQ ID NO: 795753 - RNA, 22 nt, Human
uucuugauguaccaacuuggga

SEQ ID NO: 795754 - RNA, 22 nt, Human
gacagggcauggugcagaguuc

SEQ ID NO: 795755 - RNA, 22 nt, Human
uacuauuuggaauuuuaaauug

SEQ ID NO: 795756 - RNA, 17 nt, Human
agauggcaggaggcaga

SEQ ID NO: 795757 - RNA, 22 nt, Human
ggcucugccgugugcucacaug

SEQ ID NO: 795758 - RNA, 22 nt, Human
gagauauuuauucauacuguca

SEQ ID NO: 795759 - RNA, 22 nt, Human
gugcuuauccccauucuggagg

SEQ ID NO: 795760 - RNA, 23 nt, Human
ugcuucucugcuugacaguucug

SEQ ID NO: 795761 - RNA, 20 nt, Human
aaguccugaccuagucuaaa

SEQ ID NO: 795762 - RNA, 22 nt, Human
ccugagccgagcgcucuuucuc

SEQ ID NO: 795763 - RNA, 18 nt, Human
gcagagcagaagcucaag

SEQ ID NO: 795764 - RNA, 22 nt, Human
uuuuauuaguggcuagaugggg

SEQ ID NO: 795765 - RNA, 22 nt, Human
agaaauuaggaaaguaacacuu

SEQ ID NO: 795766 - RNA, 23 nt, Human
cagcugaagcagccugggcugga

SEQ ID NO: 795767 - RNA, 22 nt, Human
ucaccccuggcccagucuugga

SEQ ID NO: 795768 - RNA, 22 nt, Human
agcagcugagccccagcuguga

SEQ ID NO: 795769 - RNA, 21 nt, Human
uucaacaaagggaauaaguuu

SEQ ID NO: 795770 - RNA, 17 nt, Human
gcugccaccuuuggagc

SEQ ID NO: 795771 - RNA, 22 nt, Human
aaucagaacuucucaggguggg

SEQ ID NO: 795772 - RNA, 22 nt, Human
agcugcagucaagcugggccac

SEQ ID NO: 795773 - RNA, 22 nt, Human
guucuauucauugcuccacgag

SEQ ID NO: 795774 - RNA, 22 nt, Human
agccacagcgaaccucucuucc

SEQ ID NO: 795775 - RNA, 22 nt, Human
cccucccagaugggcuugaggu

SEQ ID NO: 795776 - RNA, 22 nt, Human
cugcccucuagggaugcacugg

SEQ ID NO: 795777 - RNA, 22 nt, Human
uugggggcauauugaguagugg

SEQ ID NO: 795778 - RNA, 22 nt, Human
cagugucaggaucaguauauuu

SEQ ID NO: 795779 - RNA, 20 nt, Human
aguacaauguaugauucaga

SEQ ID NO: 795780 - RNA, 22 nt, Human
aggaaaaugaaacagcaacugu

SEQ ID NO: 795781 - RNA, 22 nt, Human
aggcugugggaguugagagucu

SEQ ID NO: 795782 - RNA, 22 nt, Human
agccaaggacacggagccuccu

SEQ ID NO: 795783 - RNA, 22 nt, Human
caauagaaaacucaauacuuaa

SEQ ID NO: 795784 - RNA, 22 nt, Human
acucugccccgaguucugggaa

SEQ ID NO: 795785 - RNA, 22 nt, Human
gaggagcuggcagcgucuccgc

SEQ ID NO: 795786 - RNA, 23 nt, Human
uuguuuaccguaggacuuuuaac

SEQ ID NO: 795787 - RNA, 22 nt, Human
uccaggccauugacugcauccu

SEQ ID NO: 795788 - RNA, 22 nt, Human
gggaggugauggcaagcagcgg

SEQ ID NO: 795789 - RNA, 21 nt, Human
agcaggaggcagucacagcuc

SEQ ID NO: 795790 - RNA, 19 nt, Human
auucauuuuugccuucuaa

SEQ ID NO: 795791 - RNA, 22 nt, Human
gagcauggauagaaggugggau

SEQ ID NO: 795792 - RNA, 22 nt, Human
aucaaagauguuucagggugua

SEQ ID NO: 795793 - RNA, 22 nt, Human
uggggaaaagcguuaggaguuc

SEQ ID NO: 795794 - RNA, 22 nt, Human
aaaaguucauuagugagcuucu

SEQ ID NO: 795795 - RNA, 22 nt, Human
aagcuuuaagugucagucagcc

SEQ ID NO: 795796 - RNA, 22 nt, Human
uuauuuaauuuucucacucaga

SEQ ID NO: 795797 - RNA, 22 nt, Human
aauucacaccuccgguuuuucu

SEQ ID NO: 795798 - RNA, 22 nt, Human
aggcccagcuugaagugggaag

SEQ ID NO: 795799 - RNA, 19 nt, Human
agaaggcuccuguuggaga

SEQ ID NO: 795800 - RNA, 22 nt, Human
uggcuggaagucagaaauggga

SEQ ID NO: 795801 - RNA, 22 nt, Human
auguauaugugaaagauguuua

SEQ ID NO: 795802 - RNA, 22 nt, Human
uuacauaaaaguucacguaggc

SEQ ID NO: 795803 - RNA, 22 nt, Human
uuguauacauuauccuguuuca

SEQ ID NO: 795804 - RNA, 22 nt, Human
acaaacagaguugaaaaauagg

SEQ ID NO: 795805 - RNA, 22 nt, Human
ccuggcuguuuauuucggggcu

SEQ ID NO: 795806 - RNA, 19 nt, Human
cuguuucugagcuugcuuu

SEQ ID NO: 795807 - RNA, 22 nt, Human
uacacaguauaugggaucacag

SEQ ID NO: 795808 - RNA, 22 nt, Human
cggccgcagcagugucggccca

SEQ ID NO: 795809 - RNA, 22 nt, Human
cucuuuggauguuuaugauaag

SEQ ID NO: 795810 - RNA, 22 nt, Human
gauagaaagguguugaaaucca

SEQ ID NO: 795811 - RNA, 22 nt, Human
ggagggagggcuagaccaaaga

SEQ ID NO: 795812 - RNA, 22 nt, Human
ugcuggcugcagugcugucaaa

SEQ ID NO: 795813 - RNA, 20 nt, Human
agcucuuuuuagcuaaggua

SEQ ID NO: 795814 - RNA, 22 nt, Human
acaugugcucuugcuguacagc

SEQ ID NO: 795815 - RNA, 22 nt, Human
aagaagcagcugccaggccagu

SEQ ID NO: 795816 - RNA, 22 nt, Human
caguuauaagacuaagcuauuc

SEQ ID NO: 795817 - RNA, 22 nt, Human
ggagccagagcacuggggagcc

SEQ ID NO: 795818 - RNA, 22 nt, Human
gagcccagucugcuccugcgcc

SEQ ID NO: 795819 - RNA, 22 nt, Human
aacccaggagccggagguugug

SEQ ID NO: 795820 - RNA, 22 nt, Human
gcugcagcuuuaggauccagug

SEQ ID NO: 795821 - RNA, 22 nt, Human
gcuggccugcgagggcaggcug

SEQ ID NO: 795822 - RNA, 22 nt, Human
cucuuuggcccccgaugauuca

SEQ ID NO: 795823 - RNA, 22 nt, Human
cugaaaagcuuugaaccguuaa

SEQ ID NO: 795824 - RNA, 22 nt, Human
ccuggcucugaaguccacauca

SEQ ID NO: 795825 - RNA, 21 nt, Human
gucaggagccgucuuacauuc

SEQ ID NO: 795826 - RNA, 22 nt, Human
gggaagcugaagcuagagaaaa

SEQ ID NO: 795827 - RNA, 22 nt, Human
ccuggcagcuguuuggcuuggc

SEQ ID NO: 795828 - RNA, 22 nt, Human
aggcccaugugagucuuguccu

SEQ ID NO: 795829 - RNA, 22 nt, Human
agacuucuugagcuggcacuuc

SEQ ID NO: 795830 - RNA, 22 nt, Human
uccagccuugccacuuuucugu

SEQ ID NO: 795831 - RNA, 22 nt, Human
agcaggcaggaaugguggaaca

SEQ ID NO: 795832 - RNA, 22 nt, Human
gauuucugggcuuuauuucaga

SEQ ID NO: 795833 - RNA, 22 nt, Human
gagguccagccaagcggcaagg

SEQ ID NO: 795834 - RNA, 23 nt, Human
ggguccagagaagccauuagggc

SEQ ID NO: 795835 - RNA, 22 nt, Human
aaaauguaaagcuugaguguag

SEQ ID NO: 795836 - RNA, 22 nt, Human
ucuccuuugaaaguuaggacug

SEQ ID NO: 795837 - RNA, 22 nt, Human
aggcaaaucucaguuggccucu

SEQ ID NO: 795838 - RNA, 22 nt, Human
caggaugggauguagugggccc

SEQ ID NO: 795839 - RNA, 22 nt, Human
gaaaacuuggaucucuagaaug

SEQ ID NO: 795840 - RNA, 22 nt, Human
aaugacaagacauagucucuga

SEQ ID NO: 795841 - RNA, 22 nt, Human
gccucugcggggcccgagcccg

SEQ ID NO: 795842 - RNA, 22 nt, Human
uuuccagggcucuguagaagaa

SEQ ID NO: 795843 - RNA, 22 nt, Human
accagaaaggaauaauagaauu

SEQ ID NO: 795844 - RNA, 22 nt, Human
ugacagccucacuuuguuaauu

SEQ ID NO: 795845 - RNA, 22 nt, Human
gccaggcauuauuccgaucccu

SEQ ID NO: 795846 - RNA, 19 nt, Human
acccagcccaggaguggca

SEQ ID NO: 795847 - RNA, 22 nt, Human
aggcccagcugggccaggaaca

SEQ ID NO: 795848 - RNA, 22 nt, Human
agucugggcugucugcaggagu

SEQ ID NO: 795849 - RNA, 22 nt, Human
ggagggccccuccagugggcag

SEQ ID NO: 795850 - RNA, 22 nt, Human
uggaaugaauauguuuuaagga

SEQ ID NO: 795851 - RNA, 22 nt, Human
gucuaaacuuagggaucgaaca

SEQ ID NO: 795852 - RNA, 22 nt, Human
gucccuggaucugggacagcug

SEQ ID NO: 795853 - RNA, 22 nt, Human
ucugggggaggaggcauggccc

SEQ ID NO: 795854 - RNA, 22 nt, Human
ucacagaagaugcuggauguug

SEQ ID NO: 795855 - RNA, 22 nt, Human
gggcugugagaguggggcugcu

SEQ ID NO: 795856 - RNA, 22 nt, Human
aacaaaguuucaggaagauaga

SEQ ID NO: 795857 - RNA, 22 nt, Human
ucuuuacacaagacaagaauaa

SEQ ID NO: 795858 - RNA, 22 nt, Human
guccagagaggcaggaggcuac

SEQ ID NO: 795859 - RNA, 22 nt, Human
auaaacugugcuggaugaugag

SEQ ID NO: 795860 - RNA, 22 nt, Human
ccaguguccuuccuuuccaugg

SEQ ID NO: 795861 - RNA, 22 nt, Human
ugcuuaaaauaguucauuuuug

SEQ ID NO: 795862 - RNA, 22 nt, Human
aagguaauccauaauaguuacu

SEQ ID NO: 795863 - RNA, 22 nt, Human
cuuggcuccaaucccagcucug

SEQ ID NO: 795864 - RNA, 20 nt, Human
uucaaaguguaugauaugca

SEQ ID NO: 795865 - RNA, 22 nt, Human
gauucaaaguuaaugaagaugc

SEQ ID NO: 795866 - RNA, 22 nt, Human
ccagggcagaaaaagagggaau

SEQ ID NO: 795867 - RNA, 22 nt, Human
aaauucucuaaagaaaacauga

SEQ ID NO: 795868 - RNA, 22 nt, Human
ucuuuaagaguucauuugcaug

SEQ ID NO: 795869 - RNA, 22 nt, Human
caaauguuuuuauucuacaaca

SEQ ID NO: 795870 - RNA, 22 nt, Human
cuauacacuuuuugaaaauaga

SEQ ID NO: 795871 - RNA, 22 nt, Human
aucaacagagcaaagccugaac

SEQ ID NO: 795872 - RNA, 22 nt, Human
agcugugugugaauuuggccua

SEQ ID NO: 795873 - RNA, 22 nt, Human
acuccugguucccaguugagau

SEQ ID NO: 795874 - RNA, 22 nt, Human
uccaggcauguggccaguacuc

SEQ ID NO: 795875 - RNA, 19 nt, Human
ugaacagagaggacucugg

SEQ ID NO: 795876 - RNA, 22 nt, Human
ucacaggaaggguaaauauuua

SEQ ID NO: 795877 - RNA, 22 nt, Human
uaacuuguguuacauuacucuu

SEQ ID NO: 795878 - RNA, 22 nt, Human
acaggcugccuaccaaguauca

SEQ ID NO: 795879 - RNA, 17 nt, Human
acagcagggaaguguug

SEQ ID NO: 795880 - RNA, 22 nt, Human
auguuauuucugaaagaucauu

SEQ ID NO: 795881 - RNA, 22 nt, Human
ucacauuuuuuacuggacuuaa

SEQ ID NO: 795882 - RNA, 22 nt, Human
uuuucauuguuccucgagcauu

SEQ ID NO: 795883 - RNA, 22 nt, Human
caugccuguaaucccagcucuu

SEQ ID NO: 795884 - RNA, 22 nt, Human
gucauauagguaggauucagcu

SEQ ID NO: 795885 - RNA, 22 nt, Human
ggcucagggaaugaggaagaau

SEQ ID NO: 795886 - RNA, 22 nt, Human
uuucuucuaagauuucaaacua

SEQ ID NO: 795887 - RNA, 18 nt, Human
acugccuggcgaagauag

SEQ ID NO: 795888 - RNA, 22 nt, Human
uauuuaauaaaacuauggcaug

SEQ ID NO: 795889 - RNA, 22 nt, Human
uugggcccauggggcuaagcua

SEQ ID NO: 795890 - RNA, 22 nt, Human
ugccuggguccaggccaagccu

SEQ ID NO: 795891 - RNA, 22 nt, Human
uuucauuucauagaauuguguu

SEQ ID NO: 795892 - RNA, 22 nt, Human
cacauagauaggcagaagaaca

SEQ ID NO: 795893 - RNA, 19 nt, Human
ugagcaugcgagcugagaa

SEQ ID NO: 795894 - RNA, 22 nt, Human
caggaaaaggagacuuuagcac

SEQ ID NO: 795895 - RNA, 23 nt, Human
ugcuggcuaagaaucugcauuuu

SEQ ID NO: 795896 - RNA, 22 nt, Human
uucuggaugcuguuaagaugua

SEQ ID NO: 795897 - RNA, 17 nt, Human
ggcucugggugucacau

SEQ ID NO: 795898 - RNA, 22 nt, Human
cagguucuggagaugcagagau

SEQ ID NO: 795899 - RNA, 22 nt, Human
uucauuugugguuauuuacaau

SEQ ID NO: 795900 - RNA, 22 nt, Human
uccugugccaucucuagagacu

SEQ ID NO: 795901 - RNA, 22 nt, Human
uuucugcaaaauaaauagugac

SEQ ID NO: 795902 - RNA, 22 nt, Human
uuuucuguaagaggacuuuaau

SEQ ID NO: 795903 - RNA, 22 nt, Human
uuucauguuacauuuaaaaugu

SEQ ID NO: 795904 - RNA, 21 nt, Human
auacauucuauuaagcauuua

SEQ ID NO: 795905 - RNA, 22 nt, Human
uuagugucuuucaaaagguuua

SEQ ID NO: 795906 - RNA, 22 nt, Human
agaucuggaacugagguuuauu

SEQ ID NO: 795907 - RNA, 22 nt, Human
cuggccaacaucuggggcacau

SEQ ID NO: 795908 - RNA, 22 nt, Human
acauaguuagcuuagagauacu

SEQ ID NO: 795909 - RNA, 22 nt, Human
aaagcagugcugugagaacacu

SEQ ID NO: 795910 - RNA, 22 nt, Human
uuauuuauuguguaccuacugu

SEQ ID NO: 795911 - RNA, 22 nt, Human
uuagauaaaaguguucaauaaa

SEQ ID NO: 795912 - RNA, 22 nt, Human
ucuccuucgaggcccagcuccc

SEQ ID NO: 795913 - RNA, 22 nt, Human
cugauuuagauuucacacguga

SEQ ID NO: 795914 - RNA, 22 nt, Human
gggcugaugaugagcagaggug

SEQ ID NO: 795915 - RNA, 20 nt, Human
auguacuccccacaagcaac

SEQ ID NO: 795916 - RNA, 21 nt, Human
aaauucaccuaguaaaacuuc

SEQ ID NO: 795917 - RNA, 22 nt, Human
aggccuggugaaugaaguaucu

SEQ ID NO: 795918 - RNA, 22 nt, Human
ccuugaaagccaggcagaggaa

SEQ ID NO: 795919 - RNA, 22 nt, Human
gcaaauucaacagcacauucuc

SEQ ID NO: 795920 - RNA, 22 nt, Human
cuuggccugggccgcagccacu

SEQ ID NO: 795921 - RNA, 22 nt, Human
uagauuugugcaagaagggauu

SEQ ID NO: 795922 - RNA, 22 nt, Human
aauaaaauggucaguuuucuca

SEQ ID NO: 795923 - RNA, 22 nt, Human
agaagucaaugaugagagugcu

SEQ ID NO: 795924 - RNA, 22 nt, Human
aaagaacuuauccuagaauuug

SEQ ID NO: 795925 - RNA, 22 nt, Human
aauguauuuugggaguuucuuu

SEQ ID NO: 795926 - RNA, 22 nt, Human
cuaguuguuuaauauugauuga

SEQ ID NO: 795927 - RNA, 22 nt, Human
guucagcucaagcaauaauuuu

SEQ ID NO: 795928 - RNA, 22 nt, Human
gaguuaauguguacacaaaggg

SEQ ID NO: 795929 - RNA, 22 nt, Human
ucaggaggcgucucgcuggggc

SEQ ID NO: 795930 - RNA, 22 nt, Human
ccugccagcccgcguucaugcc

SEQ ID NO: 795931 - RNA, 22 nt, Human
ggagggccaucuugggugugau

SEQ ID NO: 795932 - RNA, 22 nt, Human
uugcaucagguagacaacuaua

SEQ ID NO: 795933 - RNA, 22 nt, Human
agcagaaauagaagucaaugau

SEQ ID NO: 795934 - RNA, 22 nt, Human
gaggcacaguguuuggucagug

SEQ ID NO: 795935 - RNA, 22 nt, Human
uuuacacuccuggaaaugauau

SEQ ID NO: 795936 - RNA, 22 nt, Human
aggcuguagaucuagacaugua

SEQ ID NO: 795937 - RNA, 22 nt, Human
uacagaggguaauugaucaagg

SEQ ID NO: 795938 - RNA, 22 nt, Human
caauuucacuaauaauauuuac

SEQ ID NO: 795939 - RNA, 22 nt, Human
gguagacugagcuccuugagga

SEQ ID NO: 795940 - RNA, 22 nt, Human
aaauucaauuaacuuucaugcu

SEQ ID NO: 795941 - RNA, 22 nt, Human
uauauuaacacccacuugccuc

SEQ ID NO: 795942 - RNA, 21 nt, Human
ggagggcagcccagacuggcu

SEQ ID NO: 795943 - RNA, 23 nt, Human
acuuaaaugguucuuuaucucag

SEQ ID NO: 795944 - RNA, 22 nt, Human
aagccuucccuuuuugagcuca

SEQ ID NO: 795945 - RNA, 23 nt, Human
aaacaagucucucaauggcuugc

SEQ ID NO: 795946 - RNA, 22 nt, Human
ucaugcaaucucuuguucagga

SEQ ID NO: 795947 - RNA, 22 nt, Human
cuucucccugggggcucuuuau

SEQ ID NO: 795948 - RNA, 22 nt, Human
ucaggaggaugucggcaaauuu

SEQ ID NO: 795949 - RNA, 22 nt, Human
caaaagucuuccuauucucuua

SEQ ID NO: 795950 - RNA, 22 nt, Human
agaggccagaucaucauagaug

SEQ ID NO: 795951 - RNA, 23 nt, Human
ugaauguuuauucucggugcaga

SEQ ID NO: 795952 - RNA, 22 nt, Human
cccaggguaaucaugugaagcc

SEQ ID NO: 795953 - RNA, 22 nt, Human
cuacaaaguaccacagacuggg

SEQ ID NO: 795954 - RNA, 22 nt, Human
ccaggcugugguuuagauagag

SEQ ID NO: 795955 - RNA, 22 nt, Human
acagcuuuuuacuaauagauug

SEQ ID NO: 795956 - RNA, 22 nt, Human
ccuggcaggacuguuguaagaa

SEQ ID NO: 795957 - RNA, 22 nt, Human
gcaaagacccaggugucuaucc

SEQ ID NO: 795958 - RNA, 22 nt, Human
uuagaggacuguaggugggaau

SEQ ID NO: 795959 - RNA, 22 nt, Human
cugggagcccgcguccuggugg

SEQ ID NO: 795960 - RNA, 22 nt, Human
uuuguaaaaggaggaagcaugg

SEQ ID NO: 795961 - RNA, 22 nt, Human
uacacauaggucugaauaaaaa

SEQ ID NO: 795962 - RNA, 22 nt, Human
cacagagaaugaugagucacug

SEQ ID NO: 795963 - RNA, 22 nt, Human
gaguuaaaguaccuuuguaugu

SEQ ID NO: 795964 - RNA, 21 nt, Human
agaaacaugaucaaaggaacc

SEQ ID NO: 795965 - RNA, 22 nt, Human
uuucaggagagaccagaaauga

SEQ ID NO: 795966 - RNA, 22 nt, Human
gccagcuggagugagagugggc

SEQ ID NO: 795967 - RNA, 22 nt, Human
uaggcagagguaugguaaggac

SEQ ID NO: 795968 - RNA, 22 nt, Human
aaaauagcuauggaaugucacu

SEQ ID NO: 795969 - RNA, 22 nt, Human
ucacuauaauaugucaaaauac

SEQ ID NO: 795970 - RNA, 22 nt, Human
agucagcagugaaagcacagcc

SEQ ID NO: 795971 - RNA, 22 nt, Human
ucugaauguaucgaauugaggc

SEQ ID NO: 795972 - RNA, 22 nt, Human
uucuuuguagcaaaacguguau

SEQ ID NO: 795973 - RNA, 21 nt, Human
gccaagaacaagacagacaug

SEQ ID NO: 795974 - RNA, 22 nt, Human
auguggcaccgaucuuuagcca

SEQ ID NO: 795975 - RNA, 22 nt, Human
ccacagggucagccacucugca

SEQ ID NO: 795976 - RNA, 22 nt, Human
uaggcaaguggaccagagguuu

SEQ ID NO: 795977 - RNA, 22 nt, Human
uggcuggagccccucaagagca

SEQ ID NO: 795978 - RNA, 22 nt, Human
ugguuagaugaggcugguuuca

SEQ ID NO: 795979 - RNA, 22 nt, Human
gcaaacaaggacauacauccug

SEQ ID NO: 795980 - RNA, 22 nt, Human
cccugcuguguagcggaggaac

SEQ ID NO: 795981 - RNA, 22 nt, Human
guggggugggcugaguuaggcc

SEQ ID NO: 795982 - RNA, 22 nt, Human
aaggaaauuagguuauuuugcu

SEQ ID NO: 795983 - RNA, 22 nt, Human
augacaaacccaggauguaaca

SEQ ID NO: 795984 - RNA, 22 nt, Human
gggcagguuauuggaguaggga

SEQ ID NO: 795985 - RNA, 22 nt, Human
aggcccugcugaggccucccuc

SEQ ID NO: 795986 - RNA, 22 nt, Human
gaggagggagcuggaagcucuu

SEQ ID NO: 795987 - RNA, 22 nt, Human
auucauacaggcuuugcucuua

SEQ ID NO: 795988 - RNA, 18 nt, Human
ccucagggagauccagug

SEQ ID NO: 795989 - RNA, 22 nt, Human
uuugguaaaugcagguucuucu

SEQ ID NO: 795990 - RNA, 22 nt, Human
uugcauguuauuuaaucuguau

SEQ ID NO: 795991 - RNA, 22 nt, Human
agggaauucacuggaacgcccu

SEQ ID NO: 795992 - RNA, 22 nt, Human
cccagggguaaggcgcagcgug

SEQ ID NO: 795993 - RNA, 22 nt, Human
cagguccuuuaguguccagaac

SEQ ID NO: 795994 - RNA, 22 nt, Human
ccaggcaguggaagcuaaaauu

SEQ ID NO: 795995 - RNA, 22 nt, Human
agcagccccucggcgggugcgc

SEQ ID NO: 795996 - RNA, 22 nt, Human
uugaaugaaugguccauauaga

SEQ ID NO: 795997 - RNA, 22 nt, Human
acuggcuguguaaccucaggca

SEQ ID NO: 795998 - RNA, 22 nt, Human
agcaggcuuguuaugucugaga

SEQ ID NO: 795999 - RNA, 22 nt, Human
uuucuuuguuguuaucacauca

SEQ ID NO: 796000 - RNA, 22 nt, Human
auuuaguagagaaauuaagaaa

SEQ ID NO: 796001 - RNA, 22 nt, Human
augccuggacugacaugcacug

SEQ ID NO: 796002 - RNA, 22 nt, Human
ugcuggagugagauuaugaguu

SEQ ID NO: 796003 - RNA, 22 nt, Human
agucuccgcucucggagucggc

SEQ ID NO: 796004 - RNA, 21 nt, Human
agaggaagugauuggucuggc

SEQ ID NO: 796005 - RNA, 22 nt, Human
ucaggcagugguaaaugaguua

SEQ ID NO: 796006 - RNA, 22 nt, Human
gaccccagaggaaggggcgccg

SEQ ID NO: 796007 - RNA, 22 nt, Human
acacagagccagggaauacagu

SEQ ID NO: 796008 - RNA, 22 nt, Human
ggguggcauagggugauggcuu

SEQ ID NO: 796009 - RNA, 22 nt, Human
gccuccggaguugcagugucuu

SEQ ID NO: 796010 - RNA, 22 nt, Human
acagggagucugaggggauagu

SEQ ID NO: 796011 - RNA, 22 nt, Human
ggcuggcaggggaugucagaug

SEQ ID NO: 796012 - RNA, 22 nt, Human
uauacacaggaaucugugaaaa

SEQ ID NO: 796013 - RNA, 23 nt, Human
ucaucaaaggaaguacgugucac

SEQ ID NO: 796014 - RNA, 22 nt, Human
ccaggagcagauauggacauaa

SEQ ID NO: 796015 - RNA, 20 nt, Human
cugccgaccacagccaugga

SEQ ID NO: 796016 - RNA, 22 nt, Human
gagaggcugaaaucacaggagc

SEQ ID NO: 796017 - RNA, 22 nt, Human
aauguuacaggacaaagaugga

SEQ ID NO: 796018 - RNA, 22 nt, Human
aaggccagcccuaaugaugcuc

SEQ ID NO: 796019 - RNA, 22 nt, Human
uuucugggacuggggagauucu

SEQ ID NO: 796020 - RNA, 22 nt, Human
caggaaggaccguccagaucag

SEQ ID NO: 796021 - RNA, 22 nt, Human
ucuugaggucaucaucugaaac

SEQ ID NO: 796022 - RNA, 22 nt, Human
gugcagcugagggccucuucua

SEQ ID NO: 796023 - RNA, 22 nt, Human
ucuugauuaauaccuuagcccu

SEQ ID NO: 796024 - RNA, 22 nt, Human
ucaggcugcccguucagggcuc

SEQ ID NO: 796025 - RNA, 22 nt, Human
gcccugagccuaugagccucuc

SEQ ID NO: 796026 - RNA, 22 nt, Human
gcccaggcuagcguagagugca

SEQ ID NO: 796027 - RNA, 22 nt, Human
ccagccaguauauuccaaagcc

SEQ ID NO: 796028 - RNA, 22 nt, Human
caguggcacccacgggcugggc

SEQ ID NO: 796029 - RNA, 22 nt, Human
aaucagaaagaucuugaugaga

SEQ ID NO: 796030 - RNA, 22 nt, Human
cuggaggggcuggcaugguagc

SEQ ID NO: 796031 - RNA, 22 nt, Human
auaaacugguaggaaaacagua

SEQ ID NO: 796032 - RNA, 22 nt, Human
aaugcaaggccuguaucugauu

SEQ ID NO: 796033 - RNA, 22 nt, Human
agcucagaacugcagacaugug

SEQ ID NO: 796034 - RNA, 20 nt, Human
aauguauuguuuuguuucag

SEQ ID NO: 796035 - RNA, 22 nt, Human
ucaggccuagggagaaaauuca

SEQ ID NO: 796036 - RNA, 22 nt, Human
aauuugauucagcaaauguuca

SEQ ID NO: 796037 - RNA, 22 nt, Human
agccacucagugcuguauugac

SEQ ID NO: 796038 - RNA, 22 nt, Human
guggugugugcuuagggcuagg

SEQ ID NO: 796039 - RNA, 22 nt, Human
uccucuggcucuuucccuagga

SEQ ID NO: 796040 - RNA, 22 nt, Human
cagcccugucccugagggaccu

SEQ ID NO: 796041 - RNA, 22 nt, Human
cuucuggagcucaccaacuucc

SEQ ID NO: 796042 - RNA, 22 nt, Human
ucacaagaauuuguagaugaaa

SEQ ID NO: 796043 - RNA, 22 nt, Human
agcuggcuucucugcagacauu

SEQ ID NO: 796044 - RNA, 22 nt, Human
ugggaagguguagaaagaacaa

SEQ ID NO: 796045 - RNA, 22 nt, Human
uagguucaggagauauugcaca

SEQ ID NO: 796046 - RNA, 22 nt, Human
uugcuucagagggagacacuuu

SEQ ID NO: 796047 - RNA, 22 nt, Human
gucugcuggugccuggccugcg

SEQ ID NO: 796048 - RNA, 22 nt, Human
gaggcuggugguuaguuccauu

SEQ ID NO: 796049 - RNA, 22 nt, Human
ccuuggcaaaccagggcagcug

SEQ ID NO: 796050 - RNA, 22 nt, Human
ccaagcuuucgaucaaccagaa

SEQ ID NO: 796051 - RNA, 22 nt, Human
aaaggcuccuucucccaugacc

SEQ ID NO: 796052 - RNA, 22 nt, Human
augagauguucaggagucugag

SEQ ID NO: 796053 - RNA, 22 nt, Human
acacuuggagcaacacuuaugg

SEQ ID NO: 796054 - RNA, 22 nt, Human
gaauucuuugaucuuaaucuug

SEQ ID NO: 796055 - RNA, 22 nt, Human
ggcugcagcggauuggggauug

SEQ ID NO: 796056 - RNA, 22 nt, Human
uggggaggaagucagauuucag

SEQ ID NO: 796057 - RNA, 22 nt, Human
aggcagcuuaagcccuggccca

SEQ ID NO: 796058 - RNA, 22 nt, Human
cagagccagcccacuguucccg

SEQ ID NO: 796059 - RNA, 22 nt, Human
augcaacagcugggaauaugua

SEQ ID NO: 796060 - RNA, 22 nt, Human
cuucauuaacuauuggaaugca

SEQ ID NO: 796061 - RNA, 22 nt, Human
gugcagagaaaugagaagucga

SEQ ID NO: 796062 - RNA, 22 nt, Human
augccccaggaggugccaucca

SEQ ID NO: 796063 - RNA, 22 nt, Human
gacagcaagagacagagcaucc

SEQ ID NO: 796064 - RNA, 22 nt, Human
uauaauuuuaagugguaaauua

SEQ ID NO: 796065 - RNA, 22 nt, Human
uuaaaugagauguucagauauu

SEQ ID NO: 796066 - RNA, 22 nt, Human
aaguaaggcagugaaugagauu

SEQ ID NO: 796067 - RNA, 22 nt, Human
uuuacacauaccucuuuaaagu

SEQ ID NO: 796068 - RNA, 22 nt, Human
ucaggagcagggggaagcucug

SEQ ID NO: 796069 - RNA, 22 nt, Human
gcuggcugcgucaucacagggc

SEQ ID NO: 796070 - RNA, 19 nt, Human
aaaguugagaaacaaugga

SEQ ID NO: 796071 - RNA, 22 nt, Human
ggcgguggcgugaagguggcug

SEQ ID NO: 796072 - RNA, 22 nt, Human
aaguggcaguucaggaagcaga

SEQ ID NO: 796073 - RNA, 22 nt, Human
gggaccaggucagggcucugac

SEQ ID NO: 796074 - RNA, 22 nt, Human
cagcccucagguccucagcagc

SEQ ID NO: 796075 - RNA, 22 nt, Human
caaggaaucccauuucuaacuc

SEQ ID NO: 796076 - RNA, 22 nt, Human
uugaaugaccaugaugcaaggg

SEQ ID NO: 796077 - RNA, 22 nt, Human
caugcuguugaauaugacauug

SEQ ID NO: 796078 - RNA, 19 nt, Human
aaugcuuaggacagugccu

SEQ ID NO: 796079 - RNA, 22 nt, Human
gccaggcagccacccucugcga

SEQ ID NO: 796080 - RNA, 22 nt, Human
ccuacagagcagcaggaccaga

SEQ ID NO: 796081 - RNA, 22 nt, Human
ucagugucuauagauaagguuu

SEQ ID NO: 796082 - RNA, 22 nt, Human
caacuacuggugcucaggaaau

SEQ ID NO: 796083 - RNA, 23 nt, Human
cacaggcagaaaucaagacggua

SEQ ID NO: 796084 - RNA, 22 nt, Human
acacaggcaaugugagugggag

SEQ ID NO: 796085 - RNA, 22 nt, Human
cucuaaauccaaauaagugucc

SEQ ID NO: 796086 - RNA, 22 nt, Human
cagcuuugugacuucggacaag

SEQ ID NO: 796087 - RNA, 20 nt, Human
uucauuugggaaaaucugcg

SEQ ID NO: 796088 - RNA, 22 nt, Human
uugagaacucuguauguccagc

SEQ ID NO: 796089 - RNA, 22 nt, Human
ucaguggucuaggcaauauaua

SEQ ID NO: 796090 - RNA, 22 nt, Human
cuggggaggcagggcugccccu

SEQ ID NO: 796091 - RNA, 22 nt, Human
gccaggcagcugggagggugcc

SEQ ID NO: 796092 - RNA, 22 nt, Human
aguaaugaggauguuugcaaaa

SEQ ID NO: 796093 - RNA, 22 nt, Human
aaguacauguugcucaacagcc

SEQ ID NO: 796094 - RNA, 22 nt, Human
ccuggcuguggcggugcucuca

SEQ ID NO: 796095 - RNA, 22 nt, Human
uccagggagagccgcugcucca

SEQ ID NO: 796096 - RNA, 22 nt, Human
gcaauaaacauguuugaugcgc

SEQ ID NO: 796097 - RNA, 22 nt, Human
cugcccagaaucacucacucga

SEQ ID NO: 796098 - RNA, 22 nt, Human
cacagcugcccuacuccaugug

SEQ ID NO: 796099 - RNA, 22 nt, Human
agaaaauaaauugaugguggaa

SEQ ID NO: 796100 - RNA, 22 nt, Human
uuaaagagucuacugcacaucc

SEQ ID NO: 796101 - RNA, 22 nt, Human
ugcuggggagugauugaccauc

SEQ ID NO: 796102 - RNA, 22 nt, Human
uagacauuugucaagaaugacu

SEQ ID NO: 796103 - RNA, 22 nt, Human
auucuuauuuaaauagagucug

SEQ ID NO: 796104 - RNA, 22 nt, Human
ugaauucuuuuagaauucagug

SEQ ID NO: 796105 - RNA, 22 nt, Human
gcaggcagaucaccugucagga

SEQ ID NO: 796106 - RNA, 22 nt, Human
aggcuggagguuuguugcggcu

SEQ ID NO: 796107 - RNA, 22 nt, Human
ugggcaggcaagugaauaccuu

SEQ ID NO: 796108 - RNA, 22 nt, Human
uuuuuaagagauucuccagucu

SEQ ID NO: 796109 - RNA, 22 nt, Human
cauucacagagggggaagcauc

SEQ ID NO: 796110 - RNA, 22 nt, Human
aguguaucuagguaucuauagu

SEQ ID NO: 796111 - RNA, 21 nt, Human
guuuuaagggagaaaaccuag

SEQ ID NO: 796112 - RNA, 22 nt, Human
aggcuucccagcugagcucagc

SEQ ID NO: 796113 - RNA, 22 nt, Human
caggcugggacugaccccugcu

SEQ ID NO: 796114 - RNA, 22 nt, Human
acagugguaggauaacuguuuu

SEQ ID NO: 796115 - RNA, 22 nt, Human
uaacuaacuaguguucaaaaua

SEQ ID NO: 796116 - RNA, 22 nt, Human
gugccagagauuccuaaacuuu

SEQ ID NO: 796117 - RNA, 22 nt, Human
cucaguguuaaauauaagguau

SEQ ID NO: 796118 - RNA, 20 nt, Human
ccugugcugcccucggggcc

SEQ ID NO: 796119 - RNA, 21 nt, Human
ucaggcaggcgcagagggaag

SEQ ID NO: 796120 - RNA, 20 nt, Human
gcagggcaagggauaugaaa

SEQ ID NO: 796121 - RNA, 22 nt, Human
gcuuggggucaugaggcugcug

SEQ ID NO: 796122 - RNA, 22 nt, Human
agaacauagauaccuaagacag

SEQ ID NO: 796123 - RNA, 22 nt, Human
caguguguggauccucccagga

SEQ ID NO: 796124 - RNA, 22 nt, Human
guuauaaaggugauaaugguca

SEQ ID NO: 796125 - RNA, 22 nt, Human
aggcagugccuggaccccagcu

SEQ ID NO: 796126 - RNA, 22 nt, Human
augcagaagacugaaaagcuga

SEQ ID NO: 796127 - RNA, 23 nt, Human
agaguggccuacucacacucauu

SEQ ID NO: 796128 - RNA, 22 nt, Human
gaaaucuacgauuagugaaaau

SEQ ID NO: 796129 - RNA, 22 nt, Human
uguauuguaagugguuauaugc

SEQ ID NO: 796130 - RNA, 22 nt, Human
cucguugcugaagccaaaguca

SEQ ID NO: 796131 - RNA, 22 nt, Human
cacaugcaguuuuccagcaguc

SEQ ID NO: 796132 - RNA, 22 nt, Human
acuucuggugucauacugcauu

SEQ ID NO: 796133 - RNA, 22 nt, Human
cacacacuggagcaaggagaug

SEQ ID NO: 796134 - RNA, 22 nt, Human
ugucaacauuuaucaaguuauu

SEQ ID NO: 796135 - RNA, 22 nt, Human
ucuggaguggaggugccuuggg

SEQ ID NO: 796136 - RNA, 21 nt, Human
uggauugaggugacagugugc

SEQ ID NO: 796137 - RNA, 22 nt, Human
gcaggagcugcucuccugacga

SEQ ID NO: 796138 - RNA, 22 nt, Human
ugucuuuaaaauuaaacacauc

SEQ ID NO: 796139 - RNA, 22 nt, Human
gacaugcaguucucaaggguag

SEQ ID NO: 796140 - RNA, 20 nt, Human
cucagcucuucagggcaagu

SEQ ID NO: 796141 - RNA, 22 nt, Human
cagugcuguguuugcugccugg

SEQ ID NO: 796142 - RNA, 19 nt, Human
guuuuucccagacgaggca

SEQ ID NO: 796143 - RNA, 22 nt, Human
aucagaaaaacauaauguuauu

SEQ ID NO: 796144 - RNA, 22 nt, Human
gcugccgacccacagggguuaa

SEQ ID NO: 796145 - RNA, 20 nt, Human
agaaacauuucuugagaacu

SEQ ID NO: 796146 - RNA, 19 nt, Human
ucugaaguccagggcauac

SEQ ID NO: 796147 - RNA, 22 nt, Human
auguacauacugcauuuucaaa

SEQ ID NO: 796148 - RNA, 22 nt, Human
caggaaaugaggcugaagggug

SEQ ID NO: 796149 - RNA, 22 nt, Human
cccuggcugcuaccagguagcu

SEQ ID NO: 796150 - RNA, 22 nt, Human
aacauaaauuugaaguggcaaa

SEQ ID NO: 796151 - RNA, 22 nt, Human
gucuuuauauuuacuaaagaau

SEQ ID NO: 796152 - RNA, 22 nt, Human
uagcuucucauaauuuaugcug

SEQ ID NO: 796153 - RNA, 22 nt, Human
caguagggaaugugggaggcug

SEQ ID NO: 796154 - RNA, 22 nt, Human
auucacaguucauuagcuguaa

SEQ ID NO: 796155 - RNA, 22 nt, Human
uagcauuuauggucaugugucc

SEQ ID NO: 796156 - RNA, 22 nt, Human
acagcccagaaagccuaagggg

SEQ ID NO: 796157 - RNA, 22 nt, Human
agacagcaggggagucugguuu

SEQ ID NO: 796158 - RNA, 22 nt, Human
aaugaaaauuggacccuagaac

SEQ ID NO: 796159 - RNA, 22 nt, Human
cuugcugggguaagucugugcu

SEQ ID NO: 796160 - RNA, 22 nt, Human
ucaaauauuggcuauuucacau

SEQ ID NO: 796161 - RNA, 22 nt, Human
cucuuggccagacacagaggca

SEQ ID NO: 796162 - RNA, 23 nt, Human
ucuuuagaagaacaucagaaaug

SEQ ID NO: 796163 - RNA, 22 nt, Human
aaaauugucgaacaguaguaac

SEQ ID NO: 796164 - RNA, 22 nt, Human
gcauggcuauuaugaggcagaa

SEQ ID NO: 796165 - RNA, 22 nt, Human
uuucuaagaaaguaaugguuau

SEQ ID NO: 796166 - RNA, 22 nt, Human
cacucaauacaaugguuggcac

SEQ ID NO: 796167 - RNA, 22 nt, Human
agcugugugacucuaagcaagu

SEQ ID NO: 796168 - RNA, 22 nt, Human
gcacacaggcaguuuccagcca

SEQ ID NO: 796169 - RNA, 22 nt, Human
augacucagaagauauuuucca

SEQ ID NO: 796170 - RNA, 22 nt, Human
agaagccagccuugccuccuuu

SEQ ID NO: 796171 - RNA, 22 nt, Human
gaugcaaagcauuuuugugugu

SEQ ID NO: 796172 - RNA, 22 nt, Human
uuucacagagaaauauaacagg

SEQ ID NO: 796173 - RNA, 22 nt, Human
gcuggagaccucagagaaccca

SEQ ID NO: 796174 - RNA, 22 nt, Human
uggccugccuucgcugagcuga

SEQ ID NO: 796175 - RNA, 22 nt, Human
caugugcauccuuaaucucccu

SEQ ID NO: 796176 - RNA, 22 nt, Human
uagaaaagauaacauucugugc

SEQ ID NO: 796177 - RNA, 22 nt, Human
aaaaaccucaauuacuuuugca

SEQ ID NO: 796178 - RNA, 22 nt, Human
gugaccauccugguaaugaauc

SEQ ID NO: 796179 - RNA, 22 nt, Human
agggcugcccagugugagagcu

SEQ ID NO: 796180 - RNA, 22 nt, Human
ugguguugaaccucagcagggg

SEQ ID NO: 796181 - RNA, 22 nt, Human
uagcuuugcccgugcuggauuu

SEQ ID NO: 796182 - RNA, 22 nt, Human
uccaugaggcagggaggcuggc

SEQ ID NO: 796183 - RNA, 22 nt, Human
gggcaccuugggucucaggcaa

SEQ ID NO: 796184 - RNA, 22 nt, Human
agaaacuaaccugguaggguuc

SEQ ID NO: 796185 - RNA, 22 nt, Human
gcugcccuguccggcucuccug

SEQ ID NO: 796186 - RNA, 22 nt, Human
gcaggaacuugggugaagucag

SEQ ID NO: 796187 - RNA, 22 nt, Human
aaacuuuaagacaguccucaag

SEQ ID NO: 796188 - RNA, 22 nt, Human
auauacagggagaaacagcuua

SEQ ID NO: 796189 - RNA, 20 nt, Human
uggacaggggcauagguugc

SEQ ID NO: 796190 - RNA, 22 nt, Human
uagguaggugcaauuaaaagua

SEQ ID NO: 796191 - RNA, 19 nt, Human
agacacacuuacguggaau

SEQ ID NO: 796192 - RNA, 22 nt, Human
uucauugaguuacugccugggc

SEQ ID NO: 796193 - RNA, 22 nt, Human
guuucucaucaguuucugauau

SEQ ID NO: 796194 - RNA, 22 nt, Human
agcacuggaguuuagugggauu

SEQ ID NO: 796195 - RNA, 22 nt, Human
ggcuagggagacagagggcaug

SEQ ID NO: 796196 - RNA, 22 nt, Human
acaaaaauuagcugggcauggu

SEQ ID NO: 796197 - RNA, 22 nt, Human
ucaggauggagucuauccagug

SEQ ID NO: 796198 - RNA, 22 nt, Human
cacaggcucuucucacuugauu

SEQ ID NO: 796199 - RNA, 22 nt, Human
agcaaggauuauccugggaagg

SEQ ID NO: 796200 - RNA, 22 nt, Human
uggggcuaacgagagagcagag

SEQ ID NO: 796201 - RNA, 20 nt, Human
uucacauuucuguagugauu

SEQ ID NO: 796202 - RNA, 22 nt, Human
uuuuggcaaaggcauucucuuu

SEQ ID NO: 796203 - RNA, 22 nt, Human
cagggcucaccacugggauccu

SEQ ID NO: 796204 - RNA, 21 nt, Human
guccagagagccggcuccuga

SEQ ID NO: 796205 - RNA, 22 nt, Human
cagggagcggagucccaugccu

SEQ ID NO: 796206 - RNA, 22 nt, Human
aaugucauagcaaagagaguga

SEQ ID NO: 796207 - RNA, 22 nt, Human
acauuucagcgugcaugacaug

SEQ ID NO: 796208 - RNA, 22 nt, Human
gccuagguaccagcagagagcc

SEQ ID NO: 796209 - RNA, 22 nt, Human
aauaugacauagaauugagaug

SEQ ID NO: 796210 - RNA, 22 nt, Human
agcaggcuaaauaauaauacau

SEQ ID NO: 796211 - RNA, 22 nt, Human
uucuaagcucugaaauaaaucu

SEQ ID NO: 796212 - RNA, 22 nt, Human
auggcagacacaggcaggcaga

SEQ ID NO: 796213 - RNA, 23 nt, Human
caguggagacucaugcuuccuua

SEQ ID NO: 796214 - RNA, 22 nt, Human
gaacaguauuuccaggaauccc

SEQ ID NO: 796215 - RNA, 19 nt, Human
ggcugugguggugccuugc

SEQ ID NO: 796216 - RNA, 22 nt, Human
agcacagaguugcagagagcgu

SEQ ID NO: 796217 - RNA, 22 nt, Human
uugaaauuggguguggcuguca

SEQ ID NO: 796218 - RNA, 22 nt, Human
gucagcagcauguuuaaucaaa

SEQ ID NO: 796219 - RNA, 21 nt, Human
caguggucugucuccauuuuu

SEQ ID NO: 796220 - RNA, 22 nt, Human
uccagagauaacuauuuaggag

SEQ ID NO: 796221 - RNA, 22 nt, Human
aguugucaccucuauucaaauc

SEQ ID NO: 796222 - RNA, 22 nt, Human
gcccuggggaaggugucuccaa

SEQ ID NO: 796223 - RNA, 22 nt, Human
ccaggcaggcagcguucucagg

SEQ ID NO: 796224 - RNA, 22 nt, Human
gcagcccaauggacugagacag

SEQ ID NO: 796225 - RNA, 16 nt, Human
accuccagucaagggu

SEQ ID NO: 796226 - RNA, 22 nt, Human
ucacauuuuauaucucugguuu

SEQ ID NO: 796227 - RNA, 22 nt, Human
cagucccagaagagccugggag

SEQ ID NO: 796228 - RNA, 22 nt, Human
ucaugcuuaaaagacacuugag

SEQ ID NO: 796229 - RNA, 22 nt, Human
acugauugcauucauaggguuu

SEQ ID NO: 796230 - RNA, 22 nt, Human
agccaagggucagcugcacaga

SEQ ID NO: 796231 - RNA, 22 nt, Human
ugcgauggcguagacaaauccc

SEQ ID NO: 796232 - RNA, 22 nt, Human
ggcaguggguggaucucaggga

SEQ ID NO: 796233 - RNA, 22 nt, Human
ucagaagcugguguccuuugaa

SEQ ID NO: 796234 - RNA, 22 nt, Human
auguuugcauucuuauuaucgu

SEQ ID NO: 796235 - RNA, 22 nt, Human
uggcagagagacucuccuugau

SEQ ID NO: 796236 - RNA, 22 nt, Human
uuugcugucagccgcuauuuuc

SEQ ID NO: 796237 - RNA, 22 nt, Human
uggagccagagcgcagccuggg

SEQ ID NO: 796238 - RNA, 22 nt, Human
caguuuguauuuauuacucaua

SEQ ID NO: 796239 - RNA, 20 nt, Human
ucuaaacaguuggcaugggg

SEQ ID NO: 796240 - RNA, 22 nt, Human
uuguuaguaagugacaaaaauc

SEQ ID NO: 796241 - RNA, 22 nt, Human
gugcucuguguauuaggauguc

SEQ ID NO: 796242 - RNA, 22 nt, Human
ccaggaaauagugcugugaucu

SEQ ID NO: 796243 - RNA, 22 nt, Human
acaauuacucaacuuugcugcu

SEQ ID NO: 796244 - RNA, 22 nt, Human
cagugcugcaggcgccugcggu

SEQ ID NO: 796245 - RNA, 22 nt, Human
ugaaaauuuccaucaguuauau

SEQ ID NO: 796246 - RNA, 22 nt, Human
cccaggaaacccgaaggcgacc

SEQ ID NO: 796247 - RNA, 22 nt, Human
gaccucucaggaaucucacaug

SEQ ID NO: 796248 - RNA, 22 nt, Human
uaagcaaauagcuagaucagag

SEQ ID NO: 796249 - RNA, 22 nt, Human
ucaggaaguugaggcguagaga

SEQ ID NO: 796250 - RNA, 22 nt, Human
gggcccugugauuucuugagga

SEQ ID NO: 796251 - RNA, 22 nt, Human
uggcagggaguugcaggauuuc

SEQ ID NO: 796252 - RNA, 22 nt, Human
uugcaaauaaacaaguauacau

SEQ ID NO: 796253 - RNA, 22 nt, Human
agggcagcccuucugggagggc

SEQ ID NO: 796254 - RNA, 22 nt, Human
cucugcccucgcacaucugcca

SEQ ID NO: 796255 - RNA, 22 nt, Human
cacuuucucaugaauuuggccc

SEQ ID NO: 796256 - RNA, 22 nt, Human
aaggaaauagaugcagauggua

SEQ ID NO: 796257 - RNA, 22 nt, Human
uuucauauuauuccuugagucu

SEQ ID NO: 796258 - RNA, 22 nt, Human
uucuggaacauagcaagaaguu

SEQ ID NO: 796259 - RNA, 22 nt, Human
gagcagcucugggugacccagu

SEQ ID NO: 796260 - RNA, 22 nt, Human
aguaagugagucacugugcugg

SEQ ID NO: 796261 - RNA, 22 nt, Human
uguggaagggacacuggacugg

SEQ ID NO: 796262 - RNA, 22 nt, Human
uacaaagucaccagcuucuugc

SEQ ID NO: 796263 - RNA, 22 nt, Human
aaagacuuucaccuagcaaaga

SEQ ID NO: 796264 - RNA, 22 nt, Human
ggccuggccuccagaugugggc

SEQ ID NO: 796265 - RNA, 22 nt, Human
cccucaccaggcuccaggcaug

SEQ ID NO: 796266 - RNA, 22 nt, Human
uccuggacagauccccaucauc

SEQ ID NO: 796267 - RNA, 22 nt, Human
ugagaaccacgacugugcuuaa

SEQ ID NO: 796268 - RNA, 22 nt, Human
gacagcuuagugaaaauguaaa

SEQ ID NO: 796269 - RNA, 22 nt, Human
cagcacagugaccagacccacu

SEQ ID NO: 796270 - RNA, 22 nt, Human
uuaaauuuuagaaacagacucu

SEQ ID NO: 796271 - RNA, 22 nt, Human
agccaggauggucucgaucggc

SEQ ID NO: 796272 - RNA, 22 nt, Human
uuucagagccuuuaucucucua

SEQ ID NO: 796273 - RNA, 21 nt, Human
ugcugcugaucgggguuggcu

SEQ ID NO: 796274 - RNA, 22 nt, Human
ggagggagcagagaacccaacc

SEQ ID NO: 796275 - RNA, 22 nt, Human
cauauucuguuggucacauaga

SEQ ID NO: 796276 - RNA, 22 nt, Human
uccacaggaaagcaccucccau

SEQ ID NO: 796277 - RNA, 22 nt, Human
uacaacauaacgggcauucagu

SEQ ID NO: 796278 - RNA, 22 nt, Human
guuucauaugcaguuaacagca

SEQ ID NO: 796279 - RNA, 21 nt, Human
aggcagcgugagggccacuca

SEQ ID NO: 796280 - RNA, 22 nt, Human
ucacagagaaaagcuaucacaa

SEQ ID NO: 796281 - RNA, 22 nt, Human
ugagcugguucuugaggcauga

SEQ ID NO: 796282 - RNA, 21 nt, Human
aaguuuuauguugccauuugu

SEQ ID NO: 796283 - RNA, 22 nt, Human
ggccucaggguugggcccauua

SEQ ID NO: 796284 - RNA, 22 nt, Human
cagagaguggcaguuacugaag

SEQ ID NO: 796285 - RNA, 22 nt, Human
gccagaggcccaaggacagcug

SEQ ID NO: 796286 - RNA, 22 nt, Human
gcucccacaaccuucuugcucc

SEQ ID NO: 796287 - RNA, 22 nt, Human
uauucuuacucucgacugcauu

SEQ ID NO: 796288 - RNA, 22 nt, Human
cagagcuuuggcuagaugguug

SEQ ID NO: 796289 - RNA, 22 nt, Human
acauuugagucauauuugcuua

SEQ ID NO: 796290 - RNA, 22 nt, Human
aggcagggcugggauuagacuc

SEQ ID NO: 796291 - RNA, 22 nt, Human
cuuuggcuuuuagauauccauu

SEQ ID NO: 796292 - RNA, 22 nt, Human
aaacagauaaugcuauaaaugg

SEQ ID NO: 796293 - RNA, 22 nt, Human
gcugccuccgccggcuccacag

SEQ ID NO: 796294 - RNA, 22 nt, Human
acaggacagucuaguaacagua

SEQ ID NO: 796295 - RNA, 22 nt, Human
accaauauaaguauagguaagu

SEQ ID NO: 796296 - RNA, 22 nt, Human
ugcuauaagaauuauauuacuc

SEQ ID NO: 796297 - RNA, 22 nt, Human
agccucagugucaccaucuacc

SEQ ID NO: 796298 - RNA, 22 nt, Human
uuuaauuuuccucuuccuggag

SEQ ID NO: 796299 - RNA, 22 nt, Human
ucuucagguuaacuugucuuuu

SEQ ID NO: 796300 - RNA, 19 nt, Human
ugccacagauaaaaacuga

SEQ ID NO: 796301 - RNA, 22 nt, Human
caggaaauucaagagaggcugc

SEQ ID NO: 796302 - RNA, 22 nt, Human
gucagugugagauaaucuugga

SEQ ID NO: 796303 - RNA, 21 nt, Human
ucagggcagugggagguuccu

SEQ ID NO: 796304 - RNA, 22 nt, Human
ucacauuuuaucugagauugac

SEQ ID NO: 796305 - RNA, 22 nt, Human
uccugggcgagguacuggggcu

SEQ ID NO: 796306 - RNA, 22 nt, Human
uggcccugacacgugguacugg

SEQ ID NO: 796307 - RNA, 22 nt, Human
ggcagccaugcuccaggugcag

SEQ ID NO: 796308 - RNA, 22 nt, Human
ggaguggugucacugagaggaa

SEQ ID NO: 796309 - RNA, 17 nt, Human
uucauuaauaaaagcaa

SEQ ID NO: 796310 - RNA, 23 nt, Human
acaguuauagcugugaauaacau

SEQ ID NO: 796311 - RNA, 22 nt, Human
uuuucuaucuccuagaacugcc

SEQ ID NO: 796312 - RNA, 19 nt, Human
acauuuaaauucagaucuc

SEQ ID NO: 796313 - RNA, 22 nt, Human
gcuggucccaauguguuuccuu

SEQ ID NO: 796314 - RNA, 22 nt, Human
uacaaagagguaauugcauaua

SEQ ID NO: 796315 - RNA, 21 nt, Human
gucuuuaaaaaaggcugauac

SEQ ID NO: 796316 - RNA, 22 nt, Human
uaggaaauauugauuucaguca

SEQ ID NO: 796317 - RNA, 22 nt, Human
gagcagcugguaggugaaccca

SEQ ID NO: 796318 - RNA, 18 nt, Human
uaaaggaagugggagagg

SEQ ID NO: 796319 - RNA, 22 nt, Human
cagggagcacugcgagcggcag

SEQ ID NO: 796320 - RNA, 22 nt, Human
cuggcccagagagcagagcuua

SEQ ID NO: 796321 - RNA, 22 nt, Human
ggcagggguucauuuugucuua

SEQ ID NO: 796322 - RNA, 22 nt, Human
ucaaugucagcugguaggaaau

SEQ ID NO: 796323 - RNA, 21 nt, Human
agcaggcuuuggaguggggcu

SEQ ID NO: 796324 - RNA, 22 nt, Human
gguuuuauagcaguacuaucag

SEQ ID NO: 796325 - RNA, 22 nt, Human
ucugagugaucagaugcauugc

SEQ ID NO: 796326 - RNA, 22 nt, Human
ugucaacagauacuagagagcu

SEQ ID NO: 796327 - RNA, 21 nt, Human
uucaaagagugggcauuguca

SEQ ID NO: 796328 - RNA, 17 nt, Human
auguuaauuucacauuu

SEQ ID NO: 796329 - RNA, 22 nt, Human
aaacaaugaaauucauucuuca

SEQ ID NO: 796330 - RNA, 22 nt, Human
ugcuggggauccguaccaaccc

SEQ ID NO: 796331 - RNA, 22 nt, Human
cagugcagcugccccgcuggua

SEQ ID NO: 796332 - RNA, 22 nt, Human
uggcuuggacuaaauggaccgu

SEQ ID NO: 796333 - RNA, 22 nt, Human
acacaaauuguaggauaauugc

SEQ ID NO: 796334 - RNA, 22 nt, Human
agaaggaaggaagcauucuguu

SEQ ID NO: 796335 - RNA, 22 nt, Human
ugucaagagugcacacaucugc

SEQ ID NO: 796336 - RNA, 22 nt, Human
ugaggcugaaacuggcgauaga

SEQ ID NO: 796337 - RNA, 22 nt, Human
ccacuggcugucagcaggacuc

SEQ ID NO: 796338 - RNA, 22 nt, Human
aagagagacaauagguagcauu

SEQ ID NO: 796339 - RNA, 22 nt, Human
acuuuucaaaugggaaacucag

SEQ ID NO: 796340 - RNA, 22 nt, Human
aaauuucaguuaccuuuacguu

SEQ ID NO: 796341 - RNA, 22 nt, Human
cugcuguguggauucaauggcu

SEQ ID NO: 796342 - RNA, 22 nt, Human
ugcacacacgcggcacaucugu

SEQ ID NO: 796343 - RNA, 22 nt, Human
aaagauuauggcauugaaauac

SEQ ID NO: 796344 - RNA, 22 nt, Human
uucucuugugccaaguuguugc

SEQ ID NO: 796345 - RNA, 22 nt, Human
auauaauacaaccugcuaagug

SEQ ID NO: 796346 - RNA, 22 nt, Human
acauggcaggaaucauguguuu

SEQ ID NO: 796347 - RNA, 22 nt, Human
gugauaaaauucaaauagcucu

SEQ ID NO: 796348 - RNA, 22 nt, Human
uuccuucucagcccucgaggau

SEQ ID NO: 796349 - RNA, 22 nt, Human
cacauacauacguauguauaca

SEQ ID NO: 796350 - RNA, 22 nt, Human
ugugucaaccuguggccgggug

SEQ ID NO: 796351 - RNA, 22 nt, Human
gacaaggagccaccagucacgu

SEQ ID NO: 796352 - RNA, 22 nt, Human
cagcaggaggugaguagcaggu

SEQ ID NO: 796353 - RNA, 21 nt, Human
ugagccaggcugacggcugug

SEQ ID NO: 796354 - RNA, 17 nt, Human
ucagcaggggccaagcu

SEQ ID NO: 796355 - RNA, 22 nt, Human
cuggagcccaggccuggugucu

SEQ ID NO: 796356 - RNA, 22 nt, Human
ucucugcauccccagggcucuc

SEQ ID NO: 796357 - RNA, 22 nt, Human
caggguuucaccauguuagcag

SEQ ID NO: 796358 - RNA, 22 nt, Human
aaauguaagucuuuguuucuua

SEQ ID NO: 796359 - RNA, 22 nt, Human
caucauuuguuugcaugcagga

SEQ ID NO: 796360 - RNA, 22 nt, Human
ugagaauuuuuugucaugcauu

SEQ ID NO: 796361 - RNA, 22 nt, Human
uaugaaaugauggggaaaauag

SEQ ID NO: 796362 - RNA, 22 nt, Human
acuucccacacccuguuuucuc

SEQ ID NO: 796363 - RNA, 22 nt, Human
gucagugugaguugauuccaua

SEQ ID NO: 796364 - RNA, 19 nt, Human
ucagaggauuuggcuauga

SEQ ID NO: 796365 - RNA, 22 nt, Human
ugggcuccagcaccugugcucu

SEQ ID NO: 796366 - RNA, 22 nt, Human
agcugggguugcacacauuuug

SEQ ID NO: 796367 - RNA, 22 nt, Human
ucccugcuuucuugugagggga

SEQ ID NO: 796368 - RNA, 22 nt, Human
gacccugguguccagguccugc

SEQ ID NO: 796369 - RNA, 22 nt, Human
ucuuggauuuuaauggaucaaa

SEQ ID NO: 796370 - RNA, 22 nt, Human
ucaggaaagaguguauccauca

SEQ ID NO: 796371 - RNA, 22 nt, Human
uucauucuugggaucagagagu

SEQ ID NO: 796372 - RNA, 22 nt, Human
guggggggagcugcaagcugga

SEQ ID NO: 796373 - RNA, 22 nt, Human
cagccucuguggcugccacacc

SEQ ID NO: 796374 - RNA, 22 nt, Human
cagcuucuagcaucggcuuuga

SEQ ID NO: 796375 - RNA, 20 nt, Human
aggaaaaggguggugguaga

SEQ ID NO: 796376 - RNA, 22 nt, Human
gugccucugagcucugcuacag

SEQ ID NO: 796377 - RNA, 22 nt, Human
gcccaggaguuggaggcugcag

SEQ ID NO: 796378 - RNA, 19 nt, Human
uaaaggaagaggaagggaa

SEQ ID NO: 796379 - RNA, 22 nt, Human
ugucugaacugcacugaaagac

SEQ ID NO: 796380 - RNA, 22 nt, Human
gagcaacaguuuaugguuuuuc

SEQ ID NO: 796381 - RNA, 22 nt, Human
augucuuucuugugucccaaga

SEQ ID NO: 796382 - RNA, 21 nt, Human
aaaugcagucucugagaucug

SEQ ID NO: 796383 - RNA, 22 nt, Human
caggaaauuagucucucuguug

SEQ ID NO: 796384 - RNA, 22 nt, Human
cacacauugguuuuacuccuuu

SEQ ID NO: 796385 - RNA, 22 nt, Human
acaagaaagguaggauucaggu

SEQ ID NO: 796386 - RNA, 22 nt, Human
aaaucagaucuuacacaauugu

SEQ ID NO: 796387 - RNA, 22 nt, Human
ucccagcaggaguccaguuccc

SEQ ID NO: 796388 - RNA, 22 nt, Human
ucaauguaauaaaauacucuau

SEQ ID NO: 796389 - RNA, 22 nt, Human
uacaucuagccuuacaauuauu

SEQ ID NO: 796390 - RNA, 22 nt, Human
uggugcugagaugaagugcucc

SEQ ID NO: 796391 - RNA, 22 nt, Human
auggugguagaagcacuaugug

SEQ ID NO: 796392 - RNA, 23 nt, Human
ggagcugcuguugggggagcugc

SEQ ID NO: 796393 - RNA, 22 nt, Human
ccaguucuaaacauaaagcuaa

SEQ ID NO: 796394 - RNA, 22 nt, Human
uuuuucuugugcuggaucuaau

SEQ ID NO: 796395 - RNA, 22 nt, Human
uaacaauuugcuucauuuguuu

SEQ ID NO: 796396 - RNA, 18 nt, Human
ucaguguagaucugugua

SEQ ID NO: 796397 - RNA, 22 nt, Human
uguauuuucugaagauaaucaa

SEQ ID NO: 796398 - RNA, 22 nt, Human
ucuuucaaaugcuugaauugga

SEQ ID NO: 796399 - RNA, 22 nt, Human
cugcugugaguuuggaggucua

SEQ ID NO: 796400 - RNA, 22 nt, Human
cagacagggaccucgcuccaga

SEQ ID NO: 796401 - RNA, 22 nt, Human
uuaaauguuuaaucuaacuuga

SEQ ID NO: 796402 - RNA, 22 nt, Human
agugugagugcucauguccauc

SEQ ID NO: 796403 - RNA, 22 nt, Human
cuggagcccugaaugggcagga

SEQ ID NO: 796404 - RNA, 22 nt, Human
agcucagaaaugccaguaggua

SEQ ID NO: 796405 - RNA, 23 nt, Human
agcaggcugcuucuccacagcug

SEQ ID NO: 796406 - RNA, 22 nt, Human
uguguucauguugauucauagc

SEQ ID NO: 796407 - RNA, 22 nt, Human
agcauggacaguggcagcagug

SEQ ID NO: 796408 - RNA, 23 nt, Human
acagugucugcugcaagauaucu

SEQ ID NO: 796409 - RNA, 22 nt, Human
aaaagagucuuaggcagucaua

SEQ ID NO: 796410 - RNA, 22 nt, Human
uagcuuugaacuucugggcuca

SEQ ID NO: 796411 - RNA, 22 nt, Human
ucuuugcauuccugugugcuuu

SEQ ID NO: 796412 - RNA, 22 nt, Human
aguggugaugucucuauuauug

SEQ ID NO: 796413 - RNA, 22 nt, Human
uaggggagcucgggugcaaucg

SEQ ID NO: 796414 - RNA, 22 nt, Human
acucagagaaacagcagggugu

SEQ ID NO: 796415 - RNA, 22 nt, Human
aaacaugaguuaaaaguaacug

SEQ ID NO: 796416 - RNA, 22 nt, Human
auucuucauguugaagcuguca

SEQ ID NO: 796417 - RNA, 19 nt, Human
uaacaaagucugaagucag

SEQ ID NO: 796418 - RNA, 23 nt, Human
uaucauuucagcucucugccugg

SEQ ID NO: 796419 - RNA, 22 nt, Human
gcacauggcggccagcagguga

SEQ ID NO: 796420 - RNA, 22 nt, Human
ucagcaggcagugggucacaau

SEQ ID NO: 796421 - RNA, 19 nt, Human
ccugcugaagugaugcagc

SEQ ID NO: 796422 - RNA, 22 nt, Human
caagcaggguuuaugcauggag

SEQ ID NO: 796423 - RNA, 22 nt, Human
cagguaaaaauaaauuugugag

SEQ ID NO: 796424 - RNA, 22 nt, Human
cagcccuguccaaugucugcuc

SEQ ID NO: 796425 - RNA, 22 nt, Human
uuuauuucacucuccggauacu

SEQ ID NO: 796426 - RNA, 22 nt, Human
uuccuuccgggcaccaggcacu

SEQ ID NO: 796427 - RNA, 17 nt, Human
aaacugaaaaauucacu

SEQ ID NO: 796428 - RNA, 22 nt, Human
ugcaggcugcagucucaggugg

SEQ ID NO: 796429 - RNA, 22 nt, Human
uguggugagaaacugguagauu

SEQ ID NO: 796430 - RNA, 22 nt, Human
agcaggaguguccccuggcugu

SEQ ID NO: 796431 - RNA, 22 nt, Human
uuuauugacuucagugagucuu

SEQ ID NO: 796432 - RNA, 22 nt, Human
acaccauacucauguugguucc

SEQ ID NO: 796433 - RNA, 23 nt, Human
caggaaaugcuuggaggggcugg

SEQ ID NO: 796434 - RNA, 22 nt, Human
aucuacagcugucugcacagua

SEQ ID NO: 796435 - RNA, 22 nt, Human
uuucuguuguauggcuucugca

SEQ ID NO: 796436 - RNA, 20 nt, Human
agauuaggggcuuucuucuu

SEQ ID NO: 796437 - RNA, 22 nt, Human
aagccagggguugguaugcuau

SEQ ID NO: 796438 - RNA, 22 nt, Human
ggcuguggacacugagcucaga

SEQ ID NO: 796439 - RNA, 22 nt, Human
guucacaucacuucacugaacc

SEQ ID NO: 796440 - RNA, 22 nt, Human
ggcccagccggcgagucucgcg

SEQ ID NO: 796441 - RNA, 22 nt, Human
ccugcccugucacuggcuaggg

SEQ ID NO: 796442 - RNA, 22 nt, Human
ggugggccaggaaggccgccag

SEQ ID NO: 796443 - RNA, 22 nt, Human
agggcugguauguccaugaaag

SEQ ID NO: 796444 - RNA, 18 nt, Human
gaggauggaaggagaugc

SEQ ID NO: 796445 - RNA, 22 nt, Human
aggcgagaggcuugggcuagua

SEQ ID NO: 796446 - RNA, 22 nt, Human
uggcaauauuaacaguacuuau

SEQ ID NO: 796447 - RNA, 22 nt, Human
gagccaagcaccacauuaaguu

SEQ ID NO: 796448 - RNA, 22 nt, Human
agucccagaucuacaggaggga

SEQ ID NO: 796449 - RNA, 22 nt, Human
ucacauuuucauauucucugag

SEQ ID NO: 796450 - RNA, 22 nt, Human
gcugggcugcgucggggaagcc

SEQ ID NO: 796451 - RNA, 22 nt, Human
caggagaagguuuggagugcag

SEQ ID NO: 796452 - RNA, 22 nt, Human
cagucuuaggagaaacuacaga

SEQ ID NO: 796453 - RNA, 22 nt, Human
ucccagcauaacaaacugcccg

SEQ ID NO: 796454 - RNA, 22 nt, Human
acuugauuuuuauaauaaaugg

SEQ ID NO: 796455 - RNA, 22 nt, Human
auugugauuagagaauauagag

SEQ ID NO: 796456 - RNA, 22 nt, Human
cacagugcaugaugggcagaag

SEQ ID NO: 796457 - RNA, 22 nt, Human
gcccccagaccucagugggcug

SEQ ID NO: 796458 - RNA, 22 nt, Human
acaugagauuuggguggugaua

SEQ ID NO: 796459 - RNA, 22 nt, Human
uuucuucuguuuguaguuacac

SEQ ID NO: 796460 - RNA, 19 nt, Human
cuuuucaucaacagccaau

SEQ ID NO: 796461 - RNA, 22 nt, Human
uuuccaaagguggcaggaacaa

SEQ ID NO: 796462 - RNA, 22 nt, Human
cucccuggaggcccagaccugg

SEQ ID NO: 796463 - RNA, 22 nt, Human
agcuggaggauaacucacuucu

SEQ ID NO: 796464 - RNA, 22 nt, Human
cagaagcaaaugccuugcugag

SEQ ID NO: 796465 - RNA, 22 nt, Human
auggcccacucuggucccggca

SEQ ID NO: 796466 - RNA, 22 nt, Human
aguauuuagagacacaagaugg

SEQ ID NO: 796467 - RNA, 22 nt, Human
gggauuacagaugugagccauu

SEQ ID NO: 796468 - RNA, 23 nt, Human
gucucuagaguguggagcaaaga

SEQ ID NO: 796469 - RNA, 22 nt, Human
ucugacauuuugagaaugacau

SEQ ID NO: 796470 - RNA, 22 nt, Human
aggcuugguuaauucuguguga

SEQ ID NO: 796471 - RNA, 22 nt, Human
aaugucauagcauuucuucaau

SEQ ID NO: 796472 - RNA, 22 nt, Human
uaggggugaggccaggcaucag

SEQ ID NO: 796473 - RNA, 22 nt, Human
aguguuuuuacaagcacucugg

SEQ ID NO: 796474 - RNA, 22 nt, Human
ucuuccagucuguaggacuagg

SEQ ID NO: 796475 - RNA, 22 nt, Human
auggcaggauacccaguccggc

SEQ ID NO: 796476 - RNA, 22 nt, Human
ugcucugcaagcaggagcaaga

SEQ ID NO: 796477 - RNA, 22 nt, Human
agggaagagcuugcaagaaacc

SEQ ID NO: 796478 - RNA, 22 nt, Human
ucauaaaaguacucauguucau

SEQ ID NO: 796479 - RNA, 18 nt, Human
ucacaugacagcuguugc

SEQ ID NO: 796480 - RNA, 22 nt, Human
ugaaggccuaacuuccagugcu

SEQ ID NO: 796481 - RNA, 22 nt, Human
uaguuucuucaccuguaaaaug

SEQ ID NO: 796482 - RNA, 22 nt, Human
aggcaaggugcuacagacagug

SEQ ID NO: 796483 - RNA, 22 nt, Human
cuaguguacaagugguggagau

SEQ ID NO: 796484 - RNA, 22 nt, Human
aggcaggcucuggguaugugca

SEQ ID NO: 796485 - RNA, 22 nt, Human
caaagucuuggugaucaacuuu

SEQ ID NO: 796486 - RNA, 22 nt, Human
ggaggccaucuggcuggaggcu

SEQ ID NO: 796487 - RNA, 20 nt, Human
gauaaauugucucuuaagug

SEQ ID NO: 796488 - RNA, 22 nt, Human
aauguuacauaacccauugucc

SEQ ID NO: 796489 - RNA, 22 nt, Human
acuugaauuuaguuuuuccuaa

SEQ ID NO: 796490 - RNA, 22 nt, Human
aaauaacuugguuucaucagag

SEQ ID NO: 796491 - RNA, 22 nt, Human
gucacagaucucuugagucaag

SEQ ID NO: 796492 - RNA, 22 nt, Human
cagcuucuggcguggagccuga

SEQ ID NO: 796493 - RNA, 22 nt, Human
aguggagaagaggauggucucc

SEQ ID NO: 796494 - RNA, 22 nt, Human
uuagaacaauauucucccuaca

SEQ ID NO: 796495 - RNA, 22 nt, Human
ucaggacagggaucacaucauc

SEQ ID NO: 796496 - RNA, 22 nt, Human
ucucaggaauagaguggcagca

SEQ ID NO: 796497 - RNA, 22 nt, Human
gcaggcuuugacuuggggcagc

SEQ ID NO: 796498 - RNA, 23 nt, Human
aggaacugaggccuagggaggua

SEQ ID NO: 796499 - RNA, 21 nt, Human
aggugggcagguggaguggcc

SEQ ID NO: 796500 - RNA, 22 nt, Human
ggcagggacuuugcaaaucuuu

SEQ ID NO: 796501 - RNA, 22 nt, Human
agaagccaauucugugugaguc

SEQ ID NO: 796502 - RNA, 22 nt, Human
caaggcaggccaguuucaaggc

SEQ ID NO: 796503 - RNA, 22 nt, Human
ugaaauaggaaacagauguuuc

SEQ ID NO: 796504 - RNA, 22 nt, Human
uccagggagauggcagaggcug

SEQ ID NO: 796505 - RNA, 22 nt, Human
gacaguuuaagcaccuaauauu

SEQ ID NO: 796506 - RNA, 22 nt, Human
cccaggcacucuuggucauuuu

SEQ ID NO: 796507 - RNA, 17 nt, Human
cuuggcugcugugcgau

SEQ ID NO: 796508 - RNA, 23 nt, Human
ugguucaagugagaaguaauguu

SEQ ID NO: 796509 - RNA, 22 nt, Human
caagcuggagguuggagcuacu

SEQ ID NO: 796510 - RNA, 22 nt, Human
caugcuaaaccagaacauagga

SEQ ID NO: 796511 - RNA, 22 nt, Human
gcuugcagcaggugcuuaggaa

SEQ ID NO: 796512 - RNA, 22 nt, Human
ugguggagccuaggcuaagucu

SEQ ID NO: 796513 - RNA, 22 nt, Human
acaaucuuauuaguaguauaga

SEQ ID NO: 796514 - RNA, 22 nt, Human
agcagggggaguuagacuagau

SEQ ID NO: 796515 - RNA, 22 nt, Human
aucucagggcuggagcccugga

SEQ ID NO: 796516 - RNA, 22 nt, Human
caggcagcucuaauggaaagug

SEQ ID NO: 796517 - RNA, 22 nt, Human
ucugugcuaaugcuucacaaua

SEQ ID NO: 796518 - RNA, 22 nt, Human
agcccugggcguuacugggaug

SEQ ID NO: 796519 - RNA, 22 nt, Human
ugagcugaguggcaggucucag

SEQ ID NO: 796520 - RNA, 22 nt, Human
gacauuuauuagaaaacuauca

SEQ ID NO: 796521 - RNA, 22 nt, Human
agaaaucagaacccugaaguuc

SEQ ID NO: 796522 - RNA, 22 nt, Human
aauccauguugauguauauuuu

SEQ ID NO: 796523 - RNA, 22 nt, Human
auaaacuggguaucaagaggcc

SEQ ID NO: 796524 - RNA, 22 nt, Human
cccagcagggucucugugucua

SEQ ID NO: 796525 - RNA, 23 nt, Human
cccugcacuaagaggagaaggug

SEQ ID NO: 796526 - RNA, 18 nt, Human
gacccagcagaugggcuu

SEQ ID NO: 796527 - RNA, 22 nt, Human
ucaggaagggcucagucugugc

SEQ ID NO: 796528 - RNA, 22 nt, Human
aucuuacauucccucaccauuu

SEQ ID NO: 796529 - RNA, 22 nt, Human
gacuccccugggccccauccag

SEQ ID NO: 796530 - RNA, 18 nt, Human
ggccucagccuggccgga

SEQ ID NO: 796531 - RNA, 20 nt, Human
uucuauggaccaguauauuu

SEQ ID NO: 796532 - RNA, 22 nt, Human
cucugggaagggcugagcacug

SEQ ID NO: 796533 - RNA, 22 nt, Human
ucaggcagaugcagggauggau

SEQ ID NO: 796534 - RNA, 22 nt, Human
ugguggcagugagaaggagagg

SEQ ID NO: 796535 - RNA, 22 nt, Human
uuuuugucuagcgucucuaguu

SEQ ID NO: 796536 - RNA, 22 nt, Human
aucacagagauugcuuuuaaaa

SEQ ID NO: 796537 - RNA, 22 nt, Human
acaguucaagucuuagacaaca

SEQ ID NO: 796538 - RNA, 22 nt, Human
aguccauaggcaguucauaaca

SEQ ID NO: 796539 - RNA, 22 nt, Human
ucccagccacaguuuccaccug

SEQ ID NO: 796540 - RNA, 22 nt, Human
ugaggcccagccgcccugagag

SEQ ID NO: 796541 - RNA, 22 nt, Human
auaacaugaccugugcuucaca

SEQ ID NO: 796542 - RNA, 22 nt, Human
aagugaugcuacgacuuugaca

SEQ ID NO: 796543 - RNA, 20 nt, Human
agcuccuggacuagagagug

SEQ ID NO: 796544 - RNA, 22 nt, Human
aaucaacauuguuuuaagucaa

SEQ ID NO: 796545 - RNA, 22 nt, Human
caugcaaaggucaagaucagga

SEQ ID NO: 796546 - RNA, 22 nt, Human
caccugcagggggagucaagag

SEQ ID NO: 796547 - RNA, 22 nt, Human
uuccuuccuccuccaguucugg

SEQ ID NO: 796548 - RNA, 22 nt, Human
gggugggaugccgcugucucca

SEQ ID NO: 796549 - RNA, 22 nt, Human
uuuagagacccucugcuauuuu

SEQ ID NO: 796550 - RNA, 22 nt, Human
aggagagagaacacuugggucc

SEQ ID NO: 796551 - RNA, 22 nt, Human
ccacagaaaauaaagcacgauu

SEQ ID NO: 796552 - RNA, 22 nt, Human
acaaguuaccaaaaaagauuca

SEQ ID NO: 796553 - RNA, 22 nt, Human
cuuuacaaacuauaaagugcgg

SEQ ID NO: 796554 - RNA, 22 nt, Human
gccuaauacaugaugauaggua

SEQ ID NO: 796555 - RNA, 22 nt, Human
gaguuucuccagugcuaguugu

SEQ ID NO: 796556 - RNA, 22 nt, Human
gccaucucggagcuaucaaagg

SEQ ID NO: 796557 - RNA, 22 nt, Human
agggcugccugacuccagagcc

SEQ ID NO: 796558 - RNA, 22 nt, Human
uucuuacaaguaugacguagca

SEQ ID NO: 796559 - RNA, 22 nt, Human
agaaaguacagaugagacacuu

SEQ ID NO: 796560 - RNA, 22 nt, Human
uugguucaacuuuucuaaguag

SEQ ID NO: 796561 - RNA, 22 nt, Human
uaucacaauuccuauaguuugu

SEQ ID NO: 796562 - RNA, 22 nt, Human
acauuuaaauaccuauguuucu

SEQ ID NO: 796563 - RNA, 22 nt, Human
ugcuuuauaacuuaguuuaugg

SEQ ID NO: 796564 - RNA, 22 nt, Human
agaacuuaggaacaacagcuua

SEQ ID NO: 796565 - RNA, 22 nt, Human
uuccagaguccauguuggcuca

SEQ ID NO: 796566 - RNA, 22 nt, Human
guuucauaggcaugugaccuau

SEQ ID NO: 796567 - RNA, 22 nt, Human
cuccuggcccugagcucccagg

SEQ ID NO: 796568 - RNA, 22 nt, Human
uauuucagacacugaucuugca

SEQ ID NO: 796569 - RNA, 22 nt, Human
ggcuggcacugaggagagcucu

SEQ ID NO: 796570 - RNA, 22 nt, Human
aaggcagagauauucuugaucu

SEQ ID NO: 796571 - RNA, 22 nt, Human
ugaaaucauugccaaguauuga

SEQ ID NO: 796572 - RNA, 22 nt, Human
ucucagugcagcaaggaauuua

SEQ ID NO: 796573 - RNA, 22 nt, Human
acaguacaagcaaugcauuuuu

SEQ ID NO: 796574 - RNA, 22 nt, Human
cuucacaugauguccgugcugu

SEQ ID NO: 796575 - RNA, 22 nt, Human
acauagaaccuggcacauagua

SEQ ID NO: 796576 - RNA, 23 nt, Human
uuccagaggaagaagucaugacu

SEQ ID NO: 796577 - RNA, 22 nt, Human
aacauagcuuuacucaaaugac

SEQ ID NO: 796578 - RNA, 22 nt, Human
aaagcaagucucuacaaaguac

SEQ ID NO: 796579 - RNA, 22 nt, Human
ugcuggaggccugacuguguuu

SEQ ID NO: 796580 - RNA, 22 nt, Human
gauggaggagauggcagggugc

SEQ ID NO: 796581 - RNA, 22 nt, Human
gcauguggugcugaggcugucg

SEQ ID NO: 796582 - RNA, 22 nt, Human
aggcauggcauggggcagaugu

SEQ ID NO: 796583 - RNA, 22 nt, Human
uaaaugagauguacauaacuca

SEQ ID NO: 796584 - RNA, 22 nt, Human
gcuggcuuaauagggaugggcu

SEQ ID NO: 796585 - RNA, 22 nt, Human
ggagugggaacaaugacauggu

SEQ ID NO: 796586 - RNA, 22 nt, Human
gaggcagcuuggggcugugggu

SEQ ID NO: 796587 - RNA, 22 nt, Human
agcacagacuggucccaggucu

SEQ ID NO: 796588 - RNA, 17 nt, Human
gcccugccugcugcccu

SEQ ID NO: 796589 - RNA, 22 nt, Human
gaauuacauaauaaaaugagag

SEQ ID NO: 796590 - RNA, 22 nt, Human
gcaagcacagauagacucagcc

SEQ ID NO: 796591 - RNA, 22 nt, Human
cugggggcaagcagacagcugu

SEQ ID NO: 796592 - RNA, 22 nt, Human
agauuuauguggucacacucag

SEQ ID NO: 796593 - RNA, 22 nt, Human
aaguuacaguuauuauuuaaaa

SEQ ID NO: 796594 - RNA, 22 nt, Human
gcaggugggagccgcugccuga

SEQ ID NO: 796595 - RNA, 22 nt, Human
auccuuaauuuacuugcaucuu

SEQ ID NO: 796596 - RNA, 22 nt, Human
ucaagagacaggacguguuuca

SEQ ID NO: 796597 - RNA, 22 nt, Human
gcaacagcauucucauugacau

SEQ ID NO: 796598 - RNA, 22 nt, Human
cagaggaaggcucugggaaugu

SEQ ID NO: 796599 - RNA, 18 nt, Human
uggacacauggccugggu

SEQ ID NO: 796600 - RNA, 22 nt, Human
agcugaaagcuugacuggggcu

SEQ ID NO: 796601 - RNA, 22 nt, Human
aggcugagguaggaggaucgcu

SEQ ID NO: 796602 - RNA, 22 nt, Human
acauuucucagguaagucauuu

SEQ ID NO: 796603 - RNA, 22 nt, Human
auuauuauuguugauguuaggg

SEQ ID NO: 796604 - RNA, 22 nt, Human
uugguucaauacuaacuugaac

SEQ ID NO: 796605 - RNA, 22 nt, Human
cuagaaauauuuuacagucaag

SEQ ID NO: 796606 - RNA, 22 nt, Human
cccaggcagccccagaagcuug

SEQ ID NO: 796607 - RNA, 22 nt, Human
caggcagagcaacugguccaga

SEQ ID NO: 796608 - RNA, 22 nt, Human
cuggcuggccaugcagcgccag

SEQ ID NO: 796609 - RNA, 18 nt, Human
cugugggaaggcuuucua

SEQ ID NO: 796610 - RNA, 22 nt, Human
uuccucaguuagugccugaggc

SEQ ID NO: 796611 - RNA, 22 nt, Human
cccaggaggaggaaaaagcucg

SEQ ID NO: 796612 - RNA, 22 nt, Human
aucgcaaguuuaaaaaucuuug

SEQ ID NO: 796613 - RNA, 22 nt, Human
uuucacauucuucugaaucuac

SEQ ID NO: 796614 - RNA, 22 nt, Human
gccacagcucacguuccccauu

SEQ ID NO: 796615 - RNA, 22 nt, Human
uauuaacaugaacugacuuuuc

SEQ ID NO: 796616 - RNA, 18 nt, Human
ucagacaaguuagacagg

SEQ ID NO: 796617 - RNA, 20 nt, Human
ucuuugugucagauggacag

SEQ ID NO: 796618 - RNA, 19 nt, Human
agaaauagccuuccuuguc

SEQ ID NO: 796619 - RNA, 22 nt, Human
ccacaggcugcugcaggucccg

SEQ ID NO: 796620 - RNA, 22 nt, Human
ugauaaacagcugaugaagacc

SEQ ID NO: 796621 - RNA, 20 nt, Human
agccaggguucuggaugcac

SEQ ID NO: 796622 - RNA, 18 nt, Human
guuuacauuacugaauag

SEQ ID NO: 796623 - RNA, 22 nt, Human
uggugagaaguuuugagauucu

SEQ ID NO: 796624 - RNA, 22 nt, Human
gcccagcccagaaagguucgga

SEQ ID NO: 796625 - RNA, 22 nt, Human
gcagcugagcgugaggaagagu

SEQ ID NO: 796626 - RNA, 22 nt, Human
acaggcaccugccaccacaucu

SEQ ID NO: 796627 - RNA, 21 nt, Human
aucugaaguuugagaggaaag

SEQ ID NO: 796628 - RNA, 22 nt, Human
acagggcagagaggcaggcuug

SEQ ID NO: 796629 - RNA, 22 nt, Human
aauccauagaauaaaauugcag

SEQ ID NO: 796630 - RNA, 18 nt, Human
ggaugcugugugcuccuu

SEQ ID NO: 796631 - RNA, 22 nt, Human
cugggcuggagugcaauggcgc

SEQ ID NO: 796632 - RNA, 19 nt, Human
uugagaacaccaaguacug

SEQ ID NO: 796633 - RNA, 22 nt, Human
ggagccugggccuccugcccuu

SEQ ID NO: 796634 - RNA, 22 nt, Human
uaaaggcacggaguuguuaugg

SEQ ID NO: 796635 - RNA, 22 nt, Human
uauauuaacuugugauccugga

SEQ ID NO: 796636 - RNA, 18 nt, Human
ucacagaauauugagugg

SEQ ID NO: 796637 - RNA, 22 nt, Human
ugccgcuccaggucucgcggug

SEQ ID NO: 796638 - RNA, 22 nt, Human
uuugauaugcaaaauuauggac

SEQ ID NO: 796639 - RNA, 22 nt, Human
uggcuucccauagcuugcuagu

SEQ ID NO: 796640 - RNA, 22 nt, Human
uccuggaagccagaguugagga

SEQ ID NO: 796641 - RNA, 22 nt, Human
aggcaagaccagaaagggcuga

SEQ ID NO: 796642 - RNA, 22 nt, Human
agccagcugccuuucacaucug

SEQ ID NO: 796643 - RNA, 18 nt, Human
ucaggcuggaaguuugcc

SEQ ID NO: 796644 - RNA, 22 nt, Human
cuucuauuuucaugccuggguc

SEQ ID NO: 796645 - RNA, 22 nt, Human
gccuccccugcaauuguccuug

SEQ ID NO: 796646 - RNA, 22 nt, Human
gcuggcuggcacguucgcacgu

SEQ ID NO: 796647 - RNA, 22 nt, Human
cagaagcauugacuccuugcuc

SEQ ID NO: 796648 - RNA, 22 nt, Human
gcucagaguggccuggcuaggg

SEQ ID NO: 796649 - RNA, 22 nt, Human
cugugacugcagcaccaaguaa

SEQ ID NO: 796650 - RNA, 23 nt, Human
gagagcaaugagauguaaacacu

SEQ ID NO: 796651 - RNA, 22 nt, Human
agaaacauccugcuuuccauuu

SEQ ID NO: 796652 - RNA, 22 nt, Human
cugcacuguguaacagauaacu

SEQ ID NO: 796653 - RNA, 22 nt, Human
ucaggaacauaaugugagucag

SEQ ID NO: 796654 - RNA, 22 nt, Human
uccuaggcuccagaacugugaa

SEQ ID NO: 796655 - RNA, 22 nt, Human
ugacauuuaucaaagaaauggu

SEQ ID NO: 796656 - RNA, 22 nt, Human
ggcaggugacggggaugaguau

SEQ ID NO: 796657 - RNA, 18 nt, Human
ccaggacaggcaaaaggu

SEQ ID NO: 796658 - RNA, 21 nt, Human
aaaaugugagcgugaugcuua

SEQ ID NO: 796659 - RNA, 22 nt, Human
agaugcugaauuauugugcuuu

SEQ ID NO: 796660 - RNA, 22 nt, Human
agccucucuguuagucacuggg

SEQ ID NO: 796661 - RNA, 22 nt, Human
uuucugcaaacuuccacgucuc

SEQ ID NO: 796662 - RNA, 22 nt, Human
uggggaaaguucuugaaaguaa

SEQ ID NO: 796663 - RNA, 22 nt, Human
acaacaguagccuuuacaaggc

SEQ ID NO: 796664 - RNA, 22 nt, Human
gacuuuggauucauuaucugga

SEQ ID NO: 796665 - RNA, 22 nt, Human
agugugacuacauuacaagagu

SEQ ID NO: 796666 - RNA, 22 nt, Human
gucccugggaaaggagagggca

SEQ ID NO: 796667 - RNA, 22 nt, Human
cagccugacuauggcugcaggu

SEQ ID NO: 796668 - RNA, 21 nt, Human
uccuccuggccaggcggcccc

SEQ ID NO: 796669 - RNA, 22 nt, Human
uuucuuauauucugucauuguu

SEQ ID NO: 796670 - RNA, 22 nt, Human
acgggcagacagagcuacucgc

SEQ ID NO: 796671 - RNA, 22 nt, Human
gcuaagggaggcaugccguggu

SEQ ID NO: 796672 - RNA, 18 nt, Human
caaauacuguugucuuau

SEQ ID NO: 796673 - RNA, 22 nt, Human
auauauuuuuugagacagaguc

SEQ ID NO: 796674 - RNA, 22 nt, Human
auauuaaugggauuuagucagg

SEQ ID NO: 796675 - RNA, 22 nt, Human
ggaggccaggugggagucaucu

SEQ ID NO: 796676 - RNA, 22 nt, Human
ugaacuuuuauuugaugacagg

SEQ ID NO: 796677 - RNA, 22 nt, Human
cugagcagcguggggagcuggc

SEQ ID NO: 796678 - RNA, 22 nt, Human
aaaagguagauucuccuucuau

SEQ ID NO: 796679 - RNA, 22 nt, Human
gaaaauacaaauagccuugaaa

SEQ ID NO: 796680 - RNA, 22 nt, Human
guuucugagagccacacacagc

SEQ ID NO: 796681 - RNA, 22 nt, Human
uacagaauguuaugaagcauag

SEQ ID NO: 796682 - RNA, 22 nt, Human
uccagcagaaccagagaccugg

SEQ ID NO: 796683 - RNA, 22 nt, Human
gcagcugaauguccauugcugc

SEQ ID NO: 796684 - RNA, 22 nt, Human
gccugccucaaaaucccaguuc

SEQ ID NO: 796685 - RNA, 22 nt, Human
uccagagaucacacugggcagg

SEQ ID NO: 796686 - RNA, 22 nt, Human
gccuuggacucggguggacuca

SEQ ID NO: 796687 - RNA, 22 nt, Human
agucuucccugugccagagugu

SEQ ID NO: 796688 - RNA, 22 nt, Human
gucuagggcuccucagugacaa

SEQ ID NO: 796689 - RNA, 22 nt, Human
caucaggaucucucuggaaugc

SEQ ID NO: 796690 - RNA, 22 nt, Human
uggggaaaaugcuuguagucag

SEQ ID NO: 796691 - RNA, 22 nt, Human
aggcccagggcugcucucugaa

SEQ ID NO: 796692 - RNA, 22 nt, Human
ugggagauauugcuguggcugu

SEQ ID NO: 796693 - RNA, 21 nt, Human
aacauuuggcuggcuuuugug

SEQ ID NO: 796694 - RNA, 22 nt, Human
gaauguaauagucaguagaaca

SEQ ID NO: 796695 - RNA, 22 nt, Human
caagaugccccugguagggauc

SEQ ID NO: 796696 - RNA, 22 nt, Human
cacaggcuccggccuugcagcc

SEQ ID NO: 796697 - RNA, 22 nt, Human
aagaugauguuguguuuucacu

SEQ ID NO: 796698 - RNA, 22 nt, Human
agccagggcugcgagcagacag

SEQ ID NO: 796699 - RNA, 22 nt, Human
cagagaaacucagauagcugau

SEQ ID NO: 796700 - RNA, 22 nt, Human
aucuagaacaauuauugucaca

SEQ ID NO: 796701 - RNA, 22 nt, Human
gcugcaggcauuuuccugggca

SEQ ID NO: 796702 - RNA, 22 nt, Human
gucauuuucuagaauuauuuga

SEQ ID NO: 796703 - RNA, 22 nt, Human
auagauacauuguuauauuugu

SEQ ID NO: 796704 - RNA, 22 nt, Human
acagcaggaagcuggagggaaa

SEQ ID NO: 796705 - RNA, 22 nt, Human
aagucagagaucaaggugucua

SEQ ID NO: 796706 - RNA, 19 nt, Human
caggccagugucagggggc

SEQ ID NO: 796707 - RNA, 22 nt, Human
ccaggaagguguuuaacuagag

SEQ ID NO: 796708 - RNA, 20 nt, Human
gcagccguggagacuaggag

SEQ ID NO: 796709 - RNA, 22 nt, Human
ggcucugccugcccagcagcac

SEQ ID NO: 796710 - RNA, 22 nt, Human
cauggccacaucuagcugcaag

SEQ ID NO: 796711 - RNA, 22 nt, Human
uuaagucacuuaucuaaagaca

SEQ ID NO: 796712 - RNA, 22 nt, Human
ucaguguccaaaaagaggcaag

SEQ ID NO: 796713 - RNA, 22 nt, Human
gcuucauuacugacagucugug

SEQ ID NO: 796714 - RNA, 18 nt, Human
acccaggcucaugguccu

SEQ ID NO: 796715 - RNA, 21 nt, Human
ugggccucaaguggguggcag

SEQ ID NO: 796716 - RNA, 18 nt, Human
gucauggguaguuuagua

SEQ ID NO: 796717 - RNA, 22 nt, Human
ggaaacauuccaagaguugaaa

SEQ ID NO: 796718 - RNA, 22 nt, Human
cccagccuacucugccauagca

SEQ ID NO: 796719 - RNA, 22 nt, Human
gugcaggagcaggagccauguc

SEQ ID NO: 796720 - RNA, 22 nt, Human
agcuuccuugaauucuguagaa

SEQ ID NO: 796721 - RNA, 22 nt, Human
auugagaagcuugcagauuuuu

SEQ ID NO: 796722 - RNA, 22 nt, Human
aucaaagaaugugacugaaaua

SEQ ID NO: 796723 - RNA, 22 nt, Human
auauauaagcugaugagccaca

SEQ ID NO: 796724 - RNA, 22 nt, Human
agccuggcuuagcucucucacu

SEQ ID NO: 796725 - RNA, 22 nt, Human
agccaaggcagcuagagcucug

SEQ ID NO: 796726 - RNA, 22 nt, Human
uucaaacucugaguaguucugc

SEQ ID NO: 796727 - RNA, 22 nt, Human
cuuuuuccagcuucaggguggg

SEQ ID NO: 796728 - RNA, 22 nt, Human
auucugaguacaacaagauguu

SEQ ID NO: 796729 - RNA, 21 nt, Human
agcaaaggcaggagagguuuc

SEQ ID NO: 796730 - RNA, 22 nt, Human
accacaguuucauucaugcagg

SEQ ID NO: 796731 - RNA, 22 nt, Human
accuccuggcugcucauggaac

SEQ ID NO: 796732 - RNA, 22 nt, Human
ggccuugguucugucacagccg

SEQ ID NO: 796733 - RNA, 22 nt, Human
caggcagcugcgacaagagagc

SEQ ID NO: 796734 - RNA, 22 nt, Human
aaggcucugcaaaaccuccaag

SEQ ID NO: 796735 - RNA, 22 nt, Human
cagggauggccuggcgggccac

SEQ ID NO: 796736 - RNA, 22 nt, Human
uacucaaucuagguggcuuacc

SEQ ID NO: 796737 - RNA, 22 nt, Human
agcuagccuaggcagagugcau

SEQ ID NO: 796738 - RNA, 19 nt, Human
agcugcugauugguggagg

SEQ ID NO: 796739 - RNA, 22 nt, Human
gcaaagacugcaauuacuuuug

SEQ ID NO: 796740 - RNA, 22 nt, Human
gcuggagaaacaggaggaggaa

SEQ ID NO: 796741 - RNA, 22 nt, Human
gagccagaaaagcugccugacu

SEQ ID NO: 796742 - RNA, 22 nt, Human
agggugaaucucacaacucuua

SEQ ID NO: 796743 - RNA, 22 nt, Human
caggcaguggccauguugggag

SEQ ID NO: 796744 - RNA, 16 nt, Human
ccaccugcagcucuca

SEQ ID NO: 796745 - RNA, 22 nt, Human
uccucaggagagcuccuaugcc

SEQ ID NO: 796746 - RNA, 23 nt, Human
cuauuucucauaguucaggucuu

SEQ ID NO: 796747 - RNA, 22 nt, Human
ggagggggaauucagccccagc

SEQ ID NO: 796748 - RNA, 22 nt, Human
acuccuggggauccauuccuuu

SEQ ID NO: 796749 - RNA, 22 nt, Human
caggcaguggcucacagcaacc

SEQ ID NO: 796750 - RNA, 22 nt, Human
gcuguggguuuccaauccugga

SEQ ID NO: 796751 - RNA, 22 nt, Human
gggacaggcaaagguaugcuuc

SEQ ID NO: 796752 - RNA, 19 nt, Human
ugcaaauucuaaaaacuga

SEQ ID NO: 796753 - RNA, 23 nt, Human
ugcaguguuuaacaaugacuuga

SEQ ID NO: 796754 - RNA, 22 nt, Human
ccugccacuguaggugacaguu

SEQ ID NO: 796755 - RNA, 22 nt, Human
uuucacaaguuucaggauucug

SEQ ID NO: 796756 - RNA, 22 nt, Human
auggaaauguuccauauauuga

SEQ ID NO: 796757 - RNA, 22 nt, Human
uaguauuuauaaucaugcuuaa

SEQ ID NO: 796758 - RNA, 22 nt, Human
gggccacauugaagggugggua

SEQ ID NO: 796759 - RNA, 22 nt, Human
caggcagagaacucauccguga

SEQ ID NO: 796760 - RNA, 22 nt, Human
ucaggacaacauguugcuaauc

SEQ ID NO: 796761 - RNA, 22 nt, Human
uacaaagugugcccaugcugag

SEQ ID NO: 796762 - RNA, 22 nt, Human
gcuuguuugugauuucuccaga

SEQ ID NO: 796763 - RNA, 22 nt, Human
agcuccugucucaagggagccu

SEQ ID NO: 796764 - RNA, 22 nt, Human
ggcaggcaucauguggucauua

SEQ ID NO: 796765 - RNA, 22 nt, Human
uccucagggggccaacccagcc

SEQ ID NO: 796766 - RNA, 22 nt, Human
aaaagcagaccacgcuuugugg

SEQ ID NO: 796767 - RNA, 22 nt, Human
cuggggaggaugcuacgaccug

SEQ ID NO: 796768 - RNA, 22 nt, Human
cucaggcuugggaggaggccca

SEQ ID NO: 796769 - RNA, 22 nt, Human
caggaaauuggcuauuugggau

SEQ ID NO: 796770 - RNA, 18 nt, Human
gaaagugcggggcagggg

SEQ ID NO: 796771 - RNA, 22 nt, Human
caggcucccgcuccacugggca

SEQ ID NO: 796772 - RNA, 22 nt, Human
cagcuuugugcaaugcagucuc

SEQ ID NO: 796773 - RNA, 19 nt, Human
gcacccuggccacucccac

SEQ ID NO: 796774 - RNA, 20 nt, Human
gcaaggcacagugaggaggg

SEQ ID NO: 796775 - RNA, 22 nt, Human
ggcugccuucccugagccccgg

SEQ ID NO: 796776 - RNA, 22 nt, Human
ucccacauuacccugacugaca

SEQ ID NO: 796777 - RNA, 22 nt, Human
uggcagcugaggggaggcuuug

SEQ ID NO: 796778 - RNA, 22 nt, Human
aaggacaaagcagagcuggaug

SEQ ID NO: 796779 - RNA, 22 nt, Human
gagcuggcuccgccaugcugcu

SEQ ID NO: 796780 - RNA, 22 nt, Human
ccuggcacagagcgguggucac

SEQ ID NO: 796781 - RNA, 22 nt, Human
uaaagacacugguuuuaaucau

SEQ ID NO: 796782 - RNA, 22 nt, Human
gcuggccaguguggugaccacc

SEQ ID NO: 796783 - RNA, 22 nt, Human
aggaagcacuggaagggguugg

SEQ ID NO: 796784 - RNA, 17 nt, Human
gaugaaaugaugcacac

SEQ ID NO: 796785 - RNA, 22 nt, Human
agcuuucugucaccugugcuug

SEQ ID NO: 796786 - RNA, 22 nt, Human
gaguccugcccuuguguagucc

SEQ ID NO: 796787 - RNA, 22 nt, Human
ucagaggcuucuggccagucug

SEQ ID NO: 796788 - RNA, 22 nt, Human
aagccaggccauucucugguuc

SEQ ID NO: 796789 - RNA, 22 nt, Human
cugccugggccggccacccucu

SEQ ID NO: 796790 - RNA, 22 nt, Human
uagccagugagacccagaaaua

SEQ ID NO: 796791 - RNA, 22 nt, Human
gaaaauacuucaguguucuggc

SEQ ID NO: 796792 - RNA, 21 nt, Human
aggcacuuaaccaauguuagc

SEQ ID NO: 796793 - RNA, 22 nt, Human
ugucaacaggcuuucuaaggca

SEQ ID NO: 796794 - RNA, 22 nt, Human
ugacuuccugcacucaggugau

SEQ ID NO: 796795 - RNA, 22 nt, Human
cauguuggcacugucucugccu

SEQ ID NO: 796796 - RNA, 22 nt, Human
ugaaacauaaaguuaucuucag

SEQ ID NO: 796797 - RNA, 22 nt, Human
cucaagaugucagggcaccugc

SEQ ID NO: 796798 - RNA, 22 nt, Human
uucucuugacuaccaguuagga

SEQ ID NO: 796799 - RNA, 22 nt, Human
uguguuuuaucuauuguaucuu

SEQ ID NO: 796800 - RNA, 18 nt, Human
uuuccaagaagagagcuc

SEQ ID NO: 796801 - RNA, 22 nt, Human
ugugaagcuggauccuggagcu

SEQ ID NO: 796802 - RNA, 22 nt, Human
uuaauacaacuguugucacugg

SEQ ID NO: 796803 - RNA, 22 nt, Human
aguauacaaauaaauguguaau

SEQ ID NO: 796804 - RNA, 22 nt, Human
ucagaugagugcuuucagcugc

SEQ ID NO: 796805 - RNA, 22 nt, Human
uggcuggcguuggggccaguga

SEQ ID NO: 796806 - RNA, 22 nt, Human
ucugcagcgugcaggcuggugc

SEQ ID NO: 796807 - RNA, 22 nt, Human
uggcucuggggacaguaagucc

SEQ ID NO: 796808 - RNA, 22 nt, Human
ggugcuggacacguggcacucc

SEQ ID NO: 796809 - RNA, 22 nt, Human
cucagagagugaauuccugccu

SEQ ID NO: 796810 - RNA, 22 nt, Human
agaauacuugggaauggguuaa

SEQ ID NO: 796811 - RNA, 22 nt, Human
ucccagccuccugacaguuuug

SEQ ID NO: 796812 - RNA, 22 nt, Human
ggggccacuggcaggaccuugg

SEQ ID NO: 796813 - RNA, 22 nt, Human
aggaagaggugugcaauggugu

SEQ ID NO: 796814 - RNA, 19 nt, Human
gaaaacaugggugaggguc

SEQ ID NO: 796815 - RNA, 22 nt, Human
aagugaaacauguaucucuuua

SEQ ID NO: 796816 - RNA, 22 nt, Human
uggugucaggcacuagcaugca

SEQ ID NO: 796817 - RNA, 19 nt, Human
gggguggcuggggcuccag

SEQ ID NO: 796818 - RNA, 22 nt, Human
caugugcagacucugacaggcu

SEQ ID NO: 796819 - RNA, 22 nt, Human
ccugccagcauggcuuaucucc

SEQ ID NO: 796820 - RNA, 22 nt, Human
cacagcuuaugccacugauugg

SEQ ID NO: 796821 - RNA, 22 nt, Human
ugcuggcuuagauaucacugcc

SEQ ID NO: 796822 - RNA, 22 nt, Human
ugucacagaucguuuuugagcu

SEQ ID NO: 796823 - RNA, 22 nt, Human
acuuuuucucagaaggauuggu

SEQ ID NO: 796824 - RNA, 22 nt, Human
auuugucacacauaguuuaucc

SEQ ID NO: 796825 - RNA, 20 nt, Human
aggcuggcacuccuggccag

SEQ ID NO: 796826 - RNA, 22 nt, Human
cacagugcacuaagcuccgggg

SEQ ID NO: 796827 - RNA, 22 nt, Human
ucaagagauugaauaauaacug

SEQ ID NO: 796828 - RNA, 22 nt, Human
caguaaacacuagcauucuugg

SEQ ID NO: 796829 - RNA, 22 nt, Human
cuugccuuugucuucaaaggcu

SEQ ID NO: 796830 - RNA, 22 nt, Human
gcuggaggcaguucagacacca

SEQ ID NO: 796831 - RNA, 22 nt, Human
ccuccucuggugcugccaaccc

SEQ ID NO: 796832 - RNA, 22 nt, Human
guggcagucucaucuguggcuc

SEQ ID NO: 796833 - RNA, 22 nt, Human
caguuuaaguguguugaaggua

SEQ ID NO: 796834 - RNA, 22 nt, Human
auguuuaaaggagucagagacu

SEQ ID NO: 796835 - RNA, 22 nt, Human
gccagcugagcaaauuccagcu

SEQ ID NO: 796836 - RNA, 22 nt, Human
uauaaagagucucaaagaaguu

SEQ ID NO: 796837 - RNA, 22 nt, Human
cuucacauuaguuuggaucaaa

SEQ ID NO: 796838 - RNA, 22 nt, Human
acugugauguucucuaucuugg

SEQ ID NO: 796839 - RNA, 22 nt, Human
cagggcucccuugcaaggaggg

SEQ ID NO: 796840 - RNA, 22 nt, Human
agccaggcugcaguuggcuggc

SEQ ID NO: 796841 - RNA, 20 nt, Human
guuucugauucaguaggucu

SEQ ID NO: 796842 - RNA, 22 nt, Human
cuggaggguggagagaagucuc

SEQ ID NO: 796843 - RNA, 22 nt, Human
auuuaagauugcguauucaugu

SEQ ID NO: 796844 - RNA, 22 nt, Human
acacauuucuaaauuuuuaccg

SEQ ID NO: 796845 - RNA, 22 nt, Human
auuguccuaucucagugccaug

SEQ ID NO: 796846 - RNA, 22 nt, Human
ucugcuggucaaggcugggucc

SEQ ID NO: 796847 - RNA, 22 nt, Human
uagacauuuggcaugguuuuca

SEQ ID NO: 796848 - RNA, 22 nt, Human
ugcuggcuccaaccuggcaucu

SEQ ID NO: 796849 - RNA, 22 nt, Human
ugcaggcuguuugguggaucuc

SEQ ID NO: 796850 - RNA, 22 nt, Human
acugaaauggggacaguccuua

SEQ ID NO: 796851 - RNA, 22 nt, Human
aggcagaucacuugaggccagg

SEQ ID NO: 796852 - RNA, 22 nt, Human
uauuuugcuuuagcugacuguu

SEQ ID NO: 796853 - RNA, 22 nt, Human
gauuucuuggcccacucucaga

SEQ ID NO: 796854 - RNA, 22 nt, Human
cuggagccggcgagccccagcc

SEQ ID NO: 796855 - RNA, 22 nt, Human
cacccaggcagguggcugagaa

SEQ ID NO: 796856 - RNA, 22 nt, Human
gcagggcuggggcugcuccuga

SEQ ID NO: 796857 - RNA, 22 nt, Human
cagcugugcuguauuaagcucu

SEQ ID NO: 796858 - RNA, 22 nt, Human
cagcagcagccccaggaagguu

SEQ ID NO: 796859 - RNA, 22 nt, Human
cuuggccugcaggcagcagcgc

SEQ ID NO: 796860 - RNA, 22 nt, Human
agcuucaagguucaaggaugcu

SEQ ID NO: 796861 - RNA, 23 nt, Human
cuugccuggccucucugcccaga

SEQ ID NO: 796862 - RNA, 22 nt, Human
acuggaguguuuggaggaugca

SEQ ID NO: 796863 - RNA, 22 nt, Human
cagaauacccuauagacagaau

SEQ ID NO: 796864 - RNA, 22 nt, Human
uaacacauauuugcaguaagca

SEQ ID NO: 796865 - RNA, 22 nt, Human
uuacuugauguaugaugaguag

SEQ ID NO: 796866 - RNA, 22 nt, Human
gccucugcccuccugggacugc

SEQ ID NO: 796867 - RNA, 22 nt, Human
uauacacauaucuucuaggccu

SEQ ID NO: 796868 - RNA, 22 nt, Human
gaaaucauuagcaaagauaugu

SEQ ID NO: 796869 - RNA, 21 nt, Human
uggcggggacuuguggcugcc

SEQ ID NO: 796870 - RNA, 22 nt, Human
ugagacuugugaguccuucuag

SEQ ID NO: 796871 - RNA, 22 nt, Human
aggcagcagaaaacaaaugguu

SEQ ID NO: 796872 - RNA, 22 nt, Human
aagcccuuggcagaguucccca

SEQ ID NO: 796873 - RNA, 22 nt, Human
cagggccuuguucaggagugaa

SEQ ID NO: 796874 - RNA, 22 nt, Human
gcuggcagagacaagaagacua

SEQ ID NO: 796875 - RNA, 22 nt, Human
aaauuuuagaccaggcaaaacu

SEQ ID NO: 796876 - RNA, 22 nt, Human
cagugcaauauucaaaguggag

SEQ ID NO: 796877 - RNA, 22 nt, Human
uaagaaacauuuuuaugacagu

SEQ ID NO: 796878 - RNA, 22 nt, Human
ugagccaguucuucagauccau

SEQ ID NO: 796879 - RNA, 22 nt, Human
acaguaaaaagccuuagaauuu

SEQ ID NO: 796880 - RNA, 22 nt, Human
agcaggcagcugggggaguuga

SEQ ID NO: 796881 - RNA, 22 nt, Human
ucugccagcuucuggugguugc

SEQ ID NO: 796882 - RNA, 22 nt, Human
gccuccacuuuugcuggcuucu

SEQ ID NO: 796883 - RNA, 22 nt, Human
gccagcagggcccaaaugcugg

SEQ ID NO: 796884 - RNA, 22 nt, Human
cugggagucuggaauuuuggua

SEQ ID NO: 796885 - RNA, 22 nt, Human
acauacaugggauuaaaaaauu

SEQ ID NO: 796886 - RNA, 22 nt, Human
ugagccaggucucacucaccuu

SEQ ID NO: 796887 - RNA, 22 nt, Human
ucuguuuuggucaccuuuauau

SEQ ID NO: 796888 - RNA, 22 nt, Human
cauuaacaaugacugcuugacu

SEQ ID NO: 796889 - RNA, 22 nt, Human
ucccaggccacacuuggggaac

SEQ ID NO: 796890 - RNA, 22 nt, Human
gcuggagggguaauaggauggg

SEQ ID NO: 796891 - RNA, 22 nt, Human
ucaggggacuuaggagagaagu

SEQ ID NO: 796892 - RNA, 22 nt, Human
acagcuguauccccagagcuca

SEQ ID NO: 796893 - RNA, 22 nt, Human
ucaguguccuucguucuuguug

SEQ ID NO: 796894 - RNA, 22 nt, Human
auuguaaauagugccacaauaa

SEQ ID NO: 796895 - RNA, 22 nt, Human
ucagaagcaggagugugcacaa

SEQ ID NO: 796896 - RNA, 22 nt, Human
aggugccagaugcacagcugaa

SEQ ID NO: 796897 - RNA, 22 nt, Human
uuucauugcagagucugugugc

SEQ ID NO: 796898 - RNA, 22 nt, Human
agggugcagucacaggaaaugu

SEQ ID NO: 796899 - RNA, 22 nt, Human
ucccucacugguucugcauccc

SEQ ID NO: 796900 - RNA, 22 nt, Human
uacacauccuucugaacaaccu

SEQ ID NO: 796901 - RNA, 22 nt, Human
cacaggaaaugauucugcagca

SEQ ID NO: 796902 - RNA, 22 nt, Human
uggauucugggagaguucuaua

SEQ ID NO: 796903 - RNA, 21 nt, Human
cugcaaauaccuaguuaucug

SEQ ID NO: 796904 - RNA, 22 nt, Human
gccagguccaggguggagcgcu

SEQ ID NO: 796905 - RNA, 22 nt, Human
cuccaggcuggauccaagucaa

SEQ ID NO: 796906 - RNA, 22 nt, Human
uggcagugaugcggcaggacau

SEQ ID NO: 796907 - RNA, 22 nt, Human
agagcuucacuggagagcacau

SEQ ID NO: 796908 - RNA, 22 nt, Human
ccacaguuucuucaucuauaaa

SEQ ID NO: 796909 - RNA, 22 nt, Human
ugcugccuccaacuccugggcu

SEQ ID NO: 796910 - RNA, 22 nt, Human
ucagaaaagagaaaaucuuaua

SEQ ID NO: 796911 - RNA, 23 nt, Human
uucuuuggaauugggcugcaagg

SEQ ID NO: 796912 - RNA, 22 nt, Human
uugauuuuuccagcuucuagag

SEQ ID NO: 796913 - RNA, 22 nt, Human
guggccaggucagggacuugug

SEQ ID NO: 796914 - RNA, 22 nt, Human
ugugugcauuagcauucuaggg

SEQ ID NO: 796915 - RNA, 22 nt, Human
gcugcagcccggcgcgccugag

SEQ ID NO: 796916 - RNA, 22 nt, Human
acacauuauagagaguauaaua

SEQ ID NO: 796917 - RNA, 22 nt, Human
augaguugaagcuacaagaggc

SEQ ID NO: 796918 - RNA, 22 nt, Human
gcacagccacugagugagaacc

SEQ ID NO: 796919 - RNA, 22 nt, Human
uacagaggcacaugcaauuuuc

SEQ ID NO: 796920 - RNA, 22 nt, Human
guuggggaaggugggagaaugu

SEQ ID NO: 796921 - RNA, 22 nt, Human
cacaguaagguaucccagugaa

SEQ ID NO: 796922 - RNA, 22 nt, Human
caccugggucauugcugguguu

SEQ ID NO: 796923 - RNA, 22 nt, Human
gcccagcacagcuggaagaguc

SEQ ID NO: 796924 - RNA, 22 nt, Human
aauacaagauuuauaguuguuu

SEQ ID NO: 796925 - RNA, 22 nt, Human
gucuguaauuauuaaagaaagg

SEQ ID NO: 796926 - RNA, 22 nt, Human
uaccauuugagagagaacauaa

SEQ ID NO: 796927 - RNA, 22 nt, Human
augugacuagcccuucaugacc

SEQ ID NO: 796928 - RNA, 22 nt, Human
cugccugugccaaugcuccuuu

SEQ ID NO: 796929 - RNA, 22 nt, Human
caacuauagggagagugguuaa

SEQ ID NO: 796930 - RNA, 22 nt, Human
uguuauauaacuuacaaccugu

SEQ ID NO: 796931 - RNA, 22 nt, Human
ucucuuucuauugcaccaugcu

SEQ ID NO: 796932 - RNA, 22 nt, Human
aaaggauucucuugauuucagu

SEQ ID NO: 796933 - RNA, 22 nt, Human
uaugacaagguggaguaugagu

SEQ ID NO: 796934 - RNA, 22 nt, Human
ucacugugcucucuagauaggc

SEQ ID NO: 796935 - RNA, 22 nt, Human
cuggcagguggagguugcagug

SEQ ID NO: 796936 - RNA, 22 nt, Human
auacaugaggaggcuggaaaca

SEQ ID NO: 796937 - RNA, 22 nt, Human
gagcugaggauacaucagugaa

SEQ ID NO: 796938 - RNA, 22 nt, Human
agcuggcuaugcccugugaacc

SEQ ID NO: 796939 - RNA, 22 nt, Human
agccagggggacgcuuucuggc

SEQ ID NO: 796940 - RNA, 22 nt, Human
aaggaaggaauugaucaugcgc

SEQ ID NO: 796941 - RNA, 22 nt, Human
ccagguucaaauagcuguguga

SEQ ID NO: 796942 - RNA, 22 nt, Human
caauuuuauugguccaaauaca

SEQ ID NO: 796943 - RNA, 18 nt, Human
acauacauucugucugca

SEQ ID NO: 796944 - RNA, 22 nt, Human
gcuggcuguugaauaauggcau

SEQ ID NO: 796945 - RNA, 22 nt, Human
uguuuaagcugaugagguaucg

SEQ ID NO: 796946 - RNA, 22 nt, Human
gaggccuggaccagccacagag

SEQ ID NO: 796947 - RNA, 22 nt, Human
agcaccuggucuccuggcgcug

SEQ ID NO: 796948 - RNA, 22 nt, Human
ggagacaguauggcuuguagcu

SEQ ID NO: 796949 - RNA, 22 nt, Human
ucagaaaagguagcugugacaa

SEQ ID NO: 796950 - RNA, 22 nt, Human
gauguucugggguguuuguggc

SEQ ID NO: 796951 - RNA, 22 nt, Human
acagcagggucacauucccucu

SEQ ID NO: 796952 - RNA, 22 nt, Human
agaaaggguucucugaggugcu

SEQ ID NO: 796953 - RNA, 20 nt, Human
uggcuucucuucacuccugu

SEQ ID NO: 796954 - RNA, 22 nt, Human
cuggccagugccugugggcccc

SEQ ID NO: 796955 - RNA, 22 nt, Human
acccccaaacaucaagggcuga

SEQ ID NO: 796956 - RNA, 22 nt, Human
ucccucagauuggcaauuagau

SEQ ID NO: 796957 - RNA, 22 nt, Human
gccaggcuguuuuuauuacugu

SEQ ID NO: 796958 - RNA, 22 nt, Human
uucaguauguuggacguuaugu

SEQ ID NO: 796959 - RNA, 22 nt, Human
ucuuuggcuugucuccucaguu

SEQ ID NO: 796960 - RNA, 22 nt, Human
ucccagccuuucuuuucugcug

SEQ ID NO: 796961 - RNA, 22 nt, Human
ucuggcugggugagagcuucuc

SEQ ID NO: 796962 - RNA, 22 nt, Human
uauguauagagucuuuuaaauu

SEQ ID NO: 796963 - RNA, 22 nt, Human
gcaguaggagggacaacuaccu

SEQ ID NO: 796964 - RNA, 22 nt, Human
aauaaugucugcuauuuuaaaa

SEQ ID NO: 796965 - RNA, 22 nt, Human
ccaaaucaccagcacgaucauu

SEQ ID NO: 796966 - RNA, 22 nt, Human
ucucccuacugacuccaggacc

SEQ ID NO: 796967 - RNA, 22 nt, Human
aacaugcaaagcuaugauguau

SEQ ID NO: 796968 - RNA, 22 nt, Human
uaggacagggacaucuuuuuga

SEQ ID NO: 796969 - RNA, 22 nt, Human
uaucauuuaacagaaucauugc

SEQ ID NO: 796970 - RNA, 17 nt, Human
ugcuccugggacaagga

SEQ ID NO: 796971 - RNA, 23 nt, Human
uauuacaauuggucuuauuaaga

SEQ ID NO: 796972 - RNA, 22 nt, Human
guauuuuauggccuggggccua

SEQ ID NO: 796973 - RNA, 22 nt, Human
cagagaaaaaauccugcucuca

SEQ ID NO: 796974 - RNA, 22 nt, Human
gccuuuuuuguugcucugucac

SEQ ID NO: 796975 - RNA, 19 nt, Human
ggagccagcuguggaaggc

SEQ ID NO: 796976 - RNA, 22 nt, Human
cuccucccugcgauugcucugc

SEQ ID NO: 796977 - RNA, 22 nt, Human
acccaggcuggcagaggcuccu

SEQ ID NO: 796978 - RNA, 22 nt, Human
gagggcagagucuaaugaugca

SEQ ID NO: 796979 - RNA, 19 nt, Human
auagaaaggguuaaagaca

SEQ ID NO: 796980 - RNA, 18 nt, Human
acagaggcagacauguau

SEQ ID NO: 796981 - RNA, 22 nt, Human
ccagcuaguaagcaccugcauc

SEQ ID NO: 796982 - RNA, 22 nt, Human
aggcaggauugcugacaacaau

SEQ ID NO: 796983 - RNA, 22 nt, Human
cagcaggcguugggagaaagac

SEQ ID NO: 796984 - RNA, 22 nt, Human
aaaguaacaauaagguucuauu

SEQ ID NO: 796985 - RNA, 22 nt, Human
gagagaagaaagccaugguccu

SEQ ID NO: 796986 - RNA, 22 nt, Human
aaggaaauacaacauguauuca

SEQ ID NO: 796987 - RNA, 22 nt, Human
aaccccaguaccccaggauaug

SEQ ID NO: 796988 - RNA, 22 nt, Human
ggaggugggagccuccaguggu

SEQ ID NO: 796989 - RNA, 22 nt, Human
cuucagagugcagaagauuggg

SEQ ID NO: 796990 - RNA, 22 nt, Human
aguaccauuauccaguaaagga

SEQ ID NO: 796991 - RNA, 22 nt, Human
uuuccuuugugcaggccuuggg

SEQ ID NO: 796992 - RNA, 22 nt, Human
aggcuggagagugcaguggcgu

SEQ ID NO: 796993 - RNA, 22 nt, Human
ugacaggaggcuugaggccagg

SEQ ID NO: 796994 - RNA, 22 nt, Human
aacuuaggaaaauaaggcauga

SEQ ID NO: 796995 - RNA, 22 nt, Human
cccuggcugcuuguagucuggc

SEQ ID NO: 796996 - RNA, 22 nt, Human
cccuggccagggcacagggagg

SEQ ID NO: 796997 - RNA, 22 nt, Human
ccaggcuguuuucaaacuuggg

SEQ ID NO: 796998 - RNA, 21 nt, Human
accaggcuugugggagggagc

SEQ ID NO: 796999 - RNA, 22 nt, Human
agcaggcacaagaaagggaggu

SEQ ID NO: 797000 - RNA, 22 nt, Human
ggcugccccagugcucauggcu

SEQ ID NO: 797001 - RNA, 21 nt, Human
agacuuugcuugcagagaguc

SEQ ID NO: 797002 - RNA, 22 nt, Human
uuucaugauuaacuuagugaau

SEQ ID NO: 797003 - RNA, 22 nt, Human
uggaauggaaacaaacugagga

SEQ ID NO: 797004 - RNA, 20 nt, Human
uucugcuugcaaauaucaag

SEQ ID NO: 797005 - RNA, 20 nt, Human
ggaaaaaugcaugcucaaga

SEQ ID NO: 797006 - RNA, 22 nt, Human
gcuuggcucuaagacaccuauu

SEQ ID NO: 797007 - RNA, 22 nt, Human
cauggcagggcugugggcaggu

SEQ ID NO: 797008 - RNA, 22 nt, Human
ccucccugucuaccuguugugg

SEQ ID NO: 797009 - RNA, 22 nt, Human
ucacucugacuuggccuccaac

SEQ ID NO: 797010 - RNA, 18 nt, Human
uugauucauauuaaccau

SEQ ID NO: 797011 - RNA, 22 nt, Human
cauuagcauuacuucaaagagu

SEQ ID NO: 797012 - RNA, 22 nt, Human
cauagauucuuauuuccaucuu

SEQ ID NO: 797013 - RNA, 22 nt, Human
uggccucaaucuguccuccagc

SEQ ID NO: 797014 - RNA, 22 nt, Human
ucuucagggucugccccagggg

SEQ ID NO: 797015 - RNA, 22 nt, Human
cccuaggguuuggccagagccc

SEQ ID NO: 797016 - RNA, 22 nt, Human
guacaaauacauucugaaggua

SEQ ID NO: 797017 - RNA, 22 nt, Human
ucaggccacggcucacugagac

SEQ ID NO: 797018 - RNA, 22 nt, Human
cuggcuggcagaugcucuugcu

SEQ ID NO: 797019 - RNA, 22 nt, Human
uccaggauugcaggugcacaac

SEQ ID NO: 797020 - RNA, 22 nt, Human
cagcuucucagaaagcugaggu

SEQ ID NO: 797021 - RNA, 20 nt, Human
aucuccugcuaccacccauu

SEQ ID NO: 797022 - RNA, 22 nt, Human
aaagccuuuucuguuuaacaca

SEQ ID NO: 797023 - RNA, 22 nt, Human
uaggccagaggagcagcuuugg

SEQ ID NO: 797024 - RNA, 22 nt, Human
uucaagaucgaguuuaaaguga

SEQ ID NO: 797025 - RNA, 22 nt, Human
ggcaggaagaggagggugaacu

SEQ ID NO: 797026 - RNA, 22 nt, Human
agcccagcuuccuucugucucu

SEQ ID NO: 797027 - RNA, 22 nt, Human
uguauuuuuaggaaugcgcuau

SEQ ID NO: 797028 - RNA, 22 nt, Human
guccagagggcugcaggaugcu

SEQ ID NO: 797029 - RNA, 22 nt, Human
gagcagggagacaacucuggug

SEQ ID NO: 797030 - RNA, 22 nt, Human
gugcucugccuggggucauggc

SEQ ID NO: 797031 - RNA, 22 nt, Human
gagcugaacaaauugcgagugg

SEQ ID NO: 797032 - RNA, 22 nt, Human
cagggugcgccacucagaugua

SEQ ID NO: 797033 - RNA, 22 nt, Human
aagccaggugugcccaggaucc

SEQ ID NO: 797034 - RNA, 22 nt, Human
ccaggacaagccagagggacag

SEQ ID NO: 797035 - RNA, 22 nt, Human
augucuguggcauuauauguuu

SEQ ID NO: 797036 - RNA, 22 nt, Human
ggcugcagagcuggugcccugg

SEQ ID NO: 797037 - RNA, 22 nt, Human
cugaagcaaaugaaacagcucu

SEQ ID NO: 797038 - RNA, 22 nt, Human
uugucugaauucuucuaggcag

SEQ ID NO: 797039 - RNA, 22 nt, Human
caggcaggugcagauuccucuu

SEQ ID NO: 797040 - RNA, 22 nt, Human
gaggaagcugcguggcauuuca

SEQ ID NO: 797041 - RNA, 22 nt, Human
agucacauggacucaggaugac

SEQ ID NO: 797042 - RNA, 20 nt, Human
uaguauuugcauaaggauag

SEQ ID NO: 797043 - RNA, 22 nt, Human
ucaggcuguggcuucaguucuu

SEQ ID NO: 797044 - RNA, 22 nt, Human
ucaggcaggcucagaggaaaac

SEQ ID NO: 797045 - RNA, 22 nt, Human
ccuuccuggcuguccgccugau

SEQ ID NO: 797046 - RNA, 22 nt, Human
uucagugucaauuuuuaaauau

SEQ ID NO: 797047 - RNA, 22 nt, Human
ucaggacagguucgggugggua

SEQ ID NO: 797048 - RNA, 22 nt, Human
guuuuucuagaaaucuccuccu

SEQ ID NO: 797049 - RNA, 22 nt, Human
gaaggcuucccaccugauauuu

SEQ ID NO: 797050 - RNA, 22 nt, Human
uucacaauaggagcaugcaaau

SEQ ID NO: 797051 - RNA, 22 nt, Human
gugaccaucagagaauaacaaa

SEQ ID NO: 797052 - RNA, 22 nt, Human
ccuccugguccagcaucucuuu

SEQ ID NO: 797053 - RNA, 22 nt, Human
aaguccaugaucaagauguggc

SEQ ID NO: 797054 - RNA, 18 nt, Human
guuuugaauugucuuaca

SEQ ID NO: 797055 - RNA, 22 nt, Human
aggcuuggugccaaggagccug

SEQ ID NO: 797056 - RNA, 21 nt, Human
gcaugaaaacagccugugcuc

SEQ ID NO: 797057 - RNA, 22 nt, Human
uagauaggugauuaggaaaagc

SEQ ID NO: 797058 - RNA, 22 nt, Human
ggugggaggcaggcugcuccca

SEQ ID NO: 797059 - RNA, 22 nt, Human
aaauaaguuaaacuagaaugau

SEQ ID NO: 797060 - RNA, 21 nt, Human
ugggcagauggcaguguggcu

SEQ ID NO: 797061 - RNA, 22 nt, Human
gguggcuggaggagcugaugga

SEQ ID NO: 797062 - RNA, 22 nt, Human
uuucagagucagcuccucucua

SEQ ID NO: 797063 - RNA, 22 nt, Human
ugcuggcuguauaugugagagu

SEQ ID NO: 797064 - RNA, 22 nt, Human
uucauugauuuaacaaacaagu

SEQ ID NO: 797065 - RNA, 22 nt, Human
caaguccaggucaauuuaaagc

SEQ ID NO: 797066 - RNA, 21 nt, Human
ugguggagugugcugagcaug

SEQ ID NO: 797067 - RNA, 22 nt, Human
ucccugugggaugaggacucug

SEQ ID NO: 797068 - RNA, 22 nt, Human
uguuauuuaucugagcauuuau

SEQ ID NO: 797069 - RNA, 22 nt, Human
uccuggagccaaugugcugcug

SEQ ID NO: 797070 - RNA, 22 nt, Human
aaguuuaacuugaauucuuucu

SEQ ID NO: 797071 - RNA, 22 nt, Human
aagccaggaagggagcuguccc

SEQ ID NO: 797072 - RNA, 22 nt, Human
agggccagcugcagaauuagca

SEQ ID NO: 797073 - RNA, 22 nt, Human
cugcaggcauuuauucaugcaa

SEQ ID NO: 797074 - RNA, 22 nt, Human
gaaauucacuguauuucuuggg

SEQ ID NO: 797075 - RNA, 22 nt, Human
gcaggguugguguccucugcgg

SEQ ID NO: 797076 - RNA, 20 nt, Human
uugugguuuagauuaucuga

SEQ ID NO: 797077 - RNA, 22 nt, Human
uucacauuucauaccacagcuu

SEQ ID NO: 797078 - RNA, 22 nt, Human
agguccuguuucuucccugggg

SEQ ID NO: 797079 - RNA, 22 nt, Human
ugcacacacggagauaggcuuu

SEQ ID NO: 797080 - RNA, 22 nt, Human
ccagaaaagcaucugguucuuu

SEQ ID NO: 797081 - RNA, 22 nt, Human
ucuuacaagaaauaagccaaug

SEQ ID NO: 797082 - RNA, 22 nt, Human
cccacccagccuggcugagggg

SEQ ID NO: 797083 - RNA, 22 nt, Human
gugccagccgcaccccaggaga

SEQ ID NO: 797084 - RNA, 22 nt, Human
ccuggggcucugcacagagcag

SEQ ID NO: 797085 - RNA, 22 nt, Human
cugagccagcgggcucacuuuu

SEQ ID NO: 797086 - RNA, 22 nt, Human
uguaagauucuaagaguuaaug

SEQ ID NO: 797087 - RNA, 18 nt, Human
uguagaaaagauaggaau

SEQ ID NO: 797088 - RNA, 22 nt, Human
cacauauaugaaaugaggaauu

SEQ ID NO: 797089 - RNA, 22 nt, Human
ggcgggaggcugaggaguuggu

SEQ ID NO: 797090 - RNA, 18 nt, Human
gucaggcaugaaucuggg

SEQ ID NO: 797091 - RNA, 22 nt, Human
auguuaaaaaccaguacaguug

SEQ ID NO: 797092 - RNA, 22 nt, Human
ggcucaggacacagugguuuag

SEQ ID NO: 797093 - RNA, 19 nt, Human
uaaaaggauguggaaggau

SEQ ID NO: 797094 - RNA, 22 nt, Human
ccugaagaugcuguggccuggu

SEQ ID NO: 797095 - RNA, 22 nt, Human
acaaauuucauaggcaaauuuu

SEQ ID NO: 797096 - RNA, 22 nt, Human
ugugucaaagucaggugucacu

SEQ ID NO: 797097 - RNA, 22 nt, Human
uugcaaaaucauuucucaggau

SEQ ID NO: 797098 - RNA, 22 nt, Human
ccagggcagcagaauuggggca

SEQ ID NO: 797099 - RNA, 22 nt, Human
ucuggcugaaauuagaagguuc

SEQ ID NO: 797100 - RNA, 21 nt, Human
uuggcagucagaaaugugagg

SEQ ID NO: 797101 - RNA, 22 nt, Human
uccagccacucagcagggauug

SEQ ID NO: 797102 - RNA, 22 nt, Human
auuucucaguaggugcacagug

SEQ ID NO: 797103 - RNA, 22 nt, Human
agcuggcacagaccaggagauc

SEQ ID NO: 797104 - RNA, 22 nt, Human
aguuucacuaaggucugugugu

SEQ ID NO: 797105 - RNA, 22 nt, Human
ucucuguaaggaagaauuagau

SEQ ID NO: 797106 - RNA, 22 nt, Human
uucaaaauccgggaggcgcccc

SEQ ID NO: 797107 - RNA, 22 nt, Human
agaaauucuaagcaucaauagc

SEQ ID NO: 797108 - RNA, 18 nt, Human
cuagaugagcuuggcaag

SEQ ID NO: 797109 - RNA, 22 nt, Human
agaaagugaccuugaaaacugg

SEQ ID NO: 797110 - RNA, 22 nt, Human
aaguuuguucauucauucaucc

SEQ ID NO: 797111 - RNA, 22 nt, Human
agccacagcaacaagugcaauu

SEQ ID NO: 797112 - RNA, 22 nt, Human
aggcaggcccugggccaucccg

SEQ ID NO: 797113 - RNA, 22 nt, Human
aggcagggaccaguuguuuucu

SEQ ID NO: 797114 - RNA, 22 nt, Human
agaagcaguuauuuuuugcaca

SEQ ID NO: 797115 - RNA, 22 nt, Human
gggaagagggagcuggaaugau

SEQ ID NO: 797116 - RNA, 22 nt, Human
gcagaggccaggccaccagcaa

SEQ ID NO: 797117 - RNA, 22 nt, Human
agucuuuacauguguuauauau

SEQ ID NO: 797118 - RNA, 22 nt, Human
ggagccagaggcugcugcugug

SEQ ID NO: 797119 - RNA, 19 nt, Human
augcaacaaaaguguaaga

SEQ ID NO: 797120 - RNA, 19 nt, Human
gcuggcagauguggccgug

SEQ ID NO: 797121 - RNA, 22 nt, Human
agacagcagcagaggggcuccc

SEQ ID NO: 797122 - RNA, 22 nt, Human
aggagcugguagucucauuggg

SEQ ID NO: 797123 - RNA, 22 nt, Human
caagcugcuuauucucugcucu

SEQ ID NO: 797124 - RNA, 22 nt, Human
gggagcugaucagguggauuca

SEQ ID NO: 797125 - RNA, 22 nt, Human
ucuggcugucauuggaggcccc

SEQ ID NO: 797126 - RNA, 22 nt, Human
cucuggagaacgcuauggaucu

SEQ ID NO: 797127 - RNA, 22 nt, Human
ucaggagguccgcccgggaggg

SEQ ID NO: 797128 - RNA, 22 nt, Human
caugaaauaugcuaccugucuu

SEQ ID NO: 797129 - RNA, 22 nt, Human
acuuccuugucaggugcaucau

SEQ ID NO: 797130 - RNA, 22 nt, Human
uauuaaauuauggauuuaggag

SEQ ID NO: 797131 - RNA, 22 nt, Human
cugggaguacugggggauguca

SEQ ID NO: 797132 - RNA, 20 nt, Human
ucagugauuuugaagaggaa

SEQ ID NO: 797133 - RNA, 22 nt, Human
uuaaaauuuccccaccauguau

SEQ ID NO: 797134 - RNA, 23 nt, Human
agcagcccugggaccuggccugc

SEQ ID NO: 797135 - RNA, 23 nt, Human
ggggacaguucccacuggggucu

SEQ ID NO: 797136 - RNA, 22 nt, Human
gucauuauucugggauucuaua

SEQ ID NO: 797137 - RNA, 17 nt, Human
cccuggcucuaggugga

SEQ ID NO: 797138 - RNA, 22 nt, Human
caaugcuucugagggaauuaca

SEQ ID NO: 797139 - RNA, 22 nt, Human
ugggagucaucguguuuggauc

SEQ ID NO: 797140 - RNA, 22 nt, Human
cucacuggcaagacuacaggug

SEQ ID NO: 797141 - RNA, 22 nt, Human
gagagcuguccggcugagcagc

SEQ ID NO: 797142 - RNA, 22 nt, Human
uugcuaaugcccuagaaguauu

SEQ ID NO: 797143 - RNA, 22 nt, Human
gggggugaggacaggagcacug

SEQ ID NO: 797144 - RNA, 18 nt, Human
aggcaggauccuggccuc

SEQ ID NO: 797145 - RNA, 22 nt, Human
acugcagagguggggugcagag

SEQ ID NO: 797146 - RNA, 22 nt, Human
uaacugucacuucugcacaucu

SEQ ID NO: 797147 - RNA, 19 nt, Human
uccucaggggcucacagac

SEQ ID NO: 797148 - RNA, 22 nt, Human
aaacugcaggucaugacccauu

SEQ ID NO: 797149 - RNA, 22 nt, Human
uugcagcuucuugcaucagaaa

SEQ ID NO: 797150 - RNA, 23 nt, Human
uggcucagcuaguuuuccauuuc

SEQ ID NO: 797151 - RNA, 22 nt, Human
ccuggccaguuuccaggcccug

SEQ ID NO: 797152 - RNA, 22 nt, Human
aaggcacagccacuugaucauc

SEQ ID NO: 797153 - RNA, 22 nt, Human
aaucaagagcugacuauauuuu

SEQ ID NO: 797154 - RNA, 22 nt, Human
gccugugacccagggcccagga

SEQ ID NO: 797155 - RNA, 22 nt, Human
uucauguccagaggaaguugag

SEQ ID NO: 797156 - RNA, 22 nt, Human
uaucuauaaguacuaacauggu

SEQ ID NO: 797157 - RNA, 22 nt, Human
cuucuuuacuuucuagaaauaa

SEQ ID NO: 797158 - RNA, 22 nt, Human
augggagaaacaucaugaggca

SEQ ID NO: 797159 - RNA, 22 nt, Human
ggcaggcaaugaggaugggaag

SEQ ID NO: 797160 - RNA, 22 nt, Human
aauucacaggaucacaggagag

SEQ ID NO: 797161 - RNA, 22 nt, Human
agaggcaguauacaauccgagc

SEQ ID NO: 797162 - RNA, 19 nt, Human
ucuuuucacgcauuuugaa

SEQ ID NO: 797163 - RNA, 22 nt, Human
uagcagaggaaaagagaacauu

SEQ ID NO: 797164 - RNA, 22 nt, Human
augaauugaggaaaacagucgu

SEQ ID NO: 797165 - RNA, 22 nt, Human
accacccccuuggguguggaag

SEQ ID NO: 797166 - RNA, 22 nt, Human
agcacagauucugaagaguccu

SEQ ID NO: 797167 - RNA, 22 nt, Human
caguccugaggaagagcugcug

SEQ ID NO: 797168 - RNA, 22 nt, Human
ccaggaaggcaggccuccccgc

SEQ ID NO: 797169 - RNA, 22 nt, Human
caugacaucugcuuaguaugaa

SEQ ID NO: 797170 - RNA, 22 nt, Human
ccagaaaacucuacaugcuugu

SEQ ID NO: 797171 - RNA, 22 nt, Human
uaagauuuuuaaaauguccuca

SEQ ID NO: 797172 - RNA, 22 nt, Human
agcugucuuucugccuccugau

SEQ ID NO: 797173 - RNA, 22 nt, Human
aaauuagaaauacuuucaaagc

SEQ ID NO: 797174 - RNA, 22 nt, Human
ggaggcucuugagaggggagua

SEQ ID NO: 797175 - RNA, 22 nt, Human
uccuggcccggccgggccugcu

SEQ ID NO: 797176 - RNA, 22 nt, Human
cucccugugucuucacuuggcc

SEQ ID NO: 797177 - RNA, 22 nt, Human
gcccagggcgauggucggggcc

SEQ ID NO: 797178 - RNA, 22 nt, Human
caaaguauauuggauugaaugg

SEQ ID NO: 797179 - RNA, 22 nt, Human
gaugaaaugugaaaguucuggg

SEQ ID NO: 797180 - RNA, 22 nt, Human
aauaacuuaagaaauuucccca

SEQ ID NO: 797181 - RNA, 22 nt, Human
augacaguacuggugacaauac

SEQ ID NO: 797182 - RNA, 22 nt, Human
gcgggccaccuuggagagcgcu

SEQ ID NO: 797183 - RNA, 18 nt, Human
caguuacaccuucauuca

SEQ ID NO: 797184 - RNA, 22 nt, Human
guggucaggggcugaggugccc

SEQ ID NO: 797185 - RNA, 22 nt, Human
uuaguuuucucaucuaucucac

SEQ ID NO: 797186 - RNA, 18 nt, Human
caguccuguuucuacagg

SEQ ID NO: 797187 - RNA, 22 nt, Human
ggaacauacuguguagacuuug

SEQ ID NO: 797188 - RNA, 22 nt, Human
uagggagaugcaagggacggag

SEQ ID NO: 797189 - RNA, 23 nt, Human
aguguucagcauguaguaaauac

SEQ ID NO: 797190 - RNA, 22 nt, Human
aaguaaaagcuuuaccaugcgc

SEQ ID NO: 797191 - RNA, 22 nt, Human
cccugcagccuugcaugccuuc

SEQ ID NO: 797192 - RNA, 22 nt, Human
uucucauucugacucaguguag

SEQ ID NO: 797193 - RNA, 22 nt, Human
acauacuuuuuaaaagauugcu

SEQ ID NO: 797194 - RNA, 22 nt, Human
ugagaaagugggugccuagcaa

SEQ ID NO: 797195 - RNA, 18 nt, Human
uaaaauucaaggcagggu

SEQ ID NO: 797196 - RNA, 22 nt, Human
ggagcugcacgcucugaagccu

SEQ ID NO: 797197 - RNA, 22 nt, Human
acagggagaugggugaaagcgg

SEQ ID NO: 797198 - RNA, 22 nt, Human
cugacagcaaaggccaguggcu

SEQ ID NO: 797199 - RNA, 20 nt, Human
cuucaaguuaugguuggcaa

SEQ ID NO: 797200 - RNA, 22 nt, Human
caccagggacaaugcuaggggu

SEQ ID NO: 797201 - RNA, 22 nt, Human
ggccuuggugccauggccaguu

SEQ ID NO: 797202 - RNA, 22 nt, Human
gggcagccugcuuucugaucca

SEQ ID NO: 797203 - RNA, 20 nt, Human
aggccaggaaauguaguucu

SEQ ID NO: 797204 - RNA, 22 nt, Human
aauagcacuuccugaacacauu

SEQ ID NO: 797205 - RNA, 22 nt, Human
cagggccuccccggcagucuuu

SEQ ID NO: 797206 - RNA, 22 nt, Human
auuuugaaaccaaguuauuucc

SEQ ID NO: 797207 - RNA, 22 nt, Human
ugcugggugguugcuccucccg

SEQ ID NO: 797208 - RNA, 22 nt, Human
cacaauuauagaagaaagcaua

SEQ ID NO: 797209 - RNA, 22 nt, Human
auccucaguguuucugacaucu

SEQ ID NO: 797210 - RNA, 22 nt, Human
uucagcauugguaugaaaaccc

SEQ ID NO: 797211 - RNA, 22 nt, Human
cugccaggcugucccagguccg

SEQ ID NO: 797212 - RNA, 22 nt, Human
gugugcagaacagggagugggu

SEQ ID NO: 797213 - RNA, 22 nt, Human
uccgccaggacugagggcccau

SEQ ID NO: 797214 - RNA, 19 nt, Human
uucugggcagcacaugaau

SEQ ID NO: 797215 - RNA, 22 nt, Human
gauaaacuggaaccauugccuc

SEQ ID NO: 797216 - RNA, 22 nt, Human
gcggggggaggaacaucuugca

SEQ ID NO: 797217 - RNA, 22 nt, Human
gaccuuccaugccuucuuccaa

SEQ ID NO: 797218 - RNA, 22 nt, Human
gaccuccagcggcccugcagag

SEQ ID NO: 797219 - RNA, 22 nt, Human
gagaaaaucuugggucaagaau

SEQ ID NO: 797220 - RNA, 22 nt, Human
ugugagugacaguucccuuggu

SEQ ID NO: 797221 - RNA, 22 nt, Human
gcagggcugcagagggcacugu

SEQ ID NO: 797222 - RNA, 22 nt, Human
ugauucaagauugguuagcugu

SEQ ID NO: 797223 - RNA, 22 nt, Human
ggccagaggaccucucauagcc

SEQ ID NO: 797224 - RNA, 22 nt, Human
cagucccaggguugguucagcu

SEQ ID NO: 797225 - RNA, 22 nt, Human
uaggaaauuagaacuuggaaac

SEQ ID NO: 797226 - RNA, 22 nt, Human
aggcugugcauuuuggagggcc

SEQ ID NO: 797227 - RNA, 22 nt, Human
aaauccaucaaaucuucuagaa

SEQ ID NO: 797228 - RNA, 22 nt, Human
caaaaugcaucugagaccaggc

SEQ ID NO: 797229 - RNA, 22 nt, Human
acagugaugagccggcugaggc

SEQ ID NO: 797230 - RNA, 22 nt, Human
acauucauggguuuuacauuau

SEQ ID NO: 797231 - RNA, 22 nt, Human
aaguuugugagguuaaucccuu

SEQ ID NO: 797232 - RNA, 22 nt, Human
aaagaaauagauggcauuuaaa

SEQ ID NO: 797233 - RNA, 22 nt, Human
ccucucagcgauuccucuugga

SEQ ID NO: 797234 - RNA, 22 nt, Human
uuuauucaucaucuguucauau

SEQ ID NO: 797235 - RNA, 22 nt, Human
ucuggagucuaaagaaccaaaa

SEQ ID NO: 797236 - RNA, 22 nt, Human
uaccaaauguaaucauucuaau

SEQ ID NO: 797237 - RNA, 22 nt, Human
aguggugucgugggaguggaag

SEQ ID NO: 797238 - RNA, 20 nt, Human
aggcucugcauuucugagug

SEQ ID NO: 797239 - RNA, 22 nt, Human
cuggcagguccagcuggacuca

SEQ ID NO: 797240 - RNA, 20 nt, Human
ucuuacaaucguuacaucca

SEQ ID NO: 797241 - RNA, 22 nt, Human
cagaggaagcagacacaucuug

SEQ ID NO: 797242 - RNA, 22 nt, Human
uacaauagggcuuuuguuuaug

SEQ ID NO: 797243 - RNA, 22 nt, Human
ccugguccccaucggcccagcg

SEQ ID NO: 797244 - RNA, 19 nt, Human
aggcuugguugcagcaagc

SEQ ID NO: 797245 - RNA, 22 nt, Human
ucuggagaaucugucagugugg

SEQ ID NO: 797246 - RNA, 22 nt, Human
ccuccccacgggcagccggcgc

SEQ ID NO: 797247 - RNA, 22 nt, Human
ccauuguaaauucuguggaagu

SEQ ID NO: 797248 - RNA, 22 nt, Human
gccagucugauaggggagaagu

SEQ ID NO: 797249 - RNA, 21 nt, Human
uugcaaugggcauuuuggagg

SEQ ID NO: 797250 - RNA, 22 nt, Human
aaauuccaccagaaucaguaau

SEQ ID NO: 797251 - RNA, 22 nt, Human
acagggugacuuugugacagau

SEQ ID NO: 797252 - RNA, 22 nt, Human
ugugauuauuugauuaacaugu

SEQ ID NO: 797253 - RNA, 22 nt, Human
ccuggcacauagcaaccccucc

SEQ ID NO: 797254 - RNA, 22 nt, Human
uguuucuugggugcucacauca

SEQ ID NO: 797255 - RNA, 19 nt, Human
uuucucucccucaucccga

SEQ ID NO: 797256 - RNA, 22 nt, Human
gggcagugucggggcccaggga

SEQ ID NO: 797257 - RNA, 22 nt, Human
uaaauacagucauuugagccau

SEQ ID NO: 797258 - RNA, 22 nt, Human
caaagauuuuagaauuugcaau

SEQ ID NO: 797259 - RNA, 22 nt, Human
ucuccuggcucuaaaaggcugu

SEQ ID NO: 797260 - RNA, 22 nt, Human
aauucauagcaacaaagaccca

SEQ ID NO: 797261 - RNA, 22 nt, Human
caugaggucagggggagccggu

SEQ ID NO: 797262 - RNA, 22 nt, Human
gcuggcuuugucaagggcagca

SEQ ID NO: 797263 - RNA, 22 nt, Human
uuuucaucucugcuuuguaccu

SEQ ID NO: 797264 - RNA, 22 nt, Human
uucauguguauggaacauuuuu

SEQ ID NO: 797265 - RNA, 22 nt, Human
cuacagaagaaacuaucacuau

SEQ ID NO: 797266 - RNA, 22 nt, Human
cucuguggcuugccuuucuguc

SEQ ID NO: 797267 - RNA, 22 nt, Human
cugaaaugguugccuggagaau

SEQ ID NO: 797268 - RNA, 22 nt, Human
acacauuucucuuuuuguaagu

SEQ ID NO: 797269 - RNA, 22 nt, Human
gugggcagacaugauagaagga

SEQ ID NO: 797270 - RNA, 22 nt, Human
aaacugcaauuacuuuugcagc

SEQ ID NO: 797271 - RNA, 22 nt, Human
uuuggucaaauauuauccugag

SEQ ID NO: 797272 - RNA, 22 nt, Human
ugucaacauuggcugacaguug

SEQ ID NO: 797273 - RNA, 22 nt, Human
agucugcuuccuggagaacuca

SEQ ID NO: 797274 - RNA, 22 nt, Human
aggggauggagcuggaaggcag

SEQ ID NO: 797275 - RNA, 17 nt, Human
cugucugcgcaugaggu

SEQ ID NO: 797276 - RNA, 22 nt, Human
aagggcaggaaaagauggaugu

SEQ ID NO: 797277 - RNA, 18 nt, Human
uggccccuuaucaguccu

SEQ ID NO: 797278 - RNA, 22 nt, Human
ucagggcaagucucagaagguu

SEQ ID NO: 797279 - RNA, 22 nt, Human
uacaggcauguagcauggugau

SEQ ID NO: 797280 - RNA, 22 nt, Human
cauuauauuacagcacuguuaa

SEQ ID NO: 797281 - RNA, 22 nt, Human
agagcugggugaagugccauca

SEQ ID NO: 797282 - RNA, 22 nt, Human
caguuuaagacaagggggugua

SEQ ID NO: 797283 - RNA, 22 nt, Human
gagcagcuguccccaaagcuuc

SEQ ID NO: 797284 - RNA, 22 nt, Human
ucuggcucccuggagcuccaca

SEQ ID NO: 797285 - RNA, 22 nt, Human
cacagaggcaugacccugcccu

SEQ ID NO: 797286 - RNA, 22 nt, Human
aaacacaauguuucuuuguucu

SEQ ID NO: 797287 - RNA, 22 nt, Human
ugaaccaggcacauuuccuaca

SEQ ID NO: 797288 - RNA, 22 nt, Human
gccagcucagaugcaggaagga

SEQ ID NO: 797289 - RNA, 22 nt, Human
ugcauuaaauauaaucuguuga

SEQ ID NO: 797290 - RNA, 20 nt, Human
uugaaauuggaugguagcua

SEQ ID NO: 797291 - RNA, 22 nt, Human
ucuugggaaauguuugcgagcu

SEQ ID NO: 797292 - RNA, 22 nt, Human
uagcaggcaucucagagauaau

SEQ ID NO: 797293 - RNA, 22 nt, Human
caugauuuacuaaaauuuguuu

SEQ ID NO: 797294 - RNA, 22 nt, Human
ucacacuuaucccacucaguca

SEQ ID NO: 797295 - RNA, 18 nt, Human
gaugggagcaagagaaga

SEQ ID NO: 797296 - RNA, 22 nt, Human
agugcuggaaagggacggagga

SEQ ID NO: 797297 - RNA, 21 nt, Human
gcaagccaccacugcugccac

SEQ ID NO: 797298 - RNA, 22 nt, Human
cugggagacaagagagggcuga

SEQ ID NO: 797299 - RNA, 22 nt, Human
uuuauucacucauucagccagu

SEQ ID NO: 797300 - RNA, 22 nt, Human
guccugggagaugggacccuga

SEQ ID NO: 797301 - RNA, 18 nt, Human
agaauuaccaaagugcuu

SEQ ID NO: 797302 - RNA, 22 nt, Human
ugacuuuggacuagugauuuaa

SEQ ID NO: 797303 - RNA, 22 nt, Human
augccucugcucuugguccuca

SEQ ID NO: 797304 - RNA, 22 nt, Human
aaaacuuucagggauacagaaa

SEQ ID NO: 797305 - RNA, 22 nt, Human
ugggccacucuucccugggucu

SEQ ID NO: 797306 - RNA, 17 nt, Human
aggaggaucagagagua

SEQ ID NO: 797307 - RNA, 22 nt, Human
uuauacauguguuuugagauga

SEQ ID NO: 797308 - RNA, 22 nt, Human
aggaggccuguguuugucugua

SEQ ID NO: 797309 - RNA, 22 nt, Human
cuggugccauucuguggccuag

SEQ ID NO: 797310 - RNA, 22 nt, Human
gugggagcccucagggaggugc

SEQ ID NO: 797311 - RNA, 22 nt, Human
aagaagcacuuuccuacauguu

SEQ ID NO: 797312 - RNA, 22 nt, Human
uguggcaggaagagcuucugag

SEQ ID NO: 797313 - RNA, 22 nt, Human
gcaguguuaggaauaaaaauga

SEQ ID NO: 797314 - RNA, 22 nt, Human
uuucauugagacuauagacauc

SEQ ID NO: 797315 - RNA, 22 nt, Human
uuacaagauaacggagaaagca

SEQ ID NO: 797316 - RNA, 22 nt, Human
aacaaauuaguugcaagacugg

SEQ ID NO: 797317 - RNA, 22 nt, Human
agcacagauuugucaacauaga

SEQ ID NO: 797318 - RNA, 22 nt, Human
cagaagaaaucauuaucuggac

SEQ ID NO: 797319 - RNA, 22 nt, Human
uauauuguagcugaugacaaau

SEQ ID NO: 797320 - RNA, 22 nt, Human
aagauucacagagugaaugaaa

SEQ ID NO: 797321 - RNA, 22 nt, Human
cccauggguuuuccucccugcc

SEQ ID NO: 797322 - RNA, 21 nt, Human
agagcugggacuugccugaga

SEQ ID NO: 797323 - RNA, 22 nt, Human
uaaacuacugggcaaggacagg

SEQ ID NO: 797324 - RNA, 21 nt, Human
uaaagaagaugaaugugauca

SEQ ID NO: 797325 - RNA, 22 nt, Human
gucaguguagguucaucagugg

SEQ ID NO: 797326 - RNA, 22 nt, Human
gaucuugagcaaguuguguaac

SEQ ID NO: 797327 - RNA, 22 nt, Human
ggaggcaaagcacuuugcuugg

SEQ ID NO: 797328 - RNA, 22 nt, Human
ucucaaauucccuuuuccuccu

SEQ ID NO: 797329 - RNA, 23 nt, Human
ucacauuuaaccccucagaccuc

SEQ ID NO: 797330 - RNA, 18 nt, Human
auaaagugcuaauaaugg

SEQ ID NO: 797331 - RNA, 22 nt, Human
uguguuucugagaaucccaccu

SEQ ID NO: 797332 - RNA, 22 nt, Human
ugagcagaggagugacguaggu

SEQ ID NO: 797333 - RNA, 22 nt, Human
agaacauggauugucaaaggua

SEQ ID NO: 797334 - RNA, 22 nt, Human
uggaaacacccacgcaugcaua

SEQ ID NO: 797335 - RNA, 22 nt, Human
cagcccugccauggagccuccu

SEQ ID NO: 797336 - RNA, 22 nt, Human
caaggcccugcaaccugacuug

SEQ ID NO: 797337 - RNA, 22 nt, Human
agaaagugccucccuugggagc

SEQ ID NO: 797338 - RNA, 22 nt, Human
ugaaugauaugugaaaaggaac

SEQ ID NO: 797339 - RNA, 22 nt, Human
agaaauacuaggaauauucaua

SEQ ID NO: 797340 - RNA, 22 nt, Human
caagaugaaacuacagggagga

SEQ ID NO: 797341 - RNA, 22 nt, Human
uccugguggauagaagccaagg

SEQ ID NO: 797342 - RNA, 22 nt, Human
acauagcauaaagaaugacucu

SEQ ID NO: 797343 - RNA, 20 nt, Human
uucuuaaagaccucacuuug

SEQ ID NO: 797344 - RNA, 22 nt, Human
uaaaaaguugaaaggacuuauc

SEQ ID NO: 797345 - RNA, 22 nt, Human
auacaaucaucauuauauuccc

SEQ ID NO: 797346 - RNA, 22 nt, Human
aagcacagagagguaaaguaac

SEQ ID NO: 797347 - RNA, 22 nt, Human
acagguguggggcugugguacu

SEQ ID NO: 797348 - RNA, 22 nt, Human
agccccagccccucucucacaa

SEQ ID NO: 797349 - RNA, 22 nt, Human
accugccucagugcagcuggau

SEQ ID NO: 797350 - RNA, 22 nt, Human
gaaggcuugcaagugguucaua

SEQ ID NO: 797351 - RNA, 22 nt, Human
cuucaaaugugauuuuaauaac

SEQ ID NO: 797352 - RNA, 22 nt, Human
uagggcugaggcaacaagggag

SEQ ID NO: 797353 - RNA, 22 nt, Human
auuuaccagcugugcacugaua

SEQ ID NO: 797354 - RNA, 22 nt, Human
ccagccaugggccaccuagcug

SEQ ID NO: 797355 - RNA, 22 nt, Human
uugcuuuuaaucuuuguacauc

SEQ ID NO: 797356 - RNA, 22 nt, Human
guauacagauacuuagacgugc

SEQ ID NO: 797357 - RNA, 22 nt, Human
uuuuccaaaguaccaugucccu

SEQ ID NO: 797358 - RNA, 22 nt, Human
caaacuauuguucacaagacaa

SEQ ID NO: 797359 - RNA, 22 nt, Human
aaagugaugaacucugugaccu

SEQ ID NO: 797360 - RNA, 22 nt, Human
ccagaggaaaaauaucucccua

SEQ ID NO: 797361 - RNA, 22 nt, Human
augaaugagaaagcugaaaucu

SEQ ID NO: 797362 - RNA, 22 nt, Human
cagggggcucaaaggagagugc

SEQ ID NO: 797363 - RNA, 22 nt, Human
ucagccuggugauuccucuguc

SEQ ID NO: 797364 - RNA, 22 nt, Human
aaaacacaagaagcaggguaca

SEQ ID NO: 797365 - RNA, 22 nt, Human
aaacaaccuaaaguuacugauc

SEQ ID NO: 797366 - RNA, 22 nt, Human
ccugaggcccuggcugugcuga

SEQ ID NO: 797367 - RNA, 22 nt, Human
ccaccccugggugcagggagcg

SEQ ID NO: 797368 - RNA, 22 nt, Human
gggcacaggaauuugggaugug

SEQ ID NO: 797369 - RNA, 22 nt, Human
augacuuuccuggcaaaaguug

SEQ ID NO: 797370 - RNA, 22 nt, Human
ugacaaauucauauuucagagg

SEQ ID NO: 797371 - RNA, 22 nt, Human
ucacauacugaaaguccaguga

SEQ ID NO: 797372 - RNA, 22 nt, Human
gcagcuuggauuucuguaguuu

SEQ ID NO: 797373 - RNA, 22 nt, Human
ucaccccuacauuucccuugcu

SEQ ID NO: 797374 - RNA, 21 nt, Human
ucuuuccaauauucaugucuc

SEQ ID NO: 797375 - RNA, 22 nt, Human
augcagcuauuugagcauguca

SEQ ID NO: 797376 - RNA, 22 nt, Human
cagaagaauggugucugagcuc

SEQ ID NO: 797377 - RNA, 22 nt, Human
gggucuggcaugcugagaugga

SEQ ID NO: 797378 - RNA, 22 nt, Human
aggcaggccuacacaaugggag

SEQ ID NO: 797379 - RNA, 22 nt, Human
uugucugaaucuggagcucucu

SEQ ID NO: 797380 - RNA, 22 nt, Human
agcagggcaugaauaaggguuu

SEQ ID NO: 797381 - RNA, 22 nt, Human
aaggucugaguuuugccaggcc

SEQ ID NO: 797382 - RNA, 22 nt, Human
guaaucucagcuacuugggagg

SEQ ID NO: 797383 - RNA, 22 nt, Human
gccagcugguaggcaccuagcc

SEQ ID NO: 797384 - RNA, 22 nt, Human
ucuuuguacuuucuggcugucc

SEQ ID NO: 797385 - RNA, 22 nt, Human
cugggggugagcagcagcgacg

SEQ ID NO: 797386 - RNA, 22 nt, Human
ggcccugagcugaaguacugug

SEQ ID NO: 797387 - RNA, 21 nt, Human
agcagcagaucuggugagggc

SEQ ID NO: 797388 - RNA, 22 nt, Human
aagcacauuuggaaaacaugga

SEQ ID NO: 797389 - RNA, 22 nt, Human
cugcuggaaguuugcuguggau

SEQ ID NO: 797390 - RNA, 22 nt, Human
gaggagcugggucagggagaca

SEQ ID NO: 797391 - RNA, 22 nt, Human
agaaaacauuacauaggugugu

SEQ ID NO: 797392 - RNA, 21 nt, Human
ucauguaaugcaugaaguaaa

SEQ ID NO: 797393 - RNA, 22 nt, Human
agggcagagagaugaaugggau

SEQ ID NO: 797394 - RNA, 22 nt, Human
uugcagcugcuguuccucaugg

SEQ ID NO: 797395 - RNA, 21 nt, Human
cagggcuagagagaaugacaa

SEQ ID NO: 797396 - RNA, 22 nt, Human
acugcucucugcaaguagaugg

SEQ ID NO: 797397 - RNA, 22 nt, Human
uccaggcccgagaugggcugga

SEQ ID NO: 797398 - RNA, 22 nt, Human
aguggcugcuggaguggagaug

SEQ ID NO: 797399 - RNA, 22 nt, Human
uucauugaaauguuucuagcug

SEQ ID NO: 797400 - RNA, 22 nt, Human
uugccagggucaggaugagauc

SEQ ID NO: 797401 - RNA, 22 nt, Human
cagcaagauuuuuaaagcaagg

SEQ ID NO: 797402 - RNA, 22 nt, Human
uugacuuuucuuggucacauga

SEQ ID NO: 797403 - RNA, 22 nt, Human
cuuucucuguguuucacaugcu

SEQ ID NO: 797404 - RNA, 23 nt, Human
agaucacaugcugauggaaaaug

SEQ ID NO: 797405 - RNA, 20 nt, Human
ggaccagcugucugaggggc

SEQ ID NO: 797406 - RNA, 22 nt, Human
acuccuggguuccggagauucu

SEQ ID NO: 797407 - RNA, 22 nt, Human
aauaucuucuaaggauagaacu

SEQ ID NO: 797408 - RNA, 22 nt, Human
uacacauaggaggguaauaaaa

SEQ ID NO: 797409 - RNA, 22 nt, Human
gcaggagcucguuuccaggcug

SEQ ID NO: 797410 - RNA, 20 nt, Human
ccugggguacacuggcaugu

SEQ ID NO: 797411 - RNA, 19 nt, Human
accuuacagaaacaggcau

SEQ ID NO: 797412 - RNA, 22 nt, Human
ccaugcaaagaaugugggcaua

SEQ ID NO: 797413 - RNA, 22 nt, Human
agugucaaaugugugccaagcu

SEQ ID NO: 797414 - RNA, 18 nt, Human
cuccuggcugauggugag

SEQ ID NO: 797415 - RNA, 22 nt, Human
gacuucauaauauugagcaugu

SEQ ID NO: 797416 - RNA, 22 nt, Human
acuggcuugugagacaaugccu

SEQ ID NO: 797417 - RNA, 22 nt, Human
agaggccuaaccaagauguccu

SEQ ID NO: 797418 - RNA, 22 nt, Human
ggagaggcuuggcccagccugg

SEQ ID NO: 797419 - RNA, 21 nt, Human
agcagaggcugccuggugacu

SEQ ID NO: 797420 - RNA, 22 nt, Human
agcuggagcuucaagcagguaa

SEQ ID NO: 797421 - RNA, 22 nt, Human
ccagggagcccacaggacaaug

SEQ ID NO: 797422 - RNA, 22 nt, Human
ugcaaauagccuauauuuauag

SEQ ID NO: 797423 - RNA, 22 nt, Human
agggccaguucagaggacaugg

SEQ ID NO: 797424 - RNA, 22 nt, Human
agucccagagaggucggggcca

SEQ ID NO: 797425 - RNA, 22 nt, Human
acagaaagaugauuugaaaugg

SEQ ID NO: 797426 - RNA, 19 nt, Human
uccuuugaauaucaguuga

SEQ ID NO: 797427 - RNA, 22 nt, Human
uuguuacagaucacauuucugc

SEQ ID NO: 797428 - RNA, 22 nt, Human
ugucuguuauugguguauaaga

SEQ ID NO: 797429 - RNA, 22 nt, Human
gcaaaugcuaaaguguagagac

SEQ ID NO: 797430 - RNA, 22 nt, Human
ugccagccagguucugaggcua

SEQ ID NO: 797431 - RNA, 22 nt, Human
ggcugggucccagcugggagga

SEQ ID NO: 797432 - RNA, 22 nt, Human
agaacauaauuaucauaaacug

SEQ ID NO: 797433 - RNA, 23 nt, Human
acagggcauugcuggccucgagg

SEQ ID NO: 797434 - RNA, 22 nt, Human
ggggggugacaaguagagguug

SEQ ID NO: 797435 - RNA, 22 nt, Human
ggcaggcaaggcagccugguga

SEQ ID NO: 797436 - RNA, 22 nt, Human
uggucuggggaccgaggguuac

SEQ ID NO: 797437 - RNA, 22 nt, Human
auuuacagaaacuuaaucauag

SEQ ID NO: 797438 - RNA, 22 nt, Human
cuggucaggaagguggggacag

SEQ ID NO: 797439 - RNA, 22 nt, Human
ugguggcuaccagguccugggg

SEQ ID NO: 797440 - RNA, 22 nt, Human
gcccagagugaguccugggccc

SEQ ID NO: 797441 - RNA, 22 nt, Human
gccaggcugaggcucuggaaga

SEQ ID NO: 797442 - RNA, 22 nt, Human
ugacaucuaguagguagagacc

SEQ ID NO: 797443 - RNA, 19 nt, Human
augcagcuccugccuccuu

SEQ ID NO: 797444 - RNA, 22 nt, Human
acagggagugcaauucauauug

SEQ ID NO: 797445 - RNA, 22 nt, Human
agcuguggcaaccuugucagac

SEQ ID NO: 797446 - RNA, 22 nt, Human
ucaacaaauacuuaaagcagag

SEQ ID NO: 797447 - RNA, 22 nt, Human
agcaccugcuuaaugugcagug

SEQ ID NO: 797448 - RNA, 22 nt, Human
ugaggucugcagggcugugcau

SEQ ID NO: 797449 - RNA, 22 nt, Human
uuuauuauucuguucucucuac

SEQ ID NO: 797450 - RNA, 22 nt, Human
uggccugccccgagauccuggc

SEQ ID NO: 797451 - RNA, 23 nt, Human
cacaccaggagccgucugggcca

SEQ ID NO: 797452 - RNA, 22 nt, Human
cagcaguggaacuacccaggga

SEQ ID NO: 797453 - RNA, 22 nt, Human
gcuucuauuacuacuuugagau

SEQ ID NO: 797454 - RNA, 22 nt, Human
gccugagggcuccuagcaggcu

SEQ ID NO: 797455 - RNA, 22 nt, Human
gcccugggcucccugcuccaca

SEQ ID NO: 797456 - RNA, 22 nt, Human
ucuggagaaggaagagucuuug

SEQ ID NO: 797457 - RNA, 22 nt, Human
cuucaaagggucacuauuuauc

SEQ ID NO: 797458 - RNA, 19 nt, Human
ccugggccuccaucacccc

SEQ ID NO: 797459 - RNA, 22 nt, Human
uggacaggugagugacucaggg

SEQ ID NO: 797460 - RNA, 22 nt, Human
gaggaaggauuuaguuugaggg

SEQ ID NO: 797461 - RNA, 22 nt, Human
ugagagagccugaaucucuuac

SEQ ID NO: 797462 - RNA, 22 nt, Human
aaagccaguucuuuuauauugg

SEQ ID NO: 797463 - RNA, 22 nt, Human
uccaucaccacagaggacagag

SEQ ID NO: 797464 - RNA, 22 nt, Human
aggcauggcuuuaggcaggcgu

SEQ ID NO: 797465 - RNA, 22 nt, Human
cacagcuucugagugaggauuu

SEQ ID NO: 797466 - RNA, 22 nt, Human
acccaggcuggagugcaguagc

SEQ ID NO: 797467 - RNA, 22 nt, Human
gaugcgggcccgcuccacugcc

SEQ ID NO: 797468 - RNA, 22 nt, Human
ccaaggcaaugugcagcuggug

SEQ ID NO: 797469 - RNA, 22 nt, Human
gagcaaagcuuuuagggccuuu

SEQ ID NO: 797470 - RNA, 22 nt, Human
gcacccucugagcuccgcuccg

SEQ ID NO: 797471 - RNA, 22 nt, Human
gcagaggugcucaguggcagaa

SEQ ID NO: 797472 - RNA, 22 nt, Human
uccaagaagcuuacaaucuaau

SEQ ID NO: 797473 - RNA, 22 nt, Human
gagguccaggguggggccugag

SEQ ID NO: 797474 - RNA, 22 nt, Human
ggcucagguuuccuucccagcu

SEQ ID NO: 797475 - RNA, 22 nt, Human
uaggagagcugaacuauugucu

SEQ ID NO: 797476 - RNA, 22 nt, Human
auccugggcaguuuugagugcu

SEQ ID NO: 797477 - RNA, 22 nt, Human
agcaaugaccagugaucuugua

SEQ ID NO: 797478 - RNA, 22 nt, Human
acagucuuugcaggagaaagga

SEQ ID NO: 797479 - RNA, 22 nt, Human
agggcagagaaauguaguugag

SEQ ID NO: 797480 - RNA, 22 nt, Human
gccuucagaguaccauguccuc

SEQ ID NO: 797481 - RNA, 18 nt, Human
ggguauccagaacugguc

SEQ ID NO: 797482 - RNA, 22 nt, Human
gcccuucugcuguuagguagcc

SEQ ID NO: 797483 - RNA, 22 nt, Human
acacagggggcauucuaggagu

SEQ ID NO: 797484 - RNA, 20 nt, Human
ggcaggacccgguagggagc

SEQ ID NO: 797485 - RNA, 22 nt, Human
cauuugaaauucuuagaacaaa

SEQ ID NO: 797486 - RNA, 22 nt, Human
aggcagcaugggccccagcucc

SEQ ID NO: 797487 - RNA, 22 nt, Human
gagcugccaguguaugaauucu

SEQ ID NO: 797488 - RNA, 22 nt, Human
ugaaaucaugagauagugucac

SEQ ID NO: 797489 - RNA, 22 nt, Human
gauucugaucuauaguguuaua

SEQ ID NO: 797490 - RNA, 20 nt, Human
uuugagaccagucugcccaa

SEQ ID NO: 797491 - RNA, 22 nt, Human
gaaaggccauuucugaggguuu

SEQ ID NO: 797492 - RNA, 22 nt, Human
gaaggcccgcccugagcaaggg

SEQ ID NO: 797493 - RNA, 22 nt, Human
agguacaguagacagacaguua

SEQ ID NO: 797494 - RNA, 22 nt, Human
aaauucuaugucaauguuuauu

SEQ ID NO: 797495 - RNA, 22 nt, Human
ccugcugguuuuuacaaagaug

SEQ ID NO: 797496 - RNA, 22 nt, Human
ugaacuuucacaagaauaugcu

SEQ ID NO: 797497 - RNA, 22 nt, Human
uguucuggggacagcgucccau

SEQ ID NO: 797498 - RNA, 22 nt, Human
aauuauauuguggugugaaugu

SEQ ID NO: 797499 - RNA, 23 nt, Human
cuggcuccgaagacuccaggauc

SEQ ID NO: 797500 - RNA, 22 nt, Human
gaccuagauuaacauucuguga

SEQ ID NO: 797501 - RNA, 22 nt, Human
caaacauuuugagugguuucug

SEQ ID NO: 797502 - RNA, 22 nt, Human
caguuucuucaauucagacacu

SEQ ID NO: 797503 - RNA, 22 nt, Human
uggaggcaguaacugagcaaca

SEQ ID NO: 797504 - RNA, 22 nt, Human
ggccaguccccuaauccagggc

SEQ ID NO: 797505 - RNA, 22 nt, Human
cuucugaaguguuugaugauug

SEQ ID NO: 797506 - RNA, 22 nt, Human
gaaggcuuauuuucuuuguaaa

SEQ ID NO: 797507 - RNA, 22 nt, Human
acuucuuucacaauguuucuag

SEQ ID NO: 797508 - RNA, 22 nt, Human
ucaggaggccaccaggaccugu

SEQ ID NO: 797509 - RNA, 22 nt, Human
auuuacaggacagcuuggcauu

SEQ ID NO: 797510 - RNA, 22 nt, Human
cuggcugccagcauuuggggga

SEQ ID NO: 797511 - RNA, 18 nt, Human
aggaagcaggaggaaggc

SEQ ID NO: 797512 - RNA, 22 nt, Human
cugauuuacauauacaaaagau

SEQ ID NO: 797513 - RNA, 22 nt, Human
accagcagcugccagaguggag

SEQ ID NO: 797514 - RNA, 22 nt, Human
gagaaacugaaacauagggcca

SEQ ID NO: 797515 - RNA, 22 nt, Human
agacaggcagaggcugcagagg

SEQ ID NO: 797516 - RNA, 20 nt, Human
gccugccucagcuagcugag

SEQ ID NO: 797517 - RNA, 22 nt, Human
cauaucuucugacaugaucagg

SEQ ID NO: 797518 - RNA, 22 nt, Human
auugggaugccggcugauaaga

SEQ ID NO: 797519 - RNA, 22 nt, Human
uuguauuugauugucauaucgu

SEQ ID NO: 797520 - RNA, 17 nt, Human
gcacugagccacaguuu

SEQ ID NO: 797521 - RNA, 22 nt, Human
caagcagagagguuagaacaca

SEQ ID NO: 797522 - RNA, 22 nt, Human
ucuccuggcaugugggucaucu

SEQ ID NO: 797523 - RNA, 22 nt, Human
acacuuaagcaugaaguauaaa

SEQ ID NO: 797524 - RNA, 22 nt, Human
ggaaaauacugauucaugccau

SEQ ID NO: 797525 - RNA, 22 nt, Human
uagcuguggagcagaggucucc

SEQ ID NO: 797526 - RNA, 22 nt, Human
ucauuuaucgcugccuuuuaaa

SEQ ID NO: 797527 - RNA, 22 nt, Human
ugcaagauauuaucuuugcugc

SEQ ID NO: 797528 - RNA, 22 nt, Human
ugggagacacuggugggagcuu

SEQ ID NO: 797529 - RNA, 22 nt, Human
gcugcuggaugcgcuugauggu

SEQ ID NO: 797530 - RNA, 22 nt, Human
gcuggcugggucccugagaggc

SEQ ID NO: 797531 - RNA, 22 nt, Human
cugcaagauguugucauaugcu

SEQ ID NO: 797532 - RNA, 22 nt, Human
uguccuggugcuccagguggcu

SEQ ID NO: 797533 - RNA, 22 nt, Human
agcaacaggguggucuucagaa

SEQ ID NO: 797534 - RNA, 22 nt, Human
cuggagaguaaucucuguguua

SEQ ID NO: 797535 - RNA, 22 nt, Human
acaaugucaaaauaggaaacau

SEQ ID NO: 797536 - RNA, 22 nt, Human
ucauuugugcugucagcaugca

SEQ ID NO: 797537 - RNA, 22 nt, Human
ccaggcagccugcuccauucug

SEQ ID NO: 797538 - RNA, 22 nt, Human
ugugucaaauuguuuuacacag

SEQ ID NO: 797539 - RNA, 22 nt, Human
cugcagcucuagcuuuugaccu

SEQ ID NO: 797540 - RNA, 22 nt, Human
aagucagagcaacugagacauu

SEQ ID NO: 797541 - RNA, 22 nt, Human
gcacugcagguggguggagagg

SEQ ID NO: 797542 - RNA, 22 nt, Human
gagugcagaugaacagaagauu

SEQ ID NO: 797543 - RNA, 22 nt, Human
augauauuugcaaugugcuugc

SEQ ID NO: 797544 - RNA, 19 nt, Human
cacacccaugcuugccaag

SEQ ID NO: 797545 - RNA, 22 nt, Human
auucauuggcuugaacuccacc

SEQ ID NO: 797546 - RNA, 22 nt, Human
ccucaugcugcaucucugaggu

SEQ ID NO: 797547 - RNA, 22 nt, Human
ccacuggcaguuggcuagccuu

SEQ ID NO: 797548 - RNA, 22 nt, Human
gaguaauauucuguacuggagg

SEQ ID NO: 797549 - RNA, 22 nt, Human
ccuuggcaagacaguggagggu

SEQ ID NO: 797550 - RNA, 22 nt, Human
ggguggagaggcuaaguccagu

SEQ ID NO: 797551 - RNA, 22 nt, Human
uggaccagcuccucgggagacg

SEQ ID NO: 797552 - RNA, 22 nt, Human
uugguguacaucuccccuucau

SEQ ID NO: 797553 - RNA, 22 nt, Human
ucuucccagcugcugcgaugcc

SEQ ID NO: 797554 - RNA, 23 nt, Human
ucagaagugggauacaaagcuga

SEQ ID NO: 797555 - RNA, 22 nt, Human
acaggcagagaguggcggacuc

SEQ ID NO: 797556 - RNA, 22 nt, Human
uuggccaagggcucuuuaggcu

SEQ ID NO: 797557 - RNA, 22 nt, Human
acccaggcuggaaugcaguggu

SEQ ID NO: 797558 - RNA, 22 nt, Human
cacagugcuuuaugagagaucu

SEQ ID NO: 797559 - RNA, 21 nt, Human
cagaggcagguccugggacgg

SEQ ID NO: 797560 - RNA, 22 nt, Human
uguacuugcuuauuagaaaucu

SEQ ID NO: 797561 - RNA, 22 nt, Human
gcuggcucaagugugcuuccca

SEQ ID NO: 797562 - RNA, 22 nt, Human
uggauugauaaaaugggauguu

SEQ ID NO: 797563 - RNA, 22 nt, Human
aaaggcucagaugaggcccugg

SEQ ID NO: 797564 - RNA, 22 nt, Human
cuggcucagacagcugugcagu

SEQ ID NO: 797565 - RNA, 22 nt, Human
ggagggucuaagggagaacuga

SEQ ID NO: 797566 - RNA, 22 nt, Human
cuccccacgccuggacuaagag

SEQ ID NO: 797567 - RNA, 22 nt, Human
ggggugagguuuauguucuggg

SEQ ID NO: 797568 - RNA, 22 nt, Human
uuuucauuuacauuagggaaga

SEQ ID NO: 797569 - RNA, 21 nt, Human
uuacauucagaggaguggaag

SEQ ID NO: 797570 - RNA, 22 nt, Human
aggagcuucagagagaaccugg

SEQ ID NO: 797571 - RNA, 22 nt, Human
gaaugauaaauggaagcagcau

SEQ ID NO: 797572 - RNA, 22 nt, Human
acucuuggccacucuugguguc

SEQ ID NO: 797573 - RNA, 22 nt, Human
ucagguguuagaagaaauuuca

SEQ ID NO: 797574 - RNA, 22 nt, Human
uacaaaguuugggguccucaaa

SEQ ID NO: 797575 - RNA, 22 nt, Human
auucagcauaaucaguagcuug

SEQ ID NO: 797576 - RNA, 22 nt, Human
aagacugaguggcuuaagaaaa

SEQ ID NO: 797577 - RNA, 22 nt, Human
aggcaagugcauuagaagagca

SEQ ID NO: 797578 - RNA, 22 nt, Human
cagagguguuggugaauggaga

SEQ ID NO: 797579 - RNA, 22 nt, Human
agacagcagaaacuagagcacu

SEQ ID NO: 797580 - RNA, 22 nt, Human
cagggagcaggcucuguccauc

SEQ ID NO: 797581 - RNA, 22 nt, Human
uccagccucauuucuccugcuu

SEQ ID NO: 797582 - RNA, 22 nt, Human
gaggccuguagucauggaugua

SEQ ID NO: 797583 - RNA, 22 nt, Human
ucccaaagucaagcugugucuu

SEQ ID NO: 797584 - RNA, 22 nt, Human
aauguguuuucacugaagauuc

SEQ ID NO: 797585 - RNA, 22 nt, Human
caguccaguccaauccucaaug

SEQ ID NO: 797586 - RNA, 22 nt, Human
uuagccaaacaggugaaauuga

SEQ ID NO: 797587 - RNA, 22 nt, Human
ccuguggcuuccacgaccuaau

SEQ ID NO: 797588 - RNA, 22 nt, Human
uucuauguggauauagaacugc

SEQ ID NO: 797589 - RNA, 20 nt, Human
ucaaaggcaaaggugggugu

SEQ ID NO: 797590 - RNA, 22 nt, Human
agugaaauuuguuuagauaggu

SEQ ID NO: 797591 - RNA, 23 nt, Human
aacugagauaauguauguaaagc

SEQ ID NO: 797592 - RNA, 22 nt, Human
uccaggagggguaggcaguaug

SEQ ID NO: 797593 - RNA, 22 nt, Human
acuucuugaugaaaaugguacu

SEQ ID NO: 797594 - RNA, 21 nt, Human
aaucaggaaguguguguccug

SEQ ID NO: 797595 - RNA, 22 nt, Human
uugcugaaaguggcaagaagua

SEQ ID NO: 797596 - RNA, 22 nt, Human
ugccauauuauugagcauauua

SEQ ID NO: 797597 - RNA, 22 nt, Human
agcagggcccacuaggggagau

SEQ ID NO: 797598 - RNA, 22 nt, Human
ugagggccgaggagcugugggu

SEQ ID NO: 797599 - RNA, 22 nt, Human
agagccaaggcugagagcuauu

SEQ ID NO: 797600 - RNA, 22 nt, Human
gggagcucucccugaggccugg

SEQ ID NO: 797601 - RNA, 22 nt, Human
uggagggcucuuucaccuggua

SEQ ID NO: 797602 - RNA, 22 nt, Human
cucccagggucuaggcugcugg

SEQ ID NO: 797603 - RNA, 22 nt, Human
gugaaaaaugauuuguuaacug

SEQ ID NO: 797604 - RNA, 22 nt, Human
uccagggaucuuuagagucuuu

SEQ ID NO: 797605 - RNA, 22 nt, Human
uacccagcaaucccuagagguu

SEQ ID NO: 797606 - RNA, 22 nt, Human
uuuaagcacagggauaaaguua

SEQ ID NO: 797607 - RNA, 22 nt, Human
ugcuggagaugaaagggcccug

SEQ ID NO: 797608 - RNA, 22 nt, Human
agggaaggcuuuugacauuucc

SEQ ID NO: 797609 - RNA, 22 nt, Human
gagcugagaagcagcgcuugau

SEQ ID NO: 797610 - RNA, 21 nt, Human
agaggcccucggacugggcgu

SEQ ID NO: 797611 - RNA, 22 nt, Human
gugaguuacucugguucucauu

SEQ ID NO: 797612 - RNA, 22 nt, Human
acucagagauauggugguugau

SEQ ID NO: 797613 - RNA, 21 nt, Human
ggccucagccaccuggcucug

SEQ ID NO: 797614 - RNA, 22 nt, Human
ucaguaaaugaaugaauauaug

SEQ ID NO: 797615 - RNA, 22 nt, Human
agagaagcauucuucucagggc

SEQ ID NO: 797616 - RNA, 22 nt, Human
ucccagagccaagcuauggaug

SEQ ID NO: 797617 - RNA, 22 nt, Human
cucggguaccaugcuaggcacu

SEQ ID NO: 797618 - RNA, 22 nt, Human
ggaggcgcggcucggcugugcc

SEQ ID NO: 797619 - RNA, 22 nt, Human
gagcugagccuggguggaccgc

SEQ ID NO: 797620 - RNA, 22 nt, Human
uuaacagagaacauagaaguag

SEQ ID NO: 797621 - RNA, 22 nt, Human
ggacacuagauggagaagggaa

SEQ ID NO: 797622 - RNA, 22 nt, Human
uguggaaagucaaguuccagga

SEQ ID NO: 797623 - RNA, 18 nt, Human
ggcagugcagucucaggg

SEQ ID NO: 797624 - RNA, 22 nt, Human
uaugaaauuuaaacacagauca

SEQ ID NO: 797625 - RNA, 22 nt, Human
ugaggcuguucuaccagggcca

SEQ ID NO: 797626 - RNA, 22 nt, Human
aaaggauaagguuaucaauuuu

SEQ ID NO: 797627 - RNA, 17 nt, Human
ugagacagggcaggccc

SEQ ID NO: 797628 - RNA, 22 nt, Human
caguaacaugaagagacaugga

SEQ ID NO: 797629 - RNA, 22 nt, Human
acuccuggguugcaguccucaa

SEQ ID NO: 797630 - RNA, 21 nt, Human
ucaggaagagccaguucaugc

SEQ ID NO: 797631 - RNA, 20 nt, Human
gauuacaaaaugaaaugcau

SEQ ID NO: 797632 - RNA, 22 nt, Human
gagcccagguucugcuuccagc

SEQ ID NO: 797633 - RNA, 22 nt, Human
cauauuaaggucuguaaggggu

SEQ ID NO: 797634 - RNA, 22 nt, Human
aacauuuaugguagucauugca

SEQ ID NO: 797635 - RNA, 22 nt, Human
cacagagaccccuucuggggcc

SEQ ID NO: 797636 - RNA, 22 nt, Human
caagcuuuccauuacacacauu

SEQ ID NO: 797637 - RNA, 22 nt, Human
uagaaaguagccacuuacagag

SEQ ID NO: 797638 - RNA, 22 nt, Human
uguaucuucaguuugucuuucc

SEQ ID NO: 797639 - RNA, 18 nt, Human
ucagagagcagcuuuauu

SEQ ID NO: 797640 - RNA, 23 nt, Human
ccagggagugcuacuaucaagcc

SEQ ID NO: 797641 - RNA, 21 nt, Human
aagaugauauuuuaucuguag

SEQ ID NO: 797642 - RNA, 22 nt, Human
caaaaaacacagaugucugugu

SEQ ID NO: 797643 - RNA, 22 nt, Human
cugugcugaggaugcaguuucu

SEQ ID NO: 797644 - RNA, 22 nt, Human
gcagcugggucugugugggcug

SEQ ID NO: 797645 - RNA, 22 nt, Human
ugauuuaccaguuacuaucuug

SEQ ID NO: 797646 - RNA, 22 nt, Human
gagcuuggugcugccuguuguc

SEQ ID NO: 797647 - RNA, 22 nt, Human
gccagcugugcuuuuccuaaaa

SEQ ID NO: 797648 - RNA, 22 nt, Human
uuguuuaaaauguagcaagaaa

SEQ ID NO: 797649 - RNA, 22 nt, Human
cccugcagaaccacagacaaac

SEQ ID NO: 797650 - RNA, 22 nt, Human
agggaugugggaacugcagguu

SEQ ID NO: 797651 - RNA, 18 nt, Human
gaggcacauaguuggggc

SEQ ID NO: 797652 - RNA, 22 nt, Human
gggaugagagcugggacagaag

SEQ ID NO: 797653 - RNA, 22 nt, Human
ggaggccuccugggggagguuc

SEQ ID NO: 797654 - RNA, 22 nt, Human
cauuaauaaacauuucagaaga

SEQ ID NO: 797655 - RNA, 22 nt, Human
ucuaggagcugagaguguguac

SEQ ID NO: 797656 - RNA, 22 nt, Human
cagagcaguaaaucuggggcac

SEQ ID NO: 797657 - RNA, 22 nt, Human
aacagauaauuucuaaguuacu

SEQ ID NO: 797658 - RNA, 22 nt, Human
gaguuaauucgaauauucuagc

SEQ ID NO: 797659 - RNA, 22 nt, Human
ggagucugggaauuggagagaa

SEQ ID NO: 797660 - RNA, 22 nt, Human
auacaaagcuaaauaugguuuc

SEQ ID NO: 797661 - RNA, 22 nt, Human
uaugcaacagcauuauuacaau

SEQ ID NO: 797662 - RNA, 22 nt, Human
acacggcacuuuaggaaggggc

SEQ ID NO: 797663 - RNA, 22 nt, Human
uuuguuuacaaaaauaagcagu

SEQ ID NO: 797664 - RNA, 22 nt, Human
ucauugcagacuaacaaucuca

SEQ ID NO: 797665 - RNA, 22 nt, Human
caucaguguugauccaccagca

SEQ ID NO: 797666 - RNA, 18 nt, Human
ugcaggcuguugaaacug

SEQ ID NO: 797667 - RNA, 22 nt, Human
uggaagaucaaccaggauugac

SEQ ID NO: 797668 - RNA, 22 nt, Human
ugaaaaaacaaguuggcccauu

SEQ ID NO: 797669 - RNA, 22 nt, Human
cugagaggcggagcuugcagug

SEQ ID NO: 797670 - RNA, 22 nt, Human
gcagaagcccggucagcgcacg

SEQ ID NO: 797671 - RNA, 22 nt, Human
uuuugauaucaugaugaacaga

SEQ ID NO: 797672 - RNA, 22 nt, Human
auucuauuuuuuaagaaguagu

SEQ ID NO: 797673 - RNA, 19 nt, Human
uaaguagucaaauaguaac

SEQ ID NO: 797674 - RNA, 22 nt, Human
gagguagguguaggaggccugc

SEQ ID NO: 797675 - RNA, 22 nt, Human
auuaauaaaauaccacuuuguu

SEQ ID NO: 797676 - RNA, 22 nt, Human
aauaaugugugcugcagucuua

SEQ ID NO: 797677 - RNA, 22 nt, Human
ggcugggccagggccuguggac

SEQ ID NO: 797678 - RNA, 22 nt, Human
gcagcaaaaaaguaauauuuau

SEQ ID NO: 797679 - RNA, 22 nt, Human
cuccacagccccuccaguggca

SEQ ID NO: 797680 - RNA, 22 nt, Human
gcuggcugcagauuuuagaggu

SEQ ID NO: 797681 - RNA, 22 nt, Human
gaggacagcuuagggcuuccug

SEQ ID NO: 797682 - RNA, 22 nt, Human
caggccugaguguggaagucuu

SEQ ID NO: 797683 - RNA, 22 nt, Human
uugcaaaugggcaaagcagauc

SEQ ID NO: 797684 - RNA, 22 nt, Human
aaagcauuguuucaagauuaac

SEQ ID NO: 797685 - RNA, 22 nt, Human
uggcuccaucauccaugcaaga

SEQ ID NO: 797686 - RNA, 22 nt, Human
uccaggcauaaugcccaguggu

SEQ ID NO: 797687 - RNA, 22 nt, Human
cugcagccacgagucacagccc

SEQ ID NO: 797688 - RNA, 22 nt, Human
cugagccagggccacacaugga

SEQ ID NO: 797689 - RNA, 22 nt, Human
ccagccuggacugggucuugug

SEQ ID NO: 797690 - RNA, 22 nt, Human
ucaguauuucuaaacauuggcu

SEQ ID NO: 797691 - RNA, 22 nt, Human
aaggacagguuggggcuucagg

SEQ ID NO: 797692 - RNA, 22 nt, Human
gggcagugucugcaaaugaaca

SEQ ID NO: 797693 - RNA, 19 nt, Human
gccugagccagccaugcaa

SEQ ID NO: 797694 - RNA, 22 nt, Human
augacaaaaugaaugcagcuag

SEQ ID NO: 797695 - RNA, 22 nt, Human
aggaaagggguagguguggacg

SEQ ID NO: 797696 - RNA, 22 nt, Human
uauuuguauguguguacauaua

SEQ ID NO: 797697 - RNA, 22 nt, Human
auacaaaaauuagccgggagua

SEQ ID NO: 797698 - RNA, 22 nt, Human
gagcuaguagaacaagugagga

SEQ ID NO: 797699 - RNA, 22 nt, Human
aagcaggcaagguuguggggca

SEQ ID NO: 797700 - RNA, 22 nt, Human
uuuuauacuuaagacagaguuu

SEQ ID NO: 797701 - RNA, 22 nt, Human
acaguagacccuggauaaacau

SEQ ID NO: 797702 - RNA, 22 nt, Human
uaggacaggaucaugaugcugg

SEQ ID NO: 797703 - RNA, 22 nt, Human
uuugaauaucacaaacuuucaa

SEQ ID NO: 797704 - RNA, 22 nt, Human
ucugcagggaugugagggguga

SEQ ID NO: 797705 - RNA, 22 nt, Human
aauuagaagcuguuagcaaaau

SEQ ID NO: 797706 - RNA, 22 nt, Human
uccuggagcuuccuucauggua

SEQ ID NO: 797707 - RNA, 22 nt, Human
aggccagccucaggcagggacc

SEQ ID NO: 797708 - RNA, 16 nt, Human
guucuauuuucguccu

SEQ ID NO: 797709 - RNA, 22 nt, Human
uuagaugugcaggacuuuuauc

SEQ ID NO: 797710 - RNA, 22 nt, Human
cccuggugguacggcacuggca

SEQ ID NO: 797711 - RNA, 23 nt, Human
ucguugaauagcaauagcacaac

SEQ ID NO: 797712 - RNA, 22 nt, Human
gucacuggaauuacaggcaugc

SEQ ID NO: 797713 - RNA, 22 nt, Human
acagcagagacacucaggaggc

SEQ ID NO: 797714 - RNA, 22 nt, Human
ucugugauaggaaaauaaaugg

SEQ ID NO: 797715 - RNA, 22 nt, Human
agaaacuacuuggaggaaagau

SEQ ID NO: 797716 - RNA, 22 nt, Human
gcaggacagcaggaugcuuaga

SEQ ID NO: 797717 - RNA, 22 nt, Human
cacaauuuuccuuuaaguguau

SEQ ID NO: 797718 - RNA, 22 nt, Human
agugagauguguaaucaggggu

SEQ ID NO: 797719 - RNA, 22 nt, Human
aagccagguguugugguaagag

SEQ ID NO: 797720 - RNA, 22 nt, Human
uauaacuaauacuggccaugag

SEQ ID NO: 797721 - RNA, 22 nt, Human
aggcuggcgacaucuggcgggc

SEQ ID NO: 797722 - RNA, 22 nt, Human
acaauguuucucuuuagucauu

SEQ ID NO: 797723 - RNA, 22 nt, Human
uaaggguucagaaugcaguggu

SEQ ID NO: 797724 - RNA, 22 nt, Human
uccagagcuaauucagcagcug

SEQ ID NO: 797725 - RNA, 22 nt, Human
cugcagcuguagaggacagugg

SEQ ID NO: 797726 - RNA, 22 nt, Human
ugcuucucccaaccagggccug

SEQ ID NO: 797727 - RNA, 22 nt, Human
auuauuucagucagacacuggc

SEQ ID NO: 797728 - RNA, 22 nt, Human
augcaagacccagaaaucauua

SEQ ID NO: 797729 - RNA, 22 nt, Human
uccacauagucauuaauuucug

SEQ ID NO: 797730 - RNA, 22 nt, Human
ccucuucugagugagacucccu

SEQ ID NO: 797731 - RNA, 22 nt, Human
uccagcugcaaggggcacagcu

SEQ ID NO: 797732 - RNA, 22 nt, Human
agucauaauuauaaacaucagu

SEQ ID NO: 797733 - RNA, 22 nt, Human
ggugcagaggagccagcugggg

SEQ ID NO: 797734 - RNA, 22 nt, Human
acuuaaaaacagauccagcagg

SEQ ID NO: 797735 - RNA, 22 nt, Human
uaaguucaccaguuguaauaag

SEQ ID NO: 797736 - RNA, 22 nt, Human
aaugcagaccaguaugaaaaac

SEQ ID NO: 797737 - RNA, 22 nt, Human
uggucaagggacagagcugaac

SEQ ID NO: 797738 - RNA, 21 nt, Human
agaaaaguauuugaaucaaga

SEQ ID NO: 797739 - RNA, 22 nt, Human
cacaguaacuggcguguaguaa

SEQ ID NO: 797740 - RNA, 22 nt, Human
gcacugggagucuguggggguu

SEQ ID NO: 797741 - RNA, 20 nt, Human
uaggaaauauguuuuuaccc

SEQ ID NO: 797742 - RNA, 22 nt, Human
gcccuggagcuagacuaggaca

SEQ ID NO: 797743 - RNA, 22 nt, Human
cuucuugcaauuuucaucuuau

SEQ ID NO: 797744 - RNA, 22 nt, Human
aaagcacauuacaagcucaguc

SEQ ID NO: 797745 - RNA, 22 nt, Human
ggcccagcacagugcuuggggg

SEQ ID NO: 797746 - RNA, 22 nt, Human
acaggcuucucacagaaaaggg

SEQ ID NO: 797747 - RNA, 22 nt, Human
caggccuggcugcagcucgccu

SEQ ID NO: 797748 - RNA, 22 nt, Human
aaaggcaagcauuuauauagga

SEQ ID NO: 797749 - RNA, 20 nt, Human
aaagugcacagauacagcuc

SEQ ID NO: 797750 - RNA, 22 nt, Human
gauuaauaguacagguucuuag

SEQ ID NO: 797751 - RNA, 22 nt, Human
uugauuuuaaaauagugacacu

SEQ ID NO: 797752 - RNA, 22 nt, Human
auguauuuuaagauuugccuca

SEQ ID NO: 797753 - RNA, 21 nt, Human
auggcugguggcucagccucc

SEQ ID NO: 797754 - RNA, 22 nt, Human
gagaguggauggagcugcgaag

SEQ ID NO: 797755 - RNA, 19 nt, Human
gagcaggccacacaugugu

SEQ ID NO: 797756 - RNA, 22 nt, Human
cagagcagggguuucccagguu

SEQ ID NO: 797757 - RNA, 22 nt, Human
ccauuguaguaucuguuuuagu

SEQ ID NO: 797758 - RNA, 22 nt, Human
ucacaggccuggggcagagggc

SEQ ID NO: 797759 - RNA, 22 nt, Human
acagauaaggcaguuaagaguu

SEQ ID NO: 797760 - RNA, 22 nt, Human
uguccagggauggggucaggga

SEQ ID NO: 797761 - RNA, 22 nt, Human
cucuggagggaggcugagcugg

SEQ ID NO: 797762 - RNA, 22 nt, Human
ccccagaaagccuggcacuagg

SEQ ID NO: 797763 - RNA, 22 nt, Human
gauucacagaacuuagucaagc

SEQ ID NO: 797764 - RNA, 22 nt, Human
aaggcacagaggcagggcacuu

SEQ ID NO: 797765 - RNA, 22 nt, Human
uuuuacaagcugagucguuaaa

SEQ ID NO: 797766 - RNA, 22 nt, Human
agaaguuuccagucuaguaagg

SEQ ID NO: 797767 - RNA, 17 nt, Human
aggaaacauuuucuuuc

SEQ ID NO: 797768 - RNA, 22 nt, Human
agcuccugcgcacggugcacac

SEQ ID NO: 797769 - RNA, 22 nt, Human
aagggggcacagucacuguaau

SEQ ID NO: 797770 - RNA, 22 nt, Human
aaaccacuuauaucgugauuug

SEQ ID NO: 797771 - RNA, 22 nt, Human
uccagccaggauggcccaggga

SEQ ID NO: 797772 - RNA, 22 nt, Human
aauuucuucagcucuaaaaugg

SEQ ID NO: 797773 - RNA, 22 nt, Human
cugagaaaagacauuucuagau

SEQ ID NO: 797774 - RNA, 22 nt, Human
ugcuuucaaugaauuguauacu

SEQ ID NO: 797775 - RNA, 21 nt, Human
ugauugauauuugcaaacaga

SEQ ID NO: 797776 - RNA, 22 nt, Human
ugcuauuaccugcuggacaguc

SEQ ID NO: 797777 - RNA, 22 nt, Human
uucucuuuauguauuuaguggg

SEQ ID NO: 797778 - RNA, 22 nt, Human
auuuguaucaaucucaauauau

SEQ ID NO: 797779 - RNA, 22 nt, Human
cgcccagcugaaaucuccaggc

SEQ ID NO: 797780 - RNA, 22 nt, Human
agucugaagauauucuugcagg

SEQ ID NO: 797781 - RNA, 22 nt, Human
ucagcuuauauuuuuaguguaa

SEQ ID NO: 797782 - RNA, 22 nt, Human
caggcccagcccuuagccaggu

SEQ ID NO: 797783 - RNA, 20 nt, Human
aggaugcagggagucugcag

SEQ ID NO: 797784 - RNA, 20 nt, Human
aaaaagacaaaacgaguugg

SEQ ID NO: 797785 - RNA, 22 nt, Human
gaaaaaugagcugaugucaggg

SEQ ID NO: 797786 - RNA, 22 nt, Human
ucauaaaguuacccaaauuuua

SEQ ID NO: 797787 - RNA, 22 nt, Human
ugucugaagcagccagugcugu

SEQ ID NO: 797788 - RNA, 22 nt, Human
uaucaggaagaacacgugaaau

SEQ ID NO: 797789 - RNA, 22 nt, Human
gcagauguaauggcuggagguc

SEQ ID NO: 797790 - RNA, 22 nt, Human
ugggaugaguuguuaggacuga

SEQ ID NO: 797791 - RNA, 22 nt, Human
ugcuuccuucccguucuucucc

SEQ ID NO: 797792 - RNA, 22 nt, Human
ggacacuaaauggaagugucug

SEQ ID NO: 797793 - RNA, 22 nt, Human
ccucucuccaauuuucaccuca

SEQ ID NO: 797794 - RNA, 22 nt, Human
gucaguguuuaacaaccagcuc

SEQ ID NO: 797795 - RNA, 22 nt, Human
gcuggccauggggagugaggag

SEQ ID NO: 797796 - RNA, 22 nt, Human
aaugauacauauguaucguuag

SEQ ID NO: 797797 - RNA, 22 nt, Human
uuagauuuacaagcacuguuua

SEQ ID NO: 797798 - RNA, 22 nt, Human
guucacauuaacucaccggugc

SEQ ID NO: 797799 - RNA, 22 nt, Human
auuuggcuauugaauuauuccu

SEQ ID NO: 797800 - RNA, 22 nt, Human
cccaggagcuucucucugccuc

SEQ ID NO: 797801 - RNA, 22 nt, Human
uccagccuaggggaacagcugc

SEQ ID NO: 797802 - RNA, 22 nt, Human
augcuccucgagugucucacag

SEQ ID NO: 797803 - RNA, 22 nt, Human
gcagggcaaauguggaaaggag

SEQ ID NO: 797804 - RNA, 22 nt, Human
agagcugcgucuauucacaauc

SEQ ID NO: 797805 - RNA, 22 nt, Human
gacagacaugggacuucauacu

SEQ ID NO: 797806 - RNA, 22 nt, Human
uccagccaacugccuagggagc

SEQ ID NO: 797807 - RNA, 22 nt, Human
uaggaaauuaagucucuuuugu

SEQ ID NO: 797808 - RNA, 22 nt, Human
cucacaggguucuaucgaagag

SEQ ID NO: 797809 - RNA, 22 nt, Human
aucuguaaagauaaucauaugu

SEQ ID NO: 797810 - RNA, 21 nt, Human
aggagaaacacaggucagccc

SEQ ID NO: 797811 - RNA, 22 nt, Human
gcuuccagcaccagcagagggg

SEQ ID NO: 797812 - RNA, 22 nt, Human
aggagguggcugaacuugaggg

SEQ ID NO: 797813 - RNA, 22 nt, Human
gcaggacaggcguugguccagu

SEQ ID NO: 797814 - RNA, 22 nt, Human
uggcuggagcauuccuugucuu

SEQ ID NO: 797815 - RNA, 22 nt, Human
uaccaaaagcuuguuucauaca

SEQ ID NO: 797816 - RNA, 22 nt, Human
agugacaacaaguugacuagaa

SEQ ID NO: 797817 - RNA, 22 nt, Human
cuacugccauugucucugccau

SEQ ID NO: 797818 - RNA, 22 nt, Human
uucauagacccaugugaggaag

SEQ ID NO: 797819 - RNA, 20 nt, Human
ccacaggaguccagucgacc

SEQ ID NO: 797820 - RNA, 22 nt, Human
agaggccagaaaguaugccacc

SEQ ID NO: 797821 - RNA, 23 nt, Human
ugcaacaaugaggaaagcuacug

SEQ ID NO: 797822 - RNA, 22 nt, Human
aagucagaaaacagagcaauua

SEQ ID NO: 797823 - RNA, 22 nt, Human
auaaugucugcagagccacaca

SEQ ID NO: 797824 - RNA, 22 nt, Human
cugagccaugagccugcgccca

SEQ ID NO: 797825 - RNA, 22 nt, Human
aagacaaugcauuacuaagaag

SEQ ID NO: 797826 - RNA, 22 nt, Human
ugaaauguugccaugaggucuc

SEQ ID NO: 797827 - RNA, 22 nt, Human
uagcaggguccaaugugaggca

SEQ ID NO: 797828 - RNA, 22 nt, Human
acccaggcuagagugcaguggu

SEQ ID NO: 797829 - RNA, 22 nt, Human
gauucuuaagacauuauguauu

SEQ ID NO: 797830 - RNA, 22 nt, Human
aauuaaauugguuuagagagga

SEQ ID NO: 797831 - RNA, 22 nt, Human
gauuuuauauggcauacugugg

SEQ ID NO: 797832 - RNA, 22 nt, Human
cuuuugcacccagaguuauuug

SEQ ID NO: 797833 - RNA, 22 nt, Human
ugggagcagccaacauggccuu

SEQ ID NO: 797834 - RNA, 22 nt, Human
cagucuuagccuucccucaccc

SEQ ID NO: 797835 - RNA, 20 nt, Human
caucaggacccucaguuuuu

SEQ ID NO: 797836 - RNA, 22 nt, Human
uuagaacauagcaacagaauua

SEQ ID NO: 797837 - RNA, 22 nt, Human
agcacagugccugacauauaug

SEQ ID NO: 797838 - RNA, 19 nt, Human
ugcaaaugcuguugagaau

SEQ ID NO: 797839 - RNA, 22 nt, Human
uuuauugacccaaagcgagagu

SEQ ID NO: 797840 - RNA, 22 nt, Human
augcagcugacauuuucauguu

SEQ ID NO: 797841 - RNA, 22 nt, Human
ccugggcaucaacaagcagaga

SEQ ID NO: 797842 - RNA, 22 nt, Human
cugucuuuuacuaucauuuacu

SEQ ID NO: 797843 - RNA, 22 nt, Human
caggcugggcugguguuagagu

SEQ ID NO: 797844 - RNA, 22 nt, Human
caggcucccgaaaucacccaug

SEQ ID NO: 797845 - RNA, 22 nt, Human
cuuguuuuggcuaguaugaugu

SEQ ID NO: 797846 - RNA, 22 nt, Human
acuguguauuccuauauaguaa

SEQ ID NO: 797847 - RNA, 22 nt, Human
auauuucacguagguuguuuuc

SEQ ID NO: 797848 - RNA, 22 nt, Human
auuuuccaaaauaauuguuacu

SEQ ID NO: 797849 - RNA, 22 nt, Human
uggcccugucugcacacaggau

SEQ ID NO: 797850 - RNA, 22 nt, Human
acggugccgguggugaugagcc

SEQ ID NO: 797851 - RNA, 22 nt, Human
ggcaguguucugguugucagga

SEQ ID NO: 797852 - RNA, 22 nt, Human
acauucuuugaguuuuguuaaa

SEQ ID NO: 797853 - RNA, 18 nt, Human
ggguccugugggagacag

SEQ ID NO: 797854 - RNA, 22 nt, Human
ugggccuggacaaggccacuag

SEQ ID NO: 797855 - RNA, 22 nt, Human
auuguuuuguagaaugacccuu

SEQ ID NO: 797856 - RNA, 22 nt, Human
cucuauuuuucuuggcuagugu

SEQ ID NO: 797857 - RNA, 22 nt, Human
uugagcuguauaccuaugacug

SEQ ID NO: 797858 - RNA, 22 nt, Human
caagaugaucccugaaggcagc

SEQ ID NO: 797859 - RNA, 22 nt, Human
gcagcagggagcagggguguca

SEQ ID NO: 797860 - RNA, 22 nt, Human
gagcuaggcuagggggagucgc

SEQ ID NO: 797861 - RNA, 22 nt, Human
ucuggacuaacagcagccucag

SEQ ID NO: 797862 - RNA, 22 nt, Human
ccuggagauuauuugguccaau

SEQ ID NO: 797863 - RNA, 22 nt, Human
acuuggcugggagaguugaaga

SEQ ID NO: 797864 - RNA, 17 nt, Human
acaguaacuauguuaug

SEQ ID NO: 797865 - RNA, 22 nt, Human
cugggaugugaggagcgccucu

SEQ ID NO: 797866 - RNA, 22 nt, Human
agaacaauugccccaaagcuug

SEQ ID NO: 797867 - RNA, 22 nt, Human
gucggccacgcaggugcgguag

SEQ ID NO: 797868 - RNA, 22 nt, Human
ucuauuucgcauauaaguuuug

SEQ ID NO: 797869 - RNA, 20 nt, Human
auucuaaagcucugcucuuu

SEQ ID NO: 797870 - RNA, 22 nt, Human
agcagcagauuauggucuacau

SEQ ID NO: 797871 - RNA, 22 nt, Human
uucuucuuuccuauaauuaauu

SEQ ID NO: 797872 - RNA, 22 nt, Human
uacuugcuuggauuucaccaga

SEQ ID NO: 797873 - RNA, 22 nt, Human
gcaggcugaugacuggaguugg

SEQ ID NO: 797874 - RNA, 22 nt, Human
ggggccucugcagucacgcugg

SEQ ID NO: 797875 - RNA, 22 nt, Human
gaaacauugagcagaaggagaa

SEQ ID NO: 797876 - RNA, 22 nt, Human
agcaugaaagcauaggacaguc

SEQ ID NO: 797877 - RNA, 17 nt, Human
aucugcuucacccagca

SEQ ID NO: 797878 - RNA, 22 nt, Human
aggaaaggugagagcggccgcg

SEQ ID NO: 797879 - RNA, 20 nt, Human
aggaaguauugucaugaagg

SEQ ID NO: 797880 - RNA, 22 nt, Human
uaacacauaagcugagaccaug

SEQ ID NO: 797881 - RNA, 22 nt, Human
cgauuuccgcuugaucugaucu

SEQ ID NO: 797882 - RNA, 22 nt, Human
aaagccagaguguguuagagac

SEQ ID NO: 797883 - RNA, 22 nt, Human
cagucccagcugcucagaaggc

SEQ ID NO: 797884 - RNA, 22 nt, Human
auuguuuuguuucccagugacu

SEQ ID NO: 797885 - RNA, 22 nt, Human
gccaaagcagucuugccucugc

SEQ ID NO: 797886 - RNA, 22 nt, Human
uacauauacugagugauuugcu

SEQ ID NO: 797887 - RNA, 22 nt, Human
aaaugucuuugaguauuucugc

SEQ ID NO: 797888 - RNA, 18 nt, Human
gcuggcuugcuggguuug

SEQ ID NO: 797889 - RNA, 22 nt, Human
cuacagcagagaccagccacau

SEQ ID NO: 797890 - RNA, 22 nt, Human
auuuaucucuggaaacuaagca

SEQ ID NO: 797891 - RNA, 19 nt, Human
cagcccucuuaccacugug

SEQ ID NO: 797892 - RNA, 22 nt, Human
gcagggcagcuuagucccuguc

SEQ ID NO: 797893 - RNA, 22 nt, Human
aagcaggcuugguguggccgcu

SEQ ID NO: 797894 - RNA, 22 nt, Human
ggugggagccaacacccuucug

SEQ ID NO: 797895 - RNA, 22 nt, Human
cacccuggcuggaggugcagug

SEQ ID NO: 797896 - RNA, 22 nt, Human
gccaguaaaacaaaggccaugu

SEQ ID NO: 797897 - RNA, 22 nt, Human
uaugagaagguauggugacuug

SEQ ID NO: 797898 - RNA, 22 nt, Human
uaguuuuagcagcaaugggaug

SEQ ID NO: 797899 - RNA, 22 nt, Human
ucagccagaggcuucuugguuu

SEQ ID NO: 797900 - RNA, 22 nt, Human
uauucagaggugaaguagggag

SEQ ID NO: 797901 - RNA, 22 nt, Human
uugcuuccuggaugugacuuug

SEQ ID NO: 797902 - RNA, 22 nt, Human
auguaaauuguacugacacacg

SEQ ID NO: 797903 - RNA, 22 nt, Human
uucucugggacaggaacaguuu

SEQ ID NO: 797904 - RNA, 22 nt, Human
auucuuaauugccaugcuguau

SEQ ID NO: 797905 - RNA, 22 nt, Human
uuagugucuggcuauauuuaaa

SEQ ID NO: 797906 - RNA, 22 nt, Human
cugugagggucacagccaugcc

SEQ ID NO: 797907 - RNA, 22 nt, Human
gauaacaauaugaaguagauau

SEQ ID NO: 797908 - RNA, 19 nt, Human
ucagcaucaauuugguccu

SEQ ID NO: 797909 - RNA, 22 nt, Human
gucaaauaauuuucucaauagu

SEQ ID NO: 797910 - RNA, 22 nt, Human
ucccaggacaggccacauggaa

SEQ ID NO: 797911 - RNA, 22 nt, Human
agacaggaugcauacucuuggu

SEQ ID NO: 797912 - RNA, 22 nt, Human
auggcagggaccaagcugucau

SEQ ID NO: 797913 - RNA, 22 nt, Human
gggauggaucuuggcugaggcu

SEQ ID NO: 797914 - RNA, 18 nt, Human
aaugaaauguacaccuuu

SEQ ID NO: 797915 - RNA, 22 nt, Human
agggauggagugcggcccggac

SEQ ID NO: 797916 - RNA, 22 nt, Human
acuuauuuauucauucagcuca

SEQ ID NO: 797917 - RNA, 22 nt, Human
cacaggcuugucagcaugaggc

SEQ ID NO: 797918 - RNA, 23 nt, Human
uccucaguauauaaaggcagaug

SEQ ID NO: 797919 - RNA, 22 nt, Human
uucauucaucucuaaaaugccu

SEQ ID NO: 797920 - RNA, 22 nt, Human
acuuggcucagauaccaugccc

SEQ ID NO: 797921 - RNA, 22 nt, Human
gggagcuguaagggacagguag

SEQ ID NO: 797922 - RNA, 22 nt, Human
uagagggaaggaagaauggauu

SEQ ID NO: 797923 - RNA, 22 nt, Human
uggggagguucgggaaucuugu

SEQ ID NO: 797924 - RNA, 22 nt, Human
aaaggcuucuuugcuccauguc

SEQ ID NO: 797925 - RNA, 22 nt, Human
aggcccugcaggaagcaggaug

SEQ ID NO: 797926 - RNA, 22 nt, Human
ugauuuuuggaucugagcugca

SEQ ID NO: 797927 - RNA, 22 nt, Human
cagcauggggcuuggagucagc

SEQ ID NO: 797928 - RNA, 22 nt, Human
agcacuuuccuggcaaaugugg

SEQ ID NO: 797929 - RNA, 22 nt, Human
aaguuacuaugacucuucuuuu

SEQ ID NO: 797930 - RNA, 22 nt, Human
uggcccagcaguucugccccag

SEQ ID NO: 797931 - RNA, 22 nt, Human
acccuccacuuuaucugucuuu

SEQ ID NO: 797932 - RNA, 22 nt, Human
cucccacuccuggcucaccaca

SEQ ID NO: 797933 - RNA, 22 nt, Human
ggcagugucaaaauaggcagaa

SEQ ID NO: 797934 - RNA, 22 nt, Human
ccuggaagagcugaaucaggca

SEQ ID NO: 797935 - RNA, 22 nt, Human
caggcugccaaggcuggggagg

SEQ ID NO: 797936 - RNA, 22 nt, Human
uguuuauagggucugucacuug

SEQ ID NO: 797937 - RNA, 22 nt, Human
agcuguaauauaagcaaugaaa

SEQ ID NO: 797938 - RNA, 20 nt, Human
ucugccacugcacucugccc

SEQ ID NO: 797939 - RNA, 22 nt, Human
ucuaaagcuccuuccacuaaaa

SEQ ID NO: 797940 - RNA, 22 nt, Human
uccugccucacaguugaaguuu

SEQ ID NO: 797941 - RNA, 22 nt, Human
uucuuugcccauguuuccuaag

SEQ ID NO: 797942 - RNA, 22 nt, Human
ugucaugggcauuuauugaggg

SEQ ID NO: 797943 - RNA, 23 nt, Human
cuccuugguaugccaugcccagc

SEQ ID NO: 797944 - RNA, 22 nt, Human
uaauguuuccagucuaugaugg

SEQ ID NO: 797945 - RNA, 22 nt, Human
ucuucccacugcccaugggcag

SEQ ID NO: 797946 - RNA, 22 nt, Human
agcccagcggagcgggcccggg

SEQ ID NO: 797947 - RNA, 20 nt, Human
uggggaguugagcacgagca

SEQ ID NO: 797948 - RNA, 22 nt, Human
gcagggaccugccacugcuguc

SEQ ID NO: 797949 - RNA, 22 nt, Human
auacuucuuuaagaguaagucu

SEQ ID NO: 797950 - RNA, 21 nt, Human
ugcaggcuacuucugacucua

SEQ ID NO: 797951 - RNA, 22 nt, Human
caagaaacuuuauucugccaua

SEQ ID NO: 797952 - RNA, 22 nt, Human
auacaaagacaaaucucaaucu

SEQ ID NO: 797953 - RNA, 22 nt, Human
uuggagggacugagcuucaguc

SEQ ID NO: 797954 - RNA, 22 nt, Human
ccuccugggacaggcuggcaca

SEQ ID NO: 797955 - RNA, 22 nt, Human
guuucuuauuucaacuggaaca

SEQ ID NO: 797956 - RNA, 22 nt, Human
cugcugugcuuguggccacccg

SEQ ID NO: 797957 - RNA, 22 nt, Human
gcugggcucagaccuagugaac

SEQ ID NO: 797958 - RNA, 22 nt, Human
uuugcaaaccggagcucugcaa

SEQ ID NO: 797959 - RNA, 22 nt, Human
uuucacauuuuauacuuaagcc

SEQ ID NO: 797960 - RNA, 22 nt, Human
uauauuaucauaaaaccauuca

SEQ ID NO: 797961 - RNA, 18 nt, Human
gccucccuggcuacacuu

SEQ ID NO: 797962 - RNA, 22 nt, Human
agugcagagaccuggucaggca

SEQ ID NO: 797963 - RNA, 22 nt, Human
caaguucauuguagcauuauug

SEQ ID NO: 797964 - RNA, 21 nt, Human
aaaaguuugacaggaaaggga

SEQ ID NO: 797965 - RNA, 22 nt, Human
uucaaagaauuuugagaccuga

SEQ ID NO: 797966 - RNA, 22 nt, Human
uuauuuaggaggaaacugaggu

SEQ ID NO: 797967 - RNA, 22 nt, Human
gggagccacaguagcagcuacu

SEQ ID NO: 797968 - RNA, 22 nt, Human
uucaaacucuugcucugcuagu

SEQ ID NO: 797969 - RNA, 22 nt, Human
caggaaccaggagagucccuga

SEQ ID NO: 797970 - RNA, 21 nt, Human
cuuggccucuagcuagagcug

SEQ ID NO: 797971 - RNA, 22 nt, Human
aaacugcacaugaggcuggugc

SEQ ID NO: 797972 - RNA, 18 nt, Human
acagcagguuucauucuu

SEQ ID NO: 797973 - RNA, 22 nt, Human
gauauaaauuaaucaagugcaa

SEQ ID NO: 797974 - RNA, 22 nt, Human
augcuaaauguuaauguuaccu

SEQ ID NO: 797975 - RNA, 22 nt, Human
agggcagcuggaagguggcuuc

SEQ ID NO: 797976 - RNA, 22 nt, Human
ugcagcuugcuguaggcuaagu

SEQ ID NO: 797977 - RNA, 22 nt, Human
caggcaaggagcuggcucaagu

SEQ ID NO: 797978 - RNA, 22 nt, Human
agccaggcgggucuuugcuccu

SEQ ID NO: 797979 - RNA, 22 nt, Human
caggaagcucuuagcagucacc

SEQ ID NO: 797980 - RNA, 22 nt, Human
auggcucucuugaccuaggcac

SEQ ID NO: 797981 - RNA, 22 nt, Human
auguuuccaucaaauuugauga

SEQ ID NO: 797982 - RNA, 17 nt, Human
aagacaagacaaaugca

SEQ ID NO: 797983 - RNA, 22 nt, Human
aauacaaucaaauucacuagca

SEQ ID NO: 797984 - RNA, 22 nt, Human
acuguggauaagucagagaugu

SEQ ID NO: 797985 - RNA, 21 nt, Human
agaauucuuaaguauucuaau

SEQ ID NO: 797986 - RNA, 22 nt, Human
aacccuggagaaggcuuuggau

SEQ ID NO: 797987 - RNA, 22 nt, Human
augcuccaccuuuugcaggaac

SEQ ID NO: 797988 - RNA, 22 nt, Human
ugggguaggagucagcgagaga

SEQ ID NO: 797989 - RNA, 22 nt, Human
aggaaaguggugggaaaucagg

SEQ ID NO: 797990 - RNA, 22 nt, Human
ucugcaggcucuagaugagguu

SEQ ID NO: 797991 - RNA, 22 nt, Human
uagaaacaaagaccugggugcu

SEQ ID NO: 797992 - RNA, 22 nt, Human
ucauaaauugauuaugugcuuu

SEQ ID NO: 797993 - RNA, 22 nt, Human
ugaaagaugcucaaugaauggu

SEQ ID NO: 797994 - RNA, 22 nt, Human
gcaggcugugaggcucagaugg

SEQ ID NO: 797995 - RNA, 22 nt, Human
ugcuggaggaguuuacuguggc

SEQ ID NO: 797996 - RNA, 22 nt, Human
uugcaaauaauagccugaaacu

SEQ ID NO: 797997 - RNA, 22 nt, Human
gaaggaaaucugugauuuaugc

SEQ ID NO: 797998 - RNA, 22 nt, Human
uccucagaaaccccugugaggu

SEQ ID NO: 797999 - RNA, 22 nt, Human
uucauucugggcucuaaggaac

SEQ ID NO: 798000 - RNA, 22 nt, Human
ggagaggguguggaaaguuauc

SEQ ID NO: 798001 - RNA, 22 nt, Human
guuucuaauuggaacuuugagg

SEQ ID NO: 798002 - RNA, 22 nt, Human
agauggaaaauauagacagaga

SEQ ID NO: 798003 - RNA, 22 nt, Human
uuuacaaguuuacagaaugaug

SEQ ID NO: 798004 - RNA, 22 nt, Human
aacucagauaugauagcaggag

SEQ ID NO: 798005 - RNA, 22 nt, Human
aaaaguauuggccaccauuucu

SEQ ID NO: 798006 - RNA, 22 nt, Human
ggcaggguuuacaauagcaaua

SEQ ID NO: 798007 - RNA, 22 nt, Human
uaaaauugcggugaauauuucc

SEQ ID NO: 798008 - RNA, 22 nt, Human
ugccacaggguccucaggccag

SEQ ID NO: 798009 - RNA, 22 nt, Human
uguucccugguaaacugacucc

SEQ ID NO: 798010 - RNA, 22 nt, Human
ucuucaaauacagucauauuga

SEQ ID NO: 798011 - RNA, 22 nt, Human
aagcacagaugcaagggggacc

SEQ ID NO: 798012 - RNA, 22 nt, Human
cggcuuccaacaagcuuugcug

SEQ ID NO: 798013 - RNA, 22 nt, Human
agaagcugugguaugaaaugug

SEQ ID NO: 798014 - RNA, 22 nt, Human
gcaggguucucagcagugaugg

SEQ ID NO: 798015 - RNA, 17 nt, Human
gagacagcaggagcccc

SEQ ID NO: 798016 - RNA, 20 nt, Human
acaguguaauauucacauuc

SEQ ID NO: 798017 - RNA, 22 nt, Human
cauuuacaauguacagguugug

SEQ ID NO: 798018 - RNA, 22 nt, Human
ccaggccuuccaguacgcagaa

SEQ ID NO: 798019 - RNA, 22 nt, Human
uucugaaauuucaacuuuacua

SEQ ID NO: 798020 - RNA, 17 nt, Human
gcucugccaggaaagag

SEQ ID NO: 798021 - RNA, 22 nt, Human
ugcuggagagcuaguucugcag

SEQ ID NO: 798022 - RNA, 22 nt, Human
aaacaguuuauaacaugauacu

SEQ ID NO: 798023 - RNA, 20 nt, Human
ucagagaaggagcuuuccug

SEQ ID NO: 798024 - RNA, 22 nt, Human
uuacauucaauuucuagaggua

SEQ ID NO: 798025 - RNA, 22 nt, Human
cagaagcagaacacuagauuua

SEQ ID NO: 798026 - RNA, 19 nt, Human
aggagccuugagcagugag

SEQ ID NO: 798027 - RNA, 22 nt, Human
ggguggaggagaacaggcccca

SEQ ID NO: 798028 - RNA, 22 nt, Human
ggcacagggagccgcaguugca

SEQ ID NO: 798029 - RNA, 22 nt, Human
auauaacauacauacagaaaag

SEQ ID NO: 798030 - RNA, 22 nt, Human
agcugacaggauggcauuauua

SEQ ID NO: 798031 - RNA, 22 nt, Human
guuauauauaguauuucucuga

SEQ ID NO: 798032 - RNA, 22 nt, Human
ugcauaaagugccauaguauua

SEQ ID NO: 798033 - RNA, 22 nt, Human
uacccagagggagagcaacuau

SEQ ID NO: 798034 - RNA, 22 nt, Human
aggcucuguuauucuagagggc

SEQ ID NO: 798035 - RNA, 22 nt, Human
aagaagcauggcuguagauucc

SEQ ID NO: 798036 - RNA, 23 nt, Human
acucguggaauucucugcgaucg

SEQ ID NO: 798037 - RNA, 22 nt, Human
ggcagccaugucccagggcuuc

SEQ ID NO: 798038 - RNA, 22 nt, Human
uuacaagugucagguacuggca

SEQ ID NO: 798039 - RNA, 22 nt, Human
gcucccacgcaauucuuuucag

SEQ ID NO: 798040 - RNA, 22 nt, Human
cagucccaccaggaucgcucuu

SEQ ID NO: 798041 - RNA, 22 nt, Human
uucugagccucauucaugaggc

SEQ ID NO: 798042 - RNA, 22 nt, Human
gccugagcaggcguggaccaug

SEQ ID NO: 798043 - RNA, 22 nt, Human
ucagcagggcauacugagccua

SEQ ID NO: 798044 - RNA, 22 nt, Human
agcuggagaucaugcugauacu

SEQ ID NO: 798045 - RNA, 22 nt, Human
cugggagucaccaggagcaagg

SEQ ID NO: 798046 - RNA, 22 nt, Human
ccaggcuuuuagcugcauggca

SEQ ID NO: 798047 - RNA, 22 nt, Human
uuccagccagauuugcuggguu

SEQ ID NO: 798048 - RNA, 22 nt, Human
gcuuccaaugcuucuaucacau

SEQ ID NO: 798049 - RNA, 22 nt, Human
ugaacauugucacauuccuagc

SEQ ID NO: 798050 - RNA, 23 nt, Human
uaaagcaaagucaagugcacucc

SEQ ID NO: 798051 - RNA, 21 nt, Human
aggcagaaagagcccaggcug

SEQ ID NO: 798052 - RNA, 22 nt, Human
ggcaggcuggcuuuguuccagg

SEQ ID NO: 798053 - RNA, 22 nt, Human
uuuuccuucaccucuugagccu

SEQ ID NO: 798054 - RNA, 22 nt, Human
cuuggcugucuauaggaaagag

SEQ ID NO: 798055 - RNA, 20 nt, Human
ggccggggagcucuccaggg

SEQ ID NO: 798056 - RNA, 22 nt, Human
cugcuggagguuggagcaugca

SEQ ID NO: 798057 - RNA, 22 nt, Human
ccuggcuccgugucacgugccc

SEQ ID NO: 798058 - RNA, 22 nt, Human
ucaggaaauacaagugacauca

SEQ ID NO: 798059 - RNA, 19 nt, Human
cuggaaggagggacuguuc

SEQ ID NO: 798060 - RNA, 22 nt, Human
uaacagaauccuguuauugcca

SEQ ID NO: 798061 - RNA, 22 nt, Human
aaguacauguuguucaaaagcc

SEQ ID NO: 798062 - RNA, 22 nt, Human
gagugccaagagaagaggcugg

SEQ ID NO: 798063 - RNA, 22 nt, Human
cugcacagcuggccagggagag

SEQ ID NO: 798064 - RNA, 22 nt, Human
ucaggcagaauuaucaaaagau

SEQ ID NO: 798065 - RNA, 22 nt, Human
ucacaggagcccaggggagcug

SEQ ID NO: 798066 - RNA, 22 nt, Human
gccagcugagaaaucauugaua

SEQ ID NO: 798067 - RNA, 22 nt, Human
uucauagaagcagaaaguaaac

SEQ ID NO: 798068 - RNA, 22 nt, Human
caggcagauauguucgcuuuaa

SEQ ID NO: 798069 - RNA, 18 nt, Human
gcaggccuagaacuuggu

SEQ ID NO: 798070 - RNA, 22 nt, Human
gcugagaggcagccagacccuc

SEQ ID NO: 798071 - RNA, 22 nt, Human
aagccagugggcauagcaguug

SEQ ID NO: 798072 - RNA, 22 nt, Human
ggcaggcacauuugggggccgu

SEQ ID NO: 798073 - RNA, 22 nt, Human
gccuaggaguacagaaugguuu

SEQ ID NO: 798074 - RNA, 22 nt, Human
auauacuuuucacuaauggcua

SEQ ID NO: 798075 - RNA, 22 nt, Human
aguuuucuuucgcaaagguaca

SEQ ID NO: 798076 - RNA, 22 nt, Human
ugaaacauugcacuguaugaau

SEQ ID NO: 798077 - RNA, 22 nt, Human
cucugcccacgucuugcccaga

SEQ ID NO: 798078 - RNA, 22 nt, Human
cuggcagauuggggucagcagu

SEQ ID NO: 798079 - RNA, 16 nt, Human
gugcagcugccuggua

SEQ ID NO: 798080 - RNA, 22 nt, Human
ggcagauguuauaugaucugag

SEQ ID NO: 798081 - RNA, 19 nt, Human
uccuuaaaaaagcaguucu

SEQ ID NO: 798082 - RNA, 22 nt, Human
uucaacuuuaggcaaagaaaac

SEQ ID NO: 798083 - RNA, 22 nt, Human
ucagaggacgcacuaggguugu

SEQ ID NO: 798084 - RNA, 22 nt, Human
auauauaucgaguucaugucuc

SEQ ID NO: 798085 - RNA, 22 nt, Human
gcaggcagccacgauucccuug

SEQ ID NO: 798086 - RNA, 22 nt, Human
uaucauuuuacugugacauuuu

SEQ ID NO: 798087 - RNA, 22 nt, Human
ccuggccagcagccccuuccuc

SEQ ID NO: 798088 - RNA, 22 nt, Human
guuggagugcagcuugugcgau

SEQ ID NO: 798089 - RNA, 22 nt, Human
agccucucuuaucccuucaaag

SEQ ID NO: 798090 - RNA, 22 nt, Human
augcagcugcucuuccucuauu

SEQ ID NO: 798091 - RNA, 18 nt, Human
ugagccgguagauggggu

SEQ ID NO: 798092 - RNA, 22 nt, Human
ccugcagcuccggauuucuggg

SEQ ID NO: 798093 - RNA, 22 nt, Human
aggaauuugggguuacaugaug

SEQ ID NO: 798094 - RNA, 22 nt, Human
auauuauucuaguaacagugau

SEQ ID NO: 798095 - RNA, 21 nt, Human
ccuucuccacagggucuccgg

SEQ ID NO: 798096 - RNA, 22 nt, Human
ucuucaguauuuggauaacauu

SEQ ID NO: 798097 - RNA, 22 nt, Human
uccuggcacuuugggggcucgc

SEQ ID NO: 798098 - RNA, 22 nt, Human
gcuuuaaugaagucacgcaaag

SEQ ID NO: 798099 - RNA, 22 nt, Human
guuacaaaggacugggggccac

SEQ ID NO: 798100 - RNA, 22 nt, Human
cuacauucaacagcagaguuuu

SEQ ID NO: 798101 - RNA, 22 nt, Human
auaacccucuggauaggacagg

SEQ ID NO: 798102 - RNA, 22 nt, Human
uuagauaaauuaagacuuuaca

SEQ ID NO: 798103 - RNA, 22 nt, Human
aguugcuaucgugaagcacgug

SEQ ID NO: 798104 - RNA, 22 nt, Human
ugcucaggugccuuggcugcug

SEQ ID NO: 798105 - RNA, 22 nt, Human
aaacacuucaaggacuucuguc

SEQ ID NO: 798106 - RNA, 22 nt, Human
augcacaugaggcaagcaaaau

SEQ ID NO: 798107 - RNA, 22 nt, Human
cugcagcuuauuugcuguguga

SEQ ID NO: 798108 - RNA, 22 nt, Human
ggagagccuccacggcuucugu

SEQ ID NO: 798109 - RNA, 22 nt, Human
cugggcugagccugggcugugu

SEQ ID NO: 798110 - RNA, 22 nt, Human
agccacaggaaacagagacagc

SEQ ID NO: 798111 - RNA, 22 nt, Human
ugugccucauguaucuggauga

SEQ ID NO: 798112 - RNA, 22 nt, Human
aguucaaacucuauaagaacuu

SEQ ID NO: 798113 - RNA, 22 nt, Human
uauuuucuggacagucuugcuu

SEQ ID NO: 798114 - RNA, 22 nt, Human
ucgcgcccccaagcgucauugg

SEQ ID NO: 798115 - RNA, 18 nt, Human
ucauggcuuuagucccuc

SEQ ID NO: 798116 - RNA, 22 nt, Human
ucuuuccccuacauuugguuaa

SEQ ID NO: 798117 - RNA, 23 nt, Human
cuggcccaggugagagguuggug

SEQ ID NO: 798118 - RNA, 22 nt, Human
gccccaccugcuaccuuccagc

SEQ ID NO: 798119 - RNA, 22 nt, Human
ccuggcuccagcugccuguccu

SEQ ID NO: 798120 - RNA, 20 nt, Human
uucauucauuccacaacuuc

SEQ ID NO: 798121 - RNA, 22 nt, Human
caucguauggccgaauguacau

SEQ ID NO: 798122 - RNA, 22 nt, Human
uguguaaauuuauuuacauaaa

SEQ ID NO: 798123 - RNA, 21 nt, Human
uuuguucaggcaaguuacagu

SEQ ID NO: 798124 - RNA, 22 nt, Human
acugggagucaugaggaaggag

SEQ ID NO: 798125 - RNA, 22 nt, Human
ccuggcaguucaucaaauggca

SEQ ID NO: 798126 - RNA, 22 nt, Human
caggucagaggcgcagccccca

SEQ ID NO: 798127 - RNA, 22 nt, Human
gcagccagguuugaggaccacu

SEQ ID NO: 798128 - RNA, 22 nt, Human
gcagaggacagggauuuagauu

SEQ ID NO: 798129 - RNA, 22 nt, Human
uacugaaacuuuucuucaacug

SEQ ID NO: 798130 - RNA, 22 nt, Human
cuguauauggcuuacuuuauau

SEQ ID NO: 798131 - RNA, 22 nt, Human
guguuaaugguagaaucugagu

SEQ ID NO: 798132 - RNA, 22 nt, Human
aaggccagauucucucuagggg

SEQ ID NO: 798133 - RNA, 22 nt, Human
ggcaggaacacagauggugccg

SEQ ID NO: 798134 - RNA, 22 nt, Human
guacuaaaaaaugaucaguuug

SEQ ID NO: 798135 - RNA, 22 nt, Human
gaucaggacauagcuauaggcu

SEQ ID NO: 798136 - RNA, 22 nt, Human
auguuuuaaauauguguguaaa

SEQ ID NO: 798137 - RNA, 22 nt, Human
ugccugggacuguacuaaauuu

SEQ ID NO: 798138 - RNA, 22 nt, Human
uaauauauuucugcuaagcuca

SEQ ID NO: 798139 - RNA, 22 nt, Human
aaauguuucuacuugugagcau

SEQ ID NO: 798140 - RNA, 22 nt, Human
ccuggagguggagguugcagug

SEQ ID NO: 798141 - RNA, 22 nt, Human
ucauuauuugcuuuaguuaugu

SEQ ID NO: 798142 - RNA, 22 nt, Human
ugcucugaaggggaagggaugg

SEQ ID NO: 798143 - RNA, 22 nt, Human
ugucauuuuagugcaucacuca

SEQ ID NO: 798144 - RNA, 19 nt, Human
cuuccccuguuaccucacu

SEQ ID NO: 798145 - RNA, 22 nt, Human
uagcuuuguuagaaugucuuca

SEQ ID NO: 798146 - RNA, 22 nt, Human
uuucauugucagagcuuugaau

SEQ ID NO: 798147 - RNA, 22 nt, Human
ugguggccuugauggcaucugc

SEQ ID NO: 798148 - RNA, 22 nt, Human
ccucagggaaugggaggcuggg

SEQ ID NO: 798149 - RNA, 22 nt, Human
aauauagauuuacucaagagaa

SEQ ID NO: 798150 - RNA, 22 nt, Human
ucaggcagguuggcugcagguc

SEQ ID NO: 798151 - RNA, 22 nt, Human
caggcucagcucuggccagugc

SEQ ID NO: 798152 - RNA, 22 nt, Human
cagcccaguaccaagcaguugg

SEQ ID NO: 798153 - RNA, 22 nt, Human
uccucuccauauuuucugauuu

SEQ ID NO: 798154 - RNA, 22 nt, Human
cacagugaagcaugcagacauc

SEQ ID NO: 798155 - RNA, 22 nt, Human
cccuuuaaggucugauuuucag

SEQ ID NO: 798156 - RNA, 22 nt, Human
acauucugucaacagugagcag

SEQ ID NO: 798157 - RNA, 22 nt, Human
uugguucagaugggaucugcga

SEQ ID NO: 798158 - RNA, 22 nt, Human
ucacaucauggagaauuauggg

SEQ ID NO: 798159 - RNA, 22 nt, Human
ucacauuuuguucaaggcuagu

SEQ ID NO: 798160 - RNA, 20 nt, Human
ucaugcaagauucauaaagg

SEQ ID NO: 798161 - RNA, 23 nt, Human
cauaugaauuuuagaggcaguuu

SEQ ID NO: 798162 - RNA, 22 nt, Human
augauguaaauagagccuaggu

SEQ ID NO: 798163 - RNA, 22 nt, Human
cacagggcuucucauggggugc

SEQ ID NO: 798164 - RNA, 22 nt, Human
ugcaauaaagugcuauaaaucc

SEQ ID NO: 798165 - RNA, 22 nt, Human
caggccaggguugagaagagaa

SEQ ID NO: 798166 - RNA, 22 nt, Human
caaauaguuuuucauguauuau

SEQ ID NO: 798167 - RNA, 22 nt, Human
agccaagaggagccuaaagcga

SEQ ID NO: 798168 - RNA, 23 nt, Human
uugggaaauaguuaagacaugag

SEQ ID NO: 798169 - RNA, 22 nt, Human
ugggggaguauagucuggccuc

SEQ ID NO: 798170 - RNA, 17 nt, Human
ugaaggaaggaugaugu

SEQ ID NO: 798171 - RNA, 22 nt, Human
ucccagccauuccuuuaggugu

SEQ ID NO: 798172 - RNA, 21 nt, Human
ucugucuuccucagccuaagg

SEQ ID NO: 798173 - RNA, 22 nt, Human
uacauucuauaucuguuacauc

SEQ ID NO: 798174 - RNA, 22 nt, Human
cucaagucagaaauaaaagcau

SEQ ID NO: 798175 - RNA, 22 nt, Human
ucugagcuucugccugcugcaa

SEQ ID NO: 798176 - RNA, 22 nt, Human
uuucugaaaugcuggcuuugga

SEQ ID NO: 798177 - RNA, 22 nt, Human
aggcuggcuggcaggggacaca

SEQ ID NO: 798178 - RNA, 23 nt, Human
ugcaaauaccaugcuguccuguc

SEQ ID NO: 798179 - RNA, 19 nt, Human
cagaugagaaaagugaggu

SEQ ID NO: 798180 - RNA, 22 nt, Human
gagaggcugacuggcuguccug

SEQ ID NO: 798181 - RNA, 22 nt, Human
ucaggagcugugaauacaaagg

SEQ ID NO: 798182 - RNA, 22 nt, Human
ggcuuaaaaggaaaaugagagu

SEQ ID NO: 798183 - RNA, 22 nt, Human
gcagagaaaguuuuguccucag

SEQ ID NO: 798184 - RNA, 22 nt, Human
ugaacuucagugcauaauuauc

SEQ ID NO: 798185 - RNA, 18 nt, Human
cugccugcucuccagcuu

SEQ ID NO: 798186 - RNA, 22 nt, Human
agauaacauuuauugaauguaa

SEQ ID NO: 798187 - RNA, 22 nt, Human
cagcuguguaaacacaugugua

SEQ ID NO: 798188 - RNA, 22 nt, Human
gcacacagagaggugguauguc

SEQ ID NO: 798189 - RNA, 22 nt, Human
aacaggaaugaggagaaaaggu

SEQ ID NO: 798190 - RNA, 22 nt, Human
ccaugcugacccugugcaggca

SEQ ID NO: 798191 - RNA, 22 nt, Human
uacaugcauguguguaaauaua

SEQ ID NO: 798192 - RNA, 22 nt, Human
aaaaugagacacaugugacucc

SEQ ID NO: 798193 - RNA, 22 nt, Human
ugcuauuuaacuuuuaugugua

SEQ ID NO: 798194 - RNA, 22 nt, Human
acugcagccuagggaccacagu

SEQ ID NO: 798195 - RNA, 22 nt, Human
ggucuggaauggaguaggggug

SEQ ID NO: 798196 - RNA, 22 nt, Human
ggcagcuuucaccugucuuccu

SEQ ID NO: 798197 - RNA, 22 nt, Human
ucaguguccggagccugagugc

SEQ ID NO: 798198 - RNA, 22 nt, Human
gacaggaaauauggggguuguu

SEQ ID NO: 798199 - RNA, 22 nt, Human
acggugaccaagcaucaccgag

SEQ ID NO: 798200 - RNA, 22 nt, Human
ugggugagggacaaaaguuucu

SEQ ID NO: 798201 - RNA, 22 nt, Human
cugugccagccugucccaggag

SEQ ID NO: 798202 - RNA, 22 nt, Human
cagccuuuauggaaaggccugg

SEQ ID NO: 798203 - RNA, 22 nt, Human
ugcagagauagaacuacuuucu

SEQ ID NO: 798204 - RNA, 22 nt, Human
aggaugaggcuggcaggucuug

SEQ ID NO: 798205 - RNA, 22 nt, Human
cuccuuaaguaugggcugugca

SEQ ID NO: 798206 - RNA, 21 nt, Human
uuucuggguggcugcauagug

SEQ ID NO: 798207 - RNA, 22 nt, Human
ucucuuuaaguauaaucuuaua

SEQ ID NO: 798208 - RNA, 22 nt, Human
gccaccagccccaugcgcugug

SEQ ID NO: 798209 - RNA, 22 nt, Human
cuccauggaaccggggcugcuu

SEQ ID NO: 798210 - RNA, 22 nt, Human
caauuuuuguacuuauaguacu

SEQ ID NO: 798211 - RNA, 22 nt, Human
uuuaaugaggucucucgcuggc

SEQ ID NO: 798212 - RNA, 22 nt, Human
acaugucuuuuaaagucuaaua

SEQ ID NO: 798213 - RNA, 22 nt, Human
ccuuaaaagaacuaucucuucu

SEQ ID NO: 798214 - RNA, 23 nt, Human
ggcugagaagucccaugauaggu

SEQ ID NO: 798215 - RNA, 22 nt, Human
ugggccaguuucucauugaaau

SEQ ID NO: 798216 - RNA, 22 nt, Human
agccugcuugagaguccuggcu

SEQ ID NO: 798217 - RNA, 22 nt, Human
gcuccuggugcuguagagauuu

SEQ ID NO: 798218 - RNA, 22 nt, Human
aaaauacacauacuaggggaaa

SEQ ID NO: 798219 - RNA, 22 nt, Human
uacaaagucccauugccaugga

SEQ ID NO: 798220 - RNA, 22 nt, Human
uccugccucuugccuucuucac

SEQ ID NO: 798221 - RNA, 18 nt, Human
uuacuguuaucaaaacag

SEQ ID NO: 798222 - RNA, 22 nt, Human
ggcucaggaugagccuucucau

SEQ ID NO: 798223 - RNA, 22 nt, Human
gccaggaggggagaguguguca

SEQ ID NO: 798224 - RNA, 22 nt, Human
cugcccugagucaugccagaug

SEQ ID NO: 798225 - RNA, 22 nt, Human
auguauaugaagcuaguauuuu

SEQ ID NO: 798226 - RNA, 22 nt, Human
aggagguguugauagaagguuu

SEQ ID NO: 798227 - RNA, 22 nt, Human
gaggccuggcugggaggaggug

SEQ ID NO: 798228 - RNA, 22 nt, Human
auaauacaugguuaaccucuuu

SEQ ID NO: 798229 - RNA, 22 nt, Human
uuuagacaggggcaaaauaagg

SEQ ID NO: 798230 - RNA, 22 nt, Human
auuguauuuguacaagacaugu

SEQ ID NO: 798231 - RNA, 22 nt, Human
guccagcccucugccuccaggu

SEQ ID NO: 798232 - RNA, 22 nt, Human
acaguaaacaaugcagcaaauu

SEQ ID NO: 798233 - RNA, 22 nt, Human
aggccugaaguguggagugggg

SEQ ID NO: 798234 - RNA, 19 nt, Human
aaauacagcagcuguuucc

SEQ ID NO: 798235 - RNA, 22 nt, Human
ugucuuuguguacaggaucgcc

SEQ ID NO: 798236 - RNA, 22 nt, Human
uugcugauuuguuucuauucca

SEQ ID NO: 798237 - RNA, 22 nt, Human
aagcccuuuucaagauacaaca

SEQ ID NO: 798238 - RNA, 22 nt, Human
uguuaggacuccccagaagcug

SEQ ID NO: 798239 - RNA, 20 nt, Human
uuucacaucugucccuuuaa

SEQ ID NO: 798240 - RNA, 22 nt, Human
aggcaggcugcuauggaguaga

SEQ ID NO: 798241 - RNA, 22 nt, Human
auguuuuauuaccaacuuguac

SEQ ID NO: 798242 - RNA, 22 nt, Human
aacagaggcucccugcacuugu

SEQ ID NO: 798243 - RNA, 22 nt, Human
auauuuuccgaacuugagguag

SEQ ID NO: 798244 - RNA, 22 nt, Human
gccucagagggcccuagggaca

SEQ ID NO: 798245 - RNA, 23 nt, Human
ugcagagggacugaagccagcuu

SEQ ID NO: 798246 - RNA, 22 nt, Human
ggcccaguguaccccaggcagu

SEQ ID NO: 798247 - RNA, 22 nt, Human
cuggaauguucuccagcauggc

SEQ ID NO: 798248 - RNA, 22 nt, Human
aaucaggaggaagccuugggca

SEQ ID NO: 798249 - RNA, 22 nt, Human
agagggcauaaaauagagcacg

SEQ ID NO: 798250 - RNA, 22 nt, Human
accugcaagcauuacacuucua

SEQ ID NO: 798251 - RNA, 22 nt, Human
agccaagagaugaggcugcagg

SEQ ID NO: 798252 - RNA, 22 nt, Human
uccugccucuccaugcuaacua

SEQ ID NO: 798253 - RNA, 22 nt, Human
cacagcagggaugaauggagug

SEQ ID NO: 798254 - RNA, 23 nt, Human
gcacugggcucucagcaaggugu

SEQ ID NO: 798255 - RNA, 22 nt, Human
aaagugcaguaacuugcccaag

SEQ ID NO: 798256 - RNA, 22 nt, Human
ucuaaacucucuuugaauuaug

SEQ ID NO: 798257 - RNA, 22 nt, Human
uagagagguuugaauuggcugc

SEQ ID NO: 798258 - RNA, 22 nt, Human
uggcaggguggcaacuuuuggu

SEQ ID NO: 798259 - RNA, 22 nt, Human
uggcucagaugcucuuccagug

SEQ ID NO: 798260 - RNA, 22 nt, Human
guaaaugugcuaaaaugugucg

SEQ ID NO: 798261 - RNA, 22 nt, Human
ucaggaagugcugaggcugcuu

SEQ ID NO: 798262 - RNA, 18 nt, Human
caagaaucucuaaagaag

SEQ ID NO: 798263 - RNA, 22 nt, Human
uuucugaagguuaaggaauuag

SEQ ID NO: 798264 - RNA, 22 nt, Human
aacaauaauugcgguucucuau

SEQ ID NO: 798265 - RNA, 22 nt, Human
ccugauggcugucugggccuga

SEQ ID NO: 798266 - RNA, 22 nt, Human
gggcccagcgugguuccaucug

SEQ ID NO: 798267 - RNA, 22 nt, Human
cagaaauauuuauugagugaca

SEQ ID NO: 798268 - RNA, 22 nt, Human
cuuguauagggaaagauaaauc

SEQ ID NO: 798269 - RNA, 22 nt, Human
uaaagcaaggaauagaguaguc

SEQ ID NO: 798270 - RNA, 22 nt, Human
uccucaggaucuaggagugcuu

SEQ ID NO: 798271 - RNA, 22 nt, Human
gccucaggccuauagcugcugu

SEQ ID NO: 798272 - RNA, 22 nt, Human
gccagagggauuccuggugugu

SEQ ID NO: 798273 - RNA, 22 nt, Human
cccuggacuguucagggccuga

SEQ ID NO: 798274 - RNA, 22 nt, Human
agcagcuuguuaaaaaguucca

SEQ ID NO: 798275 - RNA, 22 nt, Human
uccaggaguccuggguggcccc

SEQ ID NO: 798276 - RNA, 22 nt, Human
uagaauguggagguaacagacu

SEQ ID NO: 798277 - RNA, 22 nt, Human
uggacagggcagagaccgaguc

SEQ ID NO: 798278 - RNA, 22 nt, Human
uggcccaggcgaggugggcaga

SEQ ID NO: 798279 - RNA, 22 nt, Human
agggcagacuaggauggaagug

SEQ ID NO: 798280 - RNA, 22 nt, Human
uauugauaugcagaacugacuu

SEQ ID NO: 798281 - RNA, 22 nt, Human
gaggccagaguuccccgaguca

SEQ ID NO: 798282 - RNA, 22 nt, Human
aucacagugccuucguaaauuu

SEQ ID NO: 798283 - RNA, 22 nt, Human
uuuaucaucuuguuuuuaaagc

SEQ ID NO: 798284 - RNA, 22 nt, Human
cccaggagagagacuugaaucu

SEQ ID NO: 798285 - RNA, 22 nt, Human
ugcuucuaaucuacugcauuag

SEQ ID NO: 798286 - RNA, 22 nt, Human
cugugcagugugggguaggccu

SEQ ID NO: 798287 - RNA, 22 nt, Human
gccaccccaaccucccuaaguu

SEQ ID NO: 798288 - RNA, 22 nt, Human
ccauaaucguguguuaaauaau

SEQ ID NO: 798289 - RNA, 22 nt, Human
ugauucaucagaauaggaguuu

SEQ ID NO: 798290 - RNA, 22 nt, Human
ucccagcuuagauuugcucauu

SEQ ID NO: 798291 - RNA, 22 nt, Human
cagucucuuuauccaccaagcc

SEQ ID NO: 798292 - RNA, 22 nt, Human
agcacuuuagaauuuagaguug

SEQ ID NO: 798293 - RNA, 22 nt, Human
uaaaggccaugauggaggauca

SEQ ID NO: 798294 - RNA, 20 nt, Human
agacaaaaugacuucaugca

SEQ ID NO: 798295 - RNA, 22 nt, Human
cccugaggggaguggugaggug

SEQ ID NO: 798296 - RNA, 22 nt, Human
gugccagaagguucccgcugca

SEQ ID NO: 798297 - RNA, 22 nt, Human
gcugccugaucauacaccaggg

SEQ ID NO: 798298 - RNA, 22 nt, Human
ucuaauuuuaggcauuuguuca

SEQ ID NO: 798299 - RNA, 22 nt, Human
aaagccagcaaggugaguuuca

SEQ ID NO: 798300 - RNA, 22 nt, Human
caguuaaacgggccaugugagu

SEQ ID NO: 798301 - RNA, 22 nt, Human
cuggagggacaagguaugcauu

SEQ ID NO: 798302 - RNA, 22 nt, Human
guccaggcugcccaggguccug

SEQ ID NO: 798303 - RNA, 21 nt, Human
ggccacaguuagggcucagga

SEQ ID NO: 798304 - RNA, 19 nt, Human
augacucuuauugucugaa

SEQ ID NO: 798305 - RNA, 22 nt, Human
aggcacuuguaauugcagucau

SEQ ID NO: 798306 - RNA, 22 nt, Human
ugggagcacccugaggagcuuc

SEQ ID NO: 798307 - RNA, 22 nt, Human
ugccucagucuaaagucucuca

SEQ ID NO: 798308 - RNA, 22 nt, Human
cucucuggcuuggcacggagau

SEQ ID NO: 798309 - RNA, 22 nt, Human
ugauuuuuagcuauucugaaga

SEQ ID NO: 798310 - RNA, 22 nt, Human
agugcauucugucaucuugguu

SEQ ID NO: 798311 - RNA, 22 nt, Human
agcauuuucugagaguauagau

SEQ ID NO: 798312 - RNA, 22 nt, Human
ugauuuacacaccuaugauuua

SEQ ID NO: 798313 - RNA, 22 nt, Human
ccagugucagaaagauuauccu

SEQ ID NO: 798314 - RNA, 22 nt, Human
accugcugucuugggggaaugc

SEQ ID NO: 798315 - RNA, 22 nt, Human
gagcucuuagauagggcaggaa

SEQ ID NO: 798316 - RNA, 22 nt, Human
ggcaggcaggucuucauggccc

SEQ ID NO: 798317 - RNA, 22 nt, Human
ugcacuuuuauaucacucuggc

SEQ ID NO: 798318 - RNA, 21 nt, Human
acaggcucuggggaugcuggg

SEQ ID NO: 798319 - RNA, 22 nt, Human
guggcucuaggugagcauggag

SEQ ID NO: 798320 - RNA, 22 nt, Human
acucucaaauauuaaucuuugg

SEQ ID NO: 798321 - RNA, 20 nt, Human
aaaugcagggcugcugcgga

SEQ ID NO: 798322 - RNA, 23 nt, Human
gauucacagggugguuuaugggg

SEQ ID NO: 798323 - RNA, 22 nt, Human
aggcuucgcaagguuagagcug

SEQ ID NO: 798324 - RNA, 22 nt, Human
cagagcagaagcgguccucaca

SEQ ID NO: 798325 - RNA, 21 nt, Human
ggguccugggaugggauccag

SEQ ID NO: 798326 - RNA, 22 nt, Human
ugcaauaauguaugucacuccc

SEQ ID NO: 798327 - RNA, 22 nt, Human
aagagcaguguuuuacucagcu

SEQ ID NO: 798328 - RNA, 22 nt, Human
gccaggcuggugucacaacucu

SEQ ID NO: 798329 - RNA, 22 nt, Human
ugcccucagcagcagcuccugc

SEQ ID NO: 798330 - RNA, 22 nt, Human
agcuuugauaguacaggggcuu

SEQ ID NO: 798331 - RNA, 22 nt, Human
uaaggcucauguaauuagagau

SEQ ID NO: 798332 - RNA, 22 nt, Human
agaaccauuuugacagauauac

SEQ ID NO: 798333 - RNA, 22 nt, Human
cuucucuugguaguucuuguug

SEQ ID NO: 798334 - RNA, 22 nt, Human
ucucuuggaacacuugcucuua

SEQ ID NO: 798335 - RNA, 19 nt, Human
gcuugcuggcgggggucug

SEQ ID NO: 798336 - RNA, 22 nt, Human
ccaggcugaauauguuccaggg

SEQ ID NO: 798337 - RNA, 22 nt, Human
caauuuuacucuuccucuucca

SEQ ID NO: 798338 - RNA, 21 nt, Human
agggcacccccgcugccuacc

SEQ ID NO: 798339 - RNA, 22 nt, Human
ugaaugauacagaauuauguag

SEQ ID NO: 798340 - RNA, 22 nt, Human
uucauucauguauugucuaugg

SEQ ID NO: 798341 - RNA, 22 nt, Human
caggcacaguguugcuguucaa

SEQ ID NO: 798342 - RNA, 22 nt, Human
uacauacaagauguguuuaaaa

SEQ ID NO: 798343 - RNA, 22 nt, Human
uucaaaguugcaugacagcuua

SEQ ID NO: 798344 - RNA, 22 nt, Human
aggcacagccucccuucacaug

SEQ ID NO: 798345 - RNA, 22 nt, Human
ugccaggacaaggaccacaugg

SEQ ID NO: 798346 - RNA, 22 nt, Human
cagcccagacaccaucauucua

SEQ ID NO: 798347 - RNA, 22 nt, Human
uucuucuugaaacuuuagguug

SEQ ID NO: 798348 - RNA, 22 nt, Human
aggaaauuuugaaucagugucu

SEQ ID NO: 798349 - RNA, 22 nt, Human
cucuuuggucgcaucauccauu

SEQ ID NO: 798350 - RNA, 22 nt, Human
ugcaaauuccauuuaaacacua

SEQ ID NO: 798351 - RNA, 18 nt, Human
auggaggcagagagcuga

SEQ ID NO: 798352 - RNA, 22 nt, Human
aagugugggacuagggcuccag

SEQ ID NO: 798353 - RNA, 22 nt, Human
agugucaauucucaaaucucgg

SEQ ID NO: 798354 - RNA, 22 nt, Human
guucugggaagguggaccuguu

SEQ ID NO: 798355 - RNA, 22 nt, Human
uucuaguguccuuggacuugcu

SEQ ID NO: 798356 - RNA, 19 nt, Human
cuccucagucccagagguc

SEQ ID NO: 798357 - RNA, 22 nt, Human
gcuaggugcagcagacagcuua

SEQ ID NO: 798358 - RNA, 22 nt, Human
uugcaugugugcauauauuugc

SEQ ID NO: 798359 - RNA, 22 nt, Human
aggcuggcagccaccucagcag

SEQ ID NO: 798360 - RNA, 22 nt, Human
uaaggcaggaacuggcuguuuu

SEQ ID NO: 798361 - RNA, 22 nt, Human
cuggcagagucugcugucugca

SEQ ID NO: 798362 - RNA, 23 nt, Human
aggaagaggcaauuucucuuaga

SEQ ID NO: 798363 - RNA, 22 nt, Human
guccucuguguaggcugcagac

SEQ ID NO: 798364 - RNA, 22 nt, Human
uucuuugggcaauugcuggccc

SEQ ID NO: 798365 - RNA, 22 nt, Human
ggcugccccaugggcugggcug

SEQ ID NO: 798366 - RNA, 18 nt, Human
gguggcggggauggaggu

SEQ ID NO: 798367 - RNA, 22 nt, Human
ucaggcugccuaucagacugug

SEQ ID NO: 798368 - RNA, 22 nt, Human
ccagcuccucuucccaguguca

SEQ ID NO: 798369 - RNA, 22 nt, Human
auccagugagugcagcuguugu

SEQ ID NO: 798370 - RNA, 22 nt, Human
ugccaggagagugcaugcaggg

SEQ ID NO: 798371 - RNA, 22 nt, Human
acaguucaagacaucaguauga

SEQ ID NO: 798372 - RNA, 22 nt, Human
gaacagcuucuugggagcuggg

SEQ ID NO: 798373 - RNA, 22 nt, Human
auauuugcaggaaacuaguuuu

SEQ ID NO: 798374 - RNA, 22 nt, Human
acuggcagagacccugauggcc

SEQ ID NO: 798375 - RNA, 22 nt, Human
uggggugugagaaguagaggga

SEQ ID NO: 798376 - RNA, 22 nt, Human
caggcagacauuuuugacauag

SEQ ID NO: 798377 - RNA, 22 nt, Human
gggguagggcgauugcugcuuu

SEQ ID NO: 798378 - RNA, 19 nt, Human
uucagaauugggaggugau

SEQ ID NO: 798379 - RNA, 22 nt, Human
uacacaucucugucaguaguga

SEQ ID NO: 798380 - RNA, 22 nt, Human
agcuuuaaaucaauccagugag

SEQ ID NO: 798381 - RNA, 22 nt, Human
uggcaggguuggccaccuuacc

SEQ ID NO: 798382 - RNA, 22 nt, Human
aaagauuuaagaauaauuugug

SEQ ID NO: 798383 - RNA, 22 nt, Human
acauuuaaugauccuacuguga

SEQ ID NO: 798384 - RNA, 22 nt, Human
cccuuuccugaagaauauuuuu

SEQ ID NO: 798385 - RNA, 22 nt, Human
cuggcaggcaaauuggugggag

SEQ ID NO: 798386 - RNA, 22 nt, Human
ugugggaggaacacagccagaa

SEQ ID NO: 798387 - RNA, 22 nt, Human
ucaggcuggaaugcaguggggc

SEQ ID NO: 798388 - RNA, 22 nt, Human
cuggcaggucucgcugacgugu

SEQ ID NO: 798389 - RNA, 22 nt, Human
agugcuucuggugggcgugagg

SEQ ID NO: 798390 - RNA, 22 nt, Human
cuggcugguaauggaacgacag

SEQ ID NO: 798391 - RNA, 22 nt, Human
gagucagaccgacugggcucau

SEQ ID NO: 798392 - RNA, 22 nt, Human
aggggagcgacauuccgugccg

SEQ ID NO: 798393 - RNA, 22 nt, Human
uccucacagaguggcaggcaau

SEQ ID NO: 798394 - RNA, 22 nt, Human
auuuugcacacuaugcagcuuu

SEQ ID NO: 798395 - RNA, 22 nt, Human
uuugugcacuucuguagcugcc

SEQ ID NO: 798396 - RNA, 22 nt, Human
gcucuuggucucagccucugaa

SEQ ID NO: 798397 - RNA, 22 nt, Human
caugcagugaugcacugcauca

SEQ ID NO: 798398 - RNA, 22 nt, Human
uuugcaaacacuuaagaagaga

SEQ ID NO: 798399 - RNA, 22 nt, Human
uuucauaauacuguacaugaaa

SEQ ID NO: 798400 - RNA, 22 nt, Human
uuccaggaagcucucggccucu

SEQ ID NO: 798401 - RNA, 22 nt, Human
ugcacacacaugaaguagcaug

SEQ ID NO: 798402 - RNA, 22 nt, Human
gcuguccuuccuggcuggggug

SEQ ID NO: 798403 - RNA, 22 nt, Human
auaaggaaguugcagaagugga

SEQ ID NO: 798404 - RNA, 22 nt, Human
gcaggagcagucaggggcagcu

SEQ ID NO: 798405 - RNA, 22 nt, Human
gagccaagcaauauacccaacc

SEQ ID NO: 798406 - RNA, 22 nt, Human
gccccagccugggaacuggagg

SEQ ID NO: 798407 - RNA, 22 nt, Human
ccagcuugaagaugugcugguu

SEQ ID NO: 798408 - RNA, 22 nt, Human
aggucccagucugugaugacuc

SEQ ID NO: 798409 - RNA, 22 nt, Human
uuuaucacagaauaagaaguca

SEQ ID NO: 798410 - RNA, 22 nt, Human
ggcugccuucauagaccauggg

SEQ ID NO: 798411 - RNA, 22 nt, Human
uggcuggaccugggcuggaauu

SEQ ID NO: 798412 - RNA, 22 nt, Human
ucuucaauauguguuuaauauu

SEQ ID NO: 798413 - RNA, 22 nt, Human
agggauggaucuuggcccugga

SEQ ID NO: 798414 - RNA, 22 nt, Human
agcugaaaauuagugauaguuu

SEQ ID NO: 798415 - RNA, 22 nt, Human
cacaccagauggcagcguggga

SEQ ID NO: 798416 - RNA, 22 nt, Human
ugcccugggcuuugcuaugacu

SEQ ID NO: 798417 - RNA, 22 nt, Human
uagaaagucaaaacacuguguu

SEQ ID NO: 798418 - RNA, 22 nt, Human
uggugccacuucuuaggcuggu

SEQ ID NO: 798419 - RNA, 22 nt, Human
agaaaagcggucaggacccuca

SEQ ID NO: 798420 - RNA, 22 nt, Human
uguaaagauccuuagcaacauc

SEQ ID NO: 798421 - RNA, 22 nt, Human
augucucuuuagagcaacagua

SEQ ID NO: 798422 - RNA, 19 nt, Human
gauauaaagagauggugaa

SEQ ID NO: 798423 - RNA, 22 nt, Human
uuucucagcucagcaucugggu

SEQ ID NO: 798424 - RNA, 22 nt, Human
aggcuguccaagguggcgaagu

SEQ ID NO: 798425 - RNA, 21 nt, Human
caauuacagauggcucagggg

SEQ ID NO: 798426 - RNA, 22 nt, Human
agguccugggaguucuagugug

SEQ ID NO: 798427 - RNA, 22 nt, Human
uucauuugaguuuauaguugcu

SEQ ID NO: 798428 - RNA, 22 nt, Human
gaaacauucagucaacaguguu

SEQ ID NO: 798429 - RNA, 22 nt, Human
aguguaucaugguuggcagaca

SEQ ID NO: 798430 - RNA, 22 nt, Human
ucacaguuuuagaaaauagaua

SEQ ID NO: 798431 - RNA, 22 nt, Human
agcugccacagagccuggccag

SEQ ID NO: 798432 - RNA, 22 nt, Human
uaucaggacuucauuccuuuua

SEQ ID NO: 798433 - RNA, 22 nt, Human
ccacagugaucccugccugcga

SEQ ID NO: 798434 - RNA, 22 nt, Human
agccugagcugccugccgccuc

SEQ ID NO: 798435 - RNA, 22 nt, Human
aucacagauuugauacuuuugu

SEQ ID NO: 798436 - RNA, 18 nt, Human
ucaaagucuggcuccacu

SEQ ID NO: 798437 - RNA, 22 nt, Human
aaugaauguuuguugagugaag

SEQ ID NO: 798438 - RNA, 22 nt, Human
guguuucccuggcacaagaacc

SEQ ID NO: 798439 - RNA, 22 nt, Human
cugcagcuauauuuucccacag

SEQ ID NO: 798440 - RNA, 22 nt, Human
ggguggaauuguuggcaucgga

SEQ ID NO: 798441 - RNA, 22 nt, Human
uuuagagagaaauaaaugagau

SEQ ID NO: 798442 - RNA, 22 nt, Human
ucaagauguccagugccuauaa

SEQ ID NO: 798443 - RNA, 22 nt, Human
gcuuagagcagcucacaacaug

SEQ ID NO: 798444 - RNA, 22 nt, Human
guuacaaacucaggugccaaaa

SEQ ID NO: 798445 - RNA, 22 nt, Human
uauaccuuuaccuugaccaaau

SEQ ID NO: 798446 - RNA, 22 nt, Human
uuucagagagaucaacauagcu

SEQ ID NO: 798447 - RNA, 22 nt, Human
agcagcacacgggagaaagaca

SEQ ID NO: 798448 - RNA, 22 nt, Human
uucaauguuaagaagaauaugu

SEQ ID NO: 798449 - RNA, 22 nt, Human
aagauuuacuuucuuuguaaua

SEQ ID NO: 798450 - RNA, 22 nt, Human
gcccaagcagcuucccgagcuu

SEQ ID NO: 798451 - RNA, 22 nt, Human
uuugcuauugugaauagugcca

SEQ ID NO: 798452 - RNA, 22 nt, Human
ugcaauguguuagaugguuuua

SEQ ID NO: 798453 - RNA, 22 nt, Human
aagcugccuagaguugaauguc

SEQ ID NO: 798454 - RNA, 19 nt, Human
gcagccaggugcucuaccu

SEQ ID NO: 798455 - RNA, 22 nt, Human
aguuuccaggcaggagcuaauu

SEQ ID NO: 798456 - RNA, 22 nt, Human
agcugcagcccuccugcauggc

SEQ ID NO: 798457 - RNA, 22 nt, Human
auuucugugcaguaaaugguga

SEQ ID NO: 798458 - RNA, 22 nt, Human
uuaagauuuucuucaguauuau

SEQ ID NO: 798459 - RNA, 22 nt, Human
uauuuauuggacaguguugcug

SEQ ID NO: 798460 - RNA, 22 nt, Human
uuuggauugcuuggaugcuucg

SEQ ID NO: 798461 - RNA, 17 nt, Human
ugacuuuauuugcuugg

SEQ ID NO: 798462 - RNA, 22 nt, Human
agcuggccauugugaguggccu

SEQ ID NO: 798463 - RNA, 21 nt, Human
cugucccucuuugcuucccuc

SEQ ID NO: 798464 - RNA, 22 nt, Human
auugcuaggaacagguugcacc

SEQ ID NO: 798465 - RNA, 22 nt, Human
gagagcuggguucaaguagcug

SEQ ID NO: 798466 - RNA, 22 nt, Human
cccaggaguuagagguuguggu

SEQ ID NO: 798467 - RNA, 22 nt, Human
uccuggagcuggugucuuuccc

SEQ ID NO: 798468 - RNA, 19 nt, Human
agaggcaaggguggaagua

SEQ ID NO: 798469 - RNA, 22 nt, Human
uaaaguggaaggauccacuaag

SEQ ID NO: 798470 - RNA, 22 nt, Human
aaaugcuucaccucauuaaacu

SEQ ID NO: 798471 - RNA, 22 nt, Human
uccagaggugaacacccaggca

SEQ ID NO: 798472 - RNA, 22 nt, Human
aauagagucaguucuacauucu

SEQ ID NO: 798473 - RNA, 22 nt, Human
auaaacuauguaauuugcucua

SEQ ID NO: 798474 - RNA, 22 nt, Human
cauacaagcguucaauagaugu

SEQ ID NO: 798475 - RNA, 22 nt, Human
ugagcccaggaguaugaggcug

SEQ ID NO: 798476 - RNA, 22 nt, Human
agaggccaugcuagaggccugg

SEQ ID NO: 798477 - RNA, 22 nt, Human
gcaagcaaauuauuuauaggca

SEQ ID NO: 798478 - RNA, 22 nt, Human
auuaaauuggacgcugggggaa

SEQ ID NO: 798479 - RNA, 22 nt, Human
aggacaguguggaagagggugc

SEQ ID NO: 798480 - RNA, 22 nt, Human
ugagcagauggaggcuucugca

SEQ ID NO: 798481 - RNA, 22 nt, Human
uacaaacuguuauuauuauugu

SEQ ID NO: 798482 - RNA, 22 nt, Human
aaauguucuacuuugauaauua

SEQ ID NO: 798483 - RNA, 22 nt, Human
aggugcaggagcugugcaggga

SEQ ID NO: 798484 - RNA, 18 nt, Human
ggcacuggugaugcagag

SEQ ID NO: 798485 - RNA, 22 nt, Human
acacaguaggccaccaugucau

SEQ ID NO: 798486 - RNA, 22 nt, Human
cuucuaggcuucucagggggca

SEQ ID NO: 798487 - RNA, 22 nt, Human
uuuacagauguggaaagugagc

SEQ ID NO: 798488 - RNA, 20 nt, Human
auucacauauaccagggagg

SEQ ID NO: 798489 - RNA, 22 nt, Human
uuuagguuaaucaacaaacauu

SEQ ID NO: 798490 - RNA, 22 nt, Human
agugcuggauuacaggcgugag

SEQ ID NO: 798491 - RNA, 22 nt, Human
uuguguuuucuuauggcauaaa

SEQ ID NO: 798492 - RNA, 22 nt, Human
ccucaagaacaauccaccauua

SEQ ID NO: 798493 - RNA, 22 nt, Human
uugcagagaucagcagguuuga

SEQ ID NO: 798494 - RNA, 22 nt, Human
gagguggccucaagcagucuuc

SEQ ID NO: 798495 - RNA, 22 nt, Human
aauaagauuacugguugucuga

SEQ ID NO: 798496 - RNA, 22 nt, Human
ucagcuccucaugcaggggaua

SEQ ID NO: 798497 - RNA, 22 nt, Human
ucacaguauaaccucauauagg

SEQ ID NO: 798498 - RNA, 22 nt, Human
ugccuggguucccaccccaaag

SEQ ID NO: 798499 - RNA, 22 nt, Human
gaggaagcagggcuuggcugag

SEQ ID NO: 798500 - RNA, 18 nt, Human
ugaacuuuggugucucuc

SEQ ID NO: 798501 - RNA, 22 nt, Human
acaaaauuaccuaguuauuuuc

SEQ ID NO: 798502 - RNA, 22 nt, Human
augcugggaaguccuaaccaca

SEQ ID NO: 798503 - RNA, 22 nt, Human
guuuacuguuuucugauaagug

SEQ ID NO: 798504 - RNA, 22 nt, Human
cuuggcugucauaagguccugg

SEQ ID NO: 798505 - RNA, 22 nt, Human
ccagauguuccccuggaggccu

SEQ ID NO: 798506 - RNA, 22 nt, Human
gcccuagggggaaccgaggacu

SEQ ID NO: 798507 - RNA, 22 nt, Human
ucucuuggugacuuaaaauguu

SEQ ID NO: 798508 - RNA, 22 nt, Human
gcucagcuacuuacagguggcu

SEQ ID NO: 798509 - RNA, 22 nt, Human
aggcuucaguuguaccuucuug

SEQ ID NO: 798510 - RNA, 22 nt, Human
ccugugccauccugagcauccc

SEQ ID NO: 798511 - RNA, 22 nt, Human
uuucucauagucaugccucuua

SEQ ID NO: 798512 - RNA, 22 nt, Human
ugaucugaaggacaugggaccc

SEQ ID NO: 798513 - RNA, 22 nt, Human
aaaaguguccagauuaugaaga

SEQ ID NO: 798514 - RNA, 22 nt, Human
gugccagagacaugacuagcug

SEQ ID NO: 798515 - RNA, 22 nt, Human
uugcaaauuccaauccaauauu

SEQ ID NO: 798516 - RNA, 22 nt, Human
aaaggcuuuugguauauaggag

SEQ ID NO: 798517 - RNA, 22 nt, Human
ccagccagcugguuggacgccu

SEQ ID NO: 798518 - RNA, 22 nt, Human
acccaggcagcaggagcuaaag

SEQ ID NO: 798519 - RNA, 22 nt, Human
acugagaagcucgcagugaugc

SEQ ID NO: 798520 - RNA, 22 nt, Human
cuaggcaaaguauuaaugagug

SEQ ID NO: 798521 - RNA, 22 nt, Human
cagaaacuguuuguuaauauuu

SEQ ID NO: 798522 - RNA, 22 nt, Human
agugucaaaucagcaucugggu

SEQ ID NO: 798523 - RNA, 22 nt, Human
agucucugccagcuuguccucu

SEQ ID NO: 798524 - RNA, 17 nt, Human
uccaggcagcaacugag

SEQ ID NO: 798525 - RNA, 22 nt, Human
cagcuccuagaucggcgaagug

SEQ ID NO: 798526 - RNA, 22 nt, Human
auguuuauuuugcagaguaggg

SEQ ID NO: 798527 - RNA, 22 nt, Human
aucuaaacuauaguaccuaguc

SEQ ID NO: 798528 - RNA, 22 nt, Human
aggcucugugacaaucaagcug

SEQ ID NO: 798529 - RNA, 22 nt, Human
ucacauuuuaucuauuuuaagu

SEQ ID NO: 798530 - RNA, 22 nt, Human
cugccuggccugaucuccacgc

SEQ ID NO: 798531 - RNA, 22 nt, Human
ucaggcugugucuuuaaacaau

SEQ ID NO: 798532 - RNA, 22 nt, Human
gcuggaguacaucuuuggcggc

SEQ ID NO: 798533 - RNA, 22 nt, Human
aggcuacauguugggguggaag

SEQ ID NO: 798534 - RNA, 22 nt, Human
cagcagcagauucagcgucugg

SEQ ID NO: 798535 - RNA, 19 nt, Human
aggcuucauccugggcagc

SEQ ID NO: 798536 - RNA, 22 nt, Human
caaaauuagaaaugcagcuguu

SEQ ID NO: 798537 - RNA, 22 nt, Human
gaggcaagagaagccagcuuuc

SEQ ID NO: 798538 - RNA, 20 nt, Human
ugggaguacaaucaugagca

SEQ ID NO: 798539 - RNA, 22 nt, Human
auucugagaggcacaaugugga

SEQ ID NO: 798540 - RNA, 21 nt, Human
cauuacaugguuuuagugaac

SEQ ID NO: 798541 - RNA, 22 nt, Human
augucaaagcagacugagagcg

SEQ ID NO: 798542 - RNA, 22 nt, Human
auuucccacucuacuacaugcu

SEQ ID NO: 798543 - RNA, 22 nt, Human
aauucauugccagaaucuauga

SEQ ID NO: 798544 - RNA, 22 nt, Human
ccagcaggggaauauuuuuagg

SEQ ID NO: 798545 - RNA, 22 nt, Human
uggauuuaaggcagagagggcc

SEQ ID NO: 798546 - RNA, 22 nt, Human
uuuacauuucccucugucaguu

SEQ ID NO: 798547 - RNA, 22 nt, Human
auuuauugagacuuaacaaccc

SEQ ID NO: 798548 - RNA, 22 nt, Human
ggcugcuggggacgugggagag

SEQ ID NO: 798549 - RNA, 22 nt, Human
ugcacuuuauuuccucucacac

SEQ ID NO: 798550 - RNA, 22 nt, Human
aacgaauagggauuuuucuaac

SEQ ID NO: 798551 - RNA, 22 nt, Human
agaauuacagcuuuuagaauag

SEQ ID NO: 798552 - RNA, 18 nt, Human
ugggagugggaguggaua

SEQ ID NO: 798553 - RNA, 19 nt, Human
gccugccagccugaaucug

SEQ ID NO: 798554 - RNA, 22 nt, Human
cagcugccuguauuguccucau

SEQ ID NO: 798555 - RNA, 22 nt, Human
acuuuugaagaauuaugcaaaa

SEQ ID NO: 798556 - RNA, 22 nt, Human
uuacacaacagugcaucagcag

SEQ ID NO: 798557 - RNA, 22 nt, Human
ugggccugggagggcagacgcu

SEQ ID NO: 798558 - RNA, 22 nt, Human
ucagcaggugcuuuguuuacuc

SEQ ID NO: 798559 - RNA, 22 nt, Human
cuggcucccuggacauggggcc

SEQ ID NO: 798560 - RNA, 22 nt, Human
agcacaguaaagcagugucaca

SEQ ID NO: 798561 - RNA, 22 nt, Human
uguuucaugaaacauguuuagg

SEQ ID NO: 798562 - RNA, 20 nt, Human
ggacaggaagacaaccuacc

SEQ ID NO: 798563 - RNA, 22 nt, Human
gggaagugauggagccaggauu

SEQ ID NO: 798564 - RNA, 22 nt, Human
auuucauguugaucuuucgagg

SEQ ID NO: 798565 - RNA, 22 nt, Human
cugguucaaguccuggcucugu

SEQ ID NO: 798566 - RNA, 22 nt, Human
ugaaaucauaacaguuuggcuu

SEQ ID NO: 798567 - RNA, 22 nt, Human
cuccugugguacucccagggcc

SEQ ID NO: 798568 - RNA, 22 nt, Human
uaugcaaagccacccagggacg

SEQ ID NO: 798569 - RNA, 22 nt, Human
gaccuugugcuccgaggcgggc

SEQ ID NO: 798570 - RNA, 22 nt, Human
gugguguggcuggcagaguuua

SEQ ID NO: 798571 - RNA, 22 nt, Human
gucaaauauuaugcagcuugga

SEQ ID NO: 798572 - RNA, 22 nt, Human
ccagggccaagagaccucgagg

SEQ ID NO: 798573 - RNA, 22 nt, Human
uaaugacuugaaggacccaugg

SEQ ID NO: 798574 - RNA, 22 nt, Human
gccagaaacauacacaucacuu

SEQ ID NO: 798575 - RNA, 22 nt, Human
gagcuagguuuuccagucgcau

SEQ ID NO: 798576 - RNA, 22 nt, Human
gaugaguucuuucuauucuauu

SEQ ID NO: 798577 - RNA, 18 nt, Human
uggaggaaucacaauggc

SEQ ID NO: 798578 - RNA, 22 nt, Human
gcagggcuagauauuugcaagu

SEQ ID NO: 798579 - RNA, 21 nt, Human
uccagcacagaugaccucccc

SEQ ID NO: 798580 - RNA, 22 nt, Human
guaaaacaagcuuuaugguucc

SEQ ID NO: 798581 - RNA, 22 nt, Human
gguugcauuucucaguggaaua

SEQ ID NO: 798582 - RNA, 22 nt, Human
gugugcaucuugguaauggagc

SEQ ID NO: 798583 - RNA, 22 nt, Human
uuccauauguauauagcuguua

SEQ ID NO: 798584 - RNA, 22 nt, Human
aggcccugaagucggccccuca

SEQ ID NO: 798585 - RNA, 22 nt, Human
agaguggggaagguguugagaa

SEQ ID NO: 798586 - RNA, 22 nt, Human
uggagaggaaagugcaguuuug

SEQ ID NO: 798587 - RNA, 22 nt, Human
gcaugcugcugaggcuggaaua

SEQ ID NO: 798588 - RNA, 22 nt, Human
cucagacuuucaggguaggcca

SEQ ID NO: 798589 - RNA, 22 nt, Human
cucagggggaaucaggucacag

SEQ ID NO: 798590 - RNA, 22 nt, Human
gcccagcacuccucucugacau

SEQ ID NO: 798591 - RNA, 22 nt, Human
ucucaaauauuuggagagagga

SEQ ID NO: 798592 - RNA, 22 nt, Human
gaauaauagcagaaauuagcag

SEQ ID NO: 798593 - RNA, 23 nt, Human
acaugcaaaaaucacagucuccu

SEQ ID NO: 798594 - RNA, 22 nt, Human
agguuucuccuuuaaagcaugg

SEQ ID NO: 798595 - RNA, 22 nt, Human
uggcaggaaggagacucagccc

SEQ ID NO: 798596 - RNA, 22 nt, Human
cucugugggccugugcuuuagu

SEQ ID NO: 798597 - RNA, 22 nt, Human
cuggggugugcucagagcaggg

SEQ ID NO: 798598 - RNA, 22 nt, Human
ucacagagagguuaagcaguug

SEQ ID NO: 798599 - RNA, 22 nt, Human
uuucuuuauccuccuuugcaca

SEQ ID NO: 798600 - RNA, 22 nt, Human
ucaucuucuauuaauagggaga

SEQ ID NO: 798601 - RNA, 22 nt, Human
ugugggaggucuggaaggcucc

SEQ ID NO: 798602 - RNA, 22 nt, Human
cugccagggcauccuguggugg

SEQ ID NO: 798603 - RNA, 22 nt, Human
ugggccagagaguaagaaaggu

SEQ ID NO: 798604 - RNA, 22 nt, Human
acagcuggcaggggggcaugaa

SEQ ID NO: 798605 - RNA, 22 nt, Human
ggcacagagguugccuccagau

SEQ ID NO: 798606 - RNA, 22 nt, Human
gccuggugauaagcagugaccu

SEQ ID NO: 798607 - RNA, 22 nt, Human
caaauuuuguguguucucuagu

SEQ ID NO: 798608 - RNA, 22 nt, Human
auggccuuagugaugauuaaua

SEQ ID NO: 798609 - RNA, 22 nt, Human
uuucaaacauaucuucauuacu

SEQ ID NO: 798610 - RNA, 22 nt, Human
uggaggugaaaugagauuuugu

SEQ ID NO: 798611 - RNA, 22 nt, Human
cagugaaauaguggacaucaaa

SEQ ID NO: 798612 - RNA, 23 nt, Human
ucuccuggcugcacuguggccac

SEQ ID NO: 798613 - RNA, 22 nt, Human
cagcagccuagaagcucuacca

SEQ ID NO: 798614 - RNA, 20 nt, Human
aguagcaguaauauggaaga

SEQ ID NO: 798615 - RNA, 22 nt, Human
ggcauggccuguaagacggaga

SEQ ID NO: 798616 - RNA, 22 nt, Human
agcugugugguuugggcaaauu

SEQ ID NO: 798617 - RNA, 22 nt, Human
ucaaagaugauaggaaaucaua

SEQ ID NO: 798618 - RNA, 22 nt, Human
aaugcuuugacuauaucuauaa

SEQ ID NO: 798619 - RNA, 22 nt, Human
gcugugaguggaguucugugcu

SEQ ID NO: 798620 - RNA, 23 nt, Human
uuagacaauccucaaaagguaau

SEQ ID NO: 798621 - RNA, 22 nt, Human
auuuuggcaacagccaugagcc

SEQ ID NO: 798622 - RNA, 22 nt, Human
acugugaaagcuaacaucuuag

SEQ ID NO: 798623 - RNA, 22 nt, Human
caggcccaucugcucccaggcu

SEQ ID NO: 798624 - RNA, 22 nt, Human
gagcuuuggugccaaguauuug

SEQ ID NO: 798625 - RNA, 22 nt, Human
cagggcaaagagagcacaugcu

SEQ ID NO: 798626 - RNA, 22 nt, Human
guaacaaaggauaacuugguuu

SEQ ID NO: 798627 - RNA, 22 nt, Human
acuccuggggcugccaucacag

SEQ ID NO: 798628 - RNA, 22 nt, Human
agacagaauuugucagauaaau

SEQ ID NO: 798629 - RNA, 22 nt, Human
ccagcagaggggcggagugcag

SEQ ID NO: 798630 - RNA, 19 nt, Human
acagccuguugguggggcu

SEQ ID NO: 798631 - RNA, 22 nt, Human
acacuugaggaauguggugauu

SEQ ID NO: 798632 - RNA, 22 nt, Human
aagcacaggggaaauaaguugu

SEQ ID NO: 798633 - RNA, 22 nt, Human
uccuggccaugcaagaugagga

SEQ ID NO: 798634 - RNA, 22 nt, Human
cagcuggcccuuugguagccuu

SEQ ID NO: 798635 - RNA, 22 nt, Human
uuccuguggccuuacaucugug

SEQ ID NO: 798636 - RNA, 22 nt, Human
gcaagcaaaaugggagauuccc

SEQ ID NO: 798637 - RNA, 23 nt, Human
ugaguucuaggcuuaaaacuagc

SEQ ID NO: 798638 - RNA, 23 nt, Human
cccaggagccugaguccucucug

SEQ ID NO: 798639 - RNA, 22 nt, Human
gcacccaggcuugggcagcaac

SEQ ID NO: 798640 - RNA, 22 nt, Human
agcagcuugaggcuggauucca

SEQ ID NO: 798641 - RNA, 22 nt, Human
gccuccagcuggggcauuucag

SEQ ID NO: 798642 - RNA, 22 nt, Human
agucagcagccuggccaggaga

SEQ ID NO: 798643 - RNA, 22 nt, Human
uccagagagauaguggcuaaua

SEQ ID NO: 798644 - RNA, 22 nt, Human
aauguugauguuuucagugagc

SEQ ID NO: 798645 - RNA, 22 nt, Human
cagagcagccuccagggggagc

SEQ ID NO: 798646 - RNA, 22 nt, Human
aagugauuuagucuuauaaagg

SEQ ID NO: 798647 - RNA, 22 nt, Human
gaagagcuauguccagggagca

SEQ ID NO: 798648 - RNA, 22 nt, Human
gagaggcccuguggucccagcu

SEQ ID NO: 798649 - RNA, 22 nt, Human
caaauguuuuuuaguauaagua

SEQ ID NO: 798650 - RNA, 16 nt, Human
cacauauauuuauaug

SEQ ID NO: 798651 - RNA, 22 nt, Human
cuauuuaugugcuauuuuguau

SEQ ID NO: 798652 - RNA, 22 nt, Human
ggcuggcuuggugagcugucac

SEQ ID NO: 798653 - RNA, 22 nt, Human
caggcacacccacuggugcaga

SEQ ID NO: 798654 - RNA, 22 nt, Human
gcagccuuccguggaccuggac

SEQ ID NO: 798655 - RNA, 22 nt, Human
agggccagagucuguguagaua

SEQ ID NO: 798656 - RNA, 22 nt, Human
aaacuuuuuauucuaaugucua

SEQ ID NO: 798657 - RNA, 22 nt, Human
ucaguuuauagauauugcugau

SEQ ID NO: 798658 - RNA, 22 nt, Human
aaugcacaugucuuggccucac

SEQ ID NO: 798659 - RNA, 22 nt, Human
auauguuuugugcuucauuggu

SEQ ID NO: 798660 - RNA, 22 nt, Human
uuucauaauauccagagauuuu

SEQ ID NO: 798661 - RNA, 22 nt, Human
agucugaaguagucuuuagugu

SEQ ID NO: 798662 - RNA, 22 nt, Human
aaugucugagucucuguauccc

SEQ ID NO: 798663 - RNA, 22 nt, Human
cagaaaccaaaugggaugggga

SEQ ID NO: 798664 - RNA, 22 nt, Human
cagaggcugcucuggguggcau

SEQ ID NO: 798665 - RNA, 22 nt, Human
accucuggacacugcauccuuc

SEQ ID NO: 798666 - RNA, 23 nt, Human
aaaugcagggucgcagguuacag

SEQ ID NO: 798667 - RNA, 22 nt, Human
ggacagcauaucagcagggcag

SEQ ID NO: 798668 - RNA, 22 nt, Human
uauacacauccuccaaagauag

SEQ ID NO: 798669 - RNA, 21 nt, Human
ggcuggucgcgugcaugucuc

SEQ ID NO: 798670 - RNA, 22 nt, Human
uugagggucuggaucugcugcu

SEQ ID NO: 798671 - RNA, 22 nt, Human
ucugccagaagccagggucugg

SEQ ID NO: 798672 - RNA, 22 nt, Human
gcguuggggaccccgaagcugg

SEQ ID NO: 798673 - RNA, 22 nt, Human
aaguauuucguucugaaaaagu

SEQ ID NO: 798674 - RNA, 22 nt, Human
aauuaccaggauuuuucaguau

SEQ ID NO: 798675 - RNA, 23 nt, Human
uccucccugacuucuacagcaca

SEQ ID NO: 798676 - RNA, 22 nt, Human
uacuugcuguuaguauuuuaca

SEQ ID NO: 798677 - RNA, 22 nt, Human
caugacaauaagccagcagaaa

SEQ ID NO: 798678 - RNA, 22 nt, Human
ucauugacaguuguuucaaaua

SEQ ID NO: 798679 - RNA, 22 nt, Human
ugucauggugcuauuuaauuag

SEQ ID NO: 798680 - RNA, 22 nt, Human
uuuuuuaucuaugguaguacca

SEQ ID NO: 798681 - RNA, 22 nt, Human
ugaggagaaaugcucagagcca

SEQ ID NO: 798682 - RNA, 22 nt, Human
ggagcuguuggcagcuaucuug

SEQ ID NO: 798683 - RNA, 22 nt, Human
ugcccuggggagcccagccagg

SEQ ID NO: 798684 - RNA, 22 nt, Human
cuggguggcuguccagccagcc

SEQ ID NO: 798685 - RNA, 22 nt, Human
caggagcagaggguggucagca

SEQ ID NO: 798686 - RNA, 22 nt, Human
ggccuugggguggccuuguccc

SEQ ID NO: 798687 - RNA, 22 nt, Human
ucuggcucuauaacuccuagcu

SEQ ID NO: 798688 - RNA, 22 nt, Human
agcagggcuuugucucugugaa

SEQ ID NO: 798689 - RNA, 22 nt, Human
auuacacuaaugugacaacaau

SEQ ID NO: 798690 - RNA, 22 nt, Human
gcaguuuggaaaaugugccucu

SEQ ID NO: 798691 - RNA, 22 nt, Human
caguuuaaaugagugacugcag

SEQ ID NO: 798692 - RNA, 22 nt, Human
uuacauguucucauacacagag

SEQ ID NO: 798693 - RNA, 22 nt, Human
ccagggcaugggaagaacugaa

SEQ ID NO: 798694 - RNA, 22 nt, Human
agcagggcagugcuucagcucu

SEQ ID NO: 798695 - RNA, 22 nt, Human
cugguucagugaaaggcauggg

SEQ ID NO: 798696 - RNA, 22 nt, Human
ucuggaggcucugagggugagu

SEQ ID NO: 798697 - RNA, 22 nt, Human
gucaggaaaacccggguugacu

SEQ ID NO: 798698 - RNA, 22 nt, Human
uggcagcuguguccagguagaa

SEQ ID NO: 798699 - RNA, 22 nt, Human
caaggcuggcucacaauaauga

SEQ ID NO: 798700 - RNA, 22 nt, Human
cagggcagagccaggauuucaa

SEQ ID NO: 798701 - RNA, 22 nt, Human
cuuaaagaguauuuaauauaau

SEQ ID NO: 798702 - RNA, 22 nt, Human
aggugcugaacuggugaggucu

SEQ ID NO: 798703 - RNA, 23 nt, Human
gccugggacucaggaggagcuca

SEQ ID NO: 798704 - RNA, 22 nt, Human
auucugcaugguggugucucug

SEQ ID NO: 798705 - RNA, 22 nt, Human
aauauaaugcuguuuuaugcca

SEQ ID NO: 798706 - RNA, 22 nt, Human
ucaucuuuccucaaaagaucca

SEQ ID NO: 798707 - RNA, 22 nt, Human
uuacagaguagggaauugaagu

SEQ ID NO: 798708 - RNA, 22 nt, Human
gugcagauccugauugcaguuc

SEQ ID NO: 798709 - RNA, 22 nt, Human
aacaaguuguugaaaauaauua

SEQ ID NO: 798710 - RNA, 22 nt, Human
cuuuugcagccauuauugcugc

SEQ ID NO: 798711 - RNA, 22 nt, Human
uucuacauucauguauuaccuc

SEQ ID NO: 798712 - RNA, 22 nt, Human
cgagcaugaugacggcuguggc

SEQ ID NO: 798713 - RNA, 22 nt, Human
uggcaugaagucagcagcuggg

SEQ ID NO: 798714 - RNA, 22 nt, Human
uuaaaggcgauaaggcaguguu

SEQ ID NO: 798715 - RNA, 22 nt, Human
gugaacaaaauagcacauauua

SEQ ID NO: 798716 - RNA, 22 nt, Human
ucaggaagggugguccacaggg

SEQ ID NO: 798717 - RNA, 22 nt, Human
uccaggagguugagacugcagu

SEQ ID NO: 798718 - RNA, 22 nt, Human
uggaggaaaauuacuggggucu

SEQ ID NO: 798719 - RNA, 22 nt, Human
accugccuauggagccacaugg

SEQ ID NO: 798720 - RNA, 22 nt, Human
uguucuggugaggccauggggu

SEQ ID NO: 798721 - RNA, 22 nt, Human
cucagauaaucuuugagucuuc

SEQ ID NO: 798722 - RNA, 22 nt, Human
augaaaugagucaaugcgacua

SEQ ID NO: 798723 - RNA, 22 nt, Human
cagcuuuggagugugagugcug

SEQ ID NO: 798724 - RNA, 22 nt, Human
cauuucaaugccuucaacauag

SEQ ID NO: 798725 - RNA, 22 nt, Human
uagucacaggaaguuucaaugu

SEQ ID NO: 798726 - RNA, 22 nt, Human
uugugaauagugccacaauaaa

SEQ ID NO: 798727 - RNA, 22 nt, Human
gcagcguggggcugagucagcu

SEQ ID NO: 798728 - RNA, 22 nt, Human
cccuggaggaccccaauguggc

SEQ ID NO: 798729 - RNA, 22 nt, Human
ccacagugggcacagcaggacu

SEQ ID NO: 798730 - RNA, 22 nt, Human
cuggugggagcagcaggcagcu

SEQ ID NO: 798731 - RNA, 17 nt, Human
uacaaugugauucaauc

SEQ ID NO: 798732 - RNA, 22 nt, Human
cacugagggaggguuucuucug

SEQ ID NO: 798733 - RNA, 22 nt, Human
cugccagacacguuaugcucau

SEQ ID NO: 798734 - RNA, 22 nt, Human
cucucuagaggcccaccuugag

SEQ ID NO: 798735 - RNA, 22 nt, Human
auauuaagaugcuauugguuuu

SEQ ID NO: 798736 - RNA, 22 nt, Human
uauuucugucagccagauaugg

SEQ ID NO: 798737 - RNA, 22 nt, Human
aagucaauuuauguucucagac

SEQ ID NO: 798738 - RNA, 22 nt, Human
acagcaggcaugaaugacacug

SEQ ID NO: 798739 - RNA, 22 nt, Human
agggucacaaugugugaauugg

SEQ ID NO: 798740 - RNA, 23 nt, Human
acucuguaggcuguccaugugca

SEQ ID NO: 798741 - RNA, 22 nt, Human
gagcacagauccuggagccaca

SEQ ID NO: 798742 - RNA, 22 nt, Human
uaagucauaagucaacaaagga

SEQ ID NO: 798743 - RNA, 22 nt, Human
uuuacuacuugugauaacugaa

SEQ ID NO: 798744 - RNA, 22 nt, Human
ucaaacauaucugauuuuccau

SEQ ID NO: 798745 - RNA, 22 nt, Human
uuuacagaugaggaaacugaga

SEQ ID NO: 798746 - RNA, 22 nt, Human
ggcagcugauuagcaucaagga

SEQ ID NO: 798747 - RNA, 22 nt, Human
agucacagaaugauggcuccag

SEQ ID NO: 798748 - RNA, 22 nt, Human
aaaaguuugugcaaacacucag

SEQ ID NO: 798749 - RNA, 22 nt, Human
gagggaccccaggcuggcccuu

SEQ ID NO: 798750 - RNA, 22 nt, Human
gcacccaggccggcgacugcag

SEQ ID NO: 798751 - RNA, 22 nt, Human
ucuuuggcuaugauuuacuguu

SEQ ID NO: 798752 - RNA, 22 nt, Human
accugaggcuguuagucuaggu

SEQ ID NO: 798753 - RNA, 22 nt, Human
auuaaauuuucacuaggcuccc

SEQ ID NO: 798754 - RNA, 22 nt, Human
aguggggaagagcaugggcccu

SEQ ID NO: 798755 - RNA, 22 nt, Human
agggcccucuggcaggccaggc

SEQ ID NO: 798756 - RNA, 22 nt, Human
gagaggaacucccagugccugg

SEQ ID NO: 798757 - RNA, 22 nt, Human
gaggcucagagggagcaugguc

SEQ ID NO: 798758 - RNA, 22 nt, Human
aaaagacaggugucugcggccc

SEQ ID NO: 798759 - RNA, 22 nt, Human
cugucccuucccaagcccagcc

SEQ ID NO: 798760 - RNA, 22 nt, Human
uucccucccccagccuggcagg

SEQ ID NO: 798761 - RNA, 22 nt, Human
augagauuuuauagugucuuga

SEQ ID NO: 798762 - RNA, 22 nt, Human
ccuggccacccagccuuggcca

SEQ ID NO: 798763 - RNA, 22 nt, Human
ggagaaagggacugaucugcuc

SEQ ID NO: 798764 - RNA, 22 nt, Human
cagcagcaguggcugcagaaca

SEQ ID NO: 798765 - RNA, 22 nt, Human
ucagagaaaauggaaacuuuua

SEQ ID NO: 798766 - RNA, 22 nt, Human
cuucaaguccagcucaugcucu

SEQ ID NO: 798767 - RNA, 22 nt, Human
uuaguaauuagaaaguaauucu

SEQ ID NO: 798768 - RNA, 22 nt, Human
cagcuucuuagucuuuccuugu

SEQ ID NO: 798769 - RNA, 22 nt, Human
uugucugaagucacacagaugc

SEQ ID NO: 798770 - RNA, 22 nt, Human
uucacagugguagugcauuuag

SEQ ID NO: 798771 - RNA, 22 nt, Human
uaccagggaacagggauauuaa

SEQ ID NO: 798772 - RNA, 22 nt, Human
gcacacuggagccuggaagauu

SEQ ID NO: 798773 - RNA, 22 nt, Human
uggcuggaggcaugcaagcucc

SEQ ID NO: 798774 - RNA, 22 nt, Human
cacagcuuccauuagaaugaga

SEQ ID NO: 798775 - RNA, 22 nt, Human
ucagaaguuaauacgaggagaa

SEQ ID NO: 798776 - RNA, 22 nt, Human
gcuggcuggaaugggagaagaa

SEQ ID NO: 798777 - RNA, 22 nt, Human
agcagaaacagccagucuggac

SEQ ID NO: 798778 - RNA, 22 nt, Human
ggccuuggaaagauacccagcu

SEQ ID NO: 798779 - RNA, 22 nt, Human
cccagcauccucagggagcggg

SEQ ID NO: 798780 - RNA, 22 nt, Human
aggaaacaugaaucugccuuga

SEQ ID NO: 798781 - RNA, 22 nt, Human
cucuuugaaauccaucacugcu

SEQ ID NO: 798782 - RNA, 22 nt, Human
guacuaaacagagaaccaauau

SEQ ID NO: 798783 - RNA, 22 nt, Human
ucagagaaaggccaaaauauca

SEQ ID NO: 798784 - RNA, 22 nt, Human
gaaggcagggaauguggugcua

SEQ ID NO: 798785 - RNA, 22 nt, Human
uggauucucaugggaccaguag

SEQ ID NO: 798786 - RNA, 22 nt, Human
aggcucuggcaacagcuggugu

SEQ ID NO: 798787 - RNA, 22 nt, Human
auguuauuuauugaaacacuuu

SEQ ID NO: 798788 - RNA, 22 nt, Human
cacaggagaacccacagauucu

SEQ ID NO: 798789 - RNA, 22 nt, Human
gaaggcugagcagacaggccaa

SEQ ID NO: 798790 - RNA, 21 nt, Human
agcaauuuuuccuccucugca

SEQ ID NO: 798791 - RNA, 22 nt, Human
ucuuucaaugagcauucuuucc

SEQ ID NO: 798792 - RNA, 22 nt, Human
uguuuacuucaucgaguacuuc

SEQ ID NO: 798793 - RNA, 22 nt, Human
cagagggcuucagguucaggau

SEQ ID NO: 798794 - RNA, 22 nt, Human
ucuaguuuaagaucuguuaguc

SEQ ID NO: 798795 - RNA, 18 nt, Human
cugugggaagaguuuggg

SEQ ID NO: 798796 - RNA, 22 nt, Human
agagucaacaucgagccacugg

SEQ ID NO: 798797 - RNA, 22 nt, Human
gugcuggggguuucuguagguc

SEQ ID NO: 798798 - RNA, 22 nt, Human
ccugucucugcagggcccugcc

SEQ ID NO: 798799 - RNA, 21 nt, Human
aaggcuccuccucuaggccuc

SEQ ID NO: 798800 - RNA, 23 nt, Human
ucucaaaucuuugcguuguaucu

SEQ ID NO: 798801 - RNA, 22 nt, Human
uucuuucucaacaugaauguuu

SEQ ID NO: 798802 - RNA, 22 nt, Human
aaagccaggcagccaagccagu

SEQ ID NO: 798803 - RNA, 22 nt, Human
ugcauuaauuuuugccagguuc

SEQ ID NO: 798804 - RNA, 22 nt, Human
aagcaaaagguuacacuucugg

SEQ ID NO: 798805 - RNA, 22 nt, Human
acaaaugucuacauugagaaua

SEQ ID NO: 798806 - RNA, 22 nt, Human
aaccaguuuagucaugcuguaa

SEQ ID NO: 798807 - RNA, 22 nt, Human
cuggaggaaaacaacugcagac

SEQ ID NO: 798808 - RNA, 22 nt, Human
gcuuucccugcccucagaagga

SEQ ID NO: 798809 - RNA, 22 nt, Human
gccugcuggacauuggccggcc

SEQ ID NO: 798810 - RNA, 22 nt, Human
ccuggcagaauauuaaagugca

SEQ ID NO: 798811 - RNA, 22 nt, Human
uuacuucuugucucaugccuau

SEQ ID NO: 798812 - RNA, 22 nt, Human
agcugaaauuuuacugaguaua

SEQ ID NO: 798813 - RNA, 21 nt, Human
uuuaaagaauaggaagggagg

SEQ ID NO: 798814 - RNA, 16 nt, Human
agugggaggagaaaga

SEQ ID NO: 798815 - RNA, 22 nt, Human
ugucucccaggugugcccagug

SEQ ID NO: 798816 - RNA, 22 nt, Human
ucaaggaaugacuauaugagga

SEQ ID NO: 798817 - RNA, 22 nt, Human
uuauuuccucucuaauagggua

SEQ ID NO: 798818 - RNA, 20 nt, Human
caccuucaaauuuccuggca

SEQ ID NO: 798819 - RNA, 22 nt, Human
uuucuucucacccaggacagag

SEQ ID NO: 798820 - RNA, 22 nt, Human
guccuuggcauucugagucuug

SEQ ID NO: 798821 - RNA, 17 nt, Human
caguggcagaucuucuc

SEQ ID NO: 798822 - RNA, 22 nt, Human
uguguauuaauguuuguauaug

SEQ ID NO: 798823 - RNA, 22 nt, Human
auuuguuuaucgucgauuguag

SEQ ID NO: 798824 - RNA, 17 nt, Human
ccagaugcccugucucc

SEQ ID NO: 798825 - RNA, 21 nt, Human
uucugggccggagaaggggcg

SEQ ID NO: 798826 - RNA, 22 nt, Human
ggggcccagggcagcagugcag

SEQ ID NO: 798827 - RNA, 22 nt, Human
aaggcucuccaaaugauauaau

SEQ ID NO: 798828 - RNA, 22 nt, Human
gugggagaaauuagcucuaguu

SEQ ID NO: 798829 - RNA, 22 nt, Human
cugcagcuccuucuggcaugug

SEQ ID NO: 798830 - RNA, 22 nt, Human
uggccccugaggagcaucagcc

SEQ ID NO: 798831 - RNA, 22 nt, Human
ugagcauggugggugcagagca

SEQ ID NO: 798832 - RNA, 22 nt, Human
uuucaaagaguuguaaauuacu

SEQ ID NO: 798833 - RNA, 22 nt, Human
ggccugcacagagguggcucua

SEQ ID NO: 798834 - RNA, 22 nt, Human
uuucacauaucaacucuauccu

SEQ ID NO: 798835 - RNA, 22 nt, Human
cagcucuuuuuugcagcagcug

SEQ ID NO: 798836 - RNA, 22 nt, Human
auuuucacccugaauauauuga

SEQ ID NO: 798837 - RNA, 22 nt, Human
caggaaaugggucguuuuauaa

SEQ ID NO: 798838 - RNA, 22 nt, Human
auugcaaauaaugcgagccagu

SEQ ID NO: 798839 - RNA, 22 nt, Human
uuucuaagugugauuuuagauu

SEQ ID NO: 798840 - RNA, 22 nt, Human
auuuccauacacccauuucuga

SEQ ID NO: 798841 - RNA, 22 nt, Human
cacuucaaggaauaucuagaaa

SEQ ID NO: 798842 - RNA, 22 nt, Human
agcugagcugcagaugacugua

SEQ ID NO: 798843 - RNA, 22 nt, Human
uguuuacuuuccuucucacagg

SEQ ID NO: 798844 - RNA, 22 nt, Human
cugaguggaacauaggaugaua

SEQ ID NO: 798845 - RNA, 22 nt, Human
augugacuccaggcaguuuugu

SEQ ID NO: 798846 - RNA, 22 nt, Human
ugcauuuccagauuucuggagu

SEQ ID NO: 798847 - RNA, 22 nt, Human
cauuuacacuucuaaccacaag

SEQ ID NO: 798848 - RNA, 22 nt, Human
ucucacauuucauugacagcug

SEQ ID NO: 798849 - RNA, 22 nt, Human
cccaccacgugcuuugcuggag

SEQ ID NO: 798850 - RNA, 19 nt, Human
agagaggcugugugaggga

SEQ ID NO: 798851 - RNA, 22 nt, Human
agcaggguauguuagagcugua

SEQ ID NO: 798852 - RNA, 22 nt, Human
gaggcagugucgguggcaggau

SEQ ID NO: 798853 - RNA, 23 nt, Human
agucucaagcuggagaauuaccu

SEQ ID NO: 798854 - RNA, 22 nt, Human
uccagggaugccagccauguug

SEQ ID NO: 798855 - RNA, 22 nt, Human
aaagcaauggaugagaaucugu

SEQ ID NO: 798856 - RNA, 22 nt, Human
uggcagccuucucugagaaggu

SEQ ID NO: 798857 - RNA, 22 nt, Human
ucaggggcuugaggugcauguc

SEQ ID NO: 798858 - RNA, 22 nt, Human
uugguucauugcaggcgccggg

SEQ ID NO: 798859 - RNA, 22 nt, Human
ggcucagguuuaaagugcuuua

SEQ ID NO: 798860 - RNA, 20 nt, Human
aagcaauauagugcaaaugu

SEQ ID NO: 798861 - RNA, 22 nt, Human
uaagaaacuauugucucugaac

SEQ ID NO: 798862 - RNA, 22 nt, Human
caggucugcaggcuggagucca

SEQ ID NO: 798863 - RNA, 22 nt, Human
uuuacugagugaccuagaauaa

SEQ ID NO: 798864 - RNA, 22 nt, Human
ggugaaggucagagcaggaaaa

SEQ ID NO: 798865 - RNA, 22 nt, Human
uccaggaggugaggggaccaaa

SEQ ID NO: 798866 - RNA, 22 nt, Human
uacaucaagauaaaaacuguca

SEQ ID NO: 798867 - RNA, 22 nt, Human
gaggccucugucccaccaggga

SEQ ID NO: 798868 - RNA, 22 nt, Human
acuucacagauauuuauuuggu

SEQ ID NO: 798869 - RNA, 22 nt, Human
gcaaauucuuaacuggacugug

SEQ ID NO: 798870 - RNA, 22 nt, Human
ccugcugucaguggggcaggca

SEQ ID NO: 798871 - RNA, 22 nt, Human
aaauuuaaaaagcagcauugca

SEQ ID NO: 798872 - RNA, 22 nt, Human
aguccaaagcagaugagggcca

SEQ ID NO: 798873 - RNA, 22 nt, Human
ucauuuguuuagguagcaccau

SEQ ID NO: 798874 - RNA, 22 nt, Human
uacaaagugauuuuggaauuga

SEQ ID NO: 798875 - RNA, 22 nt, Human
ucccauauaugcaaaaauguaa

SEQ ID NO: 798876 - RNA, 22 nt, Human
aagccaaggagaauggccucag

SEQ ID NO: 798877 - RNA, 22 nt, Human
aaacugcaauuacuuuugcacc

SEQ ID NO: 798878 - RNA, 22 nt, Human
caggcagaagaaguggaaggac

SEQ ID NO: 798879 - RNA, 22 nt, Human
ucaugggguuuggcuggauguc

SEQ ID NO: 798880 - RNA, 22 nt, Human
cugccuggucucaggcaugggg

SEQ ID NO: 798881 - RNA, 22 nt, Human
uuagcuuucagccuuucucacc

SEQ ID NO: 798882 - RNA, 22 nt, Human
ucagugucccgucucuuaacuc

SEQ ID NO: 798883 - RNA, 22 nt, Human
gaguaaggcugcugauggagug

SEQ ID NO: 798884 - RNA, 22 nt, Human
acuggcagagggaaaaccauuc

SEQ ID NO: 798885 - RNA, 19 nt, Human
aaggaauggcuuuaaguag

SEQ ID NO: 798886 - RNA, 22 nt, Human
ucuucaggguaugggaaaggga

SEQ ID NO: 798887 - RNA, 22 nt, Human
aaagugcauuguuuguguuccu

SEQ ID NO: 798888 - RNA, 22 nt, Human
uacucauuucaaacagcacaaa

SEQ ID NO: 798889 - RNA, 22 nt, Human
gcaaacauuccacagaaggaag

SEQ ID NO: 798890 - RNA, 22 nt, Human
aaguccugccaccuauaagccu

SEQ ID NO: 798891 - RNA, 22 nt, Human
gagggagggaaaguuuaacacu

SEQ ID NO: 798892 - RNA, 22 nt, Human
uggcuggagagggucccaugag

SEQ ID NO: 798893 - RNA, 22 nt, Human
ugugauuauauuguaguacauu

SEQ ID NO: 798894 - RNA, 19 nt, Human
ucuuuagucacauuuuuau

SEQ ID NO: 798895 - RNA, 18 nt, Human
uguuuauucuccugacag

SEQ ID NO: 798896 - RNA, 21 nt, Human
uuccuggggacuuccguggga

SEQ ID NO: 798897 - RNA, 22 nt, Human
ucauuuuuugcauaccuguguc

SEQ ID NO: 798898 - RNA, 22 nt, Human
ugaaacaauuagaauguaauga

SEQ ID NO: 798899 - RNA, 22 nt, Human
agaacuuacauuauagagcugu

SEQ ID NO: 798900 - RNA, 22 nt, Human
cuccccacauuucucccugucu

SEQ ID NO: 798901 - RNA, 22 nt, Human
uauauuaaccauaggguucuag

SEQ ID NO: 798902 - RNA, 22 nt, Human
ugcaaauuucuuuaguacauaa

SEQ ID NO: 798903 - RNA, 22 nt, Human
auaauuuacaacugcuuuuaau

SEQ ID NO: 798904 - RNA, 22 nt, Human
agucaaauaagacugucauaag

SEQ ID NO: 798905 - RNA, 19 nt, Human
gcuugcugcuagguaggga

SEQ ID NO: 798906 - RNA, 22 nt, Human
cggcugagcagugcugauggaa

SEQ ID NO: 798907 - RNA, 22 nt, Human
cucucagggacccagccagccu

SEQ ID NO: 798908 - RNA, 22 nt, Human
gcaggagccaggccgagcuggu

SEQ ID NO: 798909 - RNA, 22 nt, Human
agccaggguaagguacuuagua

SEQ ID NO: 798910 - RNA, 22 nt, Human
cagggcaguuuuacuucucucu

SEQ ID NO: 798911 - RNA, 18 nt, Human
ggagcccacggcguccca

SEQ ID NO: 798912 - RNA, 21 nt, Human
uggcccuggccacggcugcca

SEQ ID NO: 798913 - RNA, 22 nt, Human
cuggcagguuuggugucuggug

SEQ ID NO: 798914 - RNA, 22 nt, Human
cagaagccugccucagaugcac

SEQ ID NO: 798915 - RNA, 22 nt, Human
cacauucaauuacacagauagg

SEQ ID NO: 798916 - RNA, 22 nt, Human
cagaggcugccagccaugugca

SEQ ID NO: 798917 - RNA, 22 nt, Human
uaagccauacauuucagacucu

SEQ ID NO: 798918 - RNA, 22 nt, Human
gcucccuguucucagccaugau

SEQ ID NO: 798919 - RNA, 22 nt, Human
gguccccguggaggcuggagcg

SEQ ID NO: 798920 - RNA, 22 nt, Human
aaaugcauuucacuaauguuuc

SEQ ID NO: 798921 - RNA, 22 nt, Human
acugcacuuacauagaggaggc

SEQ ID NO: 798922 - RNA, 22 nt, Human
aaaugugucauauucaaaguca

SEQ ID NO: 798923 - RNA, 22 nt, Human
caguacuuuucuggcuuucuac

SEQ ID NO: 798924 - RNA, 22 nt, Human
acacagggauauuucagguggu

SEQ ID NO: 798925 - RNA, 22 nt, Human
guucacauccuggcugugccac

SEQ ID NO: 798926 - RNA, 22 nt, Human
ccuggaaggacaauagauagug

SEQ ID NO: 798927 - RNA, 22 nt, Human
cugcccucccaguugguccgug

SEQ ID NO: 798928 - RNA, 22 nt, Human
uguuuacaaaaccgugguacug

SEQ ID NO: 798929 - RNA, 22 nt, Human
gaaagugcuuuugagugugugc

SEQ ID NO: 798930 - RNA, 22 nt, Human
aacauuaauuacagucaaacau

SEQ ID NO: 798931 - RNA, 22 nt, Human
agcaaggccgagaggaugcuau

SEQ ID NO: 798932 - RNA, 20 nt, Human
ggcaagcaacugagggagga

SEQ ID NO: 798933 - RNA, 22 nt, Human
uggugcugugauacgaggcacu

SEQ ID NO: 798934 - RNA, 22 nt, Human
ucacauuuguuccucugcacuu

SEQ ID NO: 798935 - RNA, 22 nt, Human
ccucugagaccagcucugcacc

SEQ ID NO: 798936 - RNA, 20 nt, Human
cuggguggcaagcaaggggg

SEQ ID NO: 798937 - RNA, 21 nt, Human
ugucagaaauaagcaugugau

SEQ ID NO: 798938 - RNA, 22 nt, Human
cugcagagcaugaggaggucug

SEQ ID NO: 798939 - RNA, 22 nt, Human
ugggagcaaaugacugggagau

SEQ ID NO: 798940 - RNA, 22 nt, Human
gcugccucccagagcccugcag

SEQ ID NO: 798941 - RNA, 22 nt, Human
ucucuaggcagugucagaauca

SEQ ID NO: 798942 - RNA, 22 nt, Human
aucccucucugcaugacugugu

SEQ ID NO: 798943 - RNA, 22 nt, Human
ugagccaggcucaagugauccu

SEQ ID NO: 798944 - RNA, 22 nt, Human
gggacacagagaaacuggagaa

SEQ ID NO: 798945 - RNA, 18 nt, Human
auccaaaaagauggaagu

SEQ ID NO: 798946 - RNA, 22 nt, Human
auacaaaguauuaauccuggau

SEQ ID NO: 798947 - RNA, 22 nt, Human
uccaugacuaggaaaccaguuu

SEQ ID NO: 798948 - RNA, 22 nt, Human
acagcacuuuacuucucaguga

SEQ ID NO: 798949 - RNA, 22 nt, Human
acuggcaggcugcuggccggcg

SEQ ID NO: 798950 - RNA, 22 nt, Human
cugacagcucuggcuaguagaa

SEQ ID NO: 798951 - RNA, 22 nt, Human
agggaagcugcuggguccaccu

SEQ ID NO: 798952 - RNA, 22 nt, Human
acugugagaguuuuucuaggag

SEQ ID NO: 798953 - RNA, 19 nt, Human
agccacagaacuugcagga

SEQ ID NO: 798954 - RNA, 22 nt, Human
uugacaaaacaacacagauuuc

SEQ ID NO: 798955 - RNA, 22 nt, Human
ggucccagaauugguuagcaca

SEQ ID NO: 798956 - RNA, 21 nt, Human
acagcagggcuggcaugacag

SEQ ID NO: 798957 - RNA, 22 nt, Human
uuugagaaggugacaaauucua

SEQ ID NO: 798958 - RNA, 22 nt, Human
ccagagguuccaggcuagggag

SEQ ID NO: 798959 - RNA, 22 nt, Human
gcgagugccgagagggcagggc

SEQ ID NO: 798960 - RNA, 22 nt, Human
ccucccucuuucagucccacag

SEQ ID NO: 798961 - RNA, 22 nt, Human
cccugcugcaggcuucaggagg

SEQ ID NO: 798962 - RNA, 22 nt, Human
ugcauuuuugagguuaacucaa

SEQ ID NO: 798963 - RNA, 22 nt, Human
caggaaauggcugaauaaauuc

SEQ ID NO: 798964 - RNA, 22 nt, Human
uggcucucagcucccagcagcc

SEQ ID NO: 798965 - RNA, 22 nt, Human
ggaaaucaaggggacaaauugu

SEQ ID NO: 798966 - RNA, 22 nt, Human
ccaaugaaaggucaauucuaua

SEQ ID NO: 798967 - RNA, 22 nt, Human
gcagggacuuuggcaacaggug

SEQ ID NO: 798968 - RNA, 22 nt, Human
gggcacagccuaacuauggaga

SEQ ID NO: 798969 - RNA, 22 nt, Human
agaaacagaagggaaagcuuuu

SEQ ID NO: 798970 - RNA, 22 nt, Human
gcugcugugccccaucugcaga

SEQ ID NO: 798971 - RNA, 22 nt, Human
ucugugcaccagaaugauauuu

SEQ ID NO: 798972 - RNA, 22 nt, Human
ucccagcaagaaaggggguggc

SEQ ID NO: 798973 - RNA, 22 nt, Human
agauggagaccuuggaugaacu

SEQ ID NO: 798974 - RNA, 22 nt, Human
cagaggcuaagaugagugggug

SEQ ID NO: 798975 - RNA, 22 nt, Human
ugacagagccaagaucaguacu

SEQ ID NO: 798976 - RNA, 22 nt, Human
auguacauucuucucaccgaag

SEQ ID NO: 798977 - RNA, 22 nt, Human
gucuuuagagcuccuggcaucu

SEQ ID NO: 798978 - RNA, 22 nt, Human
ccacauuuacuggaugcucagg

SEQ ID NO: 798979 - RNA, 22 nt, Human
aaggcccuuggaaaaugcagua

SEQ ID NO: 798980 - RNA, 22 nt, Human
uuaagcucucauuauuauuauu

SEQ ID NO: 798981 - RNA, 22 nt, Human
ucagaauauauucauguuguca

SEQ ID NO: 798982 - RNA, 22 nt, Human
ccaaagugcugagauuacaggu

SEQ ID NO: 798983 - RNA, 22 nt, Human
agggaagcagcagccgccuguc

SEQ ID NO: 798984 - RNA, 22 nt, Human
auucauaucauagaguuauuga

SEQ ID NO: 798985 - RNA, 22 nt, Human
acacauuuaaaaaggaacauau

SEQ ID NO: 798986 - RNA, 22 nt, Human
gcaagcaagcagguagagcuga

SEQ ID NO: 798987 - RNA, 23 nt, Human
gcucagagguuuuucucuggaug

SEQ ID NO: 798988 - RNA, 22 nt, Human
caaauuuagguaacagucugua

SEQ ID NO: 798989 - RNA, 19 nt, Human
gccucugcuggggacaggc

SEQ ID NO: 798990 - RNA, 22 nt, Human
gcccaagcuccgccuccugucg

SEQ ID NO: 798991 - RNA, 19 nt, Human
ucccaggcaaaggcuucuc

SEQ ID NO: 798992 - RNA, 22 nt, Human
uugucugacuucuuuaguuacu

SEQ ID NO: 798993 - RNA, 22 nt, Human
uauaagauacuuggcauagugc

SEQ ID NO: 798994 - RNA, 22 nt, Human
cuggcuggagcuguuguaggcu

SEQ ID NO: 798995 - RNA, 22 nt, Human
uacaacagaccuagaugaauga

SEQ ID NO: 798996 - RNA, 22 nt, Human
aguguucauuuauucauucacu

SEQ ID NO: 798997 - RNA, 22 nt, Human
agcugaaaggguguuggagugu

SEQ ID NO: 798998 - RNA, 22 nt, Human
gaaggaaaaauacucuguaagg

SEQ ID NO: 798999 - RNA, 22 nt, Human
uuuaucuuuggaucuucagaaa

SEQ ID NO: 799000 - RNA, 22 nt, Human
aaucaggacugugccaaaccua

SEQ ID NO: 799001 - RNA, 22 nt, Human
ucaauauagcaguguacuugag

SEQ ID NO: 799002 - RNA, 22 nt, Human
gaaauacaggaaugccacacag

SEQ ID NO: 799003 - RNA, 22 nt, Human
uuguauauauucuuaaagaugu

SEQ ID NO: 799004 - RNA, 22 nt, Human
ccuccugggagagcacggaggg

SEQ ID NO: 799005 - RNA, 22 nt, Human
cuggcagauagccacgccuguc

SEQ ID NO: 799006 - RNA, 22 nt, Human
ggcccacacugacagcugagcu

SEQ ID NO: 799007 - RNA, 22 nt, Human
gcucagagaaucagcagacacc

SEQ ID NO: 799008 - RNA, 22 nt, Human
aggcuguggcccuggucuagca

SEQ ID NO: 799009 - RNA, 22 nt, Human
uuugguuugccugaguacccuc

SEQ ID NO: 799010 - RNA, 22 nt, Human
cuggcuggggaagucauuugau

SEQ ID NO: 799011 - RNA, 22 nt, Human
uugcaaagagucauguaaguca

SEQ ID NO: 799012 - RNA, 22 nt, Human
ugcuggccucggcgcugggccu

SEQ ID NO: 799013 - RNA, 21 nt, Human
uuacuuuugcagcaaccuaau

SEQ ID NO: 799014 - RNA, 22 nt, Human
gccuuugaauuguuguggugag

SEQ ID NO: 799015 - RNA, 23 nt, Human
ccacucucccaccauaucuguau

SEQ ID NO: 799016 - RNA, 22 nt, Human
aaugcaagucaaugcuauaccc

SEQ ID NO: 799017 - RNA, 22 nt, Human
cucaggaguuggaggcuacagu

SEQ ID NO: 799018 - RNA, 22 nt, Human
ccuggcacauagugggcaugca

SEQ ID NO: 799019 - RNA, 22 nt, Human
cucugccaagaugacagguaag

SEQ ID NO: 799020 - RNA, 22 nt, Human
acauuucucccugcaugccugc

SEQ ID NO: 799021 - RNA, 22 nt, Human
augccaaauuucuuucuguucu

SEQ ID NO: 799022 - RNA, 22 nt, Human
ugccuucucuucccugggagcu

SEQ ID NO: 799023 - RNA, 22 nt, Human
aaaauaacuucuacuauuugca

SEQ ID NO: 799024 - RNA, 22 nt, Human
gaucugcacucugagaggcuug

SEQ ID NO: 799025 - RNA, 22 nt, Human
gugggggcuggcucguccugug

SEQ ID NO: 799026 - RNA, 22 nt, Human
agucucugcaugccugcugugc

SEQ ID NO: 799027 - RNA, 22 nt, Human
ucauuugggucaguuuuccaua

SEQ ID NO: 799028 - RNA, 22 nt, Human
caguaaaaauguugucaaggca

SEQ ID NO: 799029 - RNA, 22 nt, Human
ugugacuggcuuauuucacuua

SEQ ID NO: 799030 - RNA, 22 nt, Human
acuuuuaaggggccuugauuua

SEQ ID NO: 799031 - RNA, 22 nt, Human
ugcugccagccaggccauggag

SEQ ID NO: 799032 - RNA, 22 nt, Human
uuccagcuaacucacaucccuu

SEQ ID NO: 799033 - RNA, 22 nt, Human
gguggcagucuuaagagaucuu

SEQ ID NO: 799034 - RNA, 22 nt, Human
acuccuggugcugaugaagaga

SEQ ID NO: 799035 - RNA, 22 nt, Human
cugaagccaugugcucacuggu

SEQ ID NO: 799036 - RNA, 22 nt, Human
ugucugaauuuuggaaucaagu

SEQ ID NO: 799037 - RNA, 22 nt, Human
ugcagaagaccuuccagggcug

SEQ ID NO: 799038 - RNA, 22 nt, Human
gggcuggcugauuuuccucucu

SEQ ID NO: 799039 - RNA, 22 nt, Human
uucuaggaagggaagcauggca

SEQ ID NO: 799040 - RNA, 22 nt, Human
aggcuggccagugcugcagugg

SEQ ID NO: 799041 - RNA, 22 nt, Human
agccaggcagacucucuuucuu

SEQ ID NO: 799042 - RNA, 22 nt, Human
uucagaggggcuaaguacuugc

SEQ ID NO: 799043 - RNA, 22 nt, Human
guacaauuaagugcacaaauag

SEQ ID NO: 799044 - RNA, 22 nt, Human
ugcuuaaacccugaucaugugu

SEQ ID NO: 799045 - RNA, 22 nt, Human
gaacaacuccaagggacaucau

SEQ ID NO: 799046 - RNA, 22 nt, Human
gcuggcuuugcacugggugcau

SEQ ID NO: 799047 - RNA, 19 nt, Human
uccagcuguuuugagucac

SEQ ID NO: 799048 - RNA, 22 nt, Human
gccucugcgccucagccgaccu

SEQ ID NO: 799049 - RNA, 22 nt, Human
agcccagguugaggcugcagug

SEQ ID NO: 799050 - RNA, 23 nt, Human
agcaguaacuucagaaacaucag

SEQ ID NO: 799051 - RNA, 22 nt, Human
uuuuaaaggauacucuugucua

SEQ ID NO: 799052 - RNA, 22 nt, Human
agaagccaagaacagacagugc

SEQ ID NO: 799053 - RNA, 22 nt, Human
auugagaaugaagggacauuuu

SEQ ID NO: 799054 - RNA, 22 nt, Human
uagaaaagccccagcuggaggg

SEQ ID NO: 799055 - RNA, 22 nt, Human
auguauuugcgagguuaggaaa

SEQ ID NO: 799056 - RNA, 22 nt, Human
caggcaugggccaugggaagug

SEQ ID NO: 799057 - RNA, 22 nt, Human
uagaggaaauuuccaaggugag

SEQ ID NO: 799058 - RNA, 22 nt, Human
gugggcagaauugaaucuuuaa

SEQ ID NO: 799059 - RNA, 20 nt, Human
gggguuggcuggcacaggga

SEQ ID NO: 799060 - RNA, 22 nt, Human
aauugcauaaaauucaacucug

SEQ ID NO: 799061 - RNA, 22 nt, Human
aucuuaaacagaggaaugacuu

SEQ ID NO: 799062 - RNA, 22 nt, Human
ugcaggugugugcaagggaggg

SEQ ID NO: 799063 - RNA, 21 nt, Human
uucuccccagcgaauccucgg

SEQ ID NO: 799064 - RNA, 23 nt, Human
uagcaggcuuucuuuucucucac

SEQ ID NO: 799065 - RNA, 20 nt, Human
aauaaacuacugagagaugu

SEQ ID NO: 799066 - RNA, 22 nt, Human
cccagccugaucucggccagcu

SEQ ID NO: 799067 - RNA, 22 nt, Human
cuuccucccccacacacucacu

SEQ ID NO: 799068 - RNA, 22 nt, Human
gagguggcacugugaggagcac

SEQ ID NO: 799069 - RNA, 22 nt, Human
augaacaucucugauccaagca

SEQ ID NO: 799070 - RNA, 22 nt, Human
uaugaaauugccauuuuuaugg

SEQ ID NO: 799071 - RNA, 20 nt, Human
cagcaacuuuggacugaguu

SEQ ID NO: 799072 - RNA, 22 nt, Human
caguggcacuugucauuucuga

SEQ ID NO: 799073 - RNA, 22 nt, Human
gcuuaaaagccacuuagucuau

SEQ ID NO: 799074 - RNA, 22 nt, Human
ccuggcugccgagugugcagcg

SEQ ID NO: 799075 - RNA, 22 nt, Human
cccaggaguuggaggcuacggu

SEQ ID NO: 799076 - RNA, 22 nt, Human
aacuguggagauucggaaggua

SEQ ID NO: 799077 - RNA, 22 nt, Human
gagaaaccgauucugcauguca

SEQ ID NO: 799078 - RNA, 20 nt, Human
augcaaaucccaaaaucagg

SEQ ID NO: 799079 - RNA, 22 nt, Human
ugccagcuuuugacuaucuuag

SEQ ID NO: 799080 - RNA, 22 nt, Human
gcagggcucugcuguaguccua

SEQ ID NO: 799081 - RNA, 22 nt, Human
cagugggaagggcagaggcuuu

SEQ ID NO: 799082 - RNA, 22 nt, Human
ggcaggaauaaauuauggacuu

SEQ ID NO: 799083 - RNA, 22 nt, Human
ggggcagggagguuaucgccga

SEQ ID NO: 799084 - RNA, 20 nt, Human
cccagggaccugagcuccau

SEQ ID NO: 799085 - RNA, 21 nt, Human
acagaaguggcuuggucucag

SEQ ID NO: 799086 - RNA, 22 nt, Human
agggggcucagcauggauggag

SEQ ID NO: 799087 - RNA, 22 nt, Human
cagugccaugucugagccccua

SEQ ID NO: 799088 - RNA, 22 nt, Human
uugcuaaucauauuucaucacu

SEQ ID NO: 799089 - RNA, 22 nt, Human
aauaauguaggaugauaaauga

SEQ ID NO: 799090 - RNA, 19 nt, Human
gacaggaaggcuaccagua

SEQ ID NO: 799091 - RNA, 22 nt, Human
ucccagggacuggaugaugcag

SEQ ID NO: 799092 - RNA, 22 nt, Human
aggucagaugggagaugggaug

SEQ ID NO: 799093 - RNA, 22 nt, Human
gcaaaugcucuccuuggucagg

SEQ ID NO: 799094 - RNA, 22 nt, Human
cauuuauuaguuaguucgaugu

SEQ ID NO: 799095 - RNA, 22 nt, Human
ucagggaguguuggcaggauca

SEQ ID NO: 799096 - RNA, 22 nt, Human
ugcuauuauugucaccacugua

SEQ ID NO: 799097 - RNA, 22 nt, Human
gcuggccaaaguguaccuggag

SEQ ID NO: 799098 - RNA, 22 nt, Human
guguuaaugaaaaacaacucau

SEQ ID NO: 799099 - RNA, 22 nt, Human
ggacccagguagggaggaagau

SEQ ID NO: 799100 - RNA, 22 nt, Human
agugcugggauuacaggcauaa

SEQ ID NO: 799101 - RNA, 22 nt, Human
agugcugggauugcaggcauga

SEQ ID NO: 799102 - RNA, 22 nt, Human
ucaaaguaccagagugaacuga

SEQ ID NO: 799103 - RNA, 22 nt, Human
auuucuguauccugcugucaga

SEQ ID NO: 799104 - RNA, 22 nt, Human
ggcaagagugaggagugucucu

SEQ ID NO: 799105 - RNA, 22 nt, Human
gccacagcggggccgcuagagc

SEQ ID NO: 799106 - RNA, 22 nt, Human
uaggauuuacuuugacaauauu

SEQ ID NO: 799107 - RNA, 22 nt, Human
cccaggaguaagugacauuguu

SEQ ID NO: 799108 - RNA, 19 nt, Human
acucaagucuaaugaaauc

SEQ ID NO: 799109 - RNA, 20 nt, Human
gcccacucuaauccacuguc

SEQ ID NO: 799110 - RNA, 22 nt, Human
uguuucaaaacagugauaauuu

SEQ ID NO: 799111 - RNA, 22 nt, Human
uugcaaauauuccccuaggucu

SEQ ID NO: 799112 - RNA, 22 nt, Human
acagucuugcacuucuaucagc

SEQ ID NO: 799113 - RNA, 22 nt, Human
uggcacauagaaaaggaucaau

SEQ ID NO: 799114 - RNA, 22 nt, Human
uucuuuuaaugucuggcuuuca

SEQ ID NO: 799115 - RNA, 22 nt, Human
uaaggaaaguacauguuuugac

SEQ ID NO: 799116 - RNA, 22 nt, Human
ucucaaauguaaagcaugauuu

SEQ ID NO: 799117 - RNA, 22 nt, Human
cugaggcuaaccucgagagaca

SEQ ID NO: 799118 - RNA, 22 nt, Human
aggcagugagaaauagcaagau

SEQ ID NO: 799119 - RNA, 22 nt, Human
cagguccucugagaugggaggu

SEQ ID NO: 799120 - RNA, 22 nt, Human
gcugcaggggggucuggacuug

SEQ ID NO: 799121 - RNA, 22 nt, Human
uguucuggcuccuuuuaaaugu

SEQ ID NO: 799122 - RNA, 22 nt, Human
uucuuacaucuauaaaguuggg

SEQ ID NO: 799123 - RNA, 22 nt, Human
auccaauuacguuuuuugucau

SEQ ID NO: 799124 - RNA, 22 nt, Human
aaacaagagucuugcuccaccu

SEQ ID NO: 799125 - RNA, 21 nt, Human
ucuuuuaacaccaggaauucc

SEQ ID NO: 799126 - RNA, 22 nt, Human
cucagucaugacgcucaggacc

SEQ ID NO: 799127 - RNA, 22 nt, Human
uaggacagagcugguuacaaug

SEQ ID NO: 799128 - RNA, 22 nt, Human
uucugaaaauugggucauacuu

SEQ ID NO: 799129 - RNA, 22 nt, Human
gagaaacuuggaguuauucugg

SEQ ID NO: 799130 - RNA, 22 nt, Human
agcugaaauucuuuguccucag

SEQ ID NO: 799131 - RNA, 22 nt, Human
cucagugucuuauuugaguucu

SEQ ID NO: 799132 - RNA, 22 nt, Human
gcuucccacagcuggacugggg

SEQ ID NO: 799133 - RNA, 18 nt, Human
uggagcaggaagccuggc

SEQ ID NO: 799134 - RNA, 22 nt, Human
cuucagaacuauaaaaaguacu

SEQ ID NO: 799135 - RNA, 22 nt, Human
ugacaucauuggccauugggga

SEQ ID NO: 799136 - RNA, 22 nt, Human
aaucuauaugcuuuucacauac

SEQ ID NO: 799137 - RNA, 22 nt, Human
ucugggcugucuacagguuggc

SEQ ID NO: 799138 - RNA, 22 nt, Human
cagggcaguaccgcccucuggc

SEQ ID NO: 799139 - RNA, 22 nt, Human
aaauaacuuucuguguauaguc

SEQ ID NO: 799140 - RNA, 20 nt, Human
agugggagagggcagacugc

SEQ ID NO: 799141 - RNA, 22 nt, Human
ucuuggccagguguggugccuc

SEQ ID NO: 799142 - RNA, 22 nt, Human
auaaaaguaggaccaacuuaca

SEQ ID NO: 799143 - RNA, 20 nt, Human
acauuuuggcauacucucaa

SEQ ID NO: 799144 - RNA, 23 nt, Human
agagcuuucuaaaauguaaaucu

SEQ ID NO: 799145 - RNA, 22 nt, Human
aaugauauuuauugaauagaug

SEQ ID NO: 799146 - RNA, 22 nt, Human
auuccaaacuuaccccagagga

SEQ ID NO: 799147 - RNA, 22 nt, Human
gagaaggcugauccuuggaguu

SEQ ID NO: 799148 - RNA, 22 nt, Human
acauaccaucuccuggaaagcu

SEQ ID NO: 799149 - RNA, 22 nt, Human
cucuccccacacccucugcaug

SEQ ID NO: 799150 - RNA, 22 nt, Human
cauccagaccgugccaugcugc

SEQ ID NO: 799151 - RNA, 20 nt, Human
ugccuggccuuucucugccc

SEQ ID NO: 799152 - RNA, 22 nt, Human
gcagggcuggguccugucucau

SEQ ID NO: 799153 - RNA, 22 nt, Human
cagggcuuuguaauaugagcac

SEQ ID NO: 799154 - RNA, 22 nt, Human
agguguggcuggggcagaggcc

SEQ ID NO: 799155 - RNA, 22 nt, Human
uggcccugcacccagagcaguu

SEQ ID NO: 799156 - RNA, 22 nt, Human
uggcuggcugucaaggaaagcc

SEQ ID NO: 799157 - RNA, 22 nt, Human
uggcagccuggaaucucucagc

SEQ ID NO: 799158 - RNA, 22 nt, Human
ucuucaauuuagaauggauuua

SEQ ID NO: 799159 - RNA, 21 nt, Human
aaacugaccuugccugagaca

SEQ ID NO: 799160 - RNA, 22 nt, Human
gaaugauauuauuucgugcugg

SEQ ID NO: 799161 - RNA, 22 nt, Human
uuucagaauagcaaagcaagcu

SEQ ID NO: 799162 - RNA, 22 nt, Human
uagggggcuuugcugcuugaca

SEQ ID NO: 799163 - RNA, 22 nt, Human
accuuaaaacugacacauggag

SEQ ID NO: 799164 - RNA, 22 nt, Human
gaggcucaacccacagggguug

SEQ ID NO: 799165 - RNA, 23 nt, Human
ccaguuuaucuuuaguguagauc

SEQ ID NO: 799166 - RNA, 22 nt, Human
cugcaccacagccugaggcagc

SEQ ID NO: 799167 - RNA, 22 nt, Human
ucuggaguaugugugaacggug

SEQ ID NO: 799168 - RNA, 18 nt, Human
agucuuuauuucuuucau

SEQ ID NO: 799169 - RNA, 22 nt, Human
cauaacauugagcagcauuccu

SEQ ID NO: 799170 - RNA, 22 nt, Human
uguauuaugauuguuguucaug

SEQ ID NO: 799171 - RNA, 21 nt, Human
ggagcuggggagcuggcccca

SEQ ID NO: 799172 - RNA, 22 nt, Human
uacauuuccugucagagauaua

SEQ ID NO: 799173 - RNA, 22 nt, Human
uggcagcaugucccggccucag

SEQ ID NO: 799174 - RNA, 22 nt, Human
uagcuuugcaaaggaaguuuua

SEQ ID NO: 799175 - RNA, 19 nt, Human
caggaacauggagggaggg

SEQ ID NO: 799176 - RNA, 22 nt, Human
cugggacccccacugcguagcu

SEQ ID NO: 799177 - RNA, 17 nt, Human
uccagagaggcuucccu

SEQ ID NO: 799178 - RNA, 22 nt, Human
cccagccucuggauucugcccu

SEQ ID NO: 799179 - RNA, 22 nt, Human
agagcccugccaauggaugagg

SEQ ID NO: 799180 - RNA, 22 nt, Human
auguucugaauaaugugcauua

SEQ ID NO: 799181 - RNA, 21 nt, Human
aagaggucaaauuauaaaugg

SEQ ID NO: 799182 - RNA, 22 nt, Human
uaucaggaauugaauggcuuca

SEQ ID NO: 799183 - RNA, 22 nt, Human
uuacuugacauaaaugaguuua

SEQ ID NO: 799184 - RNA, 22 nt, Human
ucuggagaggggccuagaauuu

SEQ ID NO: 799185 - RNA, 22 nt, Human
acauauaagggaucagugacag

SEQ ID NO: 799186 - RNA, 22 nt, Human
guuuucagccaggagcacauuu

SEQ ID NO: 799187 - RNA, 22 nt, Human
ugcuucuuuacuauaggcaauu

SEQ ID NO: 799188 - RNA, 22 nt, Human
gugacucuuaccuacccagccu

SEQ ID NO: 799189 - RNA, 22 nt, Human
gaaaagggcaagagagagggca

SEQ ID NO: 799190 - RNA, 22 nt, Human
agccaaauacaaacuggggugg

SEQ ID NO: 799191 - RNA, 22 nt, Human
guuacaauguccuuacaugaaa

SEQ ID NO: 799192 - RNA, 22 nt, Human
gaugauuacacuuuuaaaacag

SEQ ID NO: 799193 - RNA, 22 nt, Human
auuauuuuaugugcggccugau

SEQ ID NO: 799194 - RNA, 22 nt, Human
cacagcugccauggcugcacuu

SEQ ID NO: 799195 - RNA, 22 nt, Human
gcauggcaagacccugucucua

SEQ ID NO: 799196 - RNA, 22 nt, Human
uccagagagguuucuccaugcu

SEQ ID NO: 799197 - RNA, 22 nt, Human
acuggcugaguugcuucagcaa

SEQ ID NO: 799198 - RNA, 23 nt, Human
agggcccaagccuggacagcagg

SEQ ID NO: 799199 - RNA, 22 nt, Human
gcagcuggggaggucgugggga

SEQ ID NO: 799200 - RNA, 22 nt, Human
ugagcagggagcugggcugagc

SEQ ID NO: 799201 - RNA, 22 nt, Human
aauaccuugcucauagggcuga

SEQ ID NO: 799202 - RNA, 22 nt, Human
agucucuuucuaaauaagguca

SEQ ID NO: 799203 - RNA, 22 nt, Human
uuauuauuccccaagucauuau

SEQ ID NO: 799204 - RNA, 22 nt, Human
guggcucuccauugacauggaa

SEQ ID NO: 799205 - RNA, 22 nt, Human
aaggcaauguuagcaacauaau

SEQ ID NO: 799206 - RNA, 21 nt, Human
agcugggccucagccugcagu

SEQ ID NO: 799207 - RNA, 22 nt, Human
cccagaaggcuaagcguggauu

SEQ ID NO: 799208 - RNA, 22 nt, Human
uuuguacauauaaaucuuguau

SEQ ID NO: 799209 - RNA, 22 nt, Human
uggacaggaucugagacugaga

SEQ ID NO: 799210 - RNA, 22 nt, Human
agaaggggcccaaggaugucag

SEQ ID NO: 799211 - RNA, 22 nt, Human
caguccugagcuccugggcuga

SEQ ID NO: 799212 - RNA, 17 nt, Human
ugguggcuggagucagg

SEQ ID NO: 799213 - RNA, 22 nt, Human
uaaggaaaauggacaucaaaca

SEQ ID NO: 799214 - RNA, 22 nt, Human
cagcuuugucauuugauuuggg

SEQ ID NO: 799215 - RNA, 22 nt, Human
aggaggccgauuucagaggucg

SEQ ID NO: 799216 - RNA, 22 nt, Human
gcuggagugaugccugugucuc

SEQ ID NO: 799217 - RNA, 22 nt, Human
gaaagugccucaguccucuuau

SEQ ID NO: 799218 - RNA, 22 nt, Human
ggguggugggcacagaaucugg

SEQ ID NO: 799219 - RNA, 22 nt, Human
uuucuacagaagauacacugcu

SEQ ID NO: 799220 - RNA, 22 nt, Human
acuuuggcacagaacuuccauu

SEQ ID NO: 799221 - RNA, 22 nt, Human
gagggcaggggucuugcacggu

SEQ ID NO: 799222 - RNA, 18 nt, Human
uaagucauuuugccagca

SEQ ID NO: 799223 - RNA, 22 nt, Human
cacuugaagugaauugcucacc

SEQ ID NO: 799224 - RNA, 22 nt, Human
agaggagguccuuuucugaugu

SEQ ID NO: 799225 - RNA, 22 nt, Human
ggaaggggagcuggaaagggua

SEQ ID NO: 799226 - RNA, 22 nt, Human
agaaagagcucgggauuaacag

SEQ ID NO: 799227 - RNA, 22 nt, Human
gccuggggcaugcagcugauac

SEQ ID NO: 799228 - RNA, 22 nt, Human
uauacagauaucuaagauguaa

SEQ ID NO: 799229 - RNA, 22 nt, Human
cccuccccacaaagcuucacac

SEQ ID NO: 799230 - RNA, 22 nt, Human
ccuggcaguggugaagaagagg

SEQ ID NO: 799231 - RNA, 22 nt, Human
caauaaagaagauuuuugcaau

SEQ ID NO: 799232 - RNA, 22 nt, Human
uggccagcccucuucccacacu

SEQ ID NO: 799233 - RNA, 22 nt, Human
uauauagaaaagcagauguugg

SEQ ID NO: 799234 - RNA, 22 nt, Human
aucaguguuucaaauguaaucu

SEQ ID NO: 799235 - RNA, 22 nt, Human
uuaaacauuuuugaugaucgau

SEQ ID NO: 799236 - RNA, 22 nt, Human
caagccauauuuugaagaauga

SEQ ID NO: 799237 - RNA, 22 nt, Human
aggcuggugauuagaagcagcc

SEQ ID NO: 799238 - RNA, 22 nt, Human
uugcauuuugguuguaaauaug

SEQ ID NO: 799239 - RNA, 22 nt, Human
uaucuuuagaggaagagaaucu

SEQ ID NO: 799240 - RNA, 22 nt, Human
agcuggagccagugugaggcuu

SEQ ID NO: 799241 - RNA, 19 nt, Human
ugguggaggugcaccugac

SEQ ID NO: 799242 - RNA, 22 nt, Human
accaugucauuuauuggccaaa

SEQ ID NO: 799243 - RNA, 22 nt, Human
uuguauuucuuccggucucauu

SEQ ID NO: 799244 - RNA, 22 nt, Human
caguucucuugaucgucucuug

SEQ ID NO: 799245 - RNA, 22 nt, Human
gggcaauggaugugaugacucc

SEQ ID NO: 799246 - RNA, 22 nt, Human
ucccagcauuaaugccugucag

SEQ ID NO: 799247 - RNA, 22 nt, Human
cugggccagggaggugucugua

SEQ ID NO: 799248 - RNA, 22 nt, Human
uucuuugugcauccaauuuucu

SEQ ID NO: 799249 - RNA, 22 nt, Human
gcaggcacuccuaggaccauca

SEQ ID NO: 799250 - RNA, 22 nt, Human
ggcugcagauagccagccacca

SEQ ID NO: 799251 - RNA, 22 nt, Human
acucagagaauaucuagaagga

SEQ ID NO: 799252 - RNA, 22 nt, Human
gcuggcagccaagugaagaggg

SEQ ID NO: 799253 - RNA, 22 nt, Human
uaaggaaagugccaugauuucu

SEQ ID NO: 799254 - RNA, 22 nt, Human
gagagcccuuagguuuagaguu

SEQ ID NO: 799255 - RNA, 22 nt, Human
ggccagcccagugguccucucu

SEQ ID NO: 799256 - RNA, 22 nt, Human
acauaagugcacaauaaauauu

SEQ ID NO: 799257 - RNA, 22 nt, Human
ccagcugugccuaggagcaggg

SEQ ID NO: 799258 - RNA, 22 nt, Human
agucuucuugaucuuuucagug

SEQ ID NO: 799259 - RNA, 22 nt, Human
guccagccaggcugcagcaccc

SEQ ID NO: 799260 - RNA, 22 nt, Human
uuauuaaucuuaucuuuggaaa

SEQ ID NO: 799261 - RNA, 22 nt, Human
ccagucagggcaggagccuggu

SEQ ID NO: 799262 - RNA, 22 nt, Human
uauuuguagaauggauuaaggg

SEQ ID NO: 799263 - RNA, 22 nt, Human
acugcuuuagaccuagagcucu

SEQ ID NO: 799264 - RNA, 15 nt, Human
aaagugcacccaaua

SEQ ID NO: 799265 - RNA, 22 nt, Human
uacauucugguggagaaaguaa

SEQ ID NO: 799266 - RNA, 22 nt, Human
auuauucauggucuuccacaau

SEQ ID NO: 799267 - RNA, 22 nt, Human
cucagggacguuagaggacagg

SEQ ID NO: 799268 - RNA, 20 nt, Human
ucaggcaguggggaaaggca

SEQ ID NO: 799269 - RNA, 22 nt, Human
auauuuugguagcucucaauga

SEQ ID NO: 799270 - RNA, 22 nt, Human
accuuaaacuuuacagccaagu

SEQ ID NO: 799271 - RNA, 22 nt, Human
cucaaauauaagcuaaaugugg

SEQ ID NO: 799272 - RNA, 20 nt, Human
uggagucugacagaugggua

SEQ ID NO: 799273 - RNA, 22 nt, Human
aaaaaccuuucauugcaaaugu

SEQ ID NO: 799274 - RNA, 22 nt, Human
gagcucagcccaaagagcagug

SEQ ID NO: 799275 - RNA, 22 nt, Human
cuggagggagauucaaaggagg

SEQ ID NO: 799276 - RNA, 22 nt, Human
agcuggcuuugagcugggaggu

SEQ ID NO: 799277 - RNA, 22 nt, Human
cuggcucugugggaccuggccu

SEQ ID NO: 799278 - RNA, 22 nt, Human
aacacaggggcguggcucuuac

SEQ ID NO: 799279 - RNA, 22 nt, Human
gcagugcuaaguagcuggccca

SEQ ID NO: 799280 - RNA, 22 nt, Human
aauuucuguaugaauagagaaa

SEQ ID NO: 799281 - RNA, 22 nt, Human
uuugacaugugcuuauaacuuu

SEQ ID NO: 799282 - RNA, 22 nt, Human
acauuuuacaguugucuggcua

SEQ ID NO: 799283 - RNA, 22 nt, Human
agaacaaugcguauuuuacucc

SEQ ID NO: 799284 - RNA, 22 nt, Human
uaggaaauugccaauauaugac

SEQ ID NO: 799285 - RNA, 22 nt, Human
aggccuggccccaguugcuagg

SEQ ID NO: 799286 - RNA, 22 nt, Human
aaaauucauggcuugggaaaag

SEQ ID NO: 799287 - RNA, 22 nt, Human
cgcugggggaacuucagccaau

SEQ ID NO: 799288 - RNA, 22 nt, Human
cuuccuaaaagcuucaagagaa

SEQ ID NO: 799289 - RNA, 22 nt, Human
acccaggcgggagugcaguguc

SEQ ID NO: 799290 - RNA, 22 nt, Human
ggcugccucagauuugcugacu

SEQ ID NO: 799291 - RNA, 22 nt, Human
ccuggccaggcauggagucaca

SEQ ID NO: 799292 - RNA, 22 nt, Human
gcauagcuguuaauuugguuuc

SEQ ID NO: 799293 - RNA, 22 nt, Human
uuggagucauuggccuggguga

SEQ ID NO: 799294 - RNA, 22 nt, Human
aggcacagcacaccuggccccc

SEQ ID NO: 799295 - RNA, 22 nt, Human
uugauuucaaaauauaugcuug

SEQ ID NO: 799296 - RNA, 22 nt, Human
gggcugugaggugagaacuuac

SEQ ID NO: 799297 - RNA, 22 nt, Human
guacaauuauuuaaauggugaa

SEQ ID NO: 799298 - RNA, 22 nt, Human
gcugggucuggaugcucaggug

SEQ ID NO: 799299 - RNA, 22 nt, Human
gggcugagagcuggaaucugag

SEQ ID NO: 799300 - RNA, 22 nt, Human
gaauaauauugacuuugcaggc

SEQ ID NO: 799301 - RNA, 22 nt, Human
uguccaggucagcagcagggac

SEQ ID NO: 799302 - RNA, 22 nt, Human
agccagagauugagaugcaggc

SEQ ID NO: 799303 - RNA, 22 nt, Human
uuauggcuuaaauacuacaggg

SEQ ID NO: 799304 - RNA, 22 nt, Human
gaggcugguucugaaguacugu

SEQ ID NO: 799305 - RNA, 22 nt, Human
agcaggagaacacuguggcucu

SEQ ID NO: 799306 - RNA, 22 nt, Human
gugcagcugugguggagccagg

SEQ ID NO: 799307 - RNA, 22 nt, Human
uuguauuaauugaaaugaaugc

SEQ ID NO: 799308 - RNA, 22 nt, Human
uugcaaaugaccauugccacau

SEQ ID NO: 799309 - RNA, 22 nt, Human
cuuaauuucaaacugcuaguga

SEQ ID NO: 799310 - RNA, 22 nt, Human
acaaaccagcuuaagcaagaug

SEQ ID NO: 799311 - RNA, 22 nt, Human
ucacagagaaauguggcacaaa

SEQ ID NO: 799312 - RNA, 22 nt, Human
uuugucaucaguuauuaauaug

SEQ ID NO: 799313 - RNA, 22 nt, Human
guggucaggggcuguggcuaug

SEQ ID NO: 799314 - RNA, 22 nt, Human
ucaggaaaguguucucagagga

SEQ ID NO: 799315 - RNA, 22 nt, Human
uguuuucauuugauguaacaaa

SEQ ID NO: 799316 - RNA, 22 nt, Human
cccaggcagugcugaucccuca

SEQ ID NO: 799317 - RNA, 22 nt, Human
aucauuuaaaacaagucucuau

SEQ ID NO: 799318 - RNA, 22 nt, Human
ggaagaggaggagccaggcuuu

SEQ ID NO: 799319 - RNA, 22 nt, Human
gccuccugagaagccacaggcu

SEQ ID NO: 799320 - RNA, 22 nt, Human
cagagccaaaccucagggcccg

SEQ ID NO: 799321 - RNA, 22 nt, Human
uuucccaagaaaaauaauugga

SEQ ID NO: 799322 - RNA, 22 nt, Human
agaacacacugggggaaacaag

SEQ ID NO: 799323 - RNA, 20 nt, Human
ucuuaaauccccagggccau

SEQ ID NO: 799324 - RNA, 22 nt, Human
uacaaaguaauguauaauaucg

SEQ ID NO: 799325 - RNA, 22 nt, Human
aucacacagagcauuaggggcc

SEQ ID NO: 799326 - RNA, 22 nt, Human
uuucuuuguaguagcauaauca

SEQ ID NO: 799327 - RNA, 22 nt, Human
aagcugccuuccaugugaggaa

SEQ ID NO: 799328 - RNA, 22 nt, Human
gucaacuuuuucauagcucugc

SEQ ID NO: 799329 - RNA, 22 nt, Human
cauggccagcccugagguucag

SEQ ID NO: 799330 - RNA, 22 nt, Human
ccuccuggaaaaauucccuggc

SEQ ID NO: 799331 - RNA, 22 nt, Human
aguggcagagccaggguuggga

SEQ ID NO: 799332 - RNA, 22 nt, Human
uaacacauagauauuuuaacuu

SEQ ID NO: 799333 - RNA, 22 nt, Human
uggcuucuagagcccauccuuc

SEQ ID NO: 799334 - RNA, 22 nt, Human
acaggacaacucagcagccagc

SEQ ID NO: 799335 - RNA, 22 nt, Human
aaacugcaauuauguuugcaga

SEQ ID NO: 799336 - RNA, 22 nt, Human
uucuggagaggaacagaaaggu

SEQ ID NO: 799337 - RNA, 22 nt, Human
uggccaguguuggcuagggaca

SEQ ID NO: 799338 - RNA, 22 nt, Human
gugggcagcaccagggaagugu

SEQ ID NO: 799339 - RNA, 22 nt, Human
ucacaauucagaaaccaaguag

SEQ ID NO: 799340 - RNA, 22 nt, Human
aggaggcuguggagcacuccau

SEQ ID NO: 799341 - RNA, 22 nt, Human
gcacuguucucagagcauuaga

SEQ ID NO: 799342 - RNA, 22 nt, Human
caucacagaaauaaacauaccu

SEQ ID NO: 799343 - RNA, 22 nt, Human
gaaagugcuaggaaguguuaga

SEQ ID NO: 799344 - RNA, 22 nt, Human
auugauucuguaagucaacaau

SEQ ID NO: 799345 - RNA, 22 nt, Human
agccagcuggugggucagcugg

SEQ ID NO: 799346 - RNA, 22 nt, Human
aauauguuccacuuaaagcugg

SEQ ID NO: 799347 - RNA, 22 nt, Human
gccacccugacgccgcagaccc

SEQ ID NO: 799348 - RNA, 22 nt, Human
uuccaggaggagguacuagagg

SEQ ID NO: 799349 - RNA, 22 nt, Human
agcuggaggaguuucuccuagc

SEQ ID NO: 799350 - RNA, 22 nt, Human
ucccaggcuaggccucugcguu

SEQ ID NO: 799351 - RNA, 22 nt, Human
caggcagcagaggaguguggga

SEQ ID NO: 799352 - RNA, 22 nt, Human
auguggcuagugcaacugagaa

SEQ ID NO: 799353 - RNA, 22 nt, Human
augccaaaauguuacauuucuu

SEQ ID NO: 799354 - RNA, 22 nt, Human
ucagcugaaguggagaagcaga

SEQ ID NO: 799355 - RNA, 22 nt, Human
ugccuggcaccccagucugcac

SEQ ID NO: 799356 - RNA, 22 nt, Human
ggcuggcucuuaccgacagcgu

SEQ ID NO: 799357 - RNA, 22 nt, Human
aaugacaauaaucauuaacuuu

SEQ ID NO: 799358 - RNA, 22 nt, Human
cacucugugauugcagcauucc

SEQ ID NO: 799359 - RNA, 22 nt, Human
uugacaauguccuuugaauuuc

SEQ ID NO: 799360 - RNA, 22 nt, Human
agcucuuuugcucuccaaguuu

SEQ ID NO: 799361 - RNA, 22 nt, Human
uucacuauaaaguuucaacuuu

SEQ ID NO: 799362 - RNA, 22 nt, Human
ucuuccaaaugaauaugguuuu

SEQ ID NO: 799363 - RNA, 22 nt, Human
gaguccuguaacuuucuuccua

SEQ ID NO: 799364 - RNA, 22 nt, Human
ccucacccacuacacucaaggg

SEQ ID NO: 799365 - RNA, 22 nt, Human
acuuucaagaacuucuuuaaug

SEQ ID NO: 799366 - RNA, 17 nt, Human
aguguucuggguugccc

SEQ ID NO: 799367 - RNA, 22 nt, Human
ggcaggcagauggcugcaccaa

SEQ ID NO: 799368 - RNA, 22 nt, Human
agugucaacugucuacagggag

SEQ ID NO: 799369 - RNA, 22 nt, Human
gagcccagcugcggcccucagc

SEQ ID NO: 799370 - RNA, 22 nt, Human
aauugagaugacagaggaauag

SEQ ID NO: 799371 - RNA, 22 nt, Human
aaucacaucacugagaaugagg

SEQ ID NO: 799372 - RNA, 22 nt, Human
ucugcagcuucuugccagagag

SEQ ID NO: 799373 - RNA, 22 nt, Human
cuggccaggcggccccugcaug

SEQ ID NO: 799374 - RNA, 22 nt, Human
ugcagagguuugugguguugcu

SEQ ID NO: 799375 - RNA, 22 nt, Human
caggaaggggcucacucuggcc

SEQ ID NO: 799376 - RNA, 22 nt, Human
agagagcaguggaucaccuagc

SEQ ID NO: 799377 - RNA, 18 nt, Human
gugggguguugugaggau

SEQ ID NO: 799378 - RNA, 22 nt, Human
agcagcuggggccugugacgau

SEQ ID NO: 799379 - RNA, 23 nt, Human
ugagaaauuuugauucaguagga

SEQ ID NO: 799380 - RNA, 22 nt, Human
uuuccugugcuuaacaaauauu

SEQ ID NO: 799381 - RNA, 22 nt, Human
ccaggcccguucccuucuccag

SEQ ID NO: 799382 - RNA, 22 nt, Human
uaggaaauuuauagagguguuu

SEQ ID NO: 799383 - RNA, 20 nt, Human
aacuuguuuuguuuucuaau

SEQ ID NO: 799384 - RNA, 22 nt, Human
agccuggaguucccaggagaag

SEQ ID NO: 799385 - RNA, 22 nt, Human
cccaggugcugaaggaggccgc

SEQ ID NO: 799386 - RNA, 22 nt, Human
agagccaggccaggccggggca

SEQ ID NO: 799387 - RNA, 22 nt, Human
uuuuuaagagucuggaaauagu

SEQ ID NO: 799388 - RNA, 22 nt, Human
guccuuggagucaggcaaggcu

SEQ ID NO: 799389 - RNA, 22 nt, Human
ugcagcagagugggccugggug

SEQ ID NO: 799390 - RNA, 22 nt, Human
acagcuucacccauuaucccug

SEQ ID NO: 799391 - RNA, 22 nt, Human
acccaggcuagggugcaguggc

SEQ ID NO: 799392 - RNA, 22 nt, Human
aucaaauauaauaauuuucgcu

SEQ ID NO: 799393 - RNA, 22 nt, Human
ccauuuaacacagaguuuucca

SEQ ID NO: 799394 - RNA, 22 nt, Human
aagucagaccuuguugauagcu

SEQ ID NO: 799395 - RNA, 22 nt, Human
cagggcucuuccggagcaggga

SEQ ID NO: 799396 - RNA, 22 nt, Human
aaagauuaaaucaaauugguca

SEQ ID NO: 799397 - RNA, 22 nt, Human
uuuugggugaauuugccaguua

SEQ ID NO: 799398 - RNA, 22 nt, Human
cuggccucuguguucaccauag

SEQ ID NO: 799399 - RNA, 22 nt, Human
cucccugcuuguuucccuucag

SEQ ID NO: 799400 - RNA, 22 nt, Human
acaguauaccauugugacuuug

SEQ ID NO: 799401 - RNA, 22 nt, Human
agcacagagguggaaguguaua

SEQ ID NO: 799402 - RNA, 22 nt, Human
cacugaggcuuccuuaggcaau

SEQ ID NO: 799403 - RNA, 22 nt, Human
acucugccaucccaggugcugu

SEQ ID NO: 799404 - RNA, 22 nt, Human
ucuaaacagccucuuaccaacu

SEQ ID NO: 799405 - RNA, 22 nt, Human
aaaagcacuacaauuucgcuuc

SEQ ID NO: 799406 - RNA, 22 nt, Human
ccaggcuguaagagugauguug

SEQ ID NO: 799407 - RNA, 23 nt, Human
uggcucugagagguucagaugcu

SEQ ID NO: 799408 - RNA, 22 nt, Human
gaggcccaguccugcaagcacg

SEQ ID NO: 799409 - RNA, 22 nt, Human
acacagggcggaaagcaugaga

SEQ ID NO: 799410 - RNA, 22 nt, Human
aggcuggcgucaggggcuguac

SEQ ID NO: 799411 - RNA, 22 nt, Human
ugcaggugaaaauuaugaggau

SEQ ID NO: 799412 - RNA, 22 nt, Human
aggguggggugcuacaucuuua

SEQ ID NO: 799413 - RNA, 22 nt, Human
uguguuuuccagaaugguguuu

SEQ ID NO: 799414 - RNA, 17 nt, Human
uuuguucauugaagaga

SEQ ID NO: 799415 - RNA, 22 nt, Human
uaggacaggugaggggcugugg

SEQ ID NO: 799416 - RNA, 22 nt, Human
caccccaaguucuguccacugc

SEQ ID NO: 799417 - RNA, 22 nt, Human
aaauuuuaaggcuggaacuuaa

SEQ ID NO: 799418 - RNA, 22 nt, Human
auuguaaaaguauucuaagauu

SEQ ID NO: 799419 - RNA, 22 nt, Human
ucagaaggaugugcagguggca

SEQ ID NO: 799420 - RNA, 22 nt, Human
ggggugaguuagcgucggcuug

SEQ ID NO: 799421 - RNA, 22 nt, Human
aaggccagggaugccagcucgg

SEQ ID NO: 799422 - RNA, 22 nt, Human
uugauuaaaaugagacaucauu

SEQ ID NO: 799423 - RNA, 20 nt, Human
cagauaaacgggaaagaagc

SEQ ID NO: 799424 - RNA, 22 nt, Human
guucagugccaguucuaagacu

SEQ ID NO: 799425 - RNA, 22 nt, Human
gccugccaguguuugaggauug

SEQ ID NO: 799426 - RNA, 22 nt, Human
ugagccugggagauggaggcug

SEQ ID NO: 799427 - RNA, 22 nt, Human
caugcagguuauaugugcuucu

SEQ ID NO: 799428 - RNA, 22 nt, Human
aaaacucugcaguuaguuucua

SEQ ID NO: 799429 - RNA, 22 nt, Human
uuggugaacacauacacauuuu

SEQ ID NO: 799430 - RNA, 22 nt, Human
cagcugggugaucuugggcagg

SEQ ID NO: 799431 - RNA, 22 nt, Human
uggcuuccaguaaucaggauuu

SEQ ID NO: 799432 - RNA, 22 nt, Human
ccaaggcuggagugcaguggcg

SEQ ID NO: 799433 - RNA, 22 nt, Human
cccagggaggcccaggcucugc

SEQ ID NO: 799434 - RNA, 22 nt, Human
gggaccaggugggugcauuccg

SEQ ID NO: 799435 - RNA, 22 nt, Human
uccagcagugcucaggacucac

SEQ ID NO: 799436 - RNA, 22 nt, Human
uguacaaauucauugaacugua

SEQ ID NO: 799437 - RNA, 22 nt, Human
uagugcuuauuacugugcuguc

SEQ ID NO: 799438 - RNA, 22 nt, Human
cuggcccauggugagcucuggg

SEQ ID NO: 799439 - RNA, 22 nt, Human
cagggugcauacccaugcauac

SEQ ID NO: 799440 - RNA, 22 nt, Human
agauauaauaauuuacaagugu

SEQ ID NO: 799441 - RNA, 22 nt, Human
uucuuguuuauuaagauauaaa

SEQ ID NO: 799442 - RNA, 22 nt, Human
aggcugugaacucuaugcugaa

SEQ ID NO: 799443 - RNA, 19 nt, Human
ggccaggcugacugugguc

SEQ ID NO: 799444 - RNA, 22 nt, Human
guggguggaucaccugagguca

SEQ ID NO: 799445 - RNA, 22 nt, Human
cucccaggguagggagagacua

SEQ ID NO: 799446 - RNA, 22 nt, Human
guccccagaaaggugaggcagg

SEQ ID NO: 799447 - RNA, 22 nt, Human
ugaggcaggacauggacaacug

SEQ ID NO: 799448 - RNA, 22 nt, Human
auauaacucuuguucuuauagu

SEQ ID NO: 799449 - RNA, 22 nt, Human
ggggccagcaauguugaggaau

SEQ ID NO: 799450 - RNA, 22 nt, Human
aguuuuucuccccuggcuucau

SEQ ID NO: 799451 - RNA, 22 nt, Human
gugucugaguuuggaaagucca

SEQ ID NO: 799452 - RNA, 22 nt, Human
gguuaaaacugauauuaugggu

SEQ ID NO: 799453 - RNA, 22 nt, Human
gguuaaaaauaauuuacuuggc

SEQ ID NO: 799454 - RNA, 22 nt, Human
cuguggcuaugguguacauacu

SEQ ID NO: 799455 - RNA, 22 nt, Human
guguggggucuucucuuggccu

SEQ ID NO: 799456 - RNA, 22 nt, Human
ccagaacacaguggaagaauau

SEQ ID NO: 799457 - RNA, 17 nt, Human
aagauuucauuagcuga

SEQ ID NO: 799458 - RNA, 22 nt, Human
agcucaggcucugcagggacua

SEQ ID NO: 799459 - RNA, 22 nt, Human
ucaggcugauaggaggaacuga

SEQ ID NO: 799460 - RNA, 22 nt, Human
ucaggaaagguuuguugaaugg

SEQ ID NO: 799461 - RNA, 22 nt, Human
ggcccagccuugggguuucuuu

SEQ ID NO: 799462 - RNA, 22 nt, Human
aaguuauaucaucucauugacg

SEQ ID NO: 799463 - RNA, 22 nt, Human
caggaggacauacuggcucaca

SEQ ID NO: 799464 - RNA, 22 nt, Human
aucuuuggguacaaacuugccu

SEQ ID NO: 799465 - RNA, 20 nt, Human
ucucccugcccaucucagau

SEQ ID NO: 799466 - RNA, 22 nt, Human
aaggcagauauaaagacuagag

SEQ ID NO: 799467 - RNA, 22 nt, Human
auuucucaucuuugugaauggu

SEQ ID NO: 799468 - RNA, 22 nt, Human
agaggcuguuacacucccagau

SEQ ID NO: 799469 - RNA, 22 nt, Human
uggaaauaugcuccauucuuuu

SEQ ID NO: 799470 - RNA, 22 nt, Human
caauaacuaguaauuauuccgg

SEQ ID NO: 799471 - RNA, 22 nt, Human
cuccaggauguuagacguccag

SEQ ID NO: 799472 - RNA, 22 nt, Human
agaaagcacucugucuuuuacc

SEQ ID NO: 799473 - RNA, 22 nt, Human
caagacaagaucuaagcaugcu

SEQ ID NO: 799474 - RNA, 20 nt, Human
uugauucaagggcugaugga

SEQ ID NO: 799475 - RNA, 22 nt, Human
uaaaaagcagcugagauuuucu

SEQ ID NO: 799476 - RNA, 22 nt, Human
cacaugggugugccuggaggaa

SEQ ID NO: 799477 - RNA, 22 nt, Human
gcaguccucucauuggccuccu

SEQ ID NO: 799478 - RNA, 22 nt, Human
ucccuccuggccgucaccgcug

SEQ ID NO: 799479 - RNA, 19 nt, Human
cacagugcagccauuucuc

SEQ ID NO: 799480 - RNA, 20 nt, Human
ggcagggcaucaacagcucu

SEQ ID NO: 799481 - RNA, 23 nt, Human
uagcagcauuuuuagccucuguc

SEQ ID NO: 799482 - RNA, 22 nt, Human
aguuuuaucuguaagcuguuca

SEQ ID NO: 799483 - RNA, 22 nt, Human
acugccuguuuggcauggcccc

SEQ ID NO: 799484 - RNA, 22 nt, Human
ucuggcugggaagggggcccga

SEQ ID NO: 799485 - RNA, 22 nt, Human
aagcacaauuuaggacugaaau

SEQ ID NO: 799486 - RNA, 22 nt, Human
cuucaguguugguucauuacga

SEQ ID NO: 799487 - RNA, 22 nt, Human
cuggcaaguacugggccagcuc

SEQ ID NO: 799488 - RNA, 22 nt, Human
acagggcaccugagguaggaag

SEQ ID NO: 799489 - RNA, 22 nt, Human
acccaggcuagaagugaauuau

SEQ ID NO: 799490 - RNA, 22 nt, Human
gaggcucccuuuagguccagau

SEQ ID NO: 799491 - RNA, 22 nt, Human
ggggaggaguguacagguuuau

SEQ ID NO: 799492 - RNA, 22 nt, Human
cagcccugcugacacugucuga

SEQ ID NO: 799493 - RNA, 22 nt, Human
ccaugcaagaaguccaaccauc

SEQ ID NO: 799494 - RNA, 22 nt, Human
ugcauuaagggccuggagauac

SEQ ID NO: 799495 - RNA, 22 nt, Human
gaggcuggggucugccuuucug

SEQ ID NO: 799496 - RNA, 22 nt, Human
ugggaacucucugggaggcauc

SEQ ID NO: 799497 - RNA, 22 nt, Human
cugggccuccagcucugccagc

SEQ ID NO: 799498 - RNA, 20 nt, Human
agguggcuccugcugggggu

SEQ ID NO: 799499 - RNA, 22 nt, Human
cacagaaaaaggcuugaaaauc

SEQ ID NO: 799500 - RNA, 22 nt, Human
uccauauacaacuuaaucuuua

SEQ ID NO: 799501 - RNA, 22 nt, Human
ccaggcugggcggggaaccugg

SEQ ID NO: 799502 - RNA, 22 nt, Human
aaugcucuuuaaccuauucuga

SEQ ID NO: 799503 - RNA, 22 nt, Human
cugugacuugccaaaggucauu

SEQ ID NO: 799504 - RNA, 22 nt, Human
guggaugagauaacuguagaag

SEQ ID NO: 799505 - RNA, 22 nt, Human
ugcaggcugccuucacagagcc

SEQ ID NO: 799506 - RNA, 22 nt, Human
aaggaagagucuagaacaggca

SEQ ID NO: 799507 - RNA, 22 nt, Human
ucuguaggguaguaguggagau

SEQ ID NO: 799508 - RNA, 22 nt, Human
aaaggcagugugauacuguggu

SEQ ID NO: 799509 - RNA, 22 nt, Human
gucuucuguuuacuuugaaguu

SEQ ID NO: 799510 - RNA, 22 nt, Human
uucaagucauguuaacugcuuc

SEQ ID NO: 799511 - RNA, 22 nt, Human
gggcuuggcacaugggcucagc

SEQ ID NO: 799512 - RNA, 22 nt, Human
aacauaagggagcuucaaaacu

SEQ ID NO: 799513 - RNA, 22 nt, Human
uaucucuuuauugacaauaaaa

SEQ ID NO: 799514 - RNA, 22 nt, Human
cuggagggauguaggguguauu

SEQ ID NO: 799515 - RNA, 22 nt, Human
uauuaaauguuauuuggguugu

SEQ ID NO: 799516 - RNA, 22 nt, Human
gcaaagugcuucagugggagcu

SEQ ID NO: 799517 - RNA, 22 nt, Human
ggcugguguuacagucggcagc

SEQ ID NO: 799518 - RNA, 22 nt, Human
gcuggcugugauuuugccaaca

SEQ ID NO: 799519 - RNA, 22 nt, Human
aggcagcauuucugcuuaucca

SEQ ID NO: 799520 - RNA, 22 nt, Human
cuugccaaugguacaaacgauu

SEQ ID NO: 799521 - RNA, 22 nt, Human
agcaggguuccaggaguugcag

SEQ ID NO: 799522 - RNA, 22 nt, Human
gcacuugugacaguuccuggca

SEQ ID NO: 799523 - RNA, 22 nt, Human
cccaggagagaggccaguuggc

SEQ ID NO: 799524 - RNA, 22 nt, Human
aggcgcugugcuuggggcugga

SEQ ID NO: 799525 - RNA, 22 nt, Human
uccaggaguggggcagaggucu

SEQ ID NO: 799526 - RNA, 22 nt, Human
uagucacaaccuucaaguuguc

SEQ ID NO: 799527 - RNA, 21 nt, Human
ucacaggcucagggagagagu

SEQ ID NO: 799528 - RNA, 22 nt, Human
cagcagugucuccagcaucaca

SEQ ID NO: 799529 - RNA, 22 nt, Human
ugcaaggguguuugagcugccc

SEQ ID NO: 799530 - RNA, 22 nt, Human
uuuaaaagggguauuaagucca

SEQ ID NO: 799531 - RNA, 22 nt, Human
ugguauaagcugugucagagcc

SEQ ID NO: 799532 - RNA, 22 nt, Human
gcuucccaaacuuguggauaga

SEQ ID NO: 799533 - RNA, 22 nt, Human
cagagaaagggugaauuccuuc

SEQ ID NO: 799534 - RNA, 22 nt, Human
aaauuacagaucaccaaugcau

SEQ ID NO: 799535 - RNA, 22 nt, Human
ggcacuggaaggaucaugugag

SEQ ID NO: 799536 - RNA, 22 nt, Human
aucaguguaccuuauggauuuu

SEQ ID NO: 799537 - RNA, 22 nt, Human
uauucacaugaaaacaaauuuu

SEQ ID NO: 799538 - RNA, 22 nt, Human
caaacauagugaagcaaugaca

SEQ ID NO: 799539 - RNA, 23 nt, Human
gcuucccagacaauacugcuucc

SEQ ID NO: 799540 - RNA, 22 nt, Human
uggcccgaccucugcucaugca

SEQ ID NO: 799541 - RNA, 22 nt, Human
gcgucucaaggcccccaggcca

SEQ ID NO: 799542 - RNA, 22 nt, Human
gucaguguuauaaguuuagcca

SEQ ID NO: 799543 - RNA, 22 nt, Human
ugccucauuaacuguccuuaau

SEQ ID NO: 799544 - RNA, 22 nt, Human
gcuucccaggcgccugaccuuu

SEQ ID NO: 799545 - RNA, 22 nt, Human
aaaauucucuugaucuugacag

SEQ ID NO: 799546 - RNA, 23 nt, Human
uggccacaguccaugcaugccca

SEQ ID NO: 799547 - RNA, 22 nt, Human
aagcagaauuuaauagaaaggu

SEQ ID NO: 799548 - RNA, 22 nt, Human
cuggcugguccucggggacagc

SEQ ID NO: 799549 - RNA, 22 nt, Human
ucagaggcuugaagcccaagcc

SEQ ID NO: 799550 - RNA, 22 nt, Human
aagcuucuuagaaugcaugugc

SEQ ID NO: 799551 - RNA, 22 nt, Human
uggccaugacauggaggcuuug

SEQ ID NO: 799552 - RNA, 22 nt, Human
aauagcaaaguuaucaaauuaa

SEQ ID NO: 799553 - RNA, 19 nt, Human
gcaggguguugacuguccc

SEQ ID NO: 799554 - RNA, 22 nt, Human
aucuacaggcugaggugggagg

SEQ ID NO: 799555 - RNA, 17 nt, Human
cucugcagugcauggcu

SEQ ID NO: 799556 - RNA, 22 nt, Human
ggcccagcccgagucagccuuc

SEQ ID NO: 799557 - RNA, 18 nt, Human
uccagucccaaggccagc

SEQ ID NO: 799558 - RNA, 22 nt, Human
cagugagguggauggauggccu

SEQ ID NO: 799559 - RNA, 22 nt, Human
ucacagaguuaaaaguuucuuu

SEQ ID NO: 799560 - RNA, 22 nt, Human
gcuggcugccaauuucagagcu

SEQ ID NO: 799561 - RNA, 22 nt, Human
aacugcaaagccaaucucagga

SEQ ID NO: 799562 - RNA, 23 nt, Human
cacggcagccuccgagggugcug

SEQ ID NO: 799563 - RNA, 22 nt, Human
uacagcaaugcuacaagaugac

SEQ ID NO: 799564 - RNA, 19 nt, Human
cccaggguuuccucucucc

SEQ ID NO: 799565 - RNA, 22 nt, Human
gcaugcaggaagggcuugggga

SEQ ID NO: 799566 - RNA, 22 nt, Human
cacacagguaagccucuuucaa

SEQ ID NO: 799567 - RNA, 22 nt, Human
gccuguggccgacugagagccu

SEQ ID NO: 799568 - RNA, 22 nt, Human
uuuaaauuuagaagaaacacug

SEQ ID NO: 799569 - RNA, 22 nt, Human
uugacacagaucaauauucaac

SEQ ID NO: 799570 - RNA, 22 nt, Human
ugauucaagccaccacauacug

SEQ ID NO: 799571 - RNA, 22 nt, Human
aaagguuuugcccuggguauuc

SEQ ID NO: 799572 - RNA, 21 nt, Human
aagcaggcuguaaucaugugg

SEQ ID NO: 799573 - RNA, 22 nt, Human
gucaggagauagggcaagcuuc

SEQ ID NO: 799574 - RNA, 22 nt, Human
acauacacaagcguacaugaac

SEQ ID NO: 799575 - RNA, 22 nt, Human
caggagcuucugcccauggcca

SEQ ID NO: 799576 - RNA, 22 nt, Human
aggcugggaaauguagucuucc

SEQ ID NO: 799577 - RNA, 22 nt, Human
cugcuggacuacaggaagaguu

SEQ ID NO: 799578 - RNA, 22 nt, Human
agcugccaggccccugagaacc

SEQ ID NO: 799579 - RNA, 23 nt, Human
ugccagaggcagucacaguggug

SEQ ID NO: 799580 - RNA, 22 nt, Human
gcagaaggucaaagcaagaugu

SEQ ID NO: 799581 - RNA, 22 nt, Human
aucugguucuucuuaggcauca

SEQ ID NO: 799582 - RNA, 22 nt, Human
accucucaggucuuccucauau

SEQ ID NO: 799583 - RNA, 22 nt, Human
ggagccauguuuucagcaugau

SEQ ID NO: 799584 - RNA, 22 nt, Human
ugauaaacauuuuaggaacuaa

SEQ ID NO: 799585 - RNA, 22 nt, Human
agcaggcugagcacccaggggg

SEQ ID NO: 799586 - RNA, 22 nt, Human
agccucucuuuauucccagcua

SEQ ID NO: 799587 - RNA, 22 nt, Human
ugggaaaguguugaggugucuu

SEQ ID NO: 799588 - RNA, 21 nt, Human
uguggcagagacaaugcuagu

SEQ ID NO: 799589 - RNA, 22 nt, Human
ucugcaagauggucuuagaggu

SEQ ID NO: 799590 - RNA, 22 nt, Human
uuguaaauaguaguaagaugcc

SEQ ID NO: 799591 - RNA, 17 nt, Human
agaaaagagaccagcag

SEQ ID NO: 799592 - RNA, 22 nt, Human
gugccagccuggugcgccuggg

SEQ ID NO: 799593 - RNA, 22 nt, Human
uccucagggaagaugagccuca

SEQ ID NO: 799594 - RNA, 22 nt, Human
cucagacuugcuuuuuauggaa

SEQ ID NO: 799595 - RNA, 22 nt, Human
uguuuuaaucucccauugcucu

SEQ ID NO: 799596 - RNA, 22 nt, Human
ucacugaagacugggcucuaaa

SEQ ID NO: 799597 - RNA, 22 nt, Human
ccucaaaucuuuagaguuauuu

SEQ ID NO: 799598 - RNA, 22 nt, Human
uguagauguagacacaggucua

SEQ ID NO: 799599 - RNA, 22 nt, Human
guaguucugcagugucaccuga

SEQ ID NO: 799600 - RNA, 22 nt, Human
uuggcuugaugacuggcagugu

SEQ ID NO: 799601 - RNA, 23 nt, Human
agcugggaauuuucugaagcuuu

SEQ ID NO: 799602 - RNA, 22 nt, Human
uagugucagggagugauaaaug

SEQ ID NO: 799603 - RNA, 22 nt, Human
uugacacauuagagcuuguaaa

SEQ ID NO: 799604 - RNA, 22 nt, Human
caagucaacucaaauuguuauc

SEQ ID NO: 799605 - RNA, 22 nt, Human
agggugcauguuugcaagagug

SEQ ID NO: 799606 - RNA, 22 nt, Human
ugauucaagcuacuguuacugg

SEQ ID NO: 799607 - RNA, 22 nt, Human
aaucuagagugcuaggucugug

SEQ ID NO: 799608 - RNA, 22 nt, Human
gaguaguugcugcagagaauac

SEQ ID NO: 799609 - RNA, 22 nt, Human
ugcuauuagaagccaugcuguu

SEQ ID NO: 799610 - RNA, 18 nt, Human
aggagccuuugcacugga

SEQ ID NO: 799611 - RNA, 22 nt, Human
gcuuggcuggaaauagguugag

SEQ ID NO: 799612 - RNA, 22 nt, Human
acucuugauugauuuagucuuu

SEQ ID NO: 799613 - RNA, 22 nt, Human
aauaagaauuuacuugucaaga

SEQ ID NO: 799614 - RNA, 22 nt, Human
gaggcagagacuccaccuucag

SEQ ID NO: 799615 - RNA, 22 nt, Human
ugcagcugcuugauucaucuug

SEQ ID NO: 799616 - RNA, 22 nt, Human
ucacaucauuaagacuucuccu

SEQ ID NO: 799617 - RNA, 22 nt, Human
uugcuuuauguguaugacuuga

SEQ ID NO: 799618 - RNA, 22 nt, Human
uuggagauaucacaccuucaca

SEQ ID NO: 799619 - RNA, 22 nt, Human
caacagagagaccagaaacagg

SEQ ID NO: 799620 - RNA, 22 nt, Human
aaauugcagaugcuaaaugacu

SEQ ID NO: 799621 - RNA, 22 nt, Human
uccaggaggccucauuuccugu

SEQ ID NO: 799622 - RNA, 22 nt, Human
cccuggaggcaaagguugcagu

SEQ ID NO: 799623 - RNA, 23 nt, Human
gacagggcugacuuggcagcugc

SEQ ID NO: 799624 - RNA, 22 nt, Human
agaggccaggcagcccaaggug

SEQ ID NO: 799625 - RNA, 22 nt, Human
cucugcacuguccggcuuucuu

SEQ ID NO: 799626 - RNA, 17 nt, Human
ggcagccucaggcguuu

SEQ ID NO: 799627 - RNA, 22 nt, Human
uugcaaauguuucauaacagua

SEQ ID NO: 799628 - RNA, 22 nt, Human
cuuaaggcuucagcacagguau

SEQ ID NO: 799629 - RNA, 22 nt, Human
ugguaagaauaggggcuuugga

SEQ ID NO: 799630 - RNA, 22 nt, Human
ggcuggacauagacauagccau

SEQ ID NO: 799631 - RNA, 22 nt, Human
gcacacagacuaaccauauuuc

SEQ ID NO: 799632 - RNA, 22 nt, Human
ucuagaaucuaaacuauaguuu

SEQ ID NO: 799633 - RNA, 22 nt, Human
gcuggcaggauagaagucuaau

SEQ ID NO: 799634 - RNA, 22 nt, Human
cacagggcuuugauggcugagu

SEQ ID NO: 799635 - RNA, 22 nt, Human
gaagacauguggauucuaguuu

SEQ ID NO: 799636 - RNA, 22 nt, Human
gcugggaaccaugggaaggcag

SEQ ID NO: 799637 - RNA, 22 nt, Human
uccugccuguuuaccuguacuu

SEQ ID NO: 799638 - RNA, 22 nt, Human
acauuccucagugccaguugag

SEQ ID NO: 799639 - RNA, 22 nt, Human
uaugacuuauuucaucaguucu

SEQ ID NO: 799640 - RNA, 22 nt, Human
acagcuuagccagucaagcucu

SEQ ID NO: 799641 - RNA, 22 nt, Human
uuucagagaugucuagccuauu

SEQ ID NO: 799642 - RNA, 22 nt, Human
uuucuuccuaaauaugauuucc

SEQ ID NO: 799643 - RNA, 22 nt, Human
uucagggacuuagugucaguuu

SEQ ID NO: 799644 - RNA, 22 nt, Human
gucuucauucaacaaauauuca

SEQ ID NO: 799645 - RNA, 22 nt, Human
cugugcaguccagcccuggaca

SEQ ID NO: 799646 - RNA, 22 nt, Human
agugccaagguauuaauuuaua

SEQ ID NO: 799647 - RNA, 22 nt, Human
uuuacacuugaggaaacugagg

SEQ ID NO: 799648 - RNA, 22 nt, Human
gcagaaacuuggagaagccagg

SEQ ID NO: 799649 - RNA, 19 nt, Human
cucucacucgccacauccu

SEQ ID NO: 799650 - RNA, 19 nt, Human
agggaaggauucugucauu

SEQ ID NO: 799651 - RNA, 22 nt, Human
aucagaauaauuagauuucaga

SEQ ID NO: 799652 - RNA, 22 nt, Human
gcugcagcaagcccuccagggg

SEQ ID NO: 799653 - RNA, 22 nt, Human
aggcccuguuaugagccacugu

SEQ ID NO: 799654 - RNA, 22 nt, Human
cacuauaugccuuugaaauaca

SEQ ID NO: 799655 - RNA, 22 nt, Human
ucuggcuguuaggccugaccuu

SEQ ID NO: 799656 - RNA, 22 nt, Human
gcuggcuggaugguugguucgc

SEQ ID NO: 799657 - RNA, 22 nt, Human
agcagggaggucuagcacgugg

SEQ ID NO: 799658 - RNA, 22 nt, Human
agcaccuggagggcugggaccu

SEQ ID NO: 799659 - RNA, 22 nt, Human
acaugcaauauugagacuuucu

SEQ ID NO: 799660 - RNA, 22 nt, Human
cugaagcuuaguuuacgcucca

SEQ ID NO: 799661 - RNA, 19 nt, Human
uucauucuuucuacuuacc

SEQ ID NO: 799662 - RNA, 22 nt, Human
gcuggaguuguggguuuacuaa

SEQ ID NO: 799663 - RNA, 22 nt, Human
cagccucugacaccacagucgu

SEQ ID NO: 799664 - RNA, 22 nt, Human
cccugaggcugaggauaggugg

SEQ ID NO: 799665 - RNA, 22 nt, Human
ccuggcucuucugugucagccc

SEQ ID NO: 799666 - RNA, 22 nt, Human
uuccaaaguuauucaagcagua

SEQ ID NO: 799667 - RNA, 22 nt, Human
gaggcagagguuguugcaguga

SEQ ID NO: 799668 - RNA, 22 nt, Human
caaaacuaucaggcucaaagcu

SEQ ID NO: 799669 - RNA, 23 nt, Human
uuuauuuauuuaggcugagggau

SEQ ID NO: 799670 - RNA, 22 nt, Human
agaguacacuguacacacaauu

SEQ ID NO: 799671 - RNA, 23 nt, Human
ucagagaaguuguaggcugggga

SEQ ID NO: 799672 - RNA, 22 nt, Human
acagcaguggauuagaggaugg

SEQ ID NO: 799673 - RNA, 18 nt, Human
uacuguuuaauugauuac

SEQ ID NO: 799674 - RNA, 22 nt, Human
gcugccauguugugaggacacu

SEQ ID NO: 799675 - RNA, 21 nt, Human
ugagagaguagcaggacauau

SEQ ID NO: 799676 - RNA, 22 nt, Human
auuugucaauaagaugaacaua

SEQ ID NO: 799677 - RNA, 22 nt, Human
gagcuggccgcagagagggcag

SEQ ID NO: 799678 - RNA, 22 nt, Human
gacaguaagguggcuucuucuu

SEQ ID NO: 799679 - RNA, 22 nt, Human
uaauuauucuagucacauagca

SEQ ID NO: 799680 - RNA, 22 nt, Human
aucugcacuuaagcgaggccug

SEQ ID NO: 799681 - RNA, 22 nt, Human
acccaggguagagugcaguggc

SEQ ID NO: 799682 - RNA, 22 nt, Human
ggcucugcuucagaaggcucau

SEQ ID NO: 799683 - RNA, 22 nt, Human
gggagcauuuauuuuccguuag

SEQ ID NO: 799684 - RNA, 22 nt, Human
gacaucaauucagcauuuuaag

SEQ ID NO: 799685 - RNA, 22 nt, Human
agcagggcagcuuuuuucagaa

SEQ ID NO: 799686 - RNA, 22 nt, Human
caggaaauauaggaaaaggaac

SEQ ID NO: 799687 - RNA, 22 nt, Human
cagaagcaagggccaaagucuu

SEQ ID NO: 799688 - RNA, 22 nt, Human
agccucugguccucccucagcu

SEQ ID NO: 799689 - RNA, 22 nt, Human
ugauuguaugauugaaauauuu

SEQ ID NO: 799690 - RNA, 19 nt, Human
aggugugggggcugcagac

SEQ ID NO: 799691 - RNA, 22 nt, Human
aaggccagaguacuagaggcug

SEQ ID NO: 799692 - RNA, 22 nt, Human
uugcauuacauuugcucagucu

SEQ ID NO: 799693 - RNA, 22 nt, Human
ugacuuugugccauuuuuauaa

SEQ ID NO: 799694 - RNA, 22 nt, Human
ggguccagacacuccagaggaa

SEQ ID NO: 799695 - RNA, 22 nt, Human
cauuucauuccuuugaaagugg

SEQ ID NO: 799696 - RNA, 22 nt, Human
cagcagccucuugugccugugg

SEQ ID NO: 799697 - RNA, 22 nt, Human
gagcagcugcagugcagacccu

SEQ ID NO: 799698 - RNA, 18 nt, Human
aagcacagguguuucagg

SEQ ID NO: 799699 - RNA, 22 nt, Human
gccagcuguaagcuggggugau

SEQ ID NO: 799700 - RNA, 22 nt, Human
acucaugauaugccuauaagau

SEQ ID NO: 799701 - RNA, 22 nt, Human
cuguguuucuaaguaaaggagc

SEQ ID NO: 799702 - RNA, 22 nt, Human
uuucccaagaccauagauggaa

SEQ ID NO: 799703 - RNA, 22 nt, Human
gagcccagggcaggcaaggcag

SEQ ID NO: 799704 - RNA, 22 nt, Human
ucugagaaugaguguuuucuua

SEQ ID NO: 799705 - RNA, 22 nt, Human
auuaaauuagcaaacugugaaa

SEQ ID NO: 799706 - RNA, 22 nt, Human
uggcaccaccagacaccaggag

SEQ ID NO: 799707 - RNA, 22 nt, Human
gggcaaugggcuuuucuguaag

SEQ ID NO: 799708 - RNA, 22 nt, Human
ggggagcaauugcccccuuaga

SEQ ID NO: 799709 - RNA, 22 nt, Human
auucuuacaaaugaaacugcaa

SEQ ID NO: 799710 - RNA, 21 nt, Human
ugcuucucuagaucaacuacu

SEQ ID NO: 799711 - RNA, 22 nt, Human
uaccauuucaguaaaaacuuag

SEQ ID NO: 799712 - RNA, 22 nt, Human
ucugaggcugcaucuaugugac

SEQ ID NO: 799713 - RNA, 22 nt, Human
gcagagugguuucagaguugag

SEQ ID NO: 799714 - RNA, 22 nt, Human
ucuuuagagcacgggaaaaaca

SEQ ID NO: 799715 - RNA, 22 nt, Human
caguccucucacucaggccuuu

SEQ ID NO: 799716 - RNA, 22 nt, Human
gcuuuggaacuuaaauccuugg

SEQ ID NO: 799717 - RNA, 19 nt, Human
gggcccagcauggaggguu

SEQ ID NO: 799718 - RNA, 22 nt, Human
uaaggcagugagaagaaacagg

SEQ ID NO: 799719 - RNA, 21 nt, Human
uaacacauuuugguacuuugg

SEQ ID NO: 799720 - RNA, 22 nt, Human
uaggcugggagccugaggcuag

SEQ ID NO: 799721 - RNA, 22 nt, Human
ggagcccucaccggcgagugcc

SEQ ID NO: 799722 - RNA, 22 nt, Human
gaaccauuucugaauaguuugu

SEQ ID NO: 799723 - RNA, 22 nt, Human
aaagcuuuucaguauguucaug

SEQ ID NO: 799724 - RNA, 22 nt, Human
aguuucucuagagucuuugaaa

SEQ ID NO: 799725 - RNA, 22 nt, Human
cccugcaggggaccugcagccu

SEQ ID NO: 799726 - RNA, 22 nt, Human
ugucucuuggcucuaucacuua

SEQ ID NO: 799727 - RNA, 20 nt, Human
uaggacagggccuggcuucu

SEQ ID NO: 799728 - RNA, 22 nt, Human
uccugcagcucugagaagcauc

SEQ ID NO: 799729 - RNA, 22 nt, Human
gaaaauaguucaucacaaugau

SEQ ID NO: 799730 - RNA, 22 nt, Human
ccccagggucaguguguggagg

SEQ ID NO: 799731 - RNA, 22 nt, Human
aacaaguguauuaauggaaaua

SEQ ID NO: 799732 - RNA, 22 nt, Human
gcaaggcugugcacuuugcauu

SEQ ID NO: 799733 - RNA, 23 nt, Human
ucacuaaaguguuuagugcagau

SEQ ID NO: 799734 - RNA, 22 nt, Human
guggagagagauaagccugguc

SEQ ID NO: 799735 - RNA, 22 nt, Human
ucucccucuuugucugcuuugg

SEQ ID NO: 799736 - RNA, 22 nt, Human
gcugguagaccucacugcacuc

SEQ ID NO: 799737 - RNA, 20 nt, Human
gugcuggaguuaggaaaggu

SEQ ID NO: 799738 - RNA, 22 nt, Human
auguccuuguuuuggugacacu

SEQ ID NO: 799739 - RNA, 22 nt, Human
ugccuggcccugacagcccugg

SEQ ID NO: 799740 - RNA, 21 nt, Human
auugcucuguugugucuagaa

SEQ ID NO: 799741 - RNA, 22 nt, Human
augcaacaggguugggaggcgg

SEQ ID NO: 799742 - RNA, 22 nt, Human
cuggcccagguggucguugagg

SEQ ID NO: 799743 - RNA, 22 nt, Human
gccaggaaugcauaaaugaccu

SEQ ID NO: 799744 - RNA, 22 nt, Human
gagccaggggucagcuccgagg

SEQ ID NO: 799745 - RNA, 22 nt, Human
agcuguugaaaaugguguccua

SEQ ID NO: 799746 - RNA, 22 nt, Human
ugcugaaacaauaacauacugg

SEQ ID NO: 799747 - RNA, 22 nt, Human
ccucuguguccuggucauugaa

SEQ ID NO: 799748 - RNA, 22 nt, Human
cugacagguugguagcuuugga

SEQ ID NO: 799749 - RNA, 22 nt, Human
aacacagggcagcugcugggaa

SEQ ID NO: 799750 - RNA, 22 nt, Human
uggcucagcagguuagaaacua

SEQ ID NO: 799751 - RNA, 22 nt, Human
gggaagaguaacuagcccaugu

SEQ ID NO: 799752 - RNA, 22 nt, Human
ccuggugcccccaagccagcug

SEQ ID NO: 799753 - RNA, 22 nt, Human
aagauaauguucuagcugucag

SEQ ID NO: 799754 - RNA, 20 nt, Human
uggcuccagccuccccuacc

SEQ ID NO: 799755 - RNA, 22 nt, Human
gcuggccugggcagaggcuaug

SEQ ID NO: 799756 - RNA, 22 nt, Human
ugagcccauguagcacuuccau

SEQ ID NO: 799757 - RNA, 22 nt, Human
aaauagcauaaaauaggaagcu

SEQ ID NO: 799758 - RNA, 22 nt, Human
uguuuacacuucaagguuaagg

SEQ ID NO: 799759 - RNA, 22 nt, Human
acugggagggucuugaagaggg

SEQ ID NO: 799760 - RNA, 18 nt, Human
auauucaagaagacagag

SEQ ID NO: 799761 - RNA, 22 nt, Human
ggcccagcucuauugaauuaca

SEQ ID NO: 799762 - RNA, 22 nt, Human
aaucuugguugcaguauauccg

SEQ ID NO: 799763 - RNA, 17 nt, Human
cugccuggagucccauc

SEQ ID NO: 799764 - RNA, 22 nt, Human
auuguuuccccggaauuauuca

SEQ ID NO: 799765 - RNA, 22 nt, Human
gagcuuugugcugguagguggu

SEQ ID NO: 799766 - RNA, 22 nt, Human
caggggcugagaaggaacgucc

SEQ ID NO: 799767 - RNA, 22 nt, Human
ccuccuggauggauuuggugga

SEQ ID NO: 799768 - RNA, 22 nt, Human
ugcaaauguguuuuaaaccaaa

SEQ ID NO: 799769 - RNA, 17 nt, Human
cagucacaggucuuuuc

SEQ ID NO: 799770 - RNA, 22 nt, Human
ugcauuaaaaugugccucucuu

SEQ ID NO: 799771 - RNA, 21 nt, Human
gaaaauacaaugagcuugacc

SEQ ID NO: 799772 - RNA, 20 nt, Human
cugcaucaugguuaagaaca

SEQ ID NO: 799773 - RNA, 22 nt, Human
gcugcagggcucucacaggggg

SEQ ID NO: 799774 - RNA, 22 nt, Human
uacugaggcugaauucuuagca

SEQ ID NO: 799775 - RNA, 22 nt, Human
ucuggagugggacuuugcaucu

SEQ ID NO: 799776 - RNA, 22 nt, Human
ucccucagaaauucucucugaa

SEQ ID NO: 799777 - RNA, 22 nt, Human
ugugccaggcccuggggaccaa

SEQ ID NO: 799778 - RNA, 22 nt, Human
aagauaaugugucugucuuugc

SEQ ID NO: 799779 - RNA, 17 nt, Human
cuggagcuguguaaccu

SEQ ID NO: 799780 - RNA, 22 nt, Human
aguuauuuggcuauagauggua

SEQ ID NO: 799781 - RNA, 22 nt, Human
gucaauaauugauagauauugg

SEQ ID NO: 799782 - RNA, 20 nt, Human
aaacauucauguacaaguga

SEQ ID NO: 799783 - RNA, 22 nt, Human
uaggaaauaaauacuuaugguu

SEQ ID NO: 799784 - RNA, 16 nt, Human
cuggcuggaagccugg

SEQ ID NO: 799785 - RNA, 22 nt, Human
gccaggcuggugcaaggauauu

SEQ ID NO: 799786 - RNA, 21 nt, Human
agauuacaggugugauccacc

SEQ ID NO: 799787 - RNA, 22 nt, Human
auguauguuaguguauuaucua

SEQ ID NO: 799788 - RNA, 22 nt, Human
agugaguggagagcucuagguu

SEQ ID NO: 799789 - RNA, 22 nt, Human
uuguuucucuggucuugaguga

SEQ ID NO: 799790 - RNA, 22 nt, Human
gcccaaggucacacacaggaag

SEQ ID NO: 799791 - RNA, 21 nt, Human
auaaacugcaucaaguuggug

SEQ ID NO: 799792 - RNA, 19 nt, Human
aacaccagagucaggaguc

SEQ ID NO: 799793 - RNA, 22 nt, Human
gauauauuuuccauggucugca

SEQ ID NO: 799794 - RNA, 22 nt, Human
gggggcuagagagaugaaauau

SEQ ID NO: 799795 - RNA, 22 nt, Human
agcucuuugagaaggcagugug

SEQ ID NO: 799796 - RNA, 22 nt, Human
uuucauugucuacauaugacau

SEQ ID NO: 799797 - RNA, 22 nt, Human
gagcagcucgagaaggaagcag

SEQ ID NO: 799798 - RNA, 22 nt, Human
cugccugacugauaaucucuga

SEQ ID NO: 799799 - RNA, 22 nt, Human
gaucaauacuauuaagaucaua

SEQ ID NO: 799800 - RNA, 22 nt, Human
acuuccagcaccucaagcggaa

SEQ ID NO: 799801 - RNA, 22 nt, Human
ggguggucaucugaaggucugg

SEQ ID NO: 799802 - RNA, 22 nt, Human
cucugcaccuuguaggaggcaa

SEQ ID NO: 799803 - RNA, 22 nt, Human
ugguaagauaagagccaggccu

SEQ ID NO: 799804 - RNA, 22 nt, Human
aagcagaaguugaucuaccaua

SEQ ID NO: 799805 - RNA, 22 nt, Human
uuucucuuugacaggaaucaga

SEQ ID NO: 799806 - RNA, 22 nt, Human
cagaaacacuuguagagaaguu

SEQ ID NO: 799807 - RNA, 22 nt, Human
aauguuauuacacuugugaaau

SEQ ID NO: 799808 - RNA, 22 nt, Human
agaggccggccgagcccauggg

SEQ ID NO: 799809 - RNA, 22 nt, Human
gcagacuguaccuggaagaggg

SEQ ID NO: 799810 - RNA, 22 nt, Human
guggagggugauugccggcugu

SEQ ID NO: 799811 - RNA, 22 nt, Human
ccaugcaacagaauccagauuu

SEQ ID NO: 799812 - RNA, 22 nt, Human
aguacaauuuaaugaagauagc

SEQ ID NO: 799813 - RNA, 22 nt, Human
uuuugccuaagaaucucucuga

SEQ ID NO: 799814 - RNA, 22 nt, Human
ugaacacacaccuauguacaaa

SEQ ID NO: 799815 - RNA, 22 nt, Human
uucaaguagcuaaauuagcugc

SEQ ID NO: 799816 - RNA, 22 nt, Human
cugcuguguuucugcuagaaaa

SEQ ID NO: 799817 - RNA, 22 nt, Human
agucuauauugugaaaguaaaa

SEQ ID NO: 799818 - RNA, 22 nt, Human
uuuuccucugcaauaaaagcag

SEQ ID NO: 799819 - RNA, 22 nt, Human
agucuuuauugucgucacuaga

SEQ ID NO: 799820 - RNA, 22 nt, Human
caguaggaaggaugcagaaaaa

SEQ ID NO: 799821 - RNA, 16 nt, Human
gcagagcucagggacu

SEQ ID NO: 799822 - RNA, 18 nt, Human
gagcugggagaaggaagg

SEQ ID NO: 799823 - RNA, 22 nt, Human
ugggaaggaacugccuuuagcu

SEQ ID NO: 799824 - RNA, 22 nt, Human
aggcugugggugauuuacugug

SEQ ID NO: 799825 - RNA, 22 nt, Human
guauuucuuuccauuauaguca

SEQ ID NO: 799826 - RNA, 22 nt, Human
gcagcccaagccugagcauccu

SEQ ID NO: 799827 - RNA, 22 nt, Human
uuucuagaguucaucaugguaa

SEQ ID NO: 799828 - RNA, 22 nt, Human
aggaccuacugauaucuuagca

SEQ ID NO: 799829 - RNA, 22 nt, Human
ggcaccugguaagugcucagua

SEQ ID NO: 799830 - RNA, 22 nt, Human
ugggucacucuauccugcuuag

SEQ ID NO: 799831 - RNA, 22 nt, Human
ucugucuuggccagccaucugg

SEQ ID NO: 799832 - RNA, 22 nt, Human
uuuggauuccaugcucuccggg

SEQ ID NO: 799833 - RNA, 22 nt, Human
ucuacagggucagaguuucaug

SEQ ID NO: 799834 - RNA, 22 nt, Human
uucacaauuaacuuuauacuua

SEQ ID NO: 799835 - RNA, 22 nt, Human
ggguccugcgugggcccaggac

SEQ ID NO: 799836 - RNA, 22 nt, Human
auacaacugcucucagauaagu

SEQ ID NO: 799837 - RNA, 22 nt, Human
ggaggcugcugccucacguggg

SEQ ID NO: 799838 - RNA, 22 nt, Human
ccaggccuccugugaguggacc

SEQ ID NO: 799839 - RNA, 22 nt, Human
cagggagccugaauguuccagg

SEQ ID NO: 799840 - RNA, 22 nt, Human
cagcaucucccaggcauuugcc

SEQ ID NO: 799841 - RNA, 22 nt, Human
uggcagaaagaaccaugugcaa

SEQ ID NO: 799842 - RNA, 22 nt, Human
uagaaacaaguuucucuuuggg

SEQ ID NO: 799843 - RNA, 22 nt, Human
cugcuggagggagcugauagug

SEQ ID NO: 799844 - RNA, 22 nt, Human
auuucuacugugagaaacauga

SEQ ID NO: 799845 - RNA, 23 nt, Human
ugggcuucugagaaagcaccuaa

SEQ ID NO: 799846 - RNA, 22 nt, Human
uucagaggacaaccagccaucu

SEQ ID NO: 799847 - RNA, 22 nt, Human
uuucuggcagcgggacaggggu

SEQ ID NO: 799848 - RNA, 22 nt, Human
gcaggcugcccucuuguguuga

SEQ ID NO: 799849 - RNA, 22 nt, Human
ugcagcuuaucucuuuggcagu

SEQ ID NO: 799850 - RNA, 22 nt, Human
cccugugauguagcuagaguag

SEQ ID NO: 799851 - RNA, 19 nt, Human
gaggagcuaucggagacag

SEQ ID NO: 799852 - RNA, 22 nt, Human
uuuccuuugggagcaugaauuu

SEQ ID NO: 799853 - RNA, 22 nt, Human
cuggccucucugagcagggagc

SEQ ID NO: 799854 - RNA, 22 nt, Human
uacaaagcuuguacugugugac

SEQ ID NO: 799855 - RNA, 22 nt, Human
ucauagaaauggaaaguauauu

SEQ ID NO: 799856 - RNA, 22 nt, Human
uguggcagaguaaggacccagu

SEQ ID NO: 799857 - RNA, 22 nt, Human
ggcuggauaccaggagacaggg

SEQ ID NO: 799858 - RNA, 22 nt, Human
cugcaggacugaaagaugaggu

SEQ ID NO: 799859 - RNA, 22 nt, Human
ccaggagaauaauggcagauua

SEQ ID NO: 799860 - RNA, 22 nt, Human
ggaagaggcugguagugcccgu

SEQ ID NO: 799861 - RNA, 22 nt, Human
gagggccacuugaauguuuuca

SEQ ID NO: 799862 - RNA, 22 nt, Human
aaagcagaacugagagagcugg

SEQ ID NO: 799863 - RNA, 22 nt, Human
ugcugagggagcaucaaagaaa

SEQ ID NO: 799864 - RNA, 22 nt, Human
uaaggcagguagaugacuacgg

SEQ ID NO: 799865 - RNA, 22 nt, Human
uuaaagucccugccuuaauucc

SEQ ID NO: 799866 - RNA, 22 nt, Human
uucuauugacauucacuguaac

SEQ ID NO: 799867 - RNA, 22 nt, Human
guuuacauugcuguuugugucu

SEQ ID NO: 799868 - RNA, 22 nt, Human
gacaaaacacauuaguuuaaaa

SEQ ID NO: 799869 - RNA, 22 nt, Human
acauggcauucacucccacagg

SEQ ID NO: 799870 - RNA, 22 nt, Human
agaggcugcacuugcucaugau

SEQ ID NO: 799871 - RNA, 22 nt, Human
ccagggcagugggagaaggugc

SEQ ID NO: 799872 - RNA, 22 nt, Human
ggccccagauucugggcugggu

SEQ ID NO: 799873 - RNA, 22 nt, Human
ggcaguguccuugcagcucuac

SEQ ID NO: 799874 - RNA, 22 nt, Human
gggcagagaaauggacaguugg

SEQ ID NO: 799875 - RNA, 22 nt, Human
ugcagccuuuagaaguucagau

SEQ ID NO: 799876 - RNA, 22 nt, Human
acagaaaaaugagggagcugga

SEQ ID NO: 799877 - RNA, 22 nt, Human
gaagaggcuuuccuagggcaag

SEQ ID NO: 799878 - RNA, 22 nt, Human
acacuacagggccgggauggaa

SEQ ID NO: 799879 - RNA, 22 nt, Human
uucauacuguguuuccaaguuu

SEQ ID NO: 799880 - RNA, 22 nt, Human
cuucuuucccaggcauguuuua

SEQ ID NO: 799881 - RNA, 22 nt, Human
uuacaaacuccagugagugagc

SEQ ID NO: 799882 - RNA, 22 nt, Human
gcaaagauauuagaauagagua

SEQ ID NO: 799883 - RNA, 22 nt, Human
auuucagcccaguaugagcccc

SEQ ID NO: 799884 - RNA, 22 nt, Human
uguuucuaggucaauaauuuuu

SEQ ID NO: 799885 - RNA, 22 nt, Human
gggauggggagcuggaaagggg

SEQ ID NO: 799886 - RNA, 22 nt, Human
cagcaggacauggaggaguaaa

SEQ ID NO: 799887 - RNA, 22 nt, Human
acaguucugagcuauaauugcu

SEQ ID NO: 799888 - RNA, 22 nt, Human
ggcaugugccugaggucacaca

SEQ ID NO: 799889 - RNA, 22 nt, Human
ccauuuggaggucauuaggaca

SEQ ID NO: 799890 - RNA, 22 nt, Human
cuucuggguguggagugaggac

SEQ ID NO: 799891 - RNA, 22 nt, Human
uaucuuugcaaauaucucuaag

SEQ ID NO: 799892 - RNA, 22 nt, Human
uucuuauugggagaccuuuucu

SEQ ID NO: 799893 - RNA, 17 nt, Human
cugggauguggacucuu

SEQ ID NO: 799894 - RNA, 19 nt, Human
acaguccagcuguuuguac

SEQ ID NO: 799895 - RNA, 22 nt, Human
auuuagcaagaguacaaaauaa

SEQ ID NO: 799896 - RNA, 22 nt, Human
uacauaguauucacauuguuuu

SEQ ID NO: 799897 - RNA, 22 nt, Human
caggaagcuggucagauccugu

SEQ ID NO: 799898 - RNA, 20 nt, Human
uaggaaaucgaggcagggug

SEQ ID NO: 799899 - RNA, 22 nt, Human
cagaaaccucccugaauauuuu

SEQ ID NO: 799900 - RNA, 22 nt, Human
guuuuauaauugcuucauaaga

SEQ ID NO: 799901 - RNA, 21 nt, Human
acaguaaauucccugcaaaga

SEQ ID NO: 799902 - RNA, 22 nt, Human
agggagccuuccuggcuguggu

SEQ ID NO: 799903 - RNA, 22 nt, Human
augcaauauagggaagauagau

SEQ ID NO: 799904 - RNA, 22 nt, Human
uuuuuuccagcuucuagaggcc

SEQ ID NO: 799905 - RNA, 22 nt, Human
cccuguggaggcagcauccugc

SEQ ID NO: 799906 - RNA, 22 nt, Human
uuauucaguuuguguagaggug

SEQ ID NO: 799907 - RNA, 21 nt, Human
uggaaggcugcucugccaggg

SEQ ID NO: 799908 - RNA, 22 nt, Human
cuaaggcaccgaggcaggagcg

SEQ ID NO: 799909 - RNA, 22 nt, Human
cagcuuugcaggcuggucagug

SEQ ID NO: 799910 - RNA, 22 nt, Human
cuccuggcacucaguguggaag

SEQ ID NO: 799911 - RNA, 22 nt, Human
cacaugaggugacuuccaagcu

SEQ ID NO: 799912 - RNA, 22 nt, Human
ugcuucuggcacuugagggggu

SEQ ID NO: 799913 - RNA, 22 nt, Human
guaaauaacugguaauuggggu

SEQ ID NO: 799914 - RNA, 22 nt, Human
augucuguacgaguuacaaugg

SEQ ID NO: 799915 - RNA, 22 nt, Human
uuuugcuuuuguaacacagugu

SEQ ID NO: 799916 - RNA, 22 nt, Human
gcaugcaaauagucaugcuucc

SEQ ID NO: 799917 - RNA, 22 nt, Human
uaugcaaacuaaguuguuuccu

SEQ ID NO: 799918 - RNA, 22 nt, Human
acagcaacuccugcuucugagu

SEQ ID NO: 799919 - RNA, 22 nt, Human
cccagaaggcuugccaggaagc

SEQ ID NO: 799920 - RNA, 22 nt, Human
aaacaguuuucucauuuagugu

SEQ ID NO: 799921 - RNA, 22 nt, Human
ggagccaguauuuaguggucuu

SEQ ID NO: 799922 - RNA, 21 nt, Human
cccaccccauaaggcagaacc

SEQ ID NO: 799923 - RNA, 22 nt, Human
aggcucuauaccgcugggaguu

SEQ ID NO: 799924 - RNA, 22 nt, Human
acagugauuuuuucgagcagaa

SEQ ID NO: 799925 - RNA, 22 nt, Human
gacaaggcagaaagcuuaaagg

SEQ ID NO: 799926 - RNA, 17 nt, Human
gcuucuggagcuucugu

SEQ ID NO: 799927 - RNA, 22 nt, Human
auaucacaggaaaggaagauac

SEQ ID NO: 799928 - RNA, 23 nt, Human
uacauucuguauuuuuauagagu

SEQ ID NO: 799929 - RNA, 22 nt, Human
ugggcagcuuccacuuaguuag

SEQ ID NO: 799930 - RNA, 22 nt, Human
uccucagcauuagcacagacau

SEQ ID NO: 799931 - RNA, 22 nt, Human
ugcagggaaucuguggcuggac

SEQ ID NO: 799932 - RNA, 22 nt, Human
ugccucagcugaggccgcucca

SEQ ID NO: 799933 - RNA, 22 nt, Human
ugcuguuauacuuagcugguua

SEQ ID NO: 799934 - RNA, 22 nt, Human
ucagagaaaugacaauauauag

SEQ ID NO: 799935 - RNA, 22 nt, Human
ugugcaauaaucauagugauuu

SEQ ID NO: 799936 - RNA, 22 nt, Human
aaauacaauuucaggcuguaau

SEQ ID NO: 799937 - RNA, 22 nt, Human
cuuuaguuguaucagucaaguu

SEQ ID NO: 799938 - RNA, 22 nt, Human
uauguauuagagcuccaugagg

SEQ ID NO: 799939 - RNA, 19 nt, Human
gccuuggcauucucugcuu

SEQ ID NO: 799940 - RNA, 22 nt, Human
aucagcugaaaaacaggcagca

SEQ ID NO: 799941 - RNA, 22 nt, Human
uaaaaccaggucuugggauuua

SEQ ID NO: 799942 - RNA, 22 nt, Human
ucccugcccucagugcacccgg

SEQ ID NO: 799943 - RNA, 22 nt, Human
ugggugguccaggcucagcaga

SEQ ID NO: 799944 - RNA, 19 nt, Human
gggcuuggggcugaagccu

SEQ ID NO: 799945 - RNA, 20 nt, Human
ccagacagcaccugccuggu

SEQ ID NO: 799946 - RNA, 18 nt, Human
ugcacuagaugcuggcag

SEQ ID NO: 799947 - RNA, 22 nt, Human
agaaaagaggcuuucuaagcau

SEQ ID NO: 799948 - RNA, 22 nt, Human
ccagcugaggcagccacacagg

SEQ ID NO: 799949 - RNA, 20 nt, Human
cuucuucagccuaugcuuca

SEQ ID NO: 799950 - RNA, 22 nt, Human
gcuggccucuggagaagggcuu

SEQ ID NO: 799951 - RNA, 22 nt, Human
caggcaagcaaggggucuugaa

SEQ ID NO: 799952 - RNA, 22 nt, Human
ccaggcacuucaucauuagggu

SEQ ID NO: 799953 - RNA, 22 nt, Human
agucauauuuauauaauuuccc

SEQ ID NO: 799954 - RNA, 22 nt, Human
aggcaguguauugcuagcggcu

SEQ ID NO: 799955 - RNA, 22 nt, Human
cugucucaagacugcaggcacu

SEQ ID NO: 799956 - RNA, 22 nt, Human
gccaguggcuugccaggcagga

SEQ ID NO: 799957 - RNA, 22 nt, Human
aaagucauacauggugcuuacu

SEQ ID NO: 799958 - RNA, 22 nt, Human
uccuggcucggcuuggggacuu

SEQ ID NO: 799959 - RNA, 23 nt, Human
ggaugggcaagccuagugccuac

SEQ ID NO: 799960 - RNA, 22 nt, Human
uacaguaaugugucccugcagg

SEQ ID NO: 799961 - RNA, 22 nt, Human
gccugagaaggacacagcaggu

SEQ ID NO: 799962 - RNA, 22 nt, Human
cagaaauaucaguugaaagugc

SEQ ID NO: 799963 - RNA, 22 nt, Human
uguggaugaauaaagugcagac

SEQ ID NO: 799964 - RNA, 22 nt, Human
uuccuaggauggugaagcagga

SEQ ID NO: 799965 - RNA, 18 nt, Human
cauaauuuucuuucuuua

SEQ ID NO: 799966 - RNA, 22 nt, Human
agauaauaagucugguaauaau

SEQ ID NO: 799967 - RNA, 22 nt, Human
gggaaggcugccugagggaugg

SEQ ID NO: 799968 - RNA, 22 nt, Human
uuucuauucuggaucuguggca

SEQ ID NO: 799969 - RNA, 22 nt, Human
agcugguaugaacaggauagga

SEQ ID NO: 799970 - RNA, 22 nt, Human
gaaucuagggccuagaucacag

SEQ ID NO: 799971 - RNA, 22 nt, Human
ugacaacuuuacaaaauucuuc

SEQ ID NO: 799972 - RNA, 22 nt, Human
uucuggaauauuugacacaauu

SEQ ID NO: 799973 - RNA, 22 nt, Human
caaacauugcacuuucugcuau

SEQ ID NO: 799974 - RNA, 22 nt, Human
ugauucaacuuucauaacaaaa

SEQ ID NO: 799975 - RNA, 22 nt, Human
uucuuucccaguagaugugaaa

SEQ ID NO: 799976 - RNA, 17 nt, Human
gggcagggacuccuggg

SEQ ID NO: 799977 - RNA, 22 nt, Human
ucuuuuagagcauuucugauuc

SEQ ID NO: 799978 - RNA, 22 nt, Human
ugcuggggcucugaccacucca

SEQ ID NO: 799979 - RNA, 22 nt, Human
gcaggggcugagcaccagcggg

SEQ ID NO: 799980 - RNA, 22 nt, Human
cccaggcugauguucagcgggu

SEQ ID NO: 799981 - RNA, 22 nt, Human
uucagagcaucucuaaagccag

SEQ ID NO: 799982 - RNA, 22 nt, Human
cugcagcugugagugcuggaug

SEQ ID NO: 799983 - RNA, 22 nt, Human
agcugggaggugggcagugaga

SEQ ID NO: 799984 - RNA, 22 nt, Human
ugaaaugacaaagguuuuucuu

SEQ ID NO: 799985 - RNA, 22 nt, Human
acuucccaacacuuuugagaug

SEQ ID NO: 799986 - RNA, 22 nt, Human
gcugcugcuugaaggcucggag

SEQ ID NO: 799987 - RNA, 22 nt, Human
aaaaccuucuagacuuuauauu

SEQ ID NO: 799988 - RNA, 22 nt, Human
ugcacagagagaugagacacgu

SEQ ID NO: 799989 - RNA, 22 nt, Human
aggcccaguagucgacggcgcu

SEQ ID NO: 799990 - RNA, 18 nt, Human
uacaaacuccuugaaggc

SEQ ID NO: 799991 - RNA, 22 nt, Human
gcaggcuggucugaccaucccu

SEQ ID NO: 799992 - RNA, 22 nt, Human
gucacuuuggccucuacagcca

SEQ ID NO: 799993 - RNA, 22 nt, Human
uucuuuuacauuaagauuucag

SEQ ID NO: 799994 - RNA, 22 nt, Human
uuguuuuaacgacucagcuugu

SEQ ID NO: 799995 - RNA, 22 nt, Human
uggaggaaguggcuggccagaa

SEQ ID NO: 799996 - RNA, 22 nt, Human
uggccaguuugcucaggcaguc

SEQ ID NO: 799997 - RNA, 22 nt, Human
aaaaccugauugaauucuauuu

SEQ ID NO: 799998 - RNA, 22 nt, Human
uggaggaaucagggcuuaggcu

SEQ ID NO: 799999 - RNA, 22 nt, Human
gcacacaggggaguucucagaa

SEQ ID NO: 800000 - RNA, 22 nt, Human
aggaaagaaaggaggugcauuu

SEQ ID NO: 800001 - RNA, 22 nt, Human
gugcagcugcaggagucagguc

SEQ ID NO: 800002 - RNA, 22 nt, Human
uccucccuaaauccuagacugu

SEQ ID NO: 800003 - RNA, 22 nt, Human
ccaggauggggagcagauagaa

SEQ ID NO: 800004 - RNA, 22 nt, Human
cauuuauucaugaucuguagcu

SEQ ID NO: 800005 - RNA, 22 nt, Human
guggggugcagcaguacugugu

SEQ ID NO: 800006 - RNA, 22 nt, Human
acuucauuucauuugcacagug

SEQ ID NO: 800007 - RNA, 22 nt, Human
caaaauucugcauuucuaauaa

SEQ ID NO: 800008 - RNA, 21 nt, Human
agcuggcucucucuggagaga

SEQ ID NO: 800009 - RNA, 20 nt, Human
ucagaagugcagcugccccu

SEQ ID NO: 800010 - RNA, 22 nt, Human
ugccaagagguccaggugggaa

SEQ ID NO: 800011 - RNA, 22 nt, Human
aucacaaucuucaaaucgauuc

SEQ ID NO: 800012 - RNA, 23 nt, Human
ucucacagcgaucuaggaagagg

SEQ ID NO: 800013 - RNA, 19 nt, Human
ugcauaaauuauauacuuu

SEQ ID NO: 800014 - RNA, 22 nt, Human
ugcauggaggauaauaauugag

SEQ ID NO: 800015 - RNA, 22 nt, Human
cugggcacagacccccugggcc

SEQ ID NO: 800016 - RNA, 21 nt, Human
aguuacauguauagauaaagu

SEQ ID NO: 800017 - RNA, 22 nt, Human
agaugggcgcgcugcucugaug

SEQ ID NO: 800018 - RNA, 22 nt, Human
cauucaaauuaagauuuuguua

SEQ ID NO: 800019 - RNA, 22 nt, Human
ugcuggagucucuugacccugg

SEQ ID NO: 800020 - RNA, 22 nt, Human
gcaugcaauuaugguauuagau

SEQ ID NO: 800021 - RNA, 22 nt, Human
ggagccaggggaccuucacaga

SEQ ID NO: 800022 - RNA, 22 nt, Human
gauacccagcaaaaugcaggag

SEQ ID NO: 800023 - RNA, 22 nt, Human
ggcgggaaguucuugcccacuu

SEQ ID NO: 800024 - RNA, 22 nt, Human
caggagugucgggucacuaggu

SEQ ID NO: 800025 - RNA, 22 nt, Human
acauuucacuguucacagcagg

SEQ ID NO: 800026 - RNA, 22 nt, Human
acuucaaacaauuaacagagaa

SEQ ID NO: 800027 - RNA, 22 nt, Human
aggcaaauuauuguaugcaguu

SEQ ID NO: 800028 - RNA, 22 nt, Human
ugggugguggcaguaaugagaa

SEQ ID NO: 800029 - RNA, 22 nt, Human
uuuaccaaggcauaguaaucuc

SEQ ID NO: 800030 - RNA, 22 nt, Human
cgcaggcuuuagaaucugcuac

SEQ ID NO: 800031 - RNA, 22 nt, Human
cucugucaggcugcagaugcuc

SEQ ID NO: 800032 - RNA, 22 nt, Human
ucaucuugcugccauugcuuua

SEQ ID NO: 800033 - RNA, 21 nt, Human
guucaaauccugacacuacac

SEQ ID NO: 800034 - RNA, 22 nt, Human
uuucccaaagccuggggugagu

SEQ ID NO: 800035 - RNA, 22 nt, Human
uuucaguuguccuguuaauagc

SEQ ID NO: 800036 - RNA, 22 nt, Human
caggacagaccaagaucgugcu

SEQ ID NO: 800037 - RNA, 22 nt, Human
acuugaauaggaaagccacaaa

SEQ ID NO: 800038 - RNA, 22 nt, Human
uuauaggcuuaguucugugugu

SEQ ID NO: 800039 - RNA, 22 nt, Human
cugcagcugcucauguuacuug

SEQ ID NO: 800040 - RNA, 22 nt, Human
aaacaaauuucaagcugugaca

SEQ ID NO: 800041 - RNA, 22 nt, Human
agcugcagccgcagcuguggcc

SEQ ID NO: 800042 - RNA, 22 nt, Human
uauacagaaccgccugaagucu

SEQ ID NO: 800043 - RNA, 23 nt, Human
acagacaacacugaugagagaaa

SEQ ID NO: 800044 - RNA, 22 nt, Human
aggagguggccugagcgugccc

SEQ ID NO: 800045 - RNA, 22 nt, Human
gauuuuauuagcccaaacuuug

SEQ ID NO: 800046 - RNA, 22 nt, Human
ucauugagcgguucuuaaccca

SEQ ID NO: 800047 - RNA, 22 nt, Human
aaccaacauaggaaugcagaga

SEQ ID NO: 800048 - RNA, 22 nt, Human
ugccuggggauugcucugggcc

SEQ ID NO: 800049 - RNA, 22 nt, Human
cagcuuugaccuaaaguaggaa

SEQ ID NO: 800050 - RNA, 22 nt, Human
ggugcugguucaggguggcugu

SEQ ID NO: 800051 - RNA, 22 nt, Human
ucaaacuggcagacuucuacuu

SEQ ID NO: 800052 - RNA, 22 nt, Human
caugcaguguguaucuacuuaa

SEQ ID NO: 800053 - RNA, 22 nt, Human
ucuuucuacaucauuugcuucu

SEQ ID NO: 800054 - RNA, 22 nt, Human
aaacagaaauuuccucaugcuc

SEQ ID NO: 800055 - RNA, 22 nt, Human
uugaucucuuguguaugguaga

SEQ ID NO: 800056 - RNA, 22 nt, Human
ucaggagacuuaugucacagug

SEQ ID NO: 800057 - RNA, 22 nt, Human
ucaaauaccagcaauuucaugu

SEQ ID NO: 800058 - RNA, 22 nt, Human
ccaggagaagcaucugagugua

SEQ ID NO: 800059 - RNA, 22 nt, Human
uuccagcaggcagacaggagau

SEQ ID NO: 800060 - RNA, 18 nt, Human
uccucucuuuccccaggg

SEQ ID NO: 800061 - RNA, 22 nt, Human
aggagcugcauggauaccuggu

SEQ ID NO: 800062 - RNA, 22 nt, Human
agaaggcucacuaagagugacu

SEQ ID NO: 800063 - RNA, 22 nt, Human
cuggaagggucagagugaugag

SEQ ID NO: 800064 - RNA, 22 nt, Human
cauucuuacacaauauuuuaau

SEQ ID NO: 800065 - RNA, 22 nt, Human
acaguuuuuucaacauuggaau

SEQ ID NO: 800066 - RNA, 20 nt, Human
gugccuggagaagaggcugu

SEQ ID NO: 800067 - RNA, 22 nt, Human
ccugacagugguagccuuggca

SEQ ID NO: 800068 - RNA, 22 nt, Human
ggcaguguuauuuuucagaaau

SEQ ID NO: 800069 - RNA, 22 nt, Human
uccaccauguaacaagcucugu

SEQ ID NO: 800070 - RNA, 22 nt, Human
ugccacagaggugaagcccacu

SEQ ID NO: 800071 - RNA, 22 nt, Human
uggcucaggcuugaaaauagau

SEQ ID NO: 800072 - RNA, 23 nt, Human
gccaggcacaugguggacacgca

SEQ ID NO: 800073 - RNA, 23 nt, Human
auuucccauugugucagcagagc

SEQ ID NO: 800074 - RNA, 22 nt, Human
ccacccugccuugggccaguga

SEQ ID NO: 800075 - RNA, 22 nt, Human
cugacuuugacuuggucauuga

SEQ ID NO: 800076 - RNA, 22 nt, Human
gaaaacuaacggaaaaguuagg

SEQ ID NO: 800077 - RNA, 22 nt, Human
auuuguucauggguuguuaugc

SEQ ID NO: 800078 - RNA, 22 nt, Human
gcaggcauggucgcugccaggu

SEQ ID NO: 800079 - RNA, 22 nt, Human
aacacaugccuuaagaauaagu

SEQ ID NO: 800080 - RNA, 22 nt, Human
ugugcagaguaaggcagcuguu

SEQ ID NO: 800081 - RNA, 22 nt, Human
gagcugaauuacggugagucau

SEQ ID NO: 800082 - RNA, 22 nt, Human
gaaggccaguuuugagauaggu

SEQ ID NO: 800083 - RNA, 22 nt, Human
cccagcacuuugaauaugucac

SEQ ID NO: 800084 - RNA, 22 nt, Human
ggcugcaguuugucuuuugcuu

SEQ ID NO: 800085 - RNA, 22 nt, Human
uucaaacagaugacucugcucu

SEQ ID NO: 800086 - RNA, 22 nt, Human
uggugccacccuccuucagcug

SEQ ID NO: 800087 - RNA, 22 nt, Human
caauaacuuugauauuuugcgg

SEQ ID NO: 800088 - RNA, 22 nt, Human
cagcucugucuguagaaacuuc

SEQ ID NO: 800089 - RNA, 22 nt, Human
ugaaugaugcauuuguuuccca

SEQ ID NO: 800090 - RNA, 15 nt, Human
gccccaggaaucaaa

SEQ ID NO: 800091 - RNA, 20 nt, Human
aagggcagagggaacagacu

SEQ ID NO: 800092 - RNA, 22 nt, Human
aaagagcaagcugagauuugaa

SEQ ID NO: 800093 - RNA, 22 nt, Human
uggggccugagguggagcugca

SEQ ID NO: 800094 - RNA, 22 nt, Human
uuuauugcccuguaguacagga

SEQ ID NO: 800095 - RNA, 22 nt, Human
auauaaguguguggcuguuagu

SEQ ID NO: 800096 - RNA, 23 nt, Human
gcugggcuuacucuuucagugag

SEQ ID NO: 800097 - RNA, 22 nt, Human
aaggcuucuggagcuugcuggc

SEQ ID NO: 800098 - RNA, 22 nt, Human
gaggcacagucccgaggcaagg

SEQ ID NO: 800099 - RNA, 22 nt, Human
gauauacauagguuucuaugca

SEQ ID NO: 800100 - RNA, 21 nt, Human
cggaaaggacuagggcucaga

SEQ ID NO: 800101 - RNA, 22 nt, Human
aacuuaguuuaggguauugauu

SEQ ID NO: 800102 - RNA, 22 nt, Human
gaaaguauuuacauuaacaucu

SEQ ID NO: 800103 - RNA, 22 nt, Human
acuucauucauuuucacgaaug

SEQ ID NO: 800104 - RNA, 17 nt, Human
ggcuggagcagcucccc

SEQ ID NO: 800105 - RNA, 22 nt, Human
uucuuuagguagauccaguuuu

SEQ ID NO: 800106 - RNA, 22 nt, Human
ucagggcagccuaaggcaccuc

SEQ ID NO: 800107 - RNA, 22 nt, Human
cagcauggacccaucgcugagu

SEQ ID NO: 800108 - RNA, 22 nt, Human
gcggcaggaagagcgcagcccc

SEQ ID NO: 800109 - RNA, 22 nt, Human
gucuuucugcugcacggacugc

SEQ ID NO: 800110 - RNA, 22 nt, Human
caagugaucagacacugaaguc

SEQ ID NO: 800111 - RNA, 19 nt, Human
aggcacagguugucuggac

SEQ ID NO: 800112 - RNA, 22 nt, Human
uggcugcagaucaagggcaggc

SEQ ID NO: 800113 - RNA, 22 nt, Human
uucauagugcuuaauuugauaa

SEQ ID NO: 800114 - RNA, 21 nt, Human
cagcuucugaagguguaggaa

SEQ ID NO: 800115 - RNA, 22 nt, Human
aaaggcucacgcaguuagugau

SEQ ID NO: 800116 - RNA, 22 nt, Human
gcacauuuaacugagcucagga

SEQ ID NO: 800117 - RNA, 22 nt, Human
gauuuauuggucuuucauuggu

SEQ ID NO: 800118 - RNA, 22 nt, Human
ucaggguuucggcucaacagaa

SEQ ID NO: 800119 - RNA, 22 nt, Human
ccaggaaccgaugaucagaggg

SEQ ID NO: 800120 - RNA, 22 nt, Human
agcacuuugggagauaaagcug

SEQ ID NO: 800121 - RNA, 22 nt, Human
aagggcuuaggauuuugcugug

SEQ ID NO: 800122 - RNA, 22 nt, Human
acaggagcucuagggacagcac

SEQ ID NO: 800123 - RNA, 22 nt, Human
gggcuggauuacugaacugagu

SEQ ID NO: 800124 - RNA, 22 nt, Human
agggaagggcagggucuaugca

SEQ ID NO: 800125 - RNA, 22 nt, Human
cagggugccuguccucagcaaa

SEQ ID NO: 800126 - RNA, 18 nt, Human
auuaaucauaaaaugcug

SEQ ID NO: 800127 - RNA, 22 nt, Human
cccuguggauuucaguuugugu

SEQ ID NO: 800128 - RNA, 22 nt, Human
agcucucaagauaagaaagaac

SEQ ID NO: 800129 - RNA, 22 nt, Human
cuggaaagugcugagacaauug

SEQ ID NO: 800130 - RNA, 22 nt, Human
auaaaugauucagcaggaaaua

SEQ ID NO: 800131 - RNA, 22 nt, Human
ccaggacaaguguggccauggc

SEQ ID NO: 800132 - RNA, 22 nt, Human
agaaacagcauuagcaucaauu

SEQ ID NO: 800133 - RNA, 22 nt, Human
ucaggcugaggucaucugcauc

SEQ ID NO: 800134 - RNA, 23 nt, Human
auauuuccagguuagugagguaa

SEQ ID NO: 800135 - RNA, 22 nt, Human
acaacaguccaguauagacugu

SEQ ID NO: 800136 - RNA, 19 nt, Human
gaggcgaggcgugcaggag

SEQ ID NO: 800137 - RNA, 22 nt, Human
aguagucagcagauaauauagg

SEQ ID NO: 800138 - RNA, 22 nt, Human
gagucuaucucacucccccagg

SEQ ID NO: 800139 - RNA, 22 nt, Human
acugaaaaaguaugauucacug

SEQ ID NO: 800140 - RNA, 22 nt, Human
ucugccaggcauugugcugcuc

SEQ ID NO: 800141 - RNA, 21 nt, Human
gugcucugggcagcagagggc

SEQ ID NO: 800142 - RNA, 22 nt, Human
ccaaacaaauccccauucuuag

SEQ ID NO: 800143 - RNA, 22 nt, Human
uccaggcugggcugaagggugc

SEQ ID NO: 800144 - RNA, 23 nt, Human
augaacauuaguuucagauauug

SEQ ID NO: 800145 - RNA, 22 nt, Human
gcugggaagaacaggagagaau

SEQ ID NO: 800146 - RNA, 22 nt, Human
acuggacagguucaugguuuua

SEQ ID NO: 800147 - RNA, 22 nt, Human
gucucaaacuccuaggcuaaag

SEQ ID NO: 800148 - RNA, 22 nt, Human
guucuauuucaguaagcaggca

SEQ ID NO: 800149 - RNA, 22 nt, Human
ugaacugagcaguuuccuggga

SEQ ID NO: 800150 - RNA, 22 nt, Human
ggaaggcuuucuguucugugac

SEQ ID NO: 800151 - RNA, 22 nt, Human
ucaagcaggguagcaagcuggu

SEQ ID NO: 800152 - RNA, 17 nt, Human
gcagccagugcagcagg

SEQ ID NO: 800153 - RNA, 22 nt, Human
cauuccaaguauauacaugaua

SEQ ID NO: 800154 - RNA, 22 nt, Human
aaguuugagagccuuuaguaua

SEQ ID NO: 800155 - RNA, 22 nt, Human
ucugaaauaggaaagcaaaugg

SEQ ID NO: 800156 - RNA, 22 nt, Human
augcacaauuaggauauagcuu

SEQ ID NO: 800157 - RNA, 22 nt, Human
uauuucagcucuuuggauuauc

SEQ ID NO: 800158 - RNA, 22 nt, Human
uuacacagugaauuuacucaag

SEQ ID NO: 800159 - RNA, 22 nt, Human
uuccuaaugucuacuuuaguuc

SEQ ID NO: 800160 - RNA, 21 nt, Human
ucugccagcugaagaggugga

SEQ ID NO: 800161 - RNA, 22 nt, Human
aaucuggacacaguucucaugc

SEQ ID NO: 800162 - RNA, 22 nt, Human
agaggucuuuuggucugcagaa

SEQ ID NO: 800163 - RNA, 22 nt, Human
uauacagaacauuaagaacugu

SEQ ID NO: 800164 - RNA, 22 nt, Human
ggcagcucacgggcauggggug

SEQ ID NO: 800165 - RNA, 22 nt, Human
gcaaaaaaugcuuguugcuuag

SEQ ID NO: 800166 - RNA, 22 nt, Human
ugauucuauggaaggcauaagg

SEQ ID NO: 800167 - RNA, 22 nt, Human
ugagaguauuuuggcauuauca

SEQ ID NO: 800168 - RNA, 22 nt, Human
ucugcccuaauucagugcuuag

SEQ ID NO: 800169 - RNA, 22 nt, Human
cugcuguccaaccugcacucgc

SEQ ID NO: 800170 - RNA, 22 nt, Human
gaaagugcaugugcccaccauu

SEQ ID NO: 800171 - RNA, 22 nt, Human
aaaguuuguuauaugauaagga

SEQ ID NO: 800172 - RNA, 22 nt, Human
ggguaggaugguagaagggacc

SEQ ID NO: 800173 - RNA, 22 nt, Human
gaaauacaauuuugucccagcu

SEQ ID NO: 800174 - RNA, 22 nt, Human
ucaggcugugggcacuggccau

SEQ ID NO: 800175 - RNA, 22 nt, Human
uccaggaggaggaaggcugcca

SEQ ID NO: 800176 - RNA, 22 nt, Human
uaggcuugcaauuaggauggaa

SEQ ID NO: 800177 - RNA, 22 nt, Human
auggugguuugggagaaaaagc

SEQ ID NO: 800178 - RNA, 21 nt, Human
cgcagagcgaacuugcggcgc

SEQ ID NO: 800179 - RNA, 22 nt, Human
ucagggcaaaagggaaaccauu

SEQ ID NO: 800180 - RNA, 22 nt, Human
uucuuacaaacaagaucauuga

SEQ ID NO: 800181 - RNA, 22 nt, Human
acccagagugucugucucaguc

SEQ ID NO: 800182 - RNA, 22 nt, Human
aggcuucagcagcccucucuug

SEQ ID NO: 800183 - RNA, 22 nt, Human
uggcaccugaacuuagaggugu

SEQ ID NO: 800184 - RNA, 22 nt, Human
ggcagcuguuggcucucuagga

SEQ ID NO: 800185 - RNA, 21 nt, Human
gcucugccacuuaccagauuu

SEQ ID NO: 800186 - RNA, 23 nt, Human
uaaagucacauauuagagugagc

SEQ ID NO: 800187 - RNA, 22 nt, Human
caaggcagcuguagggauuugg

SEQ ID NO: 800188 - RNA, 22 nt, Human
uuggaaggagccuaaaagagac

SEQ ID NO: 800189 - RNA, 22 nt, Human
agaagaauacuugauguucaug

SEQ ID NO: 800190 - RNA, 22 nt, Human
uauuaaguaucuugaugacaaa

SEQ ID NO: 800191 - RNA, 22 nt, Human
ugggccuccuuuccauucagag

SEQ ID NO: 800192 - RNA, 22 nt, Human
gcugguggcagagacaucaggu

SEQ ID NO: 800193 - RNA, 22 nt, Human
ccuggccuuaagggcagggagc

SEQ ID NO: 800194 - RNA, 22 nt, Human
acaguacagugcagaggaagau

SEQ ID NO: 800195 - RNA, 22 nt, Human
ggugguugcauaggccagcagc

SEQ ID NO: 800196 - RNA, 22 nt, Human
cagaagggcagcacugggaagg

SEQ ID NO: 800197 - RNA, 22 nt, Human
gagcucauuguggauggauggg

SEQ ID NO: 800198 - RNA, 22 nt, Human
uaguuuaguaagaggagagcug

SEQ ID NO: 800199 - RNA, 22 nt, Human
ugggaguagaugaggagugggc

SEQ ID NO: 800200 - RNA, 22 nt, Human
cugggguggagauuggcaaucu

SEQ ID NO: 800201 - RNA, 22 nt, Human
uggcuuccuaggagcccgugcu

SEQ ID NO: 800202 - RNA, 22 nt, Human
ucacauuucucagcacugauga

SEQ ID NO: 800203 - RNA, 22 nt, Human
gcaaagcugggugugaaugcac

SEQ ID NO: 800204 - RNA, 22 nt, Human
cuggggccacaacggcgcacgc

SEQ ID NO: 800205 - RNA, 18 nt, Human
aguggucuguuauaucau

SEQ ID NO: 800206 - RNA, 22 nt, Human
acaggcugaggaugauugcauc

SEQ ID NO: 800207 - RNA, 22 nt, Human
cuucccaagcuuuaguuauuuu

SEQ ID NO: 800208 - RNA, 21 nt, Human
caguuuaauaacaaagaagga

SEQ ID NO: 800209 - RNA, 22 nt, Human
gagcuaaggcacaggcaggcuu

SEQ ID NO: 800210 - RNA, 22 nt, Human
caauugucagugcuguuuaaau

SEQ ID NO: 800211 - RNA, 22 nt, Human
aggggugaaagagggcccucaa

SEQ ID NO: 800212 - RNA, 22 nt, Human
ugucaucagcauauaagacagu

SEQ ID NO: 800213 - RNA, 22 nt, Human
ucagaagucacuuaggaaaggg

SEQ ID NO: 800214 - RNA, 22 nt, Human
agcagggcuguguagguaauga

SEQ ID NO: 800215 - RNA, 22 nt, Human
uggaugaaauauugcauuuaug

SEQ ID NO: 800216 - RNA, 22 nt, Human
aucauuaaauauaagcuucaca

SEQ ID NO: 800217 - RNA, 22 nt, Human
gccuccaccccuggggagugga

SEQ ID NO: 800218 - RNA, 22 nt, Human
agagggagugaaauggaauaga

SEQ ID NO: 800219 - RNA, 22 nt, Human
gggccaaggggagcuggaaggg

SEQ ID NO: 800220 - RNA, 22 nt, Human
cugacagcuguugcagugaaug

SEQ ID NO: 800221 - RNA, 22 nt, Human
ucaauaaaucccucugacccug

SEQ ID NO: 800222 - RNA, 22 nt, Human
ucagggagauuuggggacucaa

SEQ ID NO: 800223 - RNA, 22 nt, Human
cugugacugggugacaguccuc

SEQ ID NO: 800224 - RNA, 22 nt, Human
cucauucuuucacagucugugg

SEQ ID NO: 800225 - RNA, 23 nt, Human
caggaaauguucuugaagccuga

SEQ ID NO: 800226 - RNA, 22 nt, Human
cuggguugcccugggccuguga

SEQ ID NO: 800227 - RNA, 22 nt, Human
aaaguagcuuaguugauauuuc

SEQ ID NO: 800228 - RNA, 22 nt, Human
gaacaguagaugagaugcuaga

SEQ ID NO: 800229 - RNA, 22 nt, Human
ggcugugccucuggcagcacau

SEQ ID NO: 800230 - RNA, 22 nt, Human
uccggcagcagcucugaaggag

SEQ ID NO: 800231 - RNA, 22 nt, Human
gugacagagugagacccugucu

SEQ ID NO: 800232 - RNA, 22 nt, Human
gcaguggggcgcugggaguugg

SEQ ID NO: 800233 - RNA, 22 nt, Human
ggagggcaacuuuucaguaggu

SEQ ID NO: 800234 - RNA, 22 nt, Human
uaagcacuuuauaugcuuuauc

SEQ ID NO: 800235 - RNA, 22 nt, Human
gcuggcugggacagauuccauu

SEQ ID NO: 800236 - RNA, 22 nt, Human
uaugccaaggaucaauauguau

SEQ ID NO: 800237 - RNA, 22 nt, Human
gccagugggacccgcugugggc

SEQ ID NO: 800238 - RNA, 22 nt, Human
uggguggaauaaaucaguucug

SEQ ID NO: 800239 - RNA, 22 nt, Human
cuccuucaugucauguguccgg

SEQ ID NO: 800240 - RNA, 22 nt, Human
cacaguuuugcccagggcuucu

SEQ ID NO: 800241 - RNA, 22 nt, Human
gcuccuggcucucugagggcug

SEQ ID NO: 800242 - RNA, 22 nt, Human
uguauuuuuagaccuuuagacc

SEQ ID NO: 800243 - RNA, 20 nt, Human
ggcuucuucaggugucuauu

SEQ ID NO: 800244 - RNA, 22 nt, Human
ugagggcugcuuccagagcuag

SEQ ID NO: 800245 - RNA, 22 nt, Human
uucaagaucuuccaaaggauac

SEQ ID NO: 800246 - RNA, 22 nt, Human
agugauuucaucauuuuaucaa

SEQ ID NO: 800247 - RNA, 22 nt, Human
ccugugggagguucugugaguc

SEQ ID NO: 800248 - RNA, 22 nt, Human
gggcagugucgaggucuggucc

SEQ ID NO: 800249 - RNA, 22 nt, Human
uacuuuuuaugauaagaacuga

SEQ ID NO: 800250 - RNA, 22 nt, Human
uaaaggaacagaggacucauuu

SEQ ID NO: 800251 - RNA, 22 nt, Human
acuuaaaaagaaucuuuucacg

SEQ ID NO: 800252 - RNA, 22 nt, Human
ccugugggagcccaggcagaua

SEQ ID NO: 800253 - RNA, 21 nt, Human
gcuggcugucccagggaagca

SEQ ID NO: 800254 - RNA, 22 nt, Human
uccagagacuugcaugugcuug

SEQ ID NO: 800255 - RNA, 21 nt, Human
aaugucauugaauggugagac

SEQ ID NO: 800256 - RNA, 22 nt, Human
uuuacaaguacaccuaacagcu

SEQ ID NO: 800257 - RNA, 22 nt, Human
ucacaggcuccagggccuggau

SEQ ID NO: 800258 - RNA, 22 nt, Human
ucccagcagcauagcucagaau

SEQ ID NO: 800259 - RNA, 22 nt, Human
ugaggaagccaaacagcuacac

SEQ ID NO: 800260 - RNA, 22 nt, Human
uucucuucaucucaguaaaugu

SEQ ID NO: 800261 - RNA, 23 nt, Human
aggaggccugaaacugaggcuga

SEQ ID NO: 800262 - RNA, 19 nt, Human
cucuggcuuccaaagcauc

SEQ ID NO: 800263 - RNA, 22 nt, Human
ggcaggguaaaccgagguaagu

SEQ ID NO: 800264 - RNA, 22 nt, Human
ugugucaauuuucauuccuacu

SEQ ID NO: 800265 - RNA, 22 nt, Human
uccucauucuuggugcaucaaa

SEQ ID NO: 800266 - RNA, 22 nt, Human
aacuaaaagugugucucuugua

SEQ ID NO: 800267 - RNA, 22 nt, Human
gccuggagugcaguggcgugau

SEQ ID NO: 800268 - RNA, 22 nt, Human
ucauguuuggaguuugcucacu

SEQ ID NO: 800269 - RNA, 22 nt, Human
uuccaggaagcaguuagcagcc

SEQ ID NO: 800270 - RNA, 22 nt, Human
uggucugccuggaucacagccc

SEQ ID NO: 800271 - RNA, 22 nt, Human
ccucgcggcacucgggccggau

SEQ ID NO: 800272 - RNA, 22 nt, Human
agcuagggacagauaccagcca

SEQ ID NO: 800273 - RNA, 15 nt, Human
auucacauugcuuca

SEQ ID NO: 800274 - RNA, 22 nt, Human
ucugugucugcagaaguucagc

SEQ ID NO: 800275 - RNA, 22 nt, Human
acagguagauacauacuucuaa

SEQ ID NO: 800276 - RNA, 22 nt, Human
acaauguuuugaaacaucuagg

SEQ ID NO: 800277 - RNA, 22 nt, Human
aauguacaauaagacaaagagg

SEQ ID NO: 800278 - RNA, 22 nt, Human
acagcacaaucugagucccaga

SEQ ID NO: 800279 - RNA, 22 nt, Human
ccuggcagguagcauugaggag

SEQ ID NO: 800280 - RNA, 22 nt, Human
acagugucugacacguaggaag

SEQ ID NO: 800281 - RNA, 23 nt, Human
gccaggcuccggucuguggccac

SEQ ID NO: 800282 - RNA, 19 nt, Human
ugucacugucauggcccag

SEQ ID NO: 800283 - RNA, 22 nt, Human
uuuucuucuaccugcuguccaa

SEQ ID NO: 800284 - RNA, 22 nt, Human
uggggagaagcaauagacucua

SEQ ID NO: 800285 - RNA, 22 nt, Human
ucauuguauucagaacugaaga

SEQ ID NO: 800286 - RNA, 22 nt, Human
gggugguggccagcagugggca

SEQ ID NO: 800287 - RNA, 22 nt, Human
gcuggcaguuuccucaccgagg

SEQ ID NO: 800288 - RNA, 22 nt, Human
gagggaagauuccccauauggg

SEQ ID NO: 800289 - RNA, 22 nt, Human
agcuggcuccagaaggagucgu

SEQ ID NO: 800290 - RNA, 22 nt, Human
agcuggggcauuuauccacuaa

SEQ ID NO: 800291 - RNA, 22 nt, Human
ucuuucaagggcccuaguuugg

SEQ ID NO: 800292 - RNA, 22 nt, Human
uucuuugggauuguagcugucu

SEQ ID NO: 800293 - RNA, 21 nt, Human
ccaggcagagcugugaguucu

SEQ ID NO: 800294 - RNA, 22 nt, Human
gccuccugguugcuucuccaac

SEQ ID NO: 800295 - RNA, 22 nt, Human
ccagcugucagugugaaaauaa

SEQ ID NO: 800296 - RNA, 22 nt, Human
auguuucaggaaaucagcuaga

SEQ ID NO: 800297 - RNA, 22 nt, Human
uggcccaggccaaagcccugga

SEQ ID NO: 800298 - RNA, 22 nt, Human
aaguccugagaccagaaaaugg

SEQ ID NO: 800299 - RNA, 22 nt, Human
cugugucuucugcuuacagucu

SEQ ID NO: 800300 - RNA, 22 nt, Human
aaauuauaggugccaccuugga

SEQ ID NO: 800301 - RNA, 23 nt, Human
cccaagccugugcccucugacuc

SEQ ID NO: 800302 - RNA, 22 nt, Human
augcagaaagcggcaaacaggu

SEQ ID NO: 800303 - RNA, 22 nt, Human
auucuuuaauucaauugaagga

SEQ ID NO: 800304 - RNA, 22 nt, Human
guucaugugacuacuaugaccu

SEQ ID NO: 800305 - RNA, 22 nt, Human
aguccugugaggggugcagcuu

SEQ ID NO: 800306 - RNA, 22 nt, Human
cacacacuguuaauguaggagu

SEQ ID NO: 800307 - RNA, 22 nt, Human
aguuuaauuggaggcguggcuc

SEQ ID NO: 800308 - RNA, 22 nt, Human
cccaggcagggacgugcucugg

SEQ ID NO: 800309 - RNA, 22 nt, Human
uacuguaaugagauuagcuucc

SEQ ID NO: 800310 - RNA, 22 nt, Human
uaacacuaagaaucuaaauuua

SEQ ID NO: 800311 - RNA, 22 nt, Human
aaggaaaugagguugauggaug

SEQ ID NO: 800312 - RNA, 22 nt, Human
guggggaggccuaagcaaguug

SEQ ID NO: 800313 - RNA, 22 nt, Human
gcuggcagcauuagacccuggg

SEQ ID NO: 800314 - RNA, 22 nt, Human
gaaccagcaguugccugaaaaa

SEQ ID NO: 800315 - RNA, 22 nt, Human
auuucucaaccaggucaaaaag

SEQ ID NO: 800316 - RNA, 22 nt, Human
agcagcaguccuuuguguaauu

SEQ ID NO: 800317 - RNA, 22 nt, Human
ucuagggagaagcucugucugu

SEQ ID NO: 800318 - RNA, 23 nt, Human
cuugaaugggauggaauucacug

SEQ ID NO: 800319 - RNA, 22 nt, Human
ucuugaaaguaucuuauuuugu

SEQ ID NO: 800320 - RNA, 22 nt, Human
acauugagaguuuugaagagua

SEQ ID NO: 800321 - RNA, 22 nt, Human
uuucaaacuuuacucuugaauc

SEQ ID NO: 800322 - RNA, 22 nt, Human
aacaaguaaguuuauauauauu

SEQ ID NO: 800323 - RNA, 22 nt, Human
ucuccggguggcggcgaaggga

SEQ ID NO: 800324 - RNA, 22 nt, Human
cugcugaaaacaauaaugauga

SEQ ID NO: 800325 - RNA, 22 nt, Human
acugcagcaaagcccgugucuu

SEQ ID NO: 800326 - RNA, 22 nt, Human
ugagaauuugcauuucuaacaa

SEQ ID NO: 800327 - RNA, 22 nt, Human
ccacggccacccgcucaugggc

SEQ ID NO: 800328 - RNA, 22 nt, Human
cagccugacaccagcuuugggc

SEQ ID NO: 800329 - RNA, 22 nt, Human
cucucaaaguaagguguauaca

SEQ ID NO: 800330 - RNA, 22 nt, Human
gguggcaggcccugagcauccc

SEQ ID NO: 800331 - RNA, 22 nt, Human
ggugcagugguguggcaaaggg

SEQ ID NO: 800332 - RNA, 19 nt, Human
uucuuuggugguggugacc

SEQ ID NO: 800333 - RNA, 18 nt, Human
ucacaucaucccaugcuu

SEQ ID NO: 800334 - RNA, 22 nt, Human
cuuuccuccacucccuaggcuu

SEQ ID NO: 800335 - RNA, 22 nt, Human
acccugggcuuggccugcucag

SEQ ID NO: 800336 - RNA, 23 nt, Human
ugggccagggaguccgguuucuu

SEQ ID NO: 800337 - RNA, 22 nt, Human
gcuggagugcuggagugcagug

SEQ ID NO: 800338 - RNA, 22 nt, Human
ugucuuuacuuagaaguucagg

SEQ ID NO: 800339 - RNA, 22 nt, Human
ccaggugccuccagucacagug

SEQ ID NO: 800340 - RNA, 22 nt, Human
uagaaaccaucucacugcucag

SEQ ID NO: 800341 - RNA, 20 nt, Human
uccaauuaaaaauuguaugc

SEQ ID NO: 800342 - RNA, 22 nt, Human
uagauuuuacuucugucauuac

SEQ ID NO: 800343 - RNA, 22 nt, Human
ucuggagauaagacagacagau

SEQ ID NO: 800344 - RNA, 22 nt, Human
gaacauuugaugaugacauugg

SEQ ID NO: 800345 - RNA, 22 nt, Human
aagcagguuacauacauuaucu

SEQ ID NO: 800346 - RNA, 22 nt, Human
cagcaggcccaggugcugguga

SEQ ID NO: 800347 - RNA, 22 nt, Human
acaugcuucuguuucaagaacu

SEQ ID NO: 800348 - RNA, 22 nt, Human
aacacuuauccacauuugaaag

SEQ ID NO: 800349 - RNA, 22 nt, Human
cagggcaggaugcugugauuau

SEQ ID NO: 800350 - RNA, 22 nt, Human
aaacacuuccuguaacaugaca

SEQ ID NO: 800351 - RNA, 22 nt, Human
aaauauuguuuugguaagcuuc

SEQ ID NO: 800352 - RNA, 22 nt, Human
auuaaauguuccuuaaauuaua

SEQ ID NO: 800353 - RNA, 22 nt, Human
gcuggcucuuuuugccgggcuc

SEQ ID NO: 800354 - RNA, 22 nt, Human
ucuuagaaaugaaguucuuucu

SEQ ID NO: 800355 - RNA, 22 nt, Human
gacaaagugcuaaaccacagag

SEQ ID NO: 800356 - RNA, 22 nt, Human
cagcacagugcagaugcugacu

SEQ ID NO: 800357 - RNA, 22 nt, Human
gcugaagcugcagcaggaggaa

SEQ ID NO: 800358 - RNA, 22 nt, Human
uuuuccuacugauaaacaguua

SEQ ID NO: 800359 - RNA, 22 nt, Human
gggucaggccucaaggugggcu

SEQ ID NO: 800360 - RNA, 22 nt, Human
cagaaacugcuuguggucaucu

SEQ ID NO: 800361 - RNA, 22 nt, Human
uucuuacagcccuauuacuaaa

SEQ ID NO: 800362 - RNA, 19 nt, Human
agccaggguccagacaugu

SEQ ID NO: 800363 - RNA, 22 nt, Human
uggaggagggcuggugucugua

SEQ ID NO: 800364 - RNA, 22 nt, Human
uguucuggagauaagagguaga

SEQ ID NO: 800365 - RNA, 22 nt, Human
ugcugccuucuaggcgugcccu

SEQ ID NO: 800366 - RNA, 22 nt, Human
gauggaaugucacuucuguggu

SEQ ID NO: 800367 - RNA, 22 nt, Human
ccaggugugauuuggcaguguc

SEQ ID NO: 800368 - RNA, 22 nt, Human
aaagucacauagcaucacuucu

SEQ ID NO: 800369 - RNA, 22 nt, Human
agacaauauguauauuaagaau

SEQ ID NO: 800370 - RNA, 22 nt, Human
cagcccugggaguuggggccga

SEQ ID NO: 800371 - RNA, 22 nt, Human
uucuggagccccaagaucugua

SEQ ID NO: 800372 - RNA, 22 nt, Human
auagacaaugguuugccaagaa

SEQ ID NO: 800373 - RNA, 22 nt, Human
cagcaacucuccugugcucaaa

SEQ ID NO: 800374 - RNA, 23 nt, Human
uugcaaauuucaguuaguucaug

SEQ ID NO: 800375 - RNA, 22 nt, Human
gccagcugcuucuccagaauuu

SEQ ID NO: 800376 - RNA, 20 nt, Human
uggaaggcaucugcauuauu

SEQ ID NO: 800377 - RNA, 22 nt, Human
cucuccaguuaccuaggucuga

SEQ ID NO: 800378 - RNA, 22 nt, Human
ccacugggggcugcucccaggu

SEQ ID NO: 800379 - RNA, 22 nt, Human
ugccauauugcaaagugucugc

SEQ ID NO: 800380 - RNA, 22 nt, Human
uauuccuuggcaaaaaauauau

SEQ ID NO: 800381 - RNA, 22 nt, Human
acacaguaguguggaaaaacau

SEQ ID NO: 800382 - RNA, 22 nt, Human
gcugcucagugggccugagccu

SEQ ID NO: 800383 - RNA, 22 nt, Human
gugugggaauggcggucgugca

SEQ ID NO: 800384 - RNA, 22 nt, Human
gcuucucaauucucacccucca

SEQ ID NO: 800385 - RNA, 22 nt, Human
ugagcuggucacuccuucugaa

SEQ ID NO: 800386 - RNA, 22 nt, Human
acaaauuaccauggaauuuggg

SEQ ID NO: 800387 - RNA, 22 nt, Human
acuaaaacaguggcuaguagac

SEQ ID NO: 800388 - RNA, 21 nt, Human
ugaauuucccucuaucauucu

SEQ ID NO: 800389 - RNA, 22 nt, Human
ccugcaccaggcccagcauggu

SEQ ID NO: 800390 - RNA, 22 nt, Human
cggcacagccgggcaaggcugg

SEQ ID NO: 800391 - RNA, 22 nt, Human
augcaauuuacuguacauaaau

SEQ ID NO: 800392 - RNA, 22 nt, Human
ucuggaguaugucccuggugaa

SEQ ID NO: 800393 - RNA, 22 nt, Human
aagaaacuggaauauagagagc

SEQ ID NO: 800394 - RNA, 17 nt, Human
uacugaggggucuggag

SEQ ID NO: 800395 - RNA, 22 nt, Human
gcugugaguggaggaggcugag

SEQ ID NO: 800396 - RNA, 22 nt, Human
ucgggugcuuuuagauauguag

SEQ ID NO: 800397 - RNA, 22 nt, Human
agaggccaggcugcagagggau

SEQ ID NO: 800398 - RNA, 22 nt, Human
auaaucagaauucaugaaagau

SEQ ID NO: 800399 - RNA, 22 nt, Human
aggcuggagacccgccaagaaa

SEQ ID NO: 800400 - RNA, 22 nt, Human
gugggcagccuguccggagacc

SEQ ID NO: 800401 - RNA, 22 nt, Human
gucccagggcaaggcuguuucu

SEQ ID NO: 800402 - RNA, 22 nt, Human
ggcuucaauguauucacauuca

SEQ ID NO: 800403 - RNA, 22 nt, Human
uuauuaaugaguacaaguuauu

SEQ ID NO: 800404 - RNA, 22 nt, Human
uucacauugaaggugcuuucuu

SEQ ID NO: 800405 - RNA, 22 nt, Human
gugcuggcugccaggaggcugc

SEQ ID NO: 800406 - RNA, 22 nt, Human
aucuggauagguuguuuugcau

SEQ ID NO: 800407 - RNA, 22 nt, Human
aagcacaguaaaagcagauuuu

SEQ ID NO: 800408 - RNA, 22 nt, Human
ucacaugccuuuuacucugcac

SEQ ID NO: 800409 - RNA, 22 nt, Human
ugucaaaaagcugggacaagca

SEQ ID NO: 800410 - RNA, 22 nt, Human
cagcuggcguggagugauugca

SEQ ID NO: 800411 - RNA, 22 nt, Human
gaggaggggcacuugucuccua

SEQ ID NO: 800412 - RNA, 22 nt, Human
aggcuggcuucccaagcguccu

SEQ ID NO: 800413 - RNA, 22 nt, Human
ggucacaggggagaagagugau

SEQ ID NO: 800414 - RNA, 22 nt, Human
uggcagcuggagggcaauggcc

SEQ ID NO: 800415 - RNA, 22 nt, Human
guauuuuaagugacuacuaggu

SEQ ID NO: 800416 - RNA, 22 nt, Human
guuuuucugugagcgguaaagg

SEQ ID NO: 800417 - RNA, 22 nt, Human
uugguucauuauugaaugugcu

SEQ ID NO: 800418 - RNA, 22 nt, Human
uuggagucacaggagaagaaug

SEQ ID NO: 800419 - RNA, 19 nt, Human
uuucuguuugcuucugguu

SEQ ID NO: 800420 - RNA, 22 nt, Human
uucaacaaguaguacacacagu

SEQ ID NO: 800421 - RNA, 22 nt, Human
uggcauggacuagugcugaggu

SEQ ID NO: 800422 - RNA, 22 nt, Human
uagcauuucccaaaugcauuug

SEQ ID NO: 800423 - RNA, 22 nt, Human
accuuuauguuugauuacaauu

SEQ ID NO: 800424 - RNA, 19 nt, Human
ugcauauaucuaugaaaga

SEQ ID NO: 800425 - RNA, 22 nt, Human
caguggcaaggacaguaauaau

SEQ ID NO: 800426 - RNA, 19 nt, Human
ggcagagcuccugcuuucu

SEQ ID NO: 800427 - RNA, 22 nt, Human
auuuugaaucaccuuggaagaa

SEQ ID NO: 800428 - RNA, 22 nt, Human
uucaguauuugaaaccauaggc

SEQ ID NO: 800429 - RNA, 22 nt, Human
agguggcugaagagugggugag

SEQ ID NO: 800430 - RNA, 22 nt, Human
gauuucuugauaauucaaaucc

SEQ ID NO: 800431 - RNA, 22 nt, Human
ccaggggcucucagggugugug

SEQ ID NO: 800432 - RNA, 22 nt, Human
cagggagccccaauuccaugcc

SEQ ID NO: 800433 - RNA, 22 nt, Human
aaggcagucugguuucaaagca

SEQ ID NO: 800434 - RNA, 22 nt, Human
cucccuccaaauaagacucggg

SEQ ID NO: 800435 - RNA, 22 nt, Human
ugaggccaggcaaaggcgaucu

SEQ ID NO: 800436 - RNA, 19 nt, Human
aagaagcaauaagcuguga

SEQ ID NO: 800437 - RNA, 22 nt, Human
gcuggcagguccaagauagagc

SEQ ID NO: 800438 - RNA, 22 nt, Human
aauuguaacuacauugagaaca

SEQ ID NO: 800439 - RNA, 22 nt, Human
acaagcaugugguaaaaagacc

SEQ ID NO: 800440 - RNA, 22 nt, Human
acuuuggacgccaugcuguuug

SEQ ID NO: 800441 - RNA, 22 nt, Human
cuggagugaggucugggagccu

SEQ ID NO: 800442 - RNA, 22 nt, Human
ucaggaggccugaguagcucua

SEQ ID NO: 800443 - RNA, 22 nt, Human
agugucaacucggaauaaggau

SEQ ID NO: 800444 - RNA, 22 nt, Human
cgcaggcucgguucacagagca

SEQ ID NO: 800445 - RNA, 22 nt, Human
gucauauacacugcauguaauc

SEQ ID NO: 800446 - RNA, 22 nt, Human
ucagggcugugguuccuuuucu

SEQ ID NO: 800447 - RNA, 22 nt, Human
acaugacagugcuuagcaaacu

SEQ ID NO: 800448 - RNA, 22 nt, Human
uuacaacacuacuuauccuuga

SEQ ID NO: 800449 - RNA, 22 nt, Human
acuucuucuucagcugggggau

SEQ ID NO: 800450 - RNA, 22 nt, Human
uuauaaagugagaagugcuaug

SEQ ID NO: 800451 - RNA, 18 nt, Human
gccagagggcccaagguc

SEQ ID NO: 800452 - RNA, 21 nt, Human
cauaccauucucuaagcaaaa

SEQ ID NO: 800453 - RNA, 22 nt, Human
ucaccccuaccaaggagcacug

SEQ ID NO: 800454 - RNA, 23 nt, Human
agaagcugggagccuggggaugg

SEQ ID NO: 800455 - RNA, 22 nt, Human
gaguggagcaaaagagguagau

SEQ ID NO: 800456 - RNA, 22 nt, Human
gcaggcuggaggcuguucuggg

SEQ ID NO: 800457 - RNA, 22 nt, Human
ggacauggagcuccauggaggc

SEQ ID NO: 800458 - RNA, 20 nt, Human
ucaggcuggugggcuuuccc

SEQ ID NO: 800459 - RNA, 22 nt, Human
uggugcugccaccuccucugcu

SEQ ID NO: 800460 - RNA, 22 nt, Human
uauucugugugauauguaaaug

SEQ ID NO: 800461 - RNA, 22 nt, Human
guggcaugacagugaaugggca

SEQ ID NO: 800462 - RNA, 20 nt, Human
cuggcuggaaacuuagccuu

SEQ ID NO: 800463 - RNA, 22 nt, Human
auaaauucaaagcauuuaggac

SEQ ID NO: 800464 - RNA, 22 nt, Human
caaagcagaagguucuguggua

SEQ ID NO: 800465 - RNA, 22 nt, Human
aggaggaaaaaggccacagcaa

SEQ ID NO: 800466 - RNA, 22 nt, Human
agaaaucaggaacaguaaggag

SEQ ID NO: 800467 - RNA, 22 nt, Human
agagcaauuagcuuagguaaaa

SEQ ID NO: 800468 - RNA, 22 nt, Human
cuuuggcugcauucgaguugcu

SEQ ID NO: 800469 - RNA, 22 nt, Human
aagaaacguuugagcuuugacu

SEQ ID NO: 800470 - RNA, 22 nt, Human
auuguucauuguacaccuagua

SEQ ID NO: 800471 - RNA, 22 nt, Human
agggaugggaacuccuccagca

SEQ ID NO: 800472 - RNA, 22 nt, Human
caggcagaggaggccuucuccu

SEQ ID NO: 800473 - RNA, 20 nt, Human
ugccugggaaggcguggagg

SEQ ID NO: 800474 - RNA, 22 nt, Human
agccagggaagaggccuaccuc

SEQ ID NO: 800475 - RNA, 22 nt, Human
uggacucuaagcagaggaucua

SEQ ID NO: 800476 - RNA, 22 nt, Human
uauggaaaaauguaucuuguca

SEQ ID NO: 800477 - RNA, 22 nt, Human
ucaggaggccggcaggauuuga

SEQ ID NO: 800478 - RNA, 22 nt, Human
auuucucugccucagcuucugc

SEQ ID NO: 800479 - RNA, 22 nt, Human
gugggcagccccuucaaggcca

SEQ ID NO: 800480 - RNA, 22 nt, Human
uuacuguuugaaaaaugaaugu

SEQ ID NO: 800481 - RNA, 22 nt, Human
uccuuaaaugaacucugcauga

SEQ ID NO: 800482 - RNA, 21 nt, Human
gcugggucagcagguccucug

SEQ ID NO: 800483 - RNA, 22 nt, Human
guucugggagaucuugagcuuc

SEQ ID NO: 800484 - RNA, 22 nt, Human
acuggcugaucaccugccucag

SEQ ID NO: 800485 - RNA, 22 nt, Human
cccagccucugggcucacccaa

SEQ ID NO: 800486 - RNA, 22 nt, Human
uagcuuuguccuccacccucag

SEQ ID NO: 800487 - RNA, 22 nt, Human
ugcuaggggcacuaaaagcuga

SEQ ID NO: 800488 - RNA, 22 nt, Human
cagcugagaccagaaugcaggu

SEQ ID NO: 800489 - RNA, 22 nt, Human
agcagcuggguccggcggagca

SEQ ID NO: 800490 - RNA, 22 nt, Human
ugggagcaagcuggugcuggag

SEQ ID NO: 800491 - RNA, 22 nt, Human
uuucagagcucagcagcuagag

SEQ ID NO: 800492 - RNA, 22 nt, Human
gcaagcugcucuuauguggagg

SEQ ID NO: 800493 - RNA, 22 nt, Human
cacagcaaaggcuucggcugau

SEQ ID NO: 800494 - RNA, 21 nt, Human
aaauguguuccauaaugcuuu

SEQ ID NO: 800495 - RNA, 22 nt, Human
cagagcagaagguccaagccug

SEQ ID NO: 800496 - RNA, 22 nt, Human
ccuugaaucucugcucuagaac

SEQ ID NO: 800497 - RNA, 22 nt, Human
aagcugaggauacaugaagccu

SEQ ID NO: 800498 - RNA, 18 nt, Human
agugccagcucugcuuuc

SEQ ID NO: 800499 - RNA, 22 nt, Human
acacaaaguuggaugacaaaau

SEQ ID NO: 800500 - RNA, 23 nt, Human
agcaccugugauuuccuagcucu

SEQ ID NO: 800501 - RNA, 22 nt, Human
ucaaugaaagagcaugcauuuu

SEQ ID NO: 800502 - RNA, 22 nt, Human
ugcagcucaggauucucagggc

SEQ ID NO: 800503 - RNA, 22 nt, Human
uggggacacagagccaaacuau

SEQ ID NO: 800504 - RNA, 23 nt, Human
agggccaggugcggaaacagcuc

SEQ ID NO: 800505 - RNA, 22 nt, Human
auauuuuuccaugugggacucu

SEQ ID NO: 800506 - RNA, 22 nt, Human
cagagacccuucucaguggcca

SEQ ID NO: 800507 - RNA, 22 nt, Human
guucauaauuugaaggaauagg

SEQ ID NO: 800508 - RNA, 22 nt, Human
ucuuagaaacuguaucgauuag

SEQ ID NO: 800509 - RNA, 22 nt, Human
gccucagggauaggaugagcau

SEQ ID NO: 800510 - RNA, 22 nt, Human
cagugcagccaaggacaggcac

SEQ ID NO: 800511 - RNA, 22 nt, Human
uuugcaaacuuuccucuggacc

SEQ ID NO: 800512 - RNA, 18 nt, Human
ggcuccaggaccuaccca

SEQ ID NO: 800513 - RNA, 22 nt, Human
agcaggcagccauuuggaaggc

SEQ ID NO: 800514 - RNA, 22 nt, Human
gccuaggaguggggauggcggu

SEQ ID NO: 800515 - RNA, 22 nt, Human
acaggcagcgucauugcugcuc

SEQ ID NO: 800516 - RNA, 19 nt, Human
ggcucucccuugagagagc

SEQ ID NO: 800517 - RNA, 22 nt, Human
aaucuaacuucauagcugauuu

SEQ ID NO: 800518 - RNA, 22 nt, Human
ucucagaguuuagagcugagcc

SEQ ID NO: 800519 - RNA, 22 nt, Human
ccagcauccaugcucccucggg

SEQ ID NO: 800520 - RNA, 18 nt, Human
ugucaucuguuuaaaacc

SEQ ID NO: 800521 - RNA, 22 nt, Human
agccuggguuuuuauuaaggag

SEQ ID NO: 800522 - RNA, 22 nt, Human
ggcugccuccucgagacaggau

SEQ ID NO: 800523 - RNA, 22 nt, Human
caggaaauaucuccuggcagag

SEQ ID NO: 800524 - RNA, 22 nt, Human
acaguguagaauccuguacuua

SEQ ID NO: 800525 - RNA, 23 nt, Human
ucccagggaaggugagcgaggcu

SEQ ID NO: 800526 - RNA, 22 nt, Human
aaggaacacuacaaggcuggga

SEQ ID NO: 800527 - RNA, 22 nt, Human
ucuuucuuuaucaccugauaug

SEQ ID NO: 800528 - RNA, 22 nt, Human
auagcaaaagcaugugcaauac

SEQ ID NO: 800529 - RNA, 22 nt, Human
guuuauaaauucugcuuuuguu

SEQ ID NO: 800530 - RNA, 22 nt, Human
auauuagcagugaucaaaaugg

SEQ ID NO: 800531 - RNA, 19 nt, Human
gaggaggcuucagcuuucu

SEQ ID NO: 800532 - RNA, 22 nt, Human
uucugcaugauauuaaauguaa

SEQ ID NO: 800533 - RNA, 22 nt, Human
uagcuguguagacacucagagc

SEQ ID NO: 800534 - RNA, 22 nt, Human
uacaucauuuuggagaugagca

SEQ ID NO: 800535 - RNA, 22 nt, Human
cagcaagucauccaggaugaug

SEQ ID NO: 800536 - RNA, 20 nt, Human
ucccuaggcaggagggcacu

SEQ ID NO: 800537 - RNA, 22 nt, Human
guuucauauaccaagcacuuga

SEQ ID NO: 800538 - RNA, 22 nt, Human
aguaaaaauugaggugcaaaau

SEQ ID NO: 800539 - RNA, 22 nt, Human
gcagaagucagaccaucugaau

SEQ ID NO: 800540 - RNA, 22 nt, Human
uucacaaagcuggagcauuucc

SEQ ID NO: 800541 - RNA, 21 nt, Human
ccauaaucuuaggaucaaaau

SEQ ID NO: 800542 - RNA, 22 nt, Human
cauggcagugauucagccuuug

SEQ ID NO: 800543 - RNA, 22 nt, Human
cacagucuccucucuuagccug

SEQ ID NO: 800544 - RNA, 22 nt, Human
acacuacaaucucagaacuaua

SEQ ID NO: 800545 - RNA, 22 nt, Human
caaaagcagcaaguuuauaugu

SEQ ID NO: 800546 - RNA, 22 nt, Human
ccagggcaauuauuuggagggu

SEQ ID NO: 800547 - RNA, 22 nt, Human
gcaggacauucagugaaugggc

SEQ ID NO: 800548 - RNA, 22 nt, Human
cuggggacgucgggcaguguuc

SEQ ID NO: 800549 - RNA, 22 nt, Human
uauguacaguccuuaacuuaaa

SEQ ID NO: 800550 - RNA, 22 nt, Human
acagugucugacacauuguagc

SEQ ID NO: 800551 - RNA, 22 nt, Human
acugccugugucccuucagugc

SEQ ID NO: 800552 - RNA, 22 nt, Human
agaugcuggggccccucggaug

SEQ ID NO: 800553 - RNA, 22 nt, Human
cccuguggcaggaggaggagca

SEQ ID NO: 800554 - RNA, 22 nt, Human
ugcuuaauaggaguugaacauu

SEQ ID NO: 800555 - RNA, 22 nt, Human
ccaccaggacagcccugagggg

SEQ ID NO: 800556 - RNA, 20 nt, Human
aggagggaccuggauuggcg

SEQ ID NO: 800557 - RNA, 22 nt, Human
aagaacaacugcuuuaaaagca

SEQ ID NO: 800558 - RNA, 22 nt, Human
cauuugcaagagauaaauguuu

SEQ ID NO: 800559 - RNA, 22 nt, Human
acaggcacugucaagucaugaa

SEQ ID NO: 800560 - RNA, 23 nt, Human
ugcaggcuaggaagagagccuuc

SEQ ID NO: 800561 - RNA, 22 nt, Human
gcuggagguuucaccugaguuu

SEQ ID NO: 800562 - RNA, 22 nt, Human
cuaaagaauuuugcuugaccag

SEQ ID NO: 800563 - RNA, 22 nt, Human
gccagcuuggcaugugaggagu

SEQ ID NO: 800564 - RNA, 22 nt, Human
uuucuacauuuguaaccagauu

SEQ ID NO: 800565 - RNA, 22 nt, Human
gccugcucuggaauccauguaa

SEQ ID NO: 800566 - RNA, 22 nt, Human
cucaggaguaguucagcagcug

SEQ ID NO: 800567 - RNA, 22 nt, Human
cagagagagugggguguggauu

SEQ ID NO: 800568 - RNA, 22 nt, Human
ggcauugaugggagauggugga

SEQ ID NO: 800569 - RNA, 17 nt, Human
agagggaaaaugcgguu

SEQ ID NO: 800570 - RNA, 22 nt, Human
uuagagguucuaugugucugga

SEQ ID NO: 800571 - RNA, 22 nt, Human
uuuacuuuugguaaggucauuu

SEQ ID NO: 800572 - RNA, 22 nt, Human
uaggacaguagcuggugcacag

SEQ ID NO: 800573 - RNA, 22 nt, Human
uccugaaaaauuacauguucag

SEQ ID NO: 800574 - RNA, 22 nt, Human
aaucuuaagcugaauucucucc

SEQ ID NO: 800575 - RNA, 22 nt, Human
aaacucaaauuaaacuagcuua

SEQ ID NO: 800576 - RNA, 22 nt, Human
caggcuggucccagagcauugc

SEQ ID NO: 800577 - RNA, 23 nt, Human
acagaagccaggagccgcugggc

SEQ ID NO: 800578 - RNA, 22 nt, Human
uuuuuggaaggagauccacacu

SEQ ID NO: 800579 - RNA, 22 nt, Human
auaaaaaggacagauguggucu

SEQ ID NO: 800580 - RNA, 22 nt, Human
aguaaacauaauuuaccuguag

SEQ ID NO: 800581 - RNA, 22 nt, Human
agguccuggacugcucuuguua

SEQ ID NO: 800582 - RNA, 22 nt, Human
ugcaaaugggaaacccagcagu

SEQ ID NO: 800583 - RNA, 22 nt, Human
uuguuacacauaauaacauuuu

SEQ ID NO: 800584 - RNA, 22 nt, Human
ugcaggagcaccagcucacccu

SEQ ID NO: 800585 - RNA, 22 nt, Human
ggcaagggacggccgugagaca

SEQ ID NO: 800586 - RNA, 22 nt, Human
uugccuggagggacauggagac

SEQ ID NO: 800587 - RNA, 22 nt, Human
agccaacuuggaaagucagauu

SEQ ID NO: 800588 - RNA, 22 nt, Human
gcagggugauagugaggcucag

SEQ ID NO: 800589 - RNA, 22 nt, Human
cucucagugccugcccuaggcu

SEQ ID NO: 800590 - RNA, 22 nt, Human
gcagcaggauggccaauugcca

SEQ ID NO: 800591 - RNA, 22 nt, Human
cuuauucagaaggagaaaugga

SEQ ID NO: 800592 - RNA, 22 nt, Human
caaaucuaggaugcauguagug

SEQ ID NO: 800593 - RNA, 22 nt, Human
ccugagccugaguggugcaggg

SEQ ID NO: 800594 - RNA, 22 nt, Human
ccuggcaguuuugcccaggauu

SEQ ID NO: 800595 - RNA, 22 nt, Human
aggggugaaggcccgauaggag

SEQ ID NO: 800596 - RNA, 23 nt, Human
auaguuuucccugguucuugcca

SEQ ID NO: 800597 - RNA, 22 nt, Human
ugcugucuguuuacuggcuaua

SEQ ID NO: 800598 - RNA, 22 nt, Human
gcagggccagugcagagaggaa

SEQ ID NO: 800599 - RNA, 22 nt, Human
gauuucuugagcaaguugcuua

SEQ ID NO: 800600 - RNA, 22 nt, Human
cuugucacucuggcuccagagc

SEQ ID NO: 800601 - RNA, 23 nt, Human
acagaaaucauuuguaagguacc

SEQ ID NO: 800602 - RNA, 22 nt, Human
cauuugcaaaccaacaagauga

SEQ ID NO: 800603 - RNA, 22 nt, Human
ccuggcugaggggccaaggacc

SEQ ID NO: 800604 - RNA, 22 nt, Human
cugggaccaucugugucuacuu

SEQ ID NO: 800605 - RNA, 22 nt, Human
accuugucuuuuauagaacaag

SEQ ID NO: 800606 - RNA, 22 nt, Human
ugacugaggcagccugaguuau

SEQ ID NO: 800607 - RNA, 22 nt, Human
aguuauguccucagcaaaucaa

SEQ ID NO: 800608 - RNA, 22 nt, Human
cagcaggauuugaaaggaagag

SEQ ID NO: 800609 - RNA, 22 nt, Human
cuuguuuaauaauaccuuagca

SEQ ID NO: 800610 - RNA, 18 nt, Human
ucacauuauaauguaaca

SEQ ID NO: 800611 - RNA, 22 nt, Human
aaugcaaugcagcaccuccuug

SEQ ID NO: 800612 - RNA, 22 nt, Human
uagcuuuguauuaucagcauug

SEQ ID NO: 800613 - RNA, 22 nt, Human
acuuucuuaggcuguauaaaug

SEQ ID NO: 800614 - RNA, 22 nt, Human
ucugagagucucugaggcagau

SEQ ID NO: 800615 - RNA, 22 nt, Human
aagcuuuguccaaggccaugca

SEQ ID NO: 800616 - RNA, 22 nt, Human
uguucuuaugaauucaagacac

SEQ ID NO: 800617 - RNA, 22 nt, Human
acugcagcagguaagagcauuu

SEQ ID NO: 800618 - RNA, 21 nt, Human
uucuccaggcaaccauuucag

SEQ ID NO: 800619 - RNA, 22 nt, Human
aagagaagaaagugucuacaca

SEQ ID NO: 800620 - RNA, 22 nt, Human
cugcccucuagaggaggacuga

SEQ ID NO: 800621 - RNA, 22 nt, Human
acacugguguaguuuucugcag

SEQ ID NO: 800622 - RNA, 22 nt, Human
ggccuuggaguccuccacugga

SEQ ID NO: 800623 - RNA, 22 nt, Human
caguuuaaggcaggacauggga

SEQ ID NO: 800624 - RNA, 22 nt, Human
ccaggguggcguagaugcuggg

SEQ ID NO: 800625 - RNA, 22 nt, Human
ucaaauacauggucaaucaacu

SEQ ID NO: 800626 - RNA, 22 nt, Human
ugucacaugaagccaacauagc

SEQ ID NO: 800627 - RNA, 22 nt, Human
ucuaggguccacagggucagcc

SEQ ID NO: 800628 - RNA, 22 nt, Human
aguuucuucauccaaaaaaugg

SEQ ID NO: 800629 - RNA, 20 nt, Human
ugcagcugguuucacaggga

SEQ ID NO: 800630 - RNA, 22 nt, Human
ccugggagggcaagugcugaug

SEQ ID NO: 800631 - RNA, 22 nt, Human
uuuuauguugcuauaauaggua

SEQ ID NO: 800632 - RNA, 22 nt, Human
cgcaggggaggaagguacaccu

SEQ ID NO: 800633 - RNA, 22 nt, Human
cuuugcuuacuggugucugcau

SEQ ID NO: 800634 - RNA, 22 nt, Human
aaaaauagaaggauugacugag

SEQ ID NO: 800635 - RNA, 22 nt, Human
uuuacaaggcagaacugauuaa

SEQ ID NO: 800636 - RNA, 22 nt, Human
ccuggcagguggagguugcagu

SEQ ID NO: 800637 - RNA, 22 nt, Human
accagcugugugaccugaggca

SEQ ID NO: 800638 - RNA, 22 nt, Human
caggcagcugggucaccguccc

SEQ ID NO: 800639 - RNA, 22 nt, Human
cccacugcugcucuccauggca

SEQ ID NO: 800640 - RNA, 22 nt, Human
ccugggcucugaggagggaguc

SEQ ID NO: 800641 - RNA, 22 nt, Human
guggggaguguucugugauugg

SEQ ID NO: 800642 - RNA, 22 nt, Human
uggcacagacagcacagcaaug

SEQ ID NO: 800643 - RNA, 22 nt, Human
ugcuggggguagcucugcguag

SEQ ID NO: 800644 - RNA, 22 nt, Human
aaguuuuauuggcuauagcacu

SEQ ID NO: 800645 - RNA, 22 nt, Human
agcuuagaagugugcugagagg

SEQ ID NO: 800646 - RNA, 22 nt, Human
gaggugggaugugugugcuacu

SEQ ID NO: 800647 - RNA, 16 nt, Human
augcugcuauuagagg

SEQ ID NO: 800648 - RNA, 22 nt, Human
uucaaagucagccaucuggcua

SEQ ID NO: 800649 - RNA, 22 nt, Human
agggccaggaucacagccaaga

SEQ ID NO: 800650 - RNA, 22 nt, Human
cauucacaauaguugaaaggug

SEQ ID NO: 800651 - RNA, 19 nt, Human
gucuuacaggcaacaugag

SEQ ID NO: 800652 - RNA, 22 nt, Human
cuacaaagaaaguauacuggac

SEQ ID NO: 800653 - RNA, 22 nt, Human
cugaagcagggagugaugaagu

SEQ ID NO: 800654 - RNA, 22 nt, Human
aucacauauuuaagaaacaugu

SEQ ID NO: 800655 - RNA, 22 nt, Human
auuaagagccuacuaugugccg

SEQ ID NO: 800656 - RNA, 22 nt, Human
gaggcccagagagguugcauga

SEQ ID NO: 800657 - RNA, 22 nt, Human
cucauuuacucaucugcaaaac

SEQ ID NO: 800658 - RNA, 22 nt, Human
ugcagggaggccccgcagcccu

SEQ ID NO: 800659 - RNA, 22 nt, Human
ucugugcacuaacauuccuggu

SEQ ID NO: 800660 - RNA, 22 nt, Human
uggugcugauaauggcaggauu

SEQ ID NO: 800661 - RNA, 22 nt, Human
cuucucucccuggcacucagac

SEQ ID NO: 800662 - RNA, 22 nt, Human
acauuguauacagacuuaguca

SEQ ID NO: 800663 - RNA, 22 nt, Human
cagcccucaucccgccugcguu

SEQ ID NO: 800664 - RNA, 22 nt, Human
ucccccucauuaccucauucaa

SEQ ID NO: 800665 - RNA, 22 nt, Human
gcugagagcacauagaaggggc

SEQ ID NO: 800666 - RNA, 22 nt, Human
cuggacaggcuggggacugcaa

SEQ ID NO: 800667 - RNA, 22 nt, Human
ugcagggauccuagcugaagag

SEQ ID NO: 800668 - RNA, 22 nt, Human
gcugccuuuuaaagccucgcuu

SEQ ID NO: 800669 - RNA, 22 nt, Human
uagcuuuaaaaaucaucaaagc

SEQ ID NO: 800670 - RNA, 22 nt, Human
cugggucaaggaaugcuggugg

SEQ ID NO: 800671 - RNA, 22 nt, Human
ggaagacaagcaguggcugagc

SEQ ID NO: 800672 - RNA, 22 nt, Human
ugucuauuugaauuauccuaau

SEQ ID NO: 800673 - RNA, 22 nt, Human
ucauuucaaugauacuacuaag

SEQ ID NO: 800674 - RNA, 22 nt, Human
gacacaguuuuucucacggugg

SEQ ID NO: 800675 - RNA, 20 nt, Human
gcaggcagggaaugggggug

SEQ ID NO: 800676 - RNA, 18 nt, Human
cuucucccaucuuggcca

SEQ ID NO: 800677 - RNA, 22 nt, Human
cuuggcagcuuuuggaggagcc

SEQ ID NO: 800678 - RNA, 22 nt, Human
agcuggauuaaauauagcuuuc

SEQ ID NO: 800679 - RNA, 19 nt, Human
gaauguuuguauucagcgc

SEQ ID NO: 800680 - RNA, 23 nt, Human
uguuuuucauucacaugggcugu

SEQ ID NO: 800681 - RNA, 22 nt, Human
gcacaggaggccgaugcucaug

SEQ ID NO: 800682 - RNA, 22 nt, Human
caguggagugggacuggucuga

SEQ ID NO: 800683 - RNA, 22 nt, Human
gcccagguuggagagcaguggc

SEQ ID NO: 800684 - RNA, 22 nt, Human
gggggugacgauggcagcuggu

SEQ ID NO: 800685 - RNA, 22 nt, Human
uugaacaauuugguauacaaac

SEQ ID NO: 800686 - RNA, 22 nt, Human
ucagugcauggacagauuuaga

SEQ ID NO: 800687 - RNA, 22 nt, Human
agugucaagugaggagggaaag

SEQ ID NO: 800688 - RNA, 22 nt, Human
caucagaagaaagacaaaugau

SEQ ID NO: 800689 - RNA, 22 nt, Human
caggagcccguugcuccggcgg

SEQ ID NO: 800690 - RNA, 22 nt, Human
ggacagagcccugguggccuaa

SEQ ID NO: 800691 - RNA, 22 nt, Human
guuucuaaauguucugaguuuu

SEQ ID NO: 800692 - RNA, 22 nt, Human
guuuacauaugucugucugcac

SEQ ID NO: 800693 - RNA, 19 nt, Human
agcaggccacagggccagc

SEQ ID NO: 800694 - RNA, 22 nt, Human
uauuauuauaguuauugggaag

SEQ ID NO: 800695 - RNA, 22 nt, Human
agcugccaucagccuuuggaug

SEQ ID NO: 800696 - RNA, 22 nt, Human
cucucccuaugccucccaggag

SEQ ID NO: 800697 - RNA, 22 nt, Human
cacugaggcugggggagaaggu

SEQ ID NO: 800698 - RNA, 22 nt, Human
gauucacaguuuaggcugggcu

SEQ ID NO: 800699 - RNA, 22 nt, Human
ugcccugguuacacuggagucc

SEQ ID NO: 800700 - RNA, 22 nt, Human
aguuggugagcgugugguaauc

SEQ ID NO: 800701 - RNA, 22 nt, Human
gcuggcagguaaagccccgggg

SEQ ID NO: 800702 - RNA, 19 nt, Human
gcaagguucacucccagag

SEQ ID NO: 800703 - RNA, 18 nt, Human
uguggcaggggugggaga

SEQ ID NO: 800704 - RNA, 22 nt, Human
ugggugaguggagggcauucua

SEQ ID NO: 800705 - RNA, 22 nt, Human
ggagcccuucuauuccauggag

SEQ ID NO: 800706 - RNA, 22 nt, Human
cccuccauuaaaacagaccuau

SEQ ID NO: 800707 - RNA, 22 nt, Human
acuugucuuuguaaaauagaaa

SEQ ID NO: 800708 - RNA, 22 nt, Human
cccaggcuggaauuccaggccu

SEQ ID NO: 800709 - RNA, 22 nt, Human
acuggcugugcccauagagcuc

SEQ ID NO: 800710 - RNA, 22 nt, Human
uuggcacacaguaagcccuaag

SEQ ID NO: 800711 - RNA, 22 nt, Human
agcucugguuauugaagcaggg

SEQ ID NO: 800712 - RNA, 22 nt, Human
acaaugaagggagacacuugcu

SEQ ID NO: 800713 - RNA, 22 nt, Human
aggacuggugugugaucagcau

SEQ ID NO: 800714 - RNA, 22 nt, Human
agaguggcuucuuugacaugcu

SEQ ID NO: 800715 - RNA, 22 nt, Human
uacagauauagagauuuauaga

SEQ ID NO: 800716 - RNA, 22 nt, Human
uauuuaguuaucuuucauaaaa

SEQ ID NO: 800717 - RNA, 22 nt, Human
acuggcagaacuggugauuguc

SEQ ID NO: 800718 - RNA, 22 nt, Human
uacagcuuuagcaaauuaccua

SEQ ID NO: 800719 - RNA, 22 nt, Human
aacugaaacguauuuuugagau

SEQ ID NO: 800720 - RNA, 23 nt, Human
uggcaaggaaugggauggagacu

SEQ ID NO: 800721 - RNA, 22 nt, Human
aaucacagccacaaccuggggg

SEQ ID NO: 800722 - RNA, 22 nt, Human
uaauuuuacuuccugagcaccu

SEQ ID NO: 800723 - RNA, 19 nt, Human
ugccagcucacaggagcuc

SEQ ID NO: 800724 - RNA, 22 nt, Human
agauguuuauaacucaugagug

SEQ ID NO: 800725 - RNA, 22 nt, Human
guuuuuauauccuguggagugu

SEQ ID NO: 800726 - RNA, 22 nt, Human
caaaauaccacgacuuguuuua

SEQ ID NO: 800727 - RNA, 23 nt, Human
ccucaggggaccugugagccuga

SEQ ID NO: 800728 - RNA, 22 nt, Human
gggagcaggagccugccugcca

SEQ ID NO: 800729 - RNA, 22 nt, Human
gcugugugcugggcauggcacu

SEQ ID NO: 800730 - RNA, 22 nt, Human
uaugcacauucacacaaaaaug

SEQ ID NO: 800731 - RNA, 18 nt, Human
ccugcagcccaggaggcc

SEQ ID NO: 800732 - RNA, 22 nt, Human
gcuggccaggaagagucucaga

SEQ ID NO: 800733 - RNA, 22 nt, Human
uucguauuuauauucucaauac

SEQ ID NO: 800734 - RNA, 23 nt, Human
gcugcagcuguggauguucucag

SEQ ID NO: 800735 - RNA, 22 nt, Human
uuauuucuacuauuuugccuga

SEQ ID NO: 800736 - RNA, 22 nt, Human
guccugggcccaggggcugccu

SEQ ID NO: 800737 - RNA, 22 nt, Human
aaaguauauuuacuuacuguga

SEQ ID NO: 800738 - RNA, 22 nt, Human
uguaguaagugcgcaauaaaua

SEQ ID NO: 800739 - RNA, 22 nt, Human
ucagcaggcugucagcaggggc

SEQ ID NO: 800740 - RNA, 22 nt, Human
acacuacaacagcagaggugag

SEQ ID NO: 800741 - RNA, 22 nt, Human
acauuucuuuucaucucuauau

SEQ ID NO: 800742 - RNA, 22 nt, Human
aaaagccaugcauaccuaagag

SEQ ID NO: 800743 - RNA, 22 nt, Human
aagaguuuaauuuugucuagac

SEQ ID NO: 800744 - RNA, 22 nt, Human
cacagugcucaaacacaagugc

SEQ ID NO: 800745 - RNA, 22 nt, Human
cugcugggucuaugcaagugga

SEQ ID NO: 800746 - RNA, 22 nt, Human
uuagucaaaucauucuguuucu

SEQ ID NO: 800747 - RNA, 22 nt, Human
cagagagaauauguaguaugga

SEQ ID NO: 800748 - RNA, 22 nt, Human
aguuucuaacauauagcauugg

SEQ ID NO: 800749 - RNA, 22 nt, Human
uugcuucagaaguucugcuugu

SEQ ID NO: 800750 - RNA, 22 nt, Human
ggugcaggaaucugcaauugaa

SEQ ID NO: 800751 - RNA, 22 nt, Human
aaguuucugggcaagacaaggc

SEQ ID NO: 800752 - RNA, 22 nt, Human
ggaagaggcugagccagguccc

SEQ ID NO: 800753 - RNA, 22 nt, Human
gaaggcucuggggauugagaua

SEQ ID NO: 800754 - RNA, 22 nt, Human
uaggaacacagggacuugauga

SEQ ID NO: 800755 - RNA, 22 nt, Human
cugggagaucuguugggacugg

SEQ ID NO: 800756 - RNA, 22 nt, Human
gcuuucuucauacucaagcauc

SEQ ID NO: 800757 - RNA, 22 nt, Human
ucccugggguuccuccagccac

SEQ ID NO: 800758 - RNA, 22 nt, Human
uggcccugcuggccaaaggcua

SEQ ID NO: 800759 - RNA, 22 nt, Human
aggagcugcagauucugccuug

SEQ ID NO: 800760 - RNA, 22 nt, Human
ucauuuacacuucacaaaugga

SEQ ID NO: 800761 - RNA, 22 nt, Human
cuggagcugguauagggacaaa

SEQ ID NO: 800762 - RNA, 22 nt, Human
ucuggaguuuuuucugucugug

SEQ ID NO: 800763 - RNA, 22 nt, Human
uucaaacaacucauuuaugcaa

SEQ ID NO: 800764 - RNA, 22 nt, Human
ucugcuugugucuguccagccu

SEQ ID NO: 800765 - RNA, 22 nt, Human
aucaaauacaaagggcauaagg

SEQ ID NO: 800766 - RNA, 22 nt, Human
gaaggcuugauugaggaaugcc

SEQ ID NO: 800767 - RNA, 23 nt, Human
ucuuuccuaaugaaacagugaaa

SEQ ID NO: 800768 - RNA, 22 nt, Human
cauggcagagaaggggaacugg

SEQ ID NO: 800769 - RNA, 22 nt, Human
uuugcuuugacugucagcaagu

SEQ ID NO: 800770 - RNA, 22 nt, Human
acuggcugaggaaguugccacu

SEQ ID NO: 800771 - RNA, 22 nt, Human
ucacauuuggagaaagccugcc

SEQ ID NO: 800772 - RNA, 22 nt, Human
uuuauauugggagucguuuuga

SEQ ID NO: 800773 - RNA, 22 nt, Human
gcuauuuuugagccauuuauaa

SEQ ID NO: 800774 - RNA, 22 nt, Human
uuuuagauuauaagucuaauuc

SEQ ID NO: 800775 - RNA, 22 nt, Human
ucaguucuuaguaaugcagucu

SEQ ID NO: 800776 - RNA, 22 nt, Human
ggggacaguuaaagaccaagac

SEQ ID NO: 800777 - RNA, 22 nt, Human
gcuggcuguuggagguaccugc

SEQ ID NO: 800778 - RNA, 22 nt, Human
agcagcccaguuguacugagug

SEQ ID NO: 800779 - RNA, 22 nt, Human
cuccaggacccaguggcuccag

SEQ ID NO: 800780 - RNA, 22 nt, Human
agggucaccugcuugccagggc

SEQ ID NO: 800781 - RNA, 22 nt, Human
uaggagggggaacaaggcauac

SEQ ID NO: 800782 - RNA, 22 nt, Human
agggggugcccagaugaaggau

SEQ ID NO: 800783 - RNA, 22 nt, Human
cuucuugcugggggccucagug

SEQ ID NO: 800784 - RNA, 22 nt, Human
agauggcaggcccugugggggu

SEQ ID NO: 800785 - RNA, 23 nt, Human
uuauuuggauuuuaguggaaaga

SEQ ID NO: 800786 - RNA, 22 nt, Human
acaggcaggcuucggccagagc

SEQ ID NO: 800787 - RNA, 22 nt, Human
gggaccacuccgacauguaggg

SEQ ID NO: 800788 - RNA, 20 nt, Human
agcaggcugcagggugaaau

SEQ ID NO: 800789 - RNA, 22 nt, Human
cuggcuccauuacucagcaucu

SEQ ID NO: 800790 - RNA, 22 nt, Human
ggcucccugccuguccucaguc

SEQ ID NO: 800791 - RNA, 22 nt, Human
gacagcaacacucaauucugca

SEQ ID NO: 800792 - RNA, 22 nt, Human
caggaggcagagguugcagcga

SEQ ID NO: 800793 - RNA, 17 nt, Human
ugguccagguggagcca

SEQ ID NO: 800794 - RNA, 22 nt, Human
ugcugccugguuucuucuugcu

SEQ ID NO: 800795 - RNA, 22 nt, Human
cccagccugugacagccguccu

SEQ ID NO: 800796 - RNA, 22 nt, Human
aaucagaacuccuaccacagag

SEQ ID NO: 800797 - RNA, 22 nt, Human
uuucuguuaggcaucauuuuaa

SEQ ID NO: 800798 - RNA, 22 nt, Human
cugugucggacgugggcagcag

SEQ ID NO: 800799 - RNA, 22 nt, Human
uaccaaaaagugagccccagag

SEQ ID NO: 800800 - RNA, 22 nt, Human
gaaagcacaguucugaccaugu

SEQ ID NO: 800801 - RNA, 22 nt, Human
guggcagagagcaagugucuga

SEQ ID NO: 800802 - RNA, 22 nt, Human
uuauagaauguuuccaaugccu

SEQ ID NO: 800803 - RNA, 22 nt, Human
ccugaggauauucaccagcaug

SEQ ID NO: 800804 - RNA, 22 nt, Human
acagugaugccgggcgagaaug

SEQ ID NO: 800805 - RNA, 22 nt, Human
ggcucucugaggaaacccuucc

SEQ ID NO: 800806 - RNA, 22 nt, Human
uccagcagguccgagacaaguu

SEQ ID NO: 800807 - RNA, 22 nt, Human
agugcauuugggguaguggaag

SEQ ID NO: 800808 - RNA, 22 nt, Human
gguucuaggucuggggauaaug

SEQ ID NO: 800809 - RNA, 22 nt, Human
ugccagcucagaguuaggacug

SEQ ID NO: 800810 - RNA, 22 nt, Human
gcucugagcagggagaaacagg

SEQ ID NO: 800811 - RNA, 22 nt, Human
auauacacauguguauacauuu

SEQ ID NO: 800812 - RNA, 21 nt, Human
agaguucuugcugagcaagcc

SEQ ID NO: 800813 - RNA, 22 nt, Human
aguuucucuuugacaccaaaau

SEQ ID NO: 800814 - RNA, 22 nt, Human
gcuccaggagcucacagcucgc

SEQ ID NO: 800815 - RNA, 23 nt, Human
acugcugucuuugaagugcuuga

SEQ ID NO: 800816 - RNA, 22 nt, Human
augucuguucauuauuaacugc

SEQ ID NO: 800817 - RNA, 22 nt, Human
uaaagacaaaugacauuacggc

SEQ ID NO: 800818 - RNA, 21 nt, Human
uguuuacucccugcaagcacg

SEQ ID NO: 800819 - RNA, 23 nt, Human
cucagugugugacccauggccuc

SEQ ID NO: 800820 - RNA, 22 nt, Human
uucauaaacaaauuaaggccug

SEQ ID NO: 800821 - RNA, 22 nt, Human
aaucacaucucauucaacagcc

SEQ ID NO: 800822 - RNA, 22 nt, Human
ugggaggcccaggccuggcagg

SEQ ID NO: 800823 - RNA, 22 nt, Human
auguuacagaaagcaaagauga

SEQ ID NO: 800824 - RNA, 22 nt, Human
caaauacuaaacauaagauuuu

SEQ ID NO: 800825 - RNA, 22 nt, Human
agcugaaggcuagaacagcugg

SEQ ID NO: 800826 - RNA, 22 nt, Human
gcugcugcuggucuggggccac

SEQ ID NO: 800827 - RNA, 22 nt, Human
aucugaaguccuuauaaucuga

SEQ ID NO: 800828 - RNA, 22 nt, Human
gacagagguguccuugagucca

SEQ ID NO: 800829 - RNA, 22 nt, Human
aucaauuuugaggauacaagaa

SEQ ID NO: 800830 - RNA, 22 nt, Human
uuccagaggggagguggcagcc

SEQ ID NO: 800831 - RNA, 22 nt, Human
uaacagcaguccucuucucaug

SEQ ID NO: 800832 - RNA, 22 nt, Human
uuguucaugguuguaaguuuga

SEQ ID NO: 800833 - RNA, 22 nt, Human
acaguacagcuaaugucauuag

SEQ ID NO: 800834 - RNA, 22 nt, Human
cucagagaaaaggagcaagggu

SEQ ID NO: 800835 - RNA, 22 nt, Human
gagaucgguaaagagcaugcac

SEQ ID NO: 800836 - RNA, 22 nt, Human
agaugaaaagauaagcagcaau

SEQ ID NO: 800837 - RNA, 22 nt, Human
aucugaagaaugaauggaauua

SEQ ID NO: 800838 - RNA, 22 nt, Human
gaccacagcagugcaagaggag

SEQ ID NO: 800839 - RNA, 22 nt, Human
agggccagggaaacgaucagca

SEQ ID NO: 800840 - RNA, 22 nt, Human
caugcaagaagauagauuaaau

SEQ ID NO: 800841 - RNA, 22 nt, Human
cgcugggggaacagcgagggug

SEQ ID NO: 800842 - RNA, 17 nt, Human
ucuucucuuccagucuu

SEQ ID NO: 800843 - RNA, 22 nt, Human
aguaaaaaguucagaaugguug

SEQ ID NO: 800844 - RNA, 22 nt, Human
agucaggcugacaggcuaggag

SEQ ID NO: 800845 - RNA, 22 nt, Human
ugcacuuugcaggcauggaaac

SEQ ID NO: 800846 - RNA, 22 nt, Human
aggacacagacugauugcagca

SEQ ID NO: 800847 - RNA, 22 nt, Human
ggcugcugguagggguaggaag

SEQ ID NO: 800848 - RNA, 21 nt, Human
agcuuguguguaucacagugu

SEQ ID NO: 800849 - RNA, 22 nt, Human
uugaaguuuaaugguagauucc

SEQ ID NO: 800850 - RNA, 19 nt, Human
uccuggggaggggcauggc

SEQ ID NO: 800851 - RNA, 19 nt, Human
cuggagguagaggguuagu

SEQ ID NO: 800852 - RNA, 22 nt, Human
ucagaagcaaacaucacucuag

SEQ ID NO: 800853 - RNA, 22 nt, Human
gacaggaaacaagaaggcagga

SEQ ID NO: 800854 - RNA, 22 nt, Human
gaacauaauuaaauguccuggg

SEQ ID NO: 800855 - RNA, 22 nt, Human
ugcaggcuggcagauaucucau

SEQ ID NO: 800856 - RNA, 22 nt, Human
caaauguguaaggaaguguuag

SEQ ID NO: 800857 - RNA, 22 nt, Human
uggcucaguuaggucagaaaca

SEQ ID NO: 800858 - RNA, 22 nt, Human
aaaugcuguaacugauauucug

SEQ ID NO: 800859 - RNA, 22 nt, Human
aaaguauauaugcacuuuagaa

SEQ ID NO: 800860 - RNA, 22 nt, Human
agccccaguaagggagggccug

SEQ ID NO: 800861 - RNA, 22 nt, Human
cagugcuuggggagcggagaga

SEQ ID NO: 800862 - RNA, 22 nt, Human
uugacuuuacaguuuucuuagg

SEQ ID NO: 800863 - RNA, 22 nt, Human
gcugccucacuccagcccaaua

SEQ ID NO: 800864 - RNA, 22 nt, Human
agggaagcaauauuagauauca

SEQ ID NO: 800865 - RNA, 22 nt, Human
aaagcaaugcccguucauuauc

SEQ ID NO: 800866 - RNA, 22 nt, Human
uggcccaguagaaaagggaucg

SEQ ID NO: 800867 - RNA, 21 nt, Human
ucucuacacuuucacuaggcu

SEQ ID NO: 800868 - RNA, 22 nt, Human
gcugcaggcgccugcggucucu

SEQ ID NO: 800869 - RNA, 22 nt, Human
agggcagcaauuugguuccugg

SEQ ID NO: 800870 - RNA, 22 nt, Human
uuuaaacauaucuguugaggga

SEQ ID NO: 800871 - RNA, 22 nt, Human
aucaaaguaucucaauauggua

SEQ ID NO: 800872 - RNA, 22 nt, Human
gcaugcaugugugcagacaguc

SEQ ID NO: 800873 - RNA, 22 nt, Human
guuucucacuuccaguagccaa

SEQ ID NO: 800874 - RNA, 22 nt, Human
ccagcagggaaaaacccaccaa

SEQ ID NO: 800875 - RNA, 22 nt, Human
cccaggcagagagcuggugagc

SEQ ID NO: 800876 - RNA, 23 nt, Human
acauacauaagcaccacauuuug

SEQ ID NO: 800877 - RNA, 22 nt, Human
uggggugggcaugcgcuguccu

SEQ ID NO: 800878 - RNA, 22 nt, Human
ccugaggggcugcaggccagcu

SEQ ID NO: 800879 - RNA, 22 nt, Human
acagccuguuugaucuggugcu

SEQ ID NO: 800880 - RNA, 22 nt, Human
agaguaugcaucuauuguaccu

SEQ ID NO: 800881 - RNA, 22 nt, Human
aaguuucugauauuguuaaagc

SEQ ID NO: 800882 - RNA, 22 nt, Human
cuuacaacuuguaugugauugu

SEQ ID NO: 800883 - RNA, 22 nt, Human
ugcacugggaaagaaggaggga

SEQ ID NO: 800884 - RNA, 22 nt, Human
gaggauggugagcaggacccag

SEQ ID NO: 800885 - RNA, 22 nt, Human
guuacaaaggucauaaaagugu

SEQ ID NO: 800886 - RNA, 22 nt, Human
ucuuuagagcucagaaauacag

SEQ ID NO: 800887 - RNA, 22 nt, Human
uauccaaaguggcauauuauag

SEQ ID NO: 800888 - RNA, 18 nt, Human
uagauuaaaauugaauuc

SEQ ID NO: 800889 - RNA, 22 nt, Human
caauacuauucggaccaucucu

SEQ ID NO: 800890 - RNA, 22 nt, Human
uacaaagugacaagcucugcug

SEQ ID NO: 800891 - RNA, 22 nt, Human
caaaugcuaacuucuuuccaaa

SEQ ID NO: 800892 - RNA, 22 nt, Human
acuuuuaugauaaucaauguuc

SEQ ID NO: 800893 - RNA, 22 nt, Human
aguauuacccucagaacuugau

SEQ ID NO: 800894 - RNA, 22 nt, Human
cagacuugacggcagcugcuuu

SEQ ID NO: 800895 - RNA, 22 nt, Human
uuucaugaggggcaaaaucuca

SEQ ID NO: 800896 - RNA, 20 nt, Human
caggccagagguuugauggc

SEQ ID NO: 800897 - RNA, 22 nt, Human
uaauuacagagguuugccaguu

SEQ ID NO: 800898 - RNA, 22 nt, Human
ucagggagaggugagagccugu

SEQ ID NO: 800899 - RNA, 22 nt, Human
gggcagcucggaagugggaaag

SEQ ID NO: 800900 - RNA, 17 nt, Human
agguguggucaagggag

SEQ ID NO: 800901 - RNA, 22 nt, Human
uagaggcauaagagggaagcag

SEQ ID NO: 800902 - RNA, 22 nt, Human
guaaagaaggcaaccugguuau

SEQ ID NO: 800903 - RNA, 20 nt, Human
uccuggaggcuucauccaua

SEQ ID NO: 800904 - RNA, 21 nt, Human
uaaacauaaccuuguauggcu

SEQ ID NO: 800905 - RNA, 22 nt, Human
cccaggaggcagagauagcagu

SEQ ID NO: 800906 - RNA, 22 nt, Human
acuguucauuuggauuucucug

SEQ ID NO: 800907 - RNA, 21 nt, Human
ucagaggcugggggaaugccc

SEQ ID NO: 800908 - RNA, 22 nt, Human
aagggcagccugacucacgguc

SEQ ID NO: 800909 - RNA, 22 nt, Human
ugucuuuuggagcaucuuucuu

SEQ ID NO: 800910 - RNA, 22 nt, Human
guuucaaagcacagcucacauu

SEQ ID NO: 800911 - RNA, 22 nt, Human
cugccaggcagggagauggcug

SEQ ID NO: 800912 - RNA, 22 nt, Human
uuguuacagcagugauuucaga

SEQ ID NO: 800913 - RNA, 22 nt, Human
ucaggaaauggaauucuugugu

SEQ ID NO: 800914 - RNA, 22 nt, Human
caggaaagggaugggcugccac

SEQ ID NO: 800915 - RNA, 22 nt, Human
acacuucucuuugaagaacaau

SEQ ID NO: 800916 - RNA, 20 nt, Human
ccuugccaguagggcuggga

SEQ ID NO: 800917 - RNA, 22 nt, Human
cagaacagacuuaacagggcug

SEQ ID NO: 800918 - RNA, 22 nt, Human
acaaaagugagugugucucaga

SEQ ID NO: 800919 - RNA, 22 nt, Human
ggcaggguggcccuccagugag

SEQ ID NO: 800920 - RNA, 22 nt, Human
gaggccugaggcugccuggagc

SEQ ID NO: 800921 - RNA, 22 nt, Human
cagcugcucuucuggccuguca

SEQ ID NO: 800922 - RNA, 22 nt, Human
caggcagugugacgcuaggguu

SEQ ID NO: 800923 - RNA, 22 nt, Human
uggccucuggcugaggacuaac

SEQ ID NO: 800924 - RNA, 22 nt, Human
ugcccagcugucaaaguagaua

SEQ ID NO: 800925 - RNA, 22 nt, Human
gcccggccaggaacagaguaua

SEQ ID NO: 800926 - RNA, 22 nt, Human
uucaacugggcggaucugagaa

SEQ ID NO: 800927 - RNA, 22 nt, Human
uggauucuaaugcacuucaaau

SEQ ID NO: 800928 - RNA, 22 nt, Human
ggugcagaaggaagggagcugg

SEQ ID NO: 800929 - RNA, 22 nt, Human
cugcugagguauacuaugugac

SEQ ID NO: 800930 - RNA, 23 nt, Human
ugagcaagugaccaacugucugu

SEQ ID NO: 800931 - RNA, 22 nt, Human
uuuagacauagcugaaaucauu

SEQ ID NO: 800932 - RNA, 22 nt, Human
cucccaggcacagggaggagcc

SEQ ID NO: 800933 - RNA, 22 nt, Human
caccaggcugaaccagagggga

SEQ ID NO: 800934 - RNA, 22 nt, Human
ggcaggcauggccacucccuag

SEQ ID NO: 800935 - RNA, 22 nt, Human
cuguggcaccaauacauuuuuc

SEQ ID NO: 800936 - RNA, 22 nt, Human
caguccugcuggccuucccugg

SEQ ID NO: 800937 - RNA, 19 nt, Human
cacauuuugagucugagau

SEQ ID NO: 800938 - RNA, 22 nt, Human
gcacuugaagaauugaacugga

SEQ ID NO: 800939 - RNA, 19 nt, Human
ugaggagcagcugguugau

SEQ ID NO: 800940 - RNA, 22 nt, Human
cacugccuccccaggcuccaca

SEQ ID NO: 800941 - RNA, 22 nt, Human
aaagugcagggugcucugguau

SEQ ID NO: 800942 - RNA, 22 nt, Human
caggacagagcccagacugugu

SEQ ID NO: 800943 - RNA, 22 nt, Human
agcuucuuguagaacucaaaag

SEQ ID NO: 800944 - RNA, 22 nt, Human
gagugucaaggcucucuuuggc

SEQ ID NO: 800945 - RNA, 22 nt, Human
aagcaggagaugggugcuuuuc

SEQ ID NO: 800946 - RNA, 22 nt, Human
ugcuggaggggccugaccagga

SEQ ID NO: 800947 - RNA, 22 nt, Human
ucaggaugaagucagagggguc

SEQ ID NO: 800948 - RNA, 22 nt, Human
aguuuuuccugauuuuacagaa

SEQ ID NO: 800949 - RNA, 22 nt, Human
caggcugccgugggguccaggc

SEQ ID NO: 800950 - RNA, 22 nt, Human
caguuuuagggcaaugugaaga

SEQ ID NO: 800951 - RNA, 19 nt, Human
ccagagguuugcugggccu

SEQ ID NO: 800952 - RNA, 22 nt, Human
uggggacagggcucagcaauuu

SEQ ID NO: 800953 - RNA, 22 nt, Human
caggggaagaugccaagggaga

SEQ ID NO: 800954 - RNA, 22 nt, Human
agugauuaauuguaaaaauucu

SEQ ID NO: 800955 - RNA, 22 nt, Human
ccagccucaucgccugccuguc

SEQ ID NO: 800956 - RNA, 22 nt, Human
augaaaagggagugauauuugu

SEQ ID NO: 800957 - RNA, 22 nt, Human
gacagcagggaaaguccagacc

SEQ ID NO: 800958 - RNA, 22 nt, Human
gaggcuagagcaggggcucaau

SEQ ID NO: 800959 - RNA, 22 nt, Human
uuucaguucaccugggaacccg

SEQ ID NO: 800960 - RNA, 22 nt, Human
cacagcagagggagccauugaa

SEQ ID NO: 800961 - RNA, 22 nt, Human
acugcacuucacccugggugac

SEQ ID NO: 800962 - RNA, 22 nt, Human
uguuuuaagagcgcacuuuaua

SEQ ID NO: 800963 - RNA, 22 nt, Human
uucauauaaauggaaucagaau

SEQ ID NO: 800964 - RNA, 22 nt, Human
uucuuuccaaccagauauuggu

SEQ ID NO: 800965 - RNA, 22 nt, Human
ugggggcacuucgaggucgccu

SEQ ID NO: 800966 - RNA, 22 nt, Human
gagcccaggaaguggaggcuga

SEQ ID NO: 800967 - RNA, 21 nt, Human
aagucaauacagauaagucuu

SEQ ID NO: 800968 - RNA, 22 nt, Human
ucggagagcucacagcuguggc

SEQ ID NO: 800969 - RNA, 21 nt, Human
ucugcacagccccgcaggagg

SEQ ID NO: 800970 - RNA, 22 nt, Human
cugagcugggaguagagacucu

SEQ ID NO: 800971 - RNA, 22 nt, Human
ugccagggagcccugcugacca

SEQ ID NO: 800972 - RNA, 22 nt, Human
auugagaaaauaaguauggaua

SEQ ID NO: 800973 - RNA, 22 nt, Human
cagaaucucugggaguggauca

SEQ ID NO: 800974 - RNA, 22 nt, Human
cuggaaugccucccugucagag

SEQ ID NO: 800975 - RNA, 22 nt, Human
uaaggcagagguaccacuaggc

SEQ ID NO: 800976 - RNA, 22 nt, Human
ugucuaaugaauuaauuaauua

SEQ ID NO: 800977 - RNA, 22 nt, Human
cugugggugaagacaagggaga

SEQ ID NO: 800978 - RNA, 22 nt, Human
uccagagaauucuacgcagugc

SEQ ID NO: 800979 - RNA, 21 nt, Human
agaauaaugguaucauuugcu

SEQ ID NO: 800980 - RNA, 22 nt, Human
gcuggaguuagaacuagccugg

SEQ ID NO: 800981 - RNA, 22 nt, Human
aauacuuuccuauauaaggugc

SEQ ID NO: 800982 - RNA, 22 nt, Human
caagcuuuauccgccauguagg

SEQ ID NO: 800983 - RNA, 22 nt, Human
auauccauaguaaaagucauua

SEQ ID NO: 800984 - RNA, 22 nt, Human
uaauauuucuacccugcugccu

SEQ ID NO: 800985 - RNA, 22 nt, Human
uccagggagucaaaugaacuac

SEQ ID NO: 800986 - RNA, 22 nt, Human
caggacaguuggcaucugcugc

SEQ ID NO: 800987 - RNA, 22 nt, Human
aucuuugggauauuugugauua

SEQ ID NO: 800988 - RNA, 22 nt, Human
cuucuuaaugacagauuaaaau

SEQ ID NO: 800989 - RNA, 22 nt, Human
ugaugcucuccuaauaugaaaa

SEQ ID NO: 800990 - RNA, 22 nt, Human
gugaccagugaugcugaggagu

SEQ ID NO: 800991 - RNA, 22 nt, Human
gcagcugaagcugcaguuccag

SEQ ID NO: 800992 - RNA, 22 nt, Human
gagaaaccuguaaggaaggaag

SEQ ID NO: 800993 - RNA, 22 nt, Human
ggugagggaguggaacgaggug

SEQ ID NO: 800994 - RNA, 22 nt, Human
ucaugcaaagccaauuccagcu

SEQ ID NO: 800995 - RNA, 22 nt, Human
aggucuggaaacagcagggaga

SEQ ID NO: 800996 - RNA, 22 nt, Human
acagcugggugcugcucagagc

SEQ ID NO: 800997 - RNA, 22 nt, Human
cuccuggcaguuccccuuguca

SEQ ID NO: 800998 - RNA, 22 nt, Human
aaagacauuagauuaacguaca

SEQ ID NO: 800999 - RNA, 22 nt, Human
gacccaggcucgugggacggcu

SEQ ID NO: 801000 - RNA, 20 nt, Human
gcuucccaauucuugaucug

SEQ ID NO: 801001 - RNA, 22 nt, Human
agcuggcuugcaugcuaaggag

SEQ ID NO: 801002 - RNA, 22 nt, Human
ggcagggugccuggcuccuguu

SEQ ID NO: 801003 - RNA, 22 nt, Human
ucauucagguugggcaaguguc

SEQ ID NO: 801004 - RNA, 22 nt, Human
aggccagacagcuagaaacagg

SEQ ID NO: 801005 - RNA, 22 nt, Human
cacccaggcuggagugcagggg

SEQ ID NO: 801006 - RNA, 22 nt, Human
auaagaaacauuauucuuucca

SEQ ID NO: 801007 - RNA, 22 nt, Human
gucugcugcagagcauggcuuu

SEQ ID NO: 801008 - RNA, 22 nt, Human
aggcucauucuugccucugagc

SEQ ID NO: 801009 - RNA, 22 nt, Human
ucaggcuggagugcaguggcgc

SEQ ID NO: 801010 - RNA, 22 nt, Human
cccucccaagcacucugacaua

SEQ ID NO: 801011 - RNA, 22 nt, Human
uagucuuuuuaauaaauaaugc

SEQ ID NO: 801012 - RNA, 22 nt, Human
gcuucccagcagaggaaagacu

SEQ ID NO: 801013 - RNA, 22 nt, Human
uucagagacauguucuagauca

SEQ ID NO: 801014 - RNA, 22 nt, Human
ggcucagcuuggugcgcagaaa

SEQ ID NO: 801015 - RNA, 22 nt, Human
gagagcugcagccgagaggggg

SEQ ID NO: 801016 - RNA, 22 nt, Human
uucuggaauacuaaguuccuuu

SEQ ID NO: 801017 - RNA, 22 nt, Human
cagauggcugccaagaugggcu

SEQ ID NO: 801018 - RNA, 22 nt, Human
cagucucucuuguagugcagcu

SEQ ID NO: 801019 - RNA, 22 nt, Human
aaauauagugacacuuauaguc

SEQ ID NO: 801020 - RNA, 22 nt, Human
agugacaaggugguaaugaagc

SEQ ID NO: 801021 - RNA, 22 nt, Human
ucagggcagaauccaaagaauu

SEQ ID NO: 801022 - RNA, 22 nt, Human
cauauauucugguuuucacugg

SEQ ID NO: 801023 - RNA, 22 nt, Human
guucuaggagccaagaauauag

SEQ ID NO: 801024 - RNA, 22 nt, Human
uauuaaagggaaguuaugcaug

SEQ ID NO: 801025 - RNA, 22 nt, Human
cccaggaguucgaggcuguagu

SEQ ID NO: 801026 - RNA, 20 nt, Human
uacaauauucccacuuugcu

SEQ ID NO: 801027 - RNA, 22 nt, Human
agcugugugaccuagggcaagc

SEQ ID NO: 801028 - RNA, 22 nt, Human
aacucuguguaggaaccagguc

SEQ ID NO: 801029 - RNA, 22 nt, Human
aaauaguuuagcucucauuuca

SEQ ID NO: 801030 - RNA, 22 nt, Human
ugagaugaauaacuccugcuaa

SEQ ID NO: 801031 - RNA, 22 nt, Human
acaguguauaaaaucuuaaaga

SEQ ID NO: 801032 - RNA, 22 nt, Human
aucagaauuagccagugaggcu

SEQ ID NO: 801033 - RNA, 22 nt, Human
auuuacacauucauaagauuuc

SEQ ID NO: 801034 - RNA, 22 nt, Human
ccucaggcuuacgggcaaugga

SEQ ID NO: 801035 - RNA, 22 nt, Human
uauucacauuaauaagucuuca

SEQ ID NO: 801036 - RNA, 22 nt, Human
cucaggucuuaguucugucauc

SEQ ID NO: 801037 - RNA, 21 nt, Human
cauauuaaaucggugccuuua

SEQ ID NO: 801038 - RNA, 22 nt, Human
cauuuacauaacaguaacgcug

SEQ ID NO: 801039 - RNA, 22 nt, Human
aagcaaagaguuuaguggguga

SEQ ID NO: 801040 - RNA, 22 nt, Human
aaggaagguacucagugauucu

SEQ ID NO: 801041 - RNA, 22 nt, Human
uggccaguagauaggcaggcaa

SEQ ID NO: 801042 - RNA, 22 nt, Human
caggugggagcgaggagcuacu

SEQ ID NO: 801043 - RNA, 22 nt, Human
gcaggcugaguugggaaaccaa

SEQ ID NO: 801044 - RNA, 22 nt, Human
ccuagaauguacuuaauagaug

SEQ ID NO: 801045 - RNA, 21 nt, Human
aggcccagagucuugggggga

SEQ ID NO: 801046 - RNA, 22 nt, Human
agcagcuugggucucuccugcu

SEQ ID NO: 801047 - RNA, 22 nt, Human
cucagcuggcaauucuggcucc

SEQ ID NO: 801048 - RNA, 22 nt, Human
ucaagaaagggcuucaccagga

SEQ ID NO: 801049 - RNA, 22 nt, Human
uugagaacuagcauggucuauc

SEQ ID NO: 801050 - RNA, 22 nt, Human
uuacaaaguguuaugauaaaca

SEQ ID NO: 801051 - RNA, 22 nt, Human
aagucagagaugccaaagauua

SEQ ID NO: 801052 - RNA, 22 nt, Human
cccaggguagcugagcuggcag

SEQ ID NO: 801053 - RNA, 22 nt, Human
uaucaauaucucagugugcuuc

SEQ ID NO: 801054 - RNA, 22 nt, Human
uggcuggcgccgggcuagccac

SEQ ID NO: 801055 - RNA, 22 nt, Human
aaguaacaggcaugugaaugac

SEQ ID NO: 801056 - RNA, 22 nt, Human
aaaggacaugucaauaucaggc

SEQ ID NO: 801057 - RNA, 20 nt, Human
uguagguguacaguaaggag

SEQ ID NO: 801058 - RNA, 19 nt, Human
cccaaggcccugggcaggc

SEQ ID NO: 801059 - RNA, 20 nt, Human
uugaaugaaugucuggcuca

SEQ ID NO: 801060 - RNA, 19 nt, Human
uccuagcaccuggcacaua

SEQ ID NO: 801061 - RNA, 22 nt, Human
ucccagcccagauuugugugac

SEQ ID NO: 801062 - RNA, 22 nt, Human
gaaggaaaggucucaugccuuu

SEQ ID NO: 801063 - RNA, 22 nt, Human
agaauaaucacugaaguucaaa

SEQ ID NO: 801064 - RNA, 22 nt, Human
ggugcagaagaaagcagucauu

SEQ ID NO: 801065 - RNA, 22 nt, Human
cccugccuuguuggagccuaug

SEQ ID NO: 801066 - RNA, 20 nt, Human
ucagaaggcuccagagcaga

SEQ ID NO: 801067 - RNA, 20 nt, Human
ggcacuggaagcacacagga

SEQ ID NO: 801068 - RNA, 22 nt, Human
auuagaaugaaguauaggauuu

SEQ ID NO: 801069 - RNA, 22 nt, Human
uugucgggcuuacgcagggcca

SEQ ID NO: 801070 - RNA, 22 nt, Human
cauuuggaccaaaauagccaac

SEQ ID NO: 801071 - RNA, 22 nt, Human
gcuggcucccauugguccuucc

SEQ ID NO: 801072 - RNA, 17 nt, Human
cuccuggcagccucagg

SEQ ID NO: 801073 - RNA, 22 nt, Human
ugaguggacgugaggcugagua

SEQ ID NO: 801074 - RNA, 22 nt, Human
agggaaggaaaagcugucgcuu

SEQ ID NO: 801075 - RNA, 22 nt, Human
uugggguggaagugaggaucau

SEQ ID NO: 801076 - RNA, 22 nt, Human
uggcuucagacuucugcuacgu

SEQ ID NO: 801077 - RNA, 22 nt, Human
ugcuggagaagcuccugggacu

SEQ ID NO: 801078 - RNA, 22 nt, Human
guggguggaggcgucgagggca

SEQ ID NO: 801079 - RNA, 16 nt, Human
gcagaggaaaggggag

SEQ ID NO: 801080 - RNA, 22 nt, Human
uaggccaggacagagcuuccag

SEQ ID NO: 801081 - RNA, 23 nt, Human
uggggagaguuacccuggaagcg

SEQ ID NO: 801082 - RNA, 22 nt, Human
guaaaaggucaaggccaagucu

SEQ ID NO: 801083 - RNA, 22 nt, Human
auacauaguucugugaaaagua

SEQ ID NO: 801084 - RNA, 22 nt, Human
uucuacuuucucugucauuaaa

SEQ ID NO: 801085 - RNA, 18 nt, Human
ggagcccagaggacagga

SEQ ID NO: 801086 - RNA, 22 nt, Human
ugcuuaaaguaguggauuguua

SEQ ID NO: 801087 - RNA, 22 nt, Human
aggcagcagccacaaggccuga

SEQ ID NO: 801088 - RNA, 22 nt, Human
gagaggagacuuauccagauug

SEQ ID NO: 801089 - RNA, 22 nt, Human
ccagggaagauuagaagccacu

SEQ ID NO: 801090 - RNA, 22 nt, Human
auguguuuguccugcagaaaua

SEQ ID NO: 801091 - RNA, 22 nt, Human
ugaggcuuuauguaagggugca

SEQ ID NO: 801092 - RNA, 22 nt, Human
aggccucagcucagugugacag

SEQ ID NO: 801093 - RNA, 22 nt, Human
cuuuucaaacgcugaugucagu

SEQ ID NO: 801094 - RNA, 22 nt, Human
ugcugcuuggaaauggggcuga

SEQ ID NO: 801095 - RNA, 22 nt, Human
cugggagucccuggaauagcuc

SEQ ID NO: 801096 - RNA, 22 nt, Human
ucacaggcuaaauuuaugcagg

SEQ ID NO: 801097 - RNA, 22 nt, Human
uacaguaauaaaaugagcuaca

SEQ ID NO: 801098 - RNA, 22 nt, Human
cugaggcugaagagggccuacg

SEQ ID NO: 801099 - RNA, 22 nt, Human
ggcucuggguucugcaaugcgu

SEQ ID NO: 801100 - RNA, 22 nt, Human
uuauuauugauucgcucucaaa

SEQ ID NO: 801101 - RNA, 19 nt, Human
aucuacaauuauucucagu

SEQ ID NO: 801102 - RNA, 22 nt, Human
ccuggcucugguucccucagcu

SEQ ID NO: 801103 - RNA, 22 nt, Human
guuucuuucuauugacugaaca

SEQ ID NO: 801104 - RNA, 22 nt, Human
auauaguuggguuucauucuac

SEQ ID NO: 801105 - RNA, 22 nt, Human
cuggccagccucccagguaccc

SEQ ID NO: 801106 - RNA, 22 nt, Human
gcaugcaaggggugugaaguga

SEQ ID NO: 801107 - RNA, 22 nt, Human
aacauacagugagcaguggacu

SEQ ID NO: 801108 - RNA, 23 nt, Human
uuugaacauuucuagauuacaua

SEQ ID NO: 801109 - RNA, 23 nt, Human
cuggaagugcuuuuauagcuuug

SEQ ID NO: 801110 - RNA, 22 nt, Human
uuacaaagaaaauuaggcauuu

SEQ ID NO: 801111 - RNA, 22 nt, Human
cuguucugaacugccugcaugc

SEQ ID NO: 801112 - RNA, 22 nt, Human
uggaagggguuacgcagcagga

SEQ ID NO: 801113 - RNA, 22 nt, Human
gcacugggugggagaucugaau

SEQ ID NO: 801114 - RNA, 22 nt, Human
uggacaguuacugagcuugagu

SEQ ID NO: 801115 - RNA, 22 nt, Human
agaaaauuuaaagagacacaca

SEQ ID NO: 801116 - RNA, 23 nt, Human
agguggagcugugcagccggggc

SEQ ID NO: 801117 - RNA, 22 nt, Human
ggcagaggugacagugucuuuu

SEQ ID NO: 801118 - RNA, 22 nt, Human
ccaggcugcuuuauuacucugu

SEQ ID NO: 801119 - RNA, 22 nt, Human
ucugccagugccagaguacaua

SEQ ID NO: 801120 - RNA, 22 nt, Human
ucacaagauacaguuagaagca

SEQ ID NO: 801121 - RNA, 22 nt, Human
caggcauggaucuggaaucauu

SEQ ID NO: 801122 - RNA, 22 nt, Human
agagggcaugcuugguggccug

SEQ ID NO: 801123 - RNA, 22 nt, Human
aauguauucugggaaaauguua

SEQ ID NO: 801124 - RNA, 22 nt, Human
uacaaaucagaucaugaguuua

SEQ ID NO: 801125 - RNA, 22 nt, Human
gcuggggcugggcugaggaaga

SEQ ID NO: 801126 - RNA, 22 nt, Human
auaucagaaauaguaagcagag

SEQ ID NO: 801127 - RNA, 22 nt, Human
augacaauacuucaauaagcug

SEQ ID NO: 801128 - RNA, 22 nt, Human
uggagccaguguugcccaacac

SEQ ID NO: 801129 - RNA, 22 nt, Human
uggcccuguggaggucagugag

SEQ ID NO: 801130 - RNA, 22 nt, Human
accuccccucaccaaucugguu

SEQ ID NO: 801131 - RNA, 22 nt, Human
uaguauuuuagaaaaccaugaa

SEQ ID NO: 801132 - RNA, 22 nt, Human
ugggggugcccuaugaggaagc

SEQ ID NO: 801133 - RNA, 22 nt, Human
cccagcaggaggagguugcagu

SEQ ID NO: 801134 - RNA, 22 nt, Human
caggcaaggaggcacugaggga

SEQ ID NO: 801135 - RNA, 22 nt, Human
uagauuuguuuccuucucucca

SEQ ID NO: 801136 - RNA, 22 nt, Human
auacaugugggucuaaacauau

SEQ ID NO: 801137 - RNA, 22 nt, Human
ccuggcucugcgugcagcuccg

SEQ ID NO: 801138 - RNA, 22 nt, Human
agcaaagauguccggggcaagc

SEQ ID NO: 801139 - RNA, 22 nt, Human
ggaccaggggcgcacucccugc

SEQ ID NO: 801140 - RNA, 22 nt, Human
gccucugcaacuccgccuuggu

SEQ ID NO: 801141 - RNA, 22 nt, Human
ccugcagcuuugccuccugaac

SEQ ID NO: 801142 - RNA, 22 nt, Human
gggcagcauucugugggcaggu

SEQ ID NO: 801143 - RNA, 22 nt, Human
aauaugaguuugccuuuccugc

SEQ ID NO: 801144 - RNA, 22 nt, Human
cccugcagccggccagcucauu

SEQ ID NO: 801145 - RNA, 22 nt, Human
aucccaggcggcacagguugca

SEQ ID NO: 801146 - RNA, 22 nt, Human
uuccaggaacaaacucaccuua

SEQ ID NO: 801147 - RNA, 22 nt, Human
aaaauaugacugugcuccuuaa

SEQ ID NO: 801148 - RNA, 22 nt, Human
uuugcaaaugaagcucugagga

SEQ ID NO: 801149 - RNA, 20 nt, Human
uggcaggaauagggccagag

SEQ ID NO: 801150 - RNA, 22 nt, Human
uccccagucccggcggugggug

SEQ ID NO: 801151 - RNA, 22 nt, Human
uucuacauauauuuuucucacu

SEQ ID NO: 801152 - RNA, 22 nt, Human
augcaaauaagugcaggcgugg

SEQ ID NO: 801153 - RNA, 22 nt, Human
ugaggaaguuguuucucuucua

SEQ ID NO: 801154 - RNA, 22 nt, Human
uucucccugccaaagcugccuc

SEQ ID NO: 801155 - RNA, 22 nt, Human
gcucccugacucaguuccugag

SEQ ID NO: 801156 - RNA, 22 nt, Human
uugcaugugacucuauuuaugc

SEQ ID NO: 801157 - RNA, 22 nt, Human
uuacaaguacugaauaugauuu

SEQ ID NO: 801158 - RNA, 22 nt, Human
uggcccaggugcacccagaggc

SEQ ID NO: 801159 - RNA, 22 nt, Human
agcuaggggaccaagguggccc

SEQ ID NO: 801160 - RNA, 22 nt, Human
ucaggcaaggcuggucucauac

SEQ ID NO: 801161 - RNA, 22 nt, Human
gcuggcaguguauuguuagcug

SEQ ID NO: 801162 - RNA, 22 nt, Human
auaugcaucugugugcgugucu

SEQ ID NO: 801163 - RNA, 22 nt, Human
aggcugugaaauguggcaagga

SEQ ID NO: 801164 - RNA, 22 nt, Human
cuaauauuuuuagaaaucacga

SEQ ID NO: 801165 - RNA, 22 nt, Human
gcuggucagagagaaaggaggc

SEQ ID NO: 801166 - RNA, 22 nt, Human
gccaggguggcagaaggcccca

SEQ ID NO: 801167 - RNA, 22 nt, Human
acuuucccucucagaacucuua

SEQ ID NO: 801168 - RNA, 22 nt, Human
cacacaugguagcagguacaag

SEQ ID NO: 801169 - RNA, 22 nt, Human
ccagcccugccucucagggccc

SEQ ID NO: 801170 - RNA, 22 nt, Human
agggaggcauuagcuacugcga

SEQ ID NO: 801171 - RNA, 22 nt, Human
ugggagaacccagggucaggcu

SEQ ID NO: 801172 - RNA, 22 nt, Human
ggcccacuugaaauggagcuca

SEQ ID NO: 801173 - RNA, 22 nt, Human
guauuuucaagagcaguaguau

SEQ ID NO: 801174 - RNA, 22 nt, Human
ugggagcaggugugcuagggaa

SEQ ID NO: 801175 - RNA, 22 nt, Human
ucuucauuuuauagcaucugug

SEQ ID NO: 801176 - RNA, 22 nt, Human
gagcugagauuugaagcaaguu

SEQ ID NO: 801177 - RNA, 22 nt, Human
caaguugugaaugacagacuuc

SEQ ID NO: 801178 - RNA, 20 nt, Human
gaggcccagagaggugaagc

SEQ ID NO: 801179 - RNA, 22 nt, Human
ucagugcagacuguaaguugga

SEQ ID NO: 801180 - RNA, 22 nt, Human
auuaaacaauguaaaguucuug

SEQ ID NO: 801181 - RNA, 22 nt, Human
ucagauaagugaagcaaaguuu

SEQ ID NO: 801182 - RNA, 22 nt, Human
caucacagauguuguguggagu

SEQ ID NO: 801183 - RNA, 22 nt, Human
agccagggaugcagcacaguga

SEQ ID NO: 801184 - RNA, 22 nt, Human
agaggccagcaaccacaguaaa

SEQ ID NO: 801185 - RNA, 16 nt, Human
gcaggcagaucacaug

SEQ ID NO: 801186 - RNA, 22 nt, Human
ucucaaauuuauacagaguuca

SEQ ID NO: 801187 - RNA, 22 nt, Human
aaacccugcccuucccaagaug

SEQ ID NO: 801188 - RNA, 19 nt, Human
agcuggcucuucuuugucu

SEQ ID NO: 801189 - RNA, 22 nt, Human
ccucaggcucugggugccuacc

SEQ ID NO: 801190 - RNA, 22 nt, Human
aaagccaaaugaaagaugguuc

SEQ ID NO: 801191 - RNA, 22 nt, Human
auuaaggaagccuauucucucc

SEQ ID NO: 801192 - RNA, 19 nt, Human
aacaaguaggaauggaaga

SEQ ID NO: 801193 - RNA, 22 nt, Human
acauuguaaauaccuuuaucac

SEQ ID NO: 801194 - RNA, 22 nt, Human
cucagugucacguuuugccuua

SEQ ID NO: 801195 - RNA, 22 nt, Human
cagcaggagcagucagacuccu

SEQ ID NO: 801196 - RNA, 22 nt, Human
aaacuagccacacagaauacac

SEQ ID NO: 801197 - RNA, 22 nt, Human
cugaggaaaguauugccuggug

SEQ ID NO: 801198 - RNA, 22 nt, Human
auggcagaaagaauagaggcua

SEQ ID NO: 801199 - RNA, 22 nt, Human
ugcuggcuccucgaggcuucgu

SEQ ID NO: 801200 - RNA, 22 nt, Human
uguuuacagggugauuuuaccu

SEQ ID NO: 801201 - RNA, 22 nt, Human
cggggcugcgcucuuccugccg

SEQ ID NO: 801202 - RNA, 22 nt, Human
cagaguuuaaacaaaugaaaua

SEQ ID NO: 801203 - RNA, 18 nt, Human
cagaaaguuauuuacucu

SEQ ID NO: 801204 - RNA, 22 nt, Human
gcuuuggaguuaggacucggcc

SEQ ID NO: 801205 - RNA, 22 nt, Human
ugggccagauccauggcaauaa

SEQ ID NO: 801206 - RNA, 22 nt, Human
uuuacuaaguacuuguaucccu

SEQ ID NO: 801207 - RNA, 22 nt, Human
ccuggcugguugucugauucua

SEQ ID NO: 801208 - RNA, 19 nt, Human
caucuggaugauucuccug

SEQ ID NO: 801209 - RNA, 22 nt, Human
agccagcuguacugccugcuca

SEQ ID NO: 801210 - RNA, 22 nt, Human
uaagaacuuggcagcaagaaau

SEQ ID NO: 801211 - RNA, 22 nt, Human
gcccagcaggggauggcagcuc

SEQ ID NO: 801212 - RNA, 23 nt, Human
gggcuucauuuuaauucagcugc

SEQ ID NO: 801213 - RNA, 22 nt, Human
gggcagcucagccaccaugcag

SEQ ID NO: 801214 - RNA, 22 nt, Human
cacagcuggugcacuagcucug

SEQ ID NO: 801215 - RNA, 22 nt, Human
uaauauaccaaacuguaauuuu

SEQ ID NO: 801216 - RNA, 22 nt, Human
ucaggaugaccacgagccucua

SEQ ID NO: 801217 - RNA, 22 nt, Human
cugaaauaaaguugcuaaaauu

SEQ ID NO: 801218 - RNA, 22 nt, Human
cccugccuacaggguuuucuuu

SEQ ID NO: 801219 - RNA, 22 nt, Human
agacaaacccaguggcuguuuu

SEQ ID NO: 801220 - RNA, 22 nt, Human
caggcacaugggagcucaucau

SEQ ID NO: 801221 - RNA, 22 nt, Human
uggcagggucuugcuguguugc

SEQ ID NO: 801222 - RNA, 22 nt, Human
agacagugauaccuugggaugu

SEQ ID NO: 801223 - RNA, 22 nt, Human
caguuucuucaucaguuaagca

SEQ ID NO: 801224 - RNA, 22 nt, Human
gcuguggguaaacgcugagggu

SEQ ID NO: 801225 - RNA, 22 nt, Human
ccaggcaauucugaaagcauuu

SEQ ID NO: 801226 - RNA, 22 nt, Human
uggacaggugcacacagcagcc

SEQ ID NO: 801227 - RNA, 22 nt, Human
auccacccugugguggcuuucu

SEQ ID NO: 801228 - RNA, 22 nt, Human
ggagaggcgaugagucacagcc

SEQ ID NO: 801229 - RNA, 22 nt, Human
gaaacuuacuuacucacauuuc

SEQ ID NO: 801230 - RNA, 22 nt, Human
uggaaggcaacggagugagcug

SEQ ID NO: 801231 - RNA, 22 nt, Human
auacaucauuuauggaauaagg

SEQ ID NO: 801232 - RNA, 22 nt, Human
uuugacuucuaucuaguaagaa

SEQ ID NO: 801233 - RNA, 22 nt, Human
aggaggugagcggucauguggu

SEQ ID NO: 801234 - RNA, 22 nt, Human
aacuauacucuguaaaugugcu

SEQ ID NO: 801235 - RNA, 22 nt, Human
uuaaugacaucauaggugaagu

SEQ ID NO: 801236 - RNA, 22 nt, Human
aggccagugguucucugugucc

SEQ ID NO: 801237 - RNA, 22 nt, Human
ggcaaaaacagcaaugacuuuu

SEQ ID NO: 801238 - RNA, 20 nt, Human
auaaaauaacugccacaaga

SEQ ID NO: 801239 - RNA, 22 nt, Human
aaauguauugcauaggauauuu

SEQ ID NO: 801240 - RNA, 21 nt, Human
acaugcauagagagauuucug

SEQ ID NO: 801241 - RNA, 22 nt, Human
agaguggcagcaagucagguag

SEQ ID NO: 801242 - RNA, 22 nt, Human
uuugcaauaguccuggccugua

SEQ ID NO: 801243 - RNA, 22 nt, Human
ccucuuaauuguacuccuucag

SEQ ID NO: 801244 - RNA, 22 nt, Human
cagggagcuggugccagccgac

SEQ ID NO: 801245 - RNA, 22 nt, Human
ucuuuggaugcguuacuuuuac

SEQ ID NO: 801246 - RNA, 22 nt, Human
ccggagagucagagcgcggccc

SEQ ID NO: 801247 - RNA, 22 nt, Human
ucauuuaucauuugugcuguag

SEQ ID NO: 801248 - RNA, 22 nt, Human
uggcugaggucuggggcuucug

SEQ ID NO: 801249 - RNA, 22 nt, Human
gcugccugucccaggaugagga

SEQ ID NO: 801250 - RNA, 22 nt, Human
aggaggcugguucaggccauau

SEQ ID NO: 801251 - RNA, 22 nt, Human
gccugcuggauguggccaggcc

SEQ ID NO: 801252 - RNA, 22 nt, Human
gccucagcucccagcccaggcu

SEQ ID NO: 801253 - RNA, 22 nt, Human
ccagccacagcuuccagcuccu

SEQ ID NO: 801254 - RNA, 22 nt, Human
aaauuagucgguuuaggaauuu

SEQ ID NO: 801255 - RNA, 19 nt, Human
uacuuuuucaggacagagu

SEQ ID NO: 801256 - RNA, 22 nt, Human
uucaugugccagagcugaaaau

SEQ ID NO: 801257 - RNA, 22 nt, Human
ugccagcugacagcagagacaa

SEQ ID NO: 801258 - RNA, 22 nt, Human
auaaauucucugauguauagua

SEQ ID NO: 801259 - RNA, 22 nt, Human
caggcagugucccaggaagcca

SEQ ID NO: 801260 - RNA, 22 nt, Human
gggugggauggcaggagccgcu

SEQ ID NO: 801261 - RNA, 22 nt, Human
gggaggugauuaggaccaugua

SEQ ID NO: 801262 - RNA, 22 nt, Human
acagaggccccgugggagagcc

SEQ ID NO: 801263 - RNA, 22 nt, Human
gauucaagaccuagcucagcca

SEQ ID NO: 801264 - RNA, 22 nt, Human
agcaggcuuuccacagaaggag

SEQ ID NO: 801265 - RNA, 22 nt, Human
aggucugaguauggccugagaa

SEQ ID NO: 801266 - RNA, 22 nt, Human
uuguauuuuguuaugcuacugc

SEQ ID NO: 801267 - RNA, 22 nt, Human
ccugcugggacgugugguugcc

SEQ ID NO: 801268 - RNA, 22 nt, Human
cuguggcuaggaagcuguggga

SEQ ID NO: 801269 - RNA, 22 nt, Human
guguucauggaugucaauuuga

SEQ ID NO: 801270 - RNA, 22 nt, Human
gcagugggcaacaagagcugga

SEQ ID NO: 801271 - RNA, 22 nt, Human
ucacagaaagcuguguccugac

SEQ ID NO: 801272 - RNA, 22 nt, Human
cucuugguaagacauuagaggu

SEQ ID NO: 801273 - RNA, 22 nt, Human
ccuugucuugcacagaugcagc

SEQ ID NO: 801274 - RNA, 22 nt, Human
aaaggcaugugggcugguugua

SEQ ID NO: 801275 - RNA, 22 nt, Human
accucccuugcuaaagacugug

SEQ ID NO: 801276 - RNA, 22 nt, Human
ugccuggcucuaucaguggugg

SEQ ID NO: 801277 - RNA, 22 nt, Human
caguguuuagaucaagaaggcc

SEQ ID NO: 801278 - RNA, 20 nt, Human
ccugcuguuuccauggggcc

SEQ ID NO: 801279 - RNA, 22 nt, Human
aagugcuuggauugcagguaug

SEQ ID NO: 801280 - RNA, 22 nt, Human
agagaggcauucggugauccca

SEQ ID NO: 801281 - RNA, 22 nt, Human
cagcucugguuccugggcccag

SEQ ID NO: 801282 - RNA, 18 nt, Human
ucaggcugcccugugucu

SEQ ID NO: 801283 - RNA, 22 nt, Human
cagcccuggcuagggcgagggc

SEQ ID NO: 801284 - RNA, 22 nt, Human
auggguggagggugacacggau

SEQ ID NO: 801285 - RNA, 22 nt, Human
gauuuauuuuuaaucagcaggg

SEQ ID NO: 801286 - RNA, 22 nt, Human
ucacaguauucaugaacaugga

SEQ ID NO: 801287 - RNA, 22 nt, Human
agggaaauggagaguguaguuu

SEQ ID NO: 801288 - RNA, 22 nt, Human
acagggagccccagcauuucca

SEQ ID NO: 801289 - RNA, 22 nt, Human
gcccaggcuggagugcaguagc

SEQ ID NO: 801290 - RNA, 22 nt, Human
gaggagccaagguauguguguu

SEQ ID NO: 801291 - RNA, 22 nt, Human
aucauaagacccagccaguauu

SEQ ID NO: 801292 - RNA, 22 nt, Human
uccugucuuaaugaucucgugc

SEQ ID NO: 801293 - RNA, 22 nt, Human
aaauucuuucauggcuaauaag

SEQ ID NO: 801294 - RNA, 22 nt, Human
ccaggcucaggccugcucguug

SEQ ID NO: 801295 - RNA, 22 nt, Human
gacuuaaguggugugauaagug

SEQ ID NO: 801296 - RNA, 22 nt, Human
acugugaacggacugaagccca

SEQ ID NO: 801297 - RNA, 21 nt, Human
uguuucaugcuauuuucuugu

SEQ ID NO: 801298 - RNA, 22 nt, Human
ucaggacaguucccugcaaauu

SEQ ID NO: 801299 - RNA, 22 nt, Human
uuucugaagauacagcuuugcu

SEQ ID NO: 801300 - RNA, 22 nt, Human
cugagccaugggucuaagcacu

SEQ ID NO: 801301 - RNA, 22 nt, Human
caggcagggagcuggaaaggau

SEQ ID NO: 801302 - RNA, 22 nt, Human
cugguucaauacuaaacuucuu

SEQ ID NO: 801303 - RNA, 22 nt, Human
ugauauuuuaugagcuuucaua

SEQ ID NO: 801304 - RNA, 22 nt, Human
agcuggcaguugcgauaaugca

SEQ ID NO: 801305 - RNA, 22 nt, Human
gccucugcugacaagauggaca

SEQ ID NO: 801306 - RNA, 22 nt, Human
ugacaggauaguaggaagaucu

SEQ ID NO: 801307 - RNA, 22 nt, Human
aauaacagagucuucaagauag

SEQ ID NO: 801308 - RNA, 22 nt, Human
agcauauaaauggacauauuug

SEQ ID NO: 801309 - RNA, 22 nt, Human
cuucuucaaccugaaaguuuca

SEQ ID NO: 801310 - RNA, 22 nt, Human
auugucauuccagucauuguua

SEQ ID NO: 801311 - RNA, 22 nt, Human
auugagaauccauuugagauga

SEQ ID NO: 801312 - RNA, 22 nt, Human
aguauuuucgccaucacaagaa

SEQ ID NO: 801313 - RNA, 22 nt, Human
aaaaguuaccucuguaauauaa

SEQ ID NO: 801314 - RNA, 20 nt, Human
cacagaacaaauugcaggac

SEQ ID NO: 801315 - RNA, 22 nt, Human
uggggaaaggaaaguuaaccug

SEQ ID NO: 801316 - RNA, 22 nt, Human
ucuccugucuucucagcacccc

SEQ ID NO: 801317 - RNA, 22 nt, Human
cucucagaaguuuaugucagaa

SEQ ID NO: 801318 - RNA, 20 nt, Human
agcuggcccacagguguggg

SEQ ID NO: 801319 - RNA, 22 nt, Human
uuucucauggacccuucaugau

SEQ ID NO: 801320 - RNA, 22 nt, Human
ucuucagaggaagucagucuuu

SEQ ID NO: 801321 - RNA, 22 nt, Human
cauaaaagccaccuauuuaaag

SEQ ID NO: 801322 - RNA, 22 nt, Human
agggucccgaaggagacagcaa

SEQ ID NO: 801323 - RNA, 22 nt, Human
cuuagaugaagucacagaaccc

SEQ ID NO: 801324 - RNA, 22 nt, Human
ucccaggaugugcgugccgccg

SEQ ID NO: 801325 - RNA, 22 nt, Human
uucagugugaagcuucugaaag

SEQ ID NO: 801326 - RNA, 22 nt, Human
agaaaauuuauucauguuaguu

SEQ ID NO: 801327 - RNA, 22 nt, Human
ugcagcugggucugcccuggcu

SEQ ID NO: 801328 - RNA, 22 nt, Human
gguccuggcagcucugugucca

SEQ ID NO: 801329 - RNA, 22 nt, Human
uuucccuuguuccuuccucuga

SEQ ID NO: 801330 - RNA, 22 nt, Human
uuauuuaaugugaucugaagag

SEQ ID NO: 801331 - RNA, 22 nt, Human
uuuuuaagcuccuuugauguca

SEQ ID NO: 801332 - RNA, 22 nt, Human
cucaaacugugcuuguaaauuc

SEQ ID NO: 801333 - RNA, 22 nt, Human
gcccagaguggccacuuggcuc

SEQ ID NO: 801334 - RNA, 22 nt, Human
ugcuauuucuaucucauuuaaa

SEQ ID NO: 801335 - RNA, 22 nt, Human
uuuacuucugcauuuccccuag

SEQ ID NO: 801336 - RNA, 22 nt, Human
gagcaggaaggccagaaggguc

SEQ ID NO: 801337 - RNA, 22 nt, Human
uucaaaaugcacaaagggcuag

SEQ ID NO: 801338 - RNA, 22 nt, Human
gcacccaguuugucucaggguu

SEQ ID NO: 801339 - RNA, 22 nt, Human
aacaagaacaccuacaguucua

SEQ ID NO: 801340 - RNA, 22 nt, Human
cucuucagauauacaguacucu

SEQ ID NO: 801341 - RNA, 22 nt, Human
uggcugggggugcuauagcugc

SEQ ID NO: 801342 - RNA, 22 nt, Human
ucacaagauggcugcugcagcc

SEQ ID NO: 801343 - RNA, 22 nt, Human
aagcagaaaaacugagcuccaa

SEQ ID NO: 801344 - RNA, 22 nt, Human
gggauaggagauugggaguguu

SEQ ID NO: 801345 - RNA, 22 nt, Human
auuaauauacacuguuagcaug

SEQ ID NO: 801346 - RNA, 22 nt, Human
uuacagagcuggguggagagag

SEQ ID NO: 801347 - RNA, 22 nt, Human
uuucucuguucucuaacuguaa

SEQ ID NO: 801348 - RNA, 22 nt, Human
gagccacagugguggcccacgu

SEQ ID NO: 801349 - RNA, 22 nt, Human
uuuacugaccuccaaucccacu

SEQ ID NO: 801350 - RNA, 22 nt, Human
uuauugcugcuaacauuuuaug

SEQ ID NO: 801351 - RNA, 20 nt, Human
cugggucacuuggcugcucu

SEQ ID NO: 801352 - RNA, 22 nt, Human
uacuuuggggacaauauggaau

SEQ ID NO: 801353 - RNA, 22 nt, Human
ugucccuggacuccaggagcca

SEQ ID NO: 801354 - RNA, 22 nt, Human
gagcagcucugugccuggagac

SEQ ID NO: 801355 - RNA, 22 nt, Human
uucauucagguguauuuauggg

SEQ ID NO: 801356 - RNA, 20 nt, Human
uggagguggucugcuguccu

SEQ ID NO: 801357 - RNA, 22 nt, Human
ucucaaauggacaauauugugg

SEQ ID NO: 801358 - RNA, 22 nt, Human
ucagcaggcaggaggcaugcca

SEQ ID NO: 801359 - RNA, 22 nt, Human
uugguuuucucagcuggaccau

SEQ ID NO: 801360 - RNA, 22 nt, Human
ggagaaagcuguaguggaaugu

SEQ ID NO: 801361 - RNA, 20 nt, Human
aaauguauaggacccuucua

SEQ ID NO: 801362 - RNA, 18 nt, Human
acagacaaaauggaaaug

SEQ ID NO: 801363 - RNA, 22 nt, Human
aggcuccaggcaaaauuucgga

SEQ ID NO: 801364 - RNA, 22 nt, Human
cagcuucuuugggauucuuuau

SEQ ID NO: 801365 - RNA, 22 nt, Human
ucccaagugucuuggaccaggg

SEQ ID NO: 801366 - RNA, 22 nt, Human
gcugcaggcucugcaggaauug

SEQ ID NO: 801367 - RNA, 22 nt, Human
uucuauaagacucauauuucuu

SEQ ID NO: 801368 - RNA, 22 nt, Human
aaaucaugguggaagaaacaga

SEQ ID NO: 801369 - RNA, 21 nt, Human
ucagaggcacugagagcaaug

SEQ ID NO: 801370 - RNA, 22 nt, Human
gucuuuggaggcacuguugagu

SEQ ID NO: 801371 - RNA, 22 nt, Human
gcagggaagaucuuggagcugc

SEQ ID NO: 801372 - RNA, 22 nt, Human
agggucccgucccucugcaccc

SEQ ID NO: 801373 - RNA, 22 nt, Human
cuggcagcuuagcacucugguu

SEQ ID NO: 801374 - RNA, 22 nt, Human
uagggcagaguccaggaugggc

SEQ ID NO: 801375 - RNA, 22 nt, Human
gagggaaaauaaaauugcagua

SEQ ID NO: 801376 - RNA, 21 nt, Human
aauaaaacaguuggugucaau

SEQ ID NO: 801377 - RNA, 22 nt, Human
aagcaaauauuucuagagacug

SEQ ID NO: 801378 - RNA, 22 nt, Human
ccagagcccgggaccuggacuu

SEQ ID NO: 801379 - RNA, 21 nt, Human
cccagagccuagggagggcac

SEQ ID NO: 801380 - RNA, 22 nt, Human
cuggcugggagcgagcugcuca

SEQ ID NO: 801381 - RNA, 22 nt, Human
ucauguguccuaguucauauaa

SEQ ID NO: 801382 - RNA, 22 nt, Human
uggcaaggccacaggugcaguu

SEQ ID NO: 801383 - RNA, 22 nt, Human
cuggcugucuucugggagcugu

SEQ ID NO: 801384 - RNA, 22 nt, Human
gcccuagcgccagcucagcacc

SEQ ID NO: 801385 - RNA, 22 nt, Human
aauaguuguaguaucuaucucg

SEQ ID NO: 801386 - RNA, 22 nt, Human
aaagaaauaccuuucucagcuu

SEQ ID NO: 801387 - RNA, 22 nt, Human
cccaggacccuucaauggcucc

SEQ ID NO: 801388 - RNA, 22 nt, Human
uuuuccaaauuagaaguagaga

SEQ ID NO: 801389 - RNA, 22 nt, Human
uuguucuauggugaggcagcca

SEQ ID NO: 801390 - RNA, 22 nt, Human
gggugguguauuagagcugcag

SEQ ID NO: 801391 - RNA, 22 nt, Human
ugggagaagcauggggugcaga

SEQ ID NO: 801392 - RNA, 23 nt, Human
ugggucacuguuucaccauugcu

SEQ ID NO: 801393 - RNA, 22 nt, Human
cuggguguucacccgaggcgcu

SEQ ID NO: 801394 - RNA, 21 nt, Human
ccaaagaacugccauuuguca

SEQ ID NO: 801395 - RNA, 22 nt, Human
agcugucugucuccugaggaga

SEQ ID NO: 801396 - RNA, 22 nt, Human
cagaggccaguggacaagggcc

SEQ ID NO: 801397 - RNA, 22 nt, Human
agcacuccugucuuuccccuuu

SEQ ID NO: 801398 - RNA, 22 nt, Human
ugcaaagaugaaauauuaaagg

SEQ ID NO: 801399 - RNA, 22 nt, Human
aaauaagaggacagauguuugg

SEQ ID NO: 801400 - RNA, 22 nt, Human
ggcuccugggcagcugcucccu

SEQ ID NO: 801401 - RNA, 22 nt, Human
gagcuuugccuaaaacuagaau

SEQ ID NO: 801402 - RNA, 22 nt, Human
acugccuguagcccugagaugu

SEQ ID NO: 801403 - RNA, 22 nt, Human
acuggcagguccaucgcccuuu

SEQ ID NO: 801404 - RNA, 22 nt, Human
ggagagcugaagcauggacagg

SEQ ID NO: 801405 - RNA, 22 nt, Human
ugagcagcaggaucuucuggua

SEQ ID NO: 801406 - RNA, 22 nt, Human
caagaaguugacagccagguga

SEQ ID NO: 801407 - RNA, 22 nt, Human
gaagaagacauggaacaauagu

SEQ ID NO: 801408 - RNA, 22 nt, Human
gcacacccucucaccagcacug

SEQ ID NO: 801409 - RNA, 22 nt, Human
uagggugguuagaaggaguaug

SEQ ID NO: 801410 - RNA, 22 nt, Human
ugagccagauaagggcucacgc

SEQ ID NO: 801411 - RNA, 22 nt, Human
ccucuccaguuuuaacgugacc

SEQ ID NO: 801412 - RNA, 22 nt, Human
uaagucaucccauaacagugcu

SEQ ID NO: 801413 - RNA, 22 nt, Human
aaauacauuagacggagaguua

SEQ ID NO: 801414 - RNA, 22 nt, Human
agcagcacccagagccaugucu

SEQ ID NO: 801415 - RNA, 22 nt, Human
agucaggaagcuggagcugggg

SEQ ID NO: 801416 - RNA, 22 nt, Human
cugccaggccuccgcugucccc

SEQ ID NO: 801417 - RNA, 22 nt, Human
cuuguguggucuggucuugcua

SEQ ID NO: 801418 - RNA, 22 nt, Human
ugagccagguuaagacaggagc

SEQ ID NO: 801419 - RNA, 22 nt, Human
uaaaucacaaauuuucucauuu

SEQ ID NO: 801420 - RNA, 22 nt, Human
ucagagcuuuggagaccaggaa

SEQ ID NO: 801421 - RNA, 22 nt, Human
uacaauguaauucugauuaugu

SEQ ID NO: 801422 - RNA, 22 nt, Human
gcugugcagccaagugccucug

SEQ ID NO: 801423 - RNA, 22 nt, Human
ccuaggcccucaaagagcauaa

SEQ ID NO: 801424 - RNA, 19 nt, Human
ccauauaaccagcaagugu

SEQ ID NO: 801425 - RNA, 22 nt, Human
cugcagcauccuagggucugug

SEQ ID NO: 801426 - RNA, 22 nt, Human
uagaggaaccaggcaggcugag

SEQ ID NO: 801427 - RNA, 22 nt, Human
gcccaagguauaucagagacag

SEQ ID NO: 801428 - RNA, 21 nt, Human
gcccucaggggaggauggccu

SEQ ID NO: 801429 - RNA, 22 nt, Human
ugcaccacccgugggaggacug

SEQ ID NO: 801430 - RNA, 22 nt, Human
ggguccagaaugagaaugggcu

SEQ ID NO: 801431 - RNA, 22 nt, Human
gcaaacauaauaugaagacacu

SEQ ID NO: 801432 - RNA, 22 nt, Human
uccuuaaagugcaccuccucau

SEQ ID NO: 801433 - RNA, 22 nt, Human
agccacaugagugagccaucuu

SEQ ID NO: 801434 - RNA, 22 nt, Human
uuuucccaucuacaaagcaggg

SEQ ID NO: 801435 - RNA, 22 nt, Human
uacaugcacaugaacaugugug

SEQ ID NO: 801436 - RNA, 22 nt, Human
cagugagauaccacagagcaaa

SEQ ID NO: 801437 - RNA, 22 nt, Human
ggcacugggcaccggcugaggg

SEQ ID NO: 801438 - RNA, 22 nt, Human
ucaggacagccagggugcagac

SEQ ID NO: 801439 - RNA, 22 nt, Human
uauuacaagaaagggcaugaau

SEQ ID NO: 801440 - RNA, 22 nt, Human
ggcaggcaggagcgugcuuggg

SEQ ID NO: 801441 - RNA, 22 nt, Human
gcaggcuuugacuuggggcaac

SEQ ID NO: 801442 - RNA, 22 nt, Human
ucacaggacagccuuccacccg

SEQ ID NO: 801443 - RNA, 22 nt, Human
ugcaaucucggcacuuugggag

SEQ ID NO: 801444 - RNA, 22 nt, Human
guacauuuuacuuuguuugaau

SEQ ID NO: 801445 - RNA, 22 nt, Human
ugagguguguccccagggaggu

SEQ ID NO: 801446 - RNA, 22 nt, Human
gcccagcaaggaccaagggccg

SEQ ID NO: 801447 - RNA, 22 nt, Human
aggcagaucaguacaggguuaa

SEQ ID NO: 801448 - RNA, 22 nt, Human
ccaggguguagggauuccagau

SEQ ID NO: 801449 - RNA, 22 nt, Human
ccagggccucguguucugagug

SEQ ID NO: 801450 - RNA, 22 nt, Human
ugcacccauagcacacacuccu

SEQ ID NO: 801451 - RNA, 22 nt, Human
acuuguuucaacuguacucuca

SEQ ID NO: 801452 - RNA, 22 nt, Human
acagagaaagugggcugaagau

SEQ ID NO: 801453 - RNA, 22 nt, Human
agauaaaaugguucaaaggcua

SEQ ID NO: 801454 - RNA, 22 nt, Human
caguuucucucauacauauuug

SEQ ID NO: 801455 - RNA, 22 nt, Human
ugggagaaagaacccugaguga

SEQ ID NO: 801456 - RNA, 22 nt, Human
gcugggagaggcccugaaguga

SEQ ID NO: 801457 - RNA, 21 nt, Human
acccaggggaagcagaaacug

SEQ ID NO: 801458 - RNA, 22 nt, Human
ugggagccuggcaggccagagg

SEQ ID NO: 801459 - RNA, 22 nt, Human
uacaugcuccuuaugagaaucu

SEQ ID NO: 801460 - RNA, 22 nt, Human
guggcccaggcacccugaugac

SEQ ID NO: 801461 - RNA, 22 nt, Human
cagugaggcucugcugagcggu

SEQ ID NO: 801462 - RNA, 22 nt, Human
ucacaggcccaaaccacgcuua

SEQ ID NO: 801463 - RNA, 22 nt, Human
acauuugugcaacguauccaca

SEQ ID NO: 801464 - RNA, 22 nt, Human
ucuggcugauucccugggacug

SEQ ID NO: 801465 - RNA, 18 nt, Human
gaucaggaucaaucaccc

SEQ ID NO: 801466 - RNA, 22 nt, Human
ggcccugcucaggcugcgauga

SEQ ID NO: 801467 - RNA, 20 nt, Human
ugcccagcaagagugcaguu

SEQ ID NO: 801468 - RNA, 19 nt, Human
cucuggagcagacacugga

SEQ ID NO: 801469 - RNA, 22 nt, Human
gucagaggaauggaugagugau

SEQ ID NO: 801470 - RNA, 22 nt, Human
cacugggucaggauagagccca

SEQ ID NO: 801471 - RNA, 22 nt, Human
uuauggaaaauacaauuauaag

SEQ ID NO: 801472 - RNA, 22 nt, Human
aaugaaauaguuggcuguagag

SEQ ID NO: 801473 - RNA, 22 nt, Human
uggucucucuccugcaacaacu

SEQ ID NO: 801474 - RNA, 22 nt, Human
ccuggagcaaaaaucuaaggag

SEQ ID NO: 801475 - RNA, 22 nt, Human
ccagaaguggcuuucucaggga

SEQ ID NO: 801476 - RNA, 22 nt, Human
uuucaucuuccuuggcauaggu

SEQ ID NO: 801477 - RNA, 22 nt, Human
acagagcauuugggacagagag

SEQ ID NO: 801478 - RNA, 16 nt, Human
uggagguguuucuagu

SEQ ID NO: 801479 - RNA, 22 nt, Human
agaaacaacuuguuucucuugc

SEQ ID NO: 801480 - RNA, 22 nt, Human
ugucauggcacugguaggagug

SEQ ID NO: 801481 - RNA, 22 nt, Human
uuggcuucauugaucucacuuu

SEQ ID NO: 801482 - RNA, 22 nt, Human
ccccagggaagcuuugcuuacu

SEQ ID NO: 801483 - RNA, 22 nt, Human
agccaggggauucaucagggac

SEQ ID NO: 801484 - RNA, 22 nt, Human
acacauauaugucgaaguccuc

SEQ ID NO: 801485 - RNA, 22 nt, Human
ugugaggaguaggcugagggug

SEQ ID NO: 801486 - RNA, 22 nt, Human
aagggcagcuuaaauugguagc

SEQ ID NO: 801487 - RNA, 22 nt, Human
ggcucucuccuuggcuuucaga

SEQ ID NO: 801488 - RNA, 22 nt, Human
uuugcaugggagguaguaauca

SEQ ID NO: 801489 - RNA, 22 nt, Human
ucacauauuuaagaaaguuaaa

SEQ ID NO: 801490 - RNA, 22 nt, Human
uacuuucuuucccaagaggugg

SEQ ID NO: 801491 - RNA, 22 nt, Human
caggccugacccugagcuucac

SEQ ID NO: 801492 - RNA, 22 nt, Human
gcucagggcgcgagggacgugg

SEQ ID NO: 801493 - RNA, 22 nt, Human
ucucauucauacccuacaugcu

SEQ ID NO: 801494 - RNA, 22 nt, Human
gagugucacaggguaauuguuu

SEQ ID NO: 801495 - RNA, 22 nt, Human
acacagaagcuuuuucuauucc

SEQ ID NO: 801496 - RNA, 22 nt, Human
auuugugggacuauaaugcagg

SEQ ID NO: 801497 - RNA, 22 nt, Human
aauguauaaaguguuaauaacu

SEQ ID NO: 801498 - RNA, 22 nt, Human
gagcuuuggggaagaauacaga

SEQ ID NO: 801499 - RNA, 20 nt, Human
uggcacagaacccuugccua

SEQ ID NO: 801500 - RNA, 22 nt, Human
acacaguucaggaucaaauagc

SEQ ID NO: 801501 - RNA, 22 nt, Human
ugucauggaggccuccccuaaa

SEQ ID NO: 801502 - RNA, 22 nt, Human
uacuuuuugucucuuugaaugu

SEQ ID NO: 801503 - RNA, 22 nt, Human
aaggccuggauuuagguuguga

SEQ ID NO: 801504 - RNA, 22 nt, Human
agccagagaguguuggagaugu

SEQ ID NO: 801505 - RNA, 22 nt, Human
cagcuguccaaacacauuaacu

SEQ ID NO: 801506 - RNA, 22 nt, Human
uuauugagaccguaagucaggu

SEQ ID NO: 801507 - RNA, 22 nt, Human
ucaaaguagaguucagugcagc

SEQ ID NO: 801508 - RNA, 20 nt, Human
auuauucauacaugugugac

SEQ ID NO: 801509 - RNA, 21 nt, Human
ucagaagugcagcccaggaau

SEQ ID NO: 801510 - RNA, 22 nt, Human
agggaacagugaaaggcaucag

SEQ ID NO: 801511 - RNA, 22 nt, Human
acaauagaaggaaacugacaua

SEQ ID NO: 801512 - RNA, 22 nt, Human
guggaguggccuggcccugaga

SEQ ID NO: 801513 - RNA, 22 nt, Human
accaggcaugauguggagcaca

SEQ ID NO: 801514 - RNA, 22 nt, Human
aaacaaguguaaacuagucugu

SEQ ID NO: 801515 - RNA, 22 nt, Human
aagaauuuaaacuaaccauaug

SEQ ID NO: 801516 - RNA, 22 nt, Human
ucucagaguuccucuggagucc

SEQ ID NO: 801517 - RNA, 22 nt, Human
gcuggagcugcagccugggccu

SEQ ID NO: 801518 - RNA, 22 nt, Human
uuggaggcaaugggaaggaggc

SEQ ID NO: 801519 - RNA, 22 nt, Human
acauguuugccugcaggcuuag

SEQ ID NO: 801520 - RNA, 22 nt, Human
ugcugccuugaccuccugggcu

SEQ ID NO: 801521 - RNA, 22 nt, Human
aagcuuugcaaugcuucauuau

SEQ ID NO: 801522 - RNA, 22 nt, Human
ucuuggaaguagaacacagucu

SEQ ID NO: 801523 - RNA, 22 nt, Human
gaggaggccaguggaaggaagc

SEQ ID NO: 801524 - RNA, 22 nt, Human
auguucccaagggauagaaaga

SEQ ID NO: 801525 - RNA, 22 nt, Human
augaggaggccaguaagagccu

SEQ ID NO: 801526 - RNA, 22 nt, Human
ugccaccaggagaaccagugca

SEQ ID NO: 801527 - RNA, 23 nt, Human
gccucugcagccuaguuaguguc

SEQ ID NO: 801528 - RNA, 22 nt, Human
uauuugcaacauaaaacucuga

SEQ ID NO: 801529 - RNA, 22 nt, Human
gagcuuugucuccuggagaccc

SEQ ID NO: 801530 - RNA, 22 nt, Human
gcagccucugcaguucaggagg

SEQ ID NO: 801531 - RNA, 22 nt, Human
ccaggaagaaacagucuuuaua

SEQ ID NO: 801532 - RNA, 19 nt, Human
aaaaacuuaguccagaaag

SEQ ID NO: 801533 - RNA, 22 nt, Human
ugucuuuggaauauuuagcuga

SEQ ID NO: 801534 - RNA, 22 nt, Human
aaggcagaaagggaugugagug

SEQ ID NO: 801535 - RNA, 22 nt, Human
cauggcugaggcagaggacuga

SEQ ID NO: 801536 - RNA, 23 nt, Human
aucuccugagaacccacaguggu

SEQ ID NO: 801537 - RNA, 22 nt, Human
uacuuugaauuaaauauuucag

SEQ ID NO: 801538 - RNA, 22 nt, Human
ucuggaaauaaaauuauaguug

SEQ ID NO: 801539 - RNA, 22 nt, Human
caaagugcuggaauuacaggug

SEQ ID NO: 801540 - RNA, 22 nt, Human
aggccggcgcuucccaggaggc

SEQ ID NO: 801541 - RNA, 22 nt, Human
acaggcugacuuccugccaugu

SEQ ID NO: 801542 - RNA, 22 nt, Human
aggcagcuggcagcacccaggg

SEQ ID NO: 801543 - RNA, 22 nt, Human
aacaauaacuagacaugccaug

SEQ ID NO: 801544 - RNA, 18 nt, Human
gcucagcuaugggagguu

SEQ ID NO: 801545 - RNA, 22 nt, Human
uccuggccgccgcguggggccg

SEQ ID NO: 801546 - RNA, 19 nt, Human
gaagaagcuugagaaguag

SEQ ID NO: 801547 - RNA, 22 nt, Human
cagcagcauugcucuggauucc

SEQ ID NO: 801548 - RNA, 22 nt, Human
uugcaaauuaaagaggauagca

SEQ ID NO: 801549 - RNA, 22 nt, Human
uuaauaaaguaugaauuggaaa

SEQ ID NO: 801550 - RNA, 22 nt, Human
ucugcccacugcucugcugccc

SEQ ID NO: 801551 - RNA, 22 nt, Human
caaagcucaugcucuuagccau

SEQ ID NO: 801552 - RNA, 22 nt, Human
uaaaucacuccuaauaaucagu

SEQ ID NO: 801553 - RNA, 23 nt, Human
ugccuccaccgagggccaggcau

SEQ ID NO: 801554 - RNA, 22 nt, Human
acuccaggauguagaaucagag

SEQ ID NO: 801555 - RNA, 22 nt, Human
acauguuuaaguuuaaugaaaa

SEQ ID NO: 801556 - RNA, 22 nt, Human
uggugccauuagcccugcuguu

SEQ ID NO: 801557 - RNA, 22 nt, Human
acagcugcuguggagguuuuca

SEQ ID NO: 801558 - RNA, 21 nt, Human
gaggaaaugcucugguguuca

SEQ ID NO: 801559 - RNA, 22 nt, Human
ugcacacacaugcagagggaga

SEQ ID NO: 801560 - RNA, 22 nt, Human
gaggaaggagggaaagcgcgcg

SEQ ID NO: 801561 - RNA, 22 nt, Human
cagagucaguauugaauugaaa

SEQ ID NO: 801562 - RNA, 22 nt, Human
uuacugauggaacagagauaga

SEQ ID NO: 801563 - RNA, 22 nt, Human
ggacagaggguugacagaguau

SEQ ID NO: 801564 - RNA, 22 nt, Human
aaaggucuucucaaacauccca

SEQ ID NO: 801565 - RNA, 22 nt, Human
cugcugucucacuggugugguu

SEQ ID NO: 801566 - RNA, 22 nt, Human
gcugggaugcgucuucccaggc

SEQ ID NO: 801567 - RNA, 22 nt, Human
ccuccugguugcaaugaaaugg

SEQ ID NO: 801568 - RNA, 22 nt, Human
ucucccaagccuggcaggggca

SEQ ID NO: 801569 - RNA, 23 nt, Human
agagggagauguuuuucucaaga

SEQ ID NO: 801570 - RNA, 22 nt, Human
ucccuuaaccguaggacagucu

SEQ ID NO: 801571 - RNA, 22 nt, Human
uuucacauuggcuucuauuucu

SEQ ID NO: 801572 - RNA, 22 nt, Human
ucaaauugucaucuugauaaug

SEQ ID NO: 801573 - RNA, 22 nt, Human
uuuacacaaaagauagcacacc

SEQ ID NO: 801574 - RNA, 22 nt, Human
uacaguaaccagucuacuuaga

SEQ ID NO: 801575 - RNA, 21 nt, Human
cuuguuuugaaaggacuggcc

SEQ ID NO: 801576 - RNA, 22 nt, Human
ggcuggcacagagggcuggugu

SEQ ID NO: 801577 - RNA, 22 nt, Human
ggcagcagaacuggcccuguau

SEQ ID NO: 801578 - RNA, 22 nt, Human
ugguccugggcacaguauaugc

SEQ ID NO: 801579 - RNA, 23 nt, Human
gaauucuuaaggucacuaaaguc

SEQ ID NO: 801580 - RNA, 22 nt, Human
aaugaauggguuuaauauuuua

SEQ ID NO: 801581 - RNA, 22 nt, Human
ucagugucacaggaugcuaugc

SEQ ID NO: 801582 - RNA, 22 nt, Human
gcagagcugagcggcugcccgg

SEQ ID NO: 801583 - RNA, 22 nt, Human
gcacacagaacauuuggauccu

SEQ ID NO: 801584 - RNA, 22 nt, Human
gucccucaguagugcacagugg

SEQ ID NO: 801585 - RNA, 22 nt, Human
acaggcagcacuaaucucuggu

SEQ ID NO: 801586 - RNA, 21 nt, Human
aaggagccuaggaggcucagg

SEQ ID NO: 801587 - RNA, 23 nt, Human
uuaugcaagcuuccuggucucag

SEQ ID NO: 801588 - RNA, 22 nt, Human
caguccugugucccuugguggg

SEQ ID NO: 801589 - RNA, 21 nt, Human
aguuuacaacuguccagcccc

SEQ ID NO: 801590 - RNA, 22 nt, Human
uugcauguguaagguuguuuau

SEQ ID NO: 801591 - RNA, 22 nt, Human
cagcccagugcacgcccguuuc

SEQ ID NO: 801592 - RNA, 22 nt, Human
uuggcccagggucagcggcgcu

SEQ ID NO: 801593 - RNA, 22 nt, Human
cuguuuauggagguaaggcauc

SEQ ID NO: 801594 - RNA, 22 nt, Human
gacagcagaugaagccugcaga

SEQ ID NO: 801595 - RNA, 22 nt, Human
uuaauuacuaagcacaaugcaa

SEQ ID NO: 801596 - RNA, 22 nt, Human
ccaaagugcugggguuacaggc

SEQ ID NO: 801597 - RNA, 22 nt, Human
gcucugagaggugcagcaguaa

SEQ ID NO: 801598 - RNA, 22 nt, Human
cucaguguuaaagacuuuccag

SEQ ID NO: 801599 - RNA, 22 nt, Human
uuaguggagaguuauuaucagc

SEQ ID NO: 801600 - RNA, 22 nt, Human
uuguacaaguauuaugugaaca

SEQ ID NO: 801601 - RNA, 22 nt, Human
aacauuucagcaccugauuccu

SEQ ID NO: 801602 - RNA, 22 nt, Human
gcugccuccaaucugugccccg

SEQ ID NO: 801603 - RNA, 22 nt, Human
ucuuuggcugccugaagcccaa

SEQ ID NO: 801604 - RNA, 22 nt, Human
uaaacaagcugucugauauucu

SEQ ID NO: 801605 - RNA, 22 nt, Human
ucauuucuguugugcaucacug

SEQ ID NO: 801606 - RNA, 22 nt, Human
cccagagcugagggggcacguu

SEQ ID NO: 801607 - RNA, 22 nt, Human
gcccugcccugagccguagacc

SEQ ID NO: 801608 - RNA, 22 nt, Human
aaauaguccugggaauaguacu

SEQ ID NO: 801609 - RNA, 19 nt, Human
accuuuccuuucucagaug

SEQ ID NO: 801610 - RNA, 22 nt, Human
aagacauucacaaauguucacu

SEQ ID NO: 801611 - RNA, 22 nt, Human
uuaaaagaauccuguuauccuc

SEQ ID NO: 801612 - RNA, 22 nt, Human
cucuggcuuguuaaugcauauu

SEQ ID NO: 801613 - RNA, 22 nt, Human
aaugcuuucuuauaaccacugc

SEQ ID NO: 801614 - RNA, 22 nt, Human
acuacaguacuauaucuauagg

SEQ ID NO: 801615 - RNA, 20 nt, Human
agccugccagcuggcccaga

SEQ ID NO: 801616 - RNA, 22 nt, Human
uaaggcagugaaacuauucugu

SEQ ID NO: 801617 - RNA, 22 nt, Human
acugcacuccagcccgagcaac

SEQ ID NO: 801618 - RNA, 19 nt, Human
uggcuuggcugcagaugcu

SEQ ID NO: 801619 - RNA, 17 nt, Human
aguguuuccuuaucauu

SEQ ID NO: 801620 - RNA, 22 nt, Human
aucauucuaguccuuauggucu

SEQ ID NO: 801621 - RNA, 22 nt, Human
aucuuacacgauaacuguuagu

SEQ ID NO: 801622 - RNA, 22 nt, Human
aauaauacuucguaaaguuguu

SEQ ID NO: 801623 - RNA, 22 nt, Human
uugguucauuuucucaucuaga

SEQ ID NO: 801624 - RNA, 22 nt, Human
aggcaaaagaaugucauaaaug

SEQ ID NO: 801625 - RNA, 22 nt, Human
caggcacagcugggcaauugcg

SEQ ID NO: 801626 - RNA, 22 nt, Human
agcuagagcugagaagcacuug

SEQ ID NO: 801627 - RNA, 22 nt, Human
agaguccacccuggggucaggc

SEQ ID NO: 801628 - RNA, 22 nt, Human
uagcuuugccacacauguagau

SEQ ID NO: 801629 - RNA, 22 nt, Human
uguuuacuuaugugggucacau

SEQ ID NO: 801630 - RNA, 22 nt, Human
cagggagaaaucuccaggaggu

SEQ ID NO: 801631 - RNA, 22 nt, Human
uucuucuucuggcugcaccugg

SEQ ID NO: 801632 - RNA, 22 nt, Human
ccuguuuaccacugaggggcag

SEQ ID NO: 801633 - RNA, 22 nt, Human
auggaagaguccccauggauga

SEQ ID NO: 801634 - RNA, 22 nt, Human
cagcaaagguagaagcacagga

SEQ ID NO: 801635 - RNA, 22 nt, Human
gaauucuaaccauuaagccaag

SEQ ID NO: 801636 - RNA, 22 nt, Human
cucagcucuuuauacuagcugu

SEQ ID NO: 801637 - RNA, 22 nt, Human
acaugcaaagccacaggacccg

SEQ ID NO: 801638 - RNA, 22 nt, Human
uucagggacuuugauguaucag

SEQ ID NO: 801639 - RNA, 22 nt, Human
auauguuucaguauucaaguca

SEQ ID NO: 801640 - RNA, 22 nt, Human
gagggccaaagagcaagagccu

SEQ ID NO: 801641 - RNA, 22 nt, Human
caugugcauuggggccagggag

SEQ ID NO: 801642 - RNA, 19 nt, Human
agcauggccuacagugugc

SEQ ID NO: 801643 - RNA, 21 nt, Human
guugugguuggggcugcagcu

SEQ ID NO: 801644 - RNA, 22 nt, Human
aaugcuuauuauuaauagaaug

SEQ ID NO: 801645 - RNA, 22 nt, Human
agcucuuugcuggcaguaggcu

SEQ ID NO: 801646 - RNA, 22 nt, Human
ugccugguauuugaauaaagag

SEQ ID NO: 801647 - RNA, 21 nt, Human
gccucaccaugucaagccagg

SEQ ID NO: 801648 - RNA, 22 nt, Human
ggugguggagccagcugggagu

SEQ ID NO: 801649 - RNA, 22 nt, Human
cugaggcucugggugucacugu

SEQ ID NO: 801650 - RNA, 21 nt, Human
ugaggcuguuguaccagggag

SEQ ID NO: 801651 - RNA, 22 nt, Human
gccagcugaagcccugguggaa

SEQ ID NO: 801652 - RNA, 22 nt, Human
caaauguuaagacaggaucaag

SEQ ID NO: 801653 - RNA, 22 nt, Human
uccaggccuaggccaagugauu

SEQ ID NO: 801654 - RNA, 22 nt, Human
ugggccucaccuucuuggcagc

SEQ ID NO: 801655 - RNA, 22 nt, Human
agacugaauaggaaagagggaa

SEQ ID NO: 801656 - RNA, 22 nt, Human
aagguuuccagugauauugugg

SEQ ID NO: 801657 - RNA, 22 nt, Human
cuuucucaaugccggaaggcac

SEQ ID NO: 801658 - RNA, 22 nt, Human
aaugucugccagaacugaucau

SEQ ID NO: 801659 - RNA, 22 nt, Human
ggucagaaggauucugggaaau

SEQ ID NO: 801660 - RNA, 22 nt, Human
auggagugguacuuacuuggcu

SEQ ID NO: 801661 - RNA, 22 nt, Human
auacauuccuacugacuagcua

SEQ ID NO: 801662 - RNA, 19 nt, Human
gcaggcaguggcauucgga

SEQ ID NO: 801663 - RNA, 21 nt, Human
acuuggccaggcccccaccug

SEQ ID NO: 801664 - RNA, 22 nt, Human
acagggcaugugcaagagacau

SEQ ID NO: 801665 - RNA, 22 nt, Human
ucauuuauagcuaaccuugaau

SEQ ID NO: 801666 - RNA, 22 nt, Human
gucauaaaaggaccaccuauug

SEQ ID NO: 801667 - RNA, 22 nt, Human
ugauaaauccauguaaauggua

SEQ ID NO: 801668 - RNA, 22 nt, Human
cagcuucagcgugacaccagug

SEQ ID NO: 801669 - RNA, 22 nt, Human
aggagccaagaugcugucuggc

SEQ ID NO: 801670 - RNA, 21 nt, Human
uccacccucucugcucccagu

SEQ ID NO: 801671 - RNA, 22 nt, Human
uaggggaauugcagugugucca

SEQ ID NO: 801672 - RNA, 22 nt, Human
gggaagcugcguggucuagggc

SEQ ID NO: 801673 - RNA, 22 nt, Human
ggcucaagcagucugccugccu

SEQ ID NO: 801674 - RNA, 22 nt, Human
aaaugcugcagcuaguguguuu

SEQ ID NO: 801675 - RNA, 22 nt, Human
cuggcccauugccuucucucuc

SEQ ID NO: 801676 - RNA, 20 nt, Human
uaggacaggcagccgagggg

SEQ ID NO: 801677 - RNA, 21 nt, Human
uucauugaacuauuuguggag

SEQ ID NO: 801678 - RNA, 22 nt, Human
uuuuuuccaacuuaagacuuca

SEQ ID NO: 801679 - RNA, 22 nt, Human
uaaguucaguuggucgaaguag

SEQ ID NO: 801680 - RNA, 22 nt, Human
agucucucuccucgugguaacc

SEQ ID NO: 801681 - RNA, 22 nt, Human
aggugcuguuugucagcaguuu

SEQ ID NO: 801682 - RNA, 22 nt, Human
ucagcagggagaggagaaugca

SEQ ID NO: 801683 - RNA, 22 nt, Human
uccucagauauaaaugagggug

SEQ ID NO: 801684 - RNA, 22 nt, Human
uacuuauugguucagaaguuua

SEQ ID NO: 801685 - RNA, 22 nt, Human
aaauuguaaugacuucacuuga

SEQ ID NO: 801686 - RNA, 22 nt, Human
uuuuccucugagcuuugaauaa

SEQ ID NO: 801687 - RNA, 22 nt, Human
uggggcuucuccuguaggcuca

SEQ ID NO: 801688 - RNA, 22 nt, Human
ccuccaaguuugacucaggaca

SEQ ID NO: 801689 - RNA, 22 nt, Human
agccuggcggucgucggucagg

SEQ ID NO: 801690 - RNA, 22 nt, Human
uggcuugcuucuucugcugucg

SEQ ID NO: 801691 - RNA, 22 nt, Human
ggcugccuuuagaacggaugcu

SEQ ID NO: 801692 - RNA, 22 nt, Human
gagaaauagauucaugguagau

SEQ ID NO: 801693 - RNA, 22 nt, Human
aaguaaaagcaggugugcuggg

SEQ ID NO: 801694 - RNA, 16 nt, Human
ucccaggccaggugga

SEQ ID NO: 801695 - RNA, 22 nt, Human
aaagaaugucugaacagcuggc

SEQ ID NO: 801696 - RNA, 22 nt, Human
cccaggcagugugugcaugcgu

SEQ ID NO: 801697 - RNA, 19 nt, Human
cuggaauguggcuggugca

SEQ ID NO: 801698 - RNA, 22 nt, Human
cuaggcuguaaccccugccagg

SEQ ID NO: 801699 - RNA, 22 nt, Human
cagucuuugaugcauccuagcc

SEQ ID NO: 801700 - RNA, 20 nt, Human
acaaaauagguacuggguag

SEQ ID NO: 801701 - RNA, 22 nt, Human
ggcuucucucccccagcuccac

SEQ ID NO: 801702 - RNA, 22 nt, Human
aggcugaggagggauguugcuu

SEQ ID NO: 801703 - RNA, 20 nt, Human
agaggccaguuaggagucua

SEQ ID NO: 801704 - RNA, 22 nt, Human
acuccugggugcauuucugauu

SEQ ID NO: 801705 - RNA, 19 nt, Human
ugcacacagauaaguaucu

SEQ ID NO: 801706 - RNA, 22 nt, Human
uucagaauguacugauagaaca

SEQ ID NO: 801707 - RNA, 22 nt, Human
ugcaaauguguagguuuacaua

SEQ ID NO: 801708 - RNA, 22 nt, Human
agggagcagggcuccuuugggu

SEQ ID NO: 801709 - RNA, 17 nt, Human
ccagggaggggccgcgc

SEQ ID NO: 801710 - RNA, 22 nt, Human
aaggacaggagaaaacgggauc

SEQ ID NO: 801711 - RNA, 19 nt, Human
ccacuuugcuucucugggu

SEQ ID NO: 801712 - RNA, 22 nt, Human
ucaaaauucuagggagaauggu

SEQ ID NO: 801713 - RNA, 22 nt, Human
aacuucauggguucaaagcugg

SEQ ID NO: 801714 - RNA, 22 nt, Human
aggacagcccuugagagcacau

SEQ ID NO: 801715 - RNA, 22 nt, Human
aauguuuugcauuaguuuucua

SEQ ID NO: 801716 - RNA, 22 nt, Human
aaguuugagaagcuuauagaua

SEQ ID NO: 801717 - RNA, 22 nt, Human
ucccagccugacagugcaucaa

SEQ ID NO: 801718 - RNA, 22 nt, Human
uuuacagacaacuuaauagggg

SEQ ID NO: 801719 - RNA, 20 nt, Human
gcauggcauguagugaagug

SEQ ID NO: 801720 - RNA, 22 nt, Human
ccccuuccuuccucagacagcc

SEQ ID NO: 801721 - RNA, 22 nt, Human
uggcccagggcacagcagggag

SEQ ID NO: 801722 - RNA, 22 nt, Human
uccacaggcugaggcccuucug

SEQ ID NO: 801723 - RNA, 17 nt, Human
ucuuucccugggagaug

SEQ ID NO: 801724 - RNA, 22 nt, Human
cuuucauuugauaagaaugcca

SEQ ID NO: 801725 - RNA, 22 nt, Human
ucacagagaacuauaauccauc

SEQ ID NO: 801726 - RNA, 22 nt, Human
ugguuccaguuuucaauagagc

SEQ ID NO: 801727 - RNA, 22 nt, Human
acacauaagccuaaucaucucc

SEQ ID NO: 801728 - RNA, 20 nt, Human
agcuccugguauaggugccu

SEQ ID NO: 801729 - RNA, 22 nt, Human
cuauuugaauugucacaggcua

SEQ ID NO: 801730 - RNA, 22 nt, Human
ggaagggcggauaguauaaguu

SEQ ID NO: 801731 - RNA, 22 nt, Human
uucauuugugugccugaugcaa

SEQ ID NO: 801732 - RNA, 22 nt, Human
agcuggaugaauuuggaacacu

SEQ ID NO: 801733 - RNA, 22 nt, Human
gcaggcaccgcggcggcagguu

SEQ ID NO: 801734 - RNA, 22 nt, Human
uuucauugucaucuaucuuaga

SEQ ID NO: 801735 - RNA, 22 nt, Human
cccugcugaugccuugauuuug

SEQ ID NO: 801736 - RNA, 22 nt, Human
ucucuucuuguguuuuccugcc

SEQ ID NO: 801737 - RNA, 22 nt, Human
ucauugaguucaaauccuucau

SEQ ID NO: 801738 - RNA, 22 nt, Human
uggcucagcauucacuggucuu

SEQ ID NO: 801739 - RNA, 22 nt, Human
cuacauuuugugauuaugaaau

SEQ ID NO: 801740 - RNA, 22 nt, Human
agguaagguuuggaggcagugg

SEQ ID NO: 801741 - RNA, 22 nt, Human
caggaaggcgcggcugugccug

SEQ ID NO: 801742 - RNA, 16 nt, Human
agcagggcgggaagga

SEQ ID NO: 801743 - RNA, 22 nt, Human
caguuuaaccuauccauuaugu

SEQ ID NO: 801744 - RNA, 22 nt, Human
aaacaguauuaucaauauauuu

SEQ ID NO: 801745 - RNA, 22 nt, Human
accaguuuguaaccuguuuuca

SEQ ID NO: 801746 - RNA, 22 nt, Human
cucugggugagacagaccuggu

SEQ ID NO: 801747 - RNA, 22 nt, Human
ucuuagauguuagcucugugug

SEQ ID NO: 801748 - RNA, 22 nt, Human
aggaagccaagccugacacuca

SEQ ID NO: 801749 - RNA, 22 nt, Human
uagauacauuuuucuuuccugu

SEQ ID NO: 801750 - RNA, 22 nt, Human
gaaggcuugcagcucuguggca

SEQ ID NO: 801751 - RNA, 22 nt, Human
aaucuacauagagaucaaauga

SEQ ID NO: 801752 - RNA, 22 nt, Human
ucaggcagagggagaagccaag

SEQ ID NO: 801753 - RNA, 22 nt, Human
cuggccaggcucucacgugguc

SEQ ID NO: 801754 - RNA, 22 nt, Human
uagauuaagaugccaguuuuga

SEQ ID NO: 801755 - RNA, 22 nt, Human
agaccccauaccucagcaggua

SEQ ID NO: 801756 - RNA, 22 nt, Human
cacaucauguuaauucauuaca

SEQ ID NO: 801757 - RNA, 22 nt, Human
gcacugcuccagguguggcuug

SEQ ID NO: 801758 - RNA, 22 nt, Human
uuucuacaugucaguaacugau

SEQ ID NO: 801759 - RNA, 22 nt, Human
ccucagaguaggucucagcugu

SEQ ID NO: 801760 - RNA, 22 nt, Human
cuggagcuaauaauccaucuga

SEQ ID NO: 801761 - RNA, 22 nt, Human
cccacagaaugccaaugagacc

SEQ ID NO: 801762 - RNA, 22 nt, Human
cagccucuugcacuuugaaggc

SEQ ID NO: 801763 - RNA, 22 nt, Human
cagaggccuuucuacagugaua

SEQ ID NO: 801764 - RNA, 22 nt, Human
ggccccagcagacccuccucug

SEQ ID NO: 801765 - RNA, 22 nt, Human
uuucaacuuguuugcuuccaua

SEQ ID NO: 801766 - RNA, 22 nt, Human
ggcccucuguggcugccaugga

SEQ ID NO: 801767 - RNA, 22 nt, Human
agacaauggagagcagaguacu

SEQ ID NO: 801768 - RNA, 23 nt, Human
auuauuaaggacauggacuuugu

SEQ ID NO: 801769 - RNA, 22 nt, Human
caucauuuuauuaaccaagaaa

SEQ ID NO: 801770 - RNA, 22 nt, Human
auauaauaguuucauaaaggcu

SEQ ID NO: 801771 - RNA, 22 nt, Human
ccucccucccucuuaugguuua

SEQ ID NO: 801772 - RNA, 22 nt, Human
cugguucaucgcggccacuuau

SEQ ID NO: 801773 - RNA, 22 nt, Human
cccagcagugacccagugauac

SEQ ID NO: 801774 - RNA, 22 nt, Human
ugcccagccuaaacuuggcaag

SEQ ID NO: 801775 - RNA, 22 nt, Human
ccugaggacacacgcugcagga

SEQ ID NO: 801776 - RNA, 22 nt, Human
agaggccaucugcucugugggg

SEQ ID NO: 801777 - RNA, 22 nt, Human
agcuuucuucuaguuguacagu

SEQ ID NO: 801778 - RNA, 22 nt, Human
uuuuccucuguauuugaaaugc

SEQ ID NO: 801779 - RNA, 22 nt, Human
aagagggcugcaaucuuauugc

SEQ ID NO: 801780 - RNA, 22 nt, Human
cuggcuggucaugucaugagcc

SEQ ID NO: 801781 - RNA, 22 nt, Human
gacaauuagaucauuccuuuga

SEQ ID NO: 801782 - RNA, 22 nt, Human
uagcuuuacaaagugcugcacc

SEQ ID NO: 801783 - RNA, 22 nt, Human
cccauucauccucgcuuccuuc

SEQ ID NO: 801784 - RNA, 22 nt, Human
uuucuuuaucauagcaucuuug

SEQ ID NO: 801785 - RNA, 22 nt, Human
acagaacugggaaaugcacaua

SEQ ID NO: 801786 - RNA, 22 nt, Human
agcaacagcaacgacauuucuc

SEQ ID NO: 801787 - RNA, 22 nt, Human
ucaaauaguugacauuaacuug

SEQ ID NO: 801788 - RNA, 22 nt, Human
auuuuuccauucucuguuagua

SEQ ID NO: 801789 - RNA, 22 nt, Human
uaugaauauaccacaauuuagg

SEQ ID NO: 801790 - RNA, 22 nt, Human
uugguucaaagggauucaauuu

SEQ ID NO: 801791 - RNA, 22 nt, Human
uaaauuuacccaaggaacaugu

SEQ ID NO: 801792 - RNA, 22 nt, Human
ugggggugaaagucuggacagu

SEQ ID NO: 801793 - RNA, 22 nt, Human
acauucuuauaagagugaggca

SEQ ID NO: 801794 - RNA, 22 nt, Human
uaguggauggguaaaguauuuu

SEQ ID NO: 801795 - RNA, 22 nt, Human
caggaggaggugagguagaacu

SEQ ID NO: 801796 - RNA, 22 nt, Human
cagagccaggucuaggagucuc

SEQ ID NO: 801797 - RNA, 22 nt, Human
aauuaaaagauaacccaugagu

SEQ ID NO: 801798 - RNA, 22 nt, Human
acugcuagugagaaaauaacca

SEQ ID NO: 801799 - RNA, 22 nt, Human
uuuuuacagucauggucacuca

SEQ ID NO: 801800 - RNA, 22 nt, Human
gcucaaagcauaagacaucuaa

SEQ ID NO: 801801 - RNA, 22 nt, Human
agcugcuguuucuugcacguau

SEQ ID NO: 801802 - RNA, 22 nt, Human
aucugacaaccuauugacuuga

SEQ ID NO: 801803 - RNA, 22 nt, Human
caauguuuucaacugacaagua

SEQ ID NO: 801804 - RNA, 22 nt, Human
ccuucuccugccuuggguucau

SEQ ID NO: 801805 - RNA, 22 nt, Human
cagggaugggauggagucaguu

SEQ ID NO: 801806 - RNA, 23 nt, Human
acugcuuuauucaugaggcucuc

SEQ ID NO: 801807 - RNA, 23 nt, Human
agcuucaucuugcugugucucag

SEQ ID NO: 801808 - RNA, 22 nt, Human
agcaggugguaggcagucagca

SEQ ID NO: 801809 - RNA, 22 nt, Human
accaagcuguauauuauugguu

SEQ ID NO: 801810 - RNA, 22 nt, Human
gaggaggcuguuucucugcauu

SEQ ID NO: 801811 - RNA, 22 nt, Human
uagggaggaggguuuucaaauc

SEQ ID NO: 801812 - RNA, 22 nt, Human
aauaaaaugaacugguagaguu

SEQ ID NO: 801813 - RNA, 22 nt, Human
acugcagcccccuauuaggacu

SEQ ID NO: 801814 - RNA, 22 nt, Human
cugagggauguggauuuugguc

SEQ ID NO: 801815 - RNA, 22 nt, Human
aaugacaguguugggccagaug

SEQ ID NO: 801816 - RNA, 22 nt, Human
ucacaggaagaggugucuaucu

SEQ ID NO: 801817 - RNA, 22 nt, Human
cucagacuggagccccaaggac

SEQ ID NO: 801818 - RNA, 22 nt, Human
acacuaaaugagucuacaguac

SEQ ID NO: 801819 - RNA, 22 nt, Human
cagggucauggcaccugcacgg

SEQ ID NO: 801820 - RNA, 22 nt, Human
gcagugauaacuuuacucuuuu

SEQ ID NO: 801821 - RNA, 22 nt, Human
acaaaguagucaaaguagauga

SEQ ID NO: 801822 - RNA, 22 nt, Human
agcugccuccuggugccccauc

SEQ ID NO: 801823 - RNA, 22 nt, Human
uccugucugcucacagagcugg

SEQ ID NO: 801824 - RNA, 22 nt, Human
uuucacauggacuuuuuguucu

SEQ ID NO: 801825 - RNA, 22 nt, Human
gugcagaggacguggcggccuc

SEQ ID NO: 801826 - RNA, 22 nt, Human
uuaagugagcuugaauaaucuu

SEQ ID NO: 801827 - RNA, 22 nt, Human
gcuccaaaguacagugacuuac

SEQ ID NO: 801828 - RNA, 22 nt, Human
uuuguacacaggucauucaggg

SEQ ID NO: 801829 - RNA, 22 nt, Human
uuacaaacaacagacauuuauu

SEQ ID NO: 801830 - RNA, 22 nt, Human
uucacaaaaugguuuguugaug

SEQ ID NO: 801831 - RNA, 22 nt, Human
augcuuucuucuuuccuguaag

SEQ ID NO: 801832 - RNA, 22 nt, Human
cagcagaaguccgacuccaguc

SEQ ID NO: 801833 - RNA, 22 nt, Human
cuguuuauacgacagguggagg

SEQ ID NO: 801834 - RNA, 22 nt, Human
agccuaggggguccugggccac

SEQ ID NO: 801835 - RNA, 22 nt, Human
uggggaagggcacccuggagac

SEQ ID NO: 801836 - RNA, 22 nt, Human
uuguuuuuagagaagcccugaa

SEQ ID NO: 801837 - RNA, 23 nt, Human
acuuccaguuauaggaacucuuc

SEQ ID NO: 801838 - RNA, 23 nt, Human
cugaggggaaaagggcuucaggc

SEQ ID NO: 801839 - RNA, 21 nt, Human
aggauggaaaggacuaggggu

SEQ ID NO: 801840 - RNA, 22 nt, Human
gccugaggaauugaggggguaa

SEQ ID NO: 801841 - RNA, 22 nt, Human
ucauuuugccugccauuugagu

SEQ ID NO: 801842 - RNA, 19 nt, Human
ucaaaacacaaaugguuga

SEQ ID NO: 801843 - RNA, 22 nt, Human
caggccagggagaauaugaagc

SEQ ID NO: 801844 - RNA, 22 nt, Human
agcugcuguuuggugagucuug

SEQ ID NO: 801845 - RNA, 19 nt, Human
aacuggauaauggccacau

SEQ ID NO: 801846 - RNA, 22 nt, Human
acauaaauagauuauugggagg

SEQ ID NO: 801847 - RNA, 22 nt, Human
gcccagcacuaaaagcuuugcu

SEQ ID NO: 801848 - RNA, 22 nt, Human
guucuuaaagauucaucaagca

SEQ ID NO: 801849 - RNA, 22 nt, Human
ucucaagaucucaagauggccc

SEQ ID NO: 801850 - RNA, 22 nt, Human
cacaggcuuccaguccccagcu

SEQ ID NO: 801851 - RNA, 22 nt, Human
uuuuuacacuuagcauugagcg

SEQ ID NO: 801852 - RNA, 22 nt, Human
aagcgcagacacagagagugga

SEQ ID NO: 801853 - RNA, 20 nt, Human
caggcaguuugugguuaggg

SEQ ID NO: 801854 - RNA, 18 nt, Human
cucaguguuugcugaaaa

SEQ ID NO: 801855 - RNA, 20 nt, Human
ugacaucuguugaggaggaa

SEQ ID NO: 801856 - RNA, 22 nt, Human
gcaggcagagaaggaacauuua

SEQ ID NO: 801857 - RNA, 22 nt, Human
ggagaaggaauauuggaguagg

SEQ ID NO: 801858 - RNA, 22 nt, Human
uggcaaggcugugggggcagag

SEQ ID NO: 801859 - RNA, 22 nt, Human
uugguucacauuagauuuccuu

SEQ ID NO: 801860 - RNA, 22 nt, Human
agccccaguccgcugcgggcgg

SEQ ID NO: 801861 - RNA, 22 nt, Human
cuugggugcucagggaaagcuu

SEQ ID NO: 801862 - RNA, 22 nt, Human
ggcagagguagcuggaaccagg

SEQ ID NO: 801863 - RNA, 22 nt, Human
aagccaguauucaauggggcua

SEQ ID NO: 801864 - RNA, 22 nt, Human
ggcugccuugacccuggcuccg

SEQ ID NO: 801865 - RNA, 22 nt, Human
uaauauacuucccauaguuuga

SEQ ID NO: 801866 - RNA, 22 nt, Human
auacacuuccaaauauugauua

SEQ ID NO: 801867 - RNA, 21 nt, Human
aggagcuguguuagcuggucg

SEQ ID NO: 801868 - RNA, 18 nt, Human
gcagggacacagggucac

SEQ ID NO: 801869 - RNA, 22 nt, Human
uggugccaucauagcucacugc

SEQ ID NO: 801870 - RNA, 22 nt, Human
aagcuggcaauuaucaaaacug

SEQ ID NO: 801871 - RNA, 22 nt, Human
ucuccugguuuguuaaauaauu

SEQ ID NO: 801872 - RNA, 21 nt, Human
ucuugaaaaguuagauucucu

SEQ ID NO: 801873 - RNA, 22 nt, Human
uaucauucuaauucuccucgua

SEQ ID NO: 801874 - RNA, 19 nt, Human
acuggcaguuucugcaugg

SEQ ID NO: 801875 - RNA, 19 nt, Human
uaugacaaguacuaguucu

SEQ ID NO: 801876 - RNA, 22 nt, Human
cagggacauugguggccagguu

SEQ ID NO: 801877 - RNA, 17 nt, Human
ccugagugggagaggaa

SEQ ID NO: 801878 - RNA, 22 nt, Human
cuuauggccugcccacaguagu

SEQ ID NO: 801879 - RNA, 22 nt, Human
aaugccaacuuggauauacauu

SEQ ID NO: 801880 - RNA, 22 nt, Human
uucuuuggggaauauucugguu

SEQ ID NO: 801881 - RNA, 22 nt, Human
cuggucugcgggaaggcguggg

SEQ ID NO: 801882 - RNA, 21 nt, Human
ucaggaaacaccucuuaagga

SEQ ID NO: 801883 - RNA, 22 nt, Human
agagaaauuucccugccuucug

SEQ ID NO: 801884 - RNA, 22 nt, Human
ucagggaaaggggagagucauu

SEQ ID NO: 801885 - RNA, 22 nt, Human
aaaguucuaaaacucuuuguga

SEQ ID NO: 801886 - RNA, 22 nt, Human
aguggcaaugggaguggagaca

SEQ ID NO: 801887 - RNA, 20 nt, Human
ucaagaugaggucauacugg

SEQ ID NO: 801888 - RNA, 22 nt, Human
ugcugaggagguggcugugcuu

SEQ ID NO: 801889 - RNA, 22 nt, Human
aagcaguguucccagcuggccc

SEQ ID NO: 801890 - RNA, 22 nt, Human
cagucccaaggaggaagcaguc

SEQ ID NO: 801891 - RNA, 22 nt, Human
gcaguccuccugccucagccuc

SEQ ID NO: 801892 - RNA, 19 nt, Human
ccuggcccugcugcgcggg

SEQ ID NO: 801893 - RNA, 22 nt, Human
guguguacaaauuucauguaaa

SEQ ID NO: 801894 - RNA, 22 nt, Human
agcugagccagcagcaacagga

SEQ ID NO: 801895 - RNA, 22 nt, Human
aaaaaaucagaucuuugguuaa

SEQ ID NO: 801896 - RNA, 22 nt, Human
uccccaccuacacacugcuccu

SEQ ID NO: 801897 - RNA, 22 nt, Human
uggucccauuguucugcccagg

SEQ ID NO: 801898 - RNA, 22 nt, Human
auguguuaguuugugauuauac

SEQ ID NO: 801899 - RNA, 19 nt, Human
ucucccagcugagaagggc

SEQ ID NO: 801900 - RNA, 22 nt, Human
cugcagagcuaggcugagugaa

SEQ ID NO: 801901 - RNA, 22 nt, Human
ucaggaagucucaauuagcuac

SEQ ID NO: 801902 - RNA, 22 nt, Human
gcccauggaaaaccuguccucu

SEQ ID NO: 801903 - RNA, 22 nt, Human
ucuuuggaucccaacuggcugg

SEQ ID NO: 801904 - RNA, 22 nt, Human
agcuggcauuacaggagcaugc

SEQ ID NO: 801905 - RNA, 22 nt, Human
aacauucuacuguacugcauug

SEQ ID NO: 801906 - RNA, 19 nt, Human
aggcuuggauuguggccaa

SEQ ID NO: 801907 - RNA, 20 nt, Human
ucaaaauaggugugggcgga

SEQ ID NO: 801908 - RNA, 22 nt, Human
caggcuggaguacaauugugug

SEQ ID NO: 801909 - RNA, 22 nt, Human
aguccuguaucugagcugaguc

SEQ ID NO: 801910 - RNA, 22 nt, Human
ucaggcugcuguacugugaaug

SEQ ID NO: 801911 - RNA, 22 nt, Human
agcugcccccagggcugugcuu

SEQ ID NO: 801912 - RNA, 22 nt, Human
ugggccugauuuaucaucuuca

SEQ ID NO: 801913 - RNA, 22 nt, Human
aggaaagcaauggcugagaaca

SEQ ID NO: 801914 - RNA, 22 nt, Human
uuauuuagucuagaugaauuuu

SEQ ID NO: 801915 - RNA, 20 nt, Human
uucuccaaaggagacacuag

SEQ ID NO: 801916 - RNA, 22 nt, Human
gaugcaaaaguaucauuuuaau

SEQ ID NO: 801917 - RNA, 22 nt, Human
ccugggcuuugcuggcaaggcc

SEQ ID NO: 801918 - RNA, 22 nt, Human
uucuacaaauauuuacuguucc

SEQ ID NO: 801919 - RNA, 22 nt, Human
acacauuuucaacacugucaag

SEQ ID NO: 801920 - RNA, 22 nt, Human
cacagaacauuuuuagaugcag

SEQ ID NO: 801921 - RNA, 19 nt, Human
uuugaauauaaugcagcua

SEQ ID NO: 801922 - RNA, 22 nt, Human
auugagaaugcaaucuacuaug

SEQ ID NO: 801923 - RNA, 22 nt, Human
gcucugagcccccagaagcaga

SEQ ID NO: 801924 - RNA, 22 nt, Human
ucaggcugauuucuuuugaggg

SEQ ID NO: 801925 - RNA, 22 nt, Human
accaugcaucaguuaaaaggag

SEQ ID NO: 801926 - RNA, 22 nt, Human
gcacaaggguggucucuggagc

SEQ ID NO: 801927 - RNA, 21 nt, Human
ugcuggccaugugcugggcau

SEQ ID NO: 801928 - RNA, 22 nt, Human
aaaauauguauaacucuucugc

SEQ ID NO: 801929 - RNA, 22 nt, Human
gucccagggaugcagacaugag

SEQ ID NO: 801930 - RNA, 22 nt, Human
gacagccaucagcacacgcugc

SEQ ID NO: 801931 - RNA, 22 nt, Human
cugccuccaggcucaccuugac

SEQ ID NO: 801932 - RNA, 19 nt, Human
cugcucccuccuucuggca

SEQ ID NO: 801933 - RNA, 22 nt, Human
aagggcagcuauuaucgucauc

SEQ ID NO: 801934 - RNA, 22 nt, Human
cacaggaagcaagccuggggcc

SEQ ID NO: 801935 - RNA, 23 nt, Human
uauuuuccaaaugaugacuacau

SEQ ID NO: 801936 - RNA, 22 nt, Human
aggcagagaaaaaccagauaug

SEQ ID NO: 801937 - RNA, 22 nt, Human
agccuccaucucccaucuguga

SEQ ID NO: 801938 - RNA, 22 nt, Human
ucagaaguugauaaaguaguug

SEQ ID NO: 801939 - RNA, 22 nt, Human
gucuccagaauucuugggaggg

SEQ ID NO: 801940 - RNA, 22 nt, Human
cugggggcaauggucagagugu

SEQ ID NO: 801941 - RNA, 22 nt, Human
uccauuauacuucugauucaaa

SEQ ID NO: 801942 - RNA, 22 nt, Human
agugagggacuccaugacuccu

SEQ ID NO: 801943 - RNA, 22 nt, Human
uauuucugagaaccaacuuacc

SEQ ID NO: 801944 - RNA, 18 nt, Human
aaacagugccuaaguguc

SEQ ID NO: 801945 - RNA, 18 nt, Human
augcaagcuauggauuug

SEQ ID NO: 801946 - RNA, 19 nt, Human
cuuuuucaccuucuagaag

SEQ ID NO: 801947 - RNA, 22 nt, Human
auguauguaguguacauauaca

SEQ ID NO: 801948 - RNA, 18 nt, Human
uugcuucuuuucucuagg

SEQ ID NO: 801949 - RNA, 22 nt, Human
caucaggauaaguuccaggugg

SEQ ID NO: 801950 - RNA, 22 nt, Human
agcagcucauggaguaggcacu

SEQ ID NO: 801951 - RNA, 22 nt, Human
cuccacucaccagaugccagga

SEQ ID NO: 801952 - RNA, 22 nt, Human
ucagaggaaaggucagauggcu

SEQ ID NO: 801953 - RNA, 22 nt, Human
gaauaucccgcuaugcaaagua

SEQ ID NO: 801954 - RNA, 17 nt, Human
uuccaguuuaguauugu

SEQ ID NO: 801955 - RNA, 22 nt, Human
ugcagccugguggucacuggag

SEQ ID NO: 801956 - RNA, 22 nt, Human
acaaaaagggagaugagguaga

SEQ ID NO: 801957 - RNA, 21 nt, Human
uaacaaucucuacuucucauu

SEQ ID NO: 801958 - RNA, 22 nt, Human
ucuuuagaaacuuuucuucaug

SEQ ID NO: 801959 - RNA, 21 nt, Human
ucugagaacuucugcugcagc

SEQ ID NO: 801960 - RNA, 22 nt, Human
gcagcaggcuuuucauaccuug

SEQ ID NO: 801961 - RNA, 22 nt, Human
ucccagcagaugagcugaccua

SEQ ID NO: 801962 - RNA, 22 nt, Human
ucaaaguaagaauuuauuacaa

SEQ ID NO: 801963 - RNA, 22 nt, Human
aguacaaaugcagccagaguag

SEQ ID NO: 801964 - RNA, 20 nt, Human
uccuggucauguggcugggc

SEQ ID NO: 801965 - RNA, 22 nt, Human
ccucugacuccacacuugaacu

SEQ ID NO: 801966 - RNA, 22 nt, Human
cuggagggcugcagcgaggcug

SEQ ID NO: 801967 - RNA, 22 nt, Human
ccucugcacuucaccuuagcuc

SEQ ID NO: 801968 - RNA, 20 nt, Human
aagcccauuaccaugcuugg

SEQ ID NO: 801969 - RNA, 22 nt, Human
caggcaccccaggugagcacug

SEQ ID NO: 801970 - RNA, 22 nt, Human
acauuaaugaggugaugacaca

SEQ ID NO: 801971 - RNA, 22 nt, Human
ugcauuaagguaauuguauaau

SEQ ID NO: 801972 - RNA, 22 nt, Human
ugagggaguguggauacaguag

SEQ ID NO: 801973 - RNA, 22 nt, Human
ugaaaugaagggcuuguucugg

SEQ ID NO: 801974 - RNA, 22 nt, Human
uauucagaaaauaaauuggauu

SEQ ID NO: 801975 - RNA, 22 nt, Human
uaaagacaugguguaggugaac

SEQ ID NO: 801976 - RNA, 22 nt, Human
auggcccaagugcccugaccug

SEQ ID NO: 801977 - RNA, 16 nt, Human
cucuuugggcuuccag

SEQ ID NO: 801978 - RNA, 22 nt, Human
gcugagaaucaagauggagagg

SEQ ID NO: 801979 - RNA, 22 nt, Human
acucccacuccagaguagaagc

SEQ ID NO: 801980 - RNA, 17 nt, Human
caucugcucugccccuu

SEQ ID NO: 801981 - RNA, 22 nt, Human
ucauguuugagacuaauuuuuc

SEQ ID NO: 801982 - RNA, 22 nt, Human
aggccuguuuccuuggguugcu

SEQ ID NO: 801983 - RNA, 21 nt, Human
ugcauaaagaaauacaaauac

SEQ ID NO: 801984 - RNA, 22 nt, Human
aggaaaaucgagucuggaggca

SEQ ID NO: 801985 - RNA, 19 nt, Human
acaugcaaggcaccugcag

SEQ ID NO: 801986 - RNA, 22 nt, Human
auucauagcucaguacagacuc

SEQ ID NO: 801987 - RNA, 21 nt, Human
agaagucaauugaacugaaau

SEQ ID NO: 801988 - RNA, 22 nt, Human
auguucuuugaaauauuuuaga

SEQ ID NO: 801989 - RNA, 22 nt, Human
caggguggcccuguggucucau

SEQ ID NO: 801990 - RNA, 22 nt, Human
ugcuuuaacauaagauaucuuu

SEQ ID NO: 801991 - RNA, 22 nt, Human
gagcuuggcuggaccucacgga

SEQ ID NO: 801992 - RNA, 23 nt, Human
cagaaauaaacugguuuguagau

SEQ ID NO: 801993 - RNA, 22 nt, Human
cccuggaggaagaaacaauggc

SEQ ID NO: 801994 - RNA, 22 nt, Human
ggcagugaaaaaguauguuucc

SEQ ID NO: 801995 - RNA, 22 nt, Human
ggagaagaggagcuggaagccu

SEQ ID NO: 801996 - RNA, 23 nt, Human
gagauuuagcagacaaagcucuu

SEQ ID NO: 801997 - RNA, 22 nt, Human
cugcagcugucucuacugggca

SEQ ID NO: 801998 - RNA, 22 nt, Human
aauaagaacuccauuuacucgu

SEQ ID NO: 801999 - RNA, 22 nt, Human
agcugaguuaauucaucacuua

SEQ ID NO: 802000 - RNA, 22 nt, Human
ccagggaggagcauuucauggu

SEQ ID NO: 802001 - RNA, 22 nt, Human
cugcugucaaaaaucacuccau

SEQ ID NO: 802002 - RNA, 22 nt, Human
uaaaggaaucaguuuuagagau

SEQ ID NO: 802003 - RNA, 22 nt, Human
augucucuuuacucuuagaacc

SEQ ID NO: 802004 - RNA, 22 nt, Human
gccaggagcccugggcaaguuc

SEQ ID NO: 802005 - RNA, 23 nt, Human
uucaugaugauuaaucagcuaca

SEQ ID NO: 802006 - RNA, 22 nt, Human
uucaguguucuuuucuguuagc

SEQ ID NO: 802007 - RNA, 22 nt, Human
augcuuaacucuguacauaguu

SEQ ID NO: 802008 - RNA, 20 nt, Human
cacaggccuugugagcagac

SEQ ID NO: 802009 - RNA, 22 nt, Human
gagggaugcagaaacagaggcc

SEQ ID NO: 802010 - RNA, 22 nt, Human
aaucaacuguuuccacagggag

SEQ ID NO: 802011 - RNA, 23 nt, Human
aauauauguguuuuucugcuuca

SEQ ID NO: 802012 - RNA, 21 nt, Human
caucaacucuugugcucacac

SEQ ID NO: 802013 - RNA, 22 nt, Human
uucuccaaguagaagcuaaguu

SEQ ID NO: 802014 - RNA, 22 nt, Human
ccugcugagacccugagguggg

SEQ ID NO: 802015 - RNA, 22 nt, Human
ucuaaacauugugauagaccuu

SEQ ID NO: 802016 - RNA, 22 nt, Human
uguauuuucugaggagcauuag

SEQ ID NO: 802017 - RNA, 22 nt, Human
ccuggagaccugauggcagcgg

SEQ ID NO: 802018 - RNA, 19 nt, Human
gcaucugcaugaugggguu

SEQ ID NO: 802019 - RNA, 22 nt, Human
gugcaaauacauaugcugugga

SEQ ID NO: 802020 - RNA, 22 nt, Human
uugcagcuguuacugauagaua

SEQ ID NO: 802021 - RNA, 22 nt, Human
cccugcugaaucccauggaguc

SEQ ID NO: 802022 - RNA, 22 nt, Human
uaauaagucuguuguuuaauug

SEQ ID NO: 802023 - RNA, 22 nt, Human
aaacuugacagugagacaguuu

SEQ ID NO: 802024 - RNA, 21 nt, Human
accuucaguguucucagcugc

SEQ ID NO: 802025 - RNA, 22 nt, Human
ucugcacccuucuggguuggaa

SEQ ID NO: 802026 - RNA, 22 nt, Human
agcuguguuaggauguuaauaa

SEQ ID NO: 802027 - RNA, 22 nt, Human
augcuucuccugaacaucccug

SEQ ID NO: 802028 - RNA, 22 nt, Human
cccagucauccugcaggugaaa

SEQ ID NO: 802029 - RNA, 22 nt, Human
uccaaagccgacugacaucuga

SEQ ID NO: 802030 - RNA, 22 nt, Human
caggcaccucacguggguccca

SEQ ID NO: 802031 - RNA, 22 nt, Human
uccucaggugacuagguaucuu

SEQ ID NO: 802032 - RNA, 22 nt, Human
cagcugucuuuucuaaauauua

SEQ ID NO: 802033 - RNA, 22 nt, Human
agcccuccuuuguucaugcugc

SEQ ID NO: 802034 - RNA, 22 nt, Human
ccugugggucacaugggugacu

SEQ ID NO: 802035 - RNA, 22 nt, Human
auacagaagaacuauagccacu

SEQ ID NO: 802036 - RNA, 22 nt, Human
ugcaagggcuuagggggcugug

SEQ ID NO: 802037 - RNA, 22 nt, Human
cucuuaguuuguaaaaauaauu

SEQ ID NO: 802038 - RNA, 22 nt, Human
uucugucuucucgguuguuuac

SEQ ID NO: 802039 - RNA, 19 nt, Human
ucaggaggucgaccuggca

SEQ ID NO: 802040 - RNA, 22 nt, Human
ucauauaccagagaguuuauau

SEQ ID NO: 802041 - RNA, 20 nt, Human
ccacccugcuaagaauacac

SEQ ID NO: 802042 - RNA, 22 nt, Human
agcagcaggguguaauugggca

SEQ ID NO: 802043 - RNA, 22 nt, Human
aaagccaguuucuggaaguacc

SEQ ID NO: 802044 - RNA, 22 nt, Human
auaugacagcggauucacauau

SEQ ID NO: 802045 - RNA, 22 nt, Human
aggccgugugagcaugugugag

SEQ ID NO: 802046 - RNA, 22 nt, Human
acaaauguggacauggauaaug

SEQ ID NO: 802047 - RNA, 22 nt, Human
cagcccaggacugcagguguuu

SEQ ID NO: 802048 - RNA, 20 nt, Human
ggagcuggcauccagccucu

SEQ ID NO: 802049 - RNA, 22 nt, Human
ucagggaguaguuugugcuaug

SEQ ID NO: 802050 - RNA, 22 nt, Human
aggaaggcaugagguguucaca

SEQ ID NO: 802051 - RNA, 20 nt, Human
auugaaauuuuucugagauu

SEQ ID NO: 802052 - RNA, 22 nt, Human
ucuugcugugccccagcagggc

SEQ ID NO: 802053 - RNA, 22 nt, Human
uuuguguggauggaaggcagua

SEQ ID NO: 802054 - RNA, 21 nt, Human
gagugcaggucugaugccauc

SEQ ID NO: 802055 - RNA, 22 nt, Human
uccuggggcugcaaggccuguc

SEQ ID NO: 802056 - RNA, 22 nt, Human
cuggcacaucacuccuaguuua

SEQ ID NO: 802057 - RNA, 21 nt, Human
uuuauuuauauaggacacaug

SEQ ID NO: 802058 - RNA, 22 nt, Human
ucggaaggggccgcgcucggac

SEQ ID NO: 802059 - RNA, 22 nt, Human
uuaaaagagacuuccuuuguuu

SEQ ID NO: 802060 - RNA, 22 nt, Human
gaguuuaugucuuucauuguuc

SEQ ID NO: 802061 - RNA, 22 nt, Human
ugaaugaucuaguuuuguagac

SEQ ID NO: 802062 - RNA, 22 nt, Human
uugaaaugagcaaacugucagc

SEQ ID NO: 802063 - RNA, 22 nt, Human
aucuuuggucuugagugcaucu

SEQ ID NO: 802064 - RNA, 22 nt, Human
ucaaaacaaucauuggaugugc

SEQ ID NO: 802065 - RNA, 22 nt, Human
aauaaaguguauucuuugucau

SEQ ID NO: 802066 - RNA, 22 nt, Human
cugcacccucaaacuccugggc

SEQ ID NO: 802067 - RNA, 22 nt, Human
guguuuuaagaaagaagcucag

SEQ ID NO: 802068 - RNA, 22 nt, Human
uaugagauaaauggugcccccu

SEQ ID NO: 802069 - RNA, 22 nt, Human
agcagggcugugcuccuuccga

SEQ ID NO: 802070 - RNA, 20 nt, Human
agcccaggccugugugaguc

SEQ ID NO: 802071 - RNA, 22 nt, Human
acuccagguuuuuucacugaag

SEQ ID NO: 802072 - RNA, 22 nt, Human
acuagccaaguuuuacgacuaa

SEQ ID NO: 802073 - RNA, 22 nt, Human
uaggaugguacaaggcaggggu

SEQ ID NO: 802074 - RNA, 22 nt, Human
aauagacaauucuagccaacau

SEQ ID NO: 802075 - RNA, 22 nt, Human
uuucagagguaugcugcuuauc

SEQ ID NO: 802076 - RNA, 22 nt, Human
agcugccaccucugccuuuggg

SEQ ID NO: 802077 - RNA, 22 nt, Human
guggugaguucaggcuggggug

SEQ ID NO: 802078 - RNA, 22 nt, Human
cuuucuuucgaagacgugauua

SEQ ID NO: 802079 - RNA, 22 nt, Human
ggcacagggaggcccuggugug

SEQ ID NO: 802080 - RNA, 22 nt, Human
gagauauaagaucuagaaagga

SEQ ID NO: 802081 - RNA, 22 nt, Human
aguagcacaauuuugucccuaa

SEQ ID NO: 802082 - RNA, 22 nt, Human
gggcaagcagugaggacagcac

SEQ ID NO: 802083 - RNA, 22 nt, Human
cacaggagugcugcuauuguug

SEQ ID NO: 802084 - RNA, 22 nt, Human
agaaaacauaggagacaggaaa

SEQ ID NO: 802085 - RNA, 22 nt, Human
uaagagaacuggauagauagga

SEQ ID NO: 802086 - RNA, 22 nt, Human
aaacauugaugggaaguuuaau

SEQ ID NO: 802087 - RNA, 22 nt, Human
agagaaacugauguccuuugaa

SEQ ID NO: 802088 - RNA, 22 nt, Human
ucaagucauuugacuguguguu

SEQ ID NO: 802089 - RNA, 22 nt, Human
agccagcucccuccccugcagg

SEQ ID NO: 802090 - RNA, 22 nt, Human
agcuccuggucuuuguccagag

SEQ ID NO: 802091 - RNA, 22 nt, Human
agaguucucucucauuugagcu

SEQ ID NO: 802092 - RNA, 22 nt, Human
uuuacacauuauuuucagugug

SEQ ID NO: 802093 - RNA, 22 nt, Human
aaggccaggggcuggcgccucc

SEQ ID NO: 802094 - RNA, 22 nt, Human
ccugaggaccagcacccaucug

SEQ ID NO: 802095 - RNA, 19 nt, Human
ugcagaggguaggaaggcc

SEQ ID NO: 802096 - RNA, 19 nt, Human
gcugugggacagcagggug

SEQ ID NO: 802097 - RNA, 22 nt, Human
agugggagccagcagcuugggg

SEQ ID NO: 802098 - RNA, 18 nt, Human
gagucuuuguuacugcug

SEQ ID NO: 802099 - RNA, 22 nt, Human
ccaaggcuucccagagaugcuc

SEQ ID NO: 802100 - RNA, 22 nt, Human
cagccagcugaauguaccauga

SEQ ID NO: 802101 - RNA, 22 nt, Human
gcaggcagguggcaucuuguga

SEQ ID NO: 802102 - RNA, 22 nt, Human
cuggcugggcagacagaaugcu

SEQ ID NO: 802103 - RNA, 22 nt, Human
guuuucaaggggauuuaacuga

SEQ ID NO: 802104 - RNA, 22 nt, Human
uaggcugggaagaaagauucuc

SEQ ID NO: 802105 - RNA, 23 nt, Human
ccuccccaccagacucuaacaua

SEQ ID NO: 802106 - RNA, 20 nt, Human
uuuggcuucaagugcauugc

SEQ ID NO: 802107 - RNA, 22 nt, Human
uucucagggucuggauggccug

SEQ ID NO: 802108 - RNA, 22 nt, Human
auugcacaucugcacuacagcc

SEQ ID NO: 802109 - RNA, 22 nt, Human
uuuucuaaaagaagucacugau

SEQ ID NO: 802110 - RNA, 22 nt, Human
cagaugugcaugaugggaaggg

SEQ ID NO: 802111 - RNA, 22 nt, Human
ccuggcagcuccuccccggcgg

SEQ ID NO: 802112 - RNA, 22 nt, Human
uaauuacuggaaauuucaaaua

SEQ ID NO: 802113 - RNA, 22 nt, Human
gccccaggggaggugcccugca

SEQ ID NO: 802114 - RNA, 22 nt, Human
augucuuucuuauggucuguug

SEQ ID NO: 802115 - RNA, 22 nt, Human
aggugacaucccggcagcagag

SEQ ID NO: 802116 - RNA, 22 nt, Human
gagcaggccuggggugaggccu

SEQ ID NO: 802117 - RNA, 22 nt, Human
uuuguuuacucauucauugaug

SEQ ID NO: 802118 - RNA, 22 nt, Human
acacaggggaaaguggagcuga

SEQ ID NO: 802119 - RNA, 22 nt, Human
auugagaaggagauuggcaucu

SEQ ID NO: 802120 - RNA, 22 nt, Human
aacaagauagauaucacuuagg

SEQ ID NO: 802121 - RNA, 22 nt, Human
aaauauuugucugaggcgguug

SEQ ID NO: 802122 - RNA, 22 nt, Human
aaugcaaacuccacuggagcag

SEQ ID NO: 802123 - RNA, 22 nt, Human
aaacugcaugaagcugauuuua

SEQ ID NO: 802124 - RNA, 22 nt, Human
ugcacaguuggcuacaucgugg

SEQ ID NO: 802125 - RNA, 22 nt, Human
ugcugggggugucucaccaggc

SEQ ID NO: 802126 - RNA, 22 nt, Human
aguuuaauauccuucaacuuuc

SEQ ID NO: 802127 - RNA, 22 nt, Human
gaaacaauuuuuguugucuaag

SEQ ID NO: 802128 - RNA, 22 nt, Human
aggguggaagauggcacuaucu

SEQ ID NO: 802129 - RNA, 22 nt, Human
ccaccuccuaggccuggagaag

SEQ ID NO: 802130 - RNA, 22 nt, Human
gcaaggcuuugugaauuuuaaa

SEQ ID NO: 802131 - RNA, 22 nt, Human
acagaugguacuaaacccauau

SEQ ID NO: 802132 - RNA, 22 nt, Human
ggcagggaggaggugaaaguga

SEQ ID NO: 802133 - RNA, 22 nt, Human
gagcccagcccagagccauaug

SEQ ID NO: 802134 - RNA, 22 nt, Human
ucuccugugcacccucccugug

SEQ ID NO: 802135 - RNA, 22 nt, Human
ugacauuuuuauaagagucaaa

SEQ ID NO: 802136 - RNA, 22 nt, Human
uggagcccacggaugucgcuuu

SEQ ID NO: 802137 - RNA, 22 nt, Human
uggcucaguggcagccgcagcu

SEQ ID NO: 802138 - RNA, 22 nt, Human
augcuuuauacaaaacacuuaa

SEQ ID NO: 802139 - RNA, 22 nt, Human
uucuuuuccuacacagcgauuu

SEQ ID NO: 802140 - RNA, 22 nt, Human
uuggaggggccacugcagagcu

SEQ ID NO: 802141 - RNA, 22 nt, Human
gcagggcuaauggggcaaguag

SEQ ID NO: 802142 - RNA, 22 nt, Human
aggaagagcauucacaugguag

SEQ ID NO: 802143 - RNA, 22 nt, Human
agagagggaauauuugggguau

SEQ ID NO: 802144 - RNA, 22 nt, Human
caggcuguggaucaggagccuu

SEQ ID NO: 802145 - RNA, 22 nt, Human
ucaacuuggcuuuuuaaagucc

SEQ ID NO: 802146 - RNA, 22 nt, Human
ucaaguauaucuagucauuagg

SEQ ID NO: 802147 - RNA, 22 nt, Human
ucauugaggaaagguaguggcu

SEQ ID NO: 802148 - RNA, 21 nt, Human
ucaggcagugcaaauacaugg

SEQ ID NO: 802149 - RNA, 22 nt, Human
agggggcuccuccggugcuucc

SEQ ID NO: 802150 - RNA, 22 nt, Human
auuugcauaaggaugcuacugu

SEQ ID NO: 802151 - RNA, 22 nt, Human
uaguccagccuuggguguagcc

SEQ ID NO: 802152 - RNA, 22 nt, Human
aucaaaucauugcauuaauguu

SEQ ID NO: 802153 - RNA, 22 nt, Human
uagaaacagauguuuuugaaga

SEQ ID NO: 802154 - RNA, 22 nt, Human
acaguucuuaaaacuugaauua

SEQ ID NO: 802155 - RNA, 22 nt, Human
cagcucugcugguggugccagg

SEQ ID NO: 802156 - RNA, 22 nt, Human
aauagauacuacuuagauguag

SEQ ID NO: 802157 - RNA, 22 nt, Human
uggccaugaaggaggcagcaga

SEQ ID NO: 802158 - RNA, 22 nt, Human
gaggcacagagcccuaggagcu

SEQ ID NO: 802159 - RNA, 22 nt, Human
aggcaggaggaucauggaugca

SEQ ID NO: 802160 - RNA, 22 nt, Human
auacuuuagagcuagauugccu

SEQ ID NO: 802161 - RNA, 18 nt, Human
ggcaugugagugcugagg

SEQ ID NO: 802162 - RNA, 22 nt, Human
agcccaggaaguugaggcuugc

SEQ ID NO: 802163 - RNA, 22 nt, Human
gucucuaucauagcugaacccu

SEQ ID NO: 802164 - RNA, 22 nt, Human
ucguuuuaccaaauugaauguu

SEQ ID NO: 802165 - RNA, 22 nt, Human
uauuuauucuuuguacugccuu

SEQ ID NO: 802166 - RNA, 20 nt, Human
acaggagaucugaggaaagg

SEQ ID NO: 802167 - RNA, 22 nt, Human
gugcagagaggaccuuggggag

SEQ ID NO: 802168 - RNA, 22 nt, Human
ucauuguagggcauuuagagag

SEQ ID NO: 802169 - RNA, 21 nt, Human
ugaauagggccagaaccaaag

SEQ ID NO: 802170 - RNA, 22 nt, Human
auguauguucaagcaaugauua

SEQ ID NO: 802171 - RNA, 22 nt, Human
agaggaggcucugggaucgucc

SEQ ID NO: 802172 - RNA, 20 nt, Human
ccucucugcaugcucccuga

SEQ ID NO: 802173 - RNA, 22 nt, Human
uuacaugacaaagcuuuggcuc

SEQ ID NO: 802174 - RNA, 23 nt, Human
cccacaugucugagucagugcca

SEQ ID NO: 802175 - RNA, 22 nt, Human
uugcagauuaaaacacugagcu

SEQ ID NO: 802176 - RNA, 22 nt, Human
cccagggucccugcucucugug

SEQ ID NO: 802177 - RNA, 22 nt, Human
acagggccaggugagaggugcu

SEQ ID NO: 802178 - RNA, 20 nt, Human
aaaagcagccagagauggua

SEQ ID NO: 802179 - RNA, 22 nt, Human
ccagagaagguggagcuugugu

SEQ ID NO: 802180 - RNA, 22 nt, Human
gcugcuggcaucuagggggugg

SEQ ID NO: 802181 - RNA, 22 nt, Human
gaggcaggcagauugcuugagg

SEQ ID NO: 802182 - RNA, 22 nt, Human
uaauuuuuccacguacacuggg

SEQ ID NO: 802183 - RNA, 22 nt, Human
cugggagcggcugucacugguu

SEQ ID NO: 802184 - RNA, 22 nt, Human
ccccaccugugcgucugccgca

SEQ ID NO: 802185 - RNA, 22 nt, Human
gcagggcaaacccagguguuca

SEQ ID NO: 802186 - RNA, 22 nt, Human
gaggaaggaaugcaguguaugc

SEQ ID NO: 802187 - RNA, 23 nt, Human
uccagcagccaagaaggguagaa

SEQ ID NO: 802188 - RNA, 22 nt, Human
cuguccagcugaccagagcagc

SEQ ID NO: 802189 - RNA, 22 nt, Human
acuuccaggguagaggggaaga

SEQ ID NO: 802190 - RNA, 22 nt, Human
uuuguguuguuuuaagccacua

SEQ ID NO: 802191 - RNA, 22 nt, Human
guauuugucuuguuggucucca

SEQ ID NO: 802192 - RNA, 22 nt, Human
agacagcaugauacaugaugcu

SEQ ID NO: 802193 - RNA, 22 nt, Human
aggacaguggacacuagucccu

SEQ ID NO: 802194 - RNA, 22 nt, Human
uggcuuccugcacagugucugc

SEQ ID NO: 802195 - RNA, 22 nt, Human
gcauuaauguaagacccacucc

SEQ ID NO: 802196 - RNA, 22 nt, Human
aggcagauuacuugaggccagg

SEQ ID NO: 802197 - RNA, 22 nt, Human
augcaaacaugaagagaaagag

SEQ ID NO: 802198 - RNA, 20 nt, Human
auuccucagccccagccuca

SEQ ID NO: 802199 - RNA, 22 nt, Human
cuggcuuccugaguccauuacc

SEQ ID NO: 802200 - RNA, 22 nt, Human
aaaauuauggaguaucccaaag

SEQ ID NO: 802201 - RNA, 22 nt, Human
gagagcugucagcguagcaccg

SEQ ID NO: 802202 - RNA, 22 nt, Human
cuaaacaagauacuaaugaggu

SEQ ID NO: 802203 - RNA, 22 nt, Human
ccuggaguugaaggaagguggg

SEQ ID NO: 802204 - RNA, 21 nt, Human
uuugcauuuuacaugugggga

SEQ ID NO: 802205 - RNA, 22 nt, Human
gaacacagcagggauaaccacu

SEQ ID NO: 802206 - RNA, 22 nt, Human
uugcaaaaaccacaauuacuuu

SEQ ID NO: 802207 - RNA, 20 nt, Human
guggaugaucaguguagugg

SEQ ID NO: 802208 - RNA, 20 nt, Human
aaaaucucccagaaacuuau

SEQ ID NO: 802209 - RNA, 22 nt, Human
uacaaagauaguguuagaguaa

SEQ ID NO: 802210 - RNA, 22 nt, Human
aguggcuggagccccaggcugg

SEQ ID NO: 802211 - RNA, 19 nt, Human
ccacuggggcuccacauua

SEQ ID NO: 802212 - RNA, 22 nt, Human
uuuaugcaucucuaggaagggc

SEQ ID NO: 802213 - RNA, 23 nt, Human
gcaguguuugcuucaucuuaucc

SEQ ID NO: 802214 - RNA, 22 nt, Human
cugucagguuggucucagagcu

SEQ ID NO: 802215 - RNA, 22 nt, Human
ucaggagcagcuguaggaaggg

SEQ ID NO: 802216 - RNA, 22 nt, Human
cacuugaaugaaagagacuccu

SEQ ID NO: 802217 - RNA, 22 nt, Human
uuagaucaauacuaaagaaguu

SEQ ID NO: 802218 - RNA, 22 nt, Human
uucuuuccccauggaguucgga

SEQ ID NO: 802219 - RNA, 22 nt, Human
aaaagcaauugcaguucuugcc

SEQ ID NO: 802220 - RNA, 22 nt, Human
uuuaaauuuguguuuagagggu

SEQ ID NO: 802221 - RNA, 22 nt, Human
auaaucugacaaagacuuaagc

SEQ ID NO: 802222 - RNA, 22 nt, Human
uagggcagccacccaggcugcu

SEQ ID NO: 802223 - RNA, 22 nt, Human
ucaggcaggcagagggcaaaug

SEQ ID NO: 802224 - RNA, 22 nt, Human
uaaaaggcaauacuagaugagu

SEQ ID NO: 802225 - RNA, 22 nt, Human
cacacauuaauaucaaaggcuc

SEQ ID NO: 802226 - RNA, 22 nt, Human
agauggcagggguaccuggaag

SEQ ID NO: 802227 - RNA, 22 nt, Human
aucuuucuauuucuaaaaacua

SEQ ID NO: 802228 - RNA, 22 nt, Human
uuugaaauuaagauauugucca

SEQ ID NO: 802229 - RNA, 22 nt, Human
uuaaagaauagugccccuauug

SEQ ID NO: 802230 - RNA, 22 nt, Human
acuggaguauuguuuaauacca

SEQ ID NO: 802231 - RNA, 19 nt, Human
aggcugcccagucucugcc

SEQ ID NO: 802232 - RNA, 19 nt, Human
uggcccagaugguccuggg

SEQ ID NO: 802233 - RNA, 22 nt, Human
uccugggguuuuggccgcagcu

SEQ ID NO: 802234 - RNA, 22 nt, Human
ggccauguuuggcagaaggauu

SEQ ID NO: 802235 - RNA, 22 nt, Human
ucccguugaugacggugcaucc

SEQ ID NO: 802236 - RNA, 22 nt, Human
cccaugcacccucuaagaagga

SEQ ID NO: 802237 - RNA, 22 nt, Human
ugcacugguggugagugaggga

SEQ ID NO: 802238 - RNA, 22 nt, Human
gagcccuuuuccuagauacugu

SEQ ID NO: 802239 - RNA, 22 nt, Human
gucaacuuuaagaugaucuuuu

SEQ ID NO: 802240 - RNA, 23 nt, Human
gcccugcccuuagcacacucaca

SEQ ID NO: 802241 - RNA, 22 nt, Human
gacauuuaugaaggagauaugc

SEQ ID NO: 802242 - RNA, 22 nt, Human
caguccuugauccaauaguggg

SEQ ID NO: 802243 - RNA, 22 nt, Human
aauaacagugccaugaaauuga

SEQ ID NO: 802244 - RNA, 22 nt, Human
cucagacuggggcucccugagu

SEQ ID NO: 802245 - RNA, 22 nt, Human
agcccagcugccugccugcugu

SEQ ID NO: 802246 - RNA, 20 nt, Human
ggccugagcauggcuggcag

SEQ ID NO: 802247 - RNA, 22 nt, Human
auaaaaguucaagagaguacag

SEQ ID NO: 802248 - RNA, 22 nt, Human
cagcaccuuccuuaacuccagg

SEQ ID NO: 802249 - RNA, 22 nt, Human
aagggcaggagaagacggauau

SEQ ID NO: 802250 - RNA, 22 nt, Human
agcaacaggcauaauguguuga

SEQ ID NO: 802251 - RNA, 22 nt, Human
uuucugaacuugguacuggagc

SEQ ID NO: 802252 - RNA, 22 nt, Human
ggccuuggcuccugcagggagu

SEQ ID NO: 802253 - RNA, 19 nt, Human
aggcaugggaagagaaguc

SEQ ID NO: 802254 - RNA, 22 nt, Human
auucccagauuuauauugauag

SEQ ID NO: 802255 - RNA, 22 nt, Human
cauguuuucuaggcuuucacaa

SEQ ID NO: 802256 - RNA, 22 nt, Human
ccagcaggagacuagcaacaua

SEQ ID NO: 802257 - RNA, 22 nt, Human
uuuuacuuaauucuuggucaug

SEQ ID NO: 802258 - RNA, 22 nt, Human
cugggucuggccacaggaagua

SEQ ID NO: 802259 - RNA, 22 nt, Human
auaaguuugucuuuguaaagau

SEQ ID NO: 802260 - RNA, 22 nt, Human
cugccagggaggcugggaaguu

SEQ ID NO: 802261 - RNA, 22 nt, Human
acuuucaagcaagaacacuuug

SEQ ID NO: 802262 - RNA, 22 nt, Human
gcucaaagaauauucagaauga

SEQ ID NO: 802263 - RNA, 22 nt, Human
uagaaagaacuucauguaaaac

SEQ ID NO: 802264 - RNA, 22 nt, Human
cuauuuauguccaaguguuuua

SEQ ID NO: 802265 - RNA, 22 nt, Human
accugccucuaagcagcaggug

SEQ ID NO: 802266 - RNA, 22 nt, Human
cuggcccuucucuugcuuccug

SEQ ID NO: 802267 - RNA, 22 nt, Human
auuguuaaacugaagcauuacu

SEQ ID NO: 802268 - RNA, 22 nt, Human
gagccucguggcggccacugcg

SEQ ID NO: 802269 - RNA, 22 nt, Human
uggcugagccacuuguucagau

SEQ ID NO: 802270 - RNA, 22 nt, Human
aggagaauuaggaacucaagau

SEQ ID NO: 802271 - RNA, 22 nt, Human
gccaggcugcuggcugcugucc

SEQ ID NO: 802272 - RNA, 22 nt, Human
uaauuauugucugaagaguuau

SEQ ID NO: 802273 - RNA, 22 nt, Human
aagcugccacacggugaguacu

SEQ ID NO: 802274 - RNA, 16 nt, Human
gcuggagggagggguu

SEQ ID NO: 802275 - RNA, 22 nt, Human
cagcuugcuaacugguaggggu

SEQ ID NO: 802276 - RNA, 20 nt, Human
agccuggcaaacacccccag

SEQ ID NO: 802277 - RNA, 22 nt, Human
ggagggaaugucuagcauucuu

SEQ ID NO: 802278 - RNA, 19 nt, Human
uucuaaguuuugcuugcug

SEQ ID NO: 802279 - RNA, 22 nt, Human
uuacacagaaacacuguucaga

SEQ ID NO: 802280 - RNA, 22 nt, Human
cccaggguugccugccucugcu

SEQ ID NO: 802281 - RNA, 22 nt, Human
auugacauguaggcuacaagga

SEQ ID NO: 802282 - RNA, 22 nt, Human
uauacaaugaguacauucuggg

SEQ ID NO: 802283 - RNA, 22 nt, Human
ggcaggcauggggucugccauu

SEQ ID NO: 802284 - RNA, 21 nt, Human
acuguuauucccauuuucacc

SEQ ID NO: 802285 - RNA, 22 nt, Human
gagucaggaguccugugugaga

SEQ ID NO: 802286 - RNA, 19 nt, Human
uguuggaggugcugaauua

SEQ ID NO: 802287 - RNA, 23 nt, Human
cuuuucauugccuuagcgcagag

SEQ ID NO: 802288 - RNA, 22 nt, Human
ugugcucuaccucagugucauu

SEQ ID NO: 802289 - RNA, 22 nt, Human
uaacauuagguagacauaagcc

SEQ ID NO: 802290 - RNA, 22 nt, Human
ugccuggaaggcccaugggaag

SEQ ID NO: 802291 - RNA, 22 nt, Human
gccucccuccaccacugcaggu

SEQ ID NO: 802292 - RNA, 22 nt, Human
uuggcucugaaacccaagcucu

SEQ ID NO: 802293 - RNA, 22 nt, Human
uauucacagguucuggggauca

SEQ ID NO: 802294 - RNA, 22 nt, Human
cuggucaggggauggggcucag

SEQ ID NO: 802295 - RNA, 22 nt, Human
aacaugcaugaagaaguuauau

SEQ ID NO: 802296 - RNA, 19 nt, Human
gccaggccuggaccugcag

SEQ ID NO: 802297 - RNA, 22 nt, Human
ggcuggcaagucagugcugaug

SEQ ID NO: 802298 - RNA, 22 nt, Human
cuggguccccucagugacacug

SEQ ID NO: 802299 - RNA, 22 nt, Human
uugucuuagagugaaaacuuua

SEQ ID NO: 802300 - RNA, 22 nt, Human
cuggcaggagcauucacagagg

SEQ ID NO: 802301 - RNA, 18 nt, Human
gcuccuggagucugacuc

SEQ ID NO: 802302 - RNA, 22 nt, Human
acagugacguuuauuugagacg

SEQ ID NO: 802303 - RNA, 22 nt, Human
acaugcuuccaaauuauguugg

SEQ ID NO: 802304 - RNA, 22 nt, Human
cacugcagucuucaucaaccaa

SEQ ID NO: 802305 - RNA, 23 nt, Human
ccuccugggcacaggccugaugg

SEQ ID NO: 802306 - RNA, 21 nt, Human
aggcccagcuuuccucuugcu

SEQ ID NO: 802307 - RNA, 22 nt, Human
ugagcccaggaggcagagguug

SEQ ID NO: 802308 - RNA, 22 nt, Human
ccaguccucagauggucugugc

SEQ ID NO: 802309 - RNA, 18 nt, Human
ggcaggagcaagaauagg

SEQ ID NO: 802310 - RNA, 18 nt, Human
aaauguacuguccauggc

SEQ ID NO: 802311 - RNA, 22 nt, Human
ggcagggguggccuuccuuugg

SEQ ID NO: 802312 - RNA, 18 nt, Human
gacacaggagagaguccc

SEQ ID NO: 802313 - RNA, 22 nt, Human
acccagagcccuuagcacagac

SEQ ID NO: 802314 - RNA, 22 nt, Human
aaauauaguaaaugcauaguuc

SEQ ID NO: 802315 - RNA, 22 nt, Human
aaacuguccucccgagguuucc

SEQ ID NO: 802316 - RNA, 20 nt, Human
agaagucagcucagaaguga

SEQ ID NO: 802317 - RNA, 22 nt, Human
uggcccugaaucaaggccagca

SEQ ID NO: 802318 - RNA, 22 nt, Human
gggcucaggccuggccucucac

SEQ ID NO: 802319 - RNA, 22 nt, Human
agaaaugaagcaggaguuauua

SEQ ID NO: 802320 - RNA, 22 nt, Human
ggcaggcuccagagcccucucc

SEQ ID NO: 802321 - RNA, 22 nt, Human
uggggugggguuacucauucug

SEQ ID NO: 802322 - RNA, 22 nt, Human
aagagaauaucgauagcacucu

SEQ ID NO: 802323 - RNA, 22 nt, Human
uauucaaagugcgaggucaggg

SEQ ID NO: 802324 - RNA, 22 nt, Human
gugggcagaggagagaacauua

SEQ ID NO: 802325 - RNA, 22 nt, Human
gcaggagcccuggcauguucuu

SEQ ID NO: 802326 - RNA, 22 nt, Human
ugcaggcugaggcuggcucaac

SEQ ID NO: 802327 - RNA, 22 nt, Human
uacuuguuaaaauauuagcuau

SEQ ID NO: 802328 - RNA, 22 nt, Human
auuauacauuuuguguagagau

SEQ ID NO: 802329 - RNA, 22 nt, Human
ggauggcagucugcaugagaaa

SEQ ID NO: 802330 - RNA, 23 nt, Human
uuuuccuuuggacaggcuguauu

SEQ ID NO: 802331 - RNA, 22 nt, Human
ugaggccauggaacuagcuugg

SEQ ID NO: 802332 - RNA, 22 nt, Human
cuguaaaaugaaccuagucauc

SEQ ID NO: 802333 - RNA, 22 nt, Human
ggccagcuuauuagcucagagg

SEQ ID NO: 802334 - RNA, 22 nt, Human
uagauuuuaggagauuuuacug

SEQ ID NO: 802335 - RNA, 22 nt, Human
uggcucaguuucugcccagcug

SEQ ID NO: 802336 - RNA, 22 nt, Human
gaaggcccuguuuucccuauuu

SEQ ID NO: 802337 - RNA, 22 nt, Human
uauguuacucacauguucuugc

SEQ ID NO: 802338 - RNA, 22 nt, Human
gcuggggccugaacagucagcu

SEQ ID NO: 802339 - RNA, 22 nt, Human
agagggcugccucagucagcua

SEQ ID NO: 802340 - RNA, 22 nt, Human
ggugcggagacuccaugaggcc

SEQ ID NO: 802341 - RNA, 22 nt, Human
ucucagagaugucaagagucua

SEQ ID NO: 802342 - RNA, 22 nt, Human
ucauaaaucauacuccauuugc

SEQ ID NO: 802343 - RNA, 22 nt, Human
guuuacauauuuuaauugguga

SEQ ID NO: 802344 - RNA, 22 nt, Human
augccaaagcccaaguucauca

SEQ ID NO: 802345 - RNA, 22 nt, Human
uuacaacuugcagaggauguug

SEQ ID NO: 802346 - RNA, 22 nt, Human
ugcuggagacauagcaggcagc

SEQ ID NO: 802347 - RNA, 22 nt, Human
ucacauaaauuauacaauuuca

SEQ ID NO: 802348 - RNA, 22 nt, Human
uucauguuucaauuguuaaugu

SEQ ID NO: 802349 - RNA, 16 nt, Human
gggcaggaaucagggu

SEQ ID NO: 802350 - RNA, 22 nt, Human
cuccuggugacucccagauaaa

SEQ ID NO: 802351 - RNA, 22 nt, Human
uuaaauauuauguugucugcaa

SEQ ID NO: 802352 - RNA, 22 nt, Human
ggaggcccagaaggaagcccag

SEQ ID NO: 802353 - RNA, 22 nt, Human
accacugcccauggugaaaacu

SEQ ID NO: 802354 - RNA, 22 nt, Human
cagaggcaggaagaugggcagu

SEQ ID NO: 802355 - RNA, 22 nt, Human
uagaggcacagucuauguagag

SEQ ID NO: 802356 - RNA, 22 nt, Human
auguuuacagaggaagugccuc

SEQ ID NO: 802357 - RNA, 22 nt, Human
gcugccccagcugggggcugga

SEQ ID NO: 802358 - RNA, 22 nt, Human
augaaaauguacauguguauaa

SEQ ID NO: 802359 - RNA, 19 nt, Human
uacuuauuagaaauauggg

SEQ ID NO: 802360 - RNA, 22 nt, Human
ugagggagcacacacugaagug

SEQ ID NO: 802361 - RNA, 22 nt, Human
cagcucagucuugaagcacugg

SEQ ID NO: 802362 - RNA, 22 nt, Human
cugcacugagacccucuuugcu

SEQ ID NO: 802363 - RNA, 22 nt, Human
caucaggagaccagguccugcu

SEQ ID NO: 802364 - RNA, 22 nt, Human
ggaaacaugccugcuggacagu

SEQ ID NO: 802365 - RNA, 22 nt, Human
gaggagcucugcuccauccuuc

SEQ ID NO: 802366 - RNA, 22 nt, Human
gcuggcugaguucugucgucug

SEQ ID NO: 802367 - RNA, 22 nt, Human
aggcaggagugacccugacagg

SEQ ID NO: 802368 - RNA, 20 nt, Human
aacacagauaccaaagguug

SEQ ID NO: 802369 - RNA, 22 nt, Human
aggccucaguuugucaucugua

SEQ ID NO: 802370 - RNA, 22 nt, Human
acuguucugcauguaccugagg

SEQ ID NO: 802371 - RNA, 23 nt, Human
gcaggugguucgaacagaaguuu

SEQ ID NO: 802372 - RNA, 22 nt, Human
uaucaucacuguaauccguuga

SEQ ID NO: 802373 - RNA, 20 nt, Human
aggcacaguuccuaguuggg

SEQ ID NO: 802374 - RNA, 22 nt, Human
uucuuuccacagaggggaugau

SEQ ID NO: 802375 - RNA, 22 nt, Human
cacaaaauaucaagcacuuuua

SEQ ID NO: 802376 - RNA, 22 nt, Human
agcagcuuuaagucacugguua

SEQ ID NO: 802377 - RNA, 22 nt, Human
gggcuggcucugucuagaaagg

SEQ ID NO: 802378 - RNA, 22 nt, Human
uggcccaguauguauaaucuua

SEQ ID NO: 802379 - RNA, 22 nt, Human
cacagaggagugcacacucucu

SEQ ID NO: 802380 - RNA, 22 nt, Human
uaaggcaggcuuucauccagag

SEQ ID NO: 802381 - RNA, 22 nt, Human
uuuuuuauaucaacugaagucu

SEQ ID NO: 802382 - RNA, 23 nt, Human
uccaggagcaugcuggcuggcga

SEQ ID NO: 802383 - RNA, 22 nt, Human
guuuuuaucuaauagcaguuau

SEQ ID NO: 802384 - RNA, 22 nt, Human
gccaggcucagcagucaaccug

SEQ ID NO: 802385 - RNA, 22 nt, Human
caguguaagcucuagacuagaa

SEQ ID NO: 802386 - RNA, 21 nt, Human
uccugcugagaaacagauggu

SEQ ID NO: 802387 - RNA, 22 nt, Human
uugagcaaugucacugaggcuu

SEQ ID NO: 802388 - RNA, 17 nt, Human
cccugggugaguucuca

SEQ ID NO: 802389 - RNA, 21 nt, Human
ccugagggugguugugaagau

SEQ ID NO: 802390 - RNA, 22 nt, Human
ugugauuagcugaauacacugg

SEQ ID NO: 802391 - RNA, 22 nt, Human
ccucugccugcacaucauccug

SEQ ID NO: 802392 - RNA, 22 nt, Human
uuuaugaacuacagauauaacu

SEQ ID NO: 802393 - RNA, 22 nt, Human
ccugcuggaccucaacacauuu

SEQ ID NO: 802394 - RNA, 22 nt, Human
ucagucauuguccuuaaaacac

SEQ ID NO: 802395 - RNA, 22 nt, Human
ccucaggcaggaaacugucccg

SEQ ID NO: 802396 - RNA, 22 nt, Human
ucaggagcucuucccuggugug

SEQ ID NO: 802397 - RNA, 19 nt, Human
cucugccucccuccugggu

SEQ ID NO: 802398 - RNA, 22 nt, Human
aggaggcugcaacccugaggcc

SEQ ID NO: 802399 - RNA, 22 nt, Human
ccagcccuguuuaugugucacu

SEQ ID NO: 802400 - RNA, 22 nt, Human
caccaggcuggagugcagaggu

SEQ ID NO: 802401 - RNA, 22 nt, Human
uccaggagauucauuaggucau

SEQ ID NO: 802402 - RNA, 22 nt, Human
acuggcagcagcagcccuuggg

SEQ ID NO: 802403 - RNA, 22 nt, Human
ccaggacaauucgucacuuucu

SEQ ID NO: 802404 - RNA, 22 nt, Human
gaaaauuauugaaaauggcucu

SEQ ID NO: 802405 - RNA, 22 nt, Human
agacaucauguuacagauuaag

SEQ ID NO: 802406 - RNA, 22 nt, Human
agcaggcuaagggaccuguuua

SEQ ID NO: 802407 - RNA, 22 nt, Human
ccuuggcccuagccucaggcaa

SEQ ID NO: 802408 - RNA, 22 nt, Human
aacccuggggcugcucugccug

SEQ ID NO: 802409 - RNA, 22 nt, Human
acaguguucacuuaacaaugga

SEQ ID NO: 802410 - RNA, 22 nt, Human
uggcccuguggcuucagaacag

SEQ ID NO: 802411 - RNA, 22 nt, Human
gagagggcaagguagaugcuac

SEQ ID NO: 802412 - RNA, 22 nt, Human
acacaucuuagacugaaauaug

SEQ ID NO: 802413 - RNA, 22 nt, Human
uuuguaaaauuagggaauucaa

SEQ ID NO: 802414 - RNA, 22 nt, Human
gaggcucccucaacucugggug

SEQ ID NO: 802415 - RNA, 22 nt, Human
uugagcaagccugcggcgggaa

SEQ ID NO: 802416 - RNA, 22 nt, Human
guccuggcccacuggcaggcug

SEQ ID NO: 802417 - RNA, 20 nt, Human
ggcaggaccccaguggcauc

SEQ ID NO: 802418 - RNA, 23 nt, Human
agccacagccagagcuaucucca

SEQ ID NO: 802419 - RNA, 22 nt, Human
cuccagagagaaaggaggccgc

SEQ ID NO: 802420 - RNA, 18 nt, Human
ugagaaccauguucauuc

SEQ ID NO: 802421 - RNA, 22 nt, Human
uagaaacauguucuguucuguu

SEQ ID NO: 802422 - RNA, 19 nt, Human
acauguuuugcagaacagc

SEQ ID NO: 802423 - RNA, 22 nt, Human
ccucugcccuuuuccuguauca

SEQ ID NO: 802424 - RNA, 22 nt, Human
uucuuuagcaacuuggauuuag

SEQ ID NO: 802425 - RNA, 20 nt, Human
aaacuugauggcauagaaua

SEQ ID NO: 802426 - RNA, 21 nt, Human
agcugcuuucagcuccuagag

SEQ ID NO: 802427 - RNA, 22 nt, Human
ggauggagguucucagaugcuc

SEQ ID NO: 802428 - RNA, 22 nt, Human
uaucacauuuggagauuuauga

SEQ ID NO: 802429 - RNA, 22 nt, Human
gcucaggcucucccaggggaau

SEQ ID NO: 802430 - RNA, 22 nt, Human
uguuuacagaaggcagacuucc

SEQ ID NO: 802431 - RNA, 22 nt, Human
agcugagcacauucaaacaggu

SEQ ID NO: 802432 - RNA, 22 nt, Human
cucagacuagccuguaccgaca

SEQ ID NO: 802433 - RNA, 22 nt, Human
gcuggagguagggagguccugu

SEQ ID NO: 802434 - RNA, 22 nt, Human
auguuuuaugcuucagaugagg

SEQ ID NO: 802435 - RNA, 22 nt, Human
uuguuuuaaccuaguguuuaug

SEQ ID NO: 802436 - RNA, 22 nt, Human
cugccuagcgccaucugccucu

SEQ ID NO: 802437 - RNA, 18 nt, Human
uacaggaagggguucucg

SEQ ID NO: 802438 - RNA, 22 nt, Human
caccccugggcugggcacacag

SEQ ID NO: 802439 - RNA, 22 nt, Human
ucuuccuugccuugcuucauca

SEQ ID NO: 802440 - RNA, 21 nt, Human
gaggccacuaauaggggcaga

SEQ ID NO: 802441 - RNA, 20 nt, Human
ugucaauagcacugaggcug

SEQ ID NO: 802442 - RNA, 22 nt, Human
uucucucugugucauuauggac

SEQ ID NO: 802443 - RNA, 21 nt, Human
ucaggcugucugcugguucca

SEQ ID NO: 802444 - RNA, 22 nt, Human
ugguggcuucugaggauggcga

SEQ ID NO: 802445 - RNA, 22 nt, Human
ucauuuacagacugugugggug

SEQ ID NO: 802446 - RNA, 22 nt, Human
aggugggcaccaggcuuguggu

SEQ ID NO: 802447 - RNA, 22 nt, Human
aacucauuugcauuuuuccugu

SEQ ID NO: 802448 - RNA, 22 nt, Human
uagauuaacaguuuuguugaag

SEQ ID NO: 802449 - RNA, 19 nt, Human
ggcuggcaagugacagugu

SEQ ID NO: 802450 - RNA, 22 nt, Human
agucagcuuggcuccucccaug

SEQ ID NO: 802451 - RNA, 22 nt, Human
gccaagcuguuuuucagagacg

SEQ ID NO: 802452 - RNA, 22 nt, Human
aggaaggggagaaguuaaagcu

SEQ ID NO: 802453 - RNA, 22 nt, Human
aaguuuguagcuggaugucugu

SEQ ID NO: 802454 - RNA, 22 nt, Human
agcccugggcaccugugagggg

SEQ ID NO: 802455 - RNA, 22 nt, Human
cucaggagagucuuauaucucc

SEQ ID NO: 802456 - RNA, 22 nt, Human
aaaaguauuuugagcacuuuau

SEQ ID NO: 802457 - RNA, 20 nt, Human
caggacagcgcaaucggagg

SEQ ID NO: 802458 - RNA, 22 nt, Human
ucuucacaggagccugccugcc

SEQ ID NO: 802459 - RNA, 22 nt, Human
gaaauguuccugaucccugauu

SEQ ID NO: 802460 - RNA, 22 nt, Human
cucagagaaaugucacaacaau

SEQ ID NO: 802461 - RNA, 22 nt, Human
ggccugaggccaccagcagccc

SEQ ID NO: 802462 - RNA, 22 nt, Human
agggucucugggaguagggcac

SEQ ID NO: 802463 - RNA, 22 nt, Human
aggcaggcccucuggaaaggua

SEQ ID NO: 802464 - RNA, 22 nt, Human
acucugcuguuuacucucuaua

SEQ ID NO: 802465 - RNA, 22 nt, Human
gcucagaguuaauuggaugggu

SEQ ID NO: 802466 - RNA, 22 nt, Human
cuaaaugucagaguagcuugca

SEQ ID NO: 802467 - RNA, 22 nt, Human
uuugagaaaaagugaugaugau

SEQ ID NO: 802468 - RNA, 22 nt, Human
uaaaauuugucccugaguguug

SEQ ID NO: 802469 - RNA, 22 nt, Human
ccaaaauauuagugcuuaagua

SEQ ID NO: 802470 - RNA, 22 nt, Human
uggaggaaguugcuggaaguca

SEQ ID NO: 802471 - RNA, 22 nt, Human
gggcaggcugagcaugucaccu

SEQ ID NO: 802472 - RNA, 22 nt, Human
uucuaaguccuaccugaaagca

SEQ ID NO: 802473 - RNA, 22 nt, Human
aacuucuugguccugagcuguu

SEQ ID NO: 802474 - RNA, 23 nt, Human
gccucagagaaacagcugcacac

SEQ ID NO: 802475 - RNA, 22 nt, Human
aaaaugagcauauugauccuuu

SEQ ID NO: 802476 - RNA, 22 nt, Human
aggcuaggguaacagauguggc

SEQ ID NO: 802477 - RNA, 22 nt, Human
accaggcuggagugcaguggcg

SEQ ID NO: 802478 - RNA, 22 nt, Human
gcugcagcccugcggaucacuu

SEQ ID NO: 802479 - RNA, 22 nt, Human
auuuaagacugacuucaccagu

SEQ ID NO: 802480 - RNA, 22 nt, Human
cugagccaccggcagggacauc

SEQ ID NO: 802481 - RNA, 21 nt, Human
gcagagccggggcgagaaggc

SEQ ID NO: 802482 - RNA, 22 nt, Human
ucuuccuuguaagggcuuuaga

SEQ ID NO: 802483 - RNA, 22 nt, Human
aaaugucagaaaacauggagug

SEQ ID NO: 802484 - RNA, 21 nt, Human
uauacagaggggaacaggaga

SEQ ID NO: 802485 - RNA, 22 nt, Human
uuuucauguuccuuguuaagug

SEQ ID NO: 802486 - RNA, 22 nt, Human
gaagagaagcaucaauagguaa

SEQ ID NO: 802487 - RNA, 22 nt, Human
aguuucaauucuuuucacaaag

SEQ ID NO: 802488 - RNA, 22 nt, Human
aggagccaaauuacuagcucug

SEQ ID NO: 802489 - RNA, 22 nt, Human
ucugcaggcauuuuugguuguc

SEQ ID NO: 802490 - RNA, 22 nt, Human
cagcuugggaguuugguuuuau

SEQ ID NO: 802491 - RNA, 22 nt, Human
uccagccuccuauuuacccuaa

SEQ ID NO: 802492 - RNA, 22 nt, Human
ggaaggcucuguuccuugacuu

SEQ ID NO: 802493 - RNA, 22 nt, Human
uacucacauucuguuucuugcu

SEQ ID NO: 802494 - RNA, 22 nt, Human
gauaacaugguuaguguuuuua

SEQ ID NO: 802495 - RNA, 22 nt, Human
gcuggcuggaguaaggagggag

SEQ ID NO: 802496 - RNA, 22 nt, Human
ccaaggcagaagauggcucuug

SEQ ID NO: 802497 - RNA, 22 nt, Human
gagcaauggaagauagauaaca

SEQ ID NO: 802498 - RNA, 22 nt, Human
agguaggggguuugggaacugc

SEQ ID NO: 802499 - RNA, 22 nt, Human
ucuucuuccuccacagggccca

SEQ ID NO: 802500 - RNA, 22 nt, Human
gcccuuucuucuucuggacugg

SEQ ID NO: 802501 - RNA, 22 nt, Human
ccuggcagcuccguggccuucc

SEQ ID NO: 802502 - RNA, 22 nt, Human
agccaaggucgccccagggcaa

SEQ ID NO: 802503 - RNA, 22 nt, Human
gacaagcaggcuccugaagaaa

SEQ ID NO: 802504 - RNA, 22 nt, Human
aaagcagcugcucuggccuuga

SEQ ID NO: 802505 - RNA, 22 nt, Human
aguacaauuauauuuagauggu

SEQ ID NO: 802506 - RNA, 22 nt, Human
ccugucucccuggcauggcuca

SEQ ID NO: 802507 - RNA, 22 nt, Human
aaacacuucuuaggucuuaagu

SEQ ID NO: 802508 - RNA, 22 nt, Human
gcuccuggugcaaaguuucuuc

SEQ ID NO: 802509 - RNA, 22 nt, Human
ucccaagaugacacaguggacg

SEQ ID NO: 802510 - RNA, 22 nt, Human
gacuucuguuaacuuguaagag

SEQ ID NO: 802511 - RNA, 22 nt, Human
ugagaaggugaaaguguggaga

SEQ ID NO: 802512 - RNA, 23 nt, Human
ugucauugugacuacagaaccag

SEQ ID NO: 802513 - RNA, 22 nt, Human
ccggcaggcggaguugcaguga

SEQ ID NO: 802514 - RNA, 23 nt, Human
auguaaacuucagagucauugcc

SEQ ID NO: 802515 - RNA, 22 nt, Human
agacuggguuugagacuuagca

SEQ ID NO: 802516 - RNA, 22 nt, Human
cagucucugggaaagaggacag

SEQ ID NO: 802517 - RNA, 22 nt, Human
ccacuguauaagcaaaaugaaa

SEQ ID NO: 802518 - RNA, 22 nt, Human
auaaccaugauuaaucuaagaa

SEQ ID NO: 802519 - RNA, 22 nt, Human
augaaacaugagaaauggagag

SEQ ID NO: 802520 - RNA, 22 nt, Human
gcaaagugaaauggggcagaga

SEQ ID NO: 802521 - RNA, 22 nt, Human
aaugaacacagcccucuacuuu

SEQ ID NO: 802522 - RNA, 22 nt, Human
acaauguaggauauguacuugu

SEQ ID NO: 802523 - RNA, 22 nt, Human
caggcagcugacugucagauau

SEQ ID NO: 802524 - RNA, 22 nt, Human
acagugaaugagaauggagaaa

SEQ ID NO: 802525 - RNA, 22 nt, Human
gacaguaacuacaguucugugg

SEQ ID NO: 802526 - RNA, 22 nt, Human
gcagagaagaugcccaggcuuc

SEQ ID NO: 802527 - RNA, 19 nt, Human
uaaaaacugaaggaagcag

SEQ ID NO: 802528 - RNA, 22 nt, Human
aacuuuaaggcuauaaauuaug

SEQ ID NO: 802529 - RNA, 22 nt, Human
acagcuggaggucugugagcac

SEQ ID NO: 802530 - RNA, 22 nt, Human
acaguguagcaugguagcaaug

SEQ ID NO: 802531 - RNA, 22 nt, Human
cuggcaugccuugggugccucu

SEQ ID NO: 802532 - RNA, 22 nt, Human
gaacaacuuugaaacaugaaga

SEQ ID NO: 802533 - RNA, 22 nt, Human
guggcagugaggcaggagcagu

SEQ ID NO: 802534 - RNA, 22 nt, Human
aguucuuuugugaacauaugcu

SEQ ID NO: 802535 - RNA, 22 nt, Human
gaacuuguuguaagaaaauaug

SEQ ID NO: 802536 - RNA, 22 nt, Human
ccagaggacuugggggcugaau

SEQ ID NO: 802537 - RNA, 20 nt, Human
ccuggccaaugagauaggaa

SEQ ID NO: 802538 - RNA, 22 nt, Human
cuggcccagagcucuggccuuu

SEQ ID NO: 802539 - RNA, 22 nt, Human
guacuuuagaguaaaauagacc

SEQ ID NO: 802540 - RNA, 21 nt, Human
aggcagcaggauccagggaca

SEQ ID NO: 802541 - RNA, 22 nt, Human
uuucauugaacuaaagaaucug

SEQ ID NO: 802542 - RNA, 22 nt, Human
gcuggcugacagagauuuaaaa

SEQ ID NO: 802543 - RNA, 22 nt, Human
uuagcaaaccuggacuacagau

SEQ ID NO: 802544 - RNA, 19 nt, Human
ucagggaaguucaaagcuc

SEQ ID NO: 802545 - RNA, 22 nt, Human
acauuuacuuaucaaaagucag

SEQ ID NO: 802546 - RNA, 22 nt, Human
gagcuuaggccagggacaggga

SEQ ID NO: 802547 - RNA, 22 nt, Human
cugagccaaggggacagugaca

SEQ ID NO: 802548 - RNA, 22 nt, Human
guuuauaaggcccaauauuucu

SEQ ID NO: 802549 - RNA, 22 nt, Human
uuuccucuuugugacacagcug

SEQ ID NO: 802550 - RNA, 22 nt, Human
cugaggugggaguuuuucucau

SEQ ID NO: 802551 - RNA, 21 nt, Human
gcccagcaaggugagaaggcc

SEQ ID NO: 802552 - RNA, 22 nt, Human
gcacccagggcaggaagugagg

SEQ ID NO: 802553 - RNA, 22 nt, Human
agcaggguccugaggugaguca

SEQ ID NO: 802554 - RNA, 22 nt, Human
uuccucagcacaaagccaagau

SEQ ID NO: 802555 - RNA, 19 nt, Human
ucagggaguuuacagcaug

SEQ ID NO: 802556 - RNA, 22 nt, Human
cagaauggcuuuuauggcucag

SEQ ID NO: 802557 - RNA, 22 nt, Human
gggcagcucugcccaucagagg

SEQ ID NO: 802558 - RNA, 22 nt, Human
gaaauacagaaagggcugaaug

SEQ ID NO: 802559 - RNA, 22 nt, Human
ugucauuuggacuuugguauua

SEQ ID NO: 802560 - RNA, 22 nt, Human
gcaggcugugguauguugggca

SEQ ID NO: 802561 - RNA, 22 nt, Human
caugucaacaggcccagaaaau

SEQ ID NO: 802562 - RNA, 22 nt, Human
acacauuauaggcaaucaaaag

SEQ ID NO: 802563 - RNA, 22 nt, Human
ugguuuuauuuauguugaguca

SEQ ID NO: 802564 - RNA, 22 nt, Human
caggcccaugagggcagccaca

SEQ ID NO: 802565 - RNA, 22 nt, Human
uucuccuuauucauaguugucu

SEQ ID NO: 802566 - RNA, 18 nt, Human
gagcugagaagaggaugc

SEQ ID NO: 802567 - RNA, 17 nt, Human
acccucaaucuccugca

SEQ ID NO: 802568 - RNA, 22 nt, Human
uucuguuuuagaaauaaguagu

SEQ ID NO: 802569 - RNA, 22 nt, Human
cagaggccuggcuuggacaccu

SEQ ID NO: 802570 - RNA, 22 nt, Human
ucuuccucuucugcugagaagu

SEQ ID NO: 802571 - RNA, 22 nt, Human
agcugccucagucacucauggc

SEQ ID NO: 802572 - RNA, 22 nt, Human
gcaggcugcugagauccuuagg

SEQ ID NO: 802573 - RNA, 22 nt, Human
cugcugugugcuuacuuggguu

SEQ ID NO: 802574 - RNA, 22 nt, Human
ccaguggguaggccauggugag

SEQ ID NO: 802575 - RNA, 22 nt, Human
uguuuacaaggagaauuugagg

SEQ ID NO: 802576 - RNA, 22 nt, Human
ucuuuggaaugcuagcauucua

SEQ ID NO: 802577 - RNA, 22 nt, Human
aaagauuucagaagccugugcc

SEQ ID NO: 802578 - RNA, 22 nt, Human
ccagaggucuccugcacgggau

SEQ ID NO: 802579 - RNA, 22 nt, Human
uugaaugaauaguugcuagaag

SEQ ID NO: 802580 - RNA, 22 nt, Human
ucuuuggcaucagggccagcua

SEQ ID NO: 802581 - RNA, 22 nt, Human
ccuuuugcucucccauccagaa

SEQ ID NO: 802582 - RNA, 22 nt, Human
uaggcagaaaggaaggcaaguu

SEQ ID NO: 802583 - RNA, 22 nt, Human
ugcaggcugggaagagggacaa

SEQ ID NO: 802584 - RNA, 22 nt, Human
guucaguguuuacaugauuguu

SEQ ID NO: 802585 - RNA, 21 nt, Human
ucugggggugagccuagaaau

SEQ ID NO: 802586 - RNA, 22 nt, Human
caggaaauaucucaacacuuua

SEQ ID NO: 802587 - RNA, 22 nt, Human
gucccagcuucccacuagcagc

SEQ ID NO: 802588 - RNA, 22 nt, Human
aagauucuuugaggauuuuacu

SEQ ID NO: 802589 - RNA, 22 nt, Human
gggcggggggagcuggaaugaa

SEQ ID NO: 802590 - RNA, 22 nt, Human
ugccaaggguaugggcaagaua

SEQ ID NO: 802591 - RNA, 22 nt, Human
uucaaguuuguauuucuguauu

SEQ ID NO: 802592 - RNA, 22 nt, Human
uacuuugauaagguucuucuau

SEQ ID NO: 802593 - RNA, 22 nt, Human
uuacauucuuaucucaguuauu

SEQ ID NO: 802594 - RNA, 22 nt, Human
aaguucuagagguugauuuggu

SEQ ID NO: 802595 - RNA, 22 nt, Human
uguaucuuucuguacuuuuaug

SEQ ID NO: 802596 - RNA, 22 nt, Human
agugggaggaaguggugauauu

SEQ ID NO: 802597 - RNA, 22 nt, Human
agccacagagcaggagaccuuu

SEQ ID NO: 802598 - RNA, 22 nt, Human
ccagcucagggucacauggcac

SEQ ID NO: 802599 - RNA, 22 nt, Human
gccugccugaaggcuguaccag

SEQ ID NO: 802600 - RNA, 22 nt, Human
uccuccaggauaaaauguguug

SEQ ID NO: 802601 - RNA, 22 nt, Human
cugggguggugcaggccucaug

SEQ ID NO: 802602 - RNA, 22 nt, Human
agugucaaugccaacaguauau

SEQ ID NO: 802603 - RNA, 23 nt, Human
uccagcagagccuuccaggaggg

SEQ ID NO: 802604 - RNA, 22 nt, Human
cagacacacacccuggccuagc

SEQ ID NO: 802605 - RNA, 22 nt, Human
uucucuucuguucagugcccaa

SEQ ID NO: 802606 - RNA, 22 nt, Human
gggacgagccccaggcuggagg

SEQ ID NO: 802607 - RNA, 22 nt, Human
auaguuuuaaaaccucaggaag

SEQ ID NO: 802608 - RNA, 22 nt, Human
aauuuauuauauccuaggggaa

SEQ ID NO: 802609 - RNA, 22 nt, Human
auucuucauuuacuguuacuug

SEQ ID NO: 802610 - RNA, 22 nt, Human
ugcuggagaacugcucuguguu

SEQ ID NO: 802611 - RNA, 22 nt, Human
aauagacaagcacccugguaaa

SEQ ID NO: 802612 - RNA, 16 nt, Human
ccagguggggcuguga

SEQ ID NO: 802613 - RNA, 19 nt, Human
cugaaaaacauucucagga

SEQ ID NO: 802614 - RNA, 22 nt, Human
uuacacauugcagaucaaaaug

SEQ ID NO: 802615 - RNA, 22 nt, Human
uuauguaaguggagucauauag

SEQ ID NO: 802616 - RNA, 22 nt, Human
acugcagccuuugggcucauaa

SEQ ID NO: 802617 - RNA, 22 nt, Human
ucagaauuuaaaauguguagau

SEQ ID NO: 802618 - RNA, 19 nt, Human
uggcuuccaucucucucau

SEQ ID NO: 802619 - RNA, 22 nt, Human
cagugaaaucacaacuuuaguu

SEQ ID NO: 802620 - RNA, 22 nt, Human
gaugaacauuuaaagccucuug

SEQ ID NO: 802621 - RNA, 22 nt, Human
aauuuacaguugcugaugguac

SEQ ID NO: 802622 - RNA, 22 nt, Human
ugcccagccaauuuguuauguu

SEQ ID NO: 802623 - RNA, 22 nt, Human
agcagagccugggcuaggggug

SEQ ID NO: 802624 - RNA, 22 nt, Human
guguuuccaguucagaaagcaa

SEQ ID NO: 802625 - RNA, 22 nt, Human
ggcaauguuucgaugggagcug

SEQ ID NO: 802626 - RNA, 23 nt, Human
cucaacccuaguaagggaguagg

SEQ ID NO: 802627 - RNA, 22 nt, Human
agauuauuuccagacuaaugaa

SEQ ID NO: 802628 - RNA, 22 nt, Human
cccugccugugggcaucaacau

SEQ ID NO: 802629 - RNA, 22 nt, Human
accggguaggugucaacucuga

SEQ ID NO: 802630 - RNA, 22 nt, Human
aacagcgacguccuccccaaca

SEQ ID NO: 802631 - RNA, 22 nt, Human
uucuuguuuugcccaaguugua

SEQ ID NO: 802632 - RNA, 22 nt, Human
uggccagugugugcugccggcu

SEQ ID NO: 802633 - RNA, 22 nt, Human
aaacauugagcacuugcuauuu

SEQ ID NO: 802634 - RNA, 22 nt, Human
ucaguguuggucaagaaucagu

SEQ ID NO: 802635 - RNA, 22 nt, Human
caaguacaaaaugauauuuagu

SEQ ID NO: 802636 - RNA, 19 nt, Human
uuugggaagcccagagugu

SEQ ID NO: 802637 - RNA, 22 nt, Human
ugauuuacuucuggauaaaucc

SEQ ID NO: 802638 - RNA, 22 nt, Human
auuucuucaggucagaaauaga

SEQ ID NO: 802639 - RNA, 22 nt, Human
ucccugaaauuugaagaggaau

SEQ ID NO: 802640 - RNA, 22 nt, Human
ggggccuauuuguucaacuucc

SEQ ID NO: 802641 - RNA, 22 nt, Human
acaaaguauuuuuagguuugua

SEQ ID NO: 802642 - RNA, 22 nt, Human
uguacaaagguacuuugauguu

SEQ ID NO: 802643 - RNA, 22 nt, Human
uguaaacucaguauguuuuacu

SEQ ID NO: 802644 - RNA, 22 nt, Human
uuauuucauugauuucuaagac

SEQ ID NO: 802645 - RNA, 22 nt, Human
gucuuuggaaagacaaaguuca

SEQ ID NO: 802646 - RNA, 22 nt, Human
gauuguaauucuacuuuccgcu

SEQ ID NO: 802647 - RNA, 22 nt, Human
ugcaaauuuaaugaaacuaugu

SEQ ID NO: 802648 - RNA, 22 nt, Human
ucaagcagagucaaaaguacca

SEQ ID NO: 802649 - RNA, 22 nt, Human
uacaaaguuuucuuggauugag

SEQ ID NO: 802650 - RNA, 22 nt, Human
ggcuucccuaaaccuuuccacu

SEQ ID NO: 802651 - RNA, 22 nt, Human
acauacuuauguguauaugugu

SEQ ID NO: 802652 - RNA, 22 nt, Human
guauuuuuagguaaggaaagua

SEQ ID NO: 802653 - RNA, 22 nt, Human
augccaaagauguuugauagaa

SEQ ID NO: 802654 - RNA, 18 nt, Human
ugaaauugcauccaugag

SEQ ID NO: 802655 - RNA, 22 nt, Human
aguggaguugaguugauggauu

SEQ ID NO: 802656 - RNA, 22 nt, Human
uuuguuuucuguaggccuuucc

SEQ ID NO: 802657 - RNA, 22 nt, Human
uuucacauaaauauuaugccua

SEQ ID NO: 802658 - RNA, 22 nt, Human
ucuacagaaacuggcuacucuc

SEQ ID NO: 802659 - RNA, 22 nt, Human
gcagggugccgacuucagggau

SEQ ID NO: 802660 - RNA, 18 nt, Human
gauauauaggaggaaagu

SEQ ID NO: 802661 - RNA, 22 nt, Human
uugauguugcucuuaacaguau

SEQ ID NO: 802662 - RNA, 22 nt, Human
gcccgcagagaucuuuaacaaa

SEQ ID NO: 802663 - RNA, 22 nt, Human
gaguccaggcuguugcucaucu

SEQ ID NO: 802664 - RNA, 22 nt, Human
gaaacuguuucuggcuuuggug

SEQ ID NO: 802665 - RNA, 22 nt, Human
auaauaaaccaggaugggucug

SEQ ID NO: 802666 - RNA, 22 nt, Human
gacacagggacgugcucugccu

SEQ ID NO: 802667 - RNA, 22 nt, Human
aagaaauauugggccuuauaaa

SEQ ID NO: 802668 - RNA, 22 nt, Human
agggcuggagccacagcuggga

SEQ ID NO: 802669 - RNA, 22 nt, Human
ucccagagcccaaguuggagag

SEQ ID NO: 802670 - RNA, 22 nt, Human
cugcacugagcaucuaaccuua

SEQ ID NO: 802671 - RNA, 22 nt, Human
ggcaggcacugugcuaggcgcu

SEQ ID NO: 802672 - RNA, 22 nt, Human
ugcaggcagcuaaaccauguaa

SEQ ID NO: 802673 - RNA, 22 nt, Human
cuuguuuuaaacuguuguggcu

SEQ ID NO: 802674 - RNA, 20 nt, Human
guacauuuucaggaggggau

SEQ ID NO: 802675 - RNA, 22 nt, Human
acagggcagagggcaguuggua

SEQ ID NO: 802676 - RNA, 22 nt, Human
cuggccauguugccucugagac

SEQ ID NO: 802677 - RNA, 22 nt, Human
uuccuagggcagagccgcuggg

SEQ ID NO: 802678 - RNA, 17 nt, Human
uuguuucuucucugugg

SEQ ID NO: 802679 - RNA, 22 nt, Human
aggcgugguugaggcgagcaua

SEQ ID NO: 802680 - RNA, 22 nt, Human
gugcugcagggucagcacccuc

SEQ ID NO: 802681 - RNA, 22 nt, Human
cagcugcaugucuguggugguc

SEQ ID NO: 802682 - RNA, 22 nt, Human
cccuccagggagccaugcuggg

SEQ ID NO: 802683 - RNA, 17 nt, Human
acccaggcucuaucuug

SEQ ID NO: 802684 - RNA, 22 nt, Human
gcucagcugagcgaaggacaug

SEQ ID NO: 802685 - RNA, 21 nt, Human
ggaacauuguuaauagucucu

SEQ ID NO: 802686 - RNA, 21 nt, Human
uccaggaaugucuguucaucu

SEQ ID NO: 802687 - RNA, 22 nt, Human
uuugaacaggaguaucuauagu

SEQ ID NO: 802688 - RNA, 22 nt, Human
uuucaggacucaaaacgauaau

SEQ ID NO: 802689 - RNA, 23 nt, Human
uucucuuuagauuuacauuacuc

SEQ ID NO: 802690 - RNA, 22 nt, Human
ucaagucuugaugagacaaacc

SEQ ID NO: 802691 - RNA, 22 nt, Human
aaucacaaauuuagacagagcu

SEQ ID NO: 802692 - RNA, 22 nt, Human
uugcuucuuagauauuccucuc

SEQ ID NO: 802693 - RNA, 22 nt, Human
gagcugagggucuaggaggguu

SEQ ID NO: 802694 - RNA, 22 nt, Human
cauaccuuucucaagcacaugu

SEQ ID NO: 802695 - RNA, 22 nt, Human
uaccaugcuugagauacaguga

SEQ ID NO: 802696 - RNA, 23 nt, Human
uggcucugugucacauacaggau

SEQ ID NO: 802697 - RNA, 22 nt, Human
cagaggaccuguguggccagag

SEQ ID NO: 802698 - RNA, 22 nt, Human
cagccagguaugggcgugcggg

SEQ ID NO: 802699 - RNA, 21 nt, Human
auuauuauuucuguguccagc

SEQ ID NO: 802700 - RNA, 22 nt, Human
cugguaggggugacuguuaucg

SEQ ID NO: 802701 - RNA, 22 nt, Human
gaggggggcgcccugcagugca

SEQ ID NO: 802702 - RNA, 22 nt, Human
cagcagcaugaauucgagccac

SEQ ID NO: 802703 - RNA, 22 nt, Human
uggcuucucccuacaacaugcc

SEQ ID NO: 802704 - RNA, 22 nt, Human
uagaaauguuagauguauugag

SEQ ID NO: 802705 - RNA, 22 nt, Human
gcuggcucuucaguggagauag

SEQ ID NO: 802706 - RNA, 22 nt, Human
aauggagaggcugugagugaga

SEQ ID NO: 802707 - RNA, 22 nt, Human
acauauauuacuaguaaagaca

SEQ ID NO: 802708 - RNA, 22 nt, Human
ucauggggaaagcccgcccuca

SEQ ID NO: 802709 - RNA, 23 nt, Human
uagugucaagagggaguguaauu

SEQ ID NO: 802710 - RNA, 22 nt, Human
uuuccuucccuggaugagaagu

SEQ ID NO: 802711 - RNA, 22 nt, Human
uacuagaaaaacacaugcucug

SEQ ID NO: 802712 - RNA, 22 nt, Human
acacaucuaucucuacacaagg

SEQ ID NO: 802713 - RNA, 22 nt, Human
ggcacaggaaucugugaagugc

SEQ ID NO: 802714 - RNA, 18 nt, Human
ucaugcaaacgcuucaua

SEQ ID NO: 802715 - RNA, 22 nt, Human
aaagauuugaguucugcuuaua

SEQ ID NO: 802716 - RNA, 22 nt, Human
cuggggaauagagcuggagacc

SEQ ID NO: 802717 - RNA, 22 nt, Human
gcaggcaguuauuuaguagaau

SEQ ID NO: 802718 - RNA, 19 nt, Human
gaauacagauaauaagcag

SEQ ID NO: 802719 - RNA, 22 nt, Human
aguaaaaucaccaucucuuugu

SEQ ID NO: 802720 - RNA, 22 nt, Human
ccucaggugugggccagcuguc

SEQ ID NO: 802721 - RNA, 22 nt, Human
aauucccauuugcagaaaauca

SEQ ID NO: 802722 - RNA, 22 nt, Human
ccucugacuucucuuuauuggc

SEQ ID NO: 802723 - RNA, 17 nt, Human
auccccagcaucuagaa

SEQ ID NO: 802724 - RNA, 20 nt, Human
agaagaggauacaaccaggc

SEQ ID NO: 802725 - RNA, 22 nt, Human
cuuagaaaugcagauucucagg

SEQ ID NO: 802726 - RNA, 22 nt, Human
agggcagcagcugucccugaga

SEQ ID NO: 802727 - RNA, 22 nt, Human
uuauuaauaaaguggcauagcc

SEQ ID NO: 802728 - RNA, 22 nt, Human
gcagggcacagacagugccaag

SEQ ID NO: 802729 - RNA, 22 nt, Human
ucaggcaggaagggaggacuug

SEQ ID NO: 802730 - RNA, 22 nt, Human
acuaucuuccuuaugccuauca

SEQ ID NO: 802731 - RNA, 22 nt, Human
cuacuguaauagaugaauuuga

SEQ ID NO: 802732 - RNA, 22 nt, Human
uguccuggccaaggccuugcuu

SEQ ID NO: 802733 - RNA, 18 nt, Human
ugaacuuuuccugcugcu

SEQ ID NO: 802734 - RNA, 22 nt, Human
uuagaaaaaggcuguggucuua

SEQ ID NO: 802735 - RNA, 23 nt, Human
aguuuuuaauggucauagcugag

SEQ ID NO: 802736 - RNA, 22 nt, Human
gcagggccuuagcagcggcugc

SEQ ID NO: 802737 - RNA, 22 nt, Human
gagccaggucgggccgcggcga

SEQ ID NO: 802738 - RNA, 22 nt, Human
uuauugaguuguaagagcucuu

SEQ ID NO: 802739 - RNA, 22 nt, Human
cuccuggagcagcaggcgcagg

SEQ ID NO: 802740 - RNA, 22 nt, Human
ucaggaugagcucauaacuaug

SEQ ID NO: 802741 - RNA, 22 nt, Human
ccucagcauccuccugcucagu

SEQ ID NO: 802742 - RNA, 22 nt, Human
gcagguggauuaucagaagugc

SEQ ID NO: 802743 - RNA, 22 nt, Human
aaagagcacccucaaugucuga

SEQ ID NO: 802744 - RNA, 22 nt, Human
ugcagccucucugcuucaggaa

SEQ ID NO: 802745 - RNA, 20 nt, Human
gggaggcauuggucccucac

SEQ ID NO: 802746 - RNA, 22 nt, Human
auguaaggagccacaguggggg

SEQ ID NO: 802747 - RNA, 22 nt, Human
uuauugaguaucugcuuggugu

SEQ ID NO: 802748 - RNA, 22 nt, Human
aguucuggugguuuggagaucu

SEQ ID NO: 802749 - RNA, 22 nt, Human
uccucagggcggccuccgucuu

SEQ ID NO: 802750 - RNA, 18 nt, Human
cuuuaugugcagagcuuu

SEQ ID NO: 802751 - RNA, 22 nt, Human
augguauugcaacaacugucau

SEQ ID NO: 802752 - RNA, 22 nt, Human
gaaaauuuagaacugaacuucu

SEQ ID NO: 802753 - RNA, 22 nt, Human
uaaagucaucuuuacaucuuug

SEQ ID NO: 802754 - RNA, 22 nt, Human
aaauauaccaguugccugcauc

SEQ ID NO: 802755 - RNA, 23 nt, Human
caggaagcagaugggguagaaga

SEQ ID NO: 802756 - RNA, 22 nt, Human
uucauacauuuuuacuaacagc

SEQ ID NO: 802757 - RNA, 18 nt, Human
gggcccuggcguccgccc

SEQ ID NO: 802758 - RNA, 22 nt, Human
aagaaaugcagaaaugugcugg

SEQ ID NO: 802759 - RNA, 22 nt, Human
ucaggcugcaucuguaagggug

SEQ ID NO: 802760 - RNA, 21 nt, Human
uacaaagggaaauucuggcuc

SEQ ID NO: 802761 - RNA, 22 nt, Human
aaacauucacauuugcuaguaa

SEQ ID NO: 802762 - RNA, 22 nt, Human
cccagcaguaaccaguggaaau

SEQ ID NO: 802763 - RNA, 22 nt, Human
gucagaggggcagcugccaggc

SEQ ID NO: 802764 - RNA, 22 nt, Human
uuucaggauuaguuuaagcagg

SEQ ID NO: 802765 - RNA, 22 nt, Human
ucacaucuugugauguuuucau

SEQ ID NO: 802766 - RNA, 22 nt, Human
uaggagggcccugaaaauggca

SEQ ID NO: 802767 - RNA, 22 nt, Human
cuuggcccaguugccaaggaaa

SEQ ID NO: 802768 - RNA, 22 nt, Human
uuuaugcuacucaauagucagu

SEQ ID NO: 802769 - RNA, 18 nt, Human
aagccaggucaagauaag

SEQ ID NO: 802770 - RNA, 22 nt, Human
ugagcugagaacacuugggcua

SEQ ID NO: 802771 - RNA, 22 nt, Human
cuggagccgcauggagcaggga

SEQ ID NO: 802772 - RNA, 22 nt, Human
ucaggagcaacaucuuugaauc

SEQ ID NO: 802773 - RNA, 18 nt, Human
gggaagaggaucuggccc

SEQ ID NO: 802774 - RNA, 22 nt, Human
auggccaguguugagaucaggc

SEQ ID NO: 802775 - RNA, 22 nt, Human
aggcccuggcccccagagauuc

SEQ ID NO: 802776 - RNA, 22 nt, Human
ggggugggagugccauccuuga

SEQ ID NO: 802777 - RNA, 22 nt, Human
aacauuugcaugcuuuauuaga

SEQ ID NO: 802778 - RNA, 22 nt, Human
ccaggcugcagucaaggggcau

SEQ ID NO: 802779 - RNA, 22 nt, Human
agcacucuaagugcaagacacu

SEQ ID NO: 802780 - RNA, 22 nt, Human
cugcucuccccaggccagucug

SEQ ID NO: 802781 - RNA, 22 nt, Human
gguggcagggagugucccuggg

SEQ ID NO: 802782 - RNA, 22 nt, Human
uagcuuugacaguugcaggcag

SEQ ID NO: 802783 - RNA, 22 nt, Human
ucgcuggccuggaggggagcca

SEQ ID NO: 802784 - RNA, 22 nt, Human
uucauguaauaggauguguuaa

SEQ ID NO: 802785 - RNA, 22 nt, Human
aucauaaaccacuuuguaaucu

SEQ ID NO: 802786 - RNA, 22 nt, Human
acacauuugcauaauaccucau

SEQ ID NO: 802787 - RNA, 22 nt, Human
aaaauuuuacugguguuuccuu

SEQ ID NO: 802788 - RNA, 22 nt, Human
gggccagacccuuggcgaucug

SEQ ID NO: 802789 - RNA, 22 nt, Human
cagcacaggccccucucuccca

SEQ ID NO: 802790 - RNA, 22 nt, Human
ucuugauuguuuucugaccuua

SEQ ID NO: 802791 - RNA, 22 nt, Human
acucuucaugcuaugcucaacu

SEQ ID NO: 802792 - RNA, 22 nt, Human
aagaagcagagcuguggguguu

SEQ ID NO: 802793 - RNA, 22 nt, Human
cugccuggaugaauggcgccuu

SEQ ID NO: 802794 - RNA, 22 nt, Human
ggccuggcugguucaguacccu

SEQ ID NO: 802795 - RNA, 22 nt, Human
agcagggcaguuaaaggguccu

SEQ ID NO: 802796 - RNA, 22 nt, Human
cagaggcagccgggggagaacg

SEQ ID NO: 802797 - RNA, 22 nt, Human
ugaggggcggccugcagaggcc

SEQ ID NO: 802798 - RNA, 22 nt, Human
cauucacaauggauugcuucaa

SEQ ID NO: 802799 - RNA, 22 nt, Human
cucuccaggcugggacaggacc

SEQ ID NO: 802800 - RNA, 22 nt, Human
gcagcuggagaaauaccacccu

SEQ ID NO: 802801 - RNA, 22 nt, Human
acaugacauaguagaaaagccc

SEQ ID NO: 802802 - RNA, 22 nt, Human
ggaggguccacugugaggcaga

SEQ ID NO: 802803 - RNA, 22 nt, Human
acaguguacuaaauaguaagag

SEQ ID NO: 802804 - RNA, 22 nt, Human
ugcucuggcugggaugagugca

SEQ ID NO: 802805 - RNA, 22 nt, Human
auuauuuauccucuuggucuau

SEQ ID NO: 802806 - RNA, 22 nt, Human
gacccagaggccugacagugug

SEQ ID NO: 802807 - RNA, 22 nt, Human
uuacagagaggugauugugaag

SEQ ID NO: 802808 - RNA, 19 nt, Human
gggcaguggcacuagggag

SEQ ID NO: 802809 - RNA, 22 nt, Human
agacaauuguucuaaguaaaaa

SEQ ID NO: 802810 - RNA, 22 nt, Human
cucaggggaccuggcuccgagu

SEQ ID NO: 802811 - RNA, 22 nt, Human
uuaauuuucucaucugugaaau

SEQ ID NO: 802812 - RNA, 19 nt, Human
gcaggaaaugagugauugc

SEQ ID NO: 802813 - RNA, 22 nt, Human
uaagauaauaaguaugucuaug

SEQ ID NO: 802814 - RNA, 22 nt, Human
ucuugauuuauucuacccagaa

SEQ ID NO: 802815 - RNA, 22 nt, Human
ugggagugauacaguauggaau

SEQ ID NO: 802816 - RNA, 22 nt, Human
auauauuacaaaagaggaagga

SEQ ID NO: 802817 - RNA, 22 nt, Human
acaacaaagacacuugaaauga

SEQ ID NO: 802818 - RNA, 22 nt, Human
cccuggaguccggagcucaccu

SEQ ID NO: 802819 - RNA, 22 nt, Human
cucuggaguaagagcuaugaaa

SEQ ID NO: 802820 - RNA, 22 nt, Human
ggaggguccaucuugugaaaag

SEQ ID NO: 802821 - RNA, 22 nt, Human
guguuuuauuggugcagucaga

SEQ ID NO: 802822 - RNA, 22 nt, Human
cuugcuuuaucugguuucucau

SEQ ID NO: 802823 - RNA, 22 nt, Human
gaggacagagccgccuggcaag

SEQ ID NO: 802824 - RNA, 22 nt, Human
cuguucuuaucgucuuaauauc

SEQ ID NO: 802825 - RNA, 22 nt, Human
gagucagauugcagacagggcu

SEQ ID NO: 802826 - RNA, 22 nt, Human
caaggacacugauguucauccu

SEQ ID NO: 802827 - RNA, 22 nt, Human
cuggaggcaaagcagaggcaug

SEQ ID NO: 802828 - RNA, 22 nt, Human
aaagacauggaacuagagaugg

SEQ ID NO: 802829 - RNA, 22 nt, Human
ugaggaaggaauugagguuuua

SEQ ID NO: 802830 - RNA, 22 nt, Human
gaccucagauuuucccaggcca

SEQ ID NO: 802831 - RNA, 22 nt, Human
agaggcucuaauccccuccaca

SEQ ID NO: 802832 - RNA, 22 nt, Human
uuuaagauucaguaaggcaaac

SEQ ID NO: 802833 - RNA, 22 nt, Human
ucuuagaaugucaacugauguu

SEQ ID NO: 802834 - RNA, 22 nt, Human
ccuggagacgaggcuggaccau

SEQ ID NO: 802835 - RNA, 22 nt, Human
cccagguggcagaagcugcagu

SEQ ID NO: 802836 - RNA, 22 nt, Human
aauuucaaugcacucaugguug

SEQ ID NO: 802837 - RNA, 22 nt, Human
uuucuauuuuaaaggcauaugg

SEQ ID NO: 802838 - RNA, 22 nt, Human
uuucggaauaaauacgaacauc

SEQ ID NO: 802839 - RNA, 22 nt, Human
uuaaugacuuauauuuaaagca

SEQ ID NO: 802840 - RNA, 22 nt, Human
ggagguggcagagggacauucu

SEQ ID NO: 802841 - RNA, 22 nt, Human
cuuucucaguguuaauuacuuu

SEQ ID NO: 802842 - RNA, 22 nt, Human
uguuuacauauuuggucucaga

SEQ ID NO: 802843 - RNA, 22 nt, Human
agggccaaguccaggaccucgg

SEQ ID NO: 802844 - RNA, 22 nt, Human
ugcaagagauucaaaccauaaa

SEQ ID NO: 802845 - RNA, 22 nt, Human
uggcaguccccugugccuggaa

SEQ ID NO: 802846 - RNA, 22 nt, Human
agcccuccaucugugcucaggc

SEQ ID NO: 802847 - RNA, 22 nt, Human
ccagggaaggcugcuggcugug

SEQ ID NO: 802848 - RNA, 22 nt, Human
uuccuuuucuuaaacauaugug

SEQ ID NO: 802849 - RNA, 20 nt, Human
cucugcugcgcaucccacuu

SEQ ID NO: 802850 - RNA, 22 nt, Human
ucaggacaaccuguuuucagac

SEQ ID NO: 802851 - RNA, 22 nt, Human
uuucuaaguaucuugcaguuuu

SEQ ID NO: 802852 - RNA, 22 nt, Human
cucuuccucucaugcggucaua

SEQ ID NO: 802853 - RNA, 22 nt, Human
gcacccugaguguucagcucca

SEQ ID NO: 802854 - RNA, 22 nt, Human
uggcucagagcagggacucugg

SEQ ID NO: 802855 - RNA, 22 nt, Human
cacagcaaagacacucucaacu

SEQ ID NO: 802856 - RNA, 22 nt, Human
aagccacaaucugcaucagcau

SEQ ID NO: 802857 - RNA, 22 nt, Human
ggcuugcacacagccucaguuu

SEQ ID NO: 802858 - RNA, 22 nt, Human
uuguuucugaguuuucauguau

SEQ ID NO: 802859 - RNA, 22 nt, Human
caggcccacgaggcacacagag

SEQ ID NO: 802860 - RNA, 22 nt, Human
aagauacauauuuguucuagug

SEQ ID NO: 802861 - RNA, 22 nt, Human
ucucuugaagauugaagacaaa

SEQ ID NO: 802862 - RNA, 22 nt, Human
uuguaagaauaugaauacaaau

SEQ ID NO: 802863 - RNA, 22 nt, Human
aauguuguguuucaguucaaga

SEQ ID NO: 802864 - RNA, 22 nt, Human
aagaugugaacagaaccacagg

SEQ ID NO: 802865 - RNA, 22 nt, Human
aggaacaacugauucagucaac

SEQ ID NO: 802866 - RNA, 22 nt, Human
cucagggaggagcuucugggcc

SEQ ID NO: 802867 - RNA, 22 nt, Human
aacauacauauuucagugucca

SEQ ID NO: 802868 - RNA, 22 nt, Human
ggcuggcacccuuggggauagg

SEQ ID NO: 802869 - RNA, 22 nt, Human
aaacccagagacuagaaagacc

SEQ ID NO: 802870 - RNA, 22 nt, Human
aaccauuagucaaucagcaaga

SEQ ID NO: 802871 - RNA, 22 nt, Human
ucagaauucugaagggcacaaa

SEQ ID NO: 802872 - RNA, 22 nt, Human
gcagccaggaaagcuggacccu

SEQ ID NO: 802873 - RNA, 22 nt, Human
cagcuucugcucauggaggggu

SEQ ID NO: 802874 - RNA, 22 nt, Human
acagucagggcuuacucaggga

SEQ ID NO: 802875 - RNA, 22 nt, Human
ugccagggucagcugcagcucu

SEQ ID NO: 802876 - RNA, 21 nt, Human
uguggcagauguugggaggca

SEQ ID NO: 802877 - RNA, 22 nt, Human
ugcuauuaaugaggcugcauuu

SEQ ID NO: 802878 - RNA, 22 nt, Human
ugcaggcuauaucuuauuugac

SEQ ID NO: 802879 - RNA, 22 nt, Human
gaggcagaggaagguggucucu

SEQ ID NO: 802880 - RNA, 19 nt, Human
aucuuuggguccugaaggg

SEQ ID NO: 802881 - RNA, 22 nt, Human
caguuguucccagcaaugaaag

SEQ ID NO: 802882 - RNA, 22 nt, Human
uuuuuguauagaaaugaacuaa

SEQ ID NO: 802883 - RNA, 22 nt, Human
uggacaggggcugcuguuguca

SEQ ID NO: 802884 - RNA, 22 nt, Human
acacuuaaucuuacugaggauc

SEQ ID NO: 802885 - RNA, 22 nt, Human
aaggcugacguuuguguuuauu

SEQ ID NO: 802886 - RNA, 22 nt, Human
gcagcagcucagccgggcacug

SEQ ID NO: 802887 - RNA, 22 nt, Human
ggcaggguccacaccugggaaa

SEQ ID NO: 802888 - RNA, 22 nt, Human
auuucuuacauaacaaauuguu

SEQ ID NO: 802889 - RNA, 22 nt, Human
ucuuccagcccuucuaauggua

SEQ ID NO: 802890 - RNA, 22 nt, Human
cuggagauaagcagucccaggc

SEQ ID NO: 802891 - RNA, 22 nt, Human
gcaguguccaggguggucugca

SEQ ID NO: 802892 - RNA, 22 nt, Human
gcagggacgccagggacagcaa

SEQ ID NO: 802893 - RNA, 22 nt, Human
ugccugccaugcagaaagcuga

SEQ ID NO: 802894 - RNA, 22 nt, Human
aaaaucuaaguagcgaguaagg

SEQ ID NO: 802895 - RNA, 22 nt, Human
aagcacagaccagaucuccagg

SEQ ID NO: 802896 - RNA, 22 nt, Human
agaucuggcccucagcuugauu

SEQ ID NO: 802897 - RNA, 22 nt, Human
auuuaauuuucucaacagugcu

SEQ ID NO: 802898 - RNA, 22 nt, Human
augggcugugggacccuggacc

SEQ ID NO: 802899 - RNA, 19 nt, Human
cugcacugagaaaaggagg

SEQ ID NO: 802900 - RNA, 22 nt, Human
uggcugccugaucgagcaggug

SEQ ID NO: 802901 - RNA, 20 nt, Human
ccagcauguacacaugugga

SEQ ID NO: 802902 - RNA, 22 nt, Human
gcaggguggauggcagggccag

SEQ ID NO: 802903 - RNA, 22 nt, Human
cagcuggccugagcgguggcgg

SEQ ID NO: 802904 - RNA, 22 nt, Human
uccagagcagguggucagaagg

SEQ ID NO: 802905 - RNA, 22 nt, Human
acgcaguuuguggacauuuuuu

SEQ ID NO: 802906 - RNA, 18 nt, Human
agcaggcguugccuggga

SEQ ID NO: 802907 - RNA, 22 nt, Human
uaguccuggauugguggaggca

SEQ ID NO: 802908 - RNA, 22 nt, Human
gagggccagaguccugggguca

SEQ ID NO: 802909 - RNA, 18 nt, Human
uggcuggcucugucaucu

SEQ ID NO: 802910 - RNA, 22 nt, Human
gcaagcugugauuuaugugaau

SEQ ID NO: 802911 - RNA, 21 nt, Human
uauuucuuugacucucucccu

SEQ ID NO: 802912 - RNA, 22 nt, Human
uggagguguccaacucgugggu

SEQ ID NO: 802913 - RNA, 22 nt, Human
aggucagaaaaggagagcauug

SEQ ID NO: 802914 - RNA, 22 nt, Human
aaaacagacagccaguguagag

SEQ ID NO: 802915 - RNA, 22 nt, Human
gcugccugcuucaugugggaga

SEQ ID NO: 802916 - RNA, 22 nt, Human
uacuguauuguuggcucuuuug

SEQ ID NO: 802917 - RNA, 22 nt, Human
uucuucaguuugguaaauguaa

SEQ ID NO: 802918 - RNA, 22 nt, Human
auacaugugucccugauuuauu

SEQ ID NO: 802919 - RNA, 22 nt, Human
auacagaacucucaguuguaua

SEQ ID NO: 802920 - RNA, 22 nt, Human
agcugagcucaggcugauguaa

SEQ ID NO: 802921 - RNA, 22 nt, Human
cugccaggcagcagagggagaa

SEQ ID NO: 802922 - RNA, 22 nt, Human
gcacagcacagcaacauguuuu

SEQ ID NO: 802923 - RNA, 22 nt, Human
aaacaucuuucuauugcaaguu

SEQ ID NO: 802924 - RNA, 22 nt, Human
acaauacuauuuucaguauccu

SEQ ID NO: 802925 - RNA, 22 nt, Human
cagggacaaagugagaaaggaa

SEQ ID NO: 802926 - RNA, 22 nt, Human
gucucucugacugguccacacc

SEQ ID NO: 802927 - RNA, 22 nt, Human
cggcaggguugguuuucucuga

SEQ ID NO: 802928 - RNA, 22 nt, Human
gcugggcaugugaccaacagaa

SEQ ID NO: 802929 - RNA, 22 nt, Human
caggccuggguucaaaucccuu

SEQ ID NO: 802930 - RNA, 22 nt, Human
cuuucccuuuugccuugcgugg

SEQ ID NO: 802931 - RNA, 22 nt, Human
augucucucagguuuaacuuua

SEQ ID NO: 802932 - RNA, 23 nt, Human
ccuggggcacuugaguccucauc

SEQ ID NO: 802933 - RNA, 22 nt, Human
ucaauaaguaggauaucaagau

SEQ ID NO: 802934 - RNA, 21 nt, Human
gaaggcuucugccuggaggag

SEQ ID NO: 802935 - RNA, 22 nt, Human
uugggaguuccuacugcgguuu

SEQ ID NO: 802936 - RNA, 22 nt, Human
acaggugauucaggcucuggga

SEQ ID NO: 802937 - RNA, 22 nt, Human
ucagaggaauuugcuuuucaug

SEQ ID NO: 802938 - RNA, 22 nt, Human
acagauaaauuuauaggagugu

SEQ ID NO: 802939 - RNA, 22 nt, Human
gacucugggaguuuaugugauu

SEQ ID NO: 802940 - RNA, 22 nt, Human
cagcaggauaugguggagagag

SEQ ID NO: 802941 - RNA, 22 nt, Human
ucacuuagauggggaucaucac

SEQ ID NO: 802942 - RNA, 22 nt, Human
ccaggagcaggagcuggacaga

SEQ ID NO: 802943 - RNA, 22 nt, Human
ucuguuuuguaccagauacagc

SEQ ID NO: 802944 - RNA, 22 nt, Human
ucuggagaggaggauguggaca

SEQ ID NO: 802945 - RNA, 22 nt, Human
ucagcaggcgguuccuuguggg

SEQ ID NO: 802946 - RNA, 22 nt, Human
gcugggagccguaccugucacg

SEQ ID NO: 802947 - RNA, 22 nt, Human
ggagaagggacagacucagcuu

SEQ ID NO: 802948 - RNA, 22 nt, Human
agaaauacaaaguacuaagaua

SEQ ID NO: 802949 - RNA, 22 nt, Human
aggcuucaguagggagcauguc

SEQ ID NO: 802950 - RNA, 22 nt, Human
aaguccugccagcaaauguaua

SEQ ID NO: 802951 - RNA, 22 nt, Human
gcaggacacagaugcaaggcca

SEQ ID NO: 802952 - RNA, 23 nt, Human
acucagagaccccgggaagugac

SEQ ID NO: 802953 - RNA, 22 nt, Human
aguuuaauccuccagcccaacu

SEQ ID NO: 802954 - RNA, 22 nt, Human
cagccuggacagcgaccagagu

SEQ ID NO: 802955 - RNA, 22 nt, Human
gggaaccaccccucugcccuga

SEQ ID NO: 802956 - RNA, 19 nt, Human
auggaaaauuguacucaau

SEQ ID NO: 802957 - RNA, 22 nt, Human
ugcuggcacgugacugggaagu

SEQ ID NO: 802958 - RNA, 19 nt, Human
caauauauagugaguggau

SEQ ID NO: 802959 - RNA, 22 nt, Human
gugaggggccaagaguagggca

SEQ ID NO: 802960 - RNA, 18 nt, Human
ggcagggaaaagauaggg

SEQ ID NO: 802961 - RNA, 19 nt, Human
uauauuuguugaauaaaaa

SEQ ID NO: 802962 - RNA, 22 nt, Human
aacuguagcaaagaacagcucu

SEQ ID NO: 802963 - RNA, 22 nt, Human
aggcacagguggacuucacagu

SEQ ID NO: 802964 - RNA, 22 nt, Human
aauuucagaccauuugcaauua

SEQ ID NO: 802965 - RNA, 20 nt, Human
gccagaggccggcaggggcu

SEQ ID NO: 802966 - RNA, 22 nt, Human
aguggcaagucaaugauaguga

SEQ ID NO: 802967 - RNA, 22 nt, Human
acaaauuugaauccugacuucu

SEQ ID NO: 802968 - RNA, 22 nt, Human
ugaacaacugcaaaaaucucca

SEQ ID NO: 802969 - RNA, 22 nt, Human
uugacuuuaaagcuuugucucu

SEQ ID NO: 802970 - RNA, 22 nt, Human
ugagcaggacucacugcagccu

SEQ ID NO: 802971 - RNA, 22 nt, Human
gcucccaccuuugcuaucagua

SEQ ID NO: 802972 - RNA, 22 nt, Human
gagccagccuucuucugagguc

SEQ ID NO: 802973 - RNA, 22 nt, Human
aaggcccuagaaucuauauugc

SEQ ID NO: 802974 - RNA, 22 nt, Human
ugacaggaugaugagcaggggg

SEQ ID NO: 802975 - RNA, 22 nt, Human
gaccucaguauuguucaggaug

SEQ ID NO: 802976 - RNA, 22 nt, Human
agccacagcacauuguaagaaa

SEQ ID NO: 802977 - RNA, 18 nt, Human
ggcagaugacaggagaga

SEQ ID NO: 802978 - RNA, 20 nt, Human
uacaacaaguagagacauac

SEQ ID NO: 802979 - RNA, 22 nt, Human
agacaaauaacuuuuuaugucc

SEQ ID NO: 802980 - RNA, 22 nt, Human
uuucuccugaguuccacgcuac

SEQ ID NO: 802981 - RNA, 22 nt, Human
ugcaaacagccuugaaagaggg

SEQ ID NO: 802982 - RNA, 22 nt, Human
acacuugauaggucaaaucagu

SEQ ID NO: 802983 - RNA, 22 nt, Human
aaaucucacuguagucaaagug

SEQ ID NO: 802984 - RNA, 22 nt, Human
agccagcugcucgggggaaaca

SEQ ID NO: 802985 - RNA, 22 nt, Human
guuacucuugagaggcugaggu

SEQ ID NO: 802986 - RNA, 22 nt, Human
ugcaagggugacagguugcucu

SEQ ID NO: 802987 - RNA, 22 nt, Human
auacauucagcagugcucauga

SEQ ID NO: 802988 - RNA, 22 nt, Human
agugucaaugcucuguuaaaaa

SEQ ID NO: 802989 - RNA, 22 nt, Human
aggccagcaugcaguucuaagg

SEQ ID NO: 802990 - RNA, 22 nt, Human
acaaugaaccaaauuuaccaau

SEQ ID NO: 802991 - RNA, 22 nt, Human
ggucagaggggauuccuuggga

SEQ ID NO: 802992 - RNA, 22 nt, Human
aagccaggaagagagccuucac

SEQ ID NO: 802993 - RNA, 22 nt, Human
cuaggcugcagaugcauggaau

SEQ ID NO: 802994 - RNA, 22 nt, Human
ugaggccacuuccccacagccc

SEQ ID NO: 802995 - RNA, 21 nt, Human
gucagagaugcccaacugccu

SEQ ID NO: 802996 - RNA, 21 nt, Human
cagaggcaggcucugugugug

SEQ ID NO: 802997 - RNA, 22 nt, Human
uuuaaauaggacuccugggggu

SEQ ID NO: 802998 - RNA, 22 nt, Human
ggagauggcuggcagguagaug

SEQ ID NO: 802999 - RNA, 22 nt, Human
ugcacuccaggcugggugacag

SEQ ID NO: 803000 - RNA, 22 nt, Human
uucacugugaacucauauucag

SEQ ID NO: 803001 - RNA, 22 nt, Human
agggccagcccauaaugccaaa

SEQ ID NO: 803002 - RNA, 22 nt, Human
ggacccaccaggccgggcucca

SEQ ID NO: 803003 - RNA, 18 nt, Human
cuggaaguuagucuuugg

SEQ ID NO: 803004 - RNA, 22 nt, Human
cugccaggcacugggcucugca

SEQ ID NO: 803005 - RNA, 22 nt, Human
uaccucauuacaucugcaauga

SEQ ID NO: 803006 - RNA, 22 nt, Human
gagcggaggcuuggaggccagc

SEQ ID NO: 803007 - RNA, 22 nt, Human
gaugaaaugcugagccugaguu

SEQ ID NO: 803008 - RNA, 22 nt, Human
ggaaggaauuccaagacuaaag

SEQ ID NO: 803009 - RNA, 22 nt, Human
cucuuuccucgaugggcuccug

SEQ ID NO: 803010 - RNA, 22 nt, Human
aaucagaaccuugggucauaac

SEQ ID NO: 803011 - RNA, 22 nt, Human
ucacugcuuugagccacugagc

SEQ ID NO: 803012 - RNA, 22 nt, Human
ccucgcugugugaccuugggug

SEQ ID NO: 803013 - RNA, 22 nt, Human
uuguuucaaauauuucagaaua

SEQ ID NO: 803014 - RNA, 22 nt, Human
gaguugccucuaagucccuggu

SEQ ID NO: 803015 - RNA, 22 nt, Human
cuggaaugcggagaguuggaga

SEQ ID NO: 803016 - RNA, 22 nt, Human
agugucaaauuaaauaaucugg

SEQ ID NO: 803017 - RNA, 22 nt, Human
acaggcaagucacacaacuugu

SEQ ID NO: 803018 - RNA, 22 nt, Human
acacacuucagauguaauuugu

SEQ ID NO: 803019 - RNA, 22 nt, Human
aaaccacuccugauucacuuca

SEQ ID NO: 803020 - RNA, 22 nt, Human
cagcaucuucaugugcaucucc

SEQ ID NO: 803021 - RNA, 22 nt, Human
uuguuaaauggaugcagaauaa

SEQ ID NO: 803022 - RNA, 22 nt, Human
cugagcugggcucucuugaggg

SEQ ID NO: 803023 - RNA, 22 nt, Human
caggaaggcccaccuguccugu

SEQ ID NO: 803024 - RNA, 22 nt, Human
gcugaagggagugcugagucug

SEQ ID NO: 803025 - RNA, 17 nt, Human
agcaggcugcagaggcc

SEQ ID NO: 803026 - RNA, 20 nt, Human
aaggcagaguggguuggagc

SEQ ID NO: 803027 - RNA, 22 nt, Human
ccuacaguuauauucuugauug

SEQ ID NO: 803028 - RNA, 22 nt, Human
aggaagaggguggcagauaauc

SEQ ID NO: 803029 - RNA, 22 nt, Human
uccaaauacauuuacuguauuu

SEQ ID NO: 803030 - RNA, 22 nt, Human
ucuguguauuugugaccuguau

SEQ ID NO: 803031 - RNA, 22 nt, Human
ugaccauuugaucuacauucca

SEQ ID NO: 803032 - RNA, 22 nt, Human
cagccccuuccuggcaucugga

SEQ ID NO: 803033 - RNA, 20 nt, Human
cagcuuggaugagaggcuga

SEQ ID NO: 803034 - RNA, 22 nt, Human
uuuucuauucauugucuauggu

SEQ ID NO: 803035 - RNA, 22 nt, Human
uguuugaugacgacauuguaga

SEQ ID NO: 803036 - RNA, 21 nt, Human
cgacaggagaggcagccagcc

SEQ ID NO: 803037 - RNA, 22 nt, Human
uaagauaauccauuauaauguu

SEQ ID NO: 803038 - RNA, 22 nt, Human
gcuggcuggcugugcaaaggca

SEQ ID NO: 803039 - RNA, 22 nt, Human
uccucccuguaccauuccucug

SEQ ID NO: 803040 - RNA, 22 nt, Human
ccagcagcuuuauuggcucucc

SEQ ID NO: 803041 - RNA, 20 nt, Human
ucccaggcugggcuccagcu

SEQ ID NO: 803042 - RNA, 22 nt, Human
ucccagcccagguaugaugaua

SEQ ID NO: 803043 - RNA, 22 nt, Human
uuugcaaugugaaauuaaagaa

SEQ ID NO: 803044 - RNA, 22 nt, Human
uuucugcagguauugcauaagu

SEQ ID NO: 803045 - RNA, 17 nt, Human
ucaggcugugccuggua

SEQ ID NO: 803046 - RNA, 22 nt, Human
caggaggcccaaagggcgcaga

SEQ ID NO: 803047 - RNA, 22 nt, Human
accugcugaggagggggaauua

SEQ ID NO: 803048 - RNA, 22 nt, Human
gaauuacagccagaagaaugaa

SEQ ID NO: 803049 - RNA, 22 nt, Human
cagcaaaugaguggcagggcag

SEQ ID NO: 803050 - RNA, 22 nt, Human
uaggaaaagucuagauugauga

SEQ ID NO: 803051 - RNA, 22 nt, Human
cuuuauauauucccaggcugcc

SEQ ID NO: 803052 - RNA, 22 nt, Human
cuggcugugaaauggcaguguc

SEQ ID NO: 803053 - RNA, 22 nt, Human
aguuucuugaagacugauguuu

SEQ ID NO: 803054 - RNA, 19 nt, Human
cuuggcaucugugaaguga

SEQ ID NO: 803055 - RNA, 22 nt, Human
aggacacacuucugaggucuuu

SEQ ID NO: 803056 - RNA, 22 nt, Human
gagcuggcuaauacugacuuau

SEQ ID NO: 803057 - RNA, 22 nt, Human
gaaauacuguaaaguuauuauu

SEQ ID NO: 803058 - RNA, 19 nt, Human
gcaggguggcagagcucuu

SEQ ID NO: 803059 - RNA, 22 nt, Human
ucuggcuguguaauauguguag

SEQ ID NO: 803060 - RNA, 22 nt, Human
uccucuuucucaacauuaguua

SEQ ID NO: 803061 - RNA, 22 nt, Human
caaaggaaauacuaaucuggaa

SEQ ID NO: 803062 - RNA, 22 nt, Human
guccugggccugcugaggcuga

SEQ ID NO: 803063 - RNA, 22 nt, Human
uucacacacagcuuccuauugu

SEQ ID NO: 803064 - RNA, 22 nt, Human
uaaaggguagguuuuacuguaa

SEQ ID NO: 803065 - RNA, 22 nt, Human
cacaucugacuuccagugcagg

SEQ ID NO: 803066 - RNA, 22 nt, Human
ucauuucuauugcuacugucug

SEQ ID NO: 803067 - RNA, 22 nt, Human
gcugcagccuuugggaaggaca

SEQ ID NO: 803068 - RNA, 22 nt, Human
aagcaggcaugggaggccaucc

SEQ ID NO: 803069 - RNA, 22 nt, Human
uagaaaugaauguuuaaaaguc

SEQ ID NO: 803070 - RNA, 22 nt, Human
cagaguuucgguaagcauagaa

SEQ ID NO: 803071 - RNA, 22 nt, Human
cagggcucacucggcuggcguc

SEQ ID NO: 803072 - RNA, 22 nt, Human
uucauuuguccaaauacuaugu

SEQ ID NO: 803073 - RNA, 22 nt, Human
accauuuaaggaaaauguauca

SEQ ID NO: 803074 - RNA, 22 nt, Human
cuuucccugcuuagaaggauuu

SEQ ID NO: 803075 - RNA, 22 nt, Human
uaagaaacuuaacugggaacua

SEQ ID NO: 803076 - RNA, 22 nt, Human
ggcccaggaugcaagaacugaa

SEQ ID NO: 803077 - RNA, 22 nt, Human
uggaccagggucccagaguaug

SEQ ID NO: 803078 - RNA, 22 nt, Human
aggcuuccucgugccuuagaua

SEQ ID NO: 803079 - RNA, 17 nt, Human
ucaaaguauucugaugc

SEQ ID NO: 803080 - RNA, 22 nt, Human
agaaacuaaagccaagggcucu

SEQ ID NO: 803081 - RNA, 22 nt, Human
aauauaugagggagcuauuuga

SEQ ID NO: 803082 - RNA, 22 nt, Human
gcagcaggagaguaauagcggu

SEQ ID NO: 803083 - RNA, 22 nt, Human
uagggcagagcuuguacacgau

SEQ ID NO: 803084 - RNA, 22 nt, Human
acugcagccuugaacucugggc

SEQ ID NO: 803085 - RNA, 22 nt, Human
aggacagagccugugcagaccg

SEQ ID NO: 803086 - RNA, 22 nt, Human
gcaguggggaaugcuggggaga

SEQ ID NO: 803087 - RNA, 21 nt, Human
aucacauuggcuguuauuauu

SEQ ID NO: 803088 - RNA, 22 nt, Human
gucugcugcagucguggcucua

SEQ ID NO: 803089 - RNA, 22 nt, Human
cuggaagguggauggcgaggcc

SEQ ID NO: 803090 - RNA, 22 nt, Human
uggcccugcugggucagagcug

SEQ ID NO: 803091 - RNA, 22 nt, Human
uuugacaucuaagaauucuuac

SEQ ID NO: 803092 - RNA, 20 nt, Human
cagagacccaggcuucagcu

SEQ ID NO: 803093 - RNA, 22 nt, Human
augaagcagcguuguagaguga

SEQ ID NO: 803094 - RNA, 18 nt, Human
uggcagggaggaaauaua

SEQ ID NO: 803095 - RNA, 22 nt, Human
uaaaaguaggaaugaaacgcau

SEQ ID NO: 803096 - RNA, 22 nt, Human
aagaacaugaguuaugaugauu

SEQ ID NO: 803097 - RNA, 22 nt, Human
ucuuuuuauauugacaaaaggu

SEQ ID NO: 803098 - RNA, 23 nt, Human
uuucugaaguugagauggacuuu

SEQ ID NO: 803099 - RNA, 22 nt, Human
auucuucacuguuucagaauga

SEQ ID NO: 803100 - RNA, 22 nt, Human
ggcuuaaaguuuucuagaauaa

SEQ ID NO: 803101 - RNA, 22 nt, Human
uggaaugcagugggagcuuacc

SEQ ID NO: 803102 - RNA, 22 nt, Human
ugcagccaucuuucuuggagga

SEQ ID NO: 803103 - RNA, 22 nt, Human
ugauuuacaauuguaaaaguuu

SEQ ID NO: 803104 - RNA, 22 nt, Human
agcaaggcagucagcuggcugg

SEQ ID NO: 803105 - RNA, 22 nt, Human
aggcuucuacguggucccaggg

SEQ ID NO: 803106 - RNA, 22 nt, Human
caggaaaggugugucaugaugg

SEQ ID NO: 803107 - RNA, 22 nt, Human
aagauauacuauuaaguaccau

SEQ ID NO: 803108 - RNA, 22 nt, Human
aggaaaagugugaaguauggag

SEQ ID NO: 803109 - RNA, 22 nt, Human
ccauuucacccacugcuuuagg

SEQ ID NO: 803110 - RNA, 22 nt, Human
cagcuaccaugguuuguuccag

SEQ ID NO: 803111 - RNA, 22 nt, Human
agaaacuaagucauaacucuuu

SEQ ID NO: 803112 - RNA, 22 nt, Human
ugucaugggucuaaacauugau

SEQ ID NO: 803113 - RNA, 22 nt, Human
uugaauguaggucuuggugagc

SEQ ID NO: 803114 - RNA, 22 nt, Human
ccugucugcaugagugagcaua

SEQ ID NO: 803115 - RNA, 22 nt, Human
uacauucucuucccauugucuc

SEQ ID NO: 803116 - RNA, 22 nt, Human
cugggccagcaacugcaaugga

SEQ ID NO: 803117 - RNA, 22 nt, Human
ugaaaauauaguuuuccagacu

SEQ ID NO: 803118 - RNA, 22 nt, Human
aggcagaaccagcugggacuuu

SEQ ID NO: 803119 - RNA, 22 nt, Human
uuauuguuuggguauaauuuga

SEQ ID NO: 803120 - RNA, 22 nt, Human
gaugaaauucagaauugagggg

SEQ ID NO: 803121 - RNA, 22 nt, Human
ucagaagccggaagugcuccuc

SEQ ID NO: 803122 - RNA, 22 nt, Human
gccacccugcaaaugcccagga

SEQ ID NO: 803123 - RNA, 22 nt, Human
uggcccaggucucucugagccc

SEQ ID NO: 803124 - RNA, 22 nt, Human
uuggaaacuuucaagcauaaug

SEQ ID NO: 803125 - RNA, 22 nt, Human
cugcaaauccucagaaaggguu

SEQ ID NO: 803126 - RNA, 22 nt, Human
uaggaaaucagagaaagaggug

SEQ ID NO: 803127 - RNA, 20 nt, Human
aaccaguacccaaguaggaa

SEQ ID NO: 803128 - RNA, 23 nt, Human
caggagggaaugaaguuagacaa

SEQ ID NO: 803129 - RNA, 22 nt, Human
acucccuccaaaucugcacagu

SEQ ID NO: 803130 - RNA, 22 nt, Human
ugugggcccuaggcaccuuguc

SEQ ID NO: 803131 - RNA, 22 nt, Human
uuguauuuuuuccuggcggugg

SEQ ID NO: 803132 - RNA, 20 nt, Human
auacaagaugaguaauuucu

SEQ ID NO: 803133 - RNA, 22 nt, Human
gcagauggagauaaauggaacu

SEQ ID NO: 803134 - RNA, 22 nt, Human
gggcaggugugcagagcuguug

SEQ ID NO: 803135 - RNA, 22 nt, Human
auuuuucucucacacuuaccag

SEQ ID NO: 803136 - RNA, 22 nt, Human
aaugagaauguaagugaagaga

SEQ ID NO: 803137 - RNA, 22 nt, Human
uagguauacagagauuucuggg

SEQ ID NO: 803138 - RNA, 21 nt, Human
uacaacagguuuuauuucgau

SEQ ID NO: 803139 - RNA, 22 nt, Human
guguuuaacaucugguuuauac

SEQ ID NO: 803140 - RNA, 22 nt, Human
uguggagcagcgucacagccuu

SEQ ID NO: 803141 - RNA, 22 nt, Human
ucccuuaagcaccugaguaguc

SEQ ID NO: 803142 - RNA, 22 nt, Human
uauguucauagaaaucaugacc

SEQ ID NO: 803143 - RNA, 22 nt, Human
ugacaauagcgauuuaucuugc

SEQ ID NO: 803144 - RNA, 22 nt, Human
ccacauuuggagaagauacuuu

SEQ ID NO: 803145 - RNA, 22 nt, Human
caucuuaaauuaaagcuuaagg

SEQ ID NO: 803146 - RNA, 22 nt, Human
auucacauuuacaaagcacuca

SEQ ID NO: 803147 - RNA, 22 nt, Human
ucauggaugggcccagcucugu

SEQ ID NO: 803148 - RNA, 19 nt, Human
aucccaucugguuuuuccc

SEQ ID NO: 803149 - RNA, 22 nt, Human
cagggagaagucuggucagucc

SEQ ID NO: 803150 - RNA, 22 nt, Human
gcuggcugagcacugguuuaua

SEQ ID NO: 803151 - RNA, 22 nt, Human
agcaaugacuuugaaaucauga

SEQ ID NO: 803152 - RNA, 22 nt, Human
agcacauuuucucaaagcucau

SEQ ID NO: 803153 - RNA, 19 nt, Human
cauuuucccaucauccuuu

SEQ ID NO: 803154 - RNA, 22 nt, Human
cuaaauaaucccucuggucuua

SEQ ID NO: 803155 - RNA, 22 nt, Human
ccagcuuuucagaaucugccug

SEQ ID NO: 803156 - RNA, 22 nt, Human
gcuggcugcuguugagacuugu

SEQ ID NO: 803157 - RNA, 22 nt, Human
cacuggcaucuaagggugguag

SEQ ID NO: 803158 - RNA, 22 nt, Human
uacucaaugaaguagccugguu

SEQ ID NO: 803159 - RNA, 22 nt, Human
uugcaauugcuauggagagcgu

SEQ ID NO: 803160 - RNA, 22 nt, Human
aggagaggcaucaagaaaaucg

SEQ ID NO: 803161 - RNA, 22 nt, Human
cugggaggauucauugagguga

SEQ ID NO: 803162 - RNA, 22 nt, Human
ucuuguuaaagugaagauacug

SEQ ID NO: 803163 - RNA, 22 nt, Human
ucagugacaacuaugaauauuu

SEQ ID NO: 803164 - RNA, 22 nt, Human
ugagaaauauugcacagugagg

SEQ ID NO: 803165 - RNA, 22 nt, Human
agaaggcaucagaaguguguag

SEQ ID NO: 803166 - RNA, 22 nt, Human
gacagacacaauugauccauga

SEQ ID NO: 803167 - RNA, 22 nt, Human
cagggcaguaacgggaacaucu

SEQ ID NO: 803168 - RNA, 22 nt, Human
gcauuccuuguuagcauuugau

SEQ ID NO: 803169 - RNA, 21 nt, Human
uaccaauugccuucuaguugu

SEQ ID NO: 803170 - RNA, 22 nt, Human
ggagcuggagagcuagccuagg

SEQ ID NO: 803171 - RNA, 22 nt, Human
uuucuaaguguguuucauagga

SEQ ID NO: 803172 - RNA, 22 nt, Human
gccuccccaaagugcugacagc

SEQ ID NO: 803173 - RNA, 22 nt, Human
uuucuguaaguggcaaauaaug

SEQ ID NO: 803174 - RNA, 22 nt, Human
cucaaauagaacugaucuauaa

SEQ ID NO: 803175 - RNA, 22 nt, Human
aagcaaauuggaugucugugag

SEQ ID NO: 803176 - RNA, 22 nt, Human
gcuuuucauagauaaaauucua

SEQ ID NO: 803177 - RNA, 22 nt, Human
aguaaauggugguuuuuaucau

SEQ ID NO: 803178 - RNA, 22 nt, Human
ugcuggcucccaggagccgcug

SEQ ID NO: 803179 - RNA, 22 nt, Human
aaagguuuauuuaaucagggag

SEQ ID NO: 803180 - RNA, 22 nt, Human
ucagccugcuccaagugcugcc

SEQ ID NO: 803181 - RNA, 19 nt, Human
uuucuaauguguuuuucuu

SEQ ID NO: 803182 - RNA, 21 nt, Human
aggagcauuguugugguggag

SEQ ID NO: 803183 - RNA, 19 nt, Human
gagcagcuuccuaucuggu

SEQ ID NO: 803184 - RNA, 22 nt, Human
auuuauuaccucggaguuucug

SEQ ID NO: 803185 - RNA, 22 nt, Human
cugggacagcugagacaggaga

SEQ ID NO: 803186 - RNA, 22 nt, Human
gacccaggcccaaggcugccag

SEQ ID NO: 803187 - RNA, 22 nt, Human
ggaugggcccgggacggcgcug

SEQ ID NO: 803188 - RNA, 22 nt, Human
cuuggcaugcagcaggcacuca

SEQ ID NO: 803189 - RNA, 22 nt, Human
ugcauauuuguaugauguuuag

SEQ ID NO: 803190 - RNA, 22 nt, Human
guucugggugaugagguuggcu

SEQ ID NO: 803191 - RNA, 22 nt, Human
ucagaaagacgaaacagauggg

SEQ ID NO: 803192 - RNA, 22 nt, Human
agacaaauuuccugcaaugaag

SEQ ID NO: 803193 - RNA, 22 nt, Human
ucaguucuaagugcuuuacaug

SEQ ID NO: 803194 - RNA, 22 nt, Human
ggcaggcugcuugggucauguc

SEQ ID NO: 803195 - RNA, 22 nt, Human
acacagagcuucucaacuggga

SEQ ID NO: 803196 - RNA, 22 nt, Human
ccuuaaauucuccauuugaaag

SEQ ID NO: 803197 - RNA, 22 nt, Human
cuggcuggccggaggcaucccu

SEQ ID NO: 803198 - RNA, 22 nt, Human
acauuuuacaccaagacuucuu

SEQ ID NO: 803199 - RNA, 22 nt, Human
guccugggcggagggcugcugu

SEQ ID NO: 803200 - RNA, 22 nt, Human
uagagaaaagcagggaucagga

SEQ ID NO: 803201 - RNA, 22 nt, Human
aucacauauaugcaccaagaca

SEQ ID NO: 803202 - RNA, 22 nt, Human
gcaugagguucuuggccagcau

SEQ ID NO: 803203 - RNA, 22 nt, Human
cuggcuccaccccaggaggaug

SEQ ID NO: 803204 - RNA, 22 nt, Human
ugacaaaacugcaauuacuuuu

SEQ ID NO: 803205 - RNA, 22 nt, Human
ccaggccagagugcaguggcac

SEQ ID NO: 803206 - RNA, 22 nt, Human
uacaagagaacuaauguaaguc

SEQ ID NO: 803207 - RNA, 22 nt, Human
agaauuacauaaauacaugaau

SEQ ID NO: 803208 - RNA, 22 nt, Human
uggcccagcucagggugggcgg

SEQ ID NO: 803209 - RNA, 22 nt, Human
ccaugcaauauauauccucaag

SEQ ID NO: 803210 - RNA, 22 nt, Human
ggacccagcucugagacccugc

SEQ ID NO: 803211 - RNA, 23 nt, Human
agaagcagcuucuggaguaucgg

SEQ ID NO: 803212 - RNA, 22 nt, Human
agcuagggcaaauaugagauac

SEQ ID NO: 803213 - RNA, 22 nt, Human
uacaaagugagcaaccucuuuu

SEQ ID NO: 803214 - RNA, 22 nt, Human
aagugucuucugauggggugug

SEQ ID NO: 803215 - RNA, 23 nt, Human
uaauuuuagccuuacaggacccu

SEQ ID NO: 803216 - RNA, 22 nt, Human
aaagugcagcuugugaucccua

SEQ ID NO: 803217 - RNA, 22 nt, Human
gggguggauuucaggcgguguc

SEQ ID NO: 803218 - RNA, 22 nt, Human
caaacauuugacuucucucagg

SEQ ID NO: 803219 - RNA, 22 nt, Human
cucugaggcuccaugcaggcuu

SEQ ID NO: 803220 - RNA, 22 nt, Human
ucccugcaguaggcagcccucc

SEQ ID NO: 803221 - RNA, 22 nt, Human
acauccauuuuguucaaaagca

SEQ ID NO: 803222 - RNA, 22 nt, Human
ugaucuuuccucuuguuugucu

SEQ ID NO: 803223 - RNA, 22 nt, Human
cacaugaguccugccagguaug

SEQ ID NO: 803224 - RNA, 22 nt, Human
agccagccccugacuguguccu

SEQ ID NO: 803225 - RNA, 22 nt, Human
cagcccugucuaugacugauga

SEQ ID NO: 803226 - RNA, 22 nt, Human
guuaaauucgaugauggauaaa

SEQ ID NO: 803227 - RNA, 22 nt, Human
aaaauuauagaucuagugccug

SEQ ID NO: 803228 - RNA, 16 nt, Human
gagggcagaggcggaa

SEQ ID NO: 803229 - RNA, 22 nt, Human
agucauuuucugccuguaaucu

SEQ ID NO: 803230 - RNA, 22 nt, Human
cgcuggggcuuuuugcuugaga

SEQ ID NO: 803231 - RNA, 22 nt, Human
gcuccuggcucuggccaaggga

SEQ ID NO: 803232 - RNA, 22 nt, Human
auaguuuuauagauauugugua

SEQ ID NO: 803233 - RNA, 22 nt, Human
uaacauucuuaacuuagaaaca

SEQ ID NO: 803234 - RNA, 22 nt, Human
acucuguaauucugaagcaccu

SEQ ID NO: 803235 - RNA, 22 nt, Human
acaggaugagaauaucauauuu

SEQ ID NO: 803236 - RNA, 22 nt, Human
aagucaaucaaggguguaggca

SEQ ID NO: 803237 - RNA, 22 nt, Human
gccaggcuggggggagaugucu

SEQ ID NO: 803238 - RNA, 22 nt, Human
uuuuacuuuggauacaguacuu

SEQ ID NO: 803239 - RNA, 22 nt, Human
accuggcacuacaggcaccugu

SEQ ID NO: 803240 - RNA, 22 nt, Human
ugauuaaaauuuaacuuaguua

SEQ ID NO: 803241 - RNA, 22 nt, Human
ccaggcagaaugaaaccccugu

SEQ ID NO: 803242 - RNA, 22 nt, Human
cugggagcaagaggcugcaaau

SEQ ID NO: 803243 - RNA, 22 nt, Human
gagcuaagcuauguuaugcagc

SEQ ID NO: 803244 - RNA, 22 nt, Human
auuguuuuaauuccauugugaa

SEQ ID NO: 803245 - RNA, 22 nt, Human
aaauacaaaaauuagccaggca

SEQ ID NO: 803246 - RNA, 22 nt, Human
aaauacauacacuguacguggc

SEQ ID NO: 803247 - RNA, 22 nt, Human
aaauaguuguuuggaucaauaa

SEQ ID NO: 803248 - RNA, 22 nt, Human
uuugacauuaaggaacauauau

SEQ ID NO: 803249 - RNA, 22 nt, Human
ccaggcagucaggguugugugu

SEQ ID NO: 803250 - RNA, 18 nt, Human
ugcauauacugccuaucu

SEQ ID NO: 803251 - RNA, 22 nt, Human
guucuuuaggggcccaauuucc

SEQ ID NO: 803252 - RNA, 22 nt, Human
gagucagaaacucacucuauag

SEQ ID NO: 803253 - RNA, 22 nt, Human
aauuacuuaagagaaacuuuga

SEQ ID NO: 803254 - RNA, 22 nt, Human
ccuugggucuaggccagggagu

SEQ ID NO: 803255 - RNA, 22 nt, Human
ccccagcucagugcagggacau

SEQ ID NO: 803256 - RNA, 22 nt, Human
ucuugugugguggaagauaugg

SEQ ID NO: 803257 - RNA, 22 nt, Human
ucaggcuugucucuagagcaau

SEQ ID NO: 803258 - RNA, 22 nt, Human
ucacaucugaaaaaauauugag

SEQ ID NO: 803259 - RNA, 22 nt, Human
caguuucucucaauaagcaucg

SEQ ID NO: 803260 - RNA, 22 nt, Human
aaaguuuucugccuucauuaga

SEQ ID NO: 803261 - RNA, 22 nt, Human
gauacaaauucaugucugaauu

SEQ ID NO: 803262 - RNA, 22 nt, Human
gagagcccuacaaggcguuuug

SEQ ID NO: 803263 - RNA, 22 nt, Human
gagucacauacuauguaauaga

SEQ ID NO: 803264 - RNA, 22 nt, Human
acaauacuuaccaauguuuuug

SEQ ID NO: 803265 - RNA, 22 nt, Human
uucguugcuuuaagccacuacg

SEQ ID NO: 803266 - RNA, 22 nt, Human
uucagaaugugaccuuauuugg

SEQ ID NO: 803267 - RNA, 22 nt, Human
agcugcaauuaaagacugugaa

SEQ ID NO: 803268 - RNA, 22 nt, Human
ggaggcggacacagguaguguu

SEQ ID NO: 803269 - RNA, 22 nt, Human
cagucucugccacuucuaagcu

SEQ ID NO: 803270 - RNA, 22 nt, Human
uuucugaagggcagcagacucu

SEQ ID NO: 803271 - RNA, 22 nt, Human
acucucccugagagggaggcau

SEQ ID NO: 803272 - RNA, 22 nt, Human
ucaggauggagggaagcacaga

SEQ ID NO: 803273 - RNA, 22 nt, Human
gaaucacacucguaagugaguu

SEQ ID NO: 803274 - RNA, 22 nt, Human
ugcagcuucucugcaacaggag

SEQ ID NO: 803275 - RNA, 22 nt, Human
ccaggagcgggaaaaggaagaa

SEQ ID NO: 803276 - RNA, 22 nt, Human
cacaucuucuuaacuccaaagu

SEQ ID NO: 803277 - RNA, 21 nt, Human
uggaggaauaaagcacagaag

SEQ ID NO: 803278 - RNA, 22 nt, Human
caggagguuguaagagcaggcc

SEQ ID NO: 803279 - RNA, 22 nt, Human
ucaauucuagagccuuacauug

SEQ ID NO: 803280 - RNA, 22 nt, Human
uuguauuaaaauguguuucugu

SEQ ID NO: 803281 - RNA, 21 nt, Human
acacaacaggcagucauuuuc

SEQ ID NO: 803282 - RNA, 22 nt, Human
aguaaaauuucugcugaggaga

SEQ ID NO: 803283 - RNA, 22 nt, Human
caggaggcagcgcucucaggac

SEQ ID NO: 803284 - RNA, 22 nt, Human
agggcccaugugggagcacuug

SEQ ID NO: 803285 - RNA, 22 nt, Human
gcuggcuggcgggugcguccuc

SEQ ID NO: 803286 - RNA, 22 nt, Human
ugagcuagggcuggugaggagc

SEQ ID NO: 803287 - RNA, 22 nt, Human
gaugcacggucaugucuuuuca

SEQ ID NO: 803288 - RNA, 22 nt, Human
gggcugugggacccggcacuuu

SEQ ID NO: 803289 - RNA, 20 nt, Human
agcuggccuguccuaggccu

SEQ ID NO: 803290 - RNA, 22 nt, Human
aagugcuuggcuaaugguuaug

SEQ ID NO: 803291 - RNA, 22 nt, Human
acaagcaguaaaggccacaguc

SEQ ID NO: 803292 - RNA, 22 nt, Human
aggcucagauucacauuugguu

SEQ ID NO: 803293 - RNA, 22 nt, Human
auuaguaaaacauuguauaugu

SEQ ID NO: 803294 - RNA, 22 nt, Human
uccaggagcauccaggugaagc

SEQ ID NO: 803295 - RNA, 22 nt, Human
cccuuuccauggcucuccuagg

SEQ ID NO: 803296 - RNA, 22 nt, Human
uaucacacuguuuuaauuacuu

SEQ ID NO: 803297 - RNA, 22 nt, Human
ccuacagacaaaccagugacua

SEQ ID NO: 803298 - RNA, 20 nt, Human
acugggagcuaacggagauu

SEQ ID NO: 803299 - RNA, 22 nt, Human
cuccaggacugaggacagagcu

SEQ ID NO: 803300 - RNA, 22 nt, Human
uucaguaucugcaaaaugggga

SEQ ID NO: 803301 - RNA, 22 nt, Human
ugugagaagggcaugcagggag

SEQ ID NO: 803302 - RNA, 22 nt, Human
gcuguggucugugagcuccaaa

SEQ ID NO: 803303 - RNA, 22 nt, Human
gacaggcuggcaaugcccugcu

SEQ ID NO: 803304 - RNA, 20 nt, Human
uugguugagccagggccugg

SEQ ID NO: 803305 - RNA, 22 nt, Human
aacaaugugaagugcuguucag

SEQ ID NO: 803306 - RNA, 22 nt, Human
ugggagucacuguuguugaggg

SEQ ID NO: 803307 - RNA, 22 nt, Human
aggcauggacauuucggcagcu

SEQ ID NO: 803308 - RNA, 21 nt, Human
uccucugcucucauaccacaa

SEQ ID NO: 803309 - RNA, 22 nt, Human
agcagcugcagggagggucugc

SEQ ID NO: 803310 - RNA, 22 nt, Human
uccuucagggcugaccacaggc

SEQ ID NO: 803311 - RNA, 22 nt, Human
ucugaaauauugguaauacuuu

SEQ ID NO: 803312 - RNA, 22 nt, Human
agcaggcuaaucuugcugaaca

SEQ ID NO: 803313 - RNA, 22 nt, Human
agaaacuauuaugguaaacaaa

SEQ ID NO: 803314 - RNA, 22 nt, Human
auacaaggucaugaagguuuac

SEQ ID NO: 803315 - RNA, 22 nt, Human
aaccaguuguauguccuccagc

SEQ ID NO: 803316 - RNA, 22 nt, Human
ucuuuaugccuaccugggaaga

SEQ ID NO: 803317 - RNA, 22 nt, Human
gugugcagaggcaggaggugcu

SEQ ID NO: 803318 - RNA, 22 nt, Human
ucuggggacggggcccagcaau

SEQ ID NO: 803319 - RNA, 22 nt, Human
auugucuuuaaaaauauacaac

SEQ ID NO: 803320 - RNA, 22 nt, Human
cuauuuuaacuugauuaccucu

SEQ ID NO: 803321 - RNA, 22 nt, Human
accagccugucugagucguggg

SEQ ID NO: 803322 - RNA, 22 nt, Human
cucuucaguuguugcauauucu

SEQ ID NO: 803323 - RNA, 22 nt, Human
aaacaguuguuauuuuuauaug

SEQ ID NO: 803324 - RNA, 19 nt, Human
uacagugaaccaggaggag

SEQ ID NO: 803325 - RNA, 22 nt, Human
acagcucacucacagggcuagu

SEQ ID NO: 803326 - RNA, 22 nt, Human
aucauaaagugcuaucugauug

SEQ ID NO: 803327 - RNA, 22 nt, Human
gagucuuugguaaagucugcug

SEQ ID NO: 803328 - RNA, 22 nt, Human
ucacaaaagcuuuugaauuugg

SEQ ID NO: 803329 - RNA, 22 nt, Human
gaagagaagguguaggccaucc

SEQ ID NO: 803330 - RNA, 22 nt, Human
aaugcucugucucugacagugg

SEQ ID NO: 803331 - RNA, 22 nt, Human
agaaggcugagacugggaugaa

SEQ ID NO: 803332 - RNA, 22 nt, Human
uauuuuacaaaugggaaugcug

SEQ ID NO: 803333 - RNA, 22 nt, Human
acaauuucuuauaguucaauuc

SEQ ID NO: 803334 - RNA, 22 nt, Human
ucaauaaaauuguuuuccuauc

SEQ ID NO: 803335 - RNA, 22 nt, Human
gcaggucuagaagcugccucug

SEQ ID NO: 803336 - RNA, 21 nt, Human
ggguggucugcugaagaggga

SEQ ID NO: 803337 - RNA, 18 nt, Human
cuccagagcugugagaca

SEQ ID NO: 803338 - RNA, 22 nt, Human
caggccuggagugcaauggcac

SEQ ID NO: 803339 - RNA, 22 nt, Human
cucuucaguuggucacuauucu

SEQ ID NO: 803340 - RNA, 22 nt, Human
ucagagucuuggcaauagguua

SEQ ID NO: 803341 - RNA, 20 nt, Human
ggcagagggccugggagaag

SEQ ID NO: 803342 - RNA, 22 nt, Human
aguggugagaccuggugcuuuc

SEQ ID NO: 803343 - RNA, 22 nt, Human
caugcauaugucaaaaaagcua

SEQ ID NO: 803344 - RNA, 22 nt, Human
caaauagauuguucaauccuga

SEQ ID NO: 803345 - RNA, 22 nt, Human
uacauuucagagcuccucucug

SEQ ID NO: 803346 - RNA, 22 nt, Human
auuuugaagggaauugaaguuc

SEQ ID NO: 803347 - RNA, 22 nt, Human
ugguggucaaagccaguguucu

SEQ ID NO: 803348 - RNA, 22 nt, Human
auguuaggcaaucuuucuuguu

SEQ ID NO: 803349 - RNA, 22 nt, Human
ugggcaggauaauaucucaugu

SEQ ID NO: 803350 - RNA, 22 nt, Human
cagaggugcuggagugaguccu

SEQ ID NO: 803351 - RNA, 22 nt, Human
uuuuuauaccaccucucacuua

SEQ ID NO: 803352 - RNA, 22 nt, Human
caggagcucuuaaggaugugau

SEQ ID NO: 803353 - RNA, 22 nt, Human
guguuuuauggagucauaacgu

SEQ ID NO: 803354 - RNA, 22 nt, Human
ugggaguguucuuggcuugcuu

SEQ ID NO: 803355 - RNA, 22 nt, Human
ugauucaauaggaauugaguag

SEQ ID NO: 803356 - RNA, 22 nt, Human
ugaaggaaagagggaacauccc

SEQ ID NO: 803357 - RNA, 22 nt, Human
cccaaccagaaauugacagaga

SEQ ID NO: 803358 - RNA, 22 nt, Human
uacacuuguucaaacagcaaaa

SEQ ID NO: 803359 - RNA, 22 nt, Human
gcagaagcagggcaggggcaaa

SEQ ID NO: 803360 - RNA, 22 nt, Human
uccuuacaacuuguuauuuuuc

SEQ ID NO: 803361 - RNA, 22 nt, Human
cuuuggcugacgaggaggaggc

SEQ ID NO: 803362 - RNA, 22 nt, Human
cuucaguguccucucuaguaga

SEQ ID NO: 803363 - RNA, 22 nt, Human
gcuccuguuuucuuccagaaau

SEQ ID NO: 803364 - RNA, 22 nt, Human
acagugauaaaauuucacaugu

SEQ ID NO: 803365 - RNA, 17 nt, Human
gcucugccucucccacc

SEQ ID NO: 803366 - RNA, 22 nt, Human
ucagagaagacaucauugugaa

SEQ ID NO: 803367 - RNA, 22 nt, Human
cugcaaggcuggggugagcugg

SEQ ID NO: 803368 - RNA, 22 nt, Human
acaauaacuucuguuuccuugc

SEQ ID NO: 803369 - RNA, 22 nt, Human
auucuuuacauuggcuucuucc

SEQ ID NO: 803370 - RNA, 22 nt, Human
uucugagaagggugggucuggc

SEQ ID NO: 803371 - RNA, 22 nt, Human
uggggaaacuauuuccuugucc

SEQ ID NO: 803372 - RNA, 22 nt, Human
ucagaaaaugaaauggacucuc

SEQ ID NO: 803373 - RNA, 22 nt, Human
uauauguguggauucuuguaga

SEQ ID NO: 803374 - RNA, 22 nt, Human
gccagaugccguaaagaugggc

SEQ ID NO: 803375 - RNA, 21 nt, Human
uuuaaggccagcaggagguga

SEQ ID NO: 803376 - RNA, 22 nt, Human
ucugagcuguaaguagacaagg

SEQ ID NO: 803377 - RNA, 22 nt, Human
uccaggccccugccugggccug

SEQ ID NO: 803378 - RNA, 22 nt, Human
augacucuccagagcugcagau

SEQ ID NO: 803379 - RNA, 22 nt, Human
ucaaagacuauauauuuuauuu

SEQ ID NO: 803380 - RNA, 22 nt, Human
ucugcacaggagggccguggug

SEQ ID NO: 803381 - RNA, 20 nt, Human
ccuggcugguggaggaaagg

SEQ ID NO: 803382 - RNA, 22 nt, Human
ggccucucuagcauccagccug

SEQ ID NO: 803383 - RNA, 22 nt, Human
ugaggaggucagagucuggcug

SEQ ID NO: 803384 - RNA, 22 nt, Human
ugaagcuuuaggauggguucau

SEQ ID NO: 803385 - RNA, 22 nt, Human
uuuccaaauaaggucacauucu

SEQ ID NO: 803386 - RNA, 22 nt, Human
cuggcuucagcugccaucaaug

SEQ ID NO: 803387 - RNA, 22 nt, Human
gcagcaggagaguuuguccugc

SEQ ID NO: 803388 - RNA, 22 nt, Human
auggagggugguaagacagaga

SEQ ID NO: 803389 - RNA, 22 nt, Human
uaaggcaggacuggauagcuau

SEQ ID NO: 803390 - RNA, 22 nt, Human
uuuauuaauguagcauccaugg

SEQ ID NO: 803391 - RNA, 22 nt, Human
augucugucuuuguacuccaca

SEQ ID NO: 803392 - RNA, 22 nt, Human
caguggcaugguugacugcagu

SEQ ID NO: 803393 - RNA, 22 nt, Human
caacauauuuuccaagagugaa

SEQ ID NO: 803394 - RNA, 22 nt, Human
acacaucaugccaaguuucacc

SEQ ID NO: 803395 - RNA, 22 nt, Human
aagcuuuaaggaauuuuaugga

SEQ ID NO: 803396 - RNA, 22 nt, Human
cuucucagcauuuugucagucu

SEQ ID NO: 803397 - RNA, 22 nt, Human
uguucuuaugaugaagcacuga

SEQ ID NO: 803398 - RNA, 22 nt, Human
cuuguaaaauauccaguuaagg

SEQ ID NO: 803399 - RNA, 20 nt, Human
uccagagaguggcaaagcuc

SEQ ID NO: 803400 - RNA, 22 nt, Human
uuaaauauuuucagcaggguca

SEQ ID NO: 803401 - RNA, 22 nt, Human
agcugcugccucacuggucugu

SEQ ID NO: 803402 - RNA, 22 nt, Human
aauaccuugcuguagccacgca

SEQ ID NO: 803403 - RNA, 22 nt, Human
aggaggugacagccugcaucug

SEQ ID NO: 803404 - RNA, 22 nt, Human
cagcuuuguggccuugaccucg

SEQ ID NO: 803405 - RNA, 22 nt, Human
uucuaaaaccaauucugcuucu

SEQ ID NO: 803406 - RNA, 22 nt, Human
ccugcccuucuuuccccagcau

SEQ ID NO: 803407 - RNA, 22 nt, Human
gggaagggacuuguuuaagguc

SEQ ID NO: 803408 - RNA, 22 nt, Human
cuuuaugacugaguugucaauu

SEQ ID NO: 803409 - RNA, 22 nt, Human
uucucaggcuguggagccgucu

SEQ ID NO: 803410 - RNA, 22 nt, Human
gcuggcugcuaggacagcuaca

SEQ ID NO: 803411 - RNA, 22 nt, Human
agagagaggcagcagugcucac

SEQ ID NO: 803412 - RNA, 22 nt, Human
ugcagcugccuagggcuggcuu

SEQ ID NO: 803413 - RNA, 22 nt, Human
uuucaugucugaauucuuuagu

SEQ ID NO: 803414 - RNA, 22 nt, Human
cucugacagguggcauuaucuc

SEQ ID NO: 803415 - RNA, 22 nt, Human
auuuuagagcuccaaguacagc

SEQ ID NO: 803416 - RNA, 23 nt, Human
ugcaaaauuugcagaguucgaug

SEQ ID NO: 803417 - RNA, 22 nt, Human
acaggcagagaacucagccaga

SEQ ID NO: 803418 - RNA, 22 nt, Human
gacaggaaaggggucuguuuuc

SEQ ID NO: 803419 - RNA, 22 nt, Human
aaggccaggcagggagcuguga

SEQ ID NO: 803420 - RNA, 22 nt, Human
aaauaagaaauucuucuuugca

SEQ ID NO: 803421 - RNA, 22 nt, Human
uaagaaacuaaugcaauaagag

SEQ ID NO: 803422 - RNA, 22 nt, Human
uggucaagauuacacacuggug

SEQ ID NO: 803423 - RNA, 22 nt, Human
cuccugggcugucggcgcucug

SEQ ID NO: 803424 - RNA, 22 nt, Human
ggcagugcaaggcagccuggau

SEQ ID NO: 803425 - RNA, 22 nt, Human
uaaaaucauucuggugucagua

SEQ ID NO: 803426 - RNA, 19 nt, Human
ugagugucacgucagugcc

SEQ ID NO: 803427 - RNA, 22 nt, Human
gugcaguugaagcauggggaga

SEQ ID NO: 803428 - RNA, 22 nt, Human
uugcagcugugagcuuuacacg

SEQ ID NO: 803429 - RNA, 22 nt, Human
uacaaagucuuggguucuaggc

SEQ ID NO: 803430 - RNA, 22 nt, Human
cagaggccaccuguggccacug

SEQ ID NO: 803431 - RNA, 22 nt, Human
cugguggagagugggcucugga

SEQ ID NO: 803432 - RNA, 22 nt, Human
gccacaugucaugugcucagua

SEQ ID NO: 803433 - RNA, 22 nt, Human
uucaguuuugcuuuuaaucaug

SEQ ID NO: 803434 - RNA, 22 nt, Human
ucccaggcuggcaggcagcagu

SEQ ID NO: 803435 - RNA, 22 nt, Human
cugguucauuagguauuagugg

SEQ ID NO: 803436 - RNA, 22 nt, Human
cuggcccaggagagcaggcauu

SEQ ID NO: 803437 - RNA, 22 nt, Human
agcuguggaagacugucagggu

SEQ ID NO: 803438 - RNA, 22 nt, Human
cccuuucccuucuggcucaggg

SEQ ID NO: 803439 - RNA, 22 nt, Human
ucagcagggaggcucugugccc

SEQ ID NO: 803440 - RNA, 22 nt, Human
gcaggcugagaguccaagaagg

SEQ ID NO: 803441 - RNA, 22 nt, Human
aaggcauugagcaguuacagua

SEQ ID NO: 803442 - RNA, 22 nt, Human
ucaugcuuauugcauauuugga

SEQ ID NO: 803443 - RNA, 22 nt, Human
ugaaacuaggccaaucaaauua

SEQ ID NO: 803444 - RNA, 22 nt, Human
ucccagggucaguggugaggcc

SEQ ID NO: 803445 - RNA, 22 nt, Human
uuuagaaugugacuguauuuga

SEQ ID NO: 803446 - RNA, 22 nt, Human
uuaguugauagccaaaauuuau

SEQ ID NO: 803447 - RNA, 22 nt, Human
aggccagggucccacacucgca

SEQ ID NO: 803448 - RNA, 22 nt, Human
guaaacaacacaaaucauuuga

SEQ ID NO: 803449 - RNA, 22 nt, Human
uugucugaaccaucucccuggc

SEQ ID NO: 803450 - RNA, 22 nt, Human
cccacaggcaggugcaugggcu

SEQ ID NO: 803451 - RNA, 22 nt, Human
uccagggauguccuguagcacu

SEQ ID NO: 803452 - RNA, 22 nt, Human
cacauccgaggagggugagaug

SEQ ID NO: 803453 - RNA, 22 nt, Human
gaagaaggaagaucaugcuuga

SEQ ID NO: 803454 - RNA, 20 nt, Human
auuguuucauuuaauguaca

SEQ ID NO: 803455 - RNA, 22 nt, Human
cagcagaguaauucucaccucu

SEQ ID NO: 803456 - RNA, 22 nt, Human
ccaggcucugccaggcccuuga

SEQ ID NO: 803457 - RNA, 22 nt, Human
cugccagcucaaagcgcagcua

SEQ ID NO: 803458 - RNA, 22 nt, Human
uccccagggcugcagagggugu

SEQ ID NO: 803459 - RNA, 22 nt, Human
ugcucacugaacucuugcuguc

SEQ ID NO: 803460 - RNA, 22 nt, Human
uauuuugacgauuuuaugcaaa

SEQ ID NO: 803461 - RNA, 22 nt, Human
uuucaaguuguugcauuaaaug

SEQ ID NO: 803462 - RNA, 22 nt, Human
ugagugaggcugggcagucccu

SEQ ID NO: 803463 - RNA, 22 nt, Human
cuggggagaagcgacucggcug

SEQ ID NO: 803464 - RNA, 22 nt, Human
agcaccugugugguagggaggu

SEQ ID NO: 803465 - RNA, 20 nt, Human
acguggccaccaguggcuua

SEQ ID NO: 803466 - RNA, 22 nt, Human
ugggaugaauacaaugggauca

SEQ ID NO: 803467 - RNA, 22 nt, Human
ugcacagaucugguggcaagga

SEQ ID NO: 803468 - RNA, 22 nt, Human
acacauacauggggaagaugag

SEQ ID NO: 803469 - RNA, 22 nt, Human
uccucugccaaagggaguugcc

SEQ ID NO: 803470 - RNA, 22 nt, Human
uggcaugauaggaggugcagaa

SEQ ID NO: 803471 - RNA, 22 nt, Human
ucuacagugucaaugugucuug

SEQ ID NO: 803472 - RNA, 22 nt, Human
ugucccuuuguguucugaaacu

SEQ ID NO: 803473 - RNA, 22 nt, Human
ggcacuggaagucccauugucu

SEQ ID NO: 803474 - RNA, 22 nt, Human
uagucuuucauuuggagcauuu

SEQ ID NO: 803475 - RNA, 22 nt, Human
ggaggcugagaggucgcagugg

SEQ ID NO: 803476 - RNA, 22 nt, Human
uugagaaauaagcaugucuaga

SEQ ID NO: 803477 - RNA, 22 nt, Human
gcagggaccaaaagaggcagua

SEQ ID NO: 803478 - RNA, 22 nt, Human
agccugccugugaggcuuugag

SEQ ID NO: 803479 - RNA, 22 nt, Human
uucauacucacuccaauaacug

SEQ ID NO: 803480 - RNA, 23 nt, Human
ggcagcuuauacuuucauagaca

SEQ ID NO: 803481 - RNA, 22 nt, Human
auuuacuggaaaaacuaugagc

SEQ ID NO: 803482 - RNA, 22 nt, Human
uuucuaguaaucaauauaaagu

SEQ ID NO: 803483 - RNA, 22 nt, Human
cacagguguguccuggucuugu

SEQ ID NO: 803484 - RNA, 22 nt, Human
aaagugauuaugcugucaaaga

SEQ ID NO: 803485 - RNA, 23 nt, Human
caguggucagaacgugggagggu

SEQ ID NO: 803486 - RNA, 22 nt, Human
uuucacauguauauaggcauua

SEQ ID NO: 803487 - RNA, 22 nt, Human
gcuccuggcaggcagugugugu

SEQ ID NO: 803488 - RNA, 22 nt, Human
auuuaauuuacauuugacagag

SEQ ID NO: 803489 - RNA, 22 nt, Human
uugauucauuuauugagugccu

SEQ ID NO: 803490 - RNA, 22 nt, Human
gccacagcccgagcaccaugag

SEQ ID NO: 803491 - RNA, 21 nt, Human
uccugccuuaguccagagcag

SEQ ID NO: 803492 - RNA, 22 nt, Human
ucauacaacuaagaguuucaga

SEQ ID NO: 803493 - RNA, 22 nt, Human
aggagccagcguuccucaggau

SEQ ID NO: 803494 - RNA, 22 nt, Human
gcaggcuucaagcacagcuuuu

SEQ ID NO: 803495 - RNA, 22 nt, Human
acagaaguggcuucaaagagca

SEQ ID NO: 803496 - RNA, 22 nt, Human
ucuauaaauuaugcagucucag

SEQ ID NO: 803497 - RNA, 22 nt, Human
uagucacaugaucacaggaucg

SEQ ID NO: 803498 - RNA, 22 nt, Human
gagggccuacuggacaugucag

SEQ ID NO: 803499 - RNA, 22 nt, Human
aaggaagagcaaagaauuaugu

SEQ ID NO: 803500 - RNA, 22 nt, Human
ggcuggcagaagugugcuggcu

SEQ ID NO: 803501 - RNA, 22 nt, Human
uaguacaguggcauucaaacuu

SEQ ID NO: 803502 - RNA, 22 nt, Human
uucaagucuuccaugguauucu

SEQ ID NO: 803503 - RNA, 22 nt, Human
ggcagauggaaugagcugucua

SEQ ID NO: 803504 - RNA, 22 nt, Human
ugccugggccuucccaccucug

SEQ ID NO: 803505 - RNA, 22 nt, Human
cuggcaggcggagguugcagug

SEQ ID NO: 803506 - RNA, 22 nt, Human
gugcuugcagugagaugagaug

SEQ ID NO: 803507 - RNA, 22 nt, Human
cccagguguuuguggcagaggu

SEQ ID NO: 803508 - RNA, 20 nt, Human
ccuggcugcauucaggacgg

SEQ ID NO: 803509 - RNA, 22 nt, Human
acaaugcaccagcaucuucacc

SEQ ID NO: 803510 - RNA, 22 nt, Human
uuuauugaguaucuacuaugug

SEQ ID NO: 803511 - RNA, 22 nt, Human
cuggaaguuuccuuccugguca

SEQ ID NO: 803512 - RNA, 22 nt, Human
auuucuguuugcuacuauaagu

SEQ ID NO: 803513 - RNA, 22 nt, Human
aaggcucccucuucucgagugu

SEQ ID NO: 803514 - RNA, 22 nt, Human
auucaucuguacuucaauaucu

SEQ ID NO: 803515 - RNA, 22 nt, Human
caauucuuucagcugcauuugu

SEQ ID NO: 803516 - RNA, 22 nt, Human
ccagcccugucaccaacuggag

SEQ ID NO: 803517 - RNA, 22 nt, Human
gagccccaggacagcucuaguu

SEQ ID NO: 803518 - RNA, 22 nt, Human
ccugggcuuucggcggcuuccu

SEQ ID NO: 803519 - RNA, 22 nt, Human
cagcuuuagagaaaacauauuu

SEQ ID NO: 803520 - RNA, 22 nt, Human
auucagcaguuccugcuucagu

SEQ ID NO: 803521 - RNA, 21 nt, Human
aaucaaaugucauauccccag

SEQ ID NO: 803522 - RNA, 22 nt, Human
uaaggaagucacaagaaucgcu

SEQ ID NO: 803523 - RNA, 22 nt, Human
ggccccagccucaguccccuga

SEQ ID NO: 803524 - RNA, 22 nt, Human
ugcaacuaggagguucuuagcu

SEQ ID NO: 803525 - RNA, 22 nt, Human
ugaaggcccagccacagaaugg

SEQ ID NO: 803526 - RNA, 22 nt, Human
ucagaauuggaacgugaagauu

SEQ ID NO: 803527 - RNA, 22 nt, Human
ugcagcugcaggagggugggag

SEQ ID NO: 803528 - RNA, 22 nt, Human
aaaaauagcuucucuugucccu

SEQ ID NO: 803529 - RNA, 22 nt, Human
aggagcuggaguccaggcaagu

SEQ ID NO: 803530 - RNA, 22 nt, Human
aucacaucucaccacugcaacc

SEQ ID NO: 803531 - RNA, 22 nt, Human
agcaaacagugugcuaagaaau

SEQ ID NO: 803532 - RNA, 22 nt, Human
cauggccagggcagauggcagg

SEQ ID NO: 803533 - RNA, 22 nt, Human
guuuccuuuuucugcccucaau

SEQ ID NO: 803534 - RNA, 22 nt, Human
cuggcccuggagggcugugcga

SEQ ID NO: 803535 - RNA, 22 nt, Human
agacagcaauaugggagacgga

SEQ ID NO: 803536 - RNA, 22 nt, Human
gcccaggccggagagcagugcu

SEQ ID NO: 803537 - RNA, 22 nt, Human
ucaggcugguccccacagugga

SEQ ID NO: 803538 - RNA, 22 nt, Human
ugccucugcugcuguggcauca

SEQ ID NO: 803539 - RNA, 22 nt, Human
aaaauucauuccucagacugcc

SEQ ID NO: 803540 - RNA, 22 nt, Human
ccuuggcuguguugccugcccu

SEQ ID NO: 803541 - RNA, 22 nt, Human
aacauucuuaagauuugugucu

SEQ ID NO: 803542 - RNA, 22 nt, Human
uuuauauagagauuugugcaug

SEQ ID NO: 803543 - RNA, 22 nt, Human
cugcagcuggcucaugggauau

SEQ ID NO: 803544 - RNA, 22 nt, Human
gggaggcuggcucuggccacag

SEQ ID NO: 803545 - RNA, 22 nt, Human
gagccagcagccggcaccacca

SEQ ID NO: 803546 - RNA, 22 nt, Human
cucagaaguucagccuagagua

SEQ ID NO: 803547 - RNA, 22 nt, Human
aaugcaagaucaaaucuaacac

SEQ ID NO: 803548 - RNA, 22 nt, Human
uuuuuucagccugucugugcca

SEQ ID NO: 803549 - RNA, 18 nt, Human
aaguaacagaagagcaca

SEQ ID NO: 803550 - RNA, 22 nt, Human
aagugauucuagucaugauucu

SEQ ID NO: 803551 - RNA, 22 nt, Human
ccggggugcgaggagcgucuuu

SEQ ID NO: 803552 - RNA, 22 nt, Human
cuuguaauagauaggaucaaau

SEQ ID NO: 803553 - RNA, 22 nt, Human
ugcaucuuuuuccaaguuuauu

SEQ ID NO: 803554 - RNA, 22 nt, Human
ccccaggagauuugggagcaca

SEQ ID NO: 803555 - RNA, 22 nt, Human
cagcuuugucugauuccucuuu

SEQ ID NO: 803556 - RNA, 22 nt, Human
auguuucugaaguuuacagaua

SEQ ID NO: 803557 - RNA, 22 nt, Human
aagugcaugguauggucuccau

SEQ ID NO: 803558 - RNA, 22 nt, Human
auucuuauuaaauagccagaag

SEQ ID NO: 803559 - RNA, 22 nt, Human
aucuuuggccacuugugcugca

SEQ ID NO: 803560 - RNA, 18 nt, Human
ugcaaauggcuguuugau

SEQ ID NO: 803561 - RNA, 22 nt, Human
ucaggcaccccuugaguagggg

SEQ ID NO: 803562 - RNA, 22 nt, Human
guggagggugagcucauguuug

SEQ ID NO: 803563 - RNA, 22 nt, Human
uuuugucagugagaacagaguu

SEQ ID NO: 803564 - RNA, 22 nt, Human
aaagugcacucucagugcugcu

SEQ ID NO: 803565 - RNA, 22 nt, Human
cuuuuccuauugauucuguuac

SEQ ID NO: 803566 - RNA, 22 nt, Human
cuguccccugugcuuucacuug

SEQ ID NO: 803567 - RNA, 22 nt, Human
uuccauuuggcacuucacugag

SEQ ID NO: 803568 - RNA, 22 nt, Human
cagggcagggauguugcggcag

SEQ ID NO: 803569 - RNA, 22 nt, Human
acuuuacaauauccugugacuu

SEQ ID NO: 803570 - RNA, 22 nt, Human
ugauuaaguucaaaauauagaa

SEQ ID NO: 803571 - RNA, 22 nt, Human
ucauacaucuuguauaucuauc

SEQ ID NO: 803572 - RNA, 22 nt, Human
acaguuuaggaugagagaacac

SEQ ID NO: 803573 - RNA, 22 nt, Human
ucuacauuuucuuuauguacau

SEQ ID NO: 803574 - RNA, 17 nt, Human
ugaguggccgggggaca

SEQ ID NO: 803575 - RNA, 22 nt, Human
cucuucaguaaaugacacuguu

SEQ ID NO: 803576 - RNA, 22 nt, Human
uugcuuauuugauuaaaugucu

SEQ ID NO: 803577 - RNA, 22 nt, Human
caggccagagcgcgugguuggg

SEQ ID NO: 803578 - RNA, 22 nt, Human
caagagcucaccggagagcauu

SEQ ID NO: 803579 - RNA, 22 nt, Human
acuggcugaaguuuacuuuuug

SEQ ID NO: 803580 - RNA, 22 nt, Human
ccugugcuggcuuuauucucag

SEQ ID NO: 803581 - RNA, 22 nt, Human
gggaugagaguagggugugaaa

SEQ ID NO: 803582 - RNA, 22 nt, Human
gagguggcuggcucagagccag

SEQ ID NO: 803583 - RNA, 22 nt, Human
caccugagugucaguauucuca

SEQ ID NO: 803584 - RNA, 22 nt, Human
ugcuuaaaaacaguaugguagu

SEQ ID NO: 803585 - RNA, 19 nt, Human
uuccacuuggguuagaauu

SEQ ID NO: 803586 - RNA, 22 nt, Human
ugcauguuaagaaaauauugag

SEQ ID NO: 803587 - RNA, 22 nt, Human
ccaggcugcuguugguguccgc

SEQ ID NO: 803588 - RNA, 22 nt, Human
ccuguuuaucuaucuagagaug

SEQ ID NO: 803589 - RNA, 22 nt, Human
agucaagauucuggcacuagca

SEQ ID NO: 803590 - RNA, 22 nt, Human
ucuucaaaugcuaguaauauca

SEQ ID NO: 803591 - RNA, 22 nt, Human
aggcuugguuuauagaaguaau

SEQ ID NO: 803592 - RNA, 22 nt, Human
gcuuaaaauccaugauuuuuac

SEQ ID NO: 803593 - RNA, 22 nt, Human
gcucagagcccgaggcuugcau

SEQ ID NO: 803594 - RNA, 22 nt, Human
ugcacaccucuccaccacucuc

SEQ ID NO: 803595 - RNA, 19 nt, Human
ggacacagaaagcugcauu

SEQ ID NO: 803596 - RNA, 22 nt, Human
gcaggcugggguagccccacuu

SEQ ID NO: 803597 - RNA, 22 nt, Human
aaaaaugaauucuucaguggca

SEQ ID NO: 803598 - RNA, 22 nt, Human
ccaggccucaccugcccaccua

SEQ ID NO: 803599 - RNA, 22 nt, Human
gagcuuugaucgcuaagccuca

SEQ ID NO: 803600 - RNA, 22 nt, Human
caggccaggugcucuagaauca

SEQ ID NO: 803601 - RNA, 22 nt, Human
uaaacaugcccagugacaggga

SEQ ID NO: 803602 - RNA, 21 nt, Human
agucuucuccagaggcugggg

SEQ ID NO: 803603 - RNA, 19 nt, Human
agugaaauggaguauucaa

SEQ ID NO: 803604 - RNA, 22 nt, Human
aauagacauuauuucucuauga

SEQ ID NO: 803605 - RNA, 21 nt, Human
ugcagcugacacugguaugcc

SEQ ID NO: 803606 - RNA, 22 nt, Human
uucagugugccuaagucaguug

SEQ ID NO: 803607 - RNA, 22 nt, Human
ccacagggccuuuccugcuggc

SEQ ID NO: 803608 - RNA, 22 nt, Human
agccuggcacugccccauccau

SEQ ID NO: 803609 - RNA, 22 nt, Human
auuuccaguacuauuuucugcu

SEQ ID NO: 803610 - RNA, 22 nt, Human
guuucucaaauuauuucagcuu

SEQ ID NO: 803611 - RNA, 18 nt, Human
cuggagucacagugggga

SEQ ID NO: 803612 - RNA, 22 nt, Human
ucuuuguguucaggagccacgu

SEQ ID NO: 803613 - RNA, 22 nt, Human
gaagccaggggccugacaggca

SEQ ID NO: 803614 - RNA, 22 nt, Human
caauaauauccugugcuguuug

SEQ ID NO: 803615 - RNA, 22 nt, Human
ccagggucuucgaggcagcaau

SEQ ID NO: 803616 - RNA, 22 nt, Human
ugcuuccaguuccucaccacau

SEQ ID NO: 803617 - RNA, 22 nt, Human
uuacuguaaaggucacauggug

SEQ ID NO: 803618 - RNA, 20 nt, Human
caaggcagaccagagugagu

SEQ ID NO: 803619 - RNA, 22 nt, Human
cugggcugcaggaguggggcaa

SEQ ID NO: 803620 - RNA, 22 nt, Human
cucuccaggagcucagagucua

SEQ ID NO: 803621 - RNA, 22 nt, Human
aggggaaaucucucgccaucug

SEQ ID NO: 803622 - RNA, 22 nt, Human
gagcuggcugugguugagugca

SEQ ID NO: 803623 - RNA, 22 nt, Human
aagcacaggagacgcacagcca

SEQ ID NO: 803624 - RNA, 22 nt, Human
caugcaggucuggagcuugggg

SEQ ID NO: 803625 - RNA, 22 nt, Human
acaguguacuccuuuaccggag

SEQ ID NO: 803626 - RNA, 22 nt, Human
guuucuuuugugaucaccaacc

SEQ ID NO: 803627 - RNA, 22 nt, Human
uccaggagguugagugaguucc

SEQ ID NO: 803628 - RNA, 22 nt, Human
cuggcuggucugagcagucgca

SEQ ID NO: 803629 - RNA, 22 nt, Human
cagugaguucaucaagacauga

SEQ ID NO: 803630 - RNA, 22 nt, Human
uuucuucuugaguaaccagauu

SEQ ID NO: 803631 - RNA, 22 nt, Human
cccucugccugcgcccuggugu

SEQ ID NO: 803632 - RNA, 21 nt, Human
gcagggacaaagcuucaggag

SEQ ID NO: 803633 - RNA, 22 nt, Human
augaauaaaacauuuuaaucag

SEQ ID NO: 803634 - RNA, 22 nt, Human
uaaaucacuguacuuuauuccu

SEQ ID NO: 803635 - RNA, 20 nt, Human
cacaggaaagcuacucaguu

SEQ ID NO: 803636 - RNA, 22 nt, Human
agcagggggcauccuugcccuu

SEQ ID NO: 803637 - RNA, 22 nt, Human
ugacaaaccaguagcaauaaag

SEQ ID NO: 803638 - RNA, 22 nt, Human
uaagucaguagaacugugguca

SEQ ID NO: 803639 - RNA, 20 nt, Human
aacauugcuucaauguaacc

SEQ ID NO: 803640 - RNA, 22 nt, Human
cagcauggguuccgggggccug

SEQ ID NO: 803641 - RNA, 22 nt, Human
auuagaaugacagaaaugaggc

SEQ ID NO: 803642 - RNA, 22 nt, Human
uaagaguuagggcuagcaauau

SEQ ID NO: 803643 - RNA, 22 nt, Human
auaaccuuggcuaguauugugc

SEQ ID NO: 803644 - RNA, 22 nt, Human
cuauaaaucuacccagcauugg

SEQ ID NO: 803645 - RNA, 22 nt, Human
caggguccccgggucuccugug

SEQ ID NO: 803646 - RNA, 22 nt, Human
gaaaauaggcugcaucuccuuc

SEQ ID NO: 803647 - RNA, 22 nt, Human
auacaguauaacuaauaaaccc

SEQ ID NO: 803648 - RNA, 22 nt, Human
cagcuuggaggaggaucuaaga

SEQ ID NO: 803649 - RNA, 22 nt, Human
cauugagaaucugggcuacagc

SEQ ID NO: 803650 - RNA, 22 nt, Human
ucuuuuguagcuaacacauuca

SEQ ID NO: 803651 - RNA, 22 nt, Human
gcuaugaacaugagaaugcaaa

SEQ ID NO: 803652 - RNA, 19 nt, Human
gcuaggugaccagcuggau

SEQ ID NO: 803653 - RNA, 22 nt, Human
cugacagaugcugcuggcagua

SEQ ID NO: 803654 - RNA, 22 nt, Human
uggggugagauucagauauuca

SEQ ID NO: 803655 - RNA, 22 nt, Human
caucuuugaacucuguauaaac

SEQ ID NO: 803656 - RNA, 23 nt, Human
ugcugggguaguuuguggcacag

SEQ ID NO: 803657 - RNA, 22 nt, Human
acagcagguuacaguggcacag

SEQ ID NO: 803658 - RNA, 22 nt, Human
cugaccaggguagaggugagag

SEQ ID NO: 803659 - RNA, 22 nt, Human
uguuuugguuuucaccgagucc

SEQ ID NO: 803660 - RNA, 22 nt, Human
gccaguggguaguuggagcugg

SEQ ID NO: 803661 - RNA, 22 nt, Human
ggcagcacugcagcuuguuggg

SEQ ID NO: 803662 - RNA, 22 nt, Human
guccugugggcccaccaugagc

SEQ ID NO: 803663 - RNA, 22 nt, Human
ccucagggccaucucugucccu

SEQ ID NO: 803664 - RNA, 22 nt, Human
acucuguagccuguaagagagc

SEQ ID NO: 803665 - RNA, 22 nt, Human
ccaggacagugaacauguaaga

SEQ ID NO: 803666 - RNA, 22 nt, Human
aaaaauguuaucuacuguccga

SEQ ID NO: 803667 - RNA, 22 nt, Human
uccucccugcacucagugaagu

SEQ ID NO: 803668 - RNA, 22 nt, Human
aggcugugagaaguccuucagu

SEQ ID NO: 803669 - RNA, 22 nt, Human
gaugaacauauuccucuccaga

SEQ ID NO: 803670 - RNA, 19 nt, Human
ccaggagcaguggugagcu

SEQ ID NO: 803671 - RNA, 22 nt, Human
gugcuagggacaaagcagugaa

SEQ ID NO: 803672 - RNA, 22 nt, Human
aaugugucccuuauuucacagg

SEQ ID NO: 803673 - RNA, 22 nt, Human
ucugagagauacaaggaggcaa

SEQ ID NO: 803674 - RNA, 22 nt, Human
caaagucauaaaacuuguaagu

SEQ ID NO: 803675 - RNA, 22 nt, Human
auuucagauucagaaauguagg

SEQ ID NO: 803676 - RNA, 22 nt, Human
gaauuggggguuuugcaaggca

SEQ ID NO: 803677 - RNA, 22 nt, Human
gggugggaucuguggagccuca

SEQ ID NO: 803678 - RNA, 22 nt, Human
aaacugcaauuauuuuugcaau

SEQ ID NO: 803679 - RNA, 22 nt, Human
cugcagaggguuugagcauccu

SEQ ID NO: 803680 - RNA, 22 nt, Human
gaggagcuguucccucaccucu

SEQ ID NO: 803681 - RNA, 22 nt, Human
uuagauaauguagagauaugag

SEQ ID NO: 803682 - RNA, 21 nt, Human
uucuucaugaugauuaauggc

SEQ ID NO: 803683 - RNA, 22 nt, Human
ugacucuuaaauauacuguuga

SEQ ID NO: 803684 - RNA, 22 nt, Human
ucucuucuugauuuucacugga

SEQ ID NO: 803685 - RNA, 20 nt, Human
cuugcccagggucuccugcc

SEQ ID NO: 803686 - RNA, 22 nt, Human
ucaguguaaguuauguagaugu

SEQ ID NO: 803687 - RNA, 22 nt, Human
cagugcuuuuuuaccuuccaac

SEQ ID NO: 803688 - RNA, 22 nt, Human
ucagggcagguuaacuugggug

SEQ ID NO: 803689 - RNA, 22 nt, Human
agcuguggcagcagccguggca

SEQ ID NO: 803690 - RNA, 22 nt, Human
ccuccugggcuccugucugcac

SEQ ID NO: 803691 - RNA, 22 nt, Human
gcugugagggcuucugaggcau

SEQ ID NO: 803692 - RNA, 19 nt, Human
ucuaaacacagggacaagc

SEQ ID NO: 803693 - RNA, 22 nt, Human
auauuaauuauuuacacaugag

SEQ ID NO: 803694 - RNA, 22 nt, Human
cccaggcagccugcagggaagg

SEQ ID NO: 803695 - RNA, 22 nt, Human
ucaguguuacauuauauagaac

SEQ ID NO: 803696 - RNA, 22 nt, Human
auguauuucuauguagugaaga

SEQ ID NO: 803697 - RNA, 22 nt, Human
ugauaaacuggagagguggagg

SEQ ID NO: 803698 - RNA, 22 nt, Human
agucucuuuugcgaagaguguu

SEQ ID NO: 803699 - RNA, 22 nt, Human
uguucugggguugagagacaau

SEQ ID NO: 803700 - RNA, 22 nt, Human
aacugcaagaguaaaugucuag

SEQ ID NO: 803701 - RNA, 22 nt, Human
acauuugagcauauuucuuguc

SEQ ID NO: 803702 - RNA, 22 nt, Human
uuagcuaaacuguaacuagaau

SEQ ID NO: 803703 - RNA, 22 nt, Human
agcaggguuccuuaaggccaua

SEQ ID NO: 803704 - RNA, 18 nt, Human
agucuucugauccauuuu

SEQ ID NO: 803705 - RNA, 22 nt, Human
cacuggaaguucauucucagaa

SEQ ID NO: 803706 - RNA, 22 nt, Human
caucagagugguggccuggugu

SEQ ID NO: 803707 - RNA, 22 nt, Human
gcugggcuguaguuugcugacc

SEQ ID NO: 803708 - RNA, 23 nt, Human
ugccacccuucucuucccagcuu

SEQ ID NO: 803709 - RNA, 22 nt, Human
ugaaacauuauagaauauuuau

SEQ ID NO: 803710 - RNA, 19 nt, Human
aaaucagaaucugcauuuu

SEQ ID NO: 803711 - RNA, 22 nt, Human
ggcugugguggcaucccugagc

SEQ ID NO: 803712 - RNA, 22 nt, Human
cagagauuauuauaacuaauua

SEQ ID NO: 803713 - RNA, 22 nt, Human
uugcaaaucagaaguauagauu

SEQ ID NO: 803714 - RNA, 23 nt, Human
uccucccaaauuucagccucauu

SEQ ID NO: 803715 - RNA, 22 nt, Human
ucucaaggacuuugggcacuaa

SEQ ID NO: 803716 - RNA, 22 nt, Human
auauuaaugagcaaguaaguga

SEQ ID NO: 803717 - RNA, 22 nt, Human
caagcaggaugaagcccaggga

SEQ ID NO: 803718 - RNA, 23 nt, Human
uggggagggaagucauuucugua

SEQ ID NO: 803719 - RNA, 22 nt, Human
cucugcugucucagaugggcca

SEQ ID NO: 803720 - RNA, 19 nt, Human
gccugccuggguuucugag

SEQ ID NO: 803721 - RNA, 22 nt, Human
ggcucccugggugcuccugcuc

SEQ ID NO: 803722 - RNA, 22 nt, Human
uauauuauaagcccuuucagaa

SEQ ID NO: 803723 - RNA, 22 nt, Human
uggucagaacucagcgugcuug

SEQ ID NO: 803724 - RNA, 22 nt, Human
aagcaggcuagauugaagggcu

SEQ ID NO: 803725 - RNA, 22 nt, Human
uucaguguauauuuuuugagua

SEQ ID NO: 803726 - RNA, 22 nt, Human
caggcucagaagccaguggagc

SEQ ID NO: 803727 - RNA, 22 nt, Human
agaaaagguugaaaguaggauu

SEQ ID NO: 803728 - RNA, 19 nt, Human
acuccagggaugacagaag

SEQ ID NO: 803729 - RNA, 22 nt, Human
ugcagccuugccuccucccagc

SEQ ID NO: 803730 - RNA, 22 nt, Human
caggcuccuucccagggauggu

SEQ ID NO: 803731 - RNA, 20 nt, Human
aacucagagaugaaaaagac

SEQ ID NO: 803732 - RNA, 22 nt, Human
ucaccuaauugaagucaggagu

SEQ ID NO: 803733 - RNA, 22 nt, Human
gccccaggauaaauuuguaaga

SEQ ID NO: 803734 - RNA, 22 nt, Human
gaaaauguuuccuguuauuugc

SEQ ID NO: 803735 - RNA, 22 nt, Human
aaaugcuugcucuugauuauuu

SEQ ID NO: 803736 - RNA, 22 nt, Human
ucaguucuuuauuucacaguga

SEQ ID NO: 803737 - RNA, 22 nt, Human
gaguccaguuguucacagaggc

SEQ ID NO: 803738 - RNA, 22 nt, Human
ccacaggcggaguggcgggcag

SEQ ID NO: 803739 - RNA, 22 nt, Human
cugggagcuggaaugggagaag

SEQ ID NO: 803740 - RNA, 22 nt, Human
auaaacaguaaaugugagcagu

SEQ ID NO: 803741 - RNA, 22 nt, Human
uaggcuuguuacaaaacaguca

SEQ ID NO: 803742 - RNA, 22 nt, Human
gggagcauaaacucagauuuca

SEQ ID NO: 803743 - RNA, 22 nt, Human
aaucaagucaaccaucaugugc

SEQ ID NO: 803744 - RNA, 20 nt, Human
uauauuuucucuuuggccuu

SEQ ID NO: 803745 - RNA, 22 nt, Human
uacagagggauuaucuaagggu

SEQ ID NO: 803746 - RNA, 22 nt, Human
gugcucuaggaccuuagaagug

SEQ ID NO: 803747 - RNA, 22 nt, Human
gcagagcuguuaauggagcuga

SEQ ID NO: 803748 - RNA, 22 nt, Human
aaucaggagugugcacuuugau

SEQ ID NO: 803749 - RNA, 22 nt, Human
cugaguuuccagauaagaccuu

SEQ ID NO: 803750 - RNA, 22 nt, Human
gcccucagcauccucagggcca

SEQ ID NO: 803751 - RNA, 22 nt, Human
caguguggagggagagagccug

SEQ ID NO: 803752 - RNA, 22 nt, Human
gaggaccuuuaguagaagugca

SEQ ID NO: 803753 - RNA, 22 nt, Human
cugggcugcuguccacuagggu

SEQ ID NO: 803754 - RNA, 21 nt, Human
gcuggcuuuccuggaugugca

SEQ ID NO: 803755 - RNA, 22 nt, Human
uauuugaaggcauacauuuuga

SEQ ID NO: 803756 - RNA, 22 nt, Human
gccuggcauuacagcacuccug

SEQ ID NO: 803757 - RNA, 22 nt, Human
aauaacuucaucuucaggauag

SEQ ID NO: 803758 - RNA, 20 nt, Human
uucuugagccaaaaggcaua

SEQ ID NO: 803759 - RNA, 22 nt, Human
ucaggcagaguggaagcugcaa

SEQ ID NO: 803760 - RNA, 22 nt, Human
uuuacauguaauguuauacaaa

SEQ ID NO: 803761 - RNA, 22 nt, Human
gccugcugccacccuggcuccg

SEQ ID NO: 803762 - RNA, 21 nt, Human
cacaugcaugcacagguugua

SEQ ID NO: 803763 - RNA, 22 nt, Human
caucaggaaaggacgucuagcc

SEQ ID NO: 803764 - RNA, 22 nt, Human
ugggucacuauuugcagagacg

SEQ ID NO: 803765 - RNA, 22 nt, Human
auuauucagucuuguaaggagu

SEQ ID NO: 803766 - RNA, 22 nt, Human
ucaguauuccuggaaauacaag

SEQ ID NO: 803767 - RNA, 22 nt, Human
gucccuggagcugagcagugcu

SEQ ID NO: 803768 - RNA, 22 nt, Human
uaguuuuaugaauugguauaau

SEQ ID NO: 803769 - RNA, 20 nt, Human
auguucuucauuuaauguuc

SEQ ID NO: 803770 - RNA, 22 nt, Human
aggcaagcagucagucuaugag

SEQ ID NO: 803771 - RNA, 22 nt, Human
guucacauccuugugaggauuu

SEQ ID NO: 803772 - RNA, 19 nt, Human
cucuuggguggcagaggcc

SEQ ID NO: 803773 - RNA, 18 nt, Human
cugucccauccucagguu

SEQ ID NO: 803774 - RNA, 22 nt, Human
gcagggcuaggucuucuagggc

SEQ ID NO: 803775 - RNA, 22 nt, Human
agucuacaguucccucaggucc

SEQ ID NO: 803776 - RNA, 22 nt, Human
aggcuggcaaggcagaugugug

SEQ ID NO: 803777 - RNA, 22 nt, Human
uaguuaaagauucuguuaagag

SEQ ID NO: 803778 - RNA, 22 nt, Human
ccuggccuccuggccuucucau

SEQ ID NO: 803779 - RNA, 22 nt, Human
ucuugggcauguguuugauuuc

SEQ ID NO: 803780 - RNA, 22 nt, Human
acaggcugguuuguaaaagaug

SEQ ID NO: 803781 - RNA, 22 nt, Human
agaagcagggcagggaaaagca

SEQ ID NO: 803782 - RNA, 22 nt, Human
uuuuucaucugauugauaacuc

SEQ ID NO: 803783 - RNA, 22 nt, Human
uuucauugaugggugauagaaa

SEQ ID NO: 803784 - RNA, 22 nt, Human
aaggccagaguugaacugcucc

SEQ ID NO: 803785 - RNA, 22 nt, Human
cagagcugagaauguugaugcu

SEQ ID NO: 803786 - RNA, 22 nt, Human
ucauguauuugugauagaugac

SEQ ID NO: 803787 - RNA, 18 nt, Human
aucuuuccauagcauguu

SEQ ID NO: 803788 - RNA, 22 nt, Human
ucucaggagccacagcgggagu

SEQ ID NO: 803789 - RNA, 22 nt, Human
uacaaagugaaauaauucugag

SEQ ID NO: 803790 - RNA, 22 nt, Human
gacuccaggugcaggaggagcc

SEQ ID NO: 803791 - RNA, 22 nt, Human
acaaauagaaaaucuggauugg

SEQ ID NO: 803792 - RNA, 22 nt, Human
acaguguauauuguuuaucugg

SEQ ID NO: 803793 - RNA, 22 nt, Human
ggcagcagggcugucucccuac

SEQ ID NO: 803794 - RNA, 22 nt, Human
gcccucagaguuccccacagug

SEQ ID NO: 803795 - RNA, 18 nt, Human
cuuguucuucucuuggcg

SEQ ID NO: 803796 - RNA, 22 nt, Human
cucugggcaggacgccaggccu

SEQ ID NO: 803797 - RNA, 22 nt, Human
agggcuggcuaggugcguuccc

SEQ ID NO: 803798 - RNA, 22 nt, Human
cagccccucacagagcuguccu

SEQ ID NO: 803799 - RNA, 22 nt, Human
cagaguggagauguguguggaa

SEQ ID NO: 803800 - RNA, 22 nt, Human
aggcuggcuuggcucuccugug

SEQ ID NO: 803801 - RNA, 22 nt, Human
uguaaacaaaugcauucuugcu

SEQ ID NO: 803802 - RNA, 22 nt, Human
acagaggaagcauauagcacaa

SEQ ID NO: 803803 - RNA, 22 nt, Human
gagcucuuauaguucuagcagu

SEQ ID NO: 803804 - RNA, 20 nt, Human
uccuggccuucucgggcagu

SEQ ID NO: 803805 - RNA, 22 nt, Human
auugagaaaggcuuauguuugc

SEQ ID NO: 803806 - RNA, 22 nt, Human
uuuuaaugggcgacuauuaugg

SEQ ID NO: 803807 - RNA, 22 nt, Human
uacuguuagagccagaaaccua

SEQ ID NO: 803808 - RNA, 23 nt, Human
gcugugcacgagccacugccugu

SEQ ID NO: 803809 - RNA, 22 nt, Human
aacuccagugucagcugcaaug

SEQ ID NO: 803810 - RNA, 22 nt, Human
ucugcagcuuuuugguggggug

SEQ ID NO: 803811 - RNA, 22 nt, Human
gaaggcuuccugaugccaacca

SEQ ID NO: 803812 - RNA, 22 nt, Human
uaaggcccgugaguuucauauc

SEQ ID NO: 803813 - RNA, 17 nt, Human
auaaaggcaaguauuau

SEQ ID NO: 803814 - RNA, 22 nt, Human
agcaaaauaagguaauuuauug

SEQ ID NO: 803815 - RNA, 22 nt, Human
ucuguagguuaaaaguagacaa

SEQ ID NO: 803816 - RNA, 22 nt, Human
ugcaggguagaugcaggcugug

SEQ ID NO: 803817 - RNA, 22 nt, Human
caggcugcggucggcucugguc

SEQ ID NO: 803818 - RNA, 22 nt, Human
gcaaaugcucuccagccugggu

SEQ ID NO: 803819 - RNA, 22 nt, Human
uaauaauuggcuaacccuggga

SEQ ID NO: 803820 - RNA, 22 nt, Human
auugucuuuggugcuuccagga

SEQ ID NO: 803821 - RNA, 23 nt, Human
ucccuguguacagccugcaugag

SEQ ID NO: 803822 - RNA, 22 nt, Human
aaggcuccuuuguaguucuuuu

SEQ ID NO: 803823 - RNA, 22 nt, Human
gaauacaaacuuaaggcuuuac

SEQ ID NO: 803824 - RNA, 22 nt, Human
ucaucuaagagucuuacauuua

SEQ ID NO: 803825 - RNA, 22 nt, Human
uccucagagcauagcgcugucu

SEQ ID NO: 803826 - RNA, 22 nt, Human
agccagcuucuuuacgguggca

SEQ ID NO: 803827 - RNA, 22 nt, Human
cuauauauaucaucuuccaguu

SEQ ID NO: 803828 - RNA, 22 nt, Human
uguuucuagagaaaauauuuac

SEQ ID NO: 803829 - RNA, 22 nt, Human
uuucacauagaaagugauuuac

SEQ ID NO: 803830 - RNA, 22 nt, Human
ugggagccauuuuagaggcugc

SEQ ID NO: 803831 - RNA, 22 nt, Human
aauacuuuugaacugaaaggca

SEQ ID NO: 803832 - RNA, 22 nt, Human
uagggcuggguacacucuugcc

SEQ ID NO: 803833 - RNA, 22 nt, Human
uuccaggacucguucuggcuca

SEQ ID NO: 803834 - RNA, 22 nt, Human
cucuggucuucaaggccaccuc

SEQ ID NO: 803835 - RNA, 22 nt, Human
aagaacuuugauuucauugcau

SEQ ID NO: 803836 - RNA, 22 nt, Human
ucaggguucuuucaguuaaguu

SEQ ID NO: 803837 - RNA, 22 nt, Human
ucuaaacacuaagucuugaugc

SEQ ID NO: 803838 - RNA, 22 nt, Human
gccuucucugugagcuccuagg

SEQ ID NO: 803839 - RNA, 22 nt, Human
auuuccauguccaaaaauuagu

SEQ ID NO: 803840 - RNA, 22 nt, Human
gggaggucagggugccugcugg

SEQ ID NO: 803841 - RNA, 22 nt, Human
ccucuacuuaccacucagccag

SEQ ID NO: 803842 - RNA, 22 nt, Human
gggccuccgugugcuggugcuc

SEQ ID NO: 803843 - RNA, 22 nt, Human
ugcuggcuggccuggccuggac

SEQ ID NO: 803844 - RNA, 22 nt, Human
gcagcaggcacuuaccguugcu

SEQ ID NO: 803845 - RNA, 22 nt, Human
guccacagcuggccagggccuc

SEQ ID NO: 803846 - RNA, 16 nt, Human
gcacugggaugucuuc

SEQ ID NO: 803847 - RNA, 22 nt, Human
uuuuucugagaauaugagagga

SEQ ID NO: 803848 - RNA, 22 nt, Human
uuguacacaauucuuaacauac

SEQ ID NO: 803849 - RNA, 22 nt, Human
ugccuggcugggcugcucaugg

SEQ ID NO: 803850 - RNA, 22 nt, Human
caagucaucauagaaguucccc

SEQ ID NO: 803851 - RNA, 22 nt, Human
gcuggcuguguuucaucucuga

SEQ ID NO: 803852 - RNA, 22 nt, Human
cugggcagcuaccaccacugcu

SEQ ID NO: 803853 - RNA, 22 nt, Human
guuuuccugagcccagagaugc

SEQ ID NO: 803854 - RNA, 22 nt, Human
aggcccuggcacugccugggag

SEQ ID NO: 803855 - RNA, 22 nt, Human
uggcagagcuggcugcggauga

SEQ ID NO: 803856 - RNA, 22 nt, Human
caaagcaagggcugaagacucc

SEQ ID NO: 803857 - RNA, 22 nt, Human
gcaggggcugcugggaacucgg

SEQ ID NO: 803858 - RNA, 22 nt, Human
gggaggcugccauccuucagga

SEQ ID NO: 803859 - RNA, 20 nt, Human
accuccuggaagcaggugcc

SEQ ID NO: 803860 - RNA, 22 nt, Human
gugggcagagcaagggaacuca

SEQ ID NO: 803861 - RNA, 22 nt, Human
acacuucagcaguaugcuuggg

SEQ ID NO: 803862 - RNA, 22 nt, Human
uugcagcuccauuuuaauggcu

SEQ ID NO: 803863 - RNA, 22 nt, Human
cauuuauugaguggccacagug

SEQ ID NO: 803864 - RNA, 22 nt, Human
uggcaggaaauacccugccuag

SEQ ID NO: 803865 - RNA, 22 nt, Human
aggcugaggcuuuccuuggaga

SEQ ID NO: 803866 - RNA, 22 nt, Human
ugcgcggcucagucaucuccag

SEQ ID NO: 803867 - RNA, 22 nt, Human
auuuuguggcagaugcagaacc

SEQ ID NO: 803868 - RNA, 22 nt, Human
acaauuagugaucagugaugcc

SEQ ID NO: 803869 - RNA, 22 nt, Human
agagcuggggccagagucaagg

SEQ ID NO: 803870 - RNA, 22 nt, Human
uggcccuguucuguaccucaua

SEQ ID NO: 803871 - RNA, 22 nt, Human
uaagucauagauuaauggccac

SEQ ID NO: 803872 - RNA, 22 nt, Human
caaagugggugcccugaugcuc

SEQ ID NO: 803873 - RNA, 22 nt, Human
cagaguggcgacccccucagcu

SEQ ID NO: 803874 - RNA, 22 nt, Human
ccuccccucagacagagacugg

SEQ ID NO: 803875 - RNA, 21 nt, Human
gagugcucaguuaaguggaga

SEQ ID NO: 803876 - RNA, 22 nt, Human
agcugccugcuuaugagcucca

SEQ ID NO: 803877 - RNA, 22 nt, Human
cagcugggcuaagaguagaggc

SEQ ID NO: 803878 - RNA, 22 nt, Human
aggcaugaugugcaguggcaaa

SEQ ID NO: 803879 - RNA, 22 nt, Human
gaacauuauuguacaaaugucu

SEQ ID NO: 803880 - RNA, 22 nt, Human
aggaaauaagggcacuucagau

SEQ ID NO: 803881 - RNA, 22 nt, Human
cugcugccggcgagccucccuu

SEQ ID NO: 803882 - RNA, 22 nt, Human
ucuuaaaugacugauaagagga

SEQ ID NO: 803883 - RNA, 22 nt, Human
ggaggaugagcuacgaggagcu

SEQ ID NO: 803884 - RNA, 22 nt, Human
uggcagcuggcucugcgcaggc

SEQ ID NO: 803885 - RNA, 22 nt, Human
cuggcugugucuuggaggagcu

SEQ ID NO: 803886 - RNA, 22 nt, Human
gcacccagcccagggcgugaug

SEQ ID NO: 803887 - RNA, 22 nt, Human
acccaggcugcuucucaguggc

SEQ ID NO: 803888 - RNA, 22 nt, Human
uagucagagucuucucuguugu

SEQ ID NO: 803889 - RNA, 22 nt, Human
uuaauauacaauuuuacgggcu

SEQ ID NO: 803890 - RNA, 22 nt, Human
acugggaggcaaagagcaagga

SEQ ID NO: 803891 - RNA, 22 nt, Human
cuggcuccauccuaggcaaaug

SEQ ID NO: 803892 - RNA, 22 nt, Human
auaaauagugugucauaaaguc

SEQ ID NO: 803893 - RNA, 22 nt, Human
cuguaaauaugaagaauauaug

SEQ ID NO: 803894 - RNA, 22 nt, Human
agaacagcaggaaggccaggua

SEQ ID NO: 803895 - RNA, 22 nt, Human
caguaauuccaagugcuuauac

SEQ ID NO: 803896 - RNA, 22 nt, Human
ugaggggagacagaguggacuc

SEQ ID NO: 803897 - RNA, 21 nt, Human
ucuggggaagacaucuaggau

SEQ ID NO: 803898 - RNA, 20 nt, Human
uggcggggaugagggaguua

SEQ ID NO: 803899 - RNA, 22 nt, Human
uaaggcagguaugguaccaggc

SEQ ID NO: 803900 - RNA, 17 nt, Human
acagugucuaugaaaug

SEQ ID NO: 803901 - RNA, 22 nt, Human
uggcagguuucguuaaaaaugg

SEQ ID NO: 803902 - RNA, 22 nt, Human
ucccccacucuaaaggagccuu

SEQ ID NO: 803903 - RNA, 22 nt, Human
cuggcugguuuuuaaagcuagg

SEQ ID NO: 803904 - RNA, 22 nt, Human
gacuucuucaugucuuuuccac

SEQ ID NO: 803905 - RNA, 22 nt, Human
guuagagggaaaaaucauuugc

SEQ ID NO: 803906 - RNA, 22 nt, Human
ucagagaagguaagugaccugc

SEQ ID NO: 803907 - RNA, 22 nt, Human
ucugaaggugcuagagaaagcu

SEQ ID NO: 803908 - RNA, 16 nt, Human
acagugucucaagcac

SEQ ID NO: 803909 - RNA, 22 nt, Human
agucacaugggauuagaaccca

SEQ ID NO: 803910 - RNA, 22 nt, Human
ucacauuucacaugggaggagg

SEQ ID NO: 803911 - RNA, 22 nt, Human
aggugguguuugguuacaugag

SEQ ID NO: 803912 - RNA, 22 nt, Human
aaauguguuucgaaaacuggug

SEQ ID NO: 803913 - RNA, 22 nt, Human
agucugaagacucaugucugaa

SEQ ID NO: 803914 - RNA, 22 nt, Human
augggcaguuaggaggccagga

SEQ ID NO: 803915 - RNA, 22 nt, Human
cuuugcuuuacucccacugugu

SEQ ID NO: 803916 - RNA, 22 nt, Human
uuuuuaucuacagauucucagc

SEQ ID NO: 803917 - RNA, 22 nt, Human
acagagacuaagcuuuucauca

SEQ ID NO: 803918 - RNA, 22 nt, Human
gaggcugguucccuugaucuuu

SEQ ID NO: 803919 - RNA, 17 nt, Human
gcucccugaggacagcu

SEQ ID NO: 803920 - RNA, 22 nt, Human
uccagcaccuggaggcgucccc

SEQ ID NO: 803921 - RNA, 22 nt, Human
ucagggagggaccugaggcugg

SEQ ID NO: 803922 - RNA, 22 nt, Human
ugcuaggggucagcaccauauc

SEQ ID NO: 803923 - RNA, 22 nt, Human
aggcuucugauaccaugagaga

SEQ ID NO: 803924 - RNA, 22 nt, Human
aguguuuuauuucagcacuuug

SEQ ID NO: 803925 - RNA, 21 nt, Human
gcagugucaugguuucaaguu

SEQ ID NO: 803926 - RNA, 22 nt, Human
aggaucagugaauacucagggu

SEQ ID NO: 803927 - RNA, 22 nt, Human
gguccuggaaguguaaguggca

SEQ ID NO: 803928 - RNA, 18 nt, Human
cagagcaguaugaauguu

SEQ ID NO: 803929 - RNA, 22 nt, Human
ucauguuuuaaugccuuuuucu

SEQ ID NO: 803930 - RNA, 22 nt, Human
gaagagcauaugaagagcauau

SEQ ID NO: 803931 - RNA, 22 nt, Human
ugggcccaagagagucuccaac

SEQ ID NO: 803932 - RNA, 22 nt, Human
ugaguucucacccauucuucuu

SEQ ID NO: 803933 - RNA, 22 nt, Human
accagaaggaccagaggcaagg

SEQ ID NO: 803934 - RNA, 22 nt, Human
gggaacagagugccagacugac

SEQ ID NO: 803935 - RNA, 22 nt, Human
cacaguaagaaaugaagaggua

SEQ ID NO: 803936 - RNA, 22 nt, Human
cuggcaggaaguuagaugguaa

SEQ ID NO: 803937 - RNA, 22 nt, Human
uagaaacccauguuuauucagu

SEQ ID NO: 803938 - RNA, 21 nt, Human
cagaggcugagagggcaaucu

SEQ ID NO: 803939 - RNA, 22 nt, Human
acugcaauuauuuguucaccaa

SEQ ID NO: 803940 - RNA, 22 nt, Human
ggcuccaguuugugccuucagc

SEQ ID NO: 803941 - RNA, 22 nt, Human
agcagggguggaagguagcuuu

SEQ ID NO: 803942 - RNA, 22 nt, Human
cacagcaagagcuaaaugacca

SEQ ID NO: 803943 - RNA, 22 nt, Human
uguauuaacauuaauaaaaugg

SEQ ID NO: 803944 - RNA, 22 nt, Human
uggugccaagcaugaggacucu

SEQ ID NO: 803945 - RNA, 22 nt, Human
acugggaagauggaggcaagca

SEQ ID NO: 803946 - RNA, 22 nt, Human
gaaugauagagcugccuucgga

SEQ ID NO: 803947 - RNA, 22 nt, Human
cagucagggacaccagcuagga

SEQ ID NO: 803948 - RNA, 22 nt, Human
agcacaguaauugauauuacug

SEQ ID NO: 803949 - RNA, 22 nt, Human
ucccuggggaagggcaagcaag

SEQ ID NO: 803950 - RNA, 22 nt, Human
guuuauugauaaaagcuggaca

SEQ ID NO: 803951 - RNA, 22 nt, Human
ugggccaggugcagugcuuuag

SEQ ID NO: 803952 - RNA, 19 nt, Human
gggagagccaggcucaccc

SEQ ID NO: 803953 - RNA, 22 nt, Human
gcagauggugggggaggaguac

SEQ ID NO: 803954 - RNA, 22 nt, Human
gggaaggccgguccagucaggu

SEQ ID NO: 803955 - RNA, 22 nt, Human
agcacugugauuuauaacauuu

SEQ ID NO: 803956 - RNA, 22 nt, Human
cagcccagcgcaaacaacuggc

SEQ ID NO: 803957 - RNA, 22 nt, Human
ucuuuuuuuccugugcagagcu

SEQ ID NO: 803958 - RNA, 22 nt, Human
agugcauaaaggaaaaacugaa

SEQ ID NO: 803959 - RNA, 22 nt, Human
uccccuccaacuccaacuaugg

SEQ ID NO: 803960 - RNA, 22 nt, Human
cugguucaauggggcugagccc

SEQ ID NO: 803961 - RNA, 22 nt, Human
ggaggccagccugaggcugagg

SEQ ID NO: 803962 - RNA, 22 nt, Human
agcucuuuauggguaaaugcca

SEQ ID NO: 803963 - RNA, 22 nt, Human
acaggcuguacuucuaaucauc

SEQ ID NO: 803964 - RNA, 22 nt, Human
aggcucugaucagguggcugug

SEQ ID NO: 803965 - RNA, 22 nt, Human
gccagcugacaccuugauuuug

SEQ ID NO: 803966 - RNA, 22 nt, Human
gcagaggccugaagguggcggg

SEQ ID NO: 803967 - RNA, 22 nt, Human
ugaaugauguauaauauugaga

SEQ ID NO: 803968 - RNA, 21 nt, Human
ugcagcugacacccuuuggga

SEQ ID NO: 803969 - RNA, 22 nt, Human
aauaggaagcaccaaauucucc

SEQ ID NO: 803970 - RNA, 22 nt, Human
gagggagaaggacuaucaggcu

SEQ ID NO: 803971 - RNA, 22 nt, Human
cuacaacaccaggcacggagug

SEQ ID NO: 803972 - RNA, 22 nt, Human
gauguaaacugggacuuccuag

SEQ ID NO: 803973 - RNA, 22 nt, Human
acauagaaggaagaguaguagg

SEQ ID NO: 803974 - RNA, 22 nt, Human
acaggacagguaggauucgcag

SEQ ID NO: 803975 - RNA, 22 nt, Human
gcuuuggaaacuggcccugcgc

SEQ ID NO: 803976 - RNA, 22 nt, Human
ggggccagguccagcuuccaaa

SEQ ID NO: 803977 - RNA, 22 nt, Human
cucugagguccuucccagcucu

SEQ ID NO: 803978 - RNA, 22 nt, Human
cugcaaaugggcuuuagguggc

SEQ ID NO: 803979 - RNA, 22 nt, Human
ucuccugggcuugguugaaguu

SEQ ID NO: 803980 - RNA, 22 nt, Human
ucaggcagaccaccgugggcag

SEQ ID NO: 803981 - RNA, 22 nt, Human
uauuucauucuuuaucaggagc

SEQ ID NO: 803982 - RNA, 22 nt, Human
agguccuggucuugagucuuaa

SEQ ID NO: 803983 - RNA, 22 nt, Human
acaggcugccacuugcauccaa

SEQ ID NO: 803984 - RNA, 22 nt, Human
aguuuucugggaucacuggaau

SEQ ID NO: 803985 - RNA, 22 nt, Human
auaucacagguguuuaccugau

SEQ ID NO: 803986 - RNA, 22 nt, Human
caugcuguacucugugucagaa

SEQ ID NO: 803987 - RNA, 21 nt, Human
uggaccaggaaggugguggug

SEQ ID NO: 803988 - RNA, 22 nt, Human
ccuggcagcgugccgagcugcg

SEQ ID NO: 803989 - RNA, 22 nt, Human
aaauucacuugccugcuuagcu

SEQ ID NO: 803990 - RNA, 20 nt, Human
ucucuuuuagcuuacagcug

SEQ ID NO: 803991 - RNA, 22 nt, Human
gaaagcauaacuaauauuuauu

SEQ ID NO: 803992 - RNA, 22 nt, Human
aagaaauuaaugugccauuacu

SEQ ID NO: 803993 - RNA, 22 nt, Human
gaugaaauuugggcagguuaaa

SEQ ID NO: 803994 - RNA, 19 nt, Human
ccucccacggauuccuucc

SEQ ID NO: 803995 - RNA, 22 nt, Human
ccugaggcuggcccuuccaucc

SEQ ID NO: 803996 - RNA, 22 nt, Human
ggcucuggugaggguaggagau

SEQ ID NO: 803997 - RNA, 22 nt, Human
gcagaggaggacccaggaauua

SEQ ID NO: 803998 - RNA, 22 nt, Human
uagcaaaauguggauguaguug

SEQ ID NO: 803999 - RNA, 22 nt, Human
ccugccucaggacucugcauau

SEQ ID NO: 804000 - RNA, 20 nt, Human
cuuuggagaaagaugcaaua

SEQ ID NO: 804001 - RNA, 22 nt, Human
aauagcucacugauuucucuuu

SEQ ID NO: 804002 - RNA, 22 nt, Human
cacagcagaaaguguaggagga

SEQ ID NO: 804003 - RNA, 22 nt, Human
cugugacuggaaucuggcucuu

SEQ ID NO: 804004 - RNA, 22 nt, Human
aggugggggcuguguccuugac

SEQ ID NO: 804005 - RNA, 22 nt, Human
gcuccugggcucuaccuugcua

SEQ ID NO: 804006 - RNA, 18 nt, Human
caauuuuacccagucccu

SEQ ID NO: 804007 - RNA, 22 nt, Human
gccagccccagacauccuaucg

SEQ ID NO: 804008 - RNA, 22 nt, Human
uauauuguaggugcuauuugaa

SEQ ID NO: 804009 - RNA, 22 nt, Human
aguugucagucaaagacauuug

SEQ ID NO: 804010 - RNA, 22 nt, Human
aggcaugacuuuggcugaagaa

SEQ ID NO: 804011 - RNA, 22 nt, Human
ugccucuguggaaauggugguc

SEQ ID NO: 804012 - RNA, 21 nt, Human
ucaggcugaugucgauguuag

SEQ ID NO: 804013 - RNA, 20 nt, Human
uccuagcuucucucuguaca

SEQ ID NO: 804014 - RNA, 22 nt, Human
accuucaagauugugggucaau

SEQ ID NO: 804015 - RNA, 22 nt, Human
gacaagcucuuguuucaugguu

SEQ ID NO: 804016 - RNA, 22 nt, Human
uaaccaugcaugucucuaguuu

SEQ ID NO: 804017 - RNA, 22 nt, Human
agaaaacuugucacagcucuca

SEQ ID NO: 804018 - RNA, 22 nt, Human
cagcagcaaaucuagaagagga

SEQ ID NO: 804019 - RNA, 22 nt, Human
augauugaaaaugacauugcca

SEQ ID NO: 804020 - RNA, 22 nt, Human
ucaggcuguuagccaccuccuc

SEQ ID NO: 804021 - RNA, 22 nt, Human
ucacguuuuacugagugagaua

SEQ ID NO: 804022 - RNA, 22 nt, Human
agguccuggugaccauggaguu

SEQ ID NO: 804023 - RNA, 20 nt, Human
ucauaaagaggaaauaaaua

SEQ ID NO: 804024 - RNA, 22 nt, Human
ugcaggcugcucaagacuuagu

SEQ ID NO: 804025 - RNA, 22 nt, Human
uccuggaagugcuuggugaggg

SEQ ID NO: 804026 - RNA, 22 nt, Human
uaaggccaccguuauagaacca

SEQ ID NO: 804027 - RNA, 22 nt, Human
gucuggagccccagucaaugag

SEQ ID NO: 804028 - RNA, 22 nt, Human
ucacagagcucacaguuuagca

SEQ ID NO: 804029 - RNA, 22 nt, Human
guuuacuguuaaccaacgaaug

SEQ ID NO: 804030 - RNA, 21 nt, Human
uugauuuuaggaaguuuguca

SEQ ID NO: 804031 - RNA, 22 nt, Human
uugcauuugacaaauuauuuaa

SEQ ID NO: 804032 - RNA, 22 nt, Human
cagcagggggcagcgcagauca

SEQ ID NO: 804033 - RNA, 22 nt, Human
cagaaauguacugacaugcagu

SEQ ID NO: 804034 - RNA, 20 nt, Human
ucacuucuuccuuuugucua

SEQ ID NO: 804035 - RNA, 22 nt, Human
cuucgauuuaauucuuaaccuu

SEQ ID NO: 804036 - RNA, 22 nt, Human
uggcccugggcagaggcaacau

SEQ ID NO: 804037 - RNA, 17 nt, Human
auguauauuaacucuga

SEQ ID NO: 804038 - RNA, 18 nt, Human
acaggcugugggaauggu

SEQ ID NO: 804039 - RNA, 22 nt, Human
agagccugcaucaggcuugggg

SEQ ID NO: 804040 - RNA, 22 nt, Human
gccacccuggacgcacuguucg

SEQ ID NO: 804041 - RNA, 22 nt, Human
ucccaggaggugcuuccuagga

SEQ ID NO: 804042 - RNA, 22 nt, Human
uugauuucuauugaguuccugu

SEQ ID NO: 804043 - RNA, 22 nt, Human
auucuacaaucauguagauccu

SEQ ID NO: 804044 - RNA, 22 nt, Human
agaagcagaaggaagcagggcc

SEQ ID NO: 804045 - RNA, 22 nt, Human
cuggagauguccgggugcuguu

SEQ ID NO: 804046 - RNA, 22 nt, Human
gcucucucccuaggcaagugag

SEQ ID NO: 804047 - RNA, 21 nt, Human
aggauuuuguugaaguuucug

SEQ ID NO: 804048 - RNA, 22 nt, Human
agcccccucccuagugacugga

SEQ ID NO: 804049 - RNA, 16 nt, Human
aaagaaacaggugucc

SEQ ID NO: 804050 - RNA, 22 nt, Human
uaaggacauugguuuugaguaa

SEQ ID NO: 804051 - RNA, 17 nt, Human
aggaagcgagcuggccu

SEQ ID NO: 804052 - RNA, 22 nt, Human
uuucacauucucugguuaucga

SEQ ID NO: 804053 - RNA, 22 nt, Human
gaaacauuguguucuacagauu

SEQ ID NO: 804054 - RNA, 22 nt, Human
gcuggagagugaggggagcaag

SEQ ID NO: 804055 - RNA, 22 nt, Human
uucuuacauauuuucauauggu

SEQ ID NO: 804056 - RNA, 22 nt, Human
aauguguuuaguuaaugaguug

SEQ ID NO: 804057 - RNA, 22 nt, Human
cccaguuguugccggcucugga

SEQ ID NO: 804058 - RNA, 22 nt, Human
caggauugagcaaauggauuau

SEQ ID NO: 804059 - RNA, 22 nt, Human
ccacugccagcuuuguccuccc

SEQ ID NO: 804060 - RNA, 22 nt, Human
cugucucugucuuaacucccag

SEQ ID NO: 804061 - RNA, 22 nt, Human
cucuucccagcuccacgagagg

SEQ ID NO: 804062 - RNA, 22 nt, Human
uaagaacagugucugucucaca

SEQ ID NO: 804063 - RNA, 22 nt, Human
ccuuucaaaguuuugccaugcu

SEQ ID NO: 804064 - RNA, 22 nt, Human
ucaaaggcugcuugucuucugg

SEQ ID NO: 804065 - RNA, 22 nt, Human
gcuagccugcaguggcuauggu

SEQ ID NO: 804066 - RNA, 22 nt, Human
uccaggaggguuuucugccuuc

SEQ ID NO: 804067 - RNA, 22 nt, Human
gacaggcaggccagggcugugg

SEQ ID NO: 804068 - RNA, 23 nt, Human
caugggagugagaaugccagcuc

SEQ ID NO: 804069 - RNA, 20 nt, Human
uaccaacagcaggaagcaua

SEQ ID NO: 804070 - RNA, 22 nt, Human
caagagcugcaaauagcgugac

SEQ ID NO: 804071 - RNA, 22 nt, Human
ccucagggucauccuaguaaua

SEQ ID NO: 804072 - RNA, 22 nt, Human
uaagucaggaggucuccugaca

SEQ ID NO: 804073 - RNA, 22 nt, Human
gcugauggcuugcuggcugaca

SEQ ID NO: 804074 - RNA, 22 nt, Human
ccucucccgggugccgcugggc

SEQ ID NO: 804075 - RNA, 22 nt, Human
uuaaggaaggugaauuucuugg

SEQ ID NO: 804076 - RNA, 22 nt, Human
agcucagggcuccaggaccgcu

SEQ ID NO: 804077 - RNA, 22 nt, Human
acauuucagugagcuauugaag

SEQ ID NO: 804078 - RNA, 22 nt, Human
aucuacaggauuuuacagaguu

SEQ ID NO: 804079 - RNA, 18 nt, Human
agacaaacuucuucugcc

SEQ ID NO: 804080 - RNA, 22 nt, Human
uguuuacaguuuuuaguacccu

SEQ ID NO: 804081 - RNA, 22 nt, Human
aaguucaaucagaugaaaaagc

SEQ ID NO: 804082 - RNA, 22 nt, Human
guuacucuuccccggggucugg

SEQ ID NO: 804083 - RNA, 22 nt, Human
ccugcagaggucaggccagaaa

SEQ ID NO: 804084 - RNA, 22 nt, Human
cagggcuccaugcagggacucc

SEQ ID NO: 804085 - RNA, 21 nt, Human
acaguuuuaaggagcacaugg

SEQ ID NO: 804086 - RNA, 22 nt, Human
aacuaaaucuggcauuuagagc

SEQ ID NO: 804087 - RNA, 22 nt, Human
aggcuggucuauacggagacga

SEQ ID NO: 804088 - RNA, 22 nt, Human
uacauggugguggcacuugacu

SEQ ID NO: 804089 - RNA, 22 nt, Human
cacagaggaaaggcaguuggua

SEQ ID NO: 804090 - RNA, 19 nt, Human
ucauaaaaaugguaaccca

SEQ ID NO: 804091 - RNA, 22 nt, Human
aaauuucaagcaaaguagcuau

SEQ ID NO: 804092 - RNA, 22 nt, Human
ugggaaagccagcagugucacc

SEQ ID NO: 804093 - RNA, 22 nt, Human
cuucacaucucccuaaaacagc

SEQ ID NO: 804094 - RNA, 22 nt, Human
guggagaggaacccagcucugu

SEQ ID NO: 804095 - RNA, 22 nt, Human
cucccaggggaacuaucaagua

SEQ ID NO: 804096 - RNA, 22 nt, Human
agaaaauaauuucuuggcuggu

SEQ ID NO: 804097 - RNA, 22 nt, Human
acaggcuuuuuuagaaugacau

SEQ ID NO: 804098 - RNA, 22 nt, Human
uucacuaugcuuggaaacuucu

SEQ ID NO: 804099 - RNA, 22 nt, Human
uuucuauuggcgucacuguugu

SEQ ID NO: 804100 - RNA, 22 nt, Human
ucaccggcagacguggccugau

SEQ ID NO: 804101 - RNA, 22 nt, Human
gggcucuaggccaagagucccg

SEQ ID NO: 804102 - RNA, 22 nt, Human
caaacuuucaguuauaacauga

SEQ ID NO: 804103 - RNA, 22 nt, Human
acagauuauggauauaugugga

SEQ ID NO: 804104 - RNA, 22 nt, Human
cuggccagcugacagcagggcu

SEQ ID NO: 804105 - RNA, 22 nt, Human
ccuggcaggccccuccuggauu

SEQ ID NO: 804106 - RNA, 23 nt, Human
ccugcagcugcuggggcuccacc

SEQ ID NO: 804107 - RNA, 22 nt, Human
uuucacauucagauauagacuu

SEQ ID NO: 804108 - RNA, 22 nt, Human
aucuuucagggccauuuguauu

SEQ ID NO: 804109 - RNA, 22 nt, Human
gccagcagggcggagccaucua

SEQ ID NO: 804110 - RNA, 20 nt, Human
cugccuggaggccucuaccu

SEQ ID NO: 804111 - RNA, 22 nt, Human
uuguuaaaaugaggucauucug

SEQ ID NO: 804112 - RNA, 22 nt, Human
uccuggcuccacugagcaggcc

SEQ ID NO: 804113 - RNA, 22 nt, Human
caaguaaagaaucacauuucuu

SEQ ID NO: 804114 - RNA, 21 nt, Human
ggccuuggcgggggccgaauu

SEQ ID NO: 804115 - RNA, 22 nt, Human
auaugcuuaugaugucucaagu

SEQ ID NO: 804116 - RNA, 22 nt, Human
gagcuggcaaugacuuguguau

SEQ ID NO: 804117 - RNA, 22 nt, Human
auagaauaugacuuuuagaucc

SEQ ID NO: 804118 - RNA, 22 nt, Human
gcugagggcagccuccuagguc

SEQ ID NO: 804119 - RNA, 22 nt, Human
agggcagaccacgugcaaggau

SEQ ID NO: 804120 - RNA, 22 nt, Human
cacuugaauggcauuguuccuu

SEQ ID NO: 804121 - RNA, 22 nt, Human
ugucauggcguuguggggacua

SEQ ID NO: 804122 - RNA, 22 nt, Human
aggccagaaaugucagggagug

SEQ ID NO: 804123 - RNA, 22 nt, Human
ucaaaaauguuuuauauuggua

SEQ ID NO: 804124 - RNA, 19 nt, Human
cucuccagcuccaguagcu

SEQ ID NO: 804125 - RNA, 22 nt, Human
uugugaauagugccgcuauaaa

SEQ ID NO: 804126 - RNA, 22 nt, Human
gcagaggagaugaagauacuuu

SEQ ID NO: 804127 - RNA, 22 nt, Human
ugggugccaaccucugguggcc

SEQ ID NO: 804128 - RNA, 22 nt, Human
gcgguggggaaaggaggugcug

SEQ ID NO: 804129 - RNA, 22 nt, Human
ucccagaguucaaugggaaggu

SEQ ID NO: 804130 - RNA, 22 nt, Human
ccccagccagcaggaccucuga

SEQ ID NO: 804131 - RNA, 22 nt, Human
ucuuuggaagcuuucagagaag

SEQ ID NO: 804132 - RNA, 22 nt, Human
gaagucagaaaagaauuaggga

SEQ ID NO: 804133 - RNA, 22 nt, Human
ugcaaauuggugaggaccacuu

SEQ ID NO: 804134 - RNA, 22 nt, Human
gcagaauacauuuuguuuuccu

SEQ ID NO: 804135 - RNA, 22 nt, Human
aggcacuuuacaaugugugaca

SEQ ID NO: 804136 - RNA, 22 nt, Human
cugcagcugcaguucugagaga

SEQ ID NO: 804137 - RNA, 17 nt, Human
gaggacagggaaguagg

SEQ ID NO: 804138 - RNA, 22 nt, Human
ccucaggcuagcuacugucccu

SEQ ID NO: 804139 - RNA, 22 nt, Human
agguagggaagaaggcaugaaa

SEQ ID NO: 804140 - RNA, 22 nt, Human
aauuuuaugccuugcacguugg

SEQ ID NO: 804141 - RNA, 22 nt, Human
uugaacaaucaaaagaauucau

SEQ ID NO: 804142 - RNA, 18 nt, Human
ugccagccgacuggccug

SEQ ID NO: 804143 - RNA, 22 nt, Human
aggcuugggucagaaggcuugu

SEQ ID NO: 804144 - RNA, 22 nt, Human
cugcugagccuggugcgggaug

SEQ ID NO: 804145 - RNA, 22 nt, Human
aaucacauuacagcauaucugu

SEQ ID NO: 804146 - RNA, 22 nt, Human
uccagcuguuguuuuaucucag

SEQ ID NO: 804147 - RNA, 22 nt, Human
ggagccagagucugcaguguaa

SEQ ID NO: 804148 - RNA, 22 nt, Human
guuguuuuauaauugauugcaa

SEQ ID NO: 804149 - RNA, 22 nt, Human
ucaugcaacgauccuccaaaug

SEQ ID NO: 804150 - RNA, 22 nt, Human
ugaggccaaugacccugggcag

SEQ ID NO: 804151 - RNA, 22 nt, Human
cccuugggguggagguugcagu

SEQ ID NO: 804152 - RNA, 22 nt, Human
gagaggcuuaagggcugugaag

SEQ ID NO: 804153 - RNA, 22 nt, Human
accagcuguuaggcuuggugcu

SEQ ID NO: 804154 - RNA, 22 nt, Human
cagagggucaccaggaagugca

SEQ ID NO: 804155 - RNA, 22 nt, Human
agaggcccuggcuagagcagcu

SEQ ID NO: 804156 - RNA, 22 nt, Human
cacaguuugguuuugcuguaau

SEQ ID NO: 804157 - RNA, 21 nt, Human
ugaggcucuguugugccugca

SEQ ID NO: 804158 - RNA, 22 nt, Human
ccucugcagcagagagccagag

SEQ ID NO: 804159 - RNA, 22 nt, Human
ucaugcaauguuaguuugaaag

SEQ ID NO: 804160 - RNA, 22 nt, Human
cugggagcaccauacuuguuuc

SEQ ID NO: 804161 - RNA, 23 nt, Human
ugcuggcuuuuaucuggucccua

SEQ ID NO: 804162 - RNA, 22 nt, Human
ucccagccuggacccugccagu

SEQ ID NO: 804163 - RNA, 21 nt, Human
ucaaaucagguaucacuauug

SEQ ID NO: 804164 - RNA, 20 nt, Human
uucauucacguagcuguuga

SEQ ID NO: 804165 - RNA, 22 nt, Human
ucuacaaagguugaggugcccu

SEQ ID NO: 804166 - RNA, 22 nt, Human
gauuucuguggcuuguacauau

SEQ ID NO: 804167 - RNA, 22 nt, Human
aacuacucaacucugccauugu

SEQ ID NO: 804168 - RNA, 22 nt, Human
cugccuggugcggugcccaccc

SEQ ID NO: 804169 - RNA, 22 nt, Human
aaggcagccuuuugaguugauu

SEQ ID NO: 804170 - RNA, 22 nt, Human
agaagccacuggagguugagau

SEQ ID NO: 804171 - RNA, 22 nt, Human
ggcagaagaaaggcuaagucuc

SEQ ID NO: 804172 - RNA, 22 nt, Human
ucauuuaauugguuuugcucgu

SEQ ID NO: 804173 - RNA, 20 nt, Human
uguggcaggaugagggcgga

SEQ ID NO: 804174 - RNA, 22 nt, Human
gcauuuaaauuugaacuucaga

SEQ ID NO: 804175 - RNA, 22 nt, Human
aagaguuuccaugcucugugcu

SEQ ID NO: 804176 - RNA, 22 nt, Human
acagugaucuuuuaguuggaac

SEQ ID NO: 804177 - RNA, 19 nt, Human
uggccagguacugucugcu

SEQ ID NO: 804178 - RNA, 22 nt, Human
cguggccacccaguggugcgug

SEQ ID NO: 804179 - RNA, 21 nt, Human
agaggaagaagaguguauuau

SEQ ID NO: 804180 - RNA, 22 nt, Human
cagaagacagcuguuucacucg

SEQ ID NO: 804181 - RNA, 21 nt, Human
acuuaaauuccuugauauuua

SEQ ID NO: 804182 - RNA, 22 nt, Human
aggcagcuggaggcagagacua

SEQ ID NO: 804183 - RNA, 22 nt, Human
uuauuucauauaauguuaucaa

SEQ ID NO: 804184 - RNA, 21 nt, Human
uggcaggcagcuggaagcuug

SEQ ID NO: 804185 - RNA, 22 nt, Human
aggcaggggagcuggaagggua

SEQ ID NO: 804186 - RNA, 22 nt, Human
agauuuccuaugguaauuauag

SEQ ID NO: 804187 - RNA, 20 nt, Human
aaagagaagccucaccuugu

SEQ ID NO: 804188 - RNA, 22 nt, Human
uccuccuguuucucaggccugg

SEQ ID NO: 804189 - RNA, 22 nt, Human
auugcuuuucagacaaugaggc

SEQ ID NO: 804190 - RNA, 22 nt, Human
aggcugccuggcugugagugaa

SEQ ID NO: 804191 - RNA, 22 nt, Human
uuccuggaaauuaugcucaccu

SEQ ID NO: 804192 - RNA, 22 nt, Human
ucucuuggaaagcuugcccacu

SEQ ID NO: 804193 - RNA, 22 nt, Human
aaggcaaguuuuaguuuucugg

SEQ ID NO: 804194 - RNA, 22 nt, Human
agcuuucaguuacuaaugaagg

SEQ ID NO: 804195 - RNA, 23 nt, Human
acuggacagaguggacgaggcug

SEQ ID NO: 804196 - RNA, 22 nt, Human
ccucagggucucucacagcacc

SEQ ID NO: 804197 - RNA, 22 nt, Human
cugaagaugucugagaugcuca

SEQ ID NO: 804198 - RNA, 22 nt, Human
acucuaaaaugcuaugagaucu

SEQ ID NO: 804199 - RNA, 22 nt, Human
agucucagcaagcauggcuagu

SEQ ID NO: 804200 - RNA, 22 nt, Human
gccacagacagagagucuagug

SEQ ID NO: 804201 - RNA, 18 nt, Human
ugcuuacaggaguuccug

SEQ ID NO: 804202 - RNA, 22 nt, Human
auacauacguacauacguaugu

SEQ ID NO: 804203 - RNA, 22 nt, Human
auacaguagggaccaugucuga

SEQ ID NO: 804204 - RNA, 22 nt, Human
ggcuggcugugcccuguacucu

SEQ ID NO: 804205 - RNA, 22 nt, Human
ccugccaggacauugcuugaag

SEQ ID NO: 804206 - RNA, 17 nt, Human
agccugggaaggaguga

SEQ ID NO: 804207 - RNA, 22 nt, Human
cagcuuggcuucacauucugua

SEQ ID NO: 804208 - RNA, 22 nt, Human
uauuucuugaguggucaguuuc

SEQ ID NO: 804209 - RNA, 22 nt, Human
aauaaugagacagcuuauuuaa

SEQ ID NO: 804210 - RNA, 22 nt, Human
cagugucaccaggcgagucucc

SEQ ID NO: 804211 - RNA, 22 nt, Human
caauuacuuuugcaccaauaua

SEQ ID NO: 804212 - RNA, 22 nt, Human
agggcugcaggcaagauauggc

SEQ ID NO: 804213 - RNA, 21 nt, Human
ugacagcauagagcagggagg

SEQ ID NO: 804214 - RNA, 20 nt, Human
aacacacugguggcaucagg

SEQ ID NO: 804215 - RNA, 17 nt, Human
aguuuugauauaauggc

SEQ ID NO: 804216 - RNA, 22 nt, Human
ggcuccagggaguggagagaag

SEQ ID NO: 804217 - RNA, 22 nt, Human
gacaguaagaccuuaccagccu

SEQ ID NO: 804218 - RNA, 22 nt, Human
augcagcugaggguaguggagc

SEQ ID NO: 804219 - RNA, 22 nt, Human
ugaggcuuagagaagaugggau

SEQ ID NO: 804220 - RNA, 22 nt, Human
uagaaagugguugagaguuuag

SEQ ID NO: 804221 - RNA, 22 nt, Human
gcugcuucuccucccuggggau

SEQ ID NO: 804222 - RNA, 22 nt, Human
gcagcccagguguagcucuuug

SEQ ID NO: 804223 - RNA, 22 nt, Human
uacaaacucuuuauauuucaua

SEQ ID NO: 804224 - RNA, 22 nt, Human
guagaaaaagcaguaagucuca

SEQ ID NO: 804225 - RNA, 22 nt, Human
agcuuguuuuguugaauacuua

SEQ ID NO: 804226 - RNA, 22 nt, Human
uaguggaggggaugcaaagcuu

SEQ ID NO: 804227 - RNA, 22 nt, Human
ucuauuuuauacucaaaucuuc

SEQ ID NO: 804228 - RNA, 18 nt, Human
ggugggaagccagggccu

SEQ ID NO: 804229 - RNA, 22 nt, Human
agggaugcugcuaaguggucua

SEQ ID NO: 804230 - RNA, 22 nt, Human
aagcaggcccugggccagggga

SEQ ID NO: 804231 - RNA, 22 nt, Human
ucccugggcggacauucuccca

SEQ ID NO: 804232 - RNA, 22 nt, Human
caggaaauuuauguucuacuua

SEQ ID NO: 804233 - RNA, 22 nt, Human
gcucugaguaaaugaaagcauu

SEQ ID NO: 804234 - RNA, 21 nt, Human
aguuuucugaguuauaaaaua

SEQ ID NO: 804235 - RNA, 22 nt, Human
cucagccagacaugacccaguc

SEQ ID NO: 804236 - RNA, 22 nt, Human
gaagccagcaguggagaaagga

SEQ ID NO: 804237 - RNA, 22 nt, Human
ggagcugggacccugucaucug

SEQ ID NO: 804238 - RNA, 22 nt, Human
auuuacacugguucucagagcu

SEQ ID NO: 804239 - RNA, 22 nt, Human
uuuggcuuaacuuacaugauau

SEQ ID NO: 804240 - RNA, 22 nt, Human
aggcccagacucagcggggcgg

SEQ ID NO: 804241 - RNA, 22 nt, Human
ccuuggcuggaauuacucuggg

SEQ ID NO: 804242 - RNA, 22 nt, Human
uguuuacuaugauguaaccuau

SEQ ID NO: 804243 - RNA, 23 nt, Human
cagaugugcaacucuaggcaaug

SEQ ID NO: 804244 - RNA, 22 nt, Human
aaggcaugaaagcgaaaugaga

SEQ ID NO: 804245 - RNA, 22 nt, Human
aaggaacugaugcucaaagaau

SEQ ID NO: 804246 - RNA, 22 nt, Human
ggcuccaggaaccuccucuccu

SEQ ID NO: 804247 - RNA, 22 nt, Human
ccaaaauaacagcccaauucac

SEQ ID NO: 804248 - RNA, 22 nt, Human
caccugcugagcugcugggggu

SEQ ID NO: 804249 - RNA, 22 nt, Human
ccaggccuggccaggggaugcc

SEQ ID NO: 804250 - RNA, 21 nt, Human
agaauuaaauuggauuugugu

SEQ ID NO: 804251 - RNA, 22 nt, Human
ucuuaugggaaagauguaauua

SEQ ID NO: 804252 - RNA, 22 nt, Human
ccagaggugcugggagaggucu

SEQ ID NO: 804253 - RNA, 22 nt, Human
ccaggaagacacaugcucaucc

SEQ ID NO: 804254 - RNA, 22 nt, Human
cugccucuggccucaggcccag

SEQ ID NO: 804255 - RNA, 22 nt, Human
agccacagugcaagagagaaaa

SEQ ID NO: 804256 - RNA, 22 nt, Human
augugcaaagggacuugcacau

SEQ ID NO: 804257 - RNA, 22 nt, Human
uagaaagucaugaauuacacca

SEQ ID NO: 804258 - RNA, 22 nt, Human
cagaugugagcuggggagagug

SEQ ID NO: 804259 - RNA, 22 nt, Human
cuucaauugccaccagcuagca

SEQ ID NO: 804260 - RNA, 22 nt, Human
uuuuuccuagcgauuugucagc

SEQ ID NO: 804261 - RNA, 22 nt, Human
gucauuuuuuucguaauagugg

SEQ ID NO: 804262 - RNA, 19 nt, Human
agacaaugggguuggcagu

SEQ ID NO: 804263 - RNA, 22 nt, Human
auuaaauuggaucugcauaguu

SEQ ID NO: 804264 - RNA, 22 nt, Human
ggacacagauaaucacacagau

SEQ ID NO: 804265 - RNA, 20 nt, Human
aguggggagucaggagugcc

SEQ ID NO: 804266 - RNA, 22 nt, Human
agcugccaaguuggaguagcaa

SEQ ID NO: 804267 - RNA, 22 nt, Human
uaaaaucaugacagauugacau

SEQ ID NO: 804268 - RNA, 22 nt, Human
uugcuucauauuuguggcuugc

SEQ ID NO: 804269 - RNA, 22 nt, Human
cugucugcccuggccagagccc

SEQ ID NO: 804270 - RNA, 22 nt, Human
uaggcagaauuguugaaugaag

SEQ ID NO: 804271 - RNA, 21 nt, Human
agcaggugcuguuggaggaaa

SEQ ID NO: 804272 - RNA, 22 nt, Human
aaauucuaaggucacaauguug

SEQ ID NO: 804273 - RNA, 22 nt, Human
gcugggcuggaaggccaaggca

SEQ ID NO: 804274 - RNA, 22 nt, Human
aaaauaugaaguugucaguaug

SEQ ID NO: 804275 - RNA, 22 nt, Human
guacauuuauuuuugcagcaua

SEQ ID NO: 804276 - RNA, 22 nt, Human
caggguggaagcuguagagugg

SEQ ID NO: 804277 - RNA, 22 nt, Human
acaaugauuuuuuagaguaguu

SEQ ID NO: 804278 - RNA, 22 nt, Human
cuggcuucugggccagggcaga

SEQ ID NO: 804279 - RNA, 22 nt, Human
gggcaggagaagguggaugucc

SEQ ID NO: 804280 - RNA, 22 nt, Human
cacuugaaauauuaggggugau

SEQ ID NO: 804281 - RNA, 22 nt, Human
aucuguaauuuugaaugcaaau

SEQ ID NO: 804282 - RNA, 22 nt, Human
uuuaucuuuaggacuuugcaga

SEQ ID NO: 804283 - RNA, 22 nt, Human
guggucagaauggagcccagga

SEQ ID NO: 804284 - RNA, 22 nt, Human
ucucaaacuaacaaugauuaua

SEQ ID NO: 804285 - RNA, 23 nt, Human
gggaagcuccauggaggugcugg

SEQ ID NO: 804286 - RNA, 18 nt, Human
accugccuguucuucucu

SEQ ID NO: 804287 - RNA, 23 nt, Human
ucaguagugcauugaauaagugc

SEQ ID NO: 804288 - RNA, 22 nt, Human
gcuggaggcuggagugcagugg

SEQ ID NO: 804289 - RNA, 22 nt, Human
ugucauuuccugaaugcugagu

SEQ ID NO: 804290 - RNA, 22 nt, Human
acuggcugcgggguggaagaag

SEQ ID NO: 804291 - RNA, 22 nt, Human
gcaucuaagguggauaacuucu

SEQ ID NO: 804292 - RNA, 22 nt, Human
ucccagccuuccagucugguuu

SEQ ID NO: 804293 - RNA, 22 nt, Human
aagcaggcgagggccuggagca

SEQ ID NO: 804294 - RNA, 17 nt, Human
agcugccuugcuugagc

SEQ ID NO: 804295 - RNA, 22 nt, Human
uauuaauaagugacuacuagcu

SEQ ID NO: 804296 - RNA, 22 nt, Human
agaggcugcaggcuggaaauca

SEQ ID NO: 804297 - RNA, 22 nt, Human
uauuggaagugaacaccaggcu

SEQ ID NO: 804298 - RNA, 22 nt, Human
auacugauuaguugagaaagca

SEQ ID NO: 804299 - RNA, 22 nt, Human
uggcagaguaggauggcccugu

SEQ ID NO: 804300 - RNA, 22 nt, Human
guaugaaggcgagagcccacua

SEQ ID NO: 804301 - RNA, 22 nt, Human
cuauuucugccuaaugaccugu

SEQ ID NO: 804302 - RNA, 22 nt, Human
aauauauagaaguacccguugu

SEQ ID NO: 804303 - RNA, 22 nt, Human
gggcccugcguccggaagucug

SEQ ID NO: 804304 - RNA, 22 nt, Human
ccugagcuagggaaggaagacc

SEQ ID NO: 804305 - RNA, 19 nt, Human
aaaaggaauauucuuuggg

SEQ ID NO: 804306 - RNA, 19 nt, Human
ccccaggguaggcuagggg

SEQ ID NO: 804307 - RNA, 16 nt, Human
cagccugcagugguca

SEQ ID NO: 804308 - RNA, 22 nt, Human
acaggacagggaauucgaaauu

SEQ ID NO: 804309 - RNA, 22 nt, Human
aacuuccuuggguaugaaaaca

SEQ ID NO: 804310 - RNA, 22 nt, Human
gagagaggccuccauguacuga

SEQ ID NO: 804311 - RNA, 22 nt, Human
gaaacauacgauuuaggagaaa

SEQ ID NO: 804312 - RNA, 22 nt, Human
cacaauuagcagcucuuuauuu

SEQ ID NO: 804313 - RNA, 22 nt, Human
uauagcaagcaggacagucuca

SEQ ID NO: 804314 - RNA, 22 nt, Human
cuaccugaaaagguugugguga

SEQ ID NO: 804315 - RNA, 22 nt, Human
acuaucaacaucauugcucuag

SEQ ID NO: 804316 - RNA, 22 nt, Human
gcucagggccauggaccagcag

SEQ ID NO: 804317 - RNA, 22 nt, Human
agaaggcucauuugacugcauu

SEQ ID NO: 804318 - RNA, 22 nt, Human
uaagaaacaugauacuuuuccu

SEQ ID NO: 804319 - RNA, 22 nt, Human
ucacaggaggacugaaagauau

SEQ ID NO: 804320 - RNA, 22 nt, Human
gggggcuaccgucucuggagcu

SEQ ID NO: 804321 - RNA, 22 nt, Human
cuccccagguucaggagguggg

SEQ ID NO: 804322 - RNA, 22 nt, Human
gccucugcccauccaccaucag

SEQ ID NO: 804323 - RNA, 22 nt, Human
gaaacccaaacuaagacaguag

SEQ ID NO: 804324 - RNA, 22 nt, Human
uucuauguaccuagcguuguau

SEQ ID NO: 804325 - RNA, 22 nt, Human
aagccaguguggucugcccauu

SEQ ID NO: 804326 - RNA, 22 nt, Human
ccugaagagcacucuagaguug

SEQ ID NO: 804327 - RNA, 22 nt, Human
aggcuggccuauuucuuuaucg

SEQ ID NO: 804328 - RNA, 22 nt, Human
agugauucuuuaaagugguauu

SEQ ID NO: 804329 - RNA, 20 nt, Human
aaacacagccucucuuuaca

SEQ ID NO: 804330 - RNA, 20 nt, Human
agccccacccuuguccuggc

SEQ ID NO: 804331 - RNA, 22 nt, Human
cagcuuuaggacucauaauaaa

SEQ ID NO: 804332 - RNA, 22 nt, Human
ggcagguguggugaccagagau

SEQ ID NO: 804333 - RNA, 22 nt, Human
gcccuggccuucaucucagaca

SEQ ID NO: 804334 - RNA, 22 nt, Human
ucagaaucuaaauaggcuccag

SEQ ID NO: 804335 - RNA, 22 nt, Human
ugcccaggauugugaggucagg

SEQ ID NO: 804336 - RNA, 22 nt, Human
ccugggauuuccugagcacucu

SEQ ID NO: 804337 - RNA, 22 nt, Human
uuucaaauagaaucuuuccaaa

SEQ ID NO: 804338 - RNA, 22 nt, Human
aaaacaguuuuugcuaacugcu

SEQ ID NO: 804339 - RNA, 22 nt, Human
uucaggcaucccuacaguuagg

SEQ ID NO: 804340 - RNA, 22 nt, Human
cuggcccaggaagacguguccc

SEQ ID NO: 804341 - RNA, 22 nt, Human
gggggaaaguggagguucguga

SEQ ID NO: 804342 - RNA, 22 nt, Human
gcagggcagccacaggcccccu

SEQ ID NO: 804343 - RNA, 22 nt, Human
ucuuccuucuuugaugacaagg

SEQ ID NO: 804344 - RNA, 22 nt, Human
gcuccuggcuccaggcagccaa

SEQ ID NO: 804345 - RNA, 22 nt, Human
aacauauuuggcugauauuccc

SEQ ID NO: 804346 - RNA, 22 nt, Human
ccauuuaguaaggaagaacagc

SEQ ID NO: 804347 - RNA, 22 nt, Human
aucaagaaaagugcuuucggcu

SEQ ID NO: 804348 - RNA, 22 nt, Human
gccagccauaggccagcacugg

SEQ ID NO: 804349 - RNA, 22 nt, Human
gcugggcucaccaggccacuag

SEQ ID NO: 804350 - RNA, 21 nt, Human
uauagucacuugagcauuauc

SEQ ID NO: 804351 - RNA, 22 nt, Human
uggcuucugagucuccugacau

SEQ ID NO: 804352 - RNA, 19 nt, Human
ccuggcugugaagccugca

SEQ ID NO: 804353 - RNA, 22 nt, Human
gccacagggcgagcggaggcca

SEQ ID NO: 804354 - RNA, 22 nt, Human
ccauguacaugaacacggcggc

SEQ ID NO: 804355 - RNA, 22 nt, Human
uuuccaaauaaggucacacuca

SEQ ID NO: 804356 - RNA, 22 nt, Human
aggacaauuuuggcauaguucu

SEQ ID NO: 804357 - RNA, 22 nt, Human
uucugaagggcuaagugucuau

SEQ ID NO: 804358 - RNA, 22 nt, Human
cacacauucaccaugacugaaa

SEQ ID NO: 804359 - RNA, 22 nt, Human
gugcagggcagccgaaugggcu

SEQ ID NO: 804360 - RNA, 20 nt, Human
aaaagagugcuucaacugcu

SEQ ID NO: 804361 - RNA, 22 nt, Human
cacuuagaaaacuugagcaagu

SEQ ID NO: 804362 - RNA, 22 nt, Human
uugguuuucauagcuccacucu

SEQ ID NO: 804363 - RNA, 22 nt, Human
ucuuccagcuccccacgguguc

SEQ ID NO: 804364 - RNA, 22 nt, Human
cuguucaauuuguuucaguuau

SEQ ID NO: 804365 - RNA, 22 nt, Human
aguuugcagauuauauuagugu

SEQ ID NO: 804366 - RNA, 22 nt, Human
augaaugcaugcuuauuuugca

SEQ ID NO: 804367 - RNA, 22 nt, Human
uguacaaagaguauagcuuuga

SEQ ID NO: 804368 - RNA, 22 nt, Human
cagcuggcagcccuggcccugc

SEQ ID NO: 804369 - RNA, 22 nt, Human
agaaaaagaaaguggauuuguc

SEQ ID NO: 804370 - RNA, 22 nt, Human
ucauuguauacuuuauuuauga

SEQ ID NO: 804371 - RNA, 22 nt, Human
aagcagcauaugacagcaucca

SEQ ID NO: 804372 - RNA, 23 nt, Human
caggaaaucaauucuuccagcau

SEQ ID NO: 804373 - RNA, 22 nt, Human
gaggccacaguccugaggcauc

SEQ ID NO: 804374 - RNA, 22 nt, Human
aaauagauugcugaggcauuac

SEQ ID NO: 804375 - RNA, 22 nt, Human
uauuucuauuccccaggcaagu

SEQ ID NO: 804376 - RNA, 22 nt, Human
acagugcgggcugcgguggguc

SEQ ID NO: 804377 - RNA, 22 nt, Human
agaaucuaaguacacagacaga

SEQ ID NO: 804378 - RNA, 22 nt, Human
uucuuauuucccccuucaucau

SEQ ID NO: 804379 - RNA, 22 nt, Human
aauucauauggauaugcuagua

SEQ ID NO: 804380 - RNA, 22 nt, Human
gccagcagcugugggguggcca

SEQ ID NO: 804381 - RNA, 22 nt, Human
acaauuuuccccauagguuauc

SEQ ID NO: 804382 - RNA, 21 nt, Human
aggugggagaccauguagguc

SEQ ID NO: 804383 - RNA, 23 nt, Human
aaauauucuuuuuuaguaagugc

SEQ ID NO: 804384 - RNA, 22 nt, Human
uucccagaaugaauggauggag

SEQ ID NO: 804385 - RNA, 22 nt, Human
guaggagcauugaggguaugga

SEQ ID NO: 804386 - RNA, 22 nt, Human
agucacagaaacccaggugugg

SEQ ID NO: 804387 - RNA, 22 nt, Human
agccuuagauuugggcaagaac

SEQ ID NO: 804388 - RNA, 22 nt, Human
gugggagcugcggaggccuggg

SEQ ID NO: 804389 - RNA, 22 nt, Human
cagggcagagggaaacuccuuu

SEQ ID NO: 804390 - RNA, 22 nt, Human
ucagaguuccucauagauccag

SEQ ID NO: 804391 - RNA, 22 nt, Human
agcuuaauggaacuugcucaaa

SEQ ID NO: 804392 - RNA, 22 nt, Human
cuggcuggaaguuagagaacuu

SEQ ID NO: 804393 - RNA, 22 nt, Human
ucagggauugcaaaauucaucc

SEQ ID NO: 804394 - RNA, 22 nt, Human
cuaagucauggaaagugugugu

SEQ ID NO: 804395 - RNA, 22 nt, Human
aguggugcugcgcgcggagcuc

SEQ ID NO: 804396 - RNA, 22 nt, Human
cccagccuuccacccuggacua

SEQ ID NO: 804397 - RNA, 22 nt, Human
ugcaugcuucaggcuggcucug

SEQ ID NO: 804398 - RNA, 22 nt, Human
uagcuuugugaaguuuacagac

SEQ ID NO: 804399 - RNA, 22 nt, Human
cauuuauuggcauguaguaggu

SEQ ID NO: 804400 - RNA, 22 nt, Human
aggccagggcacugcucuuuag

SEQ ID NO: 804401 - RNA, 18 nt, Human
ugauucaaguugcccucc

SEQ ID NO: 804402 - RNA, 22 nt, Human
cucugggaccauggcaagugcg

SEQ ID NO: 804403 - RNA, 22 nt, Human
agcuccuggcaaggucauggug

SEQ ID NO: 804404 - RNA, 22 nt, Human
aaaaguucccugguuagaaaag

SEQ ID NO: 804405 - RNA, 22 nt, Human
cacugcuuuucagacaguuauu

SEQ ID NO: 804406 - RNA, 22 nt, Human
augcaacaguucauaguuuuau

SEQ ID NO: 804407 - RNA, 21 nt, Human
cuaagcaaggagcagggguag

SEQ ID NO: 804408 - RNA, 22 nt, Human
cauggcugccuguggacacugc

SEQ ID NO: 804409 - RNA, 22 nt, Human
aacuucugccaaacagcuguua

SEQ ID NO: 804410 - RNA, 22 nt, Human
cagcugucucagggaggugauc

SEQ ID NO: 804411 - RNA, 21 nt, Human
ccaagacucccaucuaguggu

SEQ ID NO: 804412 - RNA, 22 nt, Human
uauuccaaaaucccaaacugcc

SEQ ID NO: 804413 - RNA, 22 nt, Human
ccuggccagaggcgugccugug

SEQ ID NO: 804414 - RNA, 22 nt, Human
ccaggcaaggucuccuagagag

SEQ ID NO: 804415 - RNA, 22 nt, Human
guuuaauaauguugaauuacua

SEQ ID NO: 804416 - RNA, 22 nt, Human
ucaguaaaugagcaaaaauuuc

SEQ ID NO: 804417 - RNA, 22 nt, Human
cauguaaaacacucagaacagu

SEQ ID NO: 804418 - RNA, 22 nt, Human
augcagaaucuugagaaaaauu

SEQ ID NO: 804419 - RNA, 22 nt, Human
uaugagaaucugcaguaugcuu

SEQ ID NO: 804420 - RNA, 22 nt, Human
aauccaugaagugaacaaucug

SEQ ID NO: 804421 - RNA, 18 nt, Human
cccacccuggcucuuagu

SEQ ID NO: 804422 - RNA, 22 nt, Human
cuguuuucuagggcugagguga

SEQ ID NO: 804423 - RNA, 22 nt, Human
cucauuuaacagauuaaaaagu

SEQ ID NO: 804424 - RNA, 22 nt, Human
caauaacugcugaggagaagca

SEQ ID NO: 804425 - RNA, 22 nt, Human
ucacugggcccugaggugggac

SEQ ID NO: 804426 - RNA, 22 nt, Human
auuucaguauuauacaacugcu

SEQ ID NO: 804427 - RNA, 22 nt, Human
uacaaugugugcuucuugucac

SEQ ID NO: 804428 - RNA, 22 nt, Human
auacaggaugcugaacaucucu

SEQ ID NO: 804429 - RNA, 22 nt, Human
gcugggaggaauuuggggaaua

SEQ ID NO: 804430 - RNA, 22 nt, Human
gauucaaaaguuugagcuccaa

SEQ ID NO: 804431 - RNA, 20 nt, Human
auuuguuucuacucucugac

SEQ ID NO: 804432 - RNA, 22 nt, Human
aagucauagucgggaaagacau

SEQ ID NO: 804433 - RNA, 22 nt, Human
aaggaagaagggaaguuacuua

SEQ ID NO: 804434 - RNA, 22 nt, Human
gugggcugcccuugaggucagc

SEQ ID NO: 804435 - RNA, 22 nt, Human
uuguuucuccuggugccugaua

SEQ ID NO: 804436 - RNA, 22 nt, Human
cuggagccggaccagggacggu

SEQ ID NO: 804437 - RNA, 21 nt, Human
acacaggcagugucccgaggu

SEQ ID NO: 804438 - RNA, 20 nt, Human
gccucagccaacccaugggg

SEQ ID NO: 804439 - RNA, 22 nt, Human
aagacauuuauuugaaucaauu

SEQ ID NO: 804440 - RNA, 22 nt, Human
agguaaggaaauugaggcaauu

SEQ ID NO: 804441 - RNA, 22 nt, Human
gcauuucugugcauacacauga

SEQ ID NO: 804442 - RNA, 22 nt, Human
acggggcuagagaagguuucuu

SEQ ID NO: 804443 - RNA, 22 nt, Human
ugaaagaguuugacaugauucu

SEQ ID NO: 804444 - RNA, 22 nt, Human
uuuauuuaaagucguguguuaa

SEQ ID NO: 804445 - RNA, 22 nt, Human
ucauguauugaaaagcauuuua

SEQ ID NO: 804446 - RNA, 22 nt, Human
cagggagcucugggccggacuc

SEQ ID NO: 804447 - RNA, 22 nt, Human
gcugcaagucacagaaacagug

SEQ ID NO: 804448 - RNA, 22 nt, Human
auuuacauaauagacuuuaggu

SEQ ID NO: 804449 - RNA, 22 nt, Human
aaggcagcucagcucauggcag

SEQ ID NO: 804450 - RNA, 22 nt, Human
cccugggaggcuuccaggcaga

SEQ ID NO: 804451 - RNA, 22 nt, Human
uucauacaugagacuagaugca

SEQ ID NO: 804452 - RNA, 22 nt, Human
augagggaggcaaggagaugcu

SEQ ID NO: 804453 - RNA, 22 nt, Human
caaauucucuuacuguuugaca

SEQ ID NO: 804454 - RNA, 22 nt, Human
ucaauuacagcaaugacuguac

SEQ ID NO: 804455 - RNA, 22 nt, Human
aaagacauauuucuaaguuuau

SEQ ID NO: 804456 - RNA, 22 nt, Human
caggaugauguuaauugaaguu

SEQ ID NO: 804457 - RNA, 22 nt, Human
caggaagaaggguggugagucc

SEQ ID NO: 804458 - RNA, 22 nt, Human
auuccagacagguaaauuaggu

SEQ ID NO: 804459 - RNA, 22 nt, Human
augauuuccaguuguugcuaag

SEQ ID NO: 804460 - RNA, 22 nt, Human
ggcacagagcuuugucccaguu

SEQ ID NO: 804461 - RNA, 22 nt, Human
gaaacacuaugccaagacaggg

SEQ ID NO: 804462 - RNA, 22 nt, Human
cugccucuuaaguggauggagu

SEQ ID NO: 804463 - RNA, 22 nt, Human
agcuugaguuuuggaugaagug

SEQ ID NO: 804464 - RNA, 21 nt, Human
gccugcccucugugauggcca

SEQ ID NO: 804465 - RNA, 22 nt, Human
aaugucauuuaaaauaauucug

SEQ ID NO: 804466 - RNA, 19 nt, Human
uuucaaagggcauaagccu

SEQ ID NO: 804467 - RNA, 22 nt, Human
agagcccagguccuggagaggg

SEQ ID NO: 804468 - RNA, 22 nt, Human
caaauagugucacauugugagg

SEQ ID NO: 804469 - RNA, 22 nt, Human
auuucauguuaacugaacagaa

SEQ ID NO: 804470 - RNA, 22 nt, Human
ugaaauguuuaucucuccugcu

SEQ ID NO: 804471 - RNA, 20 nt, Human
uuuacauuuugaaacaguga

SEQ ID NO: 804472 - RNA, 22 nt, Human
acagaacugcagacagugccaa

SEQ ID NO: 804473 - RNA, 22 nt, Human
uacugucuaauaagauugaugg

SEQ ID NO: 804474 - RNA, 22 nt, Human
uagauuugauguaagcauaguc

SEQ ID NO: 804475 - RNA, 22 nt, Human
cuuccuggcaaagcaaucagag

SEQ ID NO: 804476 - RNA, 22 nt, Human
uuucuaagaauauugcucuuaa

SEQ ID NO: 804477 - RNA, 22 nt, Human
auggaagcagacagguaauucc

SEQ ID NO: 804478 - RNA, 22 nt, Human
aguugcagccuucaggagaccc

SEQ ID NO: 804479 - RNA, 22 nt, Human
uguagauauagaaaaagacuga

SEQ ID NO: 804480 - RNA, 22 nt, Human
gaggccagcgcgcagcacuuuu

SEQ ID NO: 804481 - RNA, 22 nt, Human
uauucacagguuccggagauua

SEQ ID NO: 804482 - RNA, 22 nt, Human
agggcagccucucagccuaggu

SEQ ID NO: 804483 - RNA, 19 nt, Human
uggucccauacugcuggcc

SEQ ID NO: 804484 - RNA, 22 nt, Human
gucuggggaagucagggcauca

SEQ ID NO: 804485 - RNA, 22 nt, Human
gaguguuuuacucaaagaaaga

SEQ ID NO: 804486 - RNA, 22 nt, Human
cuguggagugcuuggcucagug

SEQ ID NO: 804487 - RNA, 22 nt, Human
augagaugugucuaauggaacc

SEQ ID NO: 804488 - RNA, 22 nt, Human
ugguguguuagagcucagggca

SEQ ID NO: 804489 - RNA, 22 nt, Human
aaacagcagcuguuuaauuugc

SEQ ID NO: 804490 - RNA, 22 nt, Human
guuacaaaugccaaagcugaga

SEQ ID NO: 804491 - RNA, 22 nt, Human
aggaaaauggaccagaguuguu

SEQ ID NO: 804492 - RNA, 22 nt, Human
gugguuuuuagauuucuacagu

SEQ ID NO: 804493 - RNA, 22 nt, Human
gaaagugcucucucuauacaca

SEQ ID NO: 804494 - RNA, 22 nt, Human
ucacaugcuugaggaaagaaaa

SEQ ID NO: 804495 - RNA, 22 nt, Human
uacaggugguaaaaauauuguu

SEQ ID NO: 804496 - RNA, 22 nt, Human
guuuaugaauugcauucccuuu

SEQ ID NO: 804497 - RNA, 22 nt, Human
agggcagcagcggcccaggccu

SEQ ID NO: 804498 - RNA, 22 nt, Human
agcugccugcugcacucggugc

SEQ ID NO: 804499 - RNA, 21 nt, Human
uucccagcaccuagcacaggu

SEQ ID NO: 804500 - RNA, 22 nt, Human
cucaccauggaucuuccauuuc

SEQ ID NO: 804501 - RNA, 22 nt, Human
agaaaagggcaggagggauaca

SEQ ID NO: 804502 - RNA, 22 nt, Human
cagguggggcagcugugggagc

SEQ ID NO: 804503 - RNA, 22 nt, Human
uucaguguacagugaagggauu

SEQ ID NO: 804504 - RNA, 22 nt, Human
ugcagaagcagagaguugccaa

SEQ ID NO: 804505 - RNA, 22 nt, Human
ggcuggaccaugcugccccuuc

SEQ ID NO: 804506 - RNA, 22 nt, Human
acuccuggaaaagaacgcaggg

SEQ ID NO: 804507 - RNA, 22 nt, Human
ucuccuggauggaccuucucuu

SEQ ID NO: 804508 - RNA, 22 nt, Human
uaaacaagcuggacugauaagu

SEQ ID NO: 804509 - RNA, 22 nt, Human
caggcacacaggcucccugggc

SEQ ID NO: 804510 - RNA, 22 nt, Human
auaaaugccucagaaucauccc

SEQ ID NO: 804511 - RNA, 22 nt, Human
ugcugccaccugugguagucug

SEQ ID NO: 804512 - RNA, 22 nt, Human
ucagcugaguucuagagcacuc

SEQ ID NO: 804513 - RNA, 22 nt, Human
accagcacggauuagaaugcuu

SEQ ID NO: 804514 - RNA, 22 nt, Human
aacaucuuuuuguuugcugaaa

SEQ ID NO: 804515 - RNA, 22 nt, Human
uuaugagacuguuuuacacacu

SEQ ID NO: 804516 - RNA, 22 nt, Human
ucuuugauuuuguuacuaagac

SEQ ID NO: 804517 - RNA, 22 nt, Human
uguggcagauuuuauaaauugc

SEQ ID NO: 804518 - RNA, 22 nt, Human
auaacacuaaauguauguaaca

SEQ ID NO: 804519 - RNA, 22 nt, Human
auuguuuuauuaaaugagcccu

SEQ ID NO: 804520 - RNA, 22 nt, Human
ggugggaaggccacugaagguu

SEQ ID NO: 804521 - RNA, 22 nt, Human
ugcuggaguaacaagacacuca

SEQ ID NO: 804522 - RNA, 22 nt, Human
uucucagguagugcugaugcug

SEQ ID NO: 804523 - RNA, 22 nt, Human
cauguuuuguguacagaauauu

SEQ ID NO: 804524 - RNA, 19 nt, Human
agcagcucagggaggcacc

SEQ ID NO: 804525 - RNA, 22 nt, Human
gccaggaggcuuaacuggacag

SEQ ID NO: 804526 - RNA, 22 nt, Human
cagccuguagaauacaguaaau

SEQ ID NO: 804527 - RNA, 22 nt, Human
ucuacuauguaugcuuuaugcg

SEQ ID NO: 804528 - RNA, 22 nt, Human
uggccaccccuuucucugcacu

SEQ ID NO: 804529 - RNA, 22 nt, Human
uaaccauauucacacuaugccc

SEQ ID NO: 804530 - RNA, 22 nt, Human
cuucaaauacaaguagauuaug

SEQ ID NO: 804531 - RNA, 22 nt, Human
ccaggcagagugcuccagaaag

SEQ ID NO: 804532 - RNA, 22 nt, Human
uggaccagcagccccagugccu

SEQ ID NO: 804533 - RNA, 22 nt, Human
aacuuccugacuucuaaugagu

SEQ ID NO: 804534 - RNA, 22 nt, Human
cugucugaauccuaagcuuccu

SEQ ID NO: 804535 - RNA, 22 nt, Human
uuucugaauuccuaggauguug

SEQ ID NO: 804536 - RNA, 22 nt, Human
auuuacagaagcauguaauagc

SEQ ID NO: 804537 - RNA, 22 nt, Human
uaauacagggcacuuugaguga

SEQ ID NO: 804538 - RNA, 22 nt, Human
uucuucagauccuacaagucug

SEQ ID NO: 804539 - RNA, 22 nt, Human
uuuuuauaggucagggcaaguc

SEQ ID NO: 804540 - RNA, 22 nt, Human
gucauucuuaacaacucaguag

SEQ ID NO: 804541 - RNA, 22 nt, Human
ucuucagguagugaguggggug

SEQ ID NO: 804542 - RNA, 22 nt, Human
uccccucccuuccaacagagcu

SEQ ID NO: 804543 - RNA, 22 nt, Human
aauauaauuuuauuccuagagu

SEQ ID NO: 804544 - RNA, 22 nt, Human
aauccagaugagcaaucauacu

SEQ ID NO: 804545 - RNA, 23 nt, Human
guucauuuuauugucugauugcu

SEQ ID NO: 804546 - RNA, 22 nt, Human
aucuuucucugcacuauacaau

SEQ ID NO: 804547 - RNA, 22 nt, Human
uuucucaaccucaacacuauuu

SEQ ID NO: 804548 - RNA, 22 nt, Human
uggaaauagauaguaucauuca

SEQ ID NO: 804549 - RNA, 22 nt, Human
auuucaguagaaaaucuugauu

SEQ ID NO: 804550 - RNA, 19 nt, Human
uguuuuguuaaagcagucc

SEQ ID NO: 804551 - RNA, 22 nt, Human
acacauaagaaacuacaaagag

SEQ ID NO: 804552 - RNA, 22 nt, Human
aggcagcagagguugaggaaag

SEQ ID NO: 804553 - RNA, 22 nt, Human
aggcuguucuaggagaguggga

SEQ ID NO: 804554 - RNA, 22 nt, Human
gaauucacuugucuuccauuuu

SEQ ID NO: 804555 - RNA, 22 nt, Human
aaauguacugauacuuauuuua

SEQ ID NO: 804556 - RNA, 22 nt, Human
ucagcaacuauuuaucaaauuc

SEQ ID NO: 804557 - RNA, 22 nt, Human
gcaaggcagcgcggaguagcua

SEQ ID NO: 804558 - RNA, 22 nt, Human
ccaggcacucagagacugggac

SEQ ID NO: 804559 - RNA, 22 nt, Human
aaacaccaagagcuagcuauua

SEQ ID NO: 804560 - RNA, 22 nt, Human
gggcugacgaaggccaugugug

SEQ ID NO: 804561 - RNA, 22 nt, Human
gcaggccuuggcaaugagccug

SEQ ID NO: 804562 - RNA, 22 nt, Human
caaggcagucccuacucccugc

SEQ ID NO: 804563 - RNA, 22 nt, Human
ucucaggacuccucuggccaua

SEQ ID NO: 804564 - RNA, 22 nt, Human
aaaguauuugugauuuuuacca

SEQ ID NO: 804565 - RNA, 22 nt, Human
augcaacaaauugugugcaaua

SEQ ID NO: 804566 - RNA, 22 nt, Human
ugagccugcugucgcuggaccc

SEQ ID NO: 804567 - RNA, 22 nt, Human
ucagauaauuaaucaugaaauu

SEQ ID NO: 804568 - RNA, 19 nt, Human
cccaggagucuggcugguu

SEQ ID NO: 804569 - RNA, 22 nt, Human
uaggccaguugguggcccugga

SEQ ID NO: 804570 - RNA, 22 nt, Human
ggcucagcuuaucugggcaggc

SEQ ID NO: 804571 - RNA, 22 nt, Human
ggcuucucucuucacauggcuu

SEQ ID NO: 804572 - RNA, 22 nt, Human
agagggagaagcuaaaauaacu

SEQ ID NO: 804573 - RNA, 22 nt, Human
ucugaagcuggaggaagcuuug

SEQ ID NO: 804574 - RNA, 22 nt, Human
aguggcagagaccccagccagc

SEQ ID NO: 804575 - RNA, 22 nt, Human
ucuaaaaaagucuguucacuug

SEQ ID NO: 804576 - RNA, 22 nt, Human
aaggaaucacuucuuuaaauga

SEQ ID NO: 804577 - RNA, 22 nt, Human
uuucauguuuucuuaaauggca

SEQ ID NO: 804578 - RNA, 22 nt, Human
uggccaggcuggucuggaacgc

SEQ ID NO: 804579 - RNA, 22 nt, Human
agcuccugcuugacagaagagg

SEQ ID NO: 804580 - RNA, 22 nt, Human
uucuucaggaagagccuggacu

SEQ ID NO: 804581 - RNA, 22 nt, Human
guuucuacaugccucuuucacc

SEQ ID NO: 804582 - RNA, 22 nt, Human
ggcccucugaguagcugcaaac

SEQ ID NO: 804583 - RNA, 22 nt, Human
ucaggagguaggacauacuggu

SEQ ID NO: 804584 - RNA, 22 nt, Human
acauucaaggccuucugacaca

SEQ ID NO: 804585 - RNA, 18 nt, Human
uuucauugagugugauau

SEQ ID NO: 804586 - RNA, 18 nt, Human
aagcugcccucaggcagg

SEQ ID NO: 804587 - RNA, 22 nt, Human
auuuaagaggcugcuagaguau

SEQ ID NO: 804588 - RNA, 22 nt, Human
acagugaugagggaauuuugug

SEQ ID NO: 804589 - RNA, 22 nt, Human
gacuucaugugcaagcgcuuug

SEQ ID NO: 804590 - RNA, 22 nt, Human
ccagcugugccggggaccuggg

SEQ ID NO: 804591 - RNA, 22 nt, Human
acaggcagugauuuccucuggu

SEQ ID NO: 804592 - RNA, 22 nt, Human
ugaggccagccacagccacccu

SEQ ID NO: 804593 - RNA, 19 nt, Human
aggaaagguggccuuagca

SEQ ID NO: 804594 - RNA, 22 nt, Human
aacuagaaagaacauauuucca

SEQ ID NO: 804595 - RNA, 22 nt, Human
uggauggauugacgaaggcagc

SEQ ID NO: 804596 - RNA, 17 nt, Human
aauacuuccaacuagug

SEQ ID NO: 804597 - RNA, 22 nt, Human
uuucccaauugagagguucugu

SEQ ID NO: 804598 - RNA, 22 nt, Human
uuuaaucuucaaaauagucuua

SEQ ID NO: 804599 - RNA, 22 nt, Human
uugcuaaaaauggaauuauagg

SEQ ID NO: 804600 - RNA, 22 nt, Human
uguggcagaaccagaauucaaa

SEQ ID NO: 804601 - RNA, 22 nt, Human
accaaaaauuguggggcugaau

SEQ ID NO: 804602 - RNA, 22 nt, Human
aaaugcaugagaaaguauucug

SEQ ID NO: 804603 - RNA, 22 nt, Human
caggaagagguaucaccgagca

SEQ ID NO: 804604 - RNA, 22 nt, Human
gggcgagggcgaaagcgagagc

SEQ ID NO: 804605 - RNA, 22 nt, Human
acauguuagcuacuauuguuau

SEQ ID NO: 804606 - RNA, 22 nt, Human
ccucagaggugaacaucagugc

SEQ ID NO: 804607 - RNA, 19 nt, Human
cugugggugugcaagggug

SEQ ID NO: 804608 - RNA, 22 nt, Human
ggacauggaaaucggcuugcuc

SEQ ID NO: 804609 - RNA, 22 nt, Human
ccauguggggucaguguuuggg

SEQ ID NO: 804610 - RNA, 22 nt, Human
acagcucagacaucacugcucu

SEQ ID NO: 804611 - RNA, 22 nt, Human
accaggcacucuuguggcagug

SEQ ID NO: 804612 - RNA, 22 nt, Human
cuggcacacagcaggcucucag

SEQ ID NO: 804613 - RNA, 22 nt, Human
uuaaagaggcaugggaauguau

SEQ ID NO: 804614 - RNA, 22 nt, Human
acacagagguggccacucuuuu

SEQ ID NO: 804615 - RNA, 22 nt, Human
agccagcuguccucccuuuccu

SEQ ID NO: 804616 - RNA, 22 nt, Human
acaaaauagaguucuccccugg

SEQ ID NO: 804617 - RNA, 22 nt, Human
gaggugaguggaucacgagguc

SEQ ID NO: 804618 - RNA, 22 nt, Human
ucagugcuccuaaagugaaugc

SEQ ID NO: 804619 - RNA, 22 nt, Human
gcacugggugugaggcagcguc

SEQ ID NO: 804620 - RNA, 23 nt, Human
gggcauggaguguagguggaagg

SEQ ID NO: 804621 - RNA, 22 nt, Human
gucuccagggcugcuggcgccu

SEQ ID NO: 804622 - RNA, 18 nt, Human
ucugaaggaaugauucca

SEQ ID NO: 804623 - RNA, 22 nt, Human
ccugggcuuuggaacaguacuu

SEQ ID NO: 804624 - RNA, 22 nt, Human
uauuuugcaaaccugaguuuga

SEQ ID NO: 804625 - RNA, 22 nt, Human
guuauauuggcagaagagaaga

SEQ ID NO: 804626 - RNA, 22 nt, Human
uuucaagucaguagcuaaucau

SEQ ID NO: 804627 - RNA, 22 nt, Human
cagcaggcugcgauugcucauu

SEQ ID NO: 804628 - RNA, 22 nt, Human
uuugcuuucuugauucagauua

SEQ ID NO: 804629 - RNA, 22 nt, Human
gcacacagaauugauucacugu

SEQ ID NO: 804630 - RNA, 22 nt, Human
uaagaacuucggacauguuauc

SEQ ID NO: 804631 - RNA, 22 nt, Human
aagagggaagucaccuggaggu

SEQ ID NO: 804632 - RNA, 22 nt, Human
gugcagcugccgaucagauagg

SEQ ID NO: 804633 - RNA, 22 nt, Human
ucuccuggccuuuagguuaagg

SEQ ID NO: 804634 - RNA, 22 nt, Human
cauggcuugcuaguggcccaag

SEQ ID NO: 804635 - RNA, 22 nt, Human
uuggaaacgucaccuuuuccuu

SEQ ID NO: 804636 - RNA, 22 nt, Human
gguugguaacucccugugcagu

SEQ ID NO: 804637 - RNA, 23 nt, Human
uaucuuuuucaauguuggaaaua

SEQ ID NO: 804638 - RNA, 22 nt, Human
uguuuacagcacugcacacugc

SEQ ID NO: 804639 - RNA, 22 nt, Human
ugcacaguguaaugaaucagaa

SEQ ID NO: 804640 - RNA, 22 nt, Human
augcuuuuccaggagaaauaua

SEQ ID NO: 804641 - RNA, 22 nt, Human
agcugccugccaugccgcuggu

SEQ ID NO: 804642 - RNA, 22 nt, Human
cagggugguaccagcaucuagu

SEQ ID NO: 804643 - RNA, 23 nt, Human
aaaggcaggccuaggacauauug

SEQ ID NO: 804644 - RNA, 22 nt, Human
aggcccuguaagguguggagau

SEQ ID NO: 804645 - RNA, 22 nt, Human
auuuugcugcuaugccuugcaa

SEQ ID NO: 804646 - RNA, 19 nt, Human
caggccucuggucugcugu

SEQ ID NO: 804647 - RNA, 22 nt, Human
gaaaggccagcucacagaugag

SEQ ID NO: 804648 - RNA, 22 nt, Human
aagcuuuguucuucacagagug

SEQ ID NO: 804649 - RNA, 22 nt, Human
uccccaguaagccugcacugug

SEQ ID NO: 804650 - RNA, 22 nt, Human
cugagcagugguucuugagcgc

SEQ ID NO: 804651 - RNA, 22 nt, Human
aagcaauauacugauaugauua

SEQ ID NO: 804652 - RNA, 22 nt, Human
uuacacagacauggcaucauga

SEQ ID NO: 804653 - RNA, 22 nt, Human
uggcccugcagaacuagccugg

SEQ ID NO: 804654 - RNA, 22 nt, Human
cuccugggaaaugaaggggcag

SEQ ID NO: 804655 - RNA, 22 nt, Human
uagugcuuaacacaaagugauu

SEQ ID NO: 804656 - RNA, 22 nt, Human
gcagcugccuaaagugcuaaga

SEQ ID NO: 804657 - RNA, 22 nt, Human
gaauuguaaguaccagcaugcu

SEQ ID NO: 804658 - RNA, 22 nt, Human
ggggacccucaggacugcgucu

SEQ ID NO: 804659 - RNA, 22 nt, Human
caggccagugugcuucccaggc

SEQ ID NO: 804660 - RNA, 22 nt, Human
ucacagaaguugaauuugcaug

SEQ ID NO: 804661 - RNA, 22 nt, Human
cuggcacaguuaacauaugcua

SEQ ID NO: 804662 - RNA, 22 nt, Human
uuuauuuaccuuauguccucca

SEQ ID NO: 804663 - RNA, 18 nt, Human
gacccaggaaagaguccu

SEQ ID NO: 804664 - RNA, 19 nt, Human
cuucugcagggugacagug

SEQ ID NO: 804665 - RNA, 22 nt, Human
ccagccucacuggcaucaccua

SEQ ID NO: 804666 - RNA, 22 nt, Human
cugaaaugggcaaaaguagauu

SEQ ID NO: 804667 - RNA, 22 nt, Human
cgccggcuugaggcaggcggca

SEQ ID NO: 804668 - RNA, 22 nt, Human
ugcaaauauuuccuuauagcca

SEQ ID NO: 804669 - RNA, 22 nt, Human
agagaagggccuguauguaauc

SEQ ID NO: 804670 - RNA, 22 nt, Human
uugacaaaaaccucauuucacc

SEQ ID NO: 804671 - RNA, 22 nt, Human
ccaggcucagcgcgcacgucug

SEQ ID NO: 804672 - RNA, 22 nt, Human
gcuuuuucaaaugaaagcuggu

SEQ ID NO: 804673 - RNA, 18 nt, Human
gaugaggcugucugagaa

SEQ ID NO: 804674 - RNA, 22 nt, Human
uuucuaagaugugguuucaagg

SEQ ID NO: 804675 - RNA, 22 nt, Human
uucagaaugacuuauguaaggc

SEQ ID NO: 804676 - RNA, 22 nt, Human
guggugcaggccagcaggggcg

SEQ ID NO: 804677 - RNA, 22 nt, Human
uuuguauaaauuggagcaaugu

SEQ ID NO: 804678 - RNA, 22 nt, Human
ccuacauaacacugccaaacug

SEQ ID NO: 804679 - RNA, 22 nt, Human
uucuuuucuuggcaggaguaga

SEQ ID NO: 804680 - RNA, 22 nt, Human
cuacaacauagucuucuacaga

SEQ ID NO: 804681 - RNA, 22 nt, Human
gcaaaucaccaccuagcuggau

SEQ ID NO: 804682 - RNA, 22 nt, Human
agggccugguucuguguaggga

SEQ ID NO: 804683 - RNA, 22 nt, Human
augccaaauucucagccucuuu

SEQ ID NO: 804684 - RNA, 22 nt, Human
uuuggagagcagcuaggcccuu

SEQ ID NO: 804685 - RNA, 22 nt, Human
aagcaggcaucuuggaggucaa

SEQ ID NO: 804686 - RNA, 22 nt, Human
ccagugucuucagaguaaaucu

SEQ ID NO: 804687 - RNA, 22 nt, Human
ugggacucacucuuuuggccag

SEQ ID NO: 804688 - RNA, 20 nt, Human
cuuugccuauucucugccug

SEQ ID NO: 804689 - RNA, 22 nt, Human
aauaccuuccaacaucaagaca

SEQ ID NO: 804690 - RNA, 22 nt, Human
ugucugaggaagucagcccuuu

SEQ ID NO: 804691 - RNA, 22 nt, Human
cagcuucaacugcacagucaac

SEQ ID NO: 804692 - RNA, 17 nt, Human
gcuggcugacccaugcc

SEQ ID NO: 804693 - RNA, 22 nt, Human
aggcccuggacacucaagccgg

SEQ ID NO: 804694 - RNA, 22 nt, Human
cagagggagcccuccaggagca

SEQ ID NO: 804695 - RNA, 22 nt, Human
aaggcuggguaaccuguccacu

SEQ ID NO: 804696 - RNA, 22 nt, Human
ucuuuccuagaggcugaugagu

SEQ ID NO: 804697 - RNA, 17 nt, Human
cccagcuggcagugccg

SEQ ID NO: 804698 - RNA, 20 nt, Human
ugcacagacaaugagcccag

SEQ ID NO: 804699 - RNA, 22 nt, Human
ccaggcugugcuuuucauaaau

SEQ ID NO: 804700 - RNA, 22 nt, Human
agcagggcagugaucagaaagg

SEQ ID NO: 804701 - RNA, 22 nt, Human
ugugcucugcaaucaguucuuu

SEQ ID NO: 804702 - RNA, 22 nt, Human
gaaucagaaucucuaagguggg

SEQ ID NO: 804703 - RNA, 22 nt, Human
uugucuuucccagcuucuagag

SEQ ID NO: 804704 - RNA, 22 nt, Human
agggggaggcugugcugcgucu

SEQ ID NO: 804705 - RNA, 22 nt, Human
agaggcugggcaggacccacag

SEQ ID NO: 804706 - RNA, 22 nt, Human
ggagaaaggcauagcagaaccu

SEQ ID NO: 804707 - RNA, 22 nt, Human
uuucuugugccuaauuuugggc

SEQ ID NO: 804708 - RNA, 22 nt, Human
ugcugggcuagaagcugaggcc

SEQ ID NO: 804709 - RNA, 22 nt, Human
ccugacaguuaauuguccugua

SEQ ID NO: 804710 - RNA, 22 nt, Human
accaggcaaaaccacaggagca

SEQ ID NO: 804711 - RNA, 22 nt, Human
aggaaacagagugaagcuuggg

SEQ ID NO: 804712 - RNA, 22 nt, Human
gggacagacccaugggccaggu

SEQ ID NO: 804713 - RNA, 19 nt, Human
uaaaggaagaagggaggau

SEQ ID NO: 804714 - RNA, 22 nt, Human
cacccaggcuggagugcauugg

SEQ ID NO: 804715 - RNA, 22 nt, Human
aaguuucaugacuugguuauua

SEQ ID NO: 804716 - RNA, 22 nt, Human
cuuacaaauacacuuaggagag

SEQ ID NO: 804717 - RNA, 22 nt, Human
uggagaagucaaagugaacagg

SEQ ID NO: 804718 - RNA, 22 nt, Human
uauguuuaaauguauguguaug

SEQ ID NO: 804719 - RNA, 22 nt, Human
uuucacaugguacugccuguuu

SEQ ID NO: 804720 - RNA, 22 nt, Human
gcaaagcaagauucagauguag

SEQ ID NO: 804721 - RNA, 22 nt, Human
uccagugaucuagggagcugga

SEQ ID NO: 804722 - RNA, 22 nt, Human
aguuuuauguagacaauucauu

SEQ ID NO: 804723 - RNA, 22 nt, Human
uugacacaguuuucucauuaag

SEQ ID NO: 804724 - RNA, 22 nt, Human
gcagugauggggaucucacugg

SEQ ID NO: 804725 - RNA, 22 nt, Human
uuacaacaccaggcaguauccu

SEQ ID NO: 804726 - RNA, 22 nt, Human
acauacaucaaguaucacaaga

SEQ ID NO: 804727 - RNA, 19 nt, Human
cuuugucagaacaugcuuc

SEQ ID NO: 804728 - RNA, 22 nt, Human
uucuucagacuacugaugauug

SEQ ID NO: 804729 - RNA, 22 nt, Human
caaggaaaaagcgagcucgggg

SEQ ID NO: 804730 - RNA, 22 nt, Human
ucuuuuguggaugaagaaaugg

SEQ ID NO: 804731 - RNA, 22 nt, Human
cuccagaggaugcaggugaggg

SEQ ID NO: 804732 - RNA, 22 nt, Human
aggcacugugcugaugucuuau

SEQ ID NO: 804733 - RNA, 22 nt, Human
ugccaggggaccuagggauguc

SEQ ID NO: 804734 - RNA, 22 nt, Human
aggccaaauguguauaaaacau

SEQ ID NO: 804735 - RNA, 22 nt, Human
gcagcagcccagggcucucaga

SEQ ID NO: 804736 - RNA, 20 nt, Human
acugcuucuuucucugaccu

SEQ ID NO: 804737 - RNA, 22 nt, Human
uccagagagaaaaacaagcuuu

SEQ ID NO: 804738 - RNA, 22 nt, Human
aucuacaaaaacugucucagga

SEQ ID NO: 804739 - RNA, 22 nt, Human
uauuucugggaguucagaaauu

SEQ ID NO: 804740 - RNA, 22 nt, Human
ugucauuuaaagcuuuccagau

SEQ ID NO: 804741 - RNA, 22 nt, Human
ucuucccagaggaggugccagc

SEQ ID NO: 804742 - RNA, 22 nt, Human
caggcuacauuugcucugagaa

SEQ ID NO: 804743 - RNA, 18 nt, Human
cccugaggcuagcaugcu

SEQ ID NO: 804744 - RNA, 22 nt, Human
cagggagaggccucuguugccc

SEQ ID NO: 804745 - RNA, 22 nt, Human
gcagcaggaauaggauaagcaa

SEQ ID NO: 804746 - RNA, 22 nt, Human
agacacagugaguuucuuuccc

SEQ ID NO: 804747 - RNA, 19 nt, Human
ugggcagguucaguaaugg

SEQ ID NO: 804748 - RNA, 22 nt, Human
aaaacauuuuacugccaucuca

SEQ ID NO: 804749 - RNA, 22 nt, Human
cagcaucucuuuuugcauuccu

SEQ ID NO: 804750 - RNA, 22 nt, Human
uauacaaguaaugcugaaugau

SEQ ID NO: 804751 - RNA, 22 nt, Human
gagggggcucccugaagccagu

SEQ ID NO: 804752 - RNA, 22 nt, Human
ucuuuaguauugaguuauggua

SEQ ID NO: 804753 - RNA, 22 nt, Human
aacccgggaggcagagguugug

SEQ ID NO: 804754 - RNA, 22 nt, Human
caguguacuuggaauguaacag

SEQ ID NO: 804755 - RNA, 22 nt, Human
ucucugaaagcagcugcucauc

SEQ ID NO: 804756 - RNA, 22 nt, Human
aguuuuauaucuuccauugguu

SEQ ID NO: 804757 - RNA, 22 nt, Human
ucucuuggacauguggcucugc

SEQ ID NO: 804758 - RNA, 20 nt, Human
cugcuguguuauuguagaac

SEQ ID NO: 804759 - RNA, 22 nt, Human
cgaggccaugcaugcugaggac

SEQ ID NO: 804760 - RNA, 22 nt, Human
uucucucuuacugccaugcugu

SEQ ID NO: 804761 - RNA, 22 nt, Human
caguggaggccuugggaccuuu

SEQ ID NO: 804762 - RNA, 22 nt, Human
uggaaauauuggguaauaguug

SEQ ID NO: 804763 - RNA, 22 nt, Human
ccacaugaugaggaagcugaac

SEQ ID NO: 804764 - RNA, 22 nt, Human
cugccuggcuaaacucaagucg

SEQ ID NO: 804765 - RNA, 22 nt, Human
uauggcaauugucuaaguuuua

SEQ ID NO: 804766 - RNA, 22 nt, Human
ucuuucuucuuucauaguguga

SEQ ID NO: 804767 - RNA, 18 nt, Human
uggguggcuagggaguuu

SEQ ID NO: 804768 - RNA, 22 nt, Human
ucagggcugcauacaggagaua

SEQ ID NO: 804769 - RNA, 22 nt, Human
cauaucaaagagaaggauagga

SEQ ID NO: 804770 - RNA, 22 nt, Human
ggagccugagcggcccagggcc

SEQ ID NO: 804771 - RNA, 22 nt, Human
acacagaguaucuuuugccuag

SEQ ID NO: 804772 - RNA, 22 nt, Human
auuuguucagcauugaauuugg

SEQ ID NO: 804773 - RNA, 22 nt, Human
gugucuuuauuccucuauguuu

SEQ ID NO: 804774 - RNA, 22 nt, Human
uguuuuucaaauauugcucugu

SEQ ID NO: 804775 - RNA, 22 nt, Human
ccugucuaccagucacuuagcg

SEQ ID NO: 804776 - RNA, 22 nt, Human
ccugcacuucucacagcugcug

SEQ ID NO: 804777 - RNA, 22 nt, Human
gaaaauuucugccacaugugug

SEQ ID NO: 804778 - RNA, 22 nt, Human
aacuacauuuuacagaagauga

SEQ ID NO: 804779 - RNA, 22 nt, Human
uuugaaaaaggccuuugguaug

SEQ ID NO: 804780 - RNA, 22 nt, Human
aguuucauauuaccaugucacc

SEQ ID NO: 804781 - RNA, 22 nt, Human
ugcagggccccucugcaugagu

SEQ ID NO: 804782 - RNA, 22 nt, Human
aagccaguccucuacugggcac

SEQ ID NO: 804783 - RNA, 22 nt, Human
uccucuucugcccaucagaggc

SEQ ID NO: 804784 - RNA, 22 nt, Human
caggacaggaguggggucaaag

SEQ ID NO: 804785 - RNA, 22 nt, Human
ucaugcacuacauaacgauguu

SEQ ID NO: 804786 - RNA, 22 nt, Human
acagguagguuaaaauguguca

SEQ ID NO: 804787 - RNA, 22 nt, Human
gccucccuguagaggccagccu

SEQ ID NO: 804788 - RNA, 23 nt, Human
ggaaagagaggaguugugcauag

SEQ ID NO: 804789 - RNA, 20 nt, Human
agguccugggacuggcagag

SEQ ID NO: 804790 - RNA, 22 nt, Human
uccaggcucucaggugucagca

SEQ ID NO: 804791 - RNA, 22 nt, Human
accagcagggcugggccaaugg

SEQ ID NO: 804792 - RNA, 22 nt, Human
gaacuggguccuugagucuaga

SEQ ID NO: 804793 - RNA, 22 nt, Human
uggugccacaagaauacaaagc

SEQ ID NO: 804794 - RNA, 22 nt, Human
ucuuuggcauuuaggagcagga

SEQ ID NO: 804795 - RNA, 22 nt, Human
ugcaggcuccaggugcacauau

SEQ ID NO: 804796 - RNA, 22 nt, Human
gaaggcccagucaaggggcuag

SEQ ID NO: 804797 - RNA, 22 nt, Human
aaucagaaucaguugacacagc

SEQ ID NO: 804798 - RNA, 22 nt, Human
aaagugcaguccaugaaauuaa

SEQ ID NO: 804799 - RNA, 22 nt, Human
caggcagagccaaucguggggu

SEQ ID NO: 804800 - RNA, 22 nt, Human
cauggggaugaggcugagacuu

SEQ ID NO: 804801 - RNA, 22 nt, Human
uuacuuuucuauucgauaugug

SEQ ID NO: 804802 - RNA, 22 nt, Human
gcacacagcuagauuaccauuc

SEQ ID NO: 804803 - RNA, 20 nt, Human
cccucccagaugcuucccaa

SEQ ID NO: 804804 - RNA, 22 nt, Human
auauauuuugcggucacguggc

SEQ ID NO: 804805 - RNA, 22 nt, Human
augaaaugugaaugcuuuucau

SEQ ID NO: 804806 - RNA, 22 nt, Human
ucuucuuuggaugaaagaauau

SEQ ID NO: 804807 - RNA, 21 nt, Human
gccagggaagagaguuggcug

SEQ ID NO: 804808 - RNA, 22 nt, Human
uagaaagugaagguuaauuaau

SEQ ID NO: 804809 - RNA, 22 nt, Human
gauagaaagagugguucuuuuu

SEQ ID NO: 804810 - RNA, 20 nt, Human
aaucagaaagugugagcucu

SEQ ID NO: 804811 - RNA, 20 nt, Human
auguuuuauaaaagaacggg

SEQ ID NO: 804812 - RNA, 22 nt, Human
uggugagaccuuguuccuuaug

SEQ ID NO: 804813 - RNA, 22 nt, Human
acuggcugaaaguaaagaacac

SEQ ID NO: 804814 - RNA, 22 nt, Human
ccagcacugcucucagacugag

SEQ ID NO: 804815 - RNA, 22 nt, Human
caggagugaaaugaggcccagg

SEQ ID NO: 804816 - RNA, 22 nt, Human
cuggcaguuggcagggcugcca

SEQ ID NO: 804817 - RNA, 20 nt, Human
agaaccuaaguuaaaacaca

SEQ ID NO: 804818 - RNA, 22 nt, Human
cugccaggacugacgucuucag

SEQ ID NO: 804819 - RNA, 22 nt, Human
cagaaaauagaguuucucugag

SEQ ID NO: 804820 - RNA, 22 nt, Human
uucuuuucccaauauuuugcug

SEQ ID NO: 804821 - RNA, 22 nt, Human
cacaggcuuuuuuggcugaugu

SEQ ID NO: 804822 - RNA, 18 nt, Human
uggagccauugccaccau

SEQ ID NO: 804823 - RNA, 22 nt, Human
accaaaaccugcuacuaaagga

SEQ ID NO: 804824 - RNA, 22 nt, Human
uuuuucaugagacuagaaguca

SEQ ID NO: 804825 - RNA, 22 nt, Human
ucaaaagaaacaccauguuccu

SEQ ID NO: 804826 - RNA, 22 nt, Human
auucacauuuuauuucacugga

SEQ ID NO: 804827 - RNA, 22 nt, Human
ccauuguaaagaguauacuuug

SEQ ID NO: 804828 - RNA, 22 nt, Human
auaucaaaauaaacagcaugca

SEQ ID NO: 804829 - RNA, 22 nt, Human
agaaagugugucauacuaagug

SEQ ID NO: 804830 - RNA, 20 nt, Human
gggaggccagccucagagaa

SEQ ID NO: 804831 - RNA, 22 nt, Human
aacacuuuuuauauauuguauc

SEQ ID NO: 804832 - RNA, 22 nt, Human
acuggacagaggaaauauggag

SEQ ID NO: 804833 - RNA, 22 nt, Human
ggguccagggccaguggcugag

SEQ ID NO: 804834 - RNA, 22 nt, Human
ugcuuaaacauccagacaguau

SEQ ID NO: 804835 - RNA, 22 nt, Human
cccaggagaccugugaaaggac

SEQ ID NO: 804836 - RNA, 22 nt, Human
caggggcuguggcacauggugu

SEQ ID NO: 804837 - RNA, 22 nt, Human
gcugcagcucgccuuccggccu

SEQ ID NO: 804838 - RNA, 22 nt, Human
ggcuggcuggaugaauggauua

SEQ ID NO: 804839 - RNA, 22 nt, Human
ucagaaaggccacauggugcag

SEQ ID NO: 804840 - RNA, 22 nt, Human
cauuuuauccucugggaagcua

SEQ ID NO: 804841 - RNA, 22 nt, Human
uuuuaaagagaugcugugcaua

SEQ ID NO: 804842 - RNA, 22 nt, Human
cccuccagagcuugaccugcug

SEQ ID NO: 804843 - RNA, 22 nt, Human
cuuuuuauaccgugccaguuga

SEQ ID NO: 804844 - RNA, 22 nt, Human
uuaaauuauugagggauuguca

SEQ ID NO: 804845 - RNA, 21 nt, Human
accaaaaccuauacuuucugu

SEQ ID NO: 804846 - RNA, 22 nt, Human
uaaugagaucauaucuucugag

SEQ ID NO: 804847 - RNA, 22 nt, Human
agcugcccuuaauaggcauuca

SEQ ID NO: 804848 - RNA, 22 nt, Human
auauacuguaggccacuauaag

SEQ ID NO: 804849 - RNA, 22 nt, Human
caggccugggcuucggggcuga

SEQ ID NO: 804850 - RNA, 22 nt, Human
ggcuguggcagcuggaaguggu

SEQ ID NO: 804851 - RNA, 22 nt, Human
cagugcaauguuaaauaggaaa

SEQ ID NO: 804852 - RNA, 22 nt, Human
ccuccuggguucaagcgauucu

SEQ ID NO: 804853 - RNA, 22 nt, Human
uuucaacauauaccauaaugcc

SEQ ID NO: 804854 - RNA, 22 nt, Human
aauuaauauuuguggaauuaau

SEQ ID NO: 804855 - RNA, 20 nt, Human
gagauggacagaugaagggg

SEQ ID NO: 804856 - RNA, 22 nt, Human
uaaaagaagcuucaaggccggc

SEQ ID NO: 804857 - RNA, 22 nt, Human
gaaacauucauaugagaaaccu

SEQ ID NO: 804858 - RNA, 22 nt, Human
uccugcugcucuugggaaaccu

SEQ ID NO: 804859 - RNA, 21 nt, Human
agggagcuuuagguagaaguu

SEQ ID NO: 804860 - RNA, 22 nt, Human
gugggcugaggggacaccaagg

SEQ ID NO: 804861 - RNA, 22 nt, Human
ggcaggagggcggacaaugacc

SEQ ID NO: 804862 - RNA, 22 nt, Human
uugcauguccuacaucuguguc

SEQ ID NO: 804863 - RNA, 22 nt, Human
agcagcucaacagugucucuau

SEQ ID NO: 804864 - RNA, 22 nt, Human
aucuuuggacggucccaacuga

SEQ ID NO: 804865 - RNA, 22 nt, Human
gagcuuugcuggaagccugggg

SEQ ID NO: 804866 - RNA, 22 nt, Human
ugcugaggucaccuugcugcua

SEQ ID NO: 804867 - RNA, 22 nt, Human
gccagcugccaaguugugagau

SEQ ID NO: 804868 - RNA, 17 nt, Human
ggcaccagacggagagu

SEQ ID NO: 804869 - RNA, 22 nt, Human
cugcugagacuggcuuuguguc

SEQ ID NO: 804870 - RNA, 20 nt, Human
agggccugcucugugguguc

SEQ ID NO: 804871 - RNA, 22 nt, Human
aggcugugcgaggucucagagu

SEQ ID NO: 804872 - RNA, 18 nt, Human
uguauuucuaacagcuaa

SEQ ID NO: 804873 - RNA, 22 nt, Human
uucugagcugcaacacuaacau

SEQ ID NO: 804874 - RNA, 22 nt, Human
aacugcaauuacuuuugcacca

SEQ ID NO: 804875 - RNA, 22 nt, Human
aguagcaguuuggcugaauuua

SEQ ID NO: 804876 - RNA, 22 nt, Human
auacacauauguguguauaugu

SEQ ID NO: 804877 - RNA, 22 nt, Human
ugucugaaucgcuuccuagagg

SEQ ID NO: 804878 - RNA, 22 nt, Human
acaggcagagucagguuggguu

SEQ ID NO: 804879 - RNA, 22 nt, Human
caggcuggagugcagugucgcc

SEQ ID NO: 804880 - RNA, 22 nt, Human
uuucccucugugccagcuucuc

SEQ ID NO: 804881 - RNA, 22 nt, Human
gacacaggauuccuggcucugc

SEQ ID NO: 804882 - RNA, 22 nt, Human
cacaugaaggcuggggucguga

SEQ ID NO: 804883 - RNA, 22 nt, Human
cugagggucaacuugauuguau

SEQ ID NO: 804884 - RNA, 23 nt, Human
auuuaaugcugaguugaauguua

SEQ ID NO: 804885 - RNA, 22 nt, Human
gugugcaacuuucauuaauauu

SEQ ID NO: 804886 - RNA, 22 nt, Human
agagaauuaauuaggagcacug

SEQ ID NO: 804887 - RNA, 22 nt, Human
gcagaggcacagccccagauga

SEQ ID NO: 804888 - RNA, 21 nt, Human
aauguauguuuaucucacagu

SEQ ID NO: 804889 - RNA, 22 nt, Human
agcccuccuggggccacgcugg

SEQ ID NO: 804890 - RNA, 19 nt, Human
gcacccugaggucauggcc

SEQ ID NO: 804891 - RNA, 22 nt, Human
acaggcucucuauugagugcag

SEQ ID NO: 804892 - RNA, 21 nt, Human
accucaagcaacaaccaaggu

SEQ ID NO: 804893 - RNA, 22 nt, Human
augcagcuucaggauuaugaug

SEQ ID NO: 804894 - RNA, 22 nt, Human
cugggaccuccugagguggagc

SEQ ID NO: 804895 - RNA, 22 nt, Human
uguuuuaguucugucuugcaug

SEQ ID NO: 804896 - RNA, 22 nt, Human
aaugauguauguauaaggcagg

SEQ ID NO: 804897 - RNA, 22 nt, Human
uuaugcuaaccucaucuucucc

SEQ ID NO: 804898 - RNA, 22 nt, Human
gcaguggcaugaugugggcuca

SEQ ID NO: 804899 - RNA, 22 nt, Human
aaauuguugaucuacaguaagg

SEQ ID NO: 804900 - RNA, 22 nt, Human
ccaagcuggauuuagcugcaca

SEQ ID NO: 804901 - RNA, 22 nt, Human
ccugcugugaaacuggcauaug

SEQ ID NO: 804902 - RNA, 22 nt, Human
augcaacagucaguacauccgg

SEQ ID NO: 804903 - RNA, 21 nt, Human
ccaggcugggagggcaguucc

SEQ ID NO: 804904 - RNA, 22 nt, Human
uugcagaacuuaaagacagagu

SEQ ID NO: 804905 - RNA, 17 nt, Human
ggaagaaaaggaucauc

SEQ ID NO: 804906 - RNA, 22 nt, Human
uauguucuaaccuugucuuucc

SEQ ID NO: 804907 - RNA, 22 nt, Human
cuucauagaacagaaauuuaau

SEQ ID NO: 804908 - RNA, 22 nt, Human
aagaaacugaaaguggcuucau

SEQ ID NO: 804909 - RNA, 22 nt, Human
uaguaaaaggucuuccuuuguu

SEQ ID NO: 804910 - RNA, 22 nt, Human
aaauuuuaguaaggaaguugag

SEQ ID NO: 804911 - RNA, 22 nt, Human
cuuaauaaaugguagcuguuau

SEQ ID NO: 804912 - RNA, 22 nt, Human
cagagggaguuucugagguugc

SEQ ID NO: 804913 - RNA, 18 nt, Human
cuaucccuggagcuuggg

SEQ ID NO: 804914 - RNA, 22 nt, Human
ugcugcucaaugagaugccauc

SEQ ID NO: 804915 - RNA, 22 nt, Human
aaacucuuccuuucuuuaaagu

SEQ ID NO: 804916 - RNA, 22 nt, Human
ugguugugcacggagcugcagg

SEQ ID NO: 804917 - RNA, 22 nt, Human
ucuccaaauaguuauauuuaga

SEQ ID NO: 804918 - RNA, 21 nt, Human
uuaauuuauucaugauagcua

SEQ ID NO: 804919 - RNA, 22 nt, Human
auacucaagguuaaugauugaa

SEQ ID NO: 804920 - RNA, 22 nt, Human
auacuuuuaauuccuucugagu

SEQ ID NO: 804921 - RNA, 22 nt, Human
ggcugcagguugguuggcagcu

SEQ ID NO: 804922 - RNA, 22 nt, Human
acucauuugcaugaugugcuau

SEQ ID NO: 804923 - RNA, 22 nt, Human
cuuuucaugagucuguuauggg

SEQ ID NO: 804924 - RNA, 22 nt, Human
agcacuuuaagcaacagaucaa

SEQ ID NO: 804925 - RNA, 22 nt, Human
aucauucuauuguugagcugcc

SEQ ID NO: 804926 - RNA, 22 nt, Human
ugggugagcggcugcacacccg

SEQ ID NO: 804927 - RNA, 22 nt, Human
uaacaaacuggaaauugacauu

SEQ ID NO: 804928 - RNA, 22 nt, Human
ugcagaagcugcaggucagugg

SEQ ID NO: 804929 - RNA, 22 nt, Human
uacuacaaggccgaagcucuca

SEQ ID NO: 804930 - RNA, 22 nt, Human
uagaaauggggaaguaguuagg

SEQ ID NO: 804931 - RNA, 19 nt, Human
cuggcugcaaugccagggu

SEQ ID NO: 804932 - RNA, 18 nt, Human
uuuauauggauagagacc

SEQ ID NO: 804933 - RNA, 22 nt, Human
acaggcagugggccagauuugu

SEQ ID NO: 804934 - RNA, 22 nt, Human
caaacauuuucuacuuccagga

SEQ ID NO: 804935 - RNA, 22 nt, Human
uuuuggcucuugguaggucaga

SEQ ID NO: 804936 - RNA, 16 nt, Human
gcuccugggcccucga

SEQ ID NO: 804937 - RNA, 22 nt, Human
gugacagugacagcuagauagu

SEQ ID NO: 804938 - RNA, 22 nt, Human
cagagggccaucucuaucuuca

SEQ ID NO: 804939 - RNA, 22 nt, Human
uaaauagaaucuaaacugcuca

SEQ ID NO: 804940 - RNA, 22 nt, Human
uaaguaauuugugcagagauac

SEQ ID NO: 804941 - RNA, 20 nt, Human
augcaaacucacaaaauacc

SEQ ID NO: 804942 - RNA, 19 nt, Human
gggccucacccacaccucc

SEQ ID NO: 804943 - RNA, 22 nt, Human
uccuggccgcuggccccugaga

SEQ ID NO: 804944 - RNA, 21 nt, Human
gggcucagcgcucggcuccuc

SEQ ID NO: 804945 - RNA, 22 nt, Human
caggcaggagccagggauucca

SEQ ID NO: 804946 - RNA, 22 nt, Human
ccaggagagcaggcgugcagcu

SEQ ID NO: 804947 - RNA, 22 nt, Human
aggacgcucucgcugaacuucu

SEQ ID NO: 804948 - RNA, 22 nt, Human
gauuuuauagucaggaaaaaga

SEQ ID NO: 804949 - RNA, 22 nt, Human
agaguguaccaaauauccuaca

SEQ ID NO: 804950 - RNA, 22 nt, Human
ucuauuguaggcauguagcuug

SEQ ID NO: 804951 - RNA, 22 nt, Human
caggaaauucuuuuguuugugc

SEQ ID NO: 804952 - RNA, 22 nt, Human
gaagacagaaaccuguuuggcu

SEQ ID NO: 804953 - RNA, 22 nt, Human
auucuucacaccuguuccuguu

SEQ ID NO: 804954 - RNA, 22 nt, Human
uaauagcauuaucaucaaaacu

SEQ ID NO: 804955 - RNA, 22 nt, Human
ccaggcaggcgauggugcagug

SEQ ID NO: 804956 - RNA, 22 nt, Human
gcagagccccauugcuggcggg

SEQ ID NO: 804957 - RNA, 22 nt, Human
aagccagguguuuaggccagcg

SEQ ID NO: 804958 - RNA, 22 nt, Human
cugaaauguuaaauacuuggcu

SEQ ID NO: 804959 - RNA, 22 nt, Human
cccuaggcugaggccagggugc

SEQ ID NO: 804960 - RNA, 22 nt, Human
ggaugcuggggaccaaucucug

SEQ ID NO: 804961 - RNA, 23 nt, Human
uucaaagaucuucugaaaucugu

SEQ ID NO: 804962 - RNA, 22 nt, Human
agccacauggaccugaugcuag

SEQ ID NO: 804963 - RNA, 22 nt, Human
uuuuaucuaccuaugcucauuu

SEQ ID NO: 804964 - RNA, 22 nt, Human
auuugauuagcuguguaauuuu

SEQ ID NO: 804965 - RNA, 22 nt, Human
acugcguggggagcugugacua

SEQ ID NO: 804966 - RNA, 22 nt, Human
uggcccugcuguaucaucugcu

SEQ ID NO: 804967 - RNA, 22 nt, Human
aauauaguucuagaaauauuuu

SEQ ID NO: 804968 - RNA, 22 nt, Human
acucgugucaagauccuaaguc

SEQ ID NO: 804969 - RNA, 22 nt, Human
uggccaugggauagugcagggg

SEQ ID NO: 804970 - RNA, 22 nt, Human
cacaggagaaaggggaagcucg

SEQ ID NO: 804971 - RNA, 22 nt, Human
uggccaguaauagcuucuggug

SEQ ID NO: 804972 - RNA, 22 nt, Human
ugggcgaggcccagggcugcgu

SEQ ID NO: 804973 - RNA, 22 nt, Human
auuuacauuuauuugagaaggu

SEQ ID NO: 804974 - RNA, 22 nt, Human
uaggcuggaggaagcagugccu

SEQ ID NO: 804975 - RNA, 22 nt, Human
ccucccacauugaggacaugcu

SEQ ID NO: 804976 - RNA, 22 nt, Human
gcugccuccugaaagcgcucug

SEQ ID NO: 804977 - RNA, 22 nt, Human
uuacagaguggucuggcuaugu

SEQ ID NO: 804978 - RNA, 22 nt, Human
uaacaauacccauucuaauuac

SEQ ID NO: 804979 - RNA, 22 nt, Human
uccuggcaggguggcagcgggu

SEQ ID NO: 804980 - RNA, 22 nt, Human
ugaggccaggaucccaggcucu

SEQ ID NO: 804981 - RNA, 22 nt, Human
gaaauacaguugggaggaggua

SEQ ID NO: 804982 - RNA, 22 nt, Human
cugagaggcggagguugcagug

SEQ ID NO: 804983 - RNA, 22 nt, Human
uuaaugccaacaaagugauuuu

SEQ ID NO: 804984 - RNA, 22 nt, Human
ugagcagaggccagcaccuggg

SEQ ID NO: 804985 - RNA, 22 nt, Human
ggcagauggggugacaagagag

SEQ ID NO: 804986 - RNA, 22 nt, Human
uggucagguaccucuggcuguc

SEQ ID NO: 804987 - RNA, 22 nt, Human
caggcuggacauuagauacaua

SEQ ID NO: 804988 - RNA, 21 nt, Human
ccaggaaggacugagcucccu

SEQ ID NO: 804989 - RNA, 22 nt, Human
gcagcccucggguacucacgug

SEQ ID NO: 804990 - RNA, 22 nt, Human
uccaggcuggacaugaggcggg

SEQ ID NO: 804991 - RNA, 22 nt, Human
acaggcagguccugucccagcu

SEQ ID NO: 804992 - RNA, 20 nt, Human
uguggaugagguaaggauag

SEQ ID NO: 804993 - RNA, 22 nt, Human
accuuguuguagguacaaaaga

SEQ ID NO: 804994 - RNA, 22 nt, Human
aaacauguuuucugaauauuuu

SEQ ID NO: 804995 - RNA, 22 nt, Human
ugguucuaggcuuugucuuuug

SEQ ID NO: 804996 - RNA, 22 nt, Human
accagcuguguccuggcugcag

SEQ ID NO: 804997 - RNA, 22 nt, Human
aagugacauaccuuacauaugu

SEQ ID NO: 804998 - RNA, 22 nt, Human
ccaggggaaacagggagcacuc

SEQ ID NO: 804999 - RNA, 22 nt, Human
cuggagcucagcccagguucca

SEQ ID NO: 805000 - RNA, 22 nt, Human
agguggcagccgagacauaagg

SEQ ID NO: 805001 - RNA, 22 nt, Human
cuacauuuacacaguuaggcuu

SEQ ID NO: 805002 - RNA, 22 nt, Human
cuuggauuugggcccuuaaauu

SEQ ID NO: 805003 - RNA, 22 nt, Human
uggcccagcccugcucuagggc

SEQ ID NO: 805004 - RNA, 22 nt, Human
aaagcagggaugaggcuagagg

SEQ ID NO: 805005 - RNA, 22 nt, Human
gccaggcuggcaaaaggaaacc

SEQ ID NO: 805006 - RNA, 22 nt, Human
ggcggugguugagaggacggcg

SEQ ID NO: 805007 - RNA, 20 nt, Human
ucauggcagccacccacagg

SEQ ID NO: 805008 - RNA, 22 nt, Human
caaggacagcgucaggugcaac

SEQ ID NO: 805009 - RNA, 22 nt, Human
ggaaagagcuaaaagggugaga

SEQ ID NO: 805010 - RNA, 22 nt, Human
cccccaggcucugacacaggag

SEQ ID NO: 805011 - RNA, 22 nt, Human
aaauaaacugaagcacagagag

SEQ ID NO: 805012 - RNA, 22 nt, Human
cauugcaacuucaaacuccugg

SEQ ID NO: 805013 - RNA, 22 nt, Human
ucauaaaguucuaagaauugua

SEQ ID NO: 805014 - RNA, 22 nt, Human
uuuggaggggaagaccuuggag

SEQ ID NO: 805015 - RNA, 22 nt, Human
augcuggggccucagaccagaa

SEQ ID NO: 805016 - RNA, 22 nt, Human
ucaaggaauggguccuucccuu

SEQ ID NO: 805017 - RNA, 22 nt, Human
aggcccagugccauuaguuuug

SEQ ID NO: 805018 - RNA, 22 nt, Human
uagugucagcaucucauugagc

SEQ ID NO: 805019 - RNA, 22 nt, Human
auuucauguuucaucuaccuaa

SEQ ID NO: 805020 - RNA, 23 nt, Human
ucauaaauauuagcacaguagga

SEQ ID NO: 805021 - RNA, 22 nt, Human
aaggcugguuccaucccuggug

SEQ ID NO: 805022 - RNA, 22 nt, Human
gugcauuaggcuggaauguuga

SEQ ID NO: 805023 - RNA, 22 nt, Human
ugaauguuugaugagaaauaga

SEQ ID NO: 805024 - RNA, 22 nt, Human
caggccucuauggucagcugag

SEQ ID NO: 805025 - RNA, 22 nt, Human
uaguuaaugcuaauuaacaaau

SEQ ID NO: 805026 - RNA, 22 nt, Human
agccaauacacugaagaucuaa

SEQ ID NO: 805027 - RNA, 22 nt, Human
ucuggcugaaaggggcugugcc

SEQ ID NO: 805028 - RNA, 22 nt, Human
cagagaugugauccagcugucu

SEQ ID NO: 805029 - RNA, 20 nt, Human
cagcccugugaccuggcccu

SEQ ID NO: 805030 - RNA, 22 nt, Human
cagcuggcgggcagagccgcca

SEQ ID NO: 805031 - RNA, 22 nt, Human
gggcucagaggaguggccuggg

SEQ ID NO: 805032 - RNA, 22 nt, Human
gugucaaauccacuccucuuuu

SEQ ID NO: 805033 - RNA, 19 nt, Human
gcugcagcagagaaacugg

SEQ ID NO: 805034 - RNA, 22 nt, Human
uauacagaaagaauucaagucu

SEQ ID NO: 805035 - RNA, 23 nt, Human
uuguuuuuagagguggcaugaga

SEQ ID NO: 805036 - RNA, 22 nt, Human
agggugcaaaagcaaggacagu

SEQ ID NO: 805037 - RNA, 22 nt, Human
gaggugguuuguggugacucau

SEQ ID NO: 805038 - RNA, 22 nt, Human
aguuucuaugugaaaugcacau

SEQ ID NO: 805039 - RNA, 22 nt, Human
aaagagaaacuuagaagccuga

SEQ ID NO: 805040 - RNA, 22 nt, Human
uaggaaauauuugaacauagga

SEQ ID NO: 805041 - RNA, 22 nt, Human
gggcuguguacuaugaggaggg

SEQ ID NO: 805042 - RNA, 22 nt, Human
agucucuuuguauaaauaggca

SEQ ID NO: 805043 - RNA, 22 nt, Human
caggguagggcaagggaaccug

SEQ ID NO: 805044 - RNA, 22 nt, Human
aacaucuacagugagauguuag

SEQ ID NO: 805045 - RNA, 22 nt, Human
auaagcagggucaaaugccuac

SEQ ID NO: 805046 - RNA, 23 nt, Human
caugcaaacacuauugcauuugg

SEQ ID NO: 805047 - RNA, 22 nt, Human
aguaugucagagugaaaauggu

SEQ ID NO: 805048 - RNA, 22 nt, Human
gaaggcuuuuuggguaauugua

SEQ ID NO: 805049 - RNA, 22 nt, Human
gcacagagagcagugggggaca

SEQ ID NO: 805050 - RNA, 21 nt, Human
aggcagcucaggcccagagag

SEQ ID NO: 805051 - RNA, 21 nt, Human
gcccagagggagccaagccca

SEQ ID NO: 805052 - RNA, 22 nt, Human
agccuggccugggcaggcacau

SEQ ID NO: 805053 - RNA, 22 nt, Human
gcugcugggauccugggucuca

SEQ ID NO: 805054 - RNA, 22 nt, Human
augcauucuggaaaguagcaau

SEQ ID NO: 805055 - RNA, 22 nt, Human
gcaggaacccagacaaccaggg

SEQ ID NO: 805056 - RNA, 23 nt, Human
gcuugucuagugaauucauaucu

SEQ ID NO: 805057 - RNA, 17 nt, Human
auggucucacugagcaa

SEQ ID NO: 805058 - RNA, 19 nt, Human
uuucaggagcuaugcaggg

SEQ ID NO: 805059 - RNA, 22 nt, Human
gggagggaggugaugcuuggcu

SEQ ID NO: 805060 - RNA, 22 nt, Human
cugagaaggaagccuccacucu

SEQ ID NO: 805061 - RNA, 22 nt, Human
gagucagacagggucacccaga

SEQ ID NO: 805062 - RNA, 22 nt, Human
accaccccagaauuuuucaagg

SEQ ID NO: 805063 - RNA, 22 nt, Human
auguuuauguugggcuauauuu

SEQ ID NO: 805064 - RNA, 22 nt, Human
aggaugaauauuuagugggaua

SEQ ID NO: 805065 - RNA, 23 nt, Human
ugagcugguauuguccaucucca

SEQ ID NO: 805066 - RNA, 22 nt, Human
ccagggcuggugggagaugcug

SEQ ID NO: 805067 - RNA, 23 nt, Human
gugcugcaaaaucggccacugca

SEQ ID NO: 805068 - RNA, 20 nt, Human
auauaccaucccacaacagg

SEQ ID NO: 805069 - RNA, 22 nt, Human
gucaagucaugacucaaaggaa

SEQ ID NO: 805070 - RNA, 22 nt, Human
gcagagguggcaucugggcucu

SEQ ID NO: 805071 - RNA, 22 nt, Human
agcuuugcacaacagagaggug

SEQ ID NO: 805072 - RNA, 22 nt, Human
aguccaggaagcaucauggucu

SEQ ID NO: 805073 - RNA, 22 nt, Human
gaagccaagugcaaaugccuua

SEQ ID NO: 805074 - RNA, 22 nt, Human
ucugcuggccuuagcaggucua

SEQ ID NO: 805075 - RNA, 22 nt, Human
cuccugucccggggaccgccga

SEQ ID NO: 805076 - RNA, 22 nt, Human
cuggcagucugguggaaggccu

SEQ ID NO: 805077 - RNA, 19 nt, Human
gccaggcuccauagccggc

SEQ ID NO: 805078 - RNA, 22 nt, Human
aaggcaguaggaucuuccacag

SEQ ID NO: 805079 - RNA, 18 nt, Human
ugcagccuguagucuugu

SEQ ID NO: 805080 - RNA, 22 nt, Human
gguggcagagacauaggacaua

SEQ ID NO: 805081 - RNA, 22 nt, Human
ucaaauaaugccauucaucauc

SEQ ID NO: 805082 - RNA, 22 nt, Human
aguuauucauuuauucuguaca

SEQ ID NO: 805083 - RNA, 22 nt, Human
cauaauaucuccgauuacuugc

SEQ ID NO: 805084 - RNA, 22 nt, Human
ccuggcucaggcacgcauggcu

SEQ ID NO: 805085 - RNA, 22 nt, Human
aaaaguacuauuuuaacaaagu

SEQ ID NO: 805086 - RNA, 22 nt, Human
aggaacccggucugucacugug

SEQ ID NO: 805087 - RNA, 22 nt, Human
gcagugggccugaggaagggug

SEQ ID NO: 805088 - RNA, 22 nt, Human
uuaaggaaacauuuuuccauag

SEQ ID NO: 805089 - RNA, 22 nt, Human
ucuuugaugggagaucugagag

SEQ ID NO: 805090 - RNA, 22 nt, Human
uuguuucuccagucuaggaaaa

SEQ ID NO: 805091 - RNA, 22 nt, Human
gaggccaggagugcuguaaguu

SEQ ID NO: 805092 - RNA, 22 nt, Human
ccucaaauagcccccagucuag

SEQ ID NO: 805093 - RNA, 22 nt, Human
acaauuuuaagccagagugggu

SEQ ID NO: 805094 - RNA, 22 nt, Human
cccacaggcaggggcagagaca

SEQ ID NO: 805095 - RNA, 22 nt, Human
gaggcaggcccugaaugaguca

SEQ ID NO: 805096 - RNA, 22 nt, Human
caggcugaggguuaggccuuag

SEQ ID NO: 805097 - RNA, 22 nt, Human
ugcagaggcuggcucgccgggu

SEQ ID NO: 805098 - RNA, 22 nt, Human
aggcuccauucaugugaaggca

SEQ ID NO: 805099 - RNA, 22 nt, Human
uuacaacaaaggcacgugcaug

SEQ ID NO: 805100 - RNA, 22 nt, Human
ugccagggacccugucggcccu

SEQ ID NO: 805101 - RNA, 22 nt, Human
gaggccugguuugcaugagaau

SEQ ID NO: 805102 - RNA, 22 nt, Human
uccugccuaccuugcggaggug

SEQ ID NO: 805103 - RNA, 22 nt, Human
acugucuccucaucaugccugg

SEQ ID NO: 805104 - RNA, 22 nt, Human
agccacagguguuggccagugu

SEQ ID NO: 805105 - RNA, 22 nt, Human
caggcagaugcugacaagaguu

SEQ ID NO: 805106 - RNA, 22 nt, Human
agcagccacccagcugcucauu

SEQ ID NO: 805107 - RNA, 23 nt, Human
agggugagcaagcuauggagacc

SEQ ID NO: 805108 - RNA, 22 nt, Human
acuuucaauuugcacuaaccua

SEQ ID NO: 805109 - RNA, 19 nt, Human
ugccagcauuaggcugaag

SEQ ID NO: 805110 - RNA, 22 nt, Human
aaagaagacagacauuucuuuc

SEQ ID NO: 805111 - RNA, 22 nt, Human
uaaggaaacaacuuguauuuuu

SEQ ID NO: 805112 - RNA, 22 nt, Human
aagauaaacucuugauuucuga

SEQ ID NO: 805113 - RNA, 22 nt, Human
ugccacagagacuuucauugua

SEQ ID NO: 805114 - RNA, 22 nt, Human
uuuccucuccaccaggaggucu

SEQ ID NO: 805115 - RNA, 22 nt, Human
gcuggcuccucuguccucacgg

SEQ ID NO: 805116 - RNA, 22 nt, Human
uggauaaacucacuguaaguug

SEQ ID NO: 805117 - RNA, 17 nt, Human
gugcagggaugaaggau

SEQ ID NO: 805118 - RNA, 18 nt, Human
gccuucagacugcaugcu

SEQ ID NO: 805119 - RNA, 22 nt, Human
ucaggcugaaggaggccuaucu

SEQ ID NO: 805120 - RNA, 22 nt, Human
aggcugugcaauuaggguaaga

SEQ ID NO: 805121 - RNA, 22 nt, Human
uccaggagaaggccauccagcg

SEQ ID NO: 805122 - RNA, 22 nt, Human
uagggcugugucuccaggacca

SEQ ID NO: 805123 - RNA, 21 nt, Human
gagcccaggcaucucauuaau

SEQ ID NO: 805124 - RNA, 22 nt, Human
agucccaacagcuuacaaggaa

SEQ ID NO: 805125 - RNA, 22 nt, Human
ggugcagagcagugucagagca

SEQ ID NO: 805126 - RNA, 22 nt, Human
gacaggcccccucaggacugau

SEQ ID NO: 805127 - RNA, 22 nt, Human
auauauucuuaaagaaucugac

SEQ ID NO: 805128 - RNA, 22 nt, Human
gaggcacaucacuuggugcauu

SEQ ID NO: 805129 - RNA, 22 nt, Human
aagcaggcucacgccaggcagu

SEQ ID NO: 805130 - RNA, 22 nt, Human
uugacacagucaacuugauuuu

SEQ ID NO: 805131 - RNA, 20 nt, Human
uucuaaacuguuaggcuugc

SEQ ID NO: 805132 - RNA, 20 nt, Human
gcagggcaucuuggccccca

SEQ ID NO: 805133 - RNA, 22 nt, Human
uguauuuugaguccaaucuccu

SEQ ID NO: 805134 - RNA, 22 nt, Human
aggcugcuggcaggcguggacg

SEQ ID NO: 805135 - RNA, 22 nt, Human
aucacaggugguaggaaaagaa

SEQ ID NO: 805136 - RNA, 22 nt, Human
ccaguaaauuacuugaugucau

SEQ ID NO: 805137 - RNA, 22 nt, Human
ucacacaggguucuggucucau

SEQ ID NO: 805138 - RNA, 22 nt, Human
auucaacuuauaagauauuaau

SEQ ID NO: 805139 - RNA, 21 nt, Human
uucaucauugguaaaaagugg

SEQ ID NO: 805140 - RNA, 22 nt, Human
uucaacaaugcacuugaguaua

SEQ ID NO: 805141 - RNA, 22 nt, Human
gaggcugguuugccuuuuggca

SEQ ID NO: 805142 - RNA, 22 nt, Human
aauaaacaaauccuuccuuccc

SEQ ID NO: 805143 - RNA, 22 nt, Human
cacauacaugcacaccuaaaua

SEQ ID NO: 805144 - RNA, 22 nt, Human
uucauuugggaugagucagaag

SEQ ID NO: 805145 - RNA, 22 nt, Human
augcauaugccguagaauaagu

SEQ ID NO: 805146 - RNA, 22 nt, Human
agagaugacugauggcugauua

SEQ ID NO: 805147 - RNA, 22 nt, Human
uuagaaauacaagugagguuga

SEQ ID NO: 805148 - RNA, 22 nt, Human
ucccugccugacagcacccacc

SEQ ID NO: 805149 - RNA, 22 nt, Human
cagcugcugcccuuggcugcag

SEQ ID NO: 805150 - RNA, 22 nt, Human
ggucugaggcuccaaggaggug

SEQ ID NO: 805151 - RNA, 18 nt, Human
uacaugcauaaaugaagc

SEQ ID NO: 805152 - RNA, 22 nt, Human
cccagccuggugcacugugggg

SEQ ID NO: 805153 - RNA, 22 nt, Human
ugcuuauuugaauuuauucuca

SEQ ID NO: 805154 - RNA, 22 nt, Human
ugccaggagucaggccaggcag

SEQ ID NO: 805155 - RNA, 22 nt, Human
ccagugggagggagcuaggcca

SEQ ID NO: 805156 - RNA, 22 nt, Human
caguggagaggcaugcuuggca

SEQ ID NO: 805157 - RNA, 22 nt, Human
ugggaagguacacgggaaagag

SEQ ID NO: 805158 - RNA, 22 nt, Human
aacauaauguggccaaagucac

SEQ ID NO: 805159 - RNA, 22 nt, Human
ccugcagagcaggagaggcauc

SEQ ID NO: 805160 - RNA, 19 nt, Human
agcagcuuaauuuuguagc

SEQ ID NO: 805161 - RNA, 22 nt, Human
uuucuugagcuaggaaccuggg

SEQ ID NO: 805162 - RNA, 22 nt, Human
augauacaucuuguuuauuuca

SEQ ID NO: 805163 - RNA, 22 nt, Human
ggaagcuguugugagugcagca

SEQ ID NO: 805164 - RNA, 22 nt, Human
cuccugggcucaagugauccuc

SEQ ID NO: 805165 - RNA, 22 nt, Human
acaggcaacuucaaaucucacu

SEQ ID NO: 805166 - RNA, 22 nt, Human
ugcggaaggcagcgcagggugg

SEQ ID NO: 805167 - RNA, 22 nt, Human
caggcagaggcuuuucauggcu

SEQ ID NO: 805168 - RNA, 22 nt, Human
uggcugugucccuguccagagu

SEQ ID NO: 805169 - RNA, 22 nt, Human
ggcacagcgacuaccaucgaaa

SEQ ID NO: 805170 - RNA, 22 nt, Human
uuccuggguuuacguauugggu

SEQ ID NO: 805171 - RNA, 22 nt, Human
auucacaugcccaagcagcacc

SEQ ID NO: 805172 - RNA, 22 nt, Human
ucucuucugaaaccugucuuua

SEQ ID NO: 805173 - RNA, 21 nt, Human
acuggcuggcugaguuuccug

SEQ ID NO: 805174 - RNA, 22 nt, Human
aaguuugucucauuugaucuuc

SEQ ID NO: 805175 - RNA, 22 nt, Human
uuucuuuugcccuguggguuag

SEQ ID NO: 805176 - RNA, 22 nt, Human
aacagcuuugcuucuggagaca

SEQ ID NO: 805177 - RNA, 21 nt, Human
gcugagagguugggaaguuca

SEQ ID NO: 805178 - RNA, 22 nt, Human
uucuacaucacuuaacaugcua

SEQ ID NO: 805179 - RNA, 22 nt, Human
cuccugggaggaugcggacccg

SEQ ID NO: 805180 - RNA, 22 nt, Human
ggaggaggcggcagaaguuccu

SEQ ID NO: 805181 - RNA, 22 nt, Human
cagacaaagcggaaacuguuua

SEQ ID NO: 805182 - RNA, 22 nt, Human
ugcuucaugagguaguggcagu

SEQ ID NO: 805183 - RNA, 22 nt, Human
aggggagcuugccuggucaccc

SEQ ID NO: 805184 - RNA, 20 nt, Human
accagagauagcaauagugc

SEQ ID NO: 805185 - RNA, 22 nt, Human
ucauugaguaauacuguagugu

SEQ ID NO: 805186 - RNA, 22 nt, Human
aggcaagcccccagugaggcuc

SEQ ID NO: 805187 - RNA, 22 nt, Human
gucagaggaggcugaguaggaa

SEQ ID NO: 805188 - RNA, 22 nt, Human
caugcuccagcuccagacaggu

SEQ ID NO: 805189 - RNA, 22 nt, Human
uguuauuugggaaaguuguaca

SEQ ID NO: 805190 - RNA, 22 nt, Human
ucacaucuuuaggcuuacaggu

SEQ ID NO: 805191 - RNA, 22 nt, Human
uccagcagaccaucaaggcuca

SEQ ID NO: 805192 - RNA, 20 nt, Human
agacagaaucagagauaaag

SEQ ID NO: 805193 - RNA, 22 nt, Human
gcucaaaucccagcgggcuccu

SEQ ID NO: 805194 - RNA, 22 nt, Human
ccuaaauagagucagauguaau

SEQ ID NO: 805195 - RNA, 22 nt, Human
aaaggcucaugaaccaggcucg

SEQ ID NO: 805196 - RNA, 22 nt, Human
uaugaauucuguucauugauga

SEQ ID NO: 805197 - RNA, 22 nt, Human
uauuagauuuguuucuguagau

SEQ ID NO: 805198 - RNA, 22 nt, Human
uuagugaucaaaaucaaaauug

SEQ ID NO: 805199 - RNA, 22 nt, Human
cuccaggagggcuuccugugau

SEQ ID NO: 805200 - RNA, 18 nt, Human
ucugcccugccauucacu

SEQ ID NO: 805201 - RNA, 22 nt, Human
ccagagccggcucccucagcuu

SEQ ID NO: 805202 - RNA, 21 nt, Human
cacagcaggguuccugggcuc

SEQ ID NO: 805203 - RNA, 21 nt, Human
cauucacagucuggcucuuga

SEQ ID NO: 805204 - RNA, 22 nt, Human
ugcacagaugcuaggaggugaa

SEQ ID NO: 805205 - RNA, 22 nt, Human
ucugagccagacaagacagcca

SEQ ID NO: 805206 - RNA, 21 nt, Human
cugcaaaugcaaggugaccag

SEQ ID NO: 805207 - RNA, 22 nt, Human
aggcugagucgggaggaucacu

SEQ ID NO: 805208 - RNA, 22 nt, Human
ugcaccguugcacuccagagug

SEQ ID NO: 805209 - RNA, 22 nt, Human
ccacagaauucugucuccagga

SEQ ID NO: 805210 - RNA, 22 nt, Human
aaugcucucugccauagcuaac

SEQ ID NO: 805211 - RNA, 23 nt, Human
ugguugcagugccaaguaucacg

SEQ ID NO: 805212 - RNA, 22 nt, Human
ccaggagcaccaggccugugcc

SEQ ID NO: 805213 - RNA, 22 nt, Human
uagagcugauaaugaggccaag

SEQ ID NO: 805214 - RNA, 22 nt, Human
gcucccaccuccagccugaguu

SEQ ID NO: 805215 - RNA, 22 nt, Human
aguagaaauguaagaaggauua

SEQ ID NO: 805216 - RNA, 20 nt, Human
aaaggaauauaugaaguaua

SEQ ID NO: 805217 - RNA, 22 nt, Human
caguggcagagaacagagaccu

SEQ ID NO: 805218 - RNA, 18 nt, Human
ucccuucucccuugccuc

SEQ ID NO: 805219 - RNA, 22 nt, Human
uagacuuugauauuguacaccc

SEQ ID NO: 805220 - RNA, 23 nt, Human
acauagaacagaauauauuugug

SEQ ID NO: 805221 - RNA, 22 nt, Human
caggcucccugggcaguggcag

SEQ ID NO: 805222 - RNA, 22 nt, Human
gguagggaaggcucugcgggga

SEQ ID NO: 805223 - RNA, 22 nt, Human
accugucugcaugaucuaaaac

SEQ ID NO: 805224 - RNA, 22 nt, Human
uaugacauuucucugauuugug

SEQ ID NO: 805225 - RNA, 22 nt, Human
cccuccucaacucuggcuucca

SEQ ID NO: 805226 - RNA, 22 nt, Human
cagaggagaauugcgggaucau

SEQ ID NO: 805227 - RNA, 22 nt, Human
cagcccagccuugucucuuuau

SEQ ID NO: 805228 - RNA, 22 nt, Human
cacaggaggaggugcccgggcc

SEQ ID NO: 805229 - RNA, 22 nt, Human
aacagucuuggaagucuuguua

SEQ ID NO: 805230 - RNA, 22 nt, Human
uggacagguuugggugccuguu

SEQ ID NO: 805231 - RNA, 22 nt, Human
auucacaugauguauguagggc

SEQ ID NO: 805232 - RNA, 23 nt, Human
cuggucagaggcugcuggaaggg

SEQ ID NO: 805233 - RNA, 17 nt, Human
cauuugcugguuggcuc

SEQ ID NO: 805234 - RNA, 22 nt, Human
cuggcacauagucagcacucaa

SEQ ID NO: 805235 - RNA, 22 nt, Human
gaacagcugcuagagaucugug

SEQ ID NO: 805236 - RNA, 22 nt, Human
cccucuacagggaagcgcuuuc

SEQ ID NO: 805237 - RNA, 22 nt, Human
cgcagagggcaggcagugcugg

SEQ ID NO: 805238 - RNA, 22 nt, Human
uaauacaaggcaggaagcagua

SEQ ID NO: 805239 - RNA, 22 nt, Human
caggcagaaugaccgaccucgc

SEQ ID NO: 805240 - RNA, 22 nt, Human
ggcugccucugaugugcagacg

SEQ ID NO: 805241 - RNA, 22 nt, Human
ggagagagagcucauuagcugc

SEQ ID NO: 805242 - RNA, 22 nt, Human
gaggcagagaccuucaggaccu

SEQ ID NO: 805243 - RNA, 22 nt, Human
gacugaggugcccagaggugac

SEQ ID NO: 805244 - RNA, 22 nt, Human
cccuggcucugccucagagccc

SEQ ID NO: 805245 - RNA, 20 nt, Human
ugugagaggguggcuugccc

SEQ ID NO: 805246 - RNA, 22 nt, Human
agucacuuucuacuugguuucu

SEQ ID NO: 805247 - RNA, 20 nt, Human
gaaacauuggcagcaacuga

SEQ ID NO: 805248 - RNA, 22 nt, Human
cuggacagaucccuuguagcuu

SEQ ID NO: 805249 - RNA, 22 nt, Human
gucagugugguugcuggcuugg

SEQ ID NO: 805250 - RNA, 22 nt, Human
cugggaguggugacagcucucg

SEQ ID NO: 805251 - RNA, 22 nt, Human
cagcagaggcacgucugugaau

SEQ ID NO: 805252 - RNA, 22 nt, Human
caguaauagcagagucuuccau

SEQ ID NO: 805253 - RNA, 18 nt, Human
cacaggagccacacucac

SEQ ID NO: 805254 - RNA, 19 nt, Human
gcugcuggcucuggcugga

SEQ ID NO: 805255 - RNA, 22 nt, Human
cccagcaucuccaggcauggcc

SEQ ID NO: 805256 - RNA, 22 nt, Human
cugccucuauucacugaggcag

SEQ ID NO: 805257 - RNA, 22 nt, Human
cugucccagauguucucagcac

SEQ ID NO: 805258 - RNA, 22 nt, Human
ccuuuggagcaacugagagcua

SEQ ID NO: 805259 - RNA, 22 nt, Human
aggcagaaaauagucauccaaa

SEQ ID NO: 805260 - RNA, 22 nt, Human
cgcaggcaagagaguacaguua

SEQ ID NO: 805261 - RNA, 22 nt, Human
uuguuacauacagcagaacaua

SEQ ID NO: 805262 - RNA, 22 nt, Human
uuuucuaacaucuaguaauuug

SEQ ID NO: 805263 - RNA, 22 nt, Human
ucauggggcucuucaaguggag

SEQ ID NO: 805264 - RNA, 22 nt, Human
gcugugcugcgggaggauuccg

SEQ ID NO: 805265 - RNA, 22 nt, Human
gagggggcgaacagaagcaagg

SEQ ID NO: 805266 - RNA, 22 nt, Human
guccugugugagugcaccaccu

SEQ ID NO: 805267 - RNA, 22 nt, Human
aggggaaaugccuuggugguac

SEQ ID NO: 805268 - RNA, 22 nt, Human
acuauacauaaaacauuugggu

SEQ ID NO: 805269 - RNA, 22 nt, Human
cagaauguagaucaucaucaag

SEQ ID NO: 805270 - RNA, 18 nt, Human
uauuucccaauggaaaca

SEQ ID NO: 805271 - RNA, 22 nt, Human
acagccuugcuuauuugucucu

SEQ ID NO: 805272 - RNA, 19 nt, Human
uccagcugguaugcccaga

SEQ ID NO: 805273 - RNA, 22 nt, Human
aguguacaguucuaugaauuuc

SEQ ID NO: 805274 - RNA, 22 nt, Human
acaacauuauacauagaaagcu

SEQ ID NO: 805275 - RNA, 17 nt, Human
cugggccucugcccuuu

SEQ ID NO: 805276 - RNA, 22 nt, Human
augaaaugucuggaucuuuuuc

SEQ ID NO: 805277 - RNA, 22 nt, Human
gggauggccuagacuagcuugg

SEQ ID NO: 805278 - RNA, 22 nt, Human
auuuuauccccacuggauuaca

SEQ ID NO: 805279 - RNA, 22 nt, Human
cacacaggagagugcuggaggu

SEQ ID NO: 805280 - RNA, 22 nt, Human
gcacaguaccugucacagaggc

SEQ ID NO: 805281 - RNA, 22 nt, Human
acacaaacagucuauagcacca

SEQ ID NO: 805282 - RNA, 22 nt, Human
caugcauagaaugaagaggcug

SEQ ID NO: 805283 - RNA, 22 nt, Human
uaugcaaaucauuagauuuccu

SEQ ID NO: 805284 - RNA, 22 nt, Human
agcagggcugcggccccaccac

SEQ ID NO: 805285 - RNA, 22 nt, Human
gaggggcaaugagggaaagagu

SEQ ID NO: 805286 - RNA, 22 nt, Human
ucacaucuuggauuacaauuuu

SEQ ID NO: 805287 - RNA, 19 nt, Human
cuguggccuccaggaggga

SEQ ID NO: 805288 - RNA, 22 nt, Human
acuucauguuguuuacaacuua

SEQ ID NO: 805289 - RNA, 19 nt, Human
gcuugggagagggagcuaa

SEQ ID NO: 805290 - RNA, 22 nt, Human
uggcacacagagaagacacuug

SEQ ID NO: 805291 - RNA, 22 nt, Human
gcacaggaaaugacucauguua

SEQ ID NO: 805292 - RNA, 21 nt, Human
cucuggaguuugaaggcuggg

SEQ ID NO: 805293 - RNA, 22 nt, Human
ugggagaaucuugcucugcuac

SEQ ID NO: 805294 - RNA, 22 nt, Human
uccugcagaccucagucagguc

SEQ ID NO: 805295 - RNA, 22 nt, Human
cagcagcuaccugcucuugugg

SEQ ID NO: 805296 - RNA, 22 nt, Human
ggccaggagaggagggcacuga

SEQ ID NO: 805297 - RNA, 22 nt, Human
uuuuaucugcuucauuaguuga

SEQ ID NO: 805298 - RNA, 22 nt, Human
agagaaggucacuaaggaccca

SEQ ID NO: 805299 - RNA, 22 nt, Human
aagcuuuaugaucucucagcua

SEQ ID NO: 805300 - RNA, 22 nt, Human
agaaaaaucuuggcgcuugucu

SEQ ID NO: 805301 - RNA, 22 nt, Human
aagcugccaaugguaagcugcu

SEQ ID NO: 805302 - RNA, 22 nt, Human
agugucugcgggcagaggagcg

SEQ ID NO: 805303 - RNA, 22 nt, Human
caggaaaucagaacucaagugg

SEQ ID NO: 805304 - RNA, 22 nt, Human
uggggagugaugccucggauaa

SEQ ID NO: 805305 - RNA, 22 nt, Human
uuuguuucugcaauaccuauag

SEQ ID NO: 805306 - RNA, 19 nt, Human
cuggggcuuugguacugcc

SEQ ID NO: 805307 - RNA, 22 nt, Human
aaguggcagaauaguggcagga

SEQ ID NO: 805308 - RNA, 22 nt, Human
cagagagcuuagugugcugcau

SEQ ID NO: 805309 - RNA, 20 nt, Human
agcuggagaagggcccuucc

SEQ ID NO: 805310 - RNA, 22 nt, Human
agcaggggucucugcuaaugaa

SEQ ID NO: 805311 - RNA, 22 nt, Human
ucauuucuaucuaugcagcuuc

SEQ ID NO: 805312 - RNA, 22 nt, Human
uaaaaguuagcuaggacaaagu

SEQ ID NO: 805313 - RNA, 22 nt, Human
cuguucaugcugauucuguaug

SEQ ID NO: 805314 - RNA, 22 nt, Human
cucagugugagugagaagugca

SEQ ID NO: 805315 - RNA, 22 nt, Human
ccuccugggacucauuagcacc

SEQ ID NO: 805316 - RNA, 22 nt, Human
uagaaacaucagcuaaccaaaa

SEQ ID NO: 805317 - RNA, 22 nt, Human
uuggcaaucaauucugacgucu

SEQ ID NO: 805318 - RNA, 22 nt, Human
ucuguaggacagagaaaugggg

SEQ ID NO: 805319 - RNA, 22 nt, Human
ugggcccaagugcaaugcagug

SEQ ID NO: 805320 - RNA, 22 nt, Human
agcuccugugugaagccucccu

SEQ ID NO: 805321 - RNA, 22 nt, Human
uugaaaauaucacaggagcagc

SEQ ID NO: 805322 - RNA, 22 nt, Human
gacuugggugucggggcagucu

SEQ ID NO: 805323 - RNA, 22 nt, Human
acaagcuuccaggugaugcuga

SEQ ID NO: 805324 - RNA, 20 nt, Human
aaguuacauuguauuguacc

SEQ ID NO: 805325 - RNA, 22 nt, Human
ggcgccagcgguaaguaagaca

SEQ ID NO: 805326 - RNA, 22 nt, Human
gcaggccuccccugcuggagcu

SEQ ID NO: 805327 - RNA, 22 nt, Human
uucaguguggugcacaguuuug

SEQ ID NO: 805328 - RNA, 22 nt, Human
uggaagugagaaguuuccucag

SEQ ID NO: 805329 - RNA, 22 nt, Human
acuucugauuaaggaugaaugc

SEQ ID NO: 805330 - RNA, 22 nt, Human
uggagggcuaagcugagggaua

SEQ ID NO: 805331 - RNA, 20 nt, Human
gacaacacagcuucaggucc

SEQ ID NO: 805332 - RNA, 22 nt, Human
gugccagaguuugaggacaauu

SEQ ID NO: 805333 - RNA, 22 nt, Human
ugggcaggagagaagcuaaaga

SEQ ID NO: 805334 - RNA, 22 nt, Human
ggcugccuagacuuggaauuuc

SEQ ID NO: 805335 - RNA, 22 nt, Human
caaauguuucuuaucuauuguu

SEQ ID NO: 805336 - RNA, 22 nt, Human
agggccugcaucaggagcuugg

SEQ ID NO: 805337 - RNA, 22 nt, Human
gaggcugcggggaggagccugc

SEQ ID NO: 805338 - RNA, 21 nt, Human
uucuccuguuuugcaccacag

SEQ ID NO: 805339 - RNA, 22 nt, Human
uggcccagggucuacagccuca

SEQ ID NO: 805340 - RNA, 22 nt, Human
agcacaggaccaaggaagcugu

SEQ ID NO: 805341 - RNA, 22 nt, Human
uuuguuuagaugguaaaucagu

SEQ ID NO: 805342 - RNA, 19 nt, Human
ugccuggcaccagcuccac

SEQ ID NO: 805343 - RNA, 22 nt, Human
cagagacacuuaacaggaaugg

SEQ ID NO: 805344 - RNA, 22 nt, Human
uccugccucaggcucuggagua

SEQ ID NO: 805345 - RNA, 22 nt, Human
agggggcucagugacugaagug

SEQ ID NO: 805346 - RNA, 22 nt, Human
guggaugauugacucuguagac

SEQ ID NO: 805347 - RNA, 22 nt, Human
uuucuccccagucuaaucugga

SEQ ID NO: 805348 - RNA, 22 nt, Human
aggcauggguagaagagaagcc

SEQ ID NO: 805349 - RNA, 18 nt, Human
ggcucaggcuauccuaac

SEQ ID NO: 805350 - RNA, 22 nt, Human
ugaguucuccaagagaagguau

SEQ ID NO: 805351 - RNA, 22 nt, Human
auauuucuugagcaccugguau

SEQ ID NO: 805352 - RNA, 22 nt, Human
cagagcugagucuucaagguug

SEQ ID NO: 805353 - RNA, 22 nt, Human
ugugcccauuacacagaggcau

SEQ ID NO: 805354 - RNA, 22 nt, Human
ucagcagguggugggcagguga

SEQ ID NO: 805355 - RNA, 22 nt, Human
augcaacauccaauuccuuuug

SEQ ID NO: 805356 - RNA, 22 nt, Human
uuauuccauagaagucaaggaa

SEQ ID NO: 805357 - RNA, 22 nt, Human
aaugacagccagauucuucucu

SEQ ID NO: 805358 - RNA, 22 nt, Human
ucuggggguuaagugaggacaa

SEQ ID NO: 805359 - RNA, 22 nt, Human
ucuuucaauccauucauauguc

SEQ ID NO: 805360 - RNA, 22 nt, Human
aucuuacagcagcaaggaagua

SEQ ID NO: 805361 - RNA, 22 nt, Human
ucuuuuaagccucuggcauagg

SEQ ID NO: 805362 - RNA, 22 nt, Human
gaaugauauauuagcagauuuu

SEQ ID NO: 805363 - RNA, 22 nt, Human
agccagaggucaugagcacagg

SEQ ID NO: 805364 - RNA, 22 nt, Human
acacaguaugcaucuagaaauu

SEQ ID NO: 805365 - RNA, 22 nt, Human
gcugaaauuggaaccugggccu

SEQ ID NO: 805366 - RNA, 22 nt, Human
ugguccuggagaguguuccaua

SEQ ID NO: 805367 - RNA, 20 nt, Human
uugcacagagaaggaggcag

SEQ ID NO: 805368 - RNA, 18 nt, Human
agcagaauucuaggguuc

SEQ ID NO: 805369 - RNA, 22 nt, Human
uccuccccugcccaugaggagg

SEQ ID NO: 805370 - RNA, 22 nt, Human
ugcccaggcuggagugcagagg

SEQ ID NO: 805371 - RNA, 22 nt, Human
aaauucacucuguuccucaugg

SEQ ID NO: 805372 - RNA, 20 nt, Human
gccacugggcaccagcaggg

SEQ ID NO: 805373 - RNA, 22 nt, Human
uagauaaaagggcaaagggcau

SEQ ID NO: 805374 - RNA, 22 nt, Human
uggugggagugagggcaugcca

SEQ ID NO: 805375 - RNA, 23 nt, Human
ucacagagcauacugcauuuugc

SEQ ID NO: 805376 - RNA, 22 nt, Human
acaggcagguugagaaacauuu

SEQ ID NO: 805377 - RNA, 22 nt, Human
gggcccagcccucugcucacug

SEQ ID NO: 805378 - RNA, 22 nt, Human
aggggccaccuguggcacccug

SEQ ID NO: 805379 - RNA, 22 nt, Human
aagcccuguucuuucucucacc

SEQ ID NO: 805380 - RNA, 22 nt, Human
auagucuuagaucagauaaagu

SEQ ID NO: 805381 - RNA, 22 nt, Human
aaagguuuauugauucugcucu

SEQ ID NO: 805382 - RNA, 22 nt, Human
ucacauuuauacuccauuugca

SEQ ID NO: 805383 - RNA, 22 nt, Human
ucaauaauggcaggauaaauuu

SEQ ID NO: 805384 - RNA, 22 nt, Human
ucugcaagugacccgggcccag

SEQ ID NO: 805385 - RNA, 22 nt, Human
auacaauaguguuuguuuugag

SEQ ID NO: 805386 - RNA, 22 nt, Human
auguauguuucuauauaugaca

SEQ ID NO: 805387 - RNA, 22 nt, Human
ggacaagccucagacaaaacuc

SEQ ID NO: 805388 - RNA, 22 nt, Human
cucagcagcagggaagagguca

SEQ ID NO: 805389 - RNA, 22 nt, Human
gccucagggggagaggccagcu

SEQ ID NO: 805390 - RNA, 22 nt, Human
uucuuuaaaauagugagaaaga

SEQ ID NO: 805391 - RNA, 22 nt, Human
gcugagguuuucugccugcuca

SEQ ID NO: 805392 - RNA, 22 nt, Human
auucacaacugauccuugcuca

SEQ ID NO: 805393 - RNA, 22 nt, Human
ucagaagcuaaauuugauauuu

SEQ ID NO: 805394 - RNA, 22 nt, Human
uaggaaauuugaaauauguggg

SEQ ID NO: 805395 - RNA, 22 nt, Human
gccaggagagcuccuucagguu

SEQ ID NO: 805396 - RNA, 22 nt, Human
ggcacuggcaaagcaaagucug

SEQ ID NO: 805397 - RNA, 23 nt, Human
uuccagagucuucgacgguaggc

SEQ ID NO: 805398 - RNA, 22 nt, Human
gugacgugaggggcuccuguug

SEQ ID NO: 805399 - RNA, 22 nt, Human
gauuacaaaacucaucuaugac

SEQ ID NO: 805400 - RNA, 20 nt, Human
uccagggcccuggcuccucu

SEQ ID NO: 805401 - RNA, 19 nt, Human
agugcauuuuauguuucaa

SEQ ID NO: 805402 - RNA, 22 nt, Human
auuuuuuauauaccaagguggg

SEQ ID NO: 805403 - RNA, 22 nt, Human
ggcugcccuagagcuggcaagg

SEQ ID NO: 805404 - RNA, 22 nt, Human
gccaggcgggucucaaacuccu

SEQ ID NO: 805405 - RNA, 22 nt, Human
ggguccagaguugaagagguua

SEQ ID NO: 805406 - RNA, 22 nt, Human
ccacugccuauuugcagggccc

SEQ ID NO: 805407 - RNA, 22 nt, Human
aaggacaggcuaaccugacauu

SEQ ID NO: 805408 - RNA, 22 nt, Human
ugucaaaaugacuuuacuacag

SEQ ID NO: 805409 - RNA, 22 nt, Human
ggcucuggagacauguggagag

SEQ ID NO: 805410 - RNA, 22 nt, Human
gggagaaaugucuggccugcug

SEQ ID NO: 805411 - RNA, 18 nt, Human
aggcaggugcuggaaguc

SEQ ID NO: 805412 - RNA, 22 nt, Human
acaaugaaaaaauuuacugugg

SEQ ID NO: 805413 - RNA, 22 nt, Human
agucagaguuuugaggugugac

SEQ ID NO: 805414 - RNA, 19 nt, Human
acagcagguguggggauaa

SEQ ID NO: 805415 - RNA, 22 nt, Human
gucuaaaccucaaaucaguguc

SEQ ID NO: 805416 - RNA, 23 nt, Human
agagaaaaauaucugggcacauu

SEQ ID NO: 805417 - RNA, 22 nt, Human
gggaaagagagguggacgcagg

SEQ ID NO: 805418 - RNA, 22 nt, Human
cagcccugcugccuuagugccu

SEQ ID NO: 805419 - RNA, 22 nt, Human
cuggggucagggaucagagagc

SEQ ID NO: 805420 - RNA, 22 nt, Human
aaccacagagcccccucagaug

SEQ ID NO: 805421 - RNA, 22 nt, Human
acuggcugugcagagggcagua

SEQ ID NO: 805422 - RNA, 18 nt, Human
cauugacaguauaucuuu

SEQ ID NO: 805423 - RNA, 22 nt, Human
caccugccccagucuuggagcu

SEQ ID NO: 805424 - RNA, 22 nt, Human
ccaggagaugggaaaguagcag

SEQ ID NO: 805425 - RNA, 22 nt, Human
aguggugaggggcaugugugau

SEQ ID NO: 805426 - RNA, 22 nt, Human
acuucugauaaagagcaugugc

SEQ ID NO: 805427 - RNA, 22 nt, Human
uuacuggcugggccugagggcu

SEQ ID NO: 805428 - RNA, 22 nt, Human
gaauacuuuuguuaggaaaacg

SEQ ID NO: 805429 - RNA, 20 nt, Human
caguuuaacuuugagcaguu

SEQ ID NO: 805430 - RNA, 20 nt, Human
cuggcccaggaugauggcgc

SEQ ID NO: 805431 - RNA, 22 nt, Human
cuuguagcugacuaucuuguuc

SEQ ID NO: 805432 - RNA, 22 nt, Human
auuacagauagacuuugaagcu

SEQ ID NO: 805433 - RNA, 22 nt, Human
ccaggugugcucugcaguggau

SEQ ID NO: 805434 - RNA, 22 nt, Human
cccacccugggaagcuaggcag

SEQ ID NO: 805435 - RNA, 22 nt, Human
ucugggcuuuugcacuggccau

SEQ ID NO: 805436 - RNA, 22 nt, Human
acagugaauccaaauuccuacc

SEQ ID NO: 805437 - RNA, 22 nt, Human
uaggcagagaggccauaagaau

SEQ ID NO: 805438 - RNA, 22 nt, Human
uauuucacuauucucuguaacu

SEQ ID NO: 805439 - RNA, 20 nt, Human
agugggugaugaaggaauag

SEQ ID NO: 805440 - RNA, 22 nt, Human
uggccucuccuggcagcaucca

SEQ ID NO: 805441 - RNA, 22 nt, Human
uuugguuaauuuaggcuugcau

SEQ ID NO: 805442 - RNA, 22 nt, Human
uuucuucagagagagcuuuccc

SEQ ID NO: 805443 - RNA, 22 nt, Human
ggugacgaauccauagcaucga

SEQ ID NO: 805444 - RNA, 23 nt, Human
acuuuauugaccccaggucaguu

SEQ ID NO: 805445 - RNA, 22 nt, Human
agguaagggucacaguucauau

SEQ ID NO: 805446 - RNA, 22 nt, Human
uuaaagcaucacacuauuaauu

SEQ ID NO: 805447 - RNA, 22 nt, Human
uucugauucaugauccaguucu

SEQ ID NO: 805448 - RNA, 22 nt, Human
uuuucucuuguuaauguacuga

SEQ ID NO: 805449 - RNA, 22 nt, Human
auaaucauucacauaaggugcu

SEQ ID NO: 805450 - RNA, 22 nt, Human
cucagugucuggggccccaggg

SEQ ID NO: 805451 - RNA, 22 nt, Human
acauaacauaguugacauuuuu

SEQ ID NO: 805452 - RNA, 22 nt, Human
uggccagugucggaggccagga

SEQ ID NO: 805453 - RNA, 22 nt, Human
uaguuucugaggauugaaagau

SEQ ID NO: 805454 - RNA, 22 nt, Human
uuuucauuguuacuaugagcua

SEQ ID NO: 805455 - RNA, 22 nt, Human
uaagcaaugagauaaucauggg

SEQ ID NO: 805456 - RNA, 22 nt, Human
uauauuaaagugcuuugcagug

SEQ ID NO: 805457 - RNA, 22 nt, Human
uaauaguugugacuuuguaaag

SEQ ID NO: 805458 - RNA, 22 nt, Human
cauuuacacacagaggugugcu

SEQ ID NO: 805459 - RNA, 22 nt, Human
ugcaaacauccgacugaaagcc

SEQ ID NO: 805460 - RNA, 22 nt, Human
cugugacaguuucucagacuuu

SEQ ID NO: 805461 - RNA, 22 nt, Human
uugcacuguaagcaucuguguc

SEQ ID NO: 805462 - RNA, 22 nt, Human
uucauucuugucuuuguauagu

SEQ ID NO: 805463 - RNA, 22 nt, Human
cuggacacaaacaucuccucug

SEQ ID NO: 805464 - RNA, 22 nt, Human
aacuuguuagaaaugcagaauc

SEQ ID NO: 805465 - RNA, 22 nt, Human
accuccccauuaggucacccac

SEQ ID NO: 805466 - RNA, 22 nt, Human
aaucaacaggaugugcauugua

SEQ ID NO: 805467 - RNA, 18 nt, Human
agggagcaucugguugcc

SEQ ID NO: 805468 - RNA, 22 nt, Human
aggugcuggagucugggcagga

SEQ ID NO: 805469 - RNA, 22 nt, Human
gucagugucuuaacagagauua

SEQ ID NO: 805470 - RNA, 22 nt, Human
agggagcucaguuggaagcggu

SEQ ID NO: 805471 - RNA, 22 nt, Human
cugggagagccuuuccugaguc

SEQ ID NO: 805472 - RNA, 22 nt, Human
aauaaacugcucaauugcauca

SEQ ID NO: 805473 - RNA, 22 nt, Human
aucuacaacggguggaguaggg

SEQ ID NO: 805474 - RNA, 21 nt, Human
ugggggugaggccuaggaauc

SEQ ID NO: 805475 - RNA, 22 nt, Human
gaauaacauuuuuuccuuuaca

SEQ ID NO: 805476 - RNA, 22 nt, Human
ucagggaaauagcagggcugaa

SEQ ID NO: 805477 - RNA, 22 nt, Human
gagcccuguucaggccuccuca

SEQ ID NO: 805478 - RNA, 22 nt, Human
uuacacaauauaugguacuugg

SEQ ID NO: 805479 - RNA, 22 nt, Human
cggcaggugugcucacucugcc

SEQ ID NO: 805480 - RNA, 22 nt, Human
gcagauggcucagacacugggg

SEQ ID NO: 805481 - RNA, 22 nt, Human
aauaagaucuuaaagguuauau

SEQ ID NO: 805482 - RNA, 22 nt, Human
ucauggggugacagaagggagg

SEQ ID NO: 805483 - RNA, 22 nt, Human
cuugggugcuggaggcugccgc

SEQ ID NO: 805484 - RNA, 22 nt, Human
gaguccucaacggggagaggcg

SEQ ID NO: 805485 - RNA, 22 nt, Human
uaaagcaggugcucagugacca

SEQ ID NO: 805486 - RNA, 22 nt, Human
gcaguuugagguuuucugaugu

SEQ ID NO: 805487 - RNA, 17 nt, Human
agcagaagucagaggga

SEQ ID NO: 805488 - RNA, 22 nt, Human
uuugauaucuugguauacagau

SEQ ID NO: 805489 - RNA, 22 nt, Human
acacuaaucuuuuauuugguuu

SEQ ID NO: 805490 - RNA, 20 nt, Human
uaggcagagcugugcagccu

SEQ ID NO: 805491 - RNA, 22 nt, Human
gcagcaggacugccguuaaagu

SEQ ID NO: 805492 - RNA, 22 nt, Human
ucaaaucuuugaccacuuaugu

SEQ ID NO: 805493 - RNA, 22 nt, Human
ugggaccaagucauuucuuuag

SEQ ID NO: 805494 - RNA, 22 nt, Human
uucucuggguuaggggaacuau

SEQ ID NO: 805495 - RNA, 22 nt, Human
acacccaggaauaaggacuggg

SEQ ID NO: 805496 - RNA, 22 nt, Human
gcuggcugcacaggggcucacu

SEQ ID NO: 805497 - RNA, 22 nt, Human
uucaaaucucuccuaauccacu

SEQ ID NO: 805498 - RNA, 22 nt, Human
ucugggcugcuaugaggcagag

SEQ ID NO: 805499 - RNA, 22 nt, Human
gugugcaguagagaaagagcag

SEQ ID NO: 805500 - RNA, 22 nt, Human
ccucccacuucuugcugagguc

SEQ ID NO: 805501 - RNA, 20 nt, Human
uuccagccgccacuuccgcc

SEQ ID NO: 805502 - RNA, 22 nt, Human
gaggcugccaaugugugcaugu

SEQ ID NO: 805503 - RNA, 22 nt, Human
ggucacagggaagggcucucaa

SEQ ID NO: 805504 - RNA, 22 nt, Human
caggcccaggguuauugggaaa

SEQ ID NO: 805505 - RNA, 22 nt, Human
auuucuuaugaauauugacugu

SEQ ID NO: 805506 - RNA, 22 nt, Human
ggguuggauuacuuagggagaa

SEQ ID NO: 805507 - RNA, 22 nt, Human
agcagaagugccuuagcaauca

SEQ ID NO: 805508 - RNA, 22 nt, Human
uaauaauuuuaaagaaggcuag

SEQ ID NO: 805509 - RNA, 22 nt, Human
gcccaggaguucaagucuagug

SEQ ID NO: 805510 - RNA, 20 nt, Human
ccaggcuggcaaaugggggc

SEQ ID NO: 805511 - RNA, 22 nt, Human
agcuuugcacugagacagcuca

SEQ ID NO: 805512 - RNA, 22 nt, Human
uuucacaacugcuuauuugaga

SEQ ID NO: 805513 - RNA, 22 nt, Human
acagaggacaacuaggcgcuca

SEQ ID NO: 805514 - RNA, 22 nt, Human
ugagaaccaugaaaagcuguca

SEQ ID NO: 805515 - RNA, 22 nt, Human
ucugucuuagccaucucaggcu

SEQ ID NO: 805516 - RNA, 22 nt, Human
uggagagaagaggcagugugcu

SEQ ID NO: 805517 - RNA, 22 nt, Human
auucaaauuaaguuaauucagc

SEQ ID NO: 805518 - RNA, 23 nt, Human
agcuuugaggacuuuaaaagaua

SEQ ID NO: 805519 - RNA, 22 nt, Human
cagagcugcacauucuaugaug

SEQ ID NO: 805520 - RNA, 22 nt, Human
ccgggagcaggcgccaccgcca

SEQ ID NO: 805521 - RNA, 22 nt, Human
uuuaaugaauaauucaaaucug

SEQ ID NO: 805522 - RNA, 22 nt, Human
uucuagagaacucgagugccuu

SEQ ID NO: 805523 - RNA, 22 nt, Human
cagccaggacucccauuuagga

SEQ ID NO: 805524 - RNA, 22 nt, Human
cugggagucuaagcuagcaccg

SEQ ID NO: 805525 - RNA, 22 nt, Human
agaggaggaagagcuuuaaaau

SEQ ID NO: 805526 - RNA, 19 nt, Human
caugugcaugagcacagga

SEQ ID NO: 805527 - RNA, 22 nt, Human
ccauuggagccaagaguuuuac

SEQ ID NO: 805528 - RNA, 19 nt, Human
cuuuggaggaugaggcugg

SEQ ID NO: 805529 - RNA, 22 nt, Human
cagaaguaaugaugucauuccu

SEQ ID NO: 805530 - RNA, 22 nt, Human
agccuccaaaugucaggucccg

SEQ ID NO: 805531 - RNA, 22 nt, Human
ucagaaucuuucuagagucuag

SEQ ID NO: 805532 - RNA, 22 nt, Human
gccaggcccugggcacuucgug

SEQ ID NO: 805533 - RNA, 22 nt, Human
auaugauuccacuauuguaugg

SEQ ID NO: 805534 - RNA, 22 nt, Human
agaagcuaggcuagacaaguga

SEQ ID NO: 805535 - RNA, 22 nt, Human
uugucugaauauguauguaucc

SEQ ID NO: 805536 - RNA, 22 nt, Human
auuucccaauacgcuaagugga

SEQ ID NO: 805537 - RNA, 22 nt, Human
aaaccuauauagucuuagaagc

SEQ ID NO: 805538 - RNA, 22 nt, Human
uuucaugugcaauuagcaauau

SEQ ID NO: 805539 - RNA, 22 nt, Human
aacaauuagacugacgguauua

SEQ ID NO: 805540 - RNA, 22 nt, Human
caggccagcguccagaacaagc

SEQ ID NO: 805541 - RNA, 22 nt, Human
aauaaagccuuauugauuuuac

SEQ ID NO: 805542 - RNA, 22 nt, Human
uccaucagcaugcaggcuguuc

SEQ ID NO: 805543 - RNA, 17 nt, Human
ucugucuugacugucac

SEQ ID NO: 805544 - RNA, 22 nt, Human
agagaugaaaaguggagacugg

SEQ ID NO: 805545 - RNA, 22 nt, Human
ucugcuucuccuacuucauggg

SEQ ID NO: 805546 - RNA, 22 nt, Human
agauauguuuguauauauuugu

SEQ ID NO: 805547 - RNA, 22 nt, Human
cucaggacuugguuaguguuuu

SEQ ID NO: 805548 - RNA, 22 nt, Human
cccaggaggcggagguuguggu

SEQ ID NO: 805549 - RNA, 22 nt, Human
aggcuaggccuugcccuggaac

SEQ ID NO: 805550 - RNA, 22 nt, Human
uugggaaagaaugagaagguga

SEQ ID NO: 805551 - RNA, 22 nt, Human
agucacuguucugucaugucaa

SEQ ID NO: 805552 - RNA, 18 nt, Human
gacaguaaacuuccccau

SEQ ID NO: 805553 - RNA, 20 nt, Human
agugauuuaucuuuuuccac

SEQ ID NO: 805554 - RNA, 23 nt, Human
aggcagcagguuguccaggguga

SEQ ID NO: 805555 - RNA, 22 nt, Human
gcagggcagcugaagcuaggug

SEQ ID NO: 805556 - RNA, 22 nt, Human
ugggggcagaggauucaggaau

SEQ ID NO: 805557 - RNA, 22 nt, Human
aaaugcagcagcuaauugaaaa

SEQ ID NO: 805558 - RNA, 22 nt, Human
aaauaguucagcuuguaaaccc

SEQ ID NO: 805559 - RNA, 18 nt, Human
ggagcugggccugguucc

SEQ ID NO: 805560 - RNA, 22 nt, Human
uguuaaaaaugcagauuccuau

SEQ ID NO: 805561 - RNA, 22 nt, Human
cuuauauuuuaggaacagacaa

SEQ ID NO: 805562 - RNA, 22 nt, Human
auucagcauucauuuccaacuu

SEQ ID NO: 805563 - RNA, 22 nt, Human
auaaaacuuggguaugaucccu

SEQ ID NO: 805564 - RNA, 22 nt, Human
cauggcaauuucauaaacaggu

SEQ ID NO: 805565 - RNA, 22 nt, Human
cucagugucuuauuguacacau

SEQ ID NO: 805566 - RNA, 22 nt, Human
gccaggccugcaagugcuggug

SEQ ID NO: 805567 - RNA, 22 nt, Human
uuuauggcacacaaauaucaaa

SEQ ID NO: 805568 - RNA, 22 nt, Human
ucauauaacuggauauuuucaa

SEQ ID NO: 805569 - RNA, 22 nt, Human
ugaaugauuucuuaggcaauug

SEQ ID NO: 805570 - RNA, 22 nt, Human
cugguucauauaggcaaguuua

SEQ ID NO: 805571 - RNA, 22 nt, Human
gcagcaggaauuuaaauuuaua

SEQ ID NO: 805572 - RNA, 22 nt, Human
agaaaauuagauuuuacugugu

SEQ ID NO: 805573 - RNA, 22 nt, Human
caugagcauuuuggucuaguuu

SEQ ID NO: 805574 - RNA, 22 nt, Human
gucugcacggggaggaugggcu

SEQ ID NO: 805575 - RNA, 22 nt, Human
ggggccgaccgcgguucaggcc

SEQ ID NO: 805576 - RNA, 22 nt, Human
uuguugggcaugcaguggcugu

SEQ ID NO: 805577 - RNA, 22 nt, Human
uuuuucuacugcccacauugua

SEQ ID NO: 805578 - RNA, 22 nt, Human
acaacuagcagguauuaauuuu

SEQ ID NO: 805579 - RNA, 22 nt, Human
aacaaccaaaaagaugaaugua

SEQ ID NO: 805580 - RNA, 22 nt, Human
cugagcaggacagugggagacc

SEQ ID NO: 805581 - RNA, 22 nt, Human
cucucagugccacacagccauu

SEQ ID NO: 805582 - RNA, 22 nt, Human
ucugcaggauggaugcucagaa

SEQ ID NO: 805583 - RNA, 22 nt, Human
aaaaugaggucaauauccuuuu

SEQ ID NO: 805584 - RNA, 22 nt, Human
guggagcccugguagggacccc

SEQ ID NO: 805585 - RNA, 22 nt, Human
aagaggaagucuccauggagag

SEQ ID NO: 805586 - RNA, 23 nt, Human
acuuuucaauuagcuaugcuuaa

SEQ ID NO: 805587 - RNA, 22 nt, Human
cuggcccaggcuccuggggcac

SEQ ID NO: 805588 - RNA, 22 nt, Human
augcaaaaacugcacuuacgcu

SEQ ID NO: 805589 - RNA, 22 nt, Human
uuucugcauuuacaaaaugagg

SEQ ID NO: 805590 - RNA, 22 nt, Human
uggcagggccugaaucuuauac

SEQ ID NO: 805591 - RNA, 22 nt, Human
uggucaggauucucagcccuuc

SEQ ID NO: 805592 - RNA, 22 nt, Human
ccagagguccugcucacuggug

SEQ ID NO: 805593 - RNA, 20 nt, Human
ugcaggcuucgcucuaggag

SEQ ID NO: 805594 - RNA, 22 nt, Human
gcacaggagccagguccuucac

SEQ ID NO: 805595 - RNA, 22 nt, Human
uuugggaagugggagcaaggug

SEQ ID NO: 805596 - RNA, 22 nt, Human
uaacauuaaaagagauaauuga

SEQ ID NO: 805597 - RNA, 22 nt, Human
agugggagggccauauggugaa

SEQ ID NO: 805598 - RNA, 22 nt, Human
cucaggagacaguguccacaug

SEQ ID NO: 805599 - RNA, 22 nt, Human
ugaguucuaggcuuaaaacuaa

SEQ ID NO: 805600 - RNA, 22 nt, Human
cuagaaaaauacuuuauuguga

SEQ ID NO: 805601 - RNA, 22 nt, Human
gggagccacagugaggugcaug

SEQ ID NO: 805602 - RNA, 22 nt, Human
uccuggccacccgacagaaguc

SEQ ID NO: 805603 - RNA, 22 nt, Human
gccccagcccuguggaccaugg

SEQ ID NO: 805604 - RNA, 22 nt, Human
ccuggcaggcaagaggaaggga

SEQ ID NO: 805605 - RNA, 22 nt, Human
aggcaggccgugucccuccuca

SEQ ID NO: 805606 - RNA, 22 nt, Human
ggcacagaguuggcagagcugc

SEQ ID NO: 805607 - RNA, 21 nt, Human
agcuggcuauaguuagugaug

SEQ ID NO: 805608 - RNA, 22 nt, Human
gguucuaggauuaggaggccca

SEQ ID NO: 805609 - RNA, 22 nt, Human
aaguuucugccauacuguggug

SEQ ID NO: 805610 - RNA, 22 nt, Human
ccaggaggucugaguguggaca

SEQ ID NO: 805611 - RNA, 22 nt, Human
ccuucuggaagcucuaagggag

SEQ ID NO: 805612 - RNA, 22 nt, Human
aaauaacagucagggacaacau

SEQ ID NO: 805613 - RNA, 22 nt, Human
uggggcugaggagccucacucu

SEQ ID NO: 805614 - RNA, 22 nt, Human
uauagcaauucagaauacaugu

SEQ ID NO: 805615 - RNA, 22 nt, Human
aggaagagcccgggugacauaa

SEQ ID NO: 805616 - RNA, 22 nt, Human
aaagucaugcaguugaacuuuu

SEQ ID NO: 805617 - RNA, 22 nt, Human
gaugagaaauggacaggagugg

SEQ ID NO: 805618 - RNA, 22 nt, Human
cugcaaggucaugacucucugg

SEQ ID NO: 805619 - RNA, 22 nt, Human
gagcccagggugaaauagcagc

SEQ ID NO: 805620 - RNA, 22 nt, Human
auuugcauaauagugauuugua

SEQ ID NO: 805621 - RNA, 22 nt, Human
cuucacauggguacugcugauc

SEQ ID NO: 805622 - RNA, 22 nt, Human
auauaguuuagguucgaauggg

SEQ ID NO: 805623 - RNA, 22 nt, Human
aggcuucauguagaugguuccc

SEQ ID NO: 805624 - RNA, 22 nt, Human
cagugcaggaagugagaugccu

SEQ ID NO: 805625 - RNA, 22 nt, Human
ggcuccaggagaugcugggcag

SEQ ID NO: 805626 - RNA, 22 nt, Human
uucaaggcagaguguaguuaaa

SEQ ID NO: 805627 - RNA, 21 nt, Human
ugucacagauucucagcuugc

SEQ ID NO: 805628 - RNA, 22 nt, Human
gcuggccauggccugcgccauc

SEQ ID NO: 805629 - RNA, 22 nt, Human
uugauauucccgauuuaaggua

SEQ ID NO: 805630 - RNA, 21 nt, Human
cacuugaaugguguuuuacaa

SEQ ID NO: 805631 - RNA, 22 nt, Human
agaaagugaacguguucaguuu

SEQ ID NO: 805632 - RNA, 23 nt, Human
uuccaagugcuuuacuuaauccu

SEQ ID NO: 805633 - RNA, 22 nt, Human
gcuggccuuugaggaagcugcg

SEQ ID NO: 805634 - RNA, 22 nt, Human
uugauucaaaggggacaagugg

SEQ ID NO: 805635 - RNA, 21 nt, Human
cuacuuaaguaggggauuagg

SEQ ID NO: 805636 - RNA, 22 nt, Human
cuggagggcuggacuaaggaaa

SEQ ID NO: 805637 - RNA, 22 nt, Human
uauaacaccauguucuacagau

SEQ ID NO: 805638 - RNA, 22 nt, Human
uccaggaggcucugguugacgu

SEQ ID NO: 805639 - RNA, 22 nt, Human
ucagagaauguccuucuucauu

SEQ ID NO: 805640 - RNA, 22 nt, Human
caguagaagcuuguuuuucaga

SEQ ID NO: 805641 - RNA, 22 nt, Human
ccuggcucccugcacagggcuc

SEQ ID NO: 805642 - RNA, 22 nt, Human
gcauuuuaaugagguuuaugag

SEQ ID NO: 805643 - RNA, 22 nt, Human
augggcaguguauuggaaggaa

SEQ ID NO: 805644 - RNA, 22 nt, Human
aauuuauucccgucucugggcu

SEQ ID NO: 805645 - RNA, 19 nt, Human
aucacaugucaagagcagg

SEQ ID NO: 805646 - RNA, 22 nt, Human
auuucauauguaucaccuagcc

SEQ ID NO: 805647 - RNA, 22 nt, Human
ggucucugcucagaugccacuu

SEQ ID NO: 805648 - RNA, 22 nt, Human
guucuauuacucccugcuucuu

SEQ ID NO: 805649 - RNA, 22 nt, Human
ugucacaugacacaaauaucua

SEQ ID NO: 805650 - RNA, 22 nt, Human
guuucauggagagcugaauauu

SEQ ID NO: 805651 - RNA, 22 nt, Human
uggcuggaggguuagugagaua

SEQ ID NO: 805652 - RNA, 22 nt, Human
ugcccagcagggagcuaccugg

SEQ ID NO: 805653 - RNA, 22 nt, Human
ugaguauuuuaaguucucaauc

SEQ ID NO: 805654 - RNA, 22 nt, Human
acuuauguaguaccucuuaugu

SEQ ID NO: 805655 - RNA, 22 nt, Human
accccaggucuccaggcucugg

SEQ ID NO: 805656 - RNA, 22 nt, Human
uccaggaacagaauguuagugc

SEQ ID NO: 805657 - RNA, 22 nt, Human
acaguucacuuuuuauaucaaa

SEQ ID NO: 805658 - RNA, 22 nt, Human
uucuggaaaagaaaguuaagau

SEQ ID NO: 805659 - RNA, 22 nt, Human
uagaaauggagaacagauuaau

SEQ ID NO: 805660 - RNA, 22 nt, Human
ccagagcugaggagaugggcuu

SEQ ID NO: 805661 - RNA, 22 nt, Human
acucaggagggaucagcuauca

SEQ ID NO: 805662 - RNA, 22 nt, Human
caaacauucagaugcaauggua

SEQ ID NO: 805663 - RNA, 22 nt, Human
acacauuuagcaccagguuuau

SEQ ID NO: 805664 - RNA, 22 nt, Human
guggaaggaagagauggcccca

SEQ ID NO: 805665 - RNA, 22 nt, Human
gcagggcagaccuccagccuau

SEQ ID NO: 805666 - RNA, 22 nt, Human
uguagcucuccagccagcaagg

SEQ ID NO: 805667 - RNA, 22 nt, Human
agugggagauaacuuaacagcu

SEQ ID NO: 805668 - RNA, 22 nt, Human
agcuggagaugcccagcaccgg

SEQ ID NO: 805669 - RNA, 22 nt, Human
accucccugccucuuggcguca

SEQ ID NO: 805670 - RNA, 22 nt, Human
uuagcuuuagagccauuacugg

SEQ ID NO: 805671 - RNA, 22 nt, Human
cccugagagugagugccaccuu

SEQ ID NO: 805672 - RNA, 22 nt, Human
agugggggccaacgagggcagc

SEQ ID NO: 805673 - RNA, 22 nt, Human
aucagugugucaaaagcacaaa

SEQ ID NO: 805674 - RNA, 22 nt, Human
ggcagcuuuuaucccugacaga

SEQ ID NO: 805675 - RNA, 22 nt, Human
gaggccagaagugccucgggcu

SEQ ID NO: 805676 - RNA, 22 nt, Human
ccaggagguggagauugcagug

SEQ ID NO: 805677 - RNA, 22 nt, Human
ugggcagguuguuauuugacau

SEQ ID NO: 805678 - RNA, 22 nt, Human
agccugggaauuuagaguucgg

SEQ ID NO: 805679 - RNA, 22 nt, Human
guaauagguuuucuugcuccag

SEQ ID NO: 805680 - RNA, 22 nt, Human
caugacauuuuaaaaagaacau

SEQ ID NO: 805681 - RNA, 22 nt, Human
uaauaauuaguuauugaucgug

SEQ ID NO: 805682 - RNA, 22 nt, Human
uaguacaguuccaucaaagcag

SEQ ID NO: 805683 - RNA, 22 nt, Human
ccucugccaccucccacgaggc

SEQ ID NO: 805684 - RNA, 22 nt, Human
uuucuaaggugagguagaaaau

SEQ ID NO: 805685 - RNA, 22 nt, Human
ugcaggagcagagauggcugga

SEQ ID NO: 805686 - RNA, 22 nt, Human
gaaaaggccacuccuaggagcu

SEQ ID NO: 805687 - RNA, 22 nt, Human
uuucauguggcgaugucucugg

SEQ ID NO: 805688 - RNA, 22 nt, Human
gcccugagacugagcauggguu

SEQ ID NO: 805689 - RNA, 22 nt, Human
cagagaugggucgcagagaugg

SEQ ID NO: 805690 - RNA, 22 nt, Human
acuuuucccuugguagaguugc

SEQ ID NO: 805691 - RNA, 22 nt, Human
ugcuggaggagaagguugcuca

SEQ ID NO: 805692 - RNA, 22 nt, Human
ggcuucccugccucacuuauuc

SEQ ID NO: 805693 - RNA, 22 nt, Human
gcagugcuuuagucuguccuuu

SEQ ID NO: 805694 - RNA, 22 nt, Human
uuuuucccauauagaaagccaa

SEQ ID NO: 805695 - RNA, 22 nt, Human
ucugccagcucugugggucucg

SEQ ID NO: 805696 - RNA, 18 nt, Human
auugcuuuuguaccaacc

SEQ ID NO: 805697 - RNA, 22 nt, Human
ccugggccucacccagcucuug

SEQ ID NO: 805698 - RNA, 22 nt, Human
ucagugacuggguauuaaauca

SEQ ID NO: 805699 - RNA, 22 nt, Human
cugcacagccugucugggggcc

SEQ ID NO: 805700 - RNA, 22 nt, Human
caucucaguguacagggagucu

SEQ ID NO: 805701 - RNA, 22 nt, Human
uccucaggucaaagcaggagaa

SEQ ID NO: 805702 - RNA, 22 nt, Human
guccuguguaaguacuugcuca

SEQ ID NO: 805703 - RNA, 22 nt, Human
ggaggagcacuucugagcucag

SEQ ID NO: 805704 - RNA, 22 nt, Human
guuguuuuauaggcucaugccu

SEQ ID NO: 805705 - RNA, 22 nt, Human
aggugggcccagugggcuccag

SEQ ID NO: 805706 - RNA, 21 nt, Human
agaaaauggcguuuuagauuu

SEQ ID NO: 805707 - RNA, 19 nt, Human
cagagcugcuggccucguc

SEQ ID NO: 805708 - RNA, 22 nt, Human
gcugcagcagaaguucucagag

SEQ ID NO: 805709 - RNA, 22 nt, Human
ugcagcaguuuaaugcaggguu

SEQ ID NO: 805710 - RNA, 22 nt, Human
aaaggccaauaaagacaagcug

SEQ ID NO: 805711 - RNA, 22 nt, Human
cccagggcugcagauggaggcu

SEQ ID NO: 805712 - RNA, 22 nt, Human
aauaagaaagagucagcuucag

SEQ ID NO: 805713 - RNA, 18 nt, Human
gguccugggccuggcuca

SEQ ID NO: 805714 - RNA, 22 nt, Human
uccgggagcugaacgucuugcg

SEQ ID NO: 805715 - RNA, 22 nt, Human
acugggaguucuccaugucccu

SEQ ID NO: 805716 - RNA, 22 nt, Human
aggcugagcuggcccuugaaau

SEQ ID NO: 805717 - RNA, 22 nt, Human
ucauuauucucuuuaauguucu

SEQ ID NO: 805718 - RNA, 22 nt, Human
gagcucuugcuucuaguccagg

SEQ ID NO: 805719 - RNA, 18 nt, Human
gccuccaccauggagggu

SEQ ID NO: 805720 - RNA, 22 nt, Human
auaucaaacgaaguuauuuuaa

SEQ ID NO: 805721 - RNA, 22 nt, Human
cggagcugcgccgggacacggg

SEQ ID NO: 805722 - RNA, 22 nt, Human
ccacagaaugaugacacuucag

SEQ ID NO: 805723 - RNA, 22 nt, Human
uccucccuugacuccugcuuuu

SEQ ID NO: 805724 - RNA, 22 nt, Human
gagucagaauuguauuuuaaac

SEQ ID NO: 805725 - RNA, 22 nt, Human
agccugccuugggcugcuugag

SEQ ID NO: 805726 - RNA, 22 nt, Human
uuuaucugaggaaagcagacaa

SEQ ID NO: 805727 - RNA, 22 nt, Human
aacugcaagcucuuuacugcua

SEQ ID NO: 805728 - RNA, 22 nt, Human
gaccuccguguacaccucccag

SEQ ID NO: 805729 - RNA, 22 nt, Human
gcucagcuugggagcgcccggu

SEQ ID NO: 805730 - RNA, 22 nt, Human
uacaagaaauuucugcauauau

SEQ ID NO: 805731 - RNA, 22 nt, Human
uuuacacaaaauguuaguagau

SEQ ID NO: 805732 - RNA, 19 nt, Human
ggcaagcacaaaagcuuug

SEQ ID NO: 805733 - RNA, 22 nt, Human
ggugaccucaccuggucccacc

SEQ ID NO: 805734 - RNA, 22 nt, Human
ucaguaguucagcaaauauuuu

SEQ ID NO: 805735 - RNA, 22 nt, Human
acaggcuguugggguccagggu

SEQ ID NO: 805736 - RNA, 22 nt, Human
agagacaggguuuugucguguu

SEQ ID NO: 805737 - RNA, 22 nt, Human
ggcaaaaaccgcaauaacuucu

SEQ ID NO: 805738 - RNA, 21 nt, Human
ucuugauuauuggccucacac

SEQ ID NO: 805739 - RNA, 22 nt, Human
ccagggcucaggcucccagugg

SEQ ID NO: 805740 - RNA, 22 nt, Human
gcuggccauagaagccaaagag

SEQ ID NO: 805741 - RNA, 22 nt, Human
auaugauuguccuuagcaaauu

SEQ ID NO: 805742 - RNA, 22 nt, Human
acaugcaaagggaugcaauuau

SEQ ID NO: 805743 - RNA, 22 nt, Human
aggucacacaacugucagaggc

SEQ ID NO: 805744 - RNA, 22 nt, Human
gcugccuuuugcuccucccacc

SEQ ID NO: 805745 - RNA, 23 nt, Human
ucaucaaacagcugcucaagaaa

SEQ ID NO: 805746 - RNA, 22 nt, Human
gccuggugcuaugagggccagc

SEQ ID NO: 805747 - RNA, 20 nt, Human
uccugcaguuccuaggaggg

SEQ ID NO: 805748 - RNA, 22 nt, Human
gagucagaaaguagugugccua

SEQ ID NO: 805749 - RNA, 22 nt, Human
accaggagaggcacuugcaaug

SEQ ID NO: 805750 - RNA, 22 nt, Human
gggcccaggccuccuuccuucc

SEQ ID NO: 805751 - RNA, 22 nt, Human
caagagcuuuagaaaugcucau

SEQ ID NO: 805752 - RNA, 22 nt, Human
gcuggcuguaucaccuggccag

SEQ ID NO: 805753 - RNA, 22 nt, Human
auaugcuugggacugauacagu

SEQ ID NO: 805754 - RNA, 23 nt, Human
uggugccacagcugaagucaggu

SEQ ID NO: 805755 - RNA, 22 nt, Human
ugguccaguaaggguggagaga

SEQ ID NO: 805756 - RNA, 22 nt, Human
agcagagcccuuccauggccuu

SEQ ID NO: 805757 - RNA, 22 nt, Human
aggagcugauagucuauggaga

SEQ ID NO: 805758 - RNA, 22 nt, Human
cccaggagguguagcugcgugg

SEQ ID NO: 805759 - RNA, 22 nt, Human
acagauggggcacaaagccaca

SEQ ID NO: 805760 - RNA, 22 nt, Human
aagaacauuuuguagaaugaca

SEQ ID NO: 805761 - RNA, 22 nt, Human
aggcagugcaugcaaaggucgg

SEQ ID NO: 805762 - RNA, 22 nt, Human
agaggaagauuuuauuaaccag

SEQ ID NO: 805763 - RNA, 22 nt, Human
uagagcuggaaaacugcaggua

SEQ ID NO: 805764 - RNA, 23 nt, Human
cugggcauggagcuucagaggcu

SEQ ID NO: 805765 - RNA, 19 nt, Human
acagggcagcaauaggaua

SEQ ID NO: 805766 - RNA, 22 nt, Human
uccggcagcaucuggagggaug

SEQ ID NO: 805767 - RNA, 22 nt, Human
cugccucaugcugccugcagcc

SEQ ID NO: 805768 - RNA, 22 nt, Human
ccuggcugcugucacugaccau

SEQ ID NO: 805769 - RNA, 22 nt, Human
ugggccuggaguuuguccagag

SEQ ID NO: 805770 - RNA, 22 nt, Human
aagcagaggccacagagugggc

SEQ ID NO: 805771 - RNA, 22 nt, Human
gauaauaagcacagcaggaugu

SEQ ID NO: 805772 - RNA, 22 nt, Human
ggcuucuccccuuugagucuuc

SEQ ID NO: 805773 - RNA, 22 nt, Human
uuucaggacaccuuuaaaaacg

SEQ ID NO: 805774 - RNA, 19 nt, Human
auacacuaauauaaaccac

SEQ ID NO: 805775 - RNA, 22 nt, Human
gucugaggucauuagcucucuu

SEQ ID NO: 805776 - RNA, 22 nt, Human
agaggaugauuuuaaggacacu

SEQ ID NO: 805777 - RNA, 22 nt, Human
cugcugggccuggucucugagg

SEQ ID NO: 805778 - RNA, 22 nt, Human
uccaagcauguggucaggagcc

SEQ ID NO: 805779 - RNA, 22 nt, Human
aggcagaauguuggaaaggaag

SEQ ID NO: 805780 - RNA, 22 nt, Human
uacuuguucuuucaagagauag

SEQ ID NO: 805781 - RNA, 22 nt, Human
ugcuggcauggucuuggugaca

SEQ ID NO: 805782 - RNA, 18 nt, Human
ucugcacuccugagagag

SEQ ID NO: 805783 - RNA, 22 nt, Human
gggccaggaguggagauauggg

SEQ ID NO: 805784 - RNA, 18 nt, Human
ccugccagucuggagcag

SEQ ID NO: 805785 - RNA, 22 nt, Human
cucagaggucaagagcagagcu

SEQ ID NO: 805786 - RNA, 22 nt, Human
agcuccugauucucagagauag

SEQ ID NO: 805787 - RNA, 21 nt, Human
guaucacauuugcaugcuuau

SEQ ID NO: 805788 - RNA, 22 nt, Human
cagcauaggauguggagccagg

SEQ ID NO: 805789 - RNA, 22 nt, Human
gaugaaauuguuuugauacuuu

SEQ ID NO: 805790 - RNA, 22 nt, Human
uucaacaugcuuuauuucuaaa

SEQ ID NO: 805791 - RNA, 22 nt, Human
cacacugucagguaaauaacac

SEQ ID NO: 805792 - RNA, 22 nt, Human
gacauuuacugaauacugauua

SEQ ID NO: 805793 - RNA, 22 nt, Human
cagcuucaugacaaacaguuuu

SEQ ID NO: 805794 - RNA, 22 nt, Human
auaaaaacugacccauccuuug

SEQ ID NO: 805795 - RNA, 22 nt, Human
cucucagaaguagcacgugggc

SEQ ID NO: 805796 - RNA, 22 nt, Human
cuuccucccggcccaugcucug

SEQ ID NO: 805797 - RNA, 22 nt, Human
aguggcagggcuggcugcugca

SEQ ID NO: 805798 - RNA, 22 nt, Human
ugagagguaggaaaugaacaag

SEQ ID NO: 805799 - RNA, 22 nt, Human
cgcaggcacagaguggacagcg

SEQ ID NO: 805800 - RNA, 22 nt, Human
cugcaauaugaugucugagaaa

SEQ ID NO: 805801 - RNA, 20 nt, Human
ggcaugagaugugagggagg

SEQ ID NO: 805802 - RNA, 23 nt, Human
aauaaggccaaacuaucuggucu

SEQ ID NO: 805803 - RNA, 22 nt, Human
uuuaccuaguauaaugcaaccu

SEQ ID NO: 805804 - RNA, 22 nt, Human
aaaguacagccacauccaagua

SEQ ID NO: 805805 - RNA, 22 nt, Human
guacuuuaaaucaauguagauu

SEQ ID NO: 805806 - RNA, 22 nt, Human
augagagguuucgucagaggaa

SEQ ID NO: 805807 - RNA, 18 nt, Human
ucaaaauauuucugugga

SEQ ID NO: 805808 - RNA, 22 nt, Human
ggcucuugaaauguggcuggcg

SEQ ID NO: 805809 - RNA, 22 nt, Human
caaagcagaccuuuacccuuua

SEQ ID NO: 805810 - RNA, 21 nt, Human
agcugccuccacuucugaggc

SEQ ID NO: 805811 - RNA, 22 nt, Human
cugaagaaugacagugcuuuga

SEQ ID NO: 805812 - RNA, 22 nt, Human
ucaggggacagccagcuggagg

SEQ ID NO: 805813 - RNA, 22 nt, Human
ggaauaaaaauuguuuacugua

SEQ ID NO: 805814 - RNA, 22 nt, Human
ucccaggcuaccagugagguca

SEQ ID NO: 805815 - RNA, 22 nt, Human
gcuggggugugguggauaagcu

SEQ ID NO: 805816 - RNA, 22 nt, Human
uauuaauaaauauguaggggcc

SEQ ID NO: 805817 - RNA, 22 nt, Human
aacucaaagaugcaugacgcuu

SEQ ID NO: 805818 - RNA, 22 nt, Human
gugcuggggagauaggaagaga

SEQ ID NO: 805819 - RNA, 22 nt, Human
agggagacacaugaggaaguca

SEQ ID NO: 805820 - RNA, 22 nt, Human
caaggaaaacagaugaucaaca

SEQ ID NO: 805821 - RNA, 22 nt, Human
ucagaaaagaccacauuauucu

SEQ ID NO: 805822 - RNA, 22 nt, Human
uguauauuguucugucucuuca

SEQ ID NO: 805823 - RNA, 22 nt, Human
ggccuugggcagacacgucaca

SEQ ID NO: 805824 - RNA, 22 nt, Human
cacaugagugagaacaugcagu

SEQ ID NO: 805825 - RNA, 19 nt, Human
gggaucagcccagggcucu

SEQ ID NO: 805826 - RNA, 20 nt, Human
gcagcugaaaguaugacacc

SEQ ID NO: 805827 - RNA, 22 nt, Human
cagauauguggauucuauuagc

SEQ ID NO: 805828 - RNA, 22 nt, Human
gacagcaaccucaugagaaacu

SEQ ID NO: 805829 - RNA, 22 nt, Human
cugggcagaguccggaagaugg

SEQ ID NO: 805830 - RNA, 22 nt, Human
uggaucuaucuccagggguccu

SEQ ID NO: 805831 - RNA, 22 nt, Human
ucuuucuugguauucugagcua

SEQ ID NO: 805832 - RNA, 22 nt, Human
uugucuuaaauggauggacaau

SEQ ID NO: 805833 - RNA, 22 nt, Human
ucguuuuagguggacauugugu

SEQ ID NO: 805834 - RNA, 22 nt, Human
ggcccagcuguauauuacaguu

SEQ ID NO: 805835 - RNA, 22 nt, Human
agcagggcucugccaugggccc

SEQ ID NO: 805836 - RNA, 22 nt, Human
agaaggcugaagaagauccguu

SEQ ID NO: 805837 - RNA, 22 nt, Human
gugaaaaaucaucaugacuuga

SEQ ID NO: 805838 - RNA, 22 nt, Human
cuuuacaaagcaauuuugucuc

SEQ ID NO: 805839 - RNA, 22 nt, Human
guggggaggcauucuucucccu

SEQ ID NO: 805840 - RNA, 22 nt, Human
agugucugcuuugagucaggug

SEQ ID NO: 805841 - RNA, 22 nt, Human
agccuguggaucccugcacugg

SEQ ID NO: 805842 - RNA, 21 nt, Human
gugcugggacacagccaggcu

SEQ ID NO: 805843 - RNA, 22 nt, Human
uucacauucagaaaaagcccgu

SEQ ID NO: 805844 - RNA, 22 nt, Human
agagggaaauccaggagugcuu

SEQ ID NO: 805845 - RNA, 16 nt, Human
agccaggcugccucgg

SEQ ID NO: 805846 - RNA, 21 nt, Human
cccagggaagccgcagucacc

SEQ ID NO: 805847 - RNA, 22 nt, Human
agacccuuugggucugugcagg

SEQ ID NO: 805848 - RNA, 22 nt, Human
caggcagagaggagcauuuaau

SEQ ID NO: 805849 - RNA, 22 nt, Human
cuuugcugccagaacccagcag

SEQ ID NO: 805850 - RNA, 22 nt, Human
aggccuggugugccggaugcag

SEQ ID NO: 805851 - RNA, 22 nt, Human
cuuugguucuguccuucccaga

SEQ ID NO: 805852 - RNA, 22 nt, Human
ugcagccuagacauucugguca

SEQ ID NO: 805853 - RNA, 22 nt, Human
gugauucauccuggcauucauu

SEQ ID NO: 805854 - RNA, 22 nt, Human
agcaaggaaacuauggagagau

SEQ ID NO: 805855 - RNA, 23 nt, Human
acacuucacccauugugauagga

SEQ ID NO: 805856 - RNA, 22 nt, Human
auuuaugauuagccuauuguug

SEQ ID NO: 805857 - RNA, 22 nt, Human
cagcucugugcaggccugggga

SEQ ID NO: 805858 - RNA, 22 nt, Human
aggagccaggaaaccugcucug

SEQ ID NO: 805859 - RNA, 22 nt, Human
acauuacuuaccuuggguucua

SEQ ID NO: 805860 - RNA, 22 nt, Human
ggagggagguuagauucaagcu

SEQ ID NO: 805861 - RNA, 19 nt, Human
ggcugccuccugggagauu

SEQ ID NO: 805862 - RNA, 22 nt, Human
ucccagcccagacuucuccagu

SEQ ID NO: 805863 - RNA, 22 nt, Human
aaacaccagucccaguauacac

SEQ ID NO: 805864 - RNA, 22 nt, Human
aguuggugggugugagcuggac

SEQ ID NO: 805865 - RNA, 17 nt, Human
aggagcuggggguggug

SEQ ID NO: 805866 - RNA, 22 nt, Human
uuaucugaaaaccucaaaauau

SEQ ID NO: 805867 - RNA, 22 nt, Human
aacaaauguguuuuguaauuaa

SEQ ID NO: 805868 - RNA, 22 nt, Human
uuggcccacucucagaaugugg

SEQ ID NO: 805869 - RNA, 22 nt, Human
uggcugcagaucugugggacac

SEQ ID NO: 805870 - RNA, 22 nt, Human
uccugcaggccuguucccagua

SEQ ID NO: 805871 - RNA, 21 nt, Human
cagaggccucaugcucugugc

SEQ ID NO: 805872 - RNA, 16 nt, Human
gcacacagccagccuu

SEQ ID NO: 805873 - RNA, 22 nt, Human
caggaggcuuugggauccaagu

SEQ ID NO: 805874 - RNA, 22 nt, Human
uacuccugcugauccugccagc

SEQ ID NO: 805875 - RNA, 22 nt, Human
ggcaggcuguucaccugcuuuu

SEQ ID NO: 805876 - RNA, 22 nt, Human
aggcuggcuggggaugcgucuu

SEQ ID NO: 805877 - RNA, 22 nt, Human
gaauucuucugucuuuaacuga

SEQ ID NO: 805878 - RNA, 22 nt, Human
gggcacagagggucuugaagaa

SEQ ID NO: 805879 - RNA, 22 nt, Human
ugugucugcacugaguccucac

SEQ ID NO: 805880 - RNA, 22 nt, Human
acaaaaccagaaaaucucuacc

SEQ ID NO: 805881 - RNA, 22 nt, Human
cuucuucaagagaaugggagac

SEQ ID NO: 805882 - RNA, 22 nt, Human
ccugagacaugaaccaggcucc

SEQ ID NO: 805883 - RNA, 22 nt, Human
aggaaacaguugguaaugcaua

SEQ ID NO: 805884 - RNA, 22 nt, Human
uuuaccagaauugccaccagaa

SEQ ID NO: 805885 - RNA, 22 nt, Human
cacaagagagugcgcguugcaa

SEQ ID NO: 805886 - RNA, 22 nt, Human
ggccugagcuugggcagcguau

SEQ ID NO: 805887 - RNA, 22 nt, Human
ggaaacuagaagaauacuaguc

SEQ ID NO: 805888 - RNA, 23 nt, Human
ugccuuaguuagcacauuucuaa

SEQ ID NO: 805889 - RNA, 22 nt, Human
cugggagcucagcccuggggug

SEQ ID NO: 805890 - RNA, 22 nt, Human
auaacagacugauuuuuaaaug

SEQ ID NO: 805891 - RNA, 22 nt, Human
uucuuuggaauaagucaagcug

SEQ ID NO: 805892 - RNA, 22 nt, Human
ccucccaccguaucucaguggc

SEQ ID NO: 805893 - RNA, 22 nt, Human
gcuggaggauggacuggaagaa

SEQ ID NO: 805894 - RNA, 22 nt, Human
uaaaggcaaauguguguuugug

SEQ ID NO: 805895 - RNA, 22 nt, Human
uuuuaugaagauaauuuucuga

SEQ ID NO: 805896 - RNA, 22 nt, Human
uucuuauagaagcaaccauugu

SEQ ID NO: 805897 - RNA, 22 nt, Human
gccagcuggagacuggcagggg

SEQ ID NO: 805898 - RNA, 22 nt, Human
ucaugggguagaagcauguuua

SEQ ID NO: 805899 - RNA, 22 nt, Human
acuggcagcuguaggaugcaug

SEQ ID NO: 805900 - RNA, 22 nt, Human
ucugcaccccgcagggucaggu

SEQ ID NO: 805901 - RNA, 22 nt, Human
ucuuuagacauccaguuucucu

SEQ ID NO: 805902 - RNA, 22 nt, Human
cuucccugauaagagccucaga

SEQ ID NO: 805903 - RNA, 22 nt, Human
guauaugugugggccugcauau

SEQ ID NO: 805904 - RNA, 20 nt, Human
uuauuucaguugcuagauug

SEQ ID NO: 805905 - RNA, 23 nt, Human
caagucauggauuggaguuucag

SEQ ID NO: 805906 - RNA, 22 nt, Human
cugcugauucuuaaaugugguu

SEQ ID NO: 805907 - RNA, 17 nt, Human
cuuguuuuccacuggga

SEQ ID NO: 805908 - RNA, 22 nt, Human
agcagagcagaaugugaaggug

SEQ ID NO: 805909 - RNA, 22 nt, Human
caccccuugucuuuggggucgu

SEQ ID NO: 805910 - RNA, 22 nt, Human
gggcagauggggcacaggcuga

SEQ ID NO: 805911 - RNA, 22 nt, Human
ggaugcaggaguugaagaagga

SEQ ID NO: 805912 - RNA, 22 nt, Human
ugcuggagaccugcuugcacca

SEQ ID NO: 805913 - RNA, 22 nt, Human
cuacauuuggagaguauaggaa

SEQ ID NO: 805914 - RNA, 22 nt, Human
augaaaugcugagaggugcuuc

SEQ ID NO: 805915 - RNA, 22 nt, Human
gacccugagcaaaagcaguucu

SEQ ID NO: 805916 - RNA, 22 nt, Human
agcuagcuuagccugugaggua

SEQ ID NO: 805917 - RNA, 22 nt, Human
ccaguucugagaugaauaucca

SEQ ID NO: 805918 - RNA, 22 nt, Human
aaaauagauucuaggaugucuu

SEQ ID NO: 805919 - RNA, 18 nt, Human
agcagggcauuuugccau

SEQ ID NO: 805920 - RNA, 22 nt, Human
uuaauuagagcugauguucaua

SEQ ID NO: 805921 - RNA, 22 nt, Human
uucuauuaauauguuaauucug

SEQ ID NO: 805922 - RNA, 22 nt, Human
augucagaagcuggaugacagc

SEQ ID NO: 805923 - RNA, 22 nt, Human
uuuuauguuccugaagcuaucu

SEQ ID NO: 805924 - RNA, 22 nt, Human
ugcuuccugaggccgucuucuc

SEQ ID NO: 805925 - RNA, 22 nt, Human
caccagggcagcagccuagucu

SEQ ID NO: 805926 - RNA, 22 nt, Human
agagcuggcugugggugacuuu

SEQ ID NO: 805927 - RNA, 22 nt, Human
ucuccagaaauggggcugggga

SEQ ID NO: 805928 - RNA, 22 nt, Human
uucuaaagccuguccuaucaga

SEQ ID NO: 805929 - RNA, 22 nt, Human
gagcagcuggacaggccucccu

SEQ ID NO: 805930 - RNA, 22 nt, Human
cucaggaggaggaaguucauug

SEQ ID NO: 805931 - RNA, 22 nt, Human
acauacauguaaaggaaauuau

SEQ ID NO: 805932 - RNA, 22 nt, Human
auuuuuaugacaaaccauccuc

SEQ ID NO: 805933 - RNA, 22 nt, Human
gggcaugagaggcaggcaagug

SEQ ID NO: 805934 - RNA, 22 nt, Human
ucacaugucagucuuaaacaga

SEQ ID NO: 805935 - RNA, 22 nt, Human
gagccaggcccguacuugcugu

SEQ ID NO: 805936 - RNA, 22 nt, Human
cagccaggacagggaaacuagu

SEQ ID NO: 805937 - RNA, 22 nt, Human
uuaaggaauuacgaaaauauuu

SEQ ID NO: 805938 - RNA, 23 nt, Human
agauuuggaaagcugaguggcgu

SEQ ID NO: 805939 - RNA, 22 nt, Human
uggcugauugauuuccuaugua

SEQ ID NO: 805940 - RNA, 22 nt, Human
acuauaacccauggaauauaag

SEQ ID NO: 805941 - RNA, 22 nt, Human
gagcacaggcuuugguggacac

SEQ ID NO: 805942 - RNA, 22 nt, Human
uccuuggaagagcauucccagg

SEQ ID NO: 805943 - RNA, 22 nt, Human
aggaggugcuagagaagauguu

SEQ ID NO: 805944 - RNA, 22 nt, Human
auacaaugggugcaaagaugug

SEQ ID NO: 805945 - RNA, 22 nt, Human
caguuucuguggucucuuuuca

SEQ ID NO: 805946 - RNA, 22 nt, Human
ucagaggcuuccuuccucggag

SEQ ID NO: 805947 - RNA, 22 nt, Human
cuggagugcaaugaacaagguc

SEQ ID NO: 805948 - RNA, 22 nt, Human
uucuaagucacucagauuuugg

SEQ ID NO: 805949 - RNA, 17 nt, Human
caggcuccuuccagauu

SEQ ID NO: 805950 - RNA, 22 nt, Human
agugucugccuauuuuucaagc

SEQ ID NO: 805951 - RNA, 22 nt, Human
gugggagcauggucccagugcc

SEQ ID NO: 805952 - RNA, 22 nt, Human
uuucuguuguacuuaaacuagg

SEQ ID NO: 805953 - RNA, 22 nt, Human
aggcaggcuagucgcuugagcc

SEQ ID NO: 805954 - RNA, 22 nt, Human
ucagcugagcuccagcucauag

SEQ ID NO: 805955 - RNA, 22 nt, Human
aaguuucuuuauuagcuugucc

SEQ ID NO: 805956 - RNA, 22 nt, Human
aagccaguguccagaaugggca

SEQ ID NO: 805957 - RNA, 16 nt, Human
gcaggacacucagaca

SEQ ID NO: 805958 - RNA, 22 nt, Human
uuucacaucagagguagauuag

SEQ ID NO: 805959 - RNA, 22 nt, Human
uucccuggcccuggcacgcucu

SEQ ID NO: 805960 - RNA, 22 nt, Human
ggguguccagggcgugucugga

SEQ ID NO: 805961 - RNA, 22 nt, Human
auagaaacagggaagcaaagca

SEQ ID NO: 805962 - RNA, 22 nt, Human
ggucccaguugcccaggucagg

SEQ ID NO: 805963 - RNA, 22 nt, Human
ucaggaucaggggccuuuccuu

SEQ ID NO: 805964 - RNA, 22 nt, Human
uguguauucugagguagguaua

SEQ ID NO: 805965 - RNA, 22 nt, Human
caggagcuggauaggaccacaa

SEQ ID NO: 805966 - RNA, 22 nt, Human
gggagccuugggagugccagcc

SEQ ID NO: 805967 - RNA, 22 nt, Human
acagugaugggggugcaggaag

SEQ ID NO: 805968 - RNA, 22 nt, Human
ucuaaacauugguauggagcag

SEQ ID NO: 805969 - RNA, 22 nt, Human
cauucuuauauuuacucauuca

SEQ ID NO: 805970 - RNA, 21 nt, Human
uccucagggccccagagcacu

SEQ ID NO: 805971 - RNA, 22 nt, Human
uugauucauauagauaugcgug

SEQ ID NO: 805972 - RNA, 22 nt, Human
uggaggaaaaaaccaggcagag

SEQ ID NO: 805973 - RNA, 22 nt, Human
ucuucauacaauuucagacauc

SEQ ID NO: 805974 - RNA, 22 nt, Human
cuggcuuccaccauggccccug

SEQ ID NO: 805975 - RNA, 22 nt, Human
auaaggacacccuucucuuuac

SEQ ID NO: 805976 - RNA, 22 nt, Human
cugccuggcccagggaugggcc

SEQ ID NO: 805977 - RNA, 23 nt, Human
auuuacagguuaaaugaaaucag

SEQ ID NO: 805978 - RNA, 22 nt, Human
uucuggagacccagcaacaggg

SEQ ID NO: 805979 - RNA, 22 nt, Human
auacaagugagaaaacugaaga

SEQ ID NO: 805980 - RNA, 22 nt, Human
cugcuuggaguccuccagcacc

SEQ ID NO: 805981 - RNA, 22 nt, Human
agcuggccuccgggugccuggg

SEQ ID NO: 805982 - RNA, 22 nt, Human
gaaggcugaugacagauucugc

SEQ ID NO: 805983 - RNA, 22 nt, Human
auuauauaaaauucuggaagcu

SEQ ID NO: 805984 - RNA, 19 nt, Human
ccuggcucugagcccagcc

SEQ ID NO: 805985 - RNA, 22 nt, Human
ugcauuccuccaccuccugcac

SEQ ID NO: 805986 - RNA, 23 nt, Human
ugucuuugaaugggcuguagaca

SEQ ID NO: 805987 - RNA, 22 nt, Human
ccuuuuucccuggagggacagc

SEQ ID NO: 805988 - RNA, 22 nt, Human
ugagugaggaagcgguggagga

SEQ ID NO: 805989 - RNA, 22 nt, Human
uggcagggccugcucaucaucc

SEQ ID NO: 805990 - RNA, 22 nt, Human
ggugggaguggaacguggaaga

SEQ ID NO: 805991 - RNA, 22 nt, Human
gcagagguccuagccaggaguc

SEQ ID NO: 805992 - RNA, 22 nt, Human
gccuucaggaaaucaguccuug

SEQ ID NO: 805993 - RNA, 22 nt, Human
cugagcagcagggagacuggug

SEQ ID NO: 805994 - RNA, 22 nt, Human
auaucacagaugcagaaagaga

SEQ ID NO: 805995 - RNA, 22 nt, Human
aggaaauugagaaucagaauaa

SEQ ID NO: 805996 - RNA, 22 nt, Human
augcagaagcagaacuuacaca

SEQ ID NO: 805997 - RNA, 22 nt, Human
cagagucaauguccaagaagcu

SEQ ID NO: 805998 - RNA, 22 nt, Human
aaauaguuagcccugcauauau

SEQ ID NO: 805999 - RNA, 22 nt, Human
cuguggcuccagugaaccaaug

SEQ ID NO: 806000 - RNA, 22 nt, Human
gugggagcuuuggcaucaggcu

SEQ ID NO: 806001 - RNA, 22 nt, Human
cauuucugcagaauugcucuuc

SEQ ID NO: 806002 - RNA, 22 nt, Human
aagcuguuagggagugguaggu

SEQ ID NO: 806003 - RNA, 22 nt, Human
augcaacacauuugaugagcga

SEQ ID NO: 806004 - RNA, 22 nt, Human
aaguccugaagacacagaaaag

SEQ ID NO: 806005 - RNA, 22 nt, Human
agugucuuaguccauuugggcu

SEQ ID NO: 806006 - RNA, 22 nt, Human
uagugucuagugaguuugaugc

SEQ ID NO: 806007 - RNA, 22 nt, Human
uuucugauuugacuugaaguau

SEQ ID NO: 806008 - RNA, 22 nt, Human
augacacauaaaacaaggacug

SEQ ID NO: 806009 - RNA, 23 nt, Human
cccaacacauuccuuuucuucug

SEQ ID NO: 806010 - RNA, 22 nt, Human
gaaggcugcgaggggagugccg

SEQ ID NO: 806011 - RNA, 22 nt, Human
ugcaauaacccaugagauagaa

SEQ ID NO: 806012 - RNA, 22 nt, Human
uggaaggcgcagugaugaugcu

SEQ ID NO: 806013 - RNA, 22 nt, Human
ugcugguaccgcgccuccgcca

SEQ ID NO: 806014 - RNA, 22 nt, Human
guucacagcuucuuaggucaua

SEQ ID NO: 806015 - RNA, 22 nt, Human
agccugccucagacucaggaua

SEQ ID NO: 806016 - RNA, 20 nt, Human
aaaguucauguuugcacuuu

SEQ ID NO: 806017 - RNA, 22 nt, Human
guggaggguuugcaaugugcag

SEQ ID NO: 806018 - RNA, 22 nt, Human
ucagaaauguaagcugaugacu

SEQ ID NO: 806019 - RNA, 22 nt, Human
ugggaaagacucaggacaggag

SEQ ID NO: 806020 - RNA, 22 nt, Human
acuuuucucccuccugccuuca

SEQ ID NO: 806021 - RNA, 22 nt, Human
uuucuauuguaagucuccuaua

SEQ ID NO: 806022 - RNA, 22 nt, Human
uauuuucuggggagagugaacc

SEQ ID NO: 806023 - RNA, 22 nt, Human
aauauuucugcagaaugguuuu

SEQ ID NO: 806024 - RNA, 22 nt, Human
uuucaguuguuuuagcucugug

SEQ ID NO: 806025 - RNA, 20 nt, Human
gggcuggcucaacuggaucc

SEQ ID NO: 806026 - RNA, 20 nt, Human
caucagaaauccugacccac

SEQ ID NO: 806027 - RNA, 22 nt, Human
uuuauuauccaguguugucaug

SEQ ID NO: 806028 - RNA, 22 nt, Human
cacaugugugcugaggacugug

SEQ ID NO: 806029 - RNA, 22 nt, Human
uacuguuagagcgauuuguccu

SEQ ID NO: 806030 - RNA, 21 nt, Human
aggaggagagcuuggccuacc

SEQ ID NO: 806031 - RNA, 22 nt, Human
cugaggcuuggaggggucuggu

SEQ ID NO: 806032 - RNA, 22 nt, Human
guuuacugcucuagguugcaca

SEQ ID NO: 806033 - RNA, 20 nt, Human
cuggcaggagcgagucuacc

SEQ ID NO: 806034 - RNA, 20 nt, Human
auggccugcuagaagucugu

SEQ ID NO: 806035 - RNA, 22 nt, Human
uuccaagugggggaagcugagu

SEQ ID NO: 806036 - RNA, 22 nt, Human
ugcauuucagaagaaaauucgg

SEQ ID NO: 806037 - RNA, 22 nt, Human
agaggcuggauugagcauagac

SEQ ID NO: 806038 - RNA, 22 nt, Human
caggugucaaaauacuaagugg

SEQ ID NO: 806039 - RNA, 23 nt, Human
ucacauauguagaaguggaauuc

SEQ ID NO: 806040 - RNA, 22 nt, Human
auuuucaagggagaggccucug

SEQ ID NO: 806041 - RNA, 22 nt, Human
agaaaccucacagcaauucuga

SEQ ID NO: 806042 - RNA, 21 nt, Human
ugcaggcuguuuaagaggcaa

SEQ ID NO: 806043 - RNA, 22 nt, Human
acagaauugaagcugaguaaau

SEQ ID NO: 806044 - RNA, 22 nt, Human
agaggccccaggugagcaugcc

SEQ ID NO: 806045 - RNA, 22 nt, Human
aguucgagaucugcugaugaga

SEQ ID NO: 806046 - RNA, 22 nt, Human
auaaaagaaguuuugguacuug

SEQ ID NO: 806047 - RNA, 22 nt, Human
aaagcaggcagcaggcuggauu

SEQ ID NO: 806048 - RNA, 22 nt, Human
ccuggggagagaaagcccagcc

SEQ ID NO: 806049 - RNA, 22 nt, Human
aaaucaugugcagagaucagga

SEQ ID NO: 806050 - RNA, 22 nt, Human
gcagaggcaaucagguaugugg

SEQ ID NO: 806051 - RNA, 22 nt, Human
ucacaguaucacacaaggauua

SEQ ID NO: 806052 - RNA, 22 nt, Human
aggcuggaguguagcagugcag

SEQ ID NO: 806053 - RNA, 22 nt, Human
cgcagcuguccauguguggggg

SEQ ID NO: 806054 - RNA, 22 nt, Human
cagggcagaaggcacucuacuc

SEQ ID NO: 806055 - RNA, 21 nt, Human
aguccaggaggaggccagguu

SEQ ID NO: 806056 - RNA, 22 nt, Human
gaaggcccagcuugaaugcugc

SEQ ID NO: 806057 - RNA, 22 nt, Human
cuggcccaguucugcguuuugc

SEQ ID NO: 806058 - RNA, 23 nt, Human
aaauggccaaaaccaggugguua

SEQ ID NO: 806059 - RNA, 22 nt, Human
uuauugacuuguuuguccuggu

SEQ ID NO: 806060 - RNA, 18 nt, Human
cagagcuccuggaugcag

SEQ ID NO: 806061 - RNA, 22 nt, Human
uauucuugacugcuuacuaugu

SEQ ID NO: 806062 - RNA, 23 nt, Human
uguuuucuuguccugguauaauu

SEQ ID NO: 806063 - RNA, 22 nt, Human
caccacuggaggucuuggcuuu

SEQ ID NO: 806064 - RNA, 22 nt, Human
uacaccauucccagguggauuu

SEQ ID NO: 806065 - RNA, 22 nt, Human
uucugcacauuuuagcaaagua

SEQ ID NO: 806066 - RNA, 22 nt, Human
ugcuggaggggaugccuucacu

SEQ ID NO: 806067 - RNA, 18 nt, Human
cuucuuguuugauuuggg

SEQ ID NO: 806068 - RNA, 22 nt, Human
uaaaaggauuagcaggaugggc

SEQ ID NO: 806069 - RNA, 22 nt, Human
auuucucaguuccuacuguuua

SEQ ID NO: 806070 - RNA, 22 nt, Human
uauguacacauacacuuguaau

SEQ ID NO: 806071 - RNA, 22 nt, Human
ucuugauucauguucccugcau

SEQ ID NO: 806072 - RNA, 20 nt, Human
aagauucugauuuguagcgu

SEQ ID NO: 806073 - RNA, 22 nt, Human
auguuuucuccauguuaugcuu

SEQ ID NO: 806074 - RNA, 22 nt, Human
acuucacagguuuucauaaaac

SEQ ID NO: 806075 - RNA, 22 nt, Human
ugggucacaaaggccagaugau

SEQ ID NO: 806076 - RNA, 22 nt, Human
uuucuauuuacagugcuaggua

SEQ ID NO: 806077 - RNA, 22 nt, Human
aaugccaaugggcagaacuaga

SEQ ID NO: 806078 - RNA, 22 nt, Human
agaaggcuuuaaguacuggcau

SEQ ID NO: 806079 - RNA, 22 nt, Human
uuaagagguggucgugucugug

SEQ ID NO: 806080 - RNA, 22 nt, Human
aaggcagagauuagcagaauga

SEQ ID NO: 806081 - RNA, 22 nt, Human
ggcacagcugaugcagacacac

SEQ ID NO: 806082 - RNA, 23 nt, Human
accccaggcaucgcauuccucuu

SEQ ID NO: 806083 - RNA, 22 nt, Human
uagcuucucuuuucaacaucuu

SEQ ID NO: 806084 - RNA, 22 nt, Human
aaauacagaguugcuuaaaagc

SEQ ID NO: 806085 - RNA, 22 nt, Human
cagcccugggaucuuagugccu

SEQ ID NO: 806086 - RNA, 22 nt, Human
ccuagacuagaggcagggagcc

SEQ ID NO: 806087 - RNA, 22 nt, Human
ggcaggcaagucugcucuguga

SEQ ID NO: 806088 - RNA, 22 nt, Human
aaaguuuaguguccucuaccac

SEQ ID NO: 806089 - RNA, 22 nt, Human
gggcuuggccccagaagagcua

SEQ ID NO: 806090 - RNA, 22 nt, Human
agagaacagcauugcagcuuug

SEQ ID NO: 806091 - RNA, 22 nt, Human
gcucccugguauugcugccacu

SEQ ID NO: 806092 - RNA, 22 nt, Human
uuucugaaaucucuuuugagga

SEQ ID NO: 806093 - RNA, 22 nt, Human
aguggggacuuaugccagcauu

SEQ ID NO: 806094 - RNA, 22 nt, Human
aaaugcuuagagguguucaaau

SEQ ID NO: 806095 - RNA, 22 nt, Human
ugcccuggugaagugcucuccu

SEQ ID NO: 806096 - RNA, 21 nt, Human
aagcagggacugcccaggucc

SEQ ID NO: 806097 - RNA, 17 nt, Human
cuaagggcccacucuuc

SEQ ID NO: 806098 - RNA, 22 nt, Human
uaugacaaaugauauauuuggc

SEQ ID NO: 806099 - RNA, 22 nt, Human
aacacauagacguuugauauca

SEQ ID NO: 806100 - RNA, 22 nt, Human
gggaggcauguguuauccacuu

SEQ ID NO: 806101 - RNA, 22 nt, Human
ucuauuuuuauaguugaagugc

SEQ ID NO: 806102 - RNA, 22 nt, Human
uaacaucuuuagcagcucgaac

SEQ ID NO: 806103 - RNA, 22 nt, Human
agacuuuaaugugcaaaugaaa

SEQ ID NO: 806104 - RNA, 19 nt, Human
cacaugagggcugagggac

SEQ ID NO: 806105 - RNA, 22 nt, Human
aaaccagugauagacuagacac

SEQ ID NO: 806106 - RNA, 22 nt, Human
agucugaaggcaaucugcugac

SEQ ID NO: 806107 - RNA, 21 nt, Human
aggagggcacaaggccaggaa

SEQ ID NO: 806108 - RNA, 22 nt, Human
aguuucuugccgugcuuuccau

SEQ ID NO: 806109 - RNA, 22 nt, Human
ugucugaaucucgguuuccuca

SEQ ID NO: 806110 - RNA, 22 nt, Human
uugcaaaucucuuguguuuggu

SEQ ID NO: 806111 - RNA, 21 nt, Human
cauugagauaggagagauugu

SEQ ID NO: 806112 - RNA, 22 nt, Human
gaguuaaaagcccucucagcag

SEQ ID NO: 806113 - RNA, 22 nt, Human
cugcaaaugccgugagagcagg

SEQ ID NO: 806114 - RNA, 22 nt, Human
gaaaugcaggcuuggauucagc

SEQ ID NO: 806115 - RNA, 22 nt, Human
caaggcucugcuucuaucacau

SEQ ID NO: 806116 - RNA, 19 nt, Human
gccaggagggcucuggcug

SEQ ID NO: 806117 - RNA, 22 nt, Human
aacauuucauaacuugacuuuu

SEQ ID NO: 806118 - RNA, 22 nt, Human
uuuuucaagacaaccugcaugu

SEQ ID NO: 806119 - RNA, 22 nt, Human
uugggaaauuacucugcuagga

SEQ ID NO: 806120 - RNA, 22 nt, Human
agaucugguuggaguccugaca

SEQ ID NO: 806121 - RNA, 17 nt, Human
agcuuguuuuugaaagc

SEQ ID NO: 806122 - RNA, 22 nt, Human
uuuguguuuuagcuggugaggc

SEQ ID NO: 806123 - RNA, 22 nt, Human
uaggcccaguuccgccucccgg

SEQ ID NO: 806124 - RNA, 22 nt, Human
gguggccucgguggugcacagg

SEQ ID NO: 806125 - RNA, 22 nt, Human
acaagaauuauuucuaguuaac

SEQ ID NO: 806126 - RNA, 19 nt, Human
gcugucugaugcugagguc

SEQ ID NO: 806127 - RNA, 22 nt, Human
uagaaaugauugguugagcucu

SEQ ID NO: 806128 - RNA, 22 nt, Human
ucauggggugaauuaguaugcu

SEQ ID NO: 806129 - RNA, 22 nt, Human
ucuggagaacuugcaagaggau

SEQ ID NO: 806130 - RNA, 22 nt, Human
auuuagaaauuccaaaaguauu

SEQ ID NO: 806131 - RNA, 22 nt, Human
ggucugcuuuccuugccacugu

SEQ ID NO: 806132 - RNA, 22 nt, Human
cagcaaauacuacuaguuuuua

SEQ ID NO: 806133 - RNA, 23 nt, Human
ucacugcuacucagccugagauu

SEQ ID NO: 806134 - RNA, 23 nt, Human
gaaauguuucuugauuaauccua

SEQ ID NO: 806135 - RNA, 22 nt, Human
gagggccaggcagcaagaaggc

SEQ ID NO: 806136 - RNA, 22 nt, Human
gcuggcagacugggggcagaac

SEQ ID NO: 806137 - RNA, 22 nt, Human
aaagagcaagggcuuugaggcu

SEQ ID NO: 806138 - RNA, 22 nt, Human
cucugacauucugugacucuga

SEQ ID NO: 806139 - RNA, 22 nt, Human
aggggagcaacauagucacucu

SEQ ID NO: 806140 - RNA, 22 nt, Human
agguggagacccagagaaggcg

SEQ ID NO: 806141 - RNA, 22 nt, Human
ugcaggcagcugaaaggugccu

SEQ ID NO: 806142 - RNA, 22 nt, Human
cagaagcaaguagugauucuuu

SEQ ID NO: 806143 - RNA, 22 nt, Human
uaacuaggauuacaagcgugcg

SEQ ID NO: 806144 - RNA, 22 nt, Human
ccuuggcuuccuucccucuaga

SEQ ID NO: 806145 - RNA, 22 nt, Human
uucagugugugauaccugcugu

SEQ ID NO: 806146 - RNA, 22 nt, Human
aggcucuguuugcugugguacc

SEQ ID NO: 806147 - RNA, 22 nt, Human
gggaguggguuuggccuaggcc

SEQ ID NO: 806148 - RNA, 22 nt, Human
aggcagcaugggcccagagucc

SEQ ID NO: 806149 - RNA, 22 nt, Human
auuuuuccaauuaggauaaaga

SEQ ID NO: 806150 - RNA, 22 nt, Human
gcaaugcaaucagaugauuauu

SEQ ID NO: 806151 - RNA, 22 nt, Human
acaggacauggcuucugugacg

SEQ ID NO: 806152 - RNA, 22 nt, Human
gugauucauucgauuaguauuu

SEQ ID NO: 806153 - RNA, 22 nt, Human
ucaauucugcauacauuucacu

SEQ ID NO: 806154 - RNA, 22 nt, Human
cugugggagggaaggcgcggcc

SEQ ID NO: 806155 - RNA, 22 nt, Human
cugggcagugguggcaucuuug

SEQ ID NO: 806156 - RNA, 22 nt, Human
ugugucaauuuaugucauucau

SEQ ID NO: 806157 - RNA, 21 nt, Human
acaggcuuuagaaaaugacuc

SEQ ID NO: 806158 - RNA, 21 nt, Human
gccagcggccgcccuccagga

SEQ ID NO: 806159 - RNA, 22 nt, Human
cccaggagaugcacuccauugg

SEQ ID NO: 806160 - RNA, 22 nt, Human
gacaaauaggucaacaggaggg

SEQ ID NO: 806161 - RNA, 22 nt, Human
ggcucaggaccugggauugcca

SEQ ID NO: 806162 - RNA, 22 nt, Human
aaguguuuuggcuucuguacac

SEQ ID NO: 806163 - RNA, 22 nt, Human
cuucugaagagguuaucauaga

SEQ ID NO: 806164 - RNA, 22 nt, Human
ugggaugggaucucgcuguguc

SEQ ID NO: 806165 - RNA, 22 nt, Human
gagccacagacuguauuuggga

SEQ ID NO: 806166 - RNA, 20 nt, Human
acacagugacaggaaagaga

SEQ ID NO: 806167 - RNA, 22 nt, Human
acaauuguggcaauuuguaugu

SEQ ID NO: 806168 - RNA, 22 nt, Human
auggcagaccugggcuggagaa

SEQ ID NO: 806169 - RNA, 22 nt, Human
ucuauaaagggccagauaguag

SEQ ID NO: 806170 - RNA, 22 nt, Human
ugugaaaagggcuuuguacaaa

SEQ ID NO: 806171 - RNA, 22 nt, Human
gcagggcugggugggagacaga

SEQ ID NO: 806172 - RNA, 22 nt, Human
uucaagugaggcugucuuuaga

SEQ ID NO: 806173 - RNA, 19 nt, Human
cacauacagaaaagaguaa

SEQ ID NO: 806174 - RNA, 22 nt, Human
cagucauuccuaaccaagaaca

SEQ ID NO: 806175 - RNA, 22 nt, Human
ccaggcuggagugcaguagugu

SEQ ID NO: 806176 - RNA, 22 nt, Human
cuucacauuugcgaaggccaaa

SEQ ID NO: 806177 - RNA, 22 nt, Human
ugauaugugaagcuauuaguuc

SEQ ID NO: 806178 - RNA, 22 nt, Human
ggccaccaaaguccuguggcuu

SEQ ID NO: 806179 - RNA, 21 nt, Human
acuggcugccaugauccaggg

SEQ ID NO: 806180 - RNA, 22 nt, Human
ucuccuggccgggcuguccccu

SEQ ID NO: 806181 - RNA, 20 nt, Human
ugugggcccuuggcuggcaa

SEQ ID NO: 806182 - RNA, 22 nt, Human
caugacagaugcaaaggauugg

SEQ ID NO: 806183 - RNA, 22 nt, Human
cacacagugggaaaaccugaag

SEQ ID NO: 806184 - RNA, 18 nt, Human
uccugccugcgggcuccc

SEQ ID NO: 806185 - RNA, 22 nt, Human
acuucccacugcagugacugag

SEQ ID NO: 806186 - RNA, 22 nt, Human
uacaucuaucuagaugcucaga

SEQ ID NO: 806187 - RNA, 22 nt, Human
ugaguuaagcagguagcaagcu

SEQ ID NO: 806188 - RNA, 22 nt, Human
gcugggcugagcuagacuuggc

SEQ ID NO: 806189 - RNA, 22 nt, Human
caggcuccuuaucuuacaacuu

SEQ ID NO: 806190 - RNA, 22 nt, Human
aaauucacaagagcauugccug

SEQ ID NO: 806191 - RNA, 22 nt, Human
aagugggucagggacagaucuu

SEQ ID NO: 806192 - RNA, 22 nt, Human
aggcagcccacaggacacagga

SEQ ID NO: 806193 - RNA, 23 nt, Human
uaauucacauauacauugcuuca

SEQ ID NO: 806194 - RNA, 22 nt, Human
uaggacaguggagauaaccaga

SEQ ID NO: 806195 - RNA, 22 nt, Human
aguccagggcuuagucagcggg

SEQ ID NO: 806196 - RNA, 22 nt, Human
aguggcuggaauugcaggugcg

SEQ ID NO: 806197 - RNA, 22 nt, Human
auuucucacaaaguugcuuauc

SEQ ID NO: 806198 - RNA, 22 nt, Human
ucaaucuagagauuaaaauagg

SEQ ID NO: 806199 - RNA, 22 nt, Human
ccagcccuucccaacuggccag

SEQ ID NO: 806200 - RNA, 22 nt, Human
ugggugaggagaggcugucuaa

SEQ ID NO: 806201 - RNA, 21 nt, Human
ccuggcagaagccugauaugc

SEQ ID NO: 806202 - RNA, 22 nt, Human
augcucacuucagagaagauga

SEQ ID NO: 806203 - RNA, 22 nt, Human
ucuccuggguaaaaggguugau

SEQ ID NO: 806204 - RNA, 22 nt, Human
gccaggcacugcucuaagcccu

SEQ ID NO: 806205 - RNA, 23 nt, Human
auuuuuccuggaacagucaccca

SEQ ID NO: 806206 - RNA, 22 nt, Human
uaaaguuuauuugaacaucucu

SEQ ID NO: 806207 - RNA, 22 nt, Human
aacccaggucuuuggcuuccag

SEQ ID NO: 806208 - RNA, 22 nt, Human
augaaaagcauaaacgcugaag

SEQ ID NO: 806209 - RNA, 22 nt, Human
ucugcagcuugcacaggcaggc

SEQ ID NO: 806210 - RNA, 22 nt, Human
cuccugucagaagcauccugag

SEQ ID NO: 806211 - RNA, 22 nt, Human
ccagggcaacgcugucucagag

SEQ ID NO: 806212 - RNA, 22 nt, Human
uggcuggggccacaguuuuccu

SEQ ID NO: 806213 - RNA, 22 nt, Human
ugagaagauugggcagagugga

SEQ ID NO: 806214 - RNA, 22 nt, Human
gcugcaagcaugucauccucac

SEQ ID NO: 806215 - RNA, 22 nt, Human
ggcuagaguggaacuggagcgg

SEQ ID NO: 806216 - RNA, 22 nt, Human
gaggcagaaguugcagugagca

SEQ ID NO: 806217 - RNA, 22 nt, Human
ggccaugcaggucagagguggg

SEQ ID NO: 806218 - RNA, 22 nt, Human
aggcacuuuaggaucagguuga

SEQ ID NO: 806219 - RNA, 22 nt, Human
ccaggaggggucucugucuccc

SEQ ID NO: 806220 - RNA, 22 nt, Human
acaugacagugacuuuauaaga

SEQ ID NO: 806221 - RNA, 22 nt, Human
aggcuggugcuuccuagggcag

SEQ ID NO: 806222 - RNA, 22 nt, Human
uacagaggaggugguugggagu

SEQ ID NO: 806223 - RNA, 22 nt, Human
ccugaauacuggugcugaaagu

SEQ ID NO: 806224 - RNA, 22 nt, Human
gagccagcuauguagcaagagg

SEQ ID NO: 806225 - RNA, 21 nt, Human
ucccagggccaggugccauca

SEQ ID NO: 806226 - RNA, 22 nt, Human
cauuaauuguauuuuucaaagu

SEQ ID NO: 806227 - RNA, 22 nt, Human
uuuggcggggcaauucugaagc

SEQ ID NO: 806228 - RNA, 22 nt, Human
gccaggcuguggggaacuugaa

SEQ ID NO: 806229 - RNA, 22 nt, Human
ugaaugaugcaguauaaugaua

SEQ ID NO: 806230 - RNA, 22 nt, Human
cuagcuguaagagggauguggc

SEQ ID NO: 806231 - RNA, 18 nt, Human
gucuuuggaguggaggua

SEQ ID NO: 806232 - RNA, 22 nt, Human
auaacaauagugguagugcugg

SEQ ID NO: 806233 - RNA, 22 nt, Human
ugcaaaugggcaucuccaagug

SEQ ID NO: 806234 - RNA, 22 nt, Human
gacagacauuuccugauccaau

SEQ ID NO: 806235 - RNA, 22 nt, Human
caggcagagacgucaguguagg

SEQ ID NO: 806236 - RNA, 19 nt, Human
aggcuggagacaccaggcc

SEQ ID NO: 806237 - RNA, 22 nt, Human
ucacauuucugauuauaccaaa

SEQ ID NO: 806238 - RNA, 22 nt, Human
uugagaggcuguugacauucug

SEQ ID NO: 806239 - RNA, 22 nt, Human
aaagaccugugguagcucuaaa

SEQ ID NO: 806240 - RNA, 22 nt, Human
agcagagccagaauuggaccag

SEQ ID NO: 806241 - RNA, 22 nt, Human
gggugccacagagcuuccacuu

SEQ ID NO: 806242 - RNA, 22 nt, Human
aaguucugggguaaugagaauu

SEQ ID NO: 806243 - RNA, 22 nt, Human
cuuggcaggguggaggaugcag

SEQ ID NO: 806244 - RNA, 22 nt, Human
uggauuuaguucuucacaggcc

SEQ ID NO: 806245 - RNA, 22 nt, Human
ugcuggcuuuagugauuggggu

SEQ ID NO: 806246 - RNA, 21 nt, Human
gggguuggcaagagcagagac

SEQ ID NO: 806247 - RNA, 22 nt, Human
aggccaggguagggcccauugu

SEQ ID NO: 806248 - RNA, 17 nt, Human
ccacagccuggcacuug

SEQ ID NO: 806249 - RNA, 22 nt, Human
ucuggcugcugcgugagugcuu

SEQ ID NO: 806250 - RNA, 22 nt, Human
caucauuuguucacuugauucc

SEQ ID NO: 806251 - RNA, 22 nt, Human
aggaggagguaagaaaagcaua

SEQ ID NO: 806252 - RNA, 20 nt, Human
acaugaaaggaaacaggaaa

SEQ ID NO: 806253 - RNA, 23 nt, Human
gccugccugaccugugcaaaguc

SEQ ID NO: 806254 - RNA, 22 nt, Human
uggggaagacagcagacacugu

SEQ ID NO: 806255 - RNA, 22 nt, Human
ugucacagagcgugcaacagaa

SEQ ID NO: 806256 - RNA, 22 nt, Human
ucagaagguacagaagggaggu

SEQ ID NO: 806257 - RNA, 22 nt, Human
gagggagggccaggucccaacc

SEQ ID NO: 806258 - RNA, 22 nt, Human
agccacagcauguguguaugua

SEQ ID NO: 806259 - RNA, 20 nt, Human
acucuaccagggcagcagca

SEQ ID NO: 806260 - RNA, 21 nt, Human
ugcagaaaugguuuuucuaag

SEQ ID NO: 806261 - RNA, 22 nt, Human
cuuguuuugaaagcaguggcca

SEQ ID NO: 806262 - RNA, 22 nt, Human
aacacaguuucucuaugagagu

SEQ ID NO: 806263 - RNA, 22 nt, Human
aagaugugcaguucauggcagg

SEQ ID NO: 806264 - RNA, 20 nt, Human
aagcuggguaggagaggagc

SEQ ID NO: 806265 - RNA, 22 nt, Human
uacugaaacucuuguaaauauc

SEQ ID NO: 806266 - RNA, 17 nt, Human
cauaaaacaguucuauu

SEQ ID NO: 806267 - RNA, 22 nt, Human
ggcagcaacucggagagaagag

SEQ ID NO: 806268 - RNA, 22 nt, Human
cagccacagcugggugccugac

SEQ ID NO: 806269 - RNA, 22 nt, Human
ugcaggcuggggaggcagacuu

SEQ ID NO: 806270 - RNA, 22 nt, Human
uggcucuggauuaaucuaggaa

SEQ ID NO: 806271 - RNA, 22 nt, Human
ccaggagcagaguagguguuca

SEQ ID NO: 806272 - RNA, 22 nt, Human
ugugcuucuugcagcuccugua

SEQ ID NO: 806273 - RNA, 22 nt, Human
aaguuugucgaaauuaucagca

SEQ ID NO: 806274 - RNA, 22 nt, Human
gccaggcuccaggcccuccuga

SEQ ID NO: 806275 - RNA, 22 nt, Human
cugcugagcauuugcagggaca

SEQ ID NO: 806276 - RNA, 22 nt, Human
uguacacaaccuacagucugcu

SEQ ID NO: 806277 - RNA, 22 nt, Human
ucuccuggcucaccaggcugga

SEQ ID NO: 806278 - RNA, 22 nt, Human
uuggagucagaugacuguagga

SEQ ID NO: 806279 - RNA, 22 nt, Human
ugagggaggccuccaucugcca

SEQ ID NO: 806280 - RNA, 22 nt, Human
uuacagaagagaaagaauucag

SEQ ID NO: 806281 - RNA, 22 nt, Human
gcaggaagaugagcucagguaa

SEQ ID NO: 806282 - RNA, 22 nt, Human
cucaggcacuuuugucacagac

SEQ ID NO: 806283 - RNA, 22 nt, Human
cagggccugcaagagaccuggg

SEQ ID NO: 806284 - RNA, 22 nt, Human
caugaaaugauauuuggguggg

SEQ ID NO: 806285 - RNA, 22 nt, Human
ccucagggacgggaucacuugg

SEQ ID NO: 806286 - RNA, 18 nt, Human
aggcaggcuggagugacu

SEQ ID NO: 806287 - RNA, 20 nt, Human
cugaagagacuggaggggca

SEQ ID NO: 806288 - RNA, 22 nt, Human
aaucuggaauauuugcauugua

SEQ ID NO: 806289 - RNA, 22 nt, Human
caaagucauggggaugcagguc

SEQ ID NO: 806290 - RNA, 22 nt, Human
gcauguggccuucaggcuggaa

SEQ ID NO: 806291 - RNA, 22 nt, Human
cagcauccuuugcugguuuccc

SEQ ID NO: 806292 - RNA, 22 nt, Human
acaaugaauacuaagcaccagg

SEQ ID NO: 806293 - RNA, 22 nt, Human
gauaacauuuugaagugcuagu

SEQ ID NO: 806294 - RNA, 22 nt, Human
agcaggaaguagucuguaagca

SEQ ID NO: 806295 - RNA, 22 nt, Human
gagggagggacuagcauucucu

SEQ ID NO: 806296 - RNA, 22 nt, Human
uacauuuucuaggggaccaaga

SEQ ID NO: 806297 - RNA, 22 nt, Human
uccuggccucgcuguccaccuu

SEQ ID NO: 806298 - RNA, 22 nt, Human
uccuuaaauauuuacuguuaac

SEQ ID NO: 806299 - RNA, 22 nt, Human
gaaaugcaaauucucucucgcu

SEQ ID NO: 806300 - RNA, 21 nt, Human
ugccagcauguaggcuaguug

SEQ ID NO: 806301 - RNA, 22 nt, Human
uccugggguuuagagggaagug

SEQ ID NO: 806302 - RNA, 22 nt, Human
guuuacauguacucauuauacu

SEQ ID NO: 806303 - RNA, 21 nt, Human
acagagaaagagcagccuccu

SEQ ID NO: 806304 - RNA, 22 nt, Human
gguaggaguauuuugcagcagu

SEQ ID NO: 806305 - RNA, 22 nt, Human
gcacacagggauuuuugaaugg

SEQ ID NO: 806306 - RNA, 22 nt, Human
gccaggaguucagaugcauguu

SEQ ID NO: 806307 - RNA, 22 nt, Human
ugcaggcuggaggagggacuaa

SEQ ID NO: 806308 - RNA, 22 nt, Human
agggacuauuuacccaucucac

SEQ ID NO: 806309 - RNA, 22 nt, Human
agcuuguuagaaauguagacuc

SEQ ID NO: 806310 - RNA, 22 nt, Human
ugcuuaaaaugaugauuauuuu

SEQ ID NO: 806311 - RNA, 22 nt, Human
agagaccuuuugccuucuaguu

SEQ ID NO: 806312 - RNA, 22 nt, Human
aggcuggcugacuucugaagca

SEQ ID NO: 806313 - RNA, 22 nt, Human
agguccaguuuucugacaaggg

SEQ ID NO: 806314 - RNA, 22 nt, Human
uugguucaaaacauggaagggu

SEQ ID NO: 806315 - RNA, 22 nt, Human
ggcugggagcuggacaggccgg

SEQ ID NO: 806316 - RNA, 22 nt, Human
aaauagcuuuucauaauucuca

SEQ ID NO: 806317 - RNA, 22 nt, Human
uucugggcuguccagaggguga

SEQ ID NO: 806318 - RNA, 22 nt, Human
aagucagaaaucaucuagugua

SEQ ID NO: 806319 - RNA, 22 nt, Human
ucaggauggcacccaagcucuu

SEQ ID NO: 806320 - RNA, 22 nt, Human
aaugucugugccuuaaaacuuc

SEQ ID NO: 806321 - RNA, 22 nt, Human
gcagggcuguucaggagggugg

SEQ ID NO: 806322 - RNA, 20 nt, Human
gcuguguagcagugugcagu

SEQ ID NO: 806323 - RNA, 21 nt, Human
ggggccucuccacacagccgg

SEQ ID NO: 806324 - RNA, 22 nt, Human
caggaaaugggguuuaguuauu

SEQ ID NO: 806325 - RNA, 22 nt, Human
uugcagcuucuaacagcuucag

SEQ ID NO: 806326 - RNA, 19 nt, Human
cugcagcugcaccauccca

SEQ ID NO: 806327 - RNA, 22 nt, Human
uccacccccagacagcugguga

SEQ ID NO: 806328 - RNA, 22 nt, Human
ucuccucccaggcucuuccagg

SEQ ID NO: 806329 - RNA, 22 nt, Human
cagaugagaguggccaggguuc

SEQ ID NO: 806330 - RNA, 22 nt, Human
ugucucuucagcccauggcuuc

SEQ ID NO: 806331 - RNA, 22 nt, Human
ugcuagggauguagcagugaag

SEQ ID NO: 806332 - RNA, 21 nt, Human
ggcugcugggagagcugcgug

SEQ ID NO: 806333 - RNA, 22 nt, Human
agauacauuguucuaagcauug

SEQ ID NO: 806334 - RNA, 22 nt, Human
agugaggcuaauaggcaauggu

SEQ ID NO: 806335 - RNA, 22 nt, Human
gagggcugcaaugagacagaga

SEQ ID NO: 806336 - RNA, 22 nt, Human
cuacaaauauaaaacacagaua

SEQ ID NO: 806337 - RNA, 19 nt, Human
ugaagcaggcagagaagau

SEQ ID NO: 806338 - RNA, 22 nt, Human
agcaagcuguucuuggagagua

SEQ ID NO: 806339 - RNA, 21 nt, Human
gcaguuuauguaauaugcacu

SEQ ID NO: 806340 - RNA, 22 nt, Human
cuaggcugagcugggcugagcu

SEQ ID NO: 806341 - RNA, 22 nt, Human
auacagaauucacuacaguuuc

SEQ ID NO: 806342 - RNA, 22 nt, Human
auguggggacucugagagaauu

SEQ ID NO: 806343 - RNA, 22 nt, Human
agacaggacacaagcugcauaa

SEQ ID NO: 806344 - RNA, 22 nt, Human
acagccuggacuggcucucugc

SEQ ID NO: 806345 - RNA, 22 nt, Human
gagccacaguggauugauucca

SEQ ID NO: 806346 - RNA, 22 nt, Human
ucaggacauuugucagcaggag

SEQ ID NO: 806347 - RNA, 22 nt, Human
cagagggcugcccugaguucgu

SEQ ID NO: 806348 - RNA, 22 nt, Human
uaucaauacauguuaucagugu

SEQ ID NO: 806349 - RNA, 22 nt, Human
gagguggcuccaggagcaaugc

SEQ ID NO: 806350 - RNA, 22 nt, Human
agugcuggagggaggcagguuc

SEQ ID NO: 806351 - RNA, 22 nt, Human
aggucaaggccaaaagaguggu

SEQ ID NO: 806352 - RNA, 22 nt, Human
gaucauuugcaggaaacauuaa

SEQ ID NO: 806353 - RNA, 22 nt, Human
cauuuggaaagagacuagagaa

SEQ ID NO: 806354 - RNA, 22 nt, Human
ucaggcaggaucccagggaagg

SEQ ID NO: 806355 - RNA, 22 nt, Human
ucuuugauacagauguaagcug

SEQ ID NO: 806356 - RNA, 22 nt, Human
gagugacggcucaucucuggaa

SEQ ID NO: 806357 - RNA, 22 nt, Human
ggcaggugguaaggauuucaua

SEQ ID NO: 806358 - RNA, 22 nt, Human
gcaaacauccacugcccuugua

SEQ ID NO: 806359 - RNA, 22 nt, Human
agcagggcuucugugccugugc

SEQ ID NO: 806360 - RNA, 22 nt, Human
uggagcagaggcugagguuggg

SEQ ID NO: 806361 - RNA, 19 nt, Human
ccaggccuccugggagguc

SEQ ID NO: 806362 - RNA, 22 nt, Human
uaguuaaaauaauggagauguu

SEQ ID NO: 806363 - RNA, 22 nt, Human
gagcugcccugagcuuugcaug

SEQ ID NO: 806364 - RNA, 22 nt, Human
uugagggaacaugagaaucauc

SEQ ID NO: 806365 - RNA, 22 nt, Human
accaggagggacccugguggcc

SEQ ID NO: 806366 - RNA, 22 nt, Human
auuaaggugucaauguauuugg

SEQ ID NO: 806367 - RNA, 21 nt, Human
aucccagcacccaggagugca

SEQ ID NO: 806368 - RNA, 22 nt, Human
uccacagggaugccugcggcuu

SEQ ID NO: 806369 - RNA, 22 nt, Human
ucagugguggaagcagcaaacc

SEQ ID NO: 806370 - RNA, 22 nt, Human
cuguuauucaagacaaaggcag

SEQ ID NO: 806371 - RNA, 22 nt, Human
guacaaguguauuuggcuugau

SEQ ID NO: 806372 - RNA, 22 nt, Human
ccuccuggcccugggccuggaa

SEQ ID NO: 806373 - RNA, 22 nt, Human
gggcccuggauuuaagcaugga

SEQ ID NO: 806374 - RNA, 22 nt, Human
aggcuggcugaaaaacacccuu

SEQ ID NO: 806375 - RNA, 20 nt, Human
gggaggccccagaguccagg

SEQ ID NO: 806376 - RNA, 22 nt, Human
cugaagcugggcacuuccuuuu

SEQ ID NO: 806377 - RNA, 22 nt, Human
ggcccagcugugcuuccagccc

SEQ ID NO: 806378 - RNA, 22 nt, Human
uguaaguacauugaaacaucuu

SEQ ID NO: 806379 - RNA, 22 nt, Human
cucugcugagccagagucccca

SEQ ID NO: 806380 - RNA, 22 nt, Human
gccaggggugcccacccaagga

SEQ ID NO: 806381 - RNA, 22 nt, Human
ucacaaaggaugaugaauucug

SEQ ID NO: 806382 - RNA, 22 nt, Human
uugaacauuaacuucagucuau

SEQ ID NO: 806383 - RNA, 22 nt, Human
augauucagcccaauuuuucua

SEQ ID NO: 806384 - RNA, 22 nt, Human
ucagaauugucuggggaauguu

SEQ ID NO: 806385 - RNA, 22 nt, Human
cagcaggcucugaguggcugcc

SEQ ID NO: 806386 - RNA, 22 nt, Human
ggcagcuuucucacccaugacc

SEQ ID NO: 806387 - RNA, 22 nt, Human
agcagggugugguggcccugga

SEQ ID NO: 806388 - RNA, 22 nt, Human
gcuagcuggguuucacugugga

SEQ ID NO: 806389 - RNA, 22 nt, Human
caggcacacagcacauggccug

SEQ ID NO: 806390 - RNA, 22 nt, Human
aacugcaauuacuuuugcacua

SEQ ID NO: 806391 - RNA, 22 nt, Human
gagcuggcacagaaggaucuua

SEQ ID NO: 806392 - RNA, 22 nt, Human
ccugccaggcuuugggcuucug

SEQ ID NO: 806393 - RNA, 22 nt, Human
auguauuugaaauuugagacau

SEQ ID NO: 806394 - RNA, 22 nt, Human
uccucaguuauaaauaggaaac

SEQ ID NO: 806395 - RNA, 22 nt, Human
cuucuauucacuggucacaguu

SEQ ID NO: 806396 - RNA, 22 nt, Human
ucacaugucaaaaacuacauaa

SEQ ID NO: 806397 - RNA, 22 nt, Human
agagagguuggcuaggauguuu

SEQ ID NO: 806398 - RNA, 22 nt, Human
uuguuauaaagacuaaauaugu

SEQ ID NO: 806399 - RNA, 22 nt, Human
aguuguaauaacaauaccaaaa

SEQ ID NO: 806400 - RNA, 19 nt, Human
aaggcuggagaaggccucu

SEQ ID NO: 806401 - RNA, 22 nt, Human
acaaauuauagaaaauugagcu

SEQ ID NO: 806402 - RNA, 21 nt, Human
uaauauagguucacaacuagu

SEQ ID NO: 806403 - RNA, 22 nt, Human
uccaauauuucucauauaugga

SEQ ID NO: 806404 - RNA, 22 nt, Human
ccugggcucaagugaugguccc

SEQ ID NO: 806405 - RNA, 22 nt, Human
gcagggucugaggccacagagg

SEQ ID NO: 806406 - RNA, 22 nt, Human
acagaaaaguuuacuuuugcuc

SEQ ID NO: 806407 - RNA, 22 nt, Human
ucccagccuuucuuucuccagc

SEQ ID NO: 806408 - RNA, 22 nt, Human
agcccuggguuagggugggagc

SEQ ID NO: 806409 - RNA, 22 nt, Human
agugcaggcucgcuugugaggc

SEQ ID NO: 806410 - RNA, 22 nt, Human
cuuugacauccuuguuccucag

SEQ ID NO: 806411 - RNA, 22 nt, Human
uuugcauuuguuuagaaccuga

SEQ ID NO: 806412 - RNA, 22 nt, Human
cuguccucaccuuggcaggggg

SEQ ID NO: 806413 - RNA, 22 nt, Human
cacuggcaaagccuguuccuua

SEQ ID NO: 806414 - RNA, 22 nt, Human
ugggaaggacgugucaguggca

SEQ ID NO: 806415 - RNA, 22 nt, Human
acauuuaaccaaacuguuuaau

SEQ ID NO: 806416 - RNA, 22 nt, Human
ugcccagccccuaucccuggga

SEQ ID NO: 806417 - RNA, 22 nt, Human
agaguggcuugcucagcuagca

SEQ ID NO: 806418 - RNA, 22 nt, Human
ggaaaugguggaggaaggcuua

SEQ ID NO: 806419 - RNA, 22 nt, Human
uaaggaagagcuugguaauagg

SEQ ID NO: 806420 - RNA, 19 nt, Human
ugucugcugaugacucuau

SEQ ID NO: 806421 - RNA, 22 nt, Human
acacauauauacauauuugugc

SEQ ID NO: 806422 - RNA, 22 nt, Human
cccagccucuggguucugccgg

SEQ ID NO: 806423 - RNA, 18 nt, Human
uccagggcuuccuccucu

SEQ ID NO: 806424 - RNA, 22 nt, Human
gcuggaguaggaccaugcuuga

SEQ ID NO: 806425 - RNA, 22 nt, Human
guuucucaacaugcuuucuaac

SEQ ID NO: 806426 - RNA, 22 nt, Human
uuacacaguauccaagguucuu

SEQ ID NO: 806427 - RNA, 22 nt, Human
acccgcuuccggagcugcagug

SEQ ID NO: 806428 - RNA, 22 nt, Human
ugaaaugagcauuuauucuuua

SEQ ID NO: 806429 - RNA, 22 nt, Human
agagcugggacuuggacucaau

SEQ ID NO: 806430 - RNA, 22 nt, Human
cugccuggccacaacccagggu

SEQ ID NO: 806431 - RNA, 22 nt, Human
uacaagagugagauuaucaugu

SEQ ID NO: 806432 - RNA, 22 nt, Human
auuugccuugugauuuguaagu

SEQ ID NO: 806433 - RNA, 22 nt, Human
ccaggccuguguuguguggagg

SEQ ID NO: 806434 - RNA, 22 nt, Human
ugcuuccuugaucauucccaaa

SEQ ID NO: 806435 - RNA, 22 nt, Human
uuucacauuuguuuuaagaagu

SEQ ID NO: 806436 - RNA, 22 nt, Human
ugucccagggaaggcccagcac

SEQ ID NO: 806437 - RNA, 22 nt, Human
aauaugcagcuuaucuucuagg

SEQ ID NO: 806438 - RNA, 23 nt, Human
ugagcugggccugcaggggucuc

SEQ ID NO: 806439 - RNA, 22 nt, Human
cugcacacauauggcuucucuc

SEQ ID NO: 806440 - RNA, 22 nt, Human
cccagcaguacccaagcccuug

SEQ ID NO: 806441 - RNA, 18 nt, Human
ucaggcuuugagagaauc

SEQ ID NO: 806442 - RNA, 22 nt, Human
aaaguaucaagggaagcauuuu

SEQ ID NO: 806443 - RNA, 22 nt, Human
uggagaagauuggucaccauuc

SEQ ID NO: 806444 - RNA, 22 nt, Human
uucagagaaacugagguuuaga

SEQ ID NO: 806445 - RNA, 22 nt, Human
uucaaagaguugggugucuggg

SEQ ID NO: 806446 - RNA, 22 nt, Human
uuaauuaguagaggcauuuagu

SEQ ID NO: 806447 - RNA, 22 nt, Human
ugggcagcaaagacugugugcu

SEQ ID NO: 806448 - RNA, 22 nt, Human
gcuggaggaggaagugugaggg

SEQ ID NO: 806449 - RNA, 22 nt, Human
acuccugggugcugaccagcgu

SEQ ID NO: 806450 - RNA, 22 nt, Human
acagcagcuaaccccugggcca

SEQ ID NO: 806451 - RNA, 22 nt, Human
cugucaaauucauaacacuuau

SEQ ID NO: 806452 - RNA, 22 nt, Human
gaugucuuuuuccaggcucuuu

SEQ ID NO: 806453 - RNA, 22 nt, Human
aaggccagcuuguagggcuggu

SEQ ID NO: 806454 - RNA, 22 nt, Human
gcaaucaaugauuuauauuugu

SEQ ID NO: 806455 - RNA, 22 nt, Human
aaugauuuggcaaaggaaucca

SEQ ID NO: 806456 - RNA, 22 nt, Human
acagcaggagccuucauaugcu

SEQ ID NO: 806457 - RNA, 22 nt, Human
cuauguaugcgauuagaauuuu

SEQ ID NO: 806458 - RNA, 22 nt, Human
ugcuuucuccugucugaaagau

SEQ ID NO: 806459 - RNA, 22 nt, Human
uugcuucuggaacuuucuguuc

SEQ ID NO: 806460 - RNA, 22 nt, Human
agcugguaaguggcagagauuc

SEQ ID NO: 806461 - RNA, 22 nt, Human
gcacccagggacuuggcuggcc

SEQ ID NO: 806462 - RNA, 22 nt, Human
agaugacaugggagcaagcacu

SEQ ID NO: 806463 - RNA, 22 nt, Human
ggaagcagccugaagccaaggg

SEQ ID NO: 806464 - RNA, 22 nt, Human
caagcaacgacuuucaagcugu

SEQ ID NO: 806465 - RNA, 18 nt, Human
ugugcaauauuaaccacc

SEQ ID NO: 806466 - RNA, 19 nt, Human
auucacaucccugggaagg

SEQ ID NO: 806467 - RNA, 22 nt, Human
augugucuuggaguuuuaaugu

SEQ ID NO: 806468 - RNA, 22 nt, Human
auauauauugcccaggcugguu

SEQ ID NO: 806469 - RNA, 22 nt, Human
cucuuuggcuuugacucccauu

SEQ ID NO: 806470 - RNA, 20 nt, Human
uuaagaaaagcacauccugc

SEQ ID NO: 806471 - RNA, 22 nt, Human
gcugcccagggcugaguguccu

SEQ ID NO: 806472 - RNA, 22 nt, Human
gcugccuguguggccacucacu

SEQ ID NO: 806473 - RNA, 22 nt, Human
guuuuacacaccuaugaaagac

SEQ ID NO: 806474 - RNA, 22 nt, Human
gauaacauacuugcauguguau

SEQ ID NO: 806475 - RNA, 22 nt, Human
uagggcuguggucaguccucua

SEQ ID NO: 806476 - RNA, 22 nt, Human
cuacaaagcucuucuacaggca

SEQ ID NO: 806477 - RNA, 22 nt, Human
caugaaaucacaagcugaggac

SEQ ID NO: 806478 - RNA, 22 nt, Human
uccuguccacagcccugaccuc

SEQ ID NO: 806479 - RNA, 22 nt, Human
aacacauauuuauauaugcaca

SEQ ID NO: 806480 - RNA, 22 nt, Human
acuggcuguggccacggcugcu

SEQ ID NO: 806481 - RNA, 22 nt, Human
aggcuguguuuccccuggagcu

SEQ ID NO: 806482 - RNA, 22 nt, Human
agggccuggugaccuggguccu

SEQ ID NO: 806483 - RNA, 22 nt, Human
uugaucaaaucagcuacugagg

SEQ ID NO: 806484 - RNA, 22 nt, Human
caggauagaaaggccauggagu

SEQ ID NO: 806485 - RNA, 22 nt, Human
gcccacagucuaucaguuugcg

SEQ ID NO: 806486 - RNA, 22 nt, Human
ugcaggugguuuggacacugcu

SEQ ID NO: 806487 - RNA, 22 nt, Human
acccucaacaaauucacucuau

SEQ ID NO: 806488 - RNA, 22 nt, Human
agauauguuacugcaucauggg

SEQ ID NO: 806489 - RNA, 22 nt, Human
uuaacaaaguaacgggaaaaga

SEQ ID NO: 806490 - RNA, 22 nt, Human
uaguuuagcacuaagaaaaaca

SEQ ID NO: 806491 - RNA, 22 nt, Human
ugagaggcuagaucagcucugu

SEQ ID NO: 806492 - RNA, 22 nt, Human
augcaaauugccauaaaguggg

SEQ ID NO: 806493 - RNA, 22 nt, Human
uugcagcucucugaagguugca

SEQ ID NO: 806494 - RNA, 22 nt, Human
aacaucuaguuccuauauaaua

SEQ ID NO: 806495 - RNA, 22 nt, Human
aggcagcuaagauggauaauga

SEQ ID NO: 806496 - RNA, 22 nt, Human
cuucuagggcaucaugacaaau

SEQ ID NO: 806497 - RNA, 22 nt, Human
aagaggagggcagauucaaggc

SEQ ID NO: 806498 - RNA, 22 nt, Human
aaucagaaaauucaguggaauu

SEQ ID NO: 806499 - RNA, 22 nt, Human
ucuuccagagccuccaucccua

SEQ ID NO: 806500 - RNA, 22 nt, Human
ucugcuguguugaaugauuggu

SEQ ID NO: 806501 - RNA, 22 nt, Human
cuggggcugcgguggaggagcc

SEQ ID NO: 806502 - RNA, 22 nt, Human
ugucuucuguauucaagucuau

SEQ ID NO: 806503 - RNA, 22 nt, Human
aguccauaguuuacauuacagc

SEQ ID NO: 806504 - RNA, 17 nt, Human
ugggugguagggagagg

SEQ ID NO: 806505 - RNA, 22 nt, Human
cugccugaguacaagucccaga

SEQ ID NO: 806506 - RNA, 22 nt, Human
uagauuugccugggaaagcuca

SEQ ID NO: 806507 - RNA, 22 nt, Human
ugaccccacugugcucagaggu

SEQ ID NO: 806508 - RNA, 22 nt, Human
cuggcuggccggagcgaggcgg

SEQ ID NO: 806509 - RNA, 22 nt, Human
uucaagauggcugcaaauacuu

SEQ ID NO: 806510 - RNA, 22 nt, Human
gauuuuaucuuugugugcagua

SEQ ID NO: 806511 - RNA, 22 nt, Human
ccaguucuuucugugugcaaca

SEQ ID NO: 806512 - RNA, 22 nt, Human
augugguugaagaauuacaucu

SEQ ID NO: 806513 - RNA, 22 nt, Human
uauggaaacuaauucauuuuuc

SEQ ID NO: 806514 - RNA, 22 nt, Human
cuuguggcccauggcuuccugc

SEQ ID NO: 806515 - RNA, 22 nt, Human
cuuggcagagggcugggcucag

SEQ ID NO: 806516 - RNA, 22 nt, Human
cugcagcugggccagggccacc

SEQ ID NO: 806517 - RNA, 22 nt, Human
gauucaggccugcaucucagca

SEQ ID NO: 806518 - RNA, 22 nt, Human
cugggcugcagcgggagcgacg

SEQ ID NO: 806519 - RNA, 22 nt, Human
cugcccugcagcuccacggacu

SEQ ID NO: 806520 - RNA, 23 nt, Human
agcuauaaaaucugugacagcag

SEQ ID NO: 806521 - RNA, 19 nt, Human
ccucucccaugcuuaccuc

SEQ ID NO: 806522 - RNA, 22 nt, Human
gcaaaugaguuguaacauaaaa

SEQ ID NO: 806523 - RNA, 22 nt, Human
cggggugggaauagaccugucu

SEQ ID NO: 806524 - RNA, 22 nt, Human
uaggcagaauugugggcucuaa

SEQ ID NO: 806525 - RNA, 22 nt, Human
cagagggugugaaggggaugaa

SEQ ID NO: 806526 - RNA, 22 nt, Human
ugcaagagcccaaacuauauac

SEQ ID NO: 806527 - RNA, 22 nt, Human
agaaaucaauaucuauauguug

SEQ ID NO: 806528 - RNA, 22 nt, Human
aauaauacaugagauuaauguu

SEQ ID NO: 806529 - RNA, 22 nt, Human
uaggccagauuacuagaguagg

SEQ ID NO: 806530 - RNA, 23 nt, Human
agccuggcaccugcagaucggag

SEQ ID NO: 806531 - RNA, 21 nt, Human
uaugagauauacuuauucuuu

SEQ ID NO: 806532 - RNA, 22 nt, Human
gucuaaacuuuacagagucaag

SEQ ID NO: 806533 - RNA, 22 nt, Human
caggaagcugugaaggagacgg

SEQ ID NO: 806534 - RNA, 22 nt, Human
ugggccagcucccugccccugg

SEQ ID NO: 806535 - RNA, 22 nt, Human
uacaaaaguaauuacgguuuuu

SEQ ID NO: 806536 - RNA, 22 nt, Human
auuguaaaguacuguguacaau

SEQ ID NO: 806537 - RNA, 22 nt, Human
aucugugagaaaggcuugugcu

SEQ ID NO: 806538 - RNA, 22 nt, Human
agcugugauuauccacuggaau

SEQ ID NO: 806539 - RNA, 22 nt, Human
auccuuaauuuccugggccuca

SEQ ID NO: 806540 - RNA, 23 nt, Human
ggcuagaguggaggggaacugca

SEQ ID NO: 806541 - RNA, 22 nt, Human
accuuaaaggccgaaguaaaga

SEQ ID NO: 806542 - RNA, 22 nt, Human
agggggcaucagguccuggcuc

SEQ ID NO: 806543 - RNA, 23 nt, Human
aguaacaugcaaauaacagucug

SEQ ID NO: 806544 - RNA, 22 nt, Human
acaucucaaauuccaggcucca

SEQ ID NO: 806545 - RNA, 22 nt, Human
aaaacauugaauugcacacuau

SEQ ID NO: 806546 - RNA, 22 nt, Human
cugugggagaaguugcuggagu

SEQ ID NO: 806547 - RNA, 22 nt, Human
agcccagcagaaaguccagccu

SEQ ID NO: 806548 - RNA, 22 nt, Human
caaagcagagccagagcuuguc

SEQ ID NO: 806549 - RNA, 22 nt, Human
gcaugcugagcccacgccuggg

SEQ ID NO: 806550 - RNA, 22 nt, Human
uccaaagggaagcgcuuucugu

SEQ ID NO: 806551 - RNA, 22 nt, Human
acagcauuuaaagaaaaugaac

SEQ ID NO: 806552 - RNA, 22 nt, Human
ccagcuggggaaguggggcaua

SEQ ID NO: 806553 - RNA, 22 nt, Human
uacaaaaaauugauacugacga

SEQ ID NO: 806554 - RNA, 22 nt, Human
auuucucacugagcagauaaaa

SEQ ID NO: 806555 - RNA, 22 nt, Human
gcugggccccuugaaaggcguc

SEQ ID NO: 806556 - RNA, 22 nt, Human
uaagagcagagguugaauaaau

SEQ ID NO: 806557 - RNA, 19 nt, Human
uaaggcagcagugacaggc

SEQ ID NO: 806558 - RNA, 22 nt, Human
cuucuucauaggcaguccuguu

SEQ ID NO: 806559 - RNA, 22 nt, Human
gugcaaauguaauugugauuuu

SEQ ID NO: 806560 - RNA, 22 nt, Human
ggcacuuuucuccccggucaug

SEQ ID NO: 806561 - RNA, 22 nt, Human
uggcagauggccuggaaccaaa

SEQ ID NO: 806562 - RNA, 20 nt, Human
caguccugucccugcugccc

SEQ ID NO: 806563 - RNA, 22 nt, Human
aagacucaaggaacaacacagu

SEQ ID NO: 806564 - RNA, 22 nt, Human
ucuugggaccauuuacacauac

SEQ ID NO: 806565 - RNA, 22 nt, Human
ugaggaggcccagguuggggcu

SEQ ID NO: 806566 - RNA, 22 nt, Human
auuuuguggguucugcugaugu

SEQ ID NO: 806567 - RNA, 22 nt, Human
accaguuuauagcgaucuguca

SEQ ID NO: 806568 - RNA, 22 nt, Human
aauguugaggauaucagaaaau

SEQ ID NO: 806569 - RNA, 22 nt, Human
ggagauuuauagcacacuucag

SEQ ID NO: 806570 - RNA, 22 nt, Human
cccugaggcacaggccacguau

SEQ ID NO: 806571 - RNA, 22 nt, Human
uuucauuaaagucaaaucuggu

SEQ ID NO: 806572 - RNA, 20 nt, Human
agaaauauugaguucagagg

SEQ ID NO: 806573 - RNA, 17 nt, Human
agcagcuggcacaggag

SEQ ID NO: 806574 - RNA, 22 nt, Human
gcagcaggcacggucucgacau

SEQ ID NO: 806575 - RNA, 22 nt, Human
ccacugccucuccagggccauc

SEQ ID NO: 806576 - RNA, 22 nt, Human
aaguggacuaauacaaggacua

SEQ ID NO: 806577 - RNA, 22 nt, Human
ggaagaggcucucauugagggc

SEQ ID NO: 806578 - RNA, 22 nt, Human
gcugggaaugauuuuggagagg

SEQ ID NO: 806579 - RNA, 22 nt, Human
caggcugcugacaggcuuggag

SEQ ID NO: 806580 - RNA, 22 nt, Human
uaauuuaugaugcaaagaaaag

SEQ ID NO: 806581 - RNA, 22 nt, Human
agcaggcugccuuccaaagccu

SEQ ID NO: 806582 - RNA, 22 nt, Human
agauaaacccaacuuaaugaag

SEQ ID NO: 806583 - RNA, 22 nt, Human
gccugcuggaucaagcuuaugc

SEQ ID NO: 806584 - RNA, 22 nt, Human
guaaagaaguuuuugaaugcau

SEQ ID NO: 806585 - RNA, 22 nt, Human
ccacagagacucugcaggacug

SEQ ID NO: 806586 - RNA, 22 nt, Human
cagaggcauuacugaaaaggug

SEQ ID NO: 806587 - RNA, 22 nt, Human
aaccccaggcuggaggagucuc

SEQ ID NO: 806588 - RNA, 22 nt, Human
aaagacauugaagaaggacuua

SEQ ID NO: 806589 - RNA, 22 nt, Human
gggguccuggaggccagcugga

SEQ ID NO: 806590 - RNA, 22 nt, Human
gggacaucuuucuagucagggu

SEQ ID NO: 806591 - RNA, 22 nt, Human
ucuuccucccuacagagcucag

SEQ ID NO: 806592 - RNA, 22 nt, Human
ugaguuuagugugagacuuauc

SEQ ID NO: 806593 - RNA, 23 nt, Human
aggcuuccuaucuuagagcuggg

SEQ ID NO: 806594 - RNA, 19 nt, Human
gucaauaaaaguuaggggu

SEQ ID NO: 806595 - RNA, 22 nt, Human
aaagaggcagguguuacuggaa

SEQ ID NO: 806596 - RNA, 22 nt, Human
uguaucuuagugugaaaauauu

SEQ ID NO: 806597 - RNA, 23 nt, Human
ccuggcagcaaacgaggagguua

SEQ ID NO: 806598 - RNA, 22 nt, Human
agugggagaaugaauaagggcc

SEQ ID NO: 806599 - RNA, 19 nt, Human
guuuugcaggcagagggga

SEQ ID NO: 806600 - RNA, 22 nt, Human
uggauggccccacuggauccau

SEQ ID NO: 806601 - RNA, 22 nt, Human
gcucagggaacuuuuugcaggc

SEQ ID NO: 806602 - RNA, 22 nt, Human
gguggggccagggcuccaaccu

SEQ ID NO: 806603 - RNA, 22 nt, Human
aauauuuccaaggccugucagg

SEQ ID NO: 806604 - RNA, 22 nt, Human
augaaauguaaguagagaguuu

SEQ ID NO: 806605 - RNA, 22 nt, Human
ucucuagguugauauaaauuau

SEQ ID NO: 806606 - RNA, 22 nt, Human
uggaacgucguaauguugguua

SEQ ID NO: 806607 - RNA, 22 nt, Human
aaaaaauuccauucugugccuu

SEQ ID NO: 806608 - RNA, 22 nt, Human
cauuuguacuguucaaugucau

SEQ ID NO: 806609 - RNA, 22 nt, Human
ucuuugcagaacgaugaagaug

SEQ ID NO: 806610 - RNA, 22 nt, Human
gaggagggagaauuaggcuuaa

SEQ ID NO: 806611 - RNA, 22 nt, Human
ugcugccucagcuuccugggcu

SEQ ID NO: 806612 - RNA, 22 nt, Human
auugaaaauaaggccagaaaca

SEQ ID NO: 806613 - RNA, 20 nt, Human
caugcaacagauuauuuccc

SEQ ID NO: 806614 - RNA, 22 nt, Human
uugcaaauucgucacuguuaaa

SEQ ID NO: 806615 - RNA, 22 nt, Human
ucuugggaucaccuccuggcuu

SEQ ID NO: 806616 - RNA, 22 nt, Human
gccucugcaugcucagcaccca

SEQ ID NO: 806617 - RNA, 22 nt, Human
ucucccacgguacaggauaaac

SEQ ID NO: 806618 - RNA, 22 nt, Human
cauuuacagcagacugaugaaa

SEQ ID NO: 806619 - RNA, 22 nt, Human
agcccaggagguggagguugca

SEQ ID NO: 806620 - RNA, 22 nt, Human
gccuggcucugagggagcuccu

SEQ ID NO: 806621 - RNA, 23 nt, Human
uuuaacauuugaacauguggcca

SEQ ID NO: 806622 - RNA, 22 nt, Human
uuccuggagaguuuucccaaag

SEQ ID NO: 806623 - RNA, 22 nt, Human
cagggcuguaaauuagugcuga

SEQ ID NO: 806624 - RNA, 22 nt, Human
ccuuuggcugcauagggaaggg

SEQ ID NO: 806625 - RNA, 22 nt, Human
uuggcaucaguguaggaccugu

SEQ ID NO: 806626 - RNA, 22 nt, Human
gaggagcuggcugucgggaggc

SEQ ID NO: 806627 - RNA, 22 nt, Human
ucauaagcuagcugcaccauau

SEQ ID NO: 806628 - RNA, 22 nt, Human
ucccccaaaugaaugaggaaua

SEQ ID NO: 806629 - RNA, 22 nt, Human
gggaagugagcuggaaucaagg

SEQ ID NO: 806630 - RNA, 21 nt, Human
gcagaggcacggcaccaaggg

SEQ ID NO: 806631 - RNA, 22 nt, Human
ugggcccaucauugcugugggc

SEQ ID NO: 806632 - RNA, 22 nt, Human
auaaacaagacuggccaacuuu

SEQ ID NO: 806633 - RNA, 22 nt, Human
gaauauuaguaucaguuauacc

SEQ ID NO: 806634 - RNA, 22 nt, Human
caaguaauucugcaagaaacca

SEQ ID NO: 806635 - RNA, 22 nt, Human
ggcucugggucuguggggagcg

SEQ ID NO: 806636 - RNA, 22 nt, Human
aaacuacuaugggaauguacuu

SEQ ID NO: 806637 - RNA, 22 nt, Human
uuggcccagacucggggacuga

SEQ ID NO: 806638 - RNA, 22 nt, Human
gagcuuugagauucuuauggua

SEQ ID NO: 806639 - RNA, 22 nt, Human
ucucaaauuuguuagauaaaau

SEQ ID NO: 806640 - RNA, 19 nt, Human
ugccaggaauacuccagaa

SEQ ID NO: 806641 - RNA, 22 nt, Human
uuuuugcuaauccccagccacu

SEQ ID NO: 806642 - RNA, 22 nt, Human
cagcacuggggccacuggaguu

SEQ ID NO: 806643 - RNA, 22 nt, Human
ucagagaacuccacaccuuagg

SEQ ID NO: 806644 - RNA, 16 nt, Human
gcugggagggagaggu

SEQ ID NO: 806645 - RNA, 22 nt, Human
aucacaucacagguugagcuag

SEQ ID NO: 806646 - RNA, 22 nt, Human
ugcagaagugagucaugaggaa

SEQ ID NO: 806647 - RNA, 23 nt, Human
uucaggaaaugaauacagacaca

SEQ ID NO: 806648 - RNA, 22 nt, Human
ggaggaggggugacugaaugcu

SEQ ID NO: 806649 - RNA, 22 nt, Human
caggcaugcuucugucugggca

SEQ ID NO: 806650 - RNA, 22 nt, Human
caggggaguuuuaugcaacaga

SEQ ID NO: 806651 - RNA, 22 nt, Human
uauuauaauuuagggcuuggau

SEQ ID NO: 806652 - RNA, 22 nt, Human
uccugguguaaugguaagcaug

SEQ ID NO: 806653 - RNA, 22 nt, Human
aauaauaagauacuaagggagu

SEQ ID NO: 806654 - RNA, 19 nt, Human
ccaccccuuugcugggccc

SEQ ID NO: 806655 - RNA, 22 nt, Human
caaaguggagagccugugguug

SEQ ID NO: 806656 - RNA, 22 nt, Human
uuaauguaugggguugagauga

SEQ ID NO: 806657 - RNA, 22 nt, Human
uucuuuccuugccucagugaag

SEQ ID NO: 806658 - RNA, 20 nt, Human
accuggcuugggggaggagu

SEQ ID NO: 806659 - RNA, 22 nt, Human
auuuuacauaaggaagguuuaa

SEQ ID NO: 806660 - RNA, 22 nt, Human
agugguucuugaucuguagagu

SEQ ID NO: 806661 - RNA, 22 nt, Human
cugcuccugugggccaguggcc

SEQ ID NO: 806662 - RNA, 22 nt, Human
uagcuuuagugaaaaauaucag

SEQ ID NO: 806663 - RNA, 22 nt, Human
ggugucaaugcucccaccuugg

SEQ ID NO: 806664 - RNA, 22 nt, Human
ggccuugggaggagggucagaa

SEQ ID NO: 806665 - RNA, 22 nt, Human
uccagccacuugcacaguuaaa

SEQ ID NO: 806666 - RNA, 22 nt, Human
cuuucccuuagccccauucuau

SEQ ID NO: 806667 - RNA, 22 nt, Human
gcacccagaauaaggacaggac

SEQ ID NO: 806668 - RNA, 22 nt, Human
gcagaaguaccucguucuaguu

SEQ ID NO: 806669 - RNA, 18 nt, Human
uaggaaauagggcuguga

SEQ ID NO: 806670 - RNA, 20 nt, Human
uuucaagucagcaauucuca

SEQ ID NO: 806671 - RNA, 22 nt, Human
uacaaguuccauuuugaaagug

SEQ ID NO: 806672 - RNA, 22 nt, Human
accagccuccuagcugcuccug

SEQ ID NO: 806673 - RNA, 22 nt, Human
cagaggcagugggguugcuccu

SEQ ID NO: 806674 - RNA, 22 nt, Human
agauguggccggcuagggagag

SEQ ID NO: 806675 - RNA, 19 nt, Human
uccugaaaacuucuggaau

SEQ ID NO: 806676 - RNA, 22 nt, Human
augucugcuuuccuuuuaauca

SEQ ID NO: 806677 - RNA, 22 nt, Human
uuccucagagggcgcuggggaa

SEQ ID NO: 806678 - RNA, 22 nt, Human
ucucccacagccgugcuucaag

SEQ ID NO: 806679 - RNA, 22 nt, Human
auaaucaaaguccuaugacauc

SEQ ID NO: 806680 - RNA, 22 nt, Human
augcagcuagauuuuccagugu

SEQ ID NO: 806681 - RNA, 22 nt, Human
acagugauugggguaucugcag

SEQ ID NO: 806682 - RNA, 22 nt, Human
acgugcaggaucugguuggcga

SEQ ID NO: 806683 - RNA, 22 nt, Human
acaauguucuacauauacauaa

SEQ ID NO: 806684 - RNA, 21 nt, Human
acauuacagggugaugugucu

SEQ ID NO: 806685 - RNA, 23 nt, Human
uggaaacauucugaauguccauc

SEQ ID NO: 806686 - RNA, 22 nt, Human
agucuuuaaguaaugauaggca

SEQ ID NO: 806687 - RNA, 22 nt, Human
auuauaaauauuuucuaggggu

SEQ ID NO: 806688 - RNA, 22 nt, Human
gcuggcaucacuggcuucggug

SEQ ID NO: 806689 - RNA, 22 nt, Human
ucaucaucugcaagcucauguc

SEQ ID NO: 806690 - RNA, 22 nt, Human
cagcacauaagccgaagacugu

SEQ ID NO: 806691 - RNA, 22 nt, Human
uagcuuuuaguacuuaauggcu

SEQ ID NO: 806692 - RNA, 22 nt, Human
aagcccugcagucucugccaca

SEQ ID NO: 806693 - RNA, 22 nt, Human
guuuacaugcaugcaagaauga

SEQ ID NO: 806694 - RNA, 18 nt, Human
agcagagcccaugcauuc

SEQ ID NO: 806695 - RNA, 22 nt, Human
cagaugugauucuucccucagc

SEQ ID NO: 806696 - RNA, 22 nt, Human
uuuccucugaugcugacuugga

SEQ ID NO: 806697 - RNA, 22 nt, Human
ucuaaacacgucucuuugaaua

SEQ ID NO: 806698 - RNA, 22 nt, Human
ucuuuuccuucccuacagaucu

SEQ ID NO: 806699 - RNA, 22 nt, Human
gcagaagguuguuugggaaagg

SEQ ID NO: 806700 - RNA, 21 nt, Human
uagcaauuauagaugucuaaa

SEQ ID NO: 806701 - RNA, 22 nt, Human
ccaguguauuauuugagaaauu

SEQ ID NO: 806702 - RNA, 22 nt, Human
uugcaaaugugguuagggcuuu

SEQ ID NO: 806703 - RNA, 21 nt, Human
ccuucucuugcuucagcuuca

SEQ ID NO: 806704 - RNA, 23 nt, Human
uacuugguuuugauagaaaucca

SEQ ID NO: 806705 - RNA, 22 nt, Human
ucagcaggcacaccaaaaacug

SEQ ID NO: 806706 - RNA, 16 nt, Human
acaaauacaacugcug

SEQ ID NO: 806707 - RNA, 23 nt, Human
uuacuuuugcaccaaccuaauau

SEQ ID NO: 806708 - RNA, 22 nt, Human
uuaaggcugauaagucagauau

SEQ ID NO: 806709 - RNA, 22 nt, Human
acaauguuuuuguucaaagagu

SEQ ID NO: 806710 - RNA, 22 nt, Human
agcagggcacuggaaggcacug

SEQ ID NO: 806711 - RNA, 22 nt, Human
acagucugccucucagagcagc

SEQ ID NO: 806712 - RNA, 22 nt, Human
cugcugggcuccucaugugacu

SEQ ID NO: 806713 - RNA, 22 nt, Human
agcucaagcuacacacagaguc

SEQ ID NO: 806714 - RNA, 22 nt, Human
gugcaaaugagauggauucaag

SEQ ID NO: 806715 - RNA, 22 nt, Human
agggcagagaucugagugggca

SEQ ID NO: 806716 - RNA, 22 nt, Human
accagacacugugaagacaggc

SEQ ID NO: 806717 - RNA, 22 nt, Human
gaaggcuugguuuuuucaacac

SEQ ID NO: 806718 - RNA, 22 nt, Human
gcugccucccccauggcuggaa

SEQ ID NO: 806719 - RNA, 22 nt, Human
agcacaggugaaacagucaggu

SEQ ID NO: 806720 - RNA, 22 nt, Human
aaucuucacucauucagaguug

SEQ ID NO: 806721 - RNA, 22 nt, Human
uagaaauggguuacauuuagag

SEQ ID NO: 806722 - RNA, 22 nt, Human
gcccuggaaucucuccauggga

SEQ ID NO: 806723 - RNA, 22 nt, Human
agaaaucacuuagaggaaguga

SEQ ID NO: 806724 - RNA, 22 nt, Human
uaaaaccauaaggcuggaagga

SEQ ID NO: 806725 - RNA, 22 nt, Human
auuuccuucggacaguuugggu

SEQ ID NO: 806726 - RNA, 22 nt, Human
ugcagcugacccacuccagucc

SEQ ID NO: 806727 - RNA, 22 nt, Human
uggcagugggaauggacaaaca

SEQ ID NO: 806728 - RNA, 22 nt, Human
uuaaagcauguugcuuaacagg

SEQ ID NO: 806729 - RNA, 22 nt, Human
agcagaugugucucugcacugu

SEQ ID NO: 806730 - RNA, 22 nt, Human
cacaugcauuggcaaaagugua

SEQ ID NO: 806731 - RNA, 22 nt, Human
accuccuggcuuaucauggaca

SEQ ID NO: 806732 - RNA, 22 nt, Human
aaauguguguauguacauauau

SEQ ID NO: 806733 - RNA, 22 nt, Human
agacagcauggagcugauaaca

SEQ ID NO: 806734 - RNA, 22 nt, Human
cuugaaugguaugagaguaauu

SEQ ID NO: 806735 - RNA, 23 nt, Human
aggcaggcaguucagcuguuguu

SEQ ID NO: 806736 - RNA, 22 nt, Human
aagacuauaccaucuuaguuac

SEQ ID NO: 806737 - RNA, 22 nt, Human
ugggagcccaagggagcugccg

SEQ ID NO: 806738 - RNA, 22 nt, Human
gcugcagccaaauucauuguca

SEQ ID NO: 806739 - RNA, 22 nt, Human
guuucaaagucagaaaaggagg

SEQ ID NO: 806740 - RNA, 22 nt, Human
cauuuauucucagauccuuguc

SEQ ID NO: 806741 - RNA, 22 nt, Human
uauauuaaaugaccaguuuuaa

SEQ ID NO: 806742 - RNA, 21 nt, Human
uacauugacuacaaauaaagc

SEQ ID NO: 806743 - RNA, 22 nt, Human
aaucuuaaagaauauucuacca

SEQ ID NO: 806744 - RNA, 22 nt, Human
guccaggccaugguggacacag

SEQ ID NO: 806745 - RNA, 22 nt, Human
uaagagcagaacagcaacauau

SEQ ID NO: 806746 - RNA, 22 nt, Human
acugccucuuggugcugagaga

SEQ ID NO: 806747 - RNA, 22 nt, Human
gcuggcuguguuccuucugcca

SEQ ID NO: 806748 - RNA, 22 nt, Human
uucagagccacuucaagucuaa

SEQ ID NO: 806749 - RNA, 22 nt, Human
aggcaggcagcugucaccacuc

SEQ ID NO: 806750 - RNA, 22 nt, Human
uccccaccuaagauacccaucu

SEQ ID NO: 806751 - RNA, 22 nt, Human
uggcagggugccaguugcgagu

SEQ ID NO: 806752 - RNA, 22 nt, Human
uucacauugugcagauuauggu

SEQ ID NO: 806753 - RNA, 22 nt, Human
guuuauuauucaacuucauguu

SEQ ID NO: 806754 - RNA, 22 nt, Human
agcuggcuucacaggcagugug

SEQ ID NO: 806755 - RNA, 20 nt, Human
gggugugggcccggccaggc

SEQ ID NO: 806756 - RNA, 22 nt, Human
aauaacuuuuaaaagacccugg

SEQ ID NO: 806757 - RNA, 22 nt, Human
agaggcacuguucuuagcgacu

SEQ ID NO: 806758 - RNA, 22 nt, Human
agggaagcccuggcugagaccc

SEQ ID NO: 806759 - RNA, 22 nt, Human
cacagaacaccaaagaaccuuc

SEQ ID NO: 806760 - RNA, 22 nt, Human
caccccuguggagcaugguggc

SEQ ID NO: 806761 - RNA, 22 nt, Human
aaaggaaaauaaguaguuccau

SEQ ID NO: 806762 - RNA, 22 nt, Human
gggccagguggaccccagccuc

SEQ ID NO: 806763 - RNA, 19 nt, Human
caucagagggcauaggaug

SEQ ID NO: 806764 - RNA, 22 nt, Human
uucuguaagcuaccaaguuugu

SEQ ID NO: 806765 - RNA, 22 nt, Human
aauucaacagucaguuaucuca

SEQ ID NO: 806766 - RNA, 22 nt, Human
ugugucaaguggaauuucaggg

SEQ ID NO: 806767 - RNA, 19 nt, Human
agcagagcccugaagaucc

SEQ ID NO: 806768 - RNA, 22 nt, Human
cucauuuaccuuugcaaucaag

SEQ ID NO: 806769 - RNA, 22 nt, Human
gcagccaggggcugugaccugu

SEQ ID NO: 806770 - RNA, 22 nt, Human
gcugucugagaacaugguggaa

SEQ ID NO: 806771 - RNA, 22 nt, Human
acauuguaguuguucugcagca

SEQ ID NO: 806772 - RNA, 22 nt, Human
ugcagguggcuccagggacugc

SEQ ID NO: 806773 - RNA, 22 nt, Human
ugguggagggaacuauuuccag

SEQ ID NO: 806774 - RNA, 22 nt, Human
cuguggcaggaagggacuagca

SEQ ID NO: 806775 - RNA, 22 nt, Human
uggcagcugccauguccacgug

SEQ ID NO: 806776 - RNA, 22 nt, Human
gagguucugggggucugccugg

SEQ ID NO: 806777 - RNA, 22 nt, Human
ugggcaucucugcugccggccu

SEQ ID NO: 806778 - RNA, 22 nt, Human
cuucuccagccacgcccacucc

SEQ ID NO: 806779 - RNA, 22 nt, Human
aguauaaagugguuuucagcac

SEQ ID NO: 806780 - RNA, 22 nt, Human
cuuguccuuuacuugagacuca

SEQ ID NO: 806781 - RNA, 18 nt, Human
ggcaggcucucuggguca

SEQ ID NO: 806782 - RNA, 19 nt, Human
ggccagccaccucgccugg

SEQ ID NO: 806783 - RNA, 22 nt, Human
cagcugcucugguggucucucc

SEQ ID NO: 806784 - RNA, 22 nt, Human
ccagcagaagcucccgcugggu

SEQ ID NO: 806785 - RNA, 22 nt, Human
cuacugaugcuauacuucucag

SEQ ID NO: 806786 - RNA, 22 nt, Human
uucauguauuuaucauguaaau

SEQ ID NO: 806787 - RNA, 22 nt, Human
aaagcuuucuagcuauguucua

SEQ ID NO: 806788 - RNA, 22 nt, Human
ugucugaaacuugguccuaugc

SEQ ID NO: 806789 - RNA, 22 nt, Human
ccagaggaugcuggucagccuc

SEQ ID NO: 806790 - RNA, 18 nt, Human
agucuuuaaagauguuac

SEQ ID NO: 806791 - RNA, 22 nt, Human
ccagggcaggagaaagacucac

SEQ ID NO: 806792 - RNA, 22 nt, Human
uuugaguagugagacuaggcag

SEQ ID NO: 806793 - RNA, 22 nt, Human
uguuucacuaagcagaaauaua

SEQ ID NO: 806794 - RNA, 22 nt, Human
aggcuggcggugacugcucuga

SEQ ID NO: 806795 - RNA, 22 nt, Human
uuuuucacacauguggcuugau

SEQ ID NO: 806796 - RNA, 22 nt, Human
augcaauguuacagaauguacu

SEQ ID NO: 806797 - RNA, 22 nt, Human
agcugcuuagagucucuucuua

SEQ ID NO: 806798 - RNA, 22 nt, Human
aauguuauuguccuuuccaaaa

SEQ ID NO: 806799 - RNA, 22 nt, Human
uaguuuuacaucagccauuguu

SEQ ID NO: 806800 - RNA, 22 nt, Human
gcuuccaaaucuguucaaaaug

SEQ ID NO: 806801 - RNA, 22 nt, Human
caaggagaaaacggcuucugaa

SEQ ID NO: 806802 - RNA, 22 nt, Human
aacuaacagucauuaaaagaac

SEQ ID NO: 806803 - RNA, 22 nt, Human
aggcacugacagauucuguguc

SEQ ID NO: 806804 - RNA, 22 nt, Human
cagaaucugagucgugauugua

SEQ ID NO: 806805 - RNA, 22 nt, Human
uucuuugggcucagagagggag

SEQ ID NO: 806806 - RNA, 22 nt, Human
ucaaagagcuauucaguugugg

SEQ ID NO: 806807 - RNA, 22 nt, Human
guccagccacucaccuuccagc

SEQ ID NO: 806808 - RNA, 22 nt, Human
uaaaaaguagugagaauggcgc

SEQ ID NO: 806809 - RNA, 22 nt, Human
cacauauaccucuucuugaguu

SEQ ID NO: 806810 - RNA, 22 nt, Human
aggaaucccgcaccagcugcug

SEQ ID NO: 806811 - RNA, 22 nt, Human
acauuguugccuagccaugagu

SEQ ID NO: 806812 - RNA, 22 nt, Human
uuccuaauggcaaaacauguuu

SEQ ID NO: 806813 - RNA, 22 nt, Human
agccugccaggcgcugccugga

SEQ ID NO: 806814 - RNA, 22 nt, Human
auacagggacauccaguuuuuc

SEQ ID NO: 806815 - RNA, 19 nt, Human
cgugaacaugacugcaugg

SEQ ID NO: 806816 - RNA, 22 nt, Human
ucagcaggugccucagauucuu

SEQ ID NO: 806817 - RNA, 22 nt, Human
ucagcagggcugugguguggcu

SEQ ID NO: 806818 - RNA, 22 nt, Human
aagucauuaucucuucuaaucu

SEQ ID NO: 806819 - RNA, 22 nt, Human
aaaaaugcuuggacuuaauaaa

SEQ ID NO: 806820 - RNA, 22 nt, Human
ggcaaggccuugcccagcauuc

SEQ ID NO: 806821 - RNA, 22 nt, Human
ucacacuaagacaaaauaauuu

SEQ ID NO: 806822 - RNA, 21 nt, Human
ucuggaagaaaaaaguauuau

SEQ ID NO: 806823 - RNA, 22 nt, Human
uaccaaguguauuaugcuuugu

SEQ ID NO: 806824 - RNA, 22 nt, Human
ucagcuguaucagaaauacaau

SEQ ID NO: 806825 - RNA, 21 nt, Human
aguuuuuacucuuaacugugg

SEQ ID NO: 806826 - RNA, 22 nt, Human
uucuccuuuguaauucucaucc

SEQ ID NO: 806827 - RNA, 22 nt, Human
uuuaugcagauuuguacaguga

SEQ ID NO: 806828 - RNA, 22 nt, Human
ggcucagauuccgaguggcccu

SEQ ID NO: 806829 - RNA, 22 nt, Human
ggcuguggcauuaggugaggcc

SEQ ID NO: 806830 - RNA, 22 nt, Human
uaagucaucacauugcagagau

SEQ ID NO: 806831 - RNA, 22 nt, Human
uccgaggccaaagcugugaaua

SEQ ID NO: 806832 - RNA, 22 nt, Human
uuuguagagaauguuaagcacu

SEQ ID NO: 806833 - RNA, 22 nt, Human
gauaauaucugguuuauucacc

SEQ ID NO: 806834 - RNA, 22 nt, Human
auccaugacccucucaacaacc

SEQ ID NO: 806835 - RNA, 22 nt, Human
gcaggagccacuucagggaugc

SEQ ID NO: 806836 - RNA, 22 nt, Human
ugucauauagauauuagacagg

SEQ ID NO: 806837 - RNA, 22 nt, Human
cuucuagaguaaggaacaaaug

SEQ ID NO: 806838 - RNA, 22 nt, Human
gugacaggcauggggucaugca

SEQ ID NO: 806839 - RNA, 22 nt, Human
aucaaaguuucccagaaguugu

SEQ ID NO: 806840 - RNA, 22 nt, Human
uuuggacauguugagucugaua

SEQ ID NO: 806841 - RNA, 22 nt, Human
augcccccaucucuguuggcuc

SEQ ID NO: 806842 - RNA, 22 nt, Human
uuaaugaccuagagcaguaauu

SEQ ID NO: 806843 - RNA, 22 nt, Human
ccaggagccacucaggcccaca

SEQ ID NO: 806844 - RNA, 18 nt, Human
cacagugacuucugauac

SEQ ID NO: 806845 - RNA, 22 nt, Human
uguguuaauuuauugccucaga

SEQ ID NO: 806846 - RNA, 22 nt, Human
ugggguugaagaaaggaucuag

SEQ ID NO: 806847 - RNA, 22 nt, Human
cuucccugagcuuucucaggcu

SEQ ID NO: 806848 - RNA, 22 nt, Human
gcagggcaguaagagcuagagu

SEQ ID NO: 806849 - RNA, 17 nt, Human
cccagggaccacugcuu

SEQ ID NO: 806850 - RNA, 22 nt, Human
aguccauagaggcugcuuucau

SEQ ID NO: 806851 - RNA, 22 nt, Human
ugcaaaugcccauuuauuuucu

SEQ ID NO: 806852 - RNA, 22 nt, Human
uucauacaaugggauauuauga

SEQ ID NO: 806853 - RNA, 22 nt, Human
caaguccuuuucuuggcucagg

SEQ ID NO: 806854 - RNA, 22 nt, Human
aaaauugugaagguuucugaaa

SEQ ID NO: 806855 - RNA, 22 nt, Human
cucuggcuggcauugcuggacu

SEQ ID NO: 806856 - RNA, 22 nt, Human
cuggggggcuacugacagagga

SEQ ID NO: 806857 - RNA, 22 nt, Human
agcaaauggguuuauauuugac

SEQ ID NO: 806858 - RNA, 19 nt, Human
acacauuugcacaauccac

SEQ ID NO: 806859 - RNA, 22 nt, Human
caccagcagaagacugagggug

SEQ ID NO: 806860 - RNA, 22 nt, Human
ugcuucccugcucugcacaccu

SEQ ID NO: 806861 - RNA, 22 nt, Human
gaaacagucaacuuucuuuccc

SEQ ID NO: 806862 - RNA, 22 nt, Human
ucagaauucagagggagugggg

SEQ ID NO: 806863 - RNA, 22 nt, Human
uguaagaacaacugucaaaugu

SEQ ID NO: 806864 - RNA, 22 nt, Human
agcccuggagcaaaggugucuu

SEQ ID NO: 806865 - RNA, 22 nt, Human
aauaaugucuuuggcuugacca

SEQ ID NO: 806866 - RNA, 22 nt, Human
ucaugcaaaagacuugaacuuu

SEQ ID NO: 806867 - RNA, 22 nt, Human
uggcaggggaggugcuugcuua

SEQ ID NO: 806868 - RNA, 19 nt, Human
uuuucccacccuuuagaau

SEQ ID NO: 806869 - RNA, 22 nt, Human
gcagauggagacgagguuccgc

SEQ ID NO: 806870 - RNA, 22 nt, Human
aacaagugauauauaauggaag

SEQ ID NO: 806871 - RNA, 22 nt, Human
ugucaacacaccuaucucaauu

SEQ ID NO: 806872 - RNA, 22 nt, Human
aauaauguugacgauagucuua

SEQ ID NO: 806873 - RNA, 22 nt, Human
uugcagcuuagugauguuaucu

SEQ ID NO: 806874 - RNA, 22 nt, Human
uggcccugccacucacugcuga

SEQ ID NO: 806875 - RNA, 22 nt, Human
ucaggccugcccugaaagcaca

SEQ ID NO: 806876 - RNA, 22 nt, Human
ggugccaggcuguagucagggu

SEQ ID NO: 806877 - RNA, 22 nt, Human
gucaauaaguuuguaacuggau

SEQ ID NO: 806878 - RNA, 22 nt, Human
acuucccaggugguguggaguu

SEQ ID NO: 806879 - RNA, 22 nt, Human
auugagaagaaaaucuaauaua

SEQ ID NO: 806880 - RNA, 19 nt, Human
gcagguggauguggucagc

SEQ ID NO: 806881 - RNA, 22 nt, Human
auacacauuacuuucugucuga

SEQ ID NO: 806882 - RNA, 22 nt, Human
uggcccugagggcucggagcca

SEQ ID NO: 806883 - RNA, 22 nt, Human
aaagagaaaaagaucccggcuc

SEQ ID NO: 806884 - RNA, 19 nt, Human
caguuuguccagaggggac

SEQ ID NO: 806885 - RNA, 22 nt, Human
aguccugugcaaaugcaucuga

SEQ ID NO: 806886 - RNA, 22 nt, Human
cuguuaaaugagaaagcagacu

SEQ ID NO: 806887 - RNA, 22 nt, Human
uucuucagucccacuagccaca

SEQ ID NO: 806888 - RNA, 22 nt, Human
gccagguggagguugcagugag

SEQ ID NO: 806889 - RNA, 22 nt, Human
uauugcuaugagcauuguucuu

SEQ ID NO: 806890 - RNA, 22 nt, Human
caccagggcucugagcucugaa

SEQ ID NO: 806891 - RNA, 22 nt, Human
aagcugaauuuucuaaaagaau

SEQ ID NO: 806892 - RNA, 23 nt, Human
cacauauagcagccacuaagguc

SEQ ID NO: 806893 - RNA, 22 nt, Human
aaucauugagacaaauuagcuu

SEQ ID NO: 806894 - RNA, 22 nt, Human
aaaggccaccaacaugaagcau

SEQ ID NO: 806895 - RNA, 22 nt, Human
gccccugggagcagagccacca

SEQ ID NO: 806896 - RNA, 22 nt, Human
uugcagcucugauccagggacc

SEQ ID NO: 806897 - RNA, 22 nt, Human
uggagauguaaagcaaggcuua

SEQ ID NO: 806898 - RNA, 22 nt, Human
aauuaugguauguucaacaacu

SEQ ID NO: 806899 - RNA, 22 nt, Human
cccugcaggcucagacuggagu

SEQ ID NO: 806900 - RNA, 22 nt, Human
uuucacauuagauaugucauuu

SEQ ID NO: 806901 - RNA, 22 nt, Human
ggcaggcugggagucaucagag

SEQ ID NO: 806902 - RNA, 22 nt, Human
ugcagagguuuccaggcaaguu

SEQ ID NO: 806903 - RNA, 22 nt, Human
auuguucaauguaauaauuuug

SEQ ID NO: 806904 - RNA, 23 nt, Human
cuuugccacccagagccugacag

SEQ ID NO: 806905 - RNA, 22 nt, Human
cugacagcagcaaauggagaua

SEQ ID NO: 806906 - RNA, 22 nt, Human
ucugggcugggagcguguggac

SEQ ID NO: 806907 - RNA, 22 nt, Human
ugaggcugacaaaagaugaggu

SEQ ID NO: 806908 - RNA, 17 nt, Human
uucaagauauugaaaug

SEQ ID NO: 806909 - RNA, 22 nt, Human
cauuuguauagugcuuagacca

SEQ ID NO: 806910 - RNA, 22 nt, Human
ucacaucugugugauugucauu

SEQ ID NO: 806911 - RNA, 22 nt, Human
ucucuaagauaggaauacaguu

SEQ ID NO: 806912 - RNA, 22 nt, Human
aggaagagguagcugucaaggg

SEQ ID NO: 806913 - RNA, 22 nt, Human
aacugcaaaaaugguagucuua

SEQ ID NO: 806914 - RNA, 22 nt, Human
cagcccugcucuuagugucucc

SEQ ID NO: 806915 - RNA, 18 nt, Human
aagcaggguccauugugc

SEQ ID NO: 806916 - RNA, 22 nt, Human
ugggugaccccagaagaggauc

SEQ ID NO: 806917 - RNA, 22 nt, Human
aaauucaguuuuaauaaucacu

SEQ ID NO: 806918 - RNA, 22 nt, Human
cacaggaggaggccagagcgua

SEQ ID NO: 806919 - RNA, 22 nt, Human
caagaggcuaaacugggcuauu

SEQ ID NO: 806920 - RNA, 20 nt, Human
uucauuuguugagcaccuuc

SEQ ID NO: 806921 - RNA, 22 nt, Human
cucucccagucaggcucaggau

SEQ ID NO: 806922 - RNA, 22 nt, Human
uuauuuccugacacagcugauu

SEQ ID NO: 806923 - RNA, 22 nt, Human
ccugcugucucugggcaggcag

SEQ ID NO: 806924 - RNA, 22 nt, Human
auagaauagcauagaaaauuga

SEQ ID NO: 806925 - RNA, 19 nt, Human
acuguucuaacuugcagcu

SEQ ID NO: 806926 - RNA, 19 nt, Human
uccaggcuccauuggcaga

SEQ ID NO: 806927 - RNA, 22 nt, Human
gaggcuguguuucagugaggcc

SEQ ID NO: 806928 - RNA, 22 nt, Human
gacugaggugaccuaggacuac

SEQ ID NO: 806929 - RNA, 22 nt, Human
cuccagagguccccgcggcacu

SEQ ID NO: 806930 - RNA, 22 nt, Human
gccuggcugaggccucugcuaa

SEQ ID NO: 806931 - RNA, 23 nt, Human
auaauaauuauggcagcaaagug

SEQ ID NO: 806932 - RNA, 22 nt, Human
ugaaauagucuaaaaaaccaga

SEQ ID NO: 806933 - RNA, 22 nt, Human
uucaacaauuaaguaucagccu

SEQ ID NO: 806934 - RNA, 22 nt, Human
cuguuuauaaauagaggggagu

SEQ ID NO: 806935 - RNA, 22 nt, Human
uaucacaggugugauuuacauu

SEQ ID NO: 806936 - RNA, 18 nt, Human
gcaaggcucaggccaggc

SEQ ID NO: 806937 - RNA, 21 nt, Human
ucugugcugccgucaacaucc

SEQ ID NO: 806938 - RNA, 22 nt, Human
uaugagauuuggauucagugaa

SEQ ID NO: 806939 - RNA, 22 nt, Human
aguuuauuuuugauaagucuug

SEQ ID NO: 806940 - RNA, 22 nt, Human
uuugaaauaugaggcauuauga

SEQ ID NO: 806941 - RNA, 22 nt, Human
ucccucucuagccuguucagua

SEQ ID NO: 806942 - RNA, 22 nt, Human
accacaggacccaugagucagu

SEQ ID NO: 806943 - RNA, 22 nt, Human
gcagggcagggcaagaacuggg

SEQ ID NO: 806944 - RNA, 22 nt, Human
uugcagcugcaguaaauguuca

SEQ ID NO: 806945 - RNA, 22 nt, Human
ggccaagaucccauuauacaaa

SEQ ID NO: 806946 - RNA, 22 nt, Human
acauguauacaauguguaauga

SEQ ID NO: 806947 - RNA, 22 nt, Human
gggcuucaggagggucagccca

SEQ ID NO: 806948 - RNA, 22 nt, Human
caggcugggcuccggagauaaa

SEQ ID NO: 806949 - RNA, 22 nt, Human
cagaaacuucuggugucaaaua

SEQ ID NO: 806950 - RNA, 22 nt, Human
cucucaguccugcgcgccucug

SEQ ID NO: 806951 - RNA, 22 nt, Human
uucaaacaguugcacaacuuau

SEQ ID NO: 806952 - RNA, 22 nt, Human
uggcccagggaguucauggugu

SEQ ID NO: 806953 - RNA, 22 nt, Human
gauuucuucauucauuagaugg

SEQ ID NO: 806954 - RNA, 22 nt, Human
cuauuuggauguuagccucagu

SEQ ID NO: 806955 - RNA, 22 nt, Human
ugggaguggggcauagaaggua

SEQ ID NO: 806956 - RNA, 22 nt, Human
gcagaugggagccccaggggag

SEQ ID NO: 806957 - RNA, 23 nt, Human
agaggccaacuucuugccccucc

SEQ ID NO: 806958 - RNA, 22 nt, Human
ccaccagcuuugccacccugcu

SEQ ID NO: 806959 - RNA, 22 nt, Human
uggggaaagauaguuuucucua

SEQ ID NO: 806960 - RNA, 22 nt, Human
aaauagcugaaaguuccuagau

SEQ ID NO: 806961 - RNA, 22 nt, Human
uuucagaggaaaucucauugag

SEQ ID NO: 806962 - RNA, 22 nt, Human
gaaggcuggcucagcuuuccag

SEQ ID NO: 806963 - RNA, 22 nt, Human
aggcagugguguuugcuggugg

SEQ ID NO: 806964 - RNA, 22 nt, Human
gauucaaaaauaagcuccuauu

SEQ ID NO: 806965 - RNA, 22 nt, Human
gguccugucugacaucacugcu

SEQ ID NO: 806966 - RNA, 22 nt, Human
ugguaucaaacaauuaauuaga

SEQ ID NO: 806967 - RNA, 21 nt, Human
aacacauccagaguauuugac

SEQ ID NO: 806968 - RNA, 22 nt, Human
uuagaauuucugcucacuuuga

SEQ ID NO: 806969 - RNA, 22 nt, Human
aagcacagggacucaggaccgg

SEQ ID NO: 806970 - RNA, 22 nt, Human
aagggaaaucauauggugcagu

SEQ ID NO: 806971 - RNA, 17 nt, Human
guggaggugcucuggua

SEQ ID NO: 806972 - RNA, 22 nt, Human
caaggcaggucugaggagguug

SEQ ID NO: 806973 - RNA, 23 nt, Human
aacugcaagguugcugggaagua

SEQ ID NO: 806974 - RNA, 22 nt, Human
uggcacaggagcacugcccugg

SEQ ID NO: 806975 - RNA, 22 nt, Human
cccccaccguguuccugcucgg

SEQ ID NO: 806976 - RNA, 22 nt, Human
agugacagucucagagaucagg

SEQ ID NO: 806977 - RNA, 22 nt, Human
ucaacagaagugauagcuauua

SEQ ID NO: 806978 - RNA, 22 nt, Human
caggcacacauccgugagagau

SEQ ID NO: 806979 - RNA, 22 nt, Human
cagaugcuaaguuaucagcagg

SEQ ID NO: 806980 - RNA, 22 nt, Human
acccuuuguccaauagaaauga

SEQ ID NO: 806981 - RNA, 22 nt, Human
gcaaggagacuguagggccaag

SEQ ID NO: 806982 - RNA, 22 nt, Human
ugagaacauuccucuuccuggc

SEQ ID NO: 806983 - RNA, 22 nt, Human
cuccugaggggacaggacucau

SEQ ID NO: 806984 - RNA, 22 nt, Human
uacaacacugguucgacaugug

SEQ ID NO: 806985 - RNA, 22 nt, Human
ugcaagaaugacccaucuaccc

SEQ ID NO: 806986 - RNA, 22 nt, Human
uucuccugcgcaggcccaggga

SEQ ID NO: 806987 - RNA, 22 nt, Human
gacaguaagagugucuggguuc

SEQ ID NO: 806988 - RNA, 22 nt, Human
auucauuugcuauuguguaugg

SEQ ID NO: 806989 - RNA, 22 nt, Human
uuguauuucuccacuuucuguu

SEQ ID NO: 806990 - RNA, 22 nt, Human
accccaggcccagggaagaggc

SEQ ID NO: 806991 - RNA, 22 nt, Human
ccuccccugcucagaacucugg

SEQ ID NO: 806992 - RNA, 22 nt, Human
aucacauugccagugauuaccc

SEQ ID NO: 806993 - RNA, 19 nt, Human
agcuggggcgguguguguu

SEQ ID NO: 806994 - RNA, 22 nt, Human
uuugucuuuccccuccucauug

SEQ ID NO: 806995 - RNA, 22 nt, Human
ucacauuuucuuaggaaacuua

SEQ ID NO: 806996 - RNA, 19 nt, Human
ucuauguggcagugauggc

SEQ ID NO: 806997 - RNA, 22 nt, Human
ucaggcagcuccaggaauggua

SEQ ID NO: 806998 - RNA, 22 nt, Human
cuccucccaauugccaagugcu

SEQ ID NO: 806999 - RNA, 22 nt, Human
agcacuuuauucaggaacucca

SEQ ID NO: 807000 - RNA, 18 nt, Human
aguuucagggcaggaaac

SEQ ID NO: 807001 - RNA, 22 nt, Human
uguggaaaagccccacaggacu

SEQ ID NO: 807002 - RNA, 22 nt, Human
uuuaaccaguuuacaaagaauu

SEQ ID NO: 807003 - RNA, 22 nt, Human
ucacaguuauagucuguagaau

SEQ ID NO: 807004 - RNA, 22 nt, Human
cuaggcuggagugcauuggcgu

SEQ ID NO: 807005 - RNA, 18 nt, Human
gccagagggaagcaggug

SEQ ID NO: 807006 - RNA, 20 nt, Human
cagggcacacugcagccucg

SEQ ID NO: 807007 - RNA, 22 nt, Human
cuggcaguguccagcucgugau

SEQ ID NO: 807008 - RNA, 22 nt, Human
uuguaucagugccuauaaaaug

SEQ ID NO: 807009 - RNA, 20 nt, Human
uauuucugggcaaccauuua

SEQ ID NO: 807010 - RNA, 22 nt, Human
aaacagugacugguacauaaua

SEQ ID NO: 807011 - RNA, 20 nt, Human
ggaaggggcaaaguguguga

SEQ ID NO: 807012 - RNA, 23 nt, Human
acacauuuuucccguucugaggu

SEQ ID NO: 807013 - RNA, 22 nt, Human
uacagauauuguacaguuauag

SEQ ID NO: 807014 - RNA, 22 nt, Human
uugguuuugggauguacaaagg

SEQ ID NO: 807015 - RNA, 22 nt, Human
gagcccagcucuaccucagacu

SEQ ID NO: 807016 - RNA, 22 nt, Human
acuuccagaggguguggaaaua

SEQ ID NO: 807017 - RNA, 22 nt, Human
aaguccugggcauuugaacagg

SEQ ID NO: 807018 - RNA, 22 nt, Human
uccagagaggcauauuuacaag

SEQ ID NO: 807019 - RNA, 22 nt, Human
ugcugggcuucaacugccugag

SEQ ID NO: 807020 - RNA, 22 nt, Human
gaauuguauugauuuuucagag

SEQ ID NO: 807021 - RNA, 22 nt, Human
cucaggaugucggugacuauug

SEQ ID NO: 807022 - RNA, 22 nt, Human
cugcaaaucccuacugggcaca

SEQ ID NO: 807023 - RNA, 22 nt, Human
gagguggcuccuucagggaaua

SEQ ID NO: 807024 - RNA, 22 nt, Human
aagcgccaugguuccugcgcag

SEQ ID NO: 807025 - RNA, 22 nt, Human
guagggagcccagagcccagug

SEQ ID NO: 807026 - RNA, 22 nt, Human
gggcuggcaucaguugccgaga

SEQ ID NO: 807027 - RNA, 22 nt, Human
caugcugggccuugggugcacu

SEQ ID NO: 807028 - RNA, 22 nt, Human
uuaaaauuauggcccauuugga

SEQ ID NO: 807029 - RNA, 22 nt, Human
guggucuggggucaggccugag

SEQ ID NO: 807030 - RNA, 22 nt, Human
gaaggcugucagagaggagggc

SEQ ID NO: 807031 - RNA, 19 nt, Human
agcagagcaaaguggcuga

SEQ ID NO: 807032 - RNA, 22 nt, Human
ccaggaugacccccacuuuccu

SEQ ID NO: 807033 - RNA, 22 nt, Human
uuucaacagaauaugaucagag

SEQ ID NO: 807034 - RNA, 19 nt, Human
ucugcaagugucagaggcg

SEQ ID NO: 807035 - RNA, 22 nt, Human
gacaaggaaauuacuagcugga

SEQ ID NO: 807036 - RNA, 20 nt, Human
cagugaggaggugcuggggg

SEQ ID NO: 807037 - RNA, 21 nt, Human
ggaagggcucugaggacggcu

SEQ ID NO: 807038 - RNA, 22 nt, Human
agcaggcaggcugccagugaau

SEQ ID NO: 807039 - RNA, 22 nt, Human
caguggagagacuuuuacucuu

SEQ ID NO: 807040 - RNA, 22 nt, Human
ugcaggaguccaaucaggagac

SEQ ID NO: 807041 - RNA, 22 nt, Human
aagcacagcuggaacagcagga

SEQ ID NO: 807042 - RNA, 22 nt, Human
gagcagcuaaaauucucaugca

SEQ ID NO: 807043 - RNA, 22 nt, Human
aaauacuguccaccauggagca

SEQ ID NO: 807044 - RNA, 22 nt, Human
aaaucuuccugaaauuuguuca

SEQ ID NO: 807045 - RNA, 22 nt, Human
augagguggucuucaguagguc

SEQ ID NO: 807046 - RNA, 18 nt, Human
uugcaaauucuucccugu

SEQ ID NO: 807047 - RNA, 22 nt, Human
uuauuuaggagaaggaacccug

SEQ ID NO: 807048 - RNA, 22 nt, Human
cugccuggggcaucagucaagg

SEQ ID NO: 807049 - RNA, 23 nt, Human
cagaggcaucggauucaacauca

SEQ ID NO: 807050 - RNA, 23 nt, Human
uggccaggcauaaaggugggugg

SEQ ID NO: 807051 - RNA, 18 nt, Human
gcauucuguuaaugugga

SEQ ID NO: 807052 - RNA, 22 nt, Human
acacaauaaauuuauccuuuga

SEQ ID NO: 807053 - RNA, 22 nt, Human
ccuugacuguaauggaguaggg

SEQ ID NO: 807054 - RNA, 22 nt, Human
gaaaccacaguacccaggaaaa

SEQ ID NO: 807055 - RNA, 22 nt, Human
uagaaacagaauaugagugaga

SEQ ID NO: 807056 - RNA, 20 nt, Human
augguucaggccagcugucu

SEQ ID NO: 807057 - RNA, 22 nt, Human
uauagacuuggcaugcauguuc

SEQ ID NO: 807058 - RNA, 22 nt, Human
aaucacaguggguacuagauug

SEQ ID NO: 807059 - RNA, 22 nt, Human
acagucucuguugcugcuguuu

SEQ ID NO: 807060 - RNA, 22 nt, Human
agcagggaagccuccagaaccu

SEQ ID NO: 807061 - RNA, 20 nt, Human
gacacaggcaguccucagag

SEQ ID NO: 807062 - RNA, 22 nt, Human
cuacaaagaauuucucuagcuc

SEQ ID NO: 807063 - RNA, 23 nt, Human
cccaggaguuucacugcaaaggu

SEQ ID NO: 807064 - RNA, 17 nt, Human
cgggcauggagggcagg

SEQ ID NO: 807065 - RNA, 19 nt, Human
cacagaugauugacacaua

SEQ ID NO: 807066 - RNA, 22 nt, Human
uaguguuuucuagaaugguuuu

SEQ ID NO: 807067 - RNA, 22 nt, Human
gacauuuguuccucuaagugac

SEQ ID NO: 807068 - RNA, 22 nt, Human
agcccaggucuggcccagccug

SEQ ID NO: 807069 - RNA, 22 nt, Human
uggagggucaccccuugcugag

SEQ ID NO: 807070 - RNA, 20 nt, Human
gccaggagggugugaugagc

SEQ ID NO: 807071 - RNA, 22 nt, Human
aagccaacaugauuacuauaau

SEQ ID NO: 807072 - RNA, 22 nt, Human
aggcccagcuggacaaacugcu

SEQ ID NO: 807073 - RNA, 22 nt, Human
cccagggcuuuucucacuagac

SEQ ID NO: 807074 - RNA, 22 nt, Human
agggucuguauuucuggcaagc

SEQ ID NO: 807075 - RNA, 22 nt, Human
ucaagaugaaagauguagccau

SEQ ID NO: 807076 - RNA, 22 nt, Human
caucacaucuacuauaagugau

SEQ ID NO: 807077 - RNA, 22 nt, Human
ccaggcccccgagcagaagaca

SEQ ID NO: 807078 - RNA, 22 nt, Human
ucugaaggaaaaggguagauau

SEQ ID NO: 807079 - RNA, 22 nt, Human
gcacugggaaugagggcagcuu

SEQ ID NO: 807080 - RNA, 22 nt, Human
cugcacaggggaugagggcagu

SEQ ID NO: 807081 - RNA, 22 nt, Human
auuucuguaguccacauucuuu

SEQ ID NO: 807082 - RNA, 22 nt, Human
uggaaauaguaaugcauaagug

SEQ ID NO: 807083 - RNA, 22 nt, Human
ugagggcuaaauuguggcaggu

SEQ ID NO: 807084 - RNA, 22 nt, Human
auuuaucaucagaccuuuuaaa

SEQ ID NO: 807085 - RNA, 22 nt, Human
ccagccacugggccacugccag

SEQ ID NO: 807086 - RNA, 22 nt, Human
uaaugacuaagcaucauuaaac

SEQ ID NO: 807087 - RNA, 22 nt, Human
ugcccagcuucuuacuuuuaaa

SEQ ID NO: 807088 - RNA, 22 nt, Human
aagucauuccugcuuguugccc

SEQ ID NO: 807089 - RNA, 22 nt, Human
gaggaggcuuccgggaggcacg

SEQ ID NO: 807090 - RNA, 22 nt, Human
aguuuucugcuaaaccagcuaa

SEQ ID NO: 807091 - RNA, 22 nt, Human
cuaguauuuaaaggcuaugauu

SEQ ID NO: 807092 - RNA, 22 nt, Human
agcuggaggggccagcaggugu

SEQ ID NO: 807093 - RNA, 21 nt, Human
uuuuuucuugcgugaggccug

SEQ ID NO: 807094 - RNA, 22 nt, Human
uucuaaacggcuucacaggaau

SEQ ID NO: 807095 - RNA, 22 nt, Human
cugggagucuggccucuggucc

SEQ ID NO: 807096 - RNA, 22 nt, Human
agucagagacccuagaucuaau

SEQ ID NO: 807097 - RNA, 22 nt, Human
gcugccacgaucucugcuguag

SEQ ID NO: 807098 - RNA, 22 nt, Human
ggucagagggugggcugccugu

SEQ ID NO: 807099 - RNA, 22 nt, Human
ucacauuuguucuugaaucuaa

SEQ ID NO: 807100 - RNA, 22 nt, Human
cugcagcuggagcaucuucuca

SEQ ID NO: 807101 - RNA, 22 nt, Human
ggaacuccugcuccaagcagcu

SEQ ID NO: 807102 - RNA, 22 nt, Human
cugagcugugugguccugggca

SEQ ID NO: 807103 - RNA, 22 nt, Human
agagucaaguagggcaugggcu

SEQ ID NO: 807104 - RNA, 22 nt, Human
ccugccucccagagguccucua

SEQ ID NO: 807105 - RNA, 22 nt, Human
agcuggggguagugagaaauaa

SEQ ID NO: 807106 - RNA, 22 nt, Human
uuagaguuuuuguaaguacaau

SEQ ID NO: 807107 - RNA, 22 nt, Human
cugccugcugacauucuuuaua

SEQ ID NO: 807108 - RNA, 22 nt, Human
augcaaauggcaaugagugacc

SEQ ID NO: 807109 - RNA, 22 nt, Human
gccugccuguuggcugaggugc

SEQ ID NO: 807110 - RNA, 22 nt, Human
ugggguggauagaaagugaugu

SEQ ID NO: 807111 - RNA, 22 nt, Human
uggaagagguggaaguggcuuc

SEQ ID NO: 807112 - RNA, 22 nt, Human
auaacuuaaugggucaugcucu

SEQ ID NO: 807113 - RNA, 22 nt, Human
aggccugucccagcugaggacg

SEQ ID NO: 807114 - RNA, 22 nt, Human
acacuagagagcaggcauuccc

SEQ ID NO: 807115 - RNA, 22 nt, Human
agauauuaggaggauucauaau

SEQ ID NO: 807116 - RNA, 22 nt, Human
acccgugguuuuauacuacuuc

SEQ ID NO: 807117 - RNA, 22 nt, Human
ugggcagaggacagggaagauc

SEQ ID NO: 807118 - RNA, 22 nt, Human
ucuuuauuuaagucuguuguaa

SEQ ID NO: 807119 - RNA, 22 nt, Human
ggccacagcagaugcuucagau

SEQ ID NO: 807120 - RNA, 22 nt, Human
uuugcaaauucuugucuagccu

SEQ ID NO: 807121 - RNA, 22 nt, Human
ugagaaguacuacaagagaggg

SEQ ID NO: 807122 - RNA, 21 nt, Human
ugccagcauuaaacagucauu

SEQ ID NO: 807123 - RNA, 22 nt, Human
uagugaaagucaaagacagcua

SEQ ID NO: 807124 - RNA, 22 nt, Human
acaguucuuuggauggaagaau

SEQ ID NO: 807125 - RNA, 22 nt, Human
auacauguugagaaaauaucug

SEQ ID NO: 807126 - RNA, 22 nt, Human
cacaggagcuguggggcagugu

SEQ ID NO: 807127 - RNA, 22 nt, Human
cagcuggcuccaccucugggcu

SEQ ID NO: 807128 - RNA, 22 nt, Human
aaacaagagcuuacauggcugc

SEQ ID NO: 807129 - RNA, 22 nt, Human
auaaagauuucuuuuucucuac

SEQ ID NO: 807130 - RNA, 20 nt, Human
agcagcagauguuggaggug

SEQ ID NO: 807131 - RNA, 17 nt, Human
ucuccuggcucuaucag

SEQ ID NO: 807132 - RNA, 22 nt, Human
gggcuggaguugggaagacaaa

SEQ ID NO: 807133 - RNA, 22 nt, Human
cacaguauuuguuuuucugagu

SEQ ID NO: 807134 - RNA, 22 nt, Human
gggacaggcugagacuugagcu

SEQ ID NO: 807135 - RNA, 22 nt, Human
ggccucucauucucccuggucc

SEQ ID NO: 807136 - RNA, 21 nt, Human
auuucauggugcuuuuaagaa

SEQ ID NO: 807137 - RNA, 22 nt, Human
cuguguuuuuggucugaucuau

SEQ ID NO: 807138 - RNA, 22 nt, Human
aaacugcagagccaugguucaa

SEQ ID NO: 807139 - RNA, 22 nt, Human
aauuuuauuaacuggauguagc

SEQ ID NO: 807140 - RNA, 22 nt, Human
cagccucucuguaucucaggau

SEQ ID NO: 807141 - RNA, 22 nt, Human
gggaagcaggugcagcucgccu

SEQ ID NO: 807142 - RNA, 22 nt, Human
gcagggcagaaggugcugagga

SEQ ID NO: 807143 - RNA, 17 nt, Human
ucaggcugggugcagug

SEQ ID NO: 807144 - RNA, 22 nt, Human
ccacaguguggcauaaacugua

SEQ ID NO: 807145 - RNA, 22 nt, Human
gagggcaguagccucguacccu

SEQ ID NO: 807146 - RNA, 22 nt, Human
ugaaauauccagcccagcagga

SEQ ID NO: 807147 - RNA, 22 nt, Human
aagaugugcugucuugccacuc

SEQ ID NO: 807148 - RNA, 22 nt, Human
gugccuggaacuggguaggcug

SEQ ID NO: 807149 - RNA, 22 nt, Human
acacuugagguuuuuaggugcg

SEQ ID NO: 807150 - RNA, 22 nt, Human
acaguguccuuguggucccugu

SEQ ID NO: 807151 - RNA, 22 nt, Human
aguacaaacuguuucaaaguag

SEQ ID NO: 807152 - RNA, 16 nt, Human
aagccaguucagcauu

SEQ ID NO: 807153 - RNA, 22 nt, Human
gcagcugagagaagaacagggc

SEQ ID NO: 807154 - RNA, 22 nt, Human
uuaaaacagcgugaaucuggca

SEQ ID NO: 807155 - RNA, 22 nt, Human
ucuugauuuacucuaauagcuu

SEQ ID NO: 807156 - RNA, 22 nt, Human
ugcuguggauucagagaugaaa

SEQ ID NO: 807157 - RNA, 22 nt, Human
uuuuugcaccaaccuaauagaa

SEQ ID NO: 807158 - RNA, 22 nt, Human
ucuccuggucaccucagaaguc

SEQ ID NO: 807159 - RNA, 22 nt, Human
aauguuauuucugcauaguagu

SEQ ID NO: 807160 - RNA, 22 nt, Human
cccuggagaggacucaccccug

SEQ ID NO: 807161 - RNA, 22 nt, Human
uguccuggagacacaagguggu

SEQ ID NO: 807162 - RNA, 22 nt, Human
uucaaacaguguagaauauaug

SEQ ID NO: 807163 - RNA, 19 nt, Human
uugguggugguuuugguuc

SEQ ID NO: 807164 - RNA, 22 nt, Human
cuguuuuucagaagguaaggga

SEQ ID NO: 807165 - RNA, 20 nt, Human
uccuuuccuccuucuaaaug

SEQ ID NO: 807166 - RNA, 22 nt, Human
agcugccuuuugagaaagcuca

SEQ ID NO: 807167 - RNA, 22 nt, Human
ccaggcagaugggccggcuuca

SEQ ID NO: 807168 - RNA, 22 nt, Human
aauaaccuuuauuucaaagugu

SEQ ID NO: 807169 - RNA, 22 nt, Human
uuauucagcucucuagaggcac

SEQ ID NO: 807170 - RNA, 22 nt, Human
cuucuagagcuggagcaaaugu

SEQ ID NO: 807171 - RNA, 22 nt, Human
cugacagcugaagggucccaga

SEQ ID NO: 807172 - RNA, 22 nt, Human
uggccuggugucugcgaggccu

SEQ ID NO: 807173 - RNA, 22 nt, Human
ggcaauaguuguggguucuuua

SEQ ID NO: 807174 - RNA, 22 nt, Human
cuggcccucagacucaugggca

SEQ ID NO: 807175 - RNA, 22 nt, Human
ucacagaaggaccuuguuucau

SEQ ID NO: 807176 - RNA, 22 nt, Human
caacugcuuggaggaauacugc

SEQ ID NO: 807177 - RNA, 22 nt, Human
ggagugaggcauuuguagcuga

SEQ ID NO: 807178 - RNA, 22 nt, Human
gcagaaaccacagugucuuuua

SEQ ID NO: 807179 - RNA, 19 nt, Human
gaggaggaaaacuagugua

SEQ ID NO: 807180 - RNA, 22 nt, Human
aaauggaucuuuuuauaaugca

SEQ ID NO: 807181 - RNA, 22 nt, Human
uacuugaguauagucgcuucac

SEQ ID NO: 807182 - RNA, 22 nt, Human
agaaggcagaugggacggagca

SEQ ID NO: 807183 - RNA, 22 nt, Human
uccccagggucccugcuuccau

SEQ ID NO: 807184 - RNA, 22 nt, Human
ccaggcucugcgcuggacaugg

SEQ ID NO: 807185 - RNA, 22 nt, Human
ugaguugcccugcccugugcuu

SEQ ID NO: 807186 - RNA, 22 nt, Human
auuaaagaaacccagcauguga

SEQ ID NO: 807187 - RNA, 22 nt, Human
gggcccugcgacucgcggcgga

SEQ ID NO: 807188 - RNA, 22 nt, Human
gcugggacggcucaguaagaag

SEQ ID NO: 807189 - RNA, 23 nt, Human
auaaacugucaaaagccagcccu

SEQ ID NO: 807190 - RNA, 23 nt, Human
ccacaggcacagaggcuugcauc

SEQ ID NO: 807191 - RNA, 22 nt, Human
gcucaaugcucaaugcugcaaa

SEQ ID NO: 807192 - RNA, 22 nt, Human
acacuagaugccaauagcaccc

SEQ ID NO: 807193 - RNA, 19 nt, Human
uuucuuccaaagacuaugg

SEQ ID NO: 807194 - RNA, 22 nt, Human
uuucacauguggaaugccaggu

SEQ ID NO: 807195 - RNA, 22 nt, Human
ggacacaggcagcugggugggu

SEQ ID NO: 807196 - RNA, 22 nt, Human
gcauaauuaaacaggcaagauu

SEQ ID NO: 807197 - RNA, 22 nt, Human
agggagagguugaaaccucagu

SEQ ID NO: 807198 - RNA, 20 nt, Human
aucagacuuuuaggaacaua

SEQ ID NO: 807199 - RNA, 22 nt, Human
gaagaugggaaugaugaguggg

SEQ ID NO: 807200 - RNA, 22 nt, Human
cucccagccuucgccagucuga

SEQ ID NO: 807201 - RNA, 22 nt, Human
aaauacauuuacagucguggcu

SEQ ID NO: 807202 - RNA, 22 nt, Human
uaugugaccuucugaaugagua

SEQ ID NO: 807203 - RNA, 22 nt, Human
ugugucaagacauuuagucauu

SEQ ID NO: 807204 - RNA, 22 nt, Human
cccaggagguuggggcuacagu

SEQ ID NO: 807205 - RNA, 22 nt, Human
aagaaaagauguuugguuuuca

SEQ ID NO: 807206 - RNA, 22 nt, Human
uucuuguuccaugaaagacaga

SEQ ID NO: 807207 - RNA, 22 nt, Human
ugucucuugaguuuguuuuaau

SEQ ID NO: 807208 - RNA, 22 nt, Human
aaucaggaggauaagggggucc

SEQ ID NO: 807209 - RNA, 22 nt, Human
uaauuacagguccaaaacaauc

SEQ ID NO: 807210 - RNA, 22 nt, Human
uucagugugucaguuucagcag

SEQ ID NO: 807211 - RNA, 17 nt, Human
cagaaggaagcauggca

SEQ ID NO: 807212 - RNA, 22 nt, Human
agaguccaggggccuggugugu

SEQ ID NO: 807213 - RNA, 22 nt, Human
cugaggagaccaucaacuaauu

SEQ ID NO: 807214 - RNA, 22 nt, Human
ugacagcauaacacuggucuug

SEQ ID NO: 807215 - RNA, 22 nt, Human
ccccuucuguguccugucagcc

SEQ ID NO: 807216 - RNA, 22 nt, Human
ugcccagcaauaaaccagaaga

SEQ ID NO: 807217 - RNA, 22 nt, Human
gggccucagcucugcucugcaa

SEQ ID NO: 807218 - RNA, 22 nt, Human
aucaaaguccaucagaagguag

SEQ ID NO: 807219 - RNA, 20 nt, Human
uggggaaagccaucgaugag

SEQ ID NO: 807220 - RNA, 22 nt, Human
gccagccugugcuuggccaggc

SEQ ID NO: 807221 - RNA, 22 nt, Human
cccucccugaagaaguuacucu

SEQ ID NO: 807222 - RNA, 22 nt, Human
ccacuauuacuguguggcaguc

SEQ ID NO: 807223 - RNA, 22 nt, Human
ggcugccucuauuuaggaucaa

SEQ ID NO: 807224 - RNA, 22 nt, Human
ccaguuuaggacacaugcccac

SEQ ID NO: 807225 - RNA, 22 nt, Human
cagucuuugacaagcccuuuca

SEQ ID NO: 807226 - RNA, 22 nt, Human
uccagccaugcaugacaaucac

SEQ ID NO: 807227 - RNA, 22 nt, Human
aagagagaacucccuucgccag

SEQ ID NO: 807228 - RNA, 22 nt, Human
cagagacaaccugguagagaaa

SEQ ID NO: 807229 - RNA, 22 nt, Human
cagagagggcggcccuggcuuc

SEQ ID NO: 807230 - RNA, 22 nt, Human
aggcugugcacagggcaccugc

SEQ ID NO: 807231 - RNA, 22 nt, Human
gcaccugcucacacaugugacu

SEQ ID NO: 807232 - RNA, 22 nt, Human
gcagcuggcucagagagguggg

SEQ ID NO: 807233 - RNA, 22 nt, Human
acagaaagauaggcacaagguc

SEQ ID NO: 807234 - RNA, 22 nt, Human
gugcagcugguggagucugggg

SEQ ID NO: 807235 - RNA, 18 nt, Human
cucucuuuccacucuuug

SEQ ID NO: 807236 - RNA, 22 nt, Human
uuuucuccaacucaaaggaaag

SEQ ID NO: 807237 - RNA, 22 nt, Human
aggcugugggaauggcugcuug

SEQ ID NO: 807238 - RNA, 22 nt, Human
ggugcugggaacgaggaauuca

SEQ ID NO: 807239 - RNA, 22 nt, Human
uggcggugacggcggcgccugg

SEQ ID NO: 807240 - RNA, 22 nt, Human
cuggggugaaggauuaccugag

SEQ ID NO: 807241 - RNA, 23 nt, Human
aggcaguggugguaacaugucaa

SEQ ID NO: 807242 - RNA, 22 nt, Human
agguggcaggaggucagagaaa

SEQ ID NO: 807243 - RNA, 20 nt, Human
acacuugacaccagaaaugg

SEQ ID NO: 807244 - RNA, 22 nt, Human
caucaaagcuuuuuucuguguu

SEQ ID NO: 807245 - RNA, 22 nt, Human
gucauaggcauggauguggguu

SEQ ID NO: 807246 - RNA, 22 nt, Human
ucaggaagugguaaaggauguu

SEQ ID NO: 807247 - RNA, 22 nt, Human
uucaaagugcauguuccucaga

SEQ ID NO: 807248 - RNA, 22 nt, Human
auucuuuuuuaaggaauagaac

SEQ ID NO: 807249 - RNA, 22 nt, Human
ugaguuuaauuggagccugaau

SEQ ID NO: 807250 - RNA, 22 nt, Human
ugguuagacucaccuuauaguu

SEQ ID NO: 807251 - RNA, 22 nt, Human
caggaggcagagguugcaguga

SEQ ID NO: 807252 - RNA, 22 nt, Human
ugaaacagucuccagacuugga

SEQ ID NO: 807253 - RNA, 22 nt, Human
gucagaagcauuuguggcugaa

SEQ ID NO: 807254 - RNA, 22 nt, Human
uaaaugcuuagauucauagaaa

SEQ ID NO: 807255 - RNA, 22 nt, Human
agcccagcaaagggguuugaga

SEQ ID NO: 807256 - RNA, 22 nt, Human
agcagcucuggcacuguagcau

SEQ ID NO: 807257 - RNA, 22 nt, Human
aggggagcaucugugaugguua

SEQ ID NO: 807258 - RNA, 22 nt, Human
aaagcucacaguaauacaaggc

SEQ ID NO: 807259 - RNA, 22 nt, Human
cagcagccgagagggggcucug

SEQ ID NO: 807260 - RNA, 22 nt, Human
cuuccucuagccuaguaaugcc

SEQ ID NO: 807261 - RNA, 22 nt, Human
gauuaguaagaguuuaccuauu

SEQ ID NO: 807262 - RNA, 22 nt, Human
cuauuucuaaaccuauaaguga

SEQ ID NO: 807263 - RNA, 22 nt, Human
ccagcugcugugcagggaggcu

SEQ ID NO: 807264 - RNA, 22 nt, Human
cgucaucacggcaagcaucucc

SEQ ID NO: 807265 - RNA, 22 nt, Human
aaguuuaagguggaaguggugg

SEQ ID NO: 807266 - RNA, 22 nt, Human
agauacaacuguuuaaacauua

SEQ ID NO: 807267 - RNA, 22 nt, Human
cugggagcugucaggagcgugu

SEQ ID NO: 807268 - RNA, 22 nt, Human
ucacagccuggacaguugccug

SEQ ID NO: 807269 - RNA, 22 nt, Human
cugggacccugcccuguggccu

SEQ ID NO: 807270 - RNA, 22 nt, Human
gcagcaggcauggccgcccugg

SEQ ID NO: 807271 - RNA, 22 nt, Human
acaaguuucauuguuuagaacc

SEQ ID NO: 807272 - RNA, 22 nt, Human
cccaggaggcagaaguugcagu

SEQ ID NO: 807273 - RNA, 22 nt, Human
cguggccagcacaaggcaguga

SEQ ID NO: 807274 - RNA, 22 nt, Human
agcuccugcccaggaaggcucu

SEQ ID NO: 807275 - RNA, 22 nt, Human
gaggucaggcucaagcugggcc

SEQ ID NO: 807276 - RNA, 22 nt, Human
aacauuucugagaauaucaguu

SEQ ID NO: 807277 - RNA, 22 nt, Human
cugucccauccuuacucuaccc

SEQ ID NO: 807278 - RNA, 22 nt, Human
aaagaggggacuguuaauucca

SEQ ID NO: 807279 - RNA, 22 nt, Human
uugcuuuguuacugcaguuucc

SEQ ID NO: 807280 - RNA, 22 nt, Human
cuggcagcugcccgagaugccc

SEQ ID NO: 807281 - RNA, 22 nt, Human
uggauggguugaaaugugagcc

SEQ ID NO: 807282 - RNA, 22 nt, Human
gucugcuggcacgucacagaua

SEQ ID NO: 807283 - RNA, 22 nt, Human
uacaaagaguuuggucucuaga

SEQ ID NO: 807284 - RNA, 22 nt, Human
acccaggccugagagacaggag

SEQ ID NO: 807285 - RNA, 20 nt, Human
uccugcugaccuucacaagc

SEQ ID NO: 807286 - RNA, 22 nt, Human
augaaaugaaguuggccuggcu

SEQ ID NO: 807287 - RNA, 22 nt, Human
ugccacagagcaauucugcuga

SEQ ID NO: 807288 - RNA, 22 nt, Human
acccggagucggagguugcagu

SEQ ID NO: 807289 - RNA, 22 nt, Human
acucugcuuauugcugcaggca

SEQ ID NO: 807290 - RNA, 22 nt, Human
aggugggcgcugcucccgcugg

SEQ ID NO: 807291 - RNA, 22 nt, Human
caugcauagccagcauuguaug

SEQ ID NO: 807292 - RNA, 23 nt, Human
gugagcagcaccaugaggcuaga

SEQ ID NO: 807293 - RNA, 22 nt, Human
agagucagaaccaagaugaggc

SEQ ID NO: 807294 - RNA, 22 nt, Human
ugaagaacgugagauccagaaa

SEQ ID NO: 807295 - RNA, 22 nt, Human
aacacagguugcugggccucac

SEQ ID NO: 807296 - RNA, 22 nt, Human
ugcagcugcuggcccaggugcu

SEQ ID NO: 807297 - RNA, 18 nt, Human
gccagugcccuggcucac

SEQ ID NO: 807298 - RNA, 22 nt, Human
uacauucugaaauaaaugguuu

SEQ ID NO: 807299 - RNA, 22 nt, Human
acacagauaaugcucauauagg

SEQ ID NO: 807300 - RNA, 20 nt, Human
gcuggcagaugucuugagau

SEQ ID NO: 807301 - RNA, 22 nt, Human
caagaaucaacauuauuuagug

SEQ ID NO: 807302 - RNA, 22 nt, Human
uguaauauaagcauuaauaguu

SEQ ID NO: 807303 - RNA, 22 nt, Human
ggugugugguuuugauacaguc

SEQ ID NO: 807304 - RNA, 22 nt, Human
acauaugagguguuauucuaug

SEQ ID NO: 807305 - RNA, 22 nt, Human
ccagaagcaaaacagacaguuu

SEQ ID NO: 807306 - RNA, 22 nt, Human
uacaagagguauauagaaacag

SEQ ID NO: 807307 - RNA, 22 nt, Human
acucagaguuuuacccagagac

SEQ ID NO: 807308 - RNA, 22 nt, Human
acaagauaaggugucagugugu

SEQ ID NO: 807309 - RNA, 22 nt, Human
aauuuaaggaggccuucacucu

SEQ ID NO: 807310 - RNA, 22 nt, Human
uggugcugcaggugggcacagu

SEQ ID NO: 807311 - RNA, 22 nt, Human
uggcuucuaguuugaggaaaaa

SEQ ID NO: 807312 - RNA, 23 nt, Human
ccuggcuggauucucugcauuca

SEQ ID NO: 807313 - RNA, 22 nt, Human
uguauccccugcagguugcuau

SEQ ID NO: 807314 - RNA, 22 nt, Human
uucaacauguucuacauaaggg

SEQ ID NO: 807315 - RNA, 22 nt, Human
agucaggggaucuagacuugaa

SEQ ID NO: 807316 - RNA, 22 nt, Human
gcuuguuugugccucugcagaa

SEQ ID NO: 807317 - RNA, 22 nt, Human
gaaauucaggacaaagacucuu

SEQ ID NO: 807318 - RNA, 22 nt, Human
ccagagacgucggucagggcgc

SEQ ID NO: 807319 - RNA, 22 nt, Human
auucugcacauccaagaacagg

SEQ ID NO: 807320 - RNA, 22 nt, Human
ucaauuaagaggcuaaguuacu

SEQ ID NO: 807321 - RNA, 22 nt, Human
aagaacaugaagucacaaaugc

SEQ ID NO: 807322 - RNA, 22 nt, Human
ccuggagcaggagcugcagagg

SEQ ID NO: 807323 - RNA, 22 nt, Human
gagcaggaacugaaaaugagac

SEQ ID NO: 807324 - RNA, 22 nt, Human
uauuucucuuuguagggauaua

SEQ ID NO: 807325 - RNA, 22 nt, Human
acacacuguaaggacuaucacu

SEQ ID NO: 807326 - RNA, 22 nt, Human
gauuuacaaagcucucuagugu

SEQ ID NO: 807327 - RNA, 22 nt, Human
gcagcuuggugaaaggugaugg

SEQ ID NO: 807328 - RNA, 22 nt, Human
gaaggcuccuugagggaaggac

SEQ ID NO: 807329 - RNA, 22 nt, Human
aguguauuugccuauaaaaaug

SEQ ID NO: 807330 - RNA, 22 nt, Human
caggaaauaggcguuuguccuc

SEQ ID NO: 807331 - RNA, 22 nt, Human
cuucucucugcauaggcauggg

SEQ ID NO: 807332 - RNA, 22 nt, Human
acacuacagggagaagacucac

SEQ ID NO: 807333 - RNA, 22 nt, Human
uaacaauaguguuugcuaguca

SEQ ID NO: 807334 - RNA, 22 nt, Human
cagaggcauacucccagucuug

SEQ ID NO: 807335 - RNA, 22 nt, Human
ucuuuucacagacaaauggaga

SEQ ID NO: 807336 - RNA, 22 nt, Human
caucuccuuuggucuacuucca

SEQ ID NO: 807337 - RNA, 18 nt, Human
ucagaggagauaccuaaa

SEQ ID NO: 807338 - RNA, 22 nt, Human
ucuccccagcugagcugcccuu

SEQ ID NO: 807339 - RNA, 23 nt, Human
gcaugcaaagaauauagguguuc

SEQ ID NO: 807340 - RNA, 22 nt, Human
aagcaggagagccugggugagc

SEQ ID NO: 807341 - RNA, 22 nt, Human
ugcaugcucuguagaaagcagg

SEQ ID NO: 807342 - RNA, 22 nt, Human
ucaucaaagucaaagaaugacu

SEQ ID NO: 807343 - RNA, 22 nt, Human
cugggagcuggaugcccugccc

SEQ ID NO: 807344 - RNA, 22 nt, Human
guagucugaacaguaauuuugu

SEQ ID NO: 807345 - RNA, 22 nt, Human
ccagcaggaaagugacguuuga

SEQ ID NO: 807346 - RNA, 19 nt, Human
agcugccugugcgcgcccg

SEQ ID NO: 807347 - RNA, 22 nt, Human
auuuuguugagguaauugucaa

SEQ ID NO: 807348 - RNA, 22 nt, Human
uuacaguacagaaaauaacaga

SEQ ID NO: 807349 - RNA, 22 nt, Human
gugcuucuccguucugcagcac

SEQ ID NO: 807350 - RNA, 22 nt, Human
uuaacaaaaauaucaggcauca

SEQ ID NO: 807351 - RNA, 22 nt, Human
cagcugaggucaaagaagcagg

SEQ ID NO: 807352 - RNA, 18 nt, Human
gcugugugcaccugauaa

SEQ ID NO: 807353 - RNA, 22 nt, Human
ggggauggaggcgugugguccu

SEQ ID NO: 807354 - RNA, 22 nt, Human
aaauagaauuggaagcagaguu

SEQ ID NO: 807355 - RNA, 22 nt, Human
ggcacugggagaggugagacgg

SEQ ID NO: 807356 - RNA, 22 nt, Human
ccucaggguggcaucagaucuu

SEQ ID NO: 807357 - RNA, 22 nt, Human
ucucacagccauuucucccucu

SEQ ID NO: 807358 - RNA, 22 nt, Human
gaaacauuggucugccccuuau

SEQ ID NO: 807359 - RNA, 22 nt, Human
aggccaggggugagcacuucug

SEQ ID NO: 807360 - RNA, 22 nt, Human
gggaaggcaggauucucuggug

SEQ ID NO: 807361 - RNA, 22 nt, Human
ccucucggcagcccaucuuguc

SEQ ID NO: 807362 - RNA, 22 nt, Human
cagggguguuuuuggccaggag

SEQ ID NO: 807363 - RNA, 22 nt, Human
cagugcugcaucuccaugccag

SEQ ID NO: 807364 - RNA, 22 nt, Human
uccugcagcugaagcucaugug

SEQ ID NO: 807365 - RNA, 22 nt, Human
cuacuucugugaugaaacuaca

SEQ ID NO: 807366 - RNA, 22 nt, Human
agcuuucuaccagguccugucu

SEQ ID NO: 807367 - RNA, 22 nt, Human
ugcuuauuuagguagauauuaa

SEQ ID NO: 807368 - RNA, 22 nt, Human
agcagcuucuuucacuccugga

SEQ ID NO: 807369 - RNA, 22 nt, Human
ccaggcagagggaauagcaagu

SEQ ID NO: 807370 - RNA, 22 nt, Human
uaaagcacaguaugagcauugg

SEQ ID NO: 807371 - RNA, 22 nt, Human
uucacugugauggugcagaggc

SEQ ID NO: 807372 - RNA, 22 nt, Human
ggaagaaaucugguuaagagau

SEQ ID NO: 807373 - RNA, 22 nt, Human
cccaggaugucgaggcugcagu

SEQ ID NO: 807374 - RNA, 21 nt, Human
auuugcauuaaaauauuacgc

SEQ ID NO: 807375 - RNA, 22 nt, Human
gggugaagcuccugcaggggcc

SEQ ID NO: 807376 - RNA, 22 nt, Human
caggcuggagugcaauggcaca

SEQ ID NO: 807377 - RNA, 22 nt, Human
guggaucuacuguaugggauag

SEQ ID NO: 807378 - RNA, 22 nt, Human
ggaagggcaaaagagaugaacu

SEQ ID NO: 807379 - RNA, 23 nt, Human
cucccuggcccuugggagaccug

SEQ ID NO: 807380 - RNA, 22 nt, Human
auauuuuguaacuuggaauagg

SEQ ID NO: 807381 - RNA, 23 nt, Human
ugcugccaagcacgaguugaguu

SEQ ID NO: 807382 - RNA, 21 nt, Human
gccauguuuccuuacuaagag

SEQ ID NO: 807383 - RNA, 22 nt, Human
uuucucuggcauuagguauaaa

SEQ ID NO: 807384 - RNA, 22 nt, Human
caucugucuuuuguuacaaggc

SEQ ID NO: 807385 - RNA, 22 nt, Human
agugucugccugggaggagcau

SEQ ID NO: 807386 - RNA, 22 nt, Human
augcaaaugcuagagaauguug

SEQ ID NO: 807387 - RNA, 22 nt, Human
uccacagguaugaggccccacc

SEQ ID NO: 807388 - RNA, 20 nt, Human
ucagugucaguagccacuac

SEQ ID NO: 807389 - RNA, 22 nt, Human
uucuaaacuucaauucuaaauu

SEQ ID NO: 807390 - RNA, 22 nt, Human
auuuacugcuugacacauuggu

SEQ ID NO: 807391 - RNA, 22 nt, Human
ggccugagucacaucaggagag

SEQ ID NO: 807392 - RNA, 22 nt, Human
aggaggguucucuggacagagg

SEQ ID NO: 807393 - RNA, 22 nt, Human
ggucagaagugcaaaaucaguu

SEQ ID NO: 807394 - RNA, 22 nt, Human
cagauuaguugugcuauggccu

SEQ ID NO: 807395 - RNA, 22 nt, Human
agaagccauugaagcagaccuc

SEQ ID NO: 807396 - RNA, 22 nt, Human
cagcugagcucccaggccauca

SEQ ID NO: 807397 - RNA, 22 nt, Human
aaacacauuagcccuguggaaa

SEQ ID NO: 807398 - RNA, 22 nt, Human
uugcugaugguauuaugcuagu

SEQ ID NO: 807399 - RNA, 22 nt, Human
ccaggcugcucacaagcugccc

SEQ ID NO: 807400 - RNA, 22 nt, Human
uggcagcugaauggcuggaugg

SEQ ID NO: 807401 - RNA, 22 nt, Human
aucacaguuuacaaaccugcug

SEQ ID NO: 807402 - RNA, 22 nt, Human
caacacagggguuaugccaugg

SEQ ID NO: 807403 - RNA, 20 nt, Human
cagagcagugcccaggcggc

SEQ ID NO: 807404 - RNA, 18 nt, Human
guggaggguucucagaau

SEQ ID NO: 807405 - RNA, 22 nt, Human
ccugcuggcgcuugucugggag

SEQ ID NO: 807406 - RNA, 22 nt, Human
ucccaggaauugaagccagugu

SEQ ID NO: 807407 - RNA, 22 nt, Human
ccagggcucuaugaggguggag

SEQ ID NO: 807408 - RNA, 22 nt, Human
gccuuucacagagauuuaaaaa

SEQ ID NO: 807409 - RNA, 22 nt, Human
uguuugaauaacuuggauauau

SEQ ID NO: 807410 - RNA, 22 nt, Human
gcagaggcugggugucccaguc

SEQ ID NO: 807411 - RNA, 22 nt, Human
agaaaaugugaacuugugaauu

SEQ ID NO: 807412 - RNA, 22 nt, Human
auucaacuauguauagucuucu

SEQ ID NO: 807413 - RNA, 22 nt, Human
caggaugggugucggccagcac

SEQ ID NO: 807414 - RNA, 22 nt, Human
uuccagagcuuugcgcuuggaa

SEQ ID NO: 807415 - RNA, 22 nt, Human
uacagagaggugacccuugggc

SEQ ID NO: 807416 - RNA, 22 nt, Human
auaaaucuauuggacaugugug

SEQ ID NO: 807417 - RNA, 20 nt, Human
uggcccaguggggcagggug

SEQ ID NO: 807418 - RNA, 22 nt, Human
guuuaguguuucaagacucuuu

SEQ ID NO: 807419 - RNA, 22 nt, Human
uuuggaauauuaaaaugucuca

SEQ ID NO: 807420 - RNA, 22 nt, Human
agcaggcuccaggcuggccauc

SEQ ID NO: 807421 - RNA, 22 nt, Human
uuacacaacaucuguauuauua

SEQ ID NO: 807422 - RNA, 22 nt, Human
ucagaaguccaauaccauggga

SEQ ID NO: 807423 - RNA, 22 nt, Human
ucacaucaggugucuccccaag

SEQ ID NO: 807424 - RNA, 22 nt, Human
ugucacagucucgugagcaucu

SEQ ID NO: 807425 - RNA, 23 nt, Human
uuucacauuaauguuuagcagga

SEQ ID NO: 807426 - RNA, 22 nt, Human
gcuggcuggaacuagcaguugg

SEQ ID NO: 807427 - RNA, 22 nt, Human
cacaggcaccccugacugcuca

SEQ ID NO: 807428 - RNA, 22 nt, Human
augccaaauucuacuuucagca

SEQ ID NO: 807429 - RNA, 22 nt, Human
uugcaaaucacaagagcagagc

SEQ ID NO: 807430 - RNA, 22 nt, Human
uaaacaagaaacauuuucuguu

SEQ ID NO: 807431 - RNA, 22 nt, Human
gcacagggccuggcacauaaga

SEQ ID NO: 807432 - RNA, 19 nt, Human
gccuaugucuucaaaucau

SEQ ID NO: 807433 - RNA, 18 nt, Human
ucaggcugggccuccuuc

SEQ ID NO: 807434 - RNA, 22 nt, Human
gauaaacacaaggugauuucau

SEQ ID NO: 807435 - RNA, 22 nt, Human
aaggcuggcaauauauuuguua

SEQ ID NO: 807436 - RNA, 22 nt, Human
gacauuagacuaauguagcauu

SEQ ID NO: 807437 - RNA, 22 nt, Human
ccuccuggaggcucuaagggag

SEQ ID NO: 807438 - RNA, 22 nt, Human
aggccacauagcuugcauguag

SEQ ID NO: 807439 - RNA, 22 nt, Human
cagcuugggggcgcuggccuca

SEQ ID NO: 807440 - RNA, 22 nt, Human
acaaaucuguuuuauagacuuu

SEQ ID NO: 807441 - RNA, 22 nt, Human
ugacuucuagcauuuagcaacc

SEQ ID NO: 807442 - RNA, 22 nt, Human
uccacaagaugauaaagagagg

SEQ ID NO: 807443 - RNA, 22 nt, Human
ucaaggaagggauauucuugaa

SEQ ID NO: 807444 - RNA, 22 nt, Human
cucccucagaggagcaccuguu

SEQ ID NO: 807445 - RNA, 17 nt, Human
ugcaggcuccugucccu

SEQ ID NO: 807446 - RNA, 22 nt, Human
gggaggcgccgaggguagcuaa

SEQ ID NO: 807447 - RNA, 22 nt, Human
agugucauuuccacgacauuca

SEQ ID NO: 807448 - RNA, 22 nt, Human
aggugagggugccagugcaugg

SEQ ID NO: 807449 - RNA, 20 nt, Human
uuucuguagcucaguauuca

SEQ ID NO: 807450 - RNA, 22 nt, Human
ugacaaauguuaauucagugga

SEQ ID NO: 807451 - RNA, 19 nt, Human
aagauuuggucauugauaa

SEQ ID NO: 807452 - RNA, 17 nt, Human
ccaggagagaugcuugu

SEQ ID NO: 807453 - RNA, 21 nt, Human
uuucucauaaaauacucauua

SEQ ID NO: 807454 - RNA, 22 nt, Human
ggacaggcccggggagccugga

SEQ ID NO: 807455 - RNA, 22 nt, Human
uaugagaaauugcugauauuug

SEQ ID NO: 807456 - RNA, 22 nt, Human
uaaucacaauucagaugucuua

SEQ ID NO: 807457 - RNA, 22 nt, Human
gagaggcaggaauccuggguga

SEQ ID NO: 807458 - RNA, 22 nt, Human
ggugucaaaauaccauuucagg

SEQ ID NO: 807459 - RNA, 22 nt, Human
auagaauuuguacuuguagaac

SEQ ID NO: 807460 - RNA, 22 nt, Human
cuuguuuucuucugcagucuau

SEQ ID NO: 807461 - RNA, 23 nt, Human
aggcaaggguguaaaggaaauga

SEQ ID NO: 807462 - RNA, 22 nt, Human
uagucagauauaugacuuacgu

SEQ ID NO: 807463 - RNA, 22 nt, Human
gaguccuggaacccugaaugcu

SEQ ID NO: 807464 - RNA, 22 nt, Human
ucaggcuguuccuguccaaaau

SEQ ID NO: 807465 - RNA, 22 nt, Human
aagacaauguuucugauagaua

SEQ ID NO: 807466 - RNA, 22 nt, Human
auacccuuuacaggaacagcaa

SEQ ID NO: 807467 - RNA, 22 nt, Human
caaguuguuuaggagguguugu

SEQ ID NO: 807468 - RNA, 19 nt, Human
aaucaggagccuaauuagg

SEQ ID NO: 807469 - RNA, 22 nt, Human
cugggggcagcaagaagccaug

SEQ ID NO: 807470 - RNA, 22 nt, Human
ucucacagcaggggccaggucu

SEQ ID NO: 807471 - RNA, 22 nt, Human
cuacacuagaguugcaauggaa

SEQ ID NO: 807472 - RNA, 22 nt, Human
cuccugucaauaggcuccuggc

SEQ ID NO: 807473 - RNA, 18 nt, Human
ccucaggggaccuggcag

SEQ ID NO: 807474 - RNA, 22 nt, Human
uccagggacacagaguccuucu

SEQ ID NO: 807475 - RNA, 22 nt, Human
aagaacauugauauugucuaug

SEQ ID NO: 807476 - RNA, 22 nt, Human
uccuccccucagggcaacggau

SEQ ID NO: 807477 - RNA, 22 nt, Human
gggcaaggcagaagaguuggag

SEQ ID NO: 807478 - RNA, 22 nt, Human
guaaacaucagccacucuauuu

SEQ ID NO: 807479 - RNA, 22 nt, Human
cuggagucucuucuguagcuac

SEQ ID NO: 807480 - RNA, 22 nt, Human
ccuguguccuaauccaucaggc

SEQ ID NO: 807481 - RNA, 19 nt, Human
ccauuguaaagaaaaaugu

SEQ ID NO: 807482 - RNA, 19 nt, Human
ggcuccuguggcugcagcc

SEQ ID NO: 807483 - RNA, 22 nt, Human
ggagccugcgggagcucccauu

SEQ ID NO: 807484 - RNA, 22 nt, Human
guuuuuacuaagguugcuaagu

SEQ ID NO: 807485 - RNA, 22 nt, Human
acuccugguuuguguccuggcu

SEQ ID NO: 807486 - RNA, 22 nt, Human
aaaggcucuaacaaggagagag

SEQ ID NO: 807487 - RNA, 22 nt, Human
ggagccagaguuuaauguggag

SEQ ID NO: 807488 - RNA, 22 nt, Human
accccaggucaucugagagucc

SEQ ID NO: 807489 - RNA, 22 nt, Human
agucuucugcucugucacuaac

SEQ ID NO: 807490 - RNA, 22 nt, Human
uugcaaauuauuuuagucccuu

SEQ ID NO: 807491 - RNA, 22 nt, Human
accaggcugugaagugagacua

SEQ ID NO: 807492 - RNA, 22 nt, Human
gaggccauaagaaguucuuggg

SEQ ID NO: 807493 - RNA, 22 nt, Human
ggcaggcagaaaaauagaauau

SEQ ID NO: 807494 - RNA, 23 nt, Human
ugggguugaauuguagcugugcc

SEQ ID NO: 807495 - RNA, 22 nt, Human
auaugggggggcgugcagagga

SEQ ID NO: 807496 - RNA, 22 nt, Human
uggcccugcuggacacgccugc

SEQ ID NO: 807497 - RNA, 22 nt, Human
caucacaaauguaauaaugucu

SEQ ID NO: 807498 - RNA, 22 nt, Human
agucucuuaauuuuuucuaagu

SEQ ID NO: 807499 - RNA, 22 nt, Human
auagaaacagaggucaggcauu

SEQ ID NO: 807500 - RNA, 22 nt, Human
cugugcuugcggguguggagcc

SEQ ID NO: 807501 - RNA, 22 nt, Human
agaaauguucuucauuugccau

SEQ ID NO: 807502 - RNA, 22 nt, Human
ucaggauccauagacucccaaa

SEQ ID NO: 807503 - RNA, 23 nt, Human
ugccagcagggaaugggaaggac

SEQ ID NO: 807504 - RNA, 22 nt, Human
ucuccuggagcaggaagguggg

SEQ ID NO: 807505 - RNA, 22 nt, Human
acuuagcugugugauuuccauu

SEQ ID NO: 807506 - RNA, 22 nt, Human
ccucagcauccucaugcucagu

SEQ ID NO: 807507 - RNA, 22 nt, Human
cugcugagaaaagacugaggga

SEQ ID NO: 807508 - RNA, 22 nt, Human
agggcagcggugcuuguguuau

SEQ ID NO: 807509 - RNA, 22 nt, Human
aaagugcauucgaaaguccauc

SEQ ID NO: 807510 - RNA, 22 nt, Human
uuuucuccuuucaagauagcau

SEQ ID NO: 807511 - RNA, 23 nt, Human
uauacacauguggcaguauagug

SEQ ID NO: 807512 - RNA, 22 nt, Human
cuggaaggcagagguugcagug

SEQ ID NO: 807513 - RNA, 22 nt, Human
ucacaagauauuucaguccuuu

SEQ ID NO: 807514 - RNA, 22 nt, Human
uguggaaaaaccacaaguuugg

SEQ ID NO: 807515 - RNA, 22 nt, Human
aguucuuucuagacacguagac

SEQ ID NO: 807516 - RNA, 22 nt, Human
aggccuggccuuuauguucaag

SEQ ID NO: 807517 - RNA, 22 nt, Human
aaauuuuguauucuaguucuag

SEQ ID NO: 807518 - RNA, 22 nt, Human
gagaggcugauccugcagagaa

SEQ ID NO: 807519 - RNA, 22 nt, Human
ucagcaaggcugcauucucauc

SEQ ID NO: 807520 - RNA, 22 nt, Human
gucccaggcagagucaggaggg

SEQ ID NO: 807521 - RNA, 22 nt, Human
gcagcuggugcaaaugucacuc

SEQ ID NO: 807522 - RNA, 23 nt, Human
cagaagacagucucaagacaagg

SEQ ID NO: 807523 - RNA, 22 nt, Human
ggugggugaaaucuaggugugu

SEQ ID NO: 807524 - RNA, 22 nt, Human
uggaagucccuguguguggccu

SEQ ID NO: 807525 - RNA, 20 nt, Human
ugucugaaaaggaagcuauc

SEQ ID NO: 807526 - RNA, 16 nt, Human
cagcuuugucuccucg

SEQ ID NO: 807527 - RNA, 22 nt, Human
ggagaugggggauuuuacagcg

SEQ ID NO: 807528 - RNA, 22 nt, Human
ugggccagcaauugcugcucag

SEQ ID NO: 807529 - RNA, 22 nt, Human
aacaguaguauuuaaacugaac

SEQ ID NO: 807530 - RNA, 22 nt, Human
uuuuaugucauaaggacacuca

SEQ ID NO: 807531 - RNA, 22 nt, Human
agcaggaggguuuuguagaguc

SEQ ID NO: 807532 - RNA, 22 nt, Human
gugcaauauugccauguucuug

SEQ ID NO: 807533 - RNA, 22 nt, Human
agcagaaaacuuucaugcucug

SEQ ID NO: 807534 - RNA, 22 nt, Human
gcagggaccuaugacgauggaa

SEQ ID NO: 807535 - RNA, 22 nt, Human
aucaugcugacacaguuuaucu

SEQ ID NO: 807536 - RNA, 22 nt, Human
cuuauacacccucuucccaggc

SEQ ID NO: 807537 - RNA, 22 nt, Human
guuauauaagacaaaucagagu

SEQ ID NO: 807538 - RNA, 22 nt, Human
gucaacuugcaagaugcugggc

SEQ ID NO: 807539 - RNA, 22 nt, Human
uaaagacaauuucgagcuguag

SEQ ID NO: 807540 - RNA, 22 nt, Human
ucaguuuuaagguuugagaauu

SEQ ID NO: 807541 - RNA, 22 nt, Human
aaggccucuucucucuggagau

SEQ ID NO: 807542 - RNA, 22 nt, Human
gugccagggggcacugaacaga

SEQ ID NO: 807543 - RNA, 18 nt, Human
acagggagggcgcugggg

SEQ ID NO: 807544 - RNA, 22 nt, Human
acuuuggacaauuuauuacugu

SEQ ID NO: 807545 - RNA, 22 nt, Human
gcaggcaccacggcucaggucu

SEQ ID NO: 807546 - RNA, 22 nt, Human
uuucuacaugucaauccaaacc

SEQ ID NO: 807547 - RNA, 22 nt, Human
ugccaggauggccagggggcca

SEQ ID NO: 807548 - RNA, 22 nt, Human
acaggcuuacaggcugcaagua

SEQ ID NO: 807549 - RNA, 22 nt, Human
auacaaguugugauaauguaaa

SEQ ID NO: 807550 - RNA, 22 nt, Human
cagcugcuuucagcaggaggga

SEQ ID NO: 807551 - RNA, 22 nt, Human
ugggccagaggcauggagcuau

SEQ ID NO: 807552 - RNA, 22 nt, Human
acaugcaagccccugaacacau

SEQ ID NO: 807553 - RNA, 22 nt, Human
ugucauggacagauuagaugag

SEQ ID NO: 807554 - RNA, 23 nt, Human
uucuucagccuuauagcccuggg

SEQ ID NO: 807555 - RNA, 23 nt, Human
gggaccaggcccuuccugguuug

SEQ ID NO: 807556 - RNA, 22 nt, Human
aaaguagcccuucuggaauuua

SEQ ID NO: 807557 - RNA, 22 nt, Human
aacccaggguggagguugcagu

SEQ ID NO: 807558 - RNA, 22 nt, Human
ugcccagccaguuuaugguaau

SEQ ID NO: 807559 - RNA, 22 nt, Human
gcuccaggagagggaagcagau

SEQ ID NO: 807560 - RNA, 22 nt, Human
acacacagcgccuaccaugugc

SEQ ID NO: 807561 - RNA, 22 nt, Human
uccuuuuuaagucguuguggua

SEQ ID NO: 807562 - RNA, 22 nt, Human
acuaaacauucuugucucucaa

SEQ ID NO: 807563 - RNA, 22 nt, Human
aacaauguucuuuuagcuugaa

SEQ ID NO: 807564 - RNA, 22 nt, Human
cuuuggaaucauugcuuauuca

SEQ ID NO: 807565 - RNA, 22 nt, Human
gccucugcugcaagccugguug

SEQ ID NO: 807566 - RNA, 22 nt, Human
guuccugggaggcaugggcugg

SEQ ID NO: 807567 - RNA, 22 nt, Human
uagggcaggugaagaaaagcua

SEQ ID NO: 807568 - RNA, 23 nt, Human
ccaguaaacccuuccucaguguc

SEQ ID NO: 807569 - RNA, 22 nt, Human
auuuucaguguaaauguuuuau

SEQ ID NO: 807570 - RNA, 22 nt, Human
cugacagcugcugccgccgcau

SEQ ID NO: 807571 - RNA, 22 nt, Human
cuggcugggguccauccucuaa

SEQ ID NO: 807572 - RNA, 22 nt, Human
uuccccucucagaucuggccua

SEQ ID NO: 807573 - RNA, 22 nt, Human
gaacacagcggggcuuacccgg

SEQ ID NO: 807574 - RNA, 22 nt, Human
uaggcaugcaaauaaaugugca

SEQ ID NO: 807575 - RNA, 22 nt, Human
cagaagccuaaauagugcacca

SEQ ID NO: 807576 - RNA, 22 nt, Human
guguucuuuauuuagugaugcu

SEQ ID NO: 807577 - RNA, 22 nt, Human
ugagcauuggaucaaaugacuu

SEQ ID NO: 807578 - RNA, 22 nt, Human
aggcacaggaaugucauccagu

SEQ ID NO: 807579 - RNA, 22 nt, Human
uggccccuggcacacggaggau

SEQ ID NO: 807580 - RNA, 22 nt, Human
ugcuggaaaguuaaauuuugga

SEQ ID NO: 807581 - RNA, 22 nt, Human
ugaggcuggcaaggcugguauu

SEQ ID NO: 807582 - RNA, 22 nt, Human
ucagaggagcaaaagaggggau

SEQ ID NO: 807583 - RNA, 22 nt, Human
gagcuuugcauuauucagaagc

SEQ ID NO: 807584 - RNA, 22 nt, Human
uugagaagguggucauuugcaa

SEQ ID NO: 807585 - RNA, 22 nt, Human
uuauuucuugucuauguagcca

SEQ ID NO: 807586 - RNA, 22 nt, Human
gagguagggcagaggcugaaug

SEQ ID NO: 807587 - RNA, 22 nt, Human
gguccaggaucaaggcaucacc

SEQ ID NO: 807588 - RNA, 22 nt, Human
uauuagaaagcuuaauaucgug

SEQ ID NO: 807589 - RNA, 22 nt, Human
aauagcaaacagacaugcacaa

SEQ ID NO: 807590 - RNA, 22 nt, Human
acacauucuuuaaaugucuguu

SEQ ID NO: 807591 - RNA, 20 nt, Human
uccugggguaagccaugguc

SEQ ID NO: 807592 - RNA, 23 nt, Human
aauuaccaugcaacuugugaaac

SEQ ID NO: 807593 - RNA, 22 nt, Human
ugcacuggggucccagcgcacg

SEQ ID NO: 807594 - RNA, 22 nt, Human
aguauuuguugauugauaugaa

SEQ ID NO: 807595 - RNA, 22 nt, Human
cccagggacagaugggcagcua

SEQ ID NO: 807596 - RNA, 22 nt, Human
aagacaagccuuguuuuucugc

SEQ ID NO: 807597 - RNA, 22 nt, Human
auggaggaugugcagcaugggc

SEQ ID NO: 807598 - RNA, 17 nt, Human
uuacaacaauucaugag

SEQ ID NO: 807599 - RNA, 17 nt, Human
caggcagacauguaagc

SEQ ID NO: 807600 - RNA, 22 nt, Human
uucaacuagaggugauuuugcc

SEQ ID NO: 807601 - RNA, 22 nt, Human
acuguuuuccuaaugagcaaga

SEQ ID NO: 807602 - RNA, 22 nt, Human
aaguucacagaagauuccaauu

SEQ ID NO: 807603 - RNA, 22 nt, Human
agagcuggaagcugcucuuaga

SEQ ID NO: 807604 - RNA, 22 nt, Human
agcuucaacuuacuaaaagaua

SEQ ID NO: 807605 - RNA, 22 nt, Human
acagauaauuagcauaaaugcu

SEQ ID NO: 807606 - RNA, 22 nt, Human
cagcugagucugagguucuuug

SEQ ID NO: 807607 - RNA, 22 nt, Human
gaguggcauaugugccugugaa

SEQ ID NO: 807608 - RNA, 22 nt, Human
uuaagucaauaucaaucucagc

SEQ ID NO: 807609 - RNA, 23 nt, Human
ucucauuucccuugaucuaucuu

SEQ ID NO: 807610 - RNA, 22 nt, Human
uacaaaguauauuucuagcugu

SEQ ID NO: 807611 - RNA, 22 nt, Human
gccucucugggcugccgaggcu

SEQ ID NO: 807612 - RNA, 22 nt, Human
auauuucaugggguuccauacu

SEQ ID NO: 807613 - RNA, 22 nt, Human
gcagaggauagcauaugaaccu

SEQ ID NO: 807614 - RNA, 22 nt, Human
gaaauacaaagccagccauuuu

SEQ ID NO: 807615 - RNA, 22 nt, Human
cagugcaauuacaagcuaauuc

SEQ ID NO: 807616 - RNA, 22 nt, Human
auauauacaacuagauuaaaag

SEQ ID NO: 807617 - RNA, 22 nt, Human
uccagggcaggugcugggcucu

SEQ ID NO: 807618 - RNA, 22 nt, Human
aucuuuggugcaugauacuuug

SEQ ID NO: 807619 - RNA, 22 nt, Human
ggcuggcaagugucugcucaug

SEQ ID NO: 807620 - RNA, 22 nt, Human
aguaaauuauuuagcuuccaga

SEQ ID NO: 807621 - RNA, 22 nt, Human
ugugucaaggcaucagcccagc

SEQ ID NO: 807622 - RNA, 22 nt, Human
gcuuuggaugugugccugaggu

SEQ ID NO: 807623 - RNA, 22 nt, Human
agcaacuauauugaaagccacc

SEQ ID NO: 807624 - RNA, 19 nt, Human
cuuccuggaggagagccuc

SEQ ID NO: 807625 - RNA, 22 nt, Human
agcagagcuuuuuggacucaga

SEQ ID NO: 807626 - RNA, 22 nt, Human
uaaauuagagccagguaaguuu

SEQ ID NO: 807627 - RNA, 22 nt, Human
aggcagggcucauuucuuaggc

SEQ ID NO: 807628 - RNA, 22 nt, Human
aaacucuaagacacuguacaau

SEQ ID NO: 807629 - RNA, 22 nt, Human
cagucccacaagaucuccacaa

SEQ ID NO: 807630 - RNA, 22 nt, Human
caugcuauuuauacauaagucu

SEQ ID NO: 807631 - RNA, 22 nt, Human
uuugaaaacuuaauuuggucgu

SEQ ID NO: 807632 - RNA, 23 nt, Human
acagagacaaugguuucaucuug

SEQ ID NO: 807633 - RNA, 22 nt, Human
uugggagauggggagauaauau

SEQ ID NO: 807634 - RNA, 22 nt, Human
auaaaauuugcuacuguuaaau

SEQ ID NO: 807635 - RNA, 22 nt, Human
gcuguauuuauuuucuaggguu

SEQ ID NO: 807636 - RNA, 22 nt, Human
cagaggcugaugugggaugggc

SEQ ID NO: 807637 - RNA, 22 nt, Human
agacaggccacucuggucuggu

SEQ ID NO: 807638 - RNA, 22 nt, Human
ccuggcugaacaaagucccucc

SEQ ID NO: 807639 - RNA, 22 nt, Human
agagucagcuuaugacacaguc

SEQ ID NO: 807640 - RNA, 22 nt, Human
gagggaggcaucaugaauccag

SEQ ID NO: 807641 - RNA, 22 nt, Human
aaugucugaaaaucagacugca

SEQ ID NO: 807642 - RNA, 22 nt, Human
ugagcuggcuugucaaccaggg

SEQ ID NO: 807643 - RNA, 22 nt, Human
agucuuauaucacuaugcucug

SEQ ID NO: 807644 - RNA, 22 nt, Human
gaaauauacauugcaggaagag

SEQ ID NO: 807645 - RNA, 22 nt, Human
agccagaaaaacaccaagagga

SEQ ID NO: 807646 - RNA, 22 nt, Human
aauauuaauagaagggguucua

SEQ ID NO: 807647 - RNA, 22 nt, Human
guuacaaauguaaauucugggg

SEQ ID NO: 807648 - RNA, 22 nt, Human
uaacaacucaguuuguuccuug

SEQ ID NO: 807649 - RNA, 17 nt, Human
aggccucccuccaggcc

SEQ ID NO: 807650 - RNA, 22 nt, Human
uggaaccaucaaagagauccug

SEQ ID NO: 807651 - RNA, 22 nt, Human
aaugucugcucuacucaggagg

SEQ ID NO: 807652 - RNA, 22 nt, Human
cagcuuugaaacauggcucuag

SEQ ID NO: 807653 - RNA, 22 nt, Human
uuauuuaaaagugguaagauuc

SEQ ID NO: 807654 - RNA, 22 nt, Human
uacacaugcauguacuccagga

SEQ ID NO: 807655 - RNA, 22 nt, Human
caguaaggaugcacauaacuag

SEQ ID NO: 807656 - RNA, 22 nt, Human
ucuaucuggccccuuuuauaua

SEQ ID NO: 807657 - RNA, 22 nt, Human
gugugcagggggccagcgcagc

SEQ ID NO: 807658 - RNA, 22 nt, Human
uuccaggauagcuuucaggaau

SEQ ID NO: 807659 - RNA, 22 nt, Human
uccagagagccacggacagggg

SEQ ID NO: 807660 - RNA, 22 nt, Human
ccugugccagcugggcccugcc

SEQ ID NO: 807661 - RNA, 22 nt, Human
cuucuucagaggccagccucug

SEQ ID NO: 807662 - RNA, 22 nt, Human
gggccccacuggggcugccugc

SEQ ID NO: 807663 - RNA, 22 nt, Human
agagccuguuuugugggagaug

SEQ ID NO: 807664 - RNA, 22 nt, Human
uuuaaaaaacuagucugagucu

SEQ ID NO: 807665 - RNA, 17 nt, Human
aggcuggccuucacagu

SEQ ID NO: 807666 - RNA, 22 nt, Human
agaaacucauccuggagaugac

SEQ ID NO: 807667 - RNA, 22 nt, Human
agccaggcucaaggccugcucc

SEQ ID NO: 807668 - RNA, 22 nt, Human
gcuggaggaucacuugagccca

SEQ ID NO: 807669 - RNA, 22 nt, Human
ugcccaggcuucacccucagag

SEQ ID NO: 807670 - RNA, 22 nt, Human
gcacugggaaugugagcagcug

SEQ ID NO: 807671 - RNA, 22 nt, Human
gcaggucuugaaggugugauuu

SEQ ID NO: 807672 - RNA, 22 nt, Human
aauucacaaaaccagauugcuu

SEQ ID NO: 807673 - RNA, 22 nt, Human
aaacauagauaauagauagaug

SEQ ID NO: 807674 - RNA, 22 nt, Human
ugcuggaguucgacauugcaaa

SEQ ID NO: 807675 - RNA, 22 nt, Human
uugaccacugaaugguucugaa

SEQ ID NO: 807676 - RNA, 22 nt, Human
ccaggcacuuguuugccaggca

SEQ ID NO: 807677 - RNA, 22 nt, Human
aacugcaauaacuugugcacca

SEQ ID NO: 807678 - RNA, 19 nt, Human
ugggccucucauaucugcc

SEQ ID NO: 807679 - RNA, 22 nt, Human
ggcugaggguauagcuguccca

SEQ ID NO: 807680 - RNA, 22 nt, Human
agacagggucuugaucagagcu

SEQ ID NO: 807681 - RNA, 22 nt, Human
aggcucaagcacugauauuuuu

SEQ ID NO: 807682 - RNA, 22 nt, Human
cacauaaauggugccauguuuu

SEQ ID NO: 807683 - RNA, 23 nt, Human
uggacaggguaacuggugguuuu

SEQ ID NO: 807684 - RNA, 22 nt, Human
caguuauuuugaggauuaaaug

SEQ ID NO: 807685 - RNA, 22 nt, Human
acagaaauucaaacuggaauuu

SEQ ID NO: 807686 - RNA, 22 nt, Human
aggaaggguucuuucuguuuau

SEQ ID NO: 807687 - RNA, 22 nt, Human
gcuggcaggagaaacggggugc

SEQ ID NO: 807688 - RNA, 22 nt, Human
caggguggccagguagauaaua

SEQ ID NO: 807689 - RNA, 22 nt, Human
uccccaggaaauucugauucuu

SEQ ID NO: 807690 - RNA, 22 nt, Human
gcuggcucgggaagcaggggau

SEQ ID NO: 807691 - RNA, 22 nt, Human
gaaauuuauuaucuacaucauu

SEQ ID NO: 807692 - RNA, 22 nt, Human
uagcuuugccuguuaaucacaa

SEQ ID NO: 807693 - RNA, 23 nt, Human
uuuagucaguugacagccauaua

SEQ ID NO: 807694 - RNA, 22 nt, Human
uucugaaaacacacuuugcagc

SEQ ID NO: 807695 - RNA, 22 nt, Human
gcuggcagagagcuggugagga

SEQ ID NO: 807696 - RNA, 22 nt, Human
aggcagcuuucagugucucuca

SEQ ID NO: 807697 - RNA, 21 nt, Human
cuggaggcagguggugccagg

SEQ ID NO: 807698 - RNA, 22 nt, Human
gcauggcagccaguacauggug

SEQ ID NO: 807699 - RNA, 22 nt, Human
uagccagugaauguuuccagug

SEQ ID NO: 807700 - RNA, 22 nt, Human
uggcagauaaaauaauagggaa

SEQ ID NO: 807701 - RNA, 22 nt, Human
aaguaaauguuggagcucaaau

SEQ ID NO: 807702 - RNA, 22 nt, Human
acccagccacagcauugaggga

SEQ ID NO: 807703 - RNA, 22 nt, Human
uagaaacaaugacaugcuugua

SEQ ID NO: 807704 - RNA, 22 nt, Human
uucuggauuauguguaagugaa

SEQ ID NO: 807705 - RNA, 22 nt, Human
ggcuaggggaauaaucuguggu

SEQ ID NO: 807706 - RNA, 22 nt, Human
augaaggcaguuuuauaagauu

SEQ ID NO: 807707 - RNA, 22 nt, Human
ggcucagcaaugaugagccccu

SEQ ID NO: 807708 - RNA, 22 nt, Human
uggggcugucccgguuuggcga

SEQ ID NO: 807709 - RNA, 22 nt, Human
auuaauuuuucugacagccaca

SEQ ID NO: 807710 - RNA, 22 nt, Human
uccaggcaaagugcugggcugc

SEQ ID NO: 807711 - RNA, 19 nt, Human
caguggagauuggaggagg

SEQ ID NO: 807712 - RNA, 22 nt, Human
gcucaggaaggcucaaccagga

SEQ ID NO: 807713 - RNA, 22 nt, Human
ugcaauaaguauugcuuacaug

SEQ ID NO: 807714 - RNA, 22 nt, Human
uggagccagcgagccgaggcgg

SEQ ID NO: 807715 - RNA, 22 nt, Human
gaggcagcugggcuggugguuu

SEQ ID NO: 807716 - RNA, 22 nt, Human
cugccagcucaccggcucagac

SEQ ID NO: 807717 - RNA, 20 nt, Human
uuuauucacagagaagaguu

SEQ ID NO: 807718 - RNA, 22 nt, Human
acauuucagauguaaugugaug

SEQ ID NO: 807719 - RNA, 22 nt, Human
guugcugcaaaggaguguaggu

SEQ ID NO: 807720 - RNA, 22 nt, Human
ucacaggguaucugggauggau

SEQ ID NO: 807721 - RNA, 23 nt, Human
agguuaugauuauagagcgagga

SEQ ID NO: 807722 - RNA, 22 nt, Human
aguacaaaggcccuugauuacu

SEQ ID NO: 807723 - RNA, 22 nt, Human
aggcaguguucuucuaagggca

SEQ ID NO: 807724 - RNA, 22 nt, Human
uugcaaaugguaccaagggucu

SEQ ID NO: 807725 - RNA, 22 nt, Human
aagcagggcuagaccaagaaga

SEQ ID NO: 807726 - RNA, 22 nt, Human
ucauauauuuuggcagugauca

SEQ ID NO: 807727 - RNA, 22 nt, Human
ugggccagggcacccaguccag

SEQ ID NO: 807728 - RNA, 23 nt, Human
ugcuggcuguguuauugccaaca

SEQ ID NO: 807729 - RNA, 22 nt, Human
gugaggagcugacacuggggug

SEQ ID NO: 807730 - RNA, 23 nt, Human
cccuggccuuggggcacaggcug

SEQ ID NO: 807731 - RNA, 22 nt, Human
ugugucuuuggcgaugucugga

SEQ ID NO: 807732 - RNA, 22 nt, Human
cauguauugaagugugcaucug

SEQ ID NO: 807733 - RNA, 22 nt, Human
acaucaucgugcacauacauaa

SEQ ID NO: 807734 - RNA, 23 nt, Human
ggguccagagacaggcaugggug

SEQ ID NO: 807735 - RNA, 22 nt, Human
caucacaguuugucagaaauca

SEQ ID NO: 807736 - RNA, 22 nt, Human
gcagagauccuugcuggaugac

SEQ ID NO: 807737 - RNA, 22 nt, Human
ugcaauaacuacuuuaauguug

SEQ ID NO: 807738 - RNA, 22 nt, Human
cagcaggccaugcugcuuuuca

SEQ ID NO: 807739 - RNA, 22 nt, Human
caggaaauuuaagaguguacaa

SEQ ID NO: 807740 - RNA, 22 nt, Human
ggauguucugggguucucuugu

SEQ ID NO: 807741 - RNA, 22 nt, Human
uucuucagagaguagaagcaag

SEQ ID NO: 807742 - RNA, 22 nt, Human
uuaacauuguccuuagcagauu

SEQ ID NO: 807743 - RNA, 22 nt, Human
aaguguuuacuuaaagucaugg

SEQ ID NO: 807744 - RNA, 22 nt, Human
uccuggcacauugcaggggcuc

SEQ ID NO: 807745 - RNA, 22 nt, Human
ggcugcuggcauugagguaggu

SEQ ID NO: 807746 - RNA, 22 nt, Human
aaaaagacagaggaugaggcag

SEQ ID NO: 807747 - RNA, 22 nt, Human
agaauaaaauagucugaagaug

SEQ ID NO: 807748 - RNA, 22 nt, Human
gcugccauccccugcugggcug

SEQ ID NO: 807749 - RNA, 22 nt, Human
ugggccagcacugggugcucau

SEQ ID NO: 807750 - RNA, 22 nt, Human
uaugcaaacaguucaggugaca

SEQ ID NO: 807751 - RNA, 22 nt, Human
aaagcagagguugcagugagcu

SEQ ID NO: 807752 - RNA, 22 nt, Human
uucuuugguguuacccagcuca

SEQ ID NO: 807753 - RNA, 22 nt, Human
cugggagcuuguuaggaaugca

SEQ ID NO: 807754 - RNA, 22 nt, Human
caggagcucucaucgucagggc

SEQ ID NO: 807755 - RNA, 21 nt, Human
uuuggcuucucugcugcagcc

SEQ ID NO: 807756 - RNA, 20 nt, Human
aguggccacugcagagaugc

SEQ ID NO: 807757 - RNA, 22 nt, Human
augaaauggugguuuuccauuu

SEQ ID NO: 807758 - RNA, 22 nt, Human
ggccuccaucuuaucuuacucu

SEQ ID NO: 807759 - RNA, 22 nt, Human
uccucaggauguggaguagaau

SEQ ID NO: 807760 - RNA, 22 nt, Human
acuauguacccaaagaucugau

SEQ ID NO: 807761 - RNA, 22 nt, Human
ucuccuggaagugauuccccug

SEQ ID NO: 807762 - RNA, 22 nt, Human
augcaaauucuuugcuucuucu

SEQ ID NO: 807763 - RNA, 22 nt, Human
uggagaugccuggagauuaggg

SEQ ID NO: 807764 - RNA, 22 nt, Human
uggcuggcugucaguaggcugu

SEQ ID NO: 807765 - RNA, 22 nt, Human
uagaaacauucaguugcagucc

SEQ ID NO: 807766 - RNA, 22 nt, Human
ucaaaacacuauuaccuuuaau

SEQ ID NO: 807767 - RNA, 22 nt, Human
cugacagccauguuuuagagaa

SEQ ID NO: 807768 - RNA, 22 nt, Human
aauaagauccugaagauauguu

SEQ ID NO: 807769 - RNA, 22 nt, Human
uauuauugaaucaguucuuuga

SEQ ID NO: 807770 - RNA, 23 nt, Human
ugccaggguuuguuugugguuca

SEQ ID NO: 807771 - RNA, 22 nt, Human
aaagccagguugugugcaggaa

SEQ ID NO: 807772 - RNA, 22 nt, Human
agagcuggcugguagcccugau

SEQ ID NO: 807773 - RNA, 22 nt, Human
agcagcugguucccgagggcgu

SEQ ID NO: 807774 - RNA, 22 nt, Human
ugggacagauuauaagucugca

SEQ ID NO: 807775 - RNA, 22 nt, Human
uggcaaagauuaccacaucuac

SEQ ID NO: 807776 - RNA, 22 nt, Human
uucuuuaccagugaaauguuau

SEQ ID NO: 807777 - RNA, 22 nt, Human
uccucagcauggaaucuggacu

SEQ ID NO: 807778 - RNA, 22 nt, Human
gcagaggagcaagcuggacacc

SEQ ID NO: 807779 - RNA, 22 nt, Human
cacuugaacccgggaggcugag

SEQ ID NO: 807780 - RNA, 22 nt, Human
agcuuguaacagacauaaaaau

SEQ ID NO: 807781 - RNA, 22 nt, Human
acacaguauugugacuauaacu

SEQ ID NO: 807782 - RNA, 22 nt, Human
aaucacaauuacuuuugcacca

SEQ ID NO: 807783 - RNA, 22 nt, Human
augcaacauacauucugaagcu

SEQ ID NO: 807784 - RNA, 22 nt, Human
uauuauugcaaguauauaaagu

SEQ ID NO: 807785 - RNA, 22 nt, Human
cauuucauaguugucacaauaa

SEQ ID NO: 807786 - RNA, 22 nt, Human
ccuggcuaggagagcugggcuc

SEQ ID NO: 807787 - RNA, 22 nt, Human
gauuuugucaaauuccaaaugu

SEQ ID NO: 807788 - RNA, 22 nt, Human
gccacagggcagaugcgcagag

SEQ ID NO: 807789 - RNA, 22 nt, Human
aggcacagugccuggaaucaaa

SEQ ID NO: 807790 - RNA, 22 nt, Human
gccccaccgagggugcaguccu

SEQ ID NO: 807791 - RNA, 22 nt, Human
gcuggagaaacugcagcugagg

SEQ ID NO: 807792 - RNA, 22 nt, Human
acugucaagagauucaaauuca

SEQ ID NO: 807793 - RNA, 22 nt, Human
gcagugggagcuuaggcagugc

SEQ ID NO: 807794 - RNA, 22 nt, Human
augcaaaugaacauguugcuag

SEQ ID NO: 807795 - RNA, 22 nt, Human
auguauugucucuuuuccuuaa

SEQ ID NO: 807796 - RNA, 22 nt, Human
cauggggcccaugugcuccaag

SEQ ID NO: 807797 - RNA, 22 nt, Human
agucacugguucuguaauuaau

SEQ ID NO: 807798 - RNA, 22 nt, Human
gccuggcuggucacugccuggc

SEQ ID NO: 807799 - RNA, 22 nt, Human
ggccugcugcagugugacaguu

SEQ ID NO: 807800 - RNA, 22 nt, Human
gggcccaguacccucugccaag

SEQ ID NO: 807801 - RNA, 22 nt, Human
accuccccacaugguagugagu

SEQ ID NO: 807802 - RNA, 22 nt, Human
uuuauaugugaagguuugcaga

SEQ ID NO: 807803 - RNA, 22 nt, Human
acuuugaaacuaaaauucauua

SEQ ID NO: 807804 - RNA, 22 nt, Human
uccugggcuuaguggcuagguc

SEQ ID NO: 807805 - RNA, 22 nt, Human
uggcaggagccugcggggaggu

SEQ ID NO: 807806 - RNA, 22 nt, Human
cuuucagggcaacacuucuuuu

SEQ ID NO: 807807 - RNA, 22 nt, Human
aucagaauggagcccacauggu

SEQ ID NO: 807808 - RNA, 22 nt, Human
gggcagaugucuggacaccuca

SEQ ID NO: 807809 - RNA, 22 nt, Human
cagauaaauagauagauaaacu

SEQ ID NO: 807810 - RNA, 22 nt, Human
ugacagaaauaguucuuaauuu

SEQ ID NO: 807811 - RNA, 22 nt, Human
gauagagacuauaaugcucuuu

SEQ ID NO: 807812 - RNA, 22 nt, Human
auacaugucaucauauguuugu

SEQ ID NO: 807813 - RNA, 22 nt, Human
ugucauuuucagcuuaugcuuc

SEQ ID NO: 807814 - RNA, 22 nt, Human
uugggaaagccacaaauuggag

SEQ ID NO: 807815 - RNA, 22 nt, Human
caggcucuagguuaguaggaga

SEQ ID NO: 807816 - RNA, 22 nt, Human
uaauaauuaacagugauggguc

SEQ ID NO: 807817 - RNA, 22 nt, Human
ccccugccagcuaucccugaac

SEQ ID NO: 807818 - RNA, 22 nt, Human
cucuuuggagaagcacguauua

SEQ ID NO: 807819 - RNA, 22 nt, Human
uccugcuguuuaccuacaaugg

SEQ ID NO: 807820 - RNA, 22 nt, Human
ugaugcaauguuuacaucuuga

SEQ ID NO: 807821 - RNA, 22 nt, Human
agaaaccuggggguuguacaua

SEQ ID NO: 807822 - RNA, 22 nt, Human
gccuccuggguucaugccauuc

SEQ ID NO: 807823 - RNA, 22 nt, Human
agccagcuguucuggggcagca

SEQ ID NO: 807824 - RNA, 22 nt, Human
cagggacagagacugcaccuug

SEQ ID NO: 807825 - RNA, 18 nt, Human
gcagcugcaguuguagcu

SEQ ID NO: 807826 - RNA, 22 nt, Human
ucauuuuuagcgcgcaaaaguu

SEQ ID NO: 807827 - RNA, 22 nt, Human
agagaucaaagcuugccaagua

SEQ ID NO: 807828 - RNA, 22 nt, Human
aaaguuuuagaacuaggaagca

SEQ ID NO: 807829 - RNA, 22 nt, Human
ucacauuuguguuuuauuagag

SEQ ID NO: 807830 - RNA, 22 nt, Human
auggccagcucagagcacucag

SEQ ID NO: 807831 - RNA, 22 nt, Human
auaugugugccauuucagcagu

SEQ ID NO: 807832 - RNA, 22 nt, Human
cagaugcuuuugauucuggggu

SEQ ID NO: 807833 - RNA, 22 nt, Human
gugcuggacccuggaagguggu

SEQ ID NO: 807834 - RNA, 22 nt, Human
gcuucuccagaccuucaucccc

SEQ ID NO: 807835 - RNA, 22 nt, Human
ucauauuuaggccuuuaauuca

SEQ ID NO: 807836 - RNA, 22 nt, Human
ggaggccaaggaggagcuugcc

SEQ ID NO: 807837 - RNA, 22 nt, Human
ucucauuugccucaucuauaaa

SEQ ID NO: 807838 - RNA, 22 nt, Human
uucauauucaaauacucugcuu

SEQ ID NO: 807839 - RNA, 22 nt, Human
uugaaugaaauugcuguguuau

SEQ ID NO: 807840 - RNA, 22 nt, Human
gcuggccuugugucugaggaag

SEQ ID NO: 807841 - RNA, 22 nt, Human
caaacuuuugaggaguucagga

SEQ ID NO: 807842 - RNA, 22 nt, Human
aaaauugaagugaucaggaacu

SEQ ID NO: 807843 - RNA, 22 nt, Human
uaaguucauuagacuacagaua

SEQ ID NO: 807844 - RNA, 22 nt, Human
cucccuggcagccgcacuccug

SEQ ID NO: 807845 - RNA, 22 nt, Human
uggcucagauuuuuguaggcuu

SEQ ID NO: 807846 - RNA, 22 nt, Human
acugcccuggagacagcagagu

SEQ ID NO: 807847 - RNA, 22 nt, Human
aaaugucuguaugagaaagaga

SEQ ID NO: 807848 - RNA, 21 nt, Human
auuuucauuaauucagugugg

SEQ ID NO: 807849 - RNA, 22 nt, Human
uuucacacaacgugaauauacu

SEQ ID NO: 807850 - RNA, 22 nt, Human
acugccugccuuccagguacug

SEQ ID NO: 807851 - RNA, 22 nt, Human
agaggccagcccaggccaccga

SEQ ID NO: 807852 - RNA, 22 nt, Human
aguggugauaaccgcuaucaua

SEQ ID NO: 807853 - RNA, 20 nt, Human
gaaggcuuggacagugacag

SEQ ID NO: 807854 - RNA, 22 nt, Human
aggggagccccugguccuggug

SEQ ID NO: 807855 - RNA, 22 nt, Human
augcuuaacuuccuagucuaua

SEQ ID NO: 807856 - RNA, 22 nt, Human
ugauucaagagaguugggguau

SEQ ID NO: 807857 - RNA, 22 nt, Human
aggcccuguccauggugcugaa

SEQ ID NO: 807858 - RNA, 22 nt, Human
caaagugcugagauuacaggua

SEQ ID NO: 807859 - RNA, 22 nt, Human
cuggcuggcaaguagaacacaa

SEQ ID NO: 807860 - RNA, 22 nt, Human
uauuuuaucugccagaguggag

SEQ ID NO: 807861 - RNA, 22 nt, Human
ccagggaaguaguugugagagc

SEQ ID NO: 807862 - RNA, 22 nt, Human
gcagccauugagcgaaaaaauc

SEQ ID NO: 807863 - RNA, 22 nt, Human
agugucaagguugagaaacccu

SEQ ID NO: 807864 - RNA, 22 nt, Human
ugcaggcucacccuggagcuga

SEQ ID NO: 807865 - RNA, 22 nt, Human
ucucugaguuguaaaaaauagu

SEQ ID NO: 807866 - RNA, 22 nt, Human
uggcugugggauaugugacuga

SEQ ID NO: 807867 - RNA, 22 nt, Human
acuguucacccagcacuagcag

SEQ ID NO: 807868 - RNA, 22 nt, Human
ggucugaguagagggcuggcga

SEQ ID NO: 807869 - RNA, 22 nt, Human
gagcuggaggcagugcugaggu

SEQ ID NO: 807870 - RNA, 22 nt, Human
ucauuucuuaacuagagugaac

SEQ ID NO: 807871 - RNA, 23 nt, Human
uggcuccaggagaagccagaagc

SEQ ID NO: 807872 - RNA, 22 nt, Human
agacaucaaugaucagagguag

SEQ ID NO: 807873 - RNA, 22 nt, Human
acagggccucagccagggcaga

SEQ ID NO: 807874 - RNA, 22 nt, Human
acaggcuggugguccuggccau

SEQ ID NO: 807875 - RNA, 22 nt, Human
uucuuuuggacucaaagagaac

SEQ ID NO: 807876 - RNA, 22 nt, Human
ugccaggauauaagagugcgau

SEQ ID NO: 807877 - RNA, 22 nt, Human
uagcaaauaaaacaguauugaa

SEQ ID NO: 807878 - RNA, 22 nt, Human
auuuguaaagugcuuaaaagua

SEQ ID NO: 807879 - RNA, 22 nt, Human
aggcuggcauacauuuguucuu

SEQ ID NO: 807880 - RNA, 22 nt, Human
aaaguauucaaaaauauuuggu

SEQ ID NO: 807881 - RNA, 22 nt, Human
guagaauauaugguuaguauug

SEQ ID NO: 807882 - RNA, 22 nt, Human
gaagcacauggcugugagcaac

SEQ ID NO: 807883 - RNA, 22 nt, Human
cugggccaucucucugcaagug

SEQ ID NO: 807884 - RNA, 22 nt, Human
aaaaaugucauuauggaacuga

SEQ ID NO: 807885 - RNA, 22 nt, Human
uguaaauugaaggaaauuugug

SEQ ID NO: 807886 - RNA, 21 nt, Human
ugcuccaggagggggcagucc

SEQ ID NO: 807887 - RNA, 22 nt, Human
cagggcagugaagaacacacgu

SEQ ID NO: 807888 - RNA, 21 nt, Human
gcccagaguuaagcccaccca

SEQ ID NO: 807889 - RNA, 22 nt, Human
cuuuuucccagguggagagagg

SEQ ID NO: 807890 - RNA, 22 nt, Human
uacaugcaugauacaaaguugc

SEQ ID NO: 807891 - RNA, 23 nt, Human
aauuacaaccaagaacuggaagg

SEQ ID NO: 807892 - RNA, 22 nt, Human
agcaggagcugugggaagaugg

SEQ ID NO: 807893 - RNA, 22 nt, Human
aucauacacucacauaaacaga

SEQ ID NO: 807894 - RNA, 22 nt, Human
gugcuucucuucacacccaacu

SEQ ID NO: 807895 - RNA, 22 nt, Human
agcaggcauagaguagcacuca

SEQ ID NO: 807896 - RNA, 22 nt, Human
uuucccaaguguaaacauggca

SEQ ID NO: 807897 - RNA, 22 nt, Human
uuucauguacuuuuuugauaga

SEQ ID NO: 807898 - RNA, 22 nt, Human
uccagcacucgcccagggcuug

SEQ ID NO: 807899 - RNA, 22 nt, Human
caggggcugaaauguugggguu

SEQ ID NO: 807900 - RNA, 22 nt, Human
aaaauugucagaaguugaucuu

SEQ ID NO: 807901 - RNA, 22 nt, Human
uugaggagcaggaugggaggcu

SEQ ID NO: 807902 - RNA, 22 nt, Human
uaggcugggcugagcuggacgg

SEQ ID NO: 807903 - RNA, 21 nt, Human
cagcuccacuaaagcagcugu

SEQ ID NO: 807904 - RNA, 22 nt, Human
auggacaaugccaauacaguuu

SEQ ID NO: 807905 - RNA, 22 nt, Human
ucccugcacccuugcugggccc

SEQ ID NO: 807906 - RNA, 22 nt, Human
cgcaggcuccggggugcccugg

SEQ ID NO: 807907 - RNA, 22 nt, Human
gagggggcgugcaaggcuccgc

SEQ ID NO: 807908 - RNA, 22 nt, Human
agaaacaucauuguuugguauu

SEQ ID NO: 807909 - RNA, 20 nt, Human
cccucugcacauggcugugg

SEQ ID NO: 807910 - RNA, 22 nt, Human
accucccagcucugagcuuggg

SEQ ID NO: 807911 - RNA, 22 nt, Human
agcuacaacuuuuccaugagca

SEQ ID NO: 807912 - RNA, 22 nt, Human
agaauuguucuguagcuuggcu

SEQ ID NO: 807913 - RNA, 20 nt, Human
acaauacagguugugucuga

SEQ ID NO: 807914 - RNA, 22 nt, Human
cugagggaggagaauugcuuga

SEQ ID NO: 807915 - RNA, 22 nt, Human
uacaaacuccgaaguuuguacc

SEQ ID NO: 807916 - RNA, 22 nt, Human
uuuauucacuucagugccaaag

SEQ ID NO: 807917 - RNA, 22 nt, Human
gguaccaccaauucagcugcca

SEQ ID NO: 807918 - RNA, 22 nt, Human
caguggcaagaacaguaauaau

SEQ ID NO: 807919 - RNA, 22 nt, Human
cucugggaccacgugacucugc

SEQ ID NO: 807920 - RNA, 17 nt, Human
aguggcaggcagauggg

SEQ ID NO: 807921 - RNA, 22 nt, Human
uuuacagagagagaacuggacu

SEQ ID NO: 807922 - RNA, 22 nt, Human
uagaaacagcauauauuagccc

SEQ ID NO: 807923 - RNA, 22 nt, Human
ccuccagcauuacuggcccaug

SEQ ID NO: 807924 - RNA, 19 nt, Human
gucaccauuuccaaaugcc

SEQ ID NO: 807925 - RNA, 22 nt, Human
ugggagaacacugcucuggaug

SEQ ID NO: 807926 - RNA, 22 nt, Human
ucagagcugcccaugcaagggg

SEQ ID NO: 807927 - RNA, 22 nt, Human
agugucuggugagggcucucuc

SEQ ID NO: 807928 - RNA, 22 nt, Human
ugcagaggagucagccugggca

SEQ ID NO: 807929 - RNA, 20 nt, Human
gcagugaucucaucggucug

SEQ ID NO: 807930 - RNA, 22 nt, Human
gcaggcucguuggaaguccccu

SEQ ID NO: 807931 - RNA, 22 nt, Human
cauagacaaagaucagaagagu

SEQ ID NO: 807932 - RNA, 22 nt, Human
aauaagaauugccagauuugaa

SEQ ID NO: 807933 - RNA, 22 nt, Human
aacuacuaccacagucaagaca

SEQ ID NO: 807934 - RNA, 19 nt, Human
cucagcuguagcucaugug

SEQ ID NO: 807935 - RNA, 22 nt, Human
uggggccagagauggggcgcag

SEQ ID NO: 807936 - RNA, 22 nt, Human
caggcucuuuugguggcaagga

SEQ ID NO: 807937 - RNA, 22 nt, Human
aaaugucuuucaauagagaaau

SEQ ID NO: 807938 - RNA, 22 nt, Human
uugcuucuaaguauaaauauga

SEQ ID NO: 807939 - RNA, 21 nt, Human
cagggcaaccaaguccagaga

SEQ ID NO: 807940 - RNA, 22 nt, Human
uuuauaaaauagacugggucua

SEQ ID NO: 807941 - RNA, 18 nt, Human
ccuagccuccaagcucau

SEQ ID NO: 807942 - RNA, 22 nt, Human
uuuaccacagaaaaaaguaacu

SEQ ID NO: 807943 - RNA, 22 nt, Human
uuucacauggaagcucucgaga

SEQ ID NO: 807944 - RNA, 22 nt, Human
caugcaaaugguggcuaaaugg

SEQ ID NO: 807945 - RNA, 22 nt, Human
ggggaggccaguggaccguccc

SEQ ID NO: 807946 - RNA, 22 nt, Human
ugucuuuagaaagaagcagaca

SEQ ID NO: 807947 - RNA, 22 nt, Human
ucagggcaggcgagcagcugcu

SEQ ID NO: 807948 - RNA, 22 nt, Human
auacugugugcagaguccuaau

SEQ ID NO: 807949 - RNA, 22 nt, Human
ugcuggcuuucugucccuggca

SEQ ID NO: 807950 - RNA, 22 nt, Human
uccugcugccauuucaagugcu

SEQ ID NO: 807951 - RNA, 22 nt, Human
ccugaguccccucauucacucu

SEQ ID NO: 807952 - RNA, 22 nt, Human
ccaggcugccgaggaaagaaag

SEQ ID NO: 807953 - RNA, 22 nt, Human
ugaaggcuuuuuaaagcauuug

SEQ ID NO: 807954 - RNA, 22 nt, Human
ggcagugccacuaagcucugcu

SEQ ID NO: 807955 - RNA, 22 nt, Human
acacaguucgugcuuuucuauu

SEQ ID NO: 807956 - RNA, 22 nt, Human
cuggcagcucuacucagagccu

SEQ ID NO: 807957 - RNA, 22 nt, Human
ucugguaaccuuuaucccuccu

SEQ ID NO: 807958 - RNA, 22 nt, Human
auaguguugauagcaguggagu

SEQ ID NO: 807959 - RNA, 22 nt, Human
cuggucagggcucuuugggagc

SEQ ID NO: 807960 - RNA, 22 nt, Human
uuucauguuauuaauagugcug

SEQ ID NO: 807961 - RNA, 22 nt, Human
aggcagcuuucuguaggggugu

SEQ ID NO: 807962 - RNA, 22 nt, Human
cuaggaccacuguaacaaagua

SEQ ID NO: 807963 - RNA, 22 nt, Human
uugagagaggaaacauagucuc

SEQ ID NO: 807964 - RNA, 19 nt, Human
agcagcagaagugugccuu

SEQ ID NO: 807965 - RNA, 19 nt, Human
aaggcagaaguuggauaug

SEQ ID NO: 807966 - RNA, 22 nt, Human
ugcauuaaggccauugaaauuu

SEQ ID NO: 807967 - RNA, 22 nt, Human
gaagagaaaggcaaggaguuuu

SEQ ID NO: 807968 - RNA, 22 nt, Human
augcaaauucuuaggcuccauc

SEQ ID NO: 807969 - RNA, 19 nt, Human
acccucucagugccugagg

SEQ ID NO: 807970 - RNA, 22 nt, Human
ggcccagccucagacaugcccu

SEQ ID NO: 807971 - RNA, 22 nt, Human
augaguuuugggggauguuaga

SEQ ID NO: 807972 - RNA, 18 nt, Human
aggccacacuccagaaca

SEQ ID NO: 807973 - RNA, 22 nt, Human
uucuugauucuuccuugaagga

SEQ ID NO: 807974 - RNA, 22 nt, Human
aaaccugaauguaugucagaag

SEQ ID NO: 807975 - RNA, 22 nt, Human
ucagugcuuccuggaggaagcc

SEQ ID NO: 807976 - RNA, 22 nt, Human
caggcugggcagccuccccggc

SEQ ID NO: 807977 - RNA, 22 nt, Human
auguuucuacagcguccacuga

SEQ ID NO: 807978 - RNA, 22 nt, Human
uaugcacaguuacaagaauauc

SEQ ID NO: 807979 - RNA, 22 nt, Human
cacuuuacccuuguuacucaug

SEQ ID NO: 807980 - RNA, 19 nt, Human
ccugucugucuucagcuag

SEQ ID NO: 807981 - RNA, 22 nt, Human
uggugggagugacguugccuuc

SEQ ID NO: 807982 - RNA, 23 nt, Human
caucauuguuaugggugcuacua

SEQ ID NO: 807983 - RNA, 22 nt, Human
uucuuuuaaaagagagcagaaa

SEQ ID NO: 807984 - RNA, 22 nt, Human
cuggggaacgcagcgagcagcg

SEQ ID NO: 807985 - RNA, 22 nt, Human
uaguuuuauaauguuaacaucu

SEQ ID NO: 807986 - RNA, 22 nt, Human
ggcuccuguccccucagcugcu

SEQ ID NO: 807987 - RNA, 20 nt, Human
gccugagcuauugccaggau

SEQ ID NO: 807988 - RNA, 22 nt, Human
aagaguuuuuaauggguacugg

SEQ ID NO: 807989 - RNA, 22 nt, Human
ucuggucaucggaaagaucaaa

SEQ ID NO: 807990 - RNA, 22 nt, Human
gggcuucaaaauuggcacucuu

SEQ ID NO: 807991 - RNA, 22 nt, Human
ggcuccugggaugggacugagc

SEQ ID NO: 807992 - RNA, 22 nt, Human
uuucauugacaguugggggaaa

SEQ ID NO: 807993 - RNA, 22 nt, Human
uucccaagucuccaauguggga

SEQ ID NO: 807994 - RNA, 22 nt, Human
aaacuaaggugcuguggacuga

SEQ ID NO: 807995 - RNA, 22 nt, Human
agccucccuaugcaccuucagg

SEQ ID NO: 807996 - RNA, 20 nt, Human
ggccuuggaauagcacagcu

SEQ ID NO: 807997 - RNA, 17 nt, Human
ugccuccagcaggguga

SEQ ID NO: 807998 - RNA, 22 nt, Human
aggcaucugaguuugcaagcuu

SEQ ID NO: 807999 - RNA, 22 nt, Human
ggcuccagaugucuccuggcaa

SEQ ID NO: 808000 - RNA, 22 nt, Human
uaaaucaagaauaucagcuugu

SEQ ID NO: 808001 - RNA, 22 nt, Human
ucagucuuugcuuaugacaaua

SEQ ID NO: 808002 - RNA, 22 nt, Human
caccacugcuuccugccaucug

SEQ ID NO: 808003 - RNA, 21 nt, Human
uugguuuucugagucuguaca

SEQ ID NO: 808004 - RNA, 22 nt, Human
aagccuucaguccguugcagag

SEQ ID NO: 808005 - RNA, 22 nt, Human
aaacuucuugcugcauuuucug

SEQ ID NO: 808006 - RNA, 22 nt, Human
aagcuucaaugagauaauuguu

SEQ ID NO: 808007 - RNA, 22 nt, Human
ggccacagugggaaauccuggg

SEQ ID NO: 808008 - RNA, 22 nt, Human
gcuggccugaccugaggcuggg

SEQ ID NO: 808009 - RNA, 22 nt, Human
acacaguggugagucuggaccu

SEQ ID NO: 808010 - RNA, 22 nt, Human
acagcuccuaacaaaggcucuc

SEQ ID NO: 808011 - RNA, 22 nt, Human
auaauaacaccugaauaggaaa

SEQ ID NO: 808012 - RNA, 22 nt, Human
cacuggcaugugaggcgguggc

SEQ ID NO: 808013 - RNA, 22 nt, Human
aaaggcaggcuuucacaucuca

SEQ ID NO: 808014 - RNA, 22 nt, Human
uugcaaaagccgaggcacucca

SEQ ID NO: 808015 - RNA, 22 nt, Human
ucccuggagauaacuucuggga

SEQ ID NO: 808016 - RNA, 22 nt, Human
gcagcugggacacugaggccag

SEQ ID NO: 808017 - RNA, 22 nt, Human
augaaugcugggacaaauauau

SEQ ID NO: 808018 - RNA, 22 nt, Human
gcagggccagguacaagaagca

SEQ ID NO: 808019 - RNA, 22 nt, Human
augaaccuugauuuguucaucu

SEQ ID NO: 808020 - RNA, 22 nt, Human
aguggcaguggcugggcagagc

SEQ ID NO: 808021 - RNA, 22 nt, Human
guauauaucggcacuauuuuaa

SEQ ID NO: 808022 - RNA, 22 nt, Human
auuucaugugaagaagagauaa

SEQ ID NO: 808023 - RNA, 22 nt, Human
gcagcuggucuggccuagagua

SEQ ID NO: 808024 - RNA, 22 nt, Human
uuuauaauuaucucuacucuua

SEQ ID NO: 808025 - RNA, 18 nt, Human
acagugauuguucuaugc

SEQ ID NO: 808026 - RNA, 22 nt, Human
cacagugcaaucggccacaaau

SEQ ID NO: 808027 - RNA, 22 nt, Human
caaaaggccaguacuuuguuug

SEQ ID NO: 808028 - RNA, 23 nt, Human
guuaauaaugaacacuuucuccc

SEQ ID NO: 808029 - RNA, 22 nt, Human
agcuuguuggggaaggagaaag

SEQ ID NO: 808030 - RNA, 22 nt, Human
gaggcagcauucgcauagacag

SEQ ID NO: 808031 - RNA, 22 nt, Human
guuucuuuuaaaauauguagac

SEQ ID NO: 808032 - RNA, 22 nt, Human
ucagaagcauguggggagccug

SEQ ID NO: 808033 - RNA, 22 nt, Human
ugccugcaucuuggaggcccca

SEQ ID NO: 808034 - RNA, 22 nt, Human
cccuccccagggucauauugaa

SEQ ID NO: 808035 - RNA, 22 nt, Human
caggcccauucuaggcuugcua

SEQ ID NO: 808036 - RNA, 22 nt, Human
ugcuggcacgaaagggugucca

SEQ ID NO: 808037 - RNA, 22 nt, Human
ucagggcaaagggcagaguuug

SEQ ID NO: 808038 - RNA, 22 nt, Human
cauggauugaauauaaauuaga

SEQ ID NO: 808039 - RNA, 22 nt, Human
ggcagggaguggagacucccua

SEQ ID NO: 808040 - RNA, 20 nt, Human
guuuuaugccaguucugugu

SEQ ID NO: 808041 - RNA, 22 nt, Human
ccagcaggacuuuggaaauaug

SEQ ID NO: 808042 - RNA, 22 nt, Human
ucucccucauuccugcuuccau

SEQ ID NO: 808043 - RNA, 22 nt, Human
uuuuauucucagcuccagagag

SEQ ID NO: 808044 - RNA, 22 nt, Human
gcuggcuccaaaagcaggggcu

SEQ ID NO: 808045 - RNA, 22 nt, Human
gggaaaggaucagugggaggcu

SEQ ID NO: 808046 - RNA, 22 nt, Human
caggaagagaacauggaggcug

SEQ ID NO: 808047 - RNA, 22 nt, Human
gauuuacagaucuaagggucac

SEQ ID NO: 808048 - RNA, 22 nt, Human
ucaagaaacugugcuacagagu

SEQ ID NO: 808049 - RNA, 22 nt, Human
uagacaggagucaggcuagaau

SEQ ID NO: 808050 - RNA, 20 nt, Human
uggcaggaggcagcagugga

SEQ ID NO: 808051 - RNA, 23 nt, Human
cagaggguuccauggagcauggu

SEQ ID NO: 808052 - RNA, 22 nt, Human
acagugaaugcccaagaaaagu

SEQ ID NO: 808053 - RNA, 22 nt, Human
cugggagcaagucaggaaaggu

SEQ ID NO: 808054 - RNA, 22 nt, Human
ggcagauggagaagcagcaggu

SEQ ID NO: 808055 - RNA, 23 nt, Human
agaggcugcaggguauugagaau

SEQ ID NO: 808056 - RNA, 23 nt, Human
ugcaggguguuccugccuuugcu

SEQ ID NO: 808057 - RNA, 22 nt, Human
aacugugaggaugugcaaauuc

SEQ ID NO: 808058 - RNA, 22 nt, Human
aacauuuccggccuuuuguucu

SEQ ID NO: 808059 - RNA, 22 nt, Human
aucagaaucauuucaucccuau

SEQ ID NO: 808060 - RNA, 22 nt, Human
uggaaggaaagguagcagagaa

SEQ ID NO: 808061 - RNA, 22 nt, Human
ccuugcucaagcuagugacggg

SEQ ID NO: 808062 - RNA, 22 nt, Human
auaaguaggaaaauuugaauau

SEQ ID NO: 808063 - RNA, 22 nt, Human
ccagcccugaacccugcugcau

SEQ ID NO: 808064 - RNA, 22 nt, Human
ucauuguauuaaaauauugguu

SEQ ID NO: 808065 - RNA, 22 nt, Human
aaagccaggaggagggcgcucg

SEQ ID NO: 808066 - RNA, 22 nt, Human
caugucuuucaaaccacacagu

SEQ ID NO: 808067 - RNA, 22 nt, Human
aaagcagauucugaugcaguag

SEQ ID NO: 808068 - RNA, 22 nt, Human
agcuggcuuuaugguuggcuaa

SEQ ID NO: 808069 - RNA, 22 nt, Human
uuguaaacuguuaaaagccaga

SEQ ID NO: 808070 - RNA, 22 nt, Human
acauuugucuucuuucagauua

SEQ ID NO: 808071 - RNA, 22 nt, Human
ucaggaaggagcuggccugcca

SEQ ID NO: 808072 - RNA, 22 nt, Human
ucagcaggggccguugggugga

SEQ ID NO: 808073 - RNA, 21 nt, Human
acacaaaccuccucagccugg

SEQ ID NO: 808074 - RNA, 22 nt, Human
uuacagaguagugcagaacuca

SEQ ID NO: 808075 - RNA, 18 nt, Human
agcuggggccucuggucc

SEQ ID NO: 808076 - RNA, 22 nt, Human
gagggagagugauggaccauug

SEQ ID NO: 808077 - RNA, 22 nt, Human
ucugcccucauugcugccugga

SEQ ID NO: 808078 - RNA, 22 nt, Human
uucaucaucuacaaccaggacc

SEQ ID NO: 808079 - RNA, 22 nt, Human
aagugcauaauaacucccaagu

SEQ ID NO: 808080 - RNA, 22 nt, Human
gugauucaaauguaacuaauua

SEQ ID NO: 808081 - RNA, 22 nt, Human
ggcauuuuugacaaagagcaau

SEQ ID NO: 808082 - RNA, 22 nt, Human
ucuuuuguugccuacuuauuaa

SEQ ID NO: 808083 - RNA, 22 nt, Human
cacagugacuggcacauaguaa

SEQ ID NO: 808084 - RNA, 22 nt, Human
uagcuuugaaguuauuuaacag

SEQ ID NO: 808085 - RNA, 22 nt, Human
uaugagaaaggagaaugacuuu

SEQ ID NO: 808086 - RNA, 22 nt, Human
ccaggagcuggagggugcagug

SEQ ID NO: 808087 - RNA, 22 nt, Human
gagccaggaagaaggccuuacu

SEQ ID NO: 808088 - RNA, 22 nt, Human
agcaacagcccuguuucauuag

SEQ ID NO: 808089 - RNA, 22 nt, Human
ggaggagggguuuacauuggaa

SEQ ID NO: 808090 - RNA, 22 nt, Human
ucacaucuauacccaauaauuu

SEQ ID NO: 808091 - RNA, 22 nt, Human
ggagcugcuucuugcugugggu

SEQ ID NO: 808092 - RNA, 22 nt, Human
cagaaaucuccaugucagacau

SEQ ID NO: 808093 - RNA, 22 nt, Human
caggcagagugagguggucuaa

SEQ ID NO: 808094 - RNA, 23 nt, Human
aaugggugcaacuauccaugaca

SEQ ID NO: 808095 - RNA, 22 nt, Human
augugacuccacagcugugcug

SEQ ID NO: 808096 - RNA, 22 nt, Human
uggagucugugaugcucugggu

SEQ ID NO: 808097 - RNA, 21 nt, Human
cugugggaccaagcacuggga

SEQ ID NO: 808098 - RNA, 22 nt, Human
gugcacagauuuaauuuuauuc

SEQ ID NO: 808099 - RNA, 22 nt, Human
auagaauucguguuuguaauuc

SEQ ID NO: 808100 - RNA, 21 nt, Human
cugcaaauguaaugaguuugg

SEQ ID NO: 808101 - RNA, 22 nt, Human
ggguaaugaacagguggcagag

SEQ ID NO: 808102 - RNA, 22 nt, Human
gcccuggaugcucauggcauca

SEQ ID NO: 808103 - RNA, 21 nt, Human
agcagcuugagucuggagcuc

SEQ ID NO: 808104 - RNA, 22 nt, Human
agucuuuaugauugucaaagua

SEQ ID NO: 808105 - RNA, 22 nt, Human
ugcaaaaacagccuugaggccu

SEQ ID NO: 808106 - RNA, 22 nt, Human
cagagccacugucugccaggca

SEQ ID NO: 808107 - RNA, 22 nt, Human
aaucuacaugcaauauuuuuag

SEQ ID NO: 808108 - RNA, 22 nt, Human
aaauuccaguucuuuuaccugc

SEQ ID NO: 808109 - RNA, 22 nt, Human
cagcacuguucccagaccacug

SEQ ID NO: 808110 - RNA, 22 nt, Human
ggcuuugacaugcugaauuaaa

SEQ ID NO: 808111 - RNA, 20 nt, Human
gagggcaggcacccauuuca

SEQ ID NO: 808112 - RNA, 22 nt, Human
uagaaugugccuggaauacagu

SEQ ID NO: 808113 - RNA, 22 nt, Human
uugaaugaguguuuuacucaug

SEQ ID NO: 808114 - RNA, 22 nt, Human
guuguuuucacaaacccaugau

SEQ ID NO: 808115 - RNA, 22 nt, Human
aagcaauaaauaauuuuuagua

SEQ ID NO: 808116 - RNA, 22 nt, Human
auuauucaacacuugagaaauu

SEQ ID NO: 808117 - RNA, 22 nt, Human
uucuguuacaagugaaaaaaug

SEQ ID NO: 808118 - RNA, 22 nt, Human
ugagaacggauacuaagggcug

SEQ ID NO: 808119 - RNA, 22 nt, Human
cccuggagaucgggagaggaag

SEQ ID NO: 808120 - RNA, 22 nt, Human
caaagcugugaauuccuacaaa

SEQ ID NO: 808121 - RNA, 22 nt, Human
agcuccuguucugagagcagga

SEQ ID NO: 808122 - RNA, 22 nt, Human
cugccagagaucugggcagagu

SEQ ID NO: 808123 - RNA, 22 nt, Human
ucugcagcaaccuuucaccucc

SEQ ID NO: 808124 - RNA, 22 nt, Human
cugacaggguagacagagggca

SEQ ID NO: 808125 - RNA, 22 nt, Human
acaaauccagugaacuccagug

SEQ ID NO: 808126 - RNA, 22 nt, Human
uggcuggcuggaccacaccugc

SEQ ID NO: 808127 - RNA, 22 nt, Human
aaggcucuuggagugaaugcag

SEQ ID NO: 808128 - RNA, 22 nt, Human
caggccugggcuggguaucagg

SEQ ID NO: 808129 - RNA, 22 nt, Human
uucaagucuguuucauugcaug

SEQ ID NO: 808130 - RNA, 22 nt, Human
auauguuuuuggaaagaacaca

SEQ ID NO: 808131 - RNA, 22 nt, Human
gcugagacugacaugaagaggu

SEQ ID NO: 808132 - RNA, 22 nt, Human
uuucuucuuucccagugauggg

SEQ ID NO: 808133 - RNA, 22 nt, Human
ugcaggguagacaggugagguc

SEQ ID NO: 808134 - RNA, 22 nt, Human
uauuuuugccucucagauaaaa

SEQ ID NO: 808135 - RNA, 22 nt, Human
aggcagaagccagccagggucc

SEQ ID NO: 808136 - RNA, 22 nt, Human
uuucauugccuuuggaaggucu

SEQ ID NO: 808137 - RNA, 22 nt, Human
agcuccuggcuuuccucucacc

SEQ ID NO: 808138 - RNA, 22 nt, Human
acaaguauuuaagguuaguaua

SEQ ID NO: 808139 - RNA, 22 nt, Human
cagaggcugggaccucaggcau

SEQ ID NO: 808140 - RNA, 22 nt, Human
ggcugugccucaaggcuacuca

SEQ ID NO: 808141 - RNA, 22 nt, Human
uuucaaagucaagaaggauacu

SEQ ID NO: 808142 - RNA, 21 nt, Human
aaggccugcuuacugcuaguu

SEQ ID NO: 808143 - RNA, 22 nt, Human
ccugggcauaaaucacuccaag

SEQ ID NO: 808144 - RNA, 22 nt, Human
uggaaauauacaaugugucucu

SEQ ID NO: 808145 - RNA, 22 nt, Human
acaaauauuuacugaauccacu

SEQ ID NO: 808146 - RNA, 22 nt, Human
caugcaaagcguuuugaccagc

SEQ ID NO: 808147 - RNA, 22 nt, Human
gggguguggacggcugugccag

SEQ ID NO: 808148 - RNA, 22 nt, Human
uccacagaauguaagauccaca

SEQ ID NO: 808149 - RNA, 22 nt, Human
acaaauuguugggacucagccc

SEQ ID NO: 808150 - RNA, 22 nt, Human
uauuguccaauaggauguuccu

SEQ ID NO: 808151 - RNA, 22 nt, Human
caguuuuugccauuaagaguaa

SEQ ID NO: 808152 - RNA, 22 nt, Human
ggcaggguguggaguugggaca

SEQ ID NO: 808153 - RNA, 22 nt, Human
uucuucaggauacgucauccag

SEQ ID NO: 808154 - RNA, 22 nt, Human
gucuguuagugauaacuguuuu

SEQ ID NO: 808155 - RNA, 22 nt, Human
uuacagaggcuuccagggccca

SEQ ID NO: 808156 - RNA, 22 nt, Human
uggggaaauguccugccuuccc

SEQ ID NO: 808157 - RNA, 22 nt, Human
auguuucaaauauauagaguug

SEQ ID NO: 808158 - RNA, 22 nt, Human
caggcaccugugugucucaggg

SEQ ID NO: 808159 - RNA, 22 nt, Human
aacacagguucauucugugagg

SEQ ID NO: 808160 - RNA, 22 nt, Human
cacaggcaggagguucuccagu

SEQ ID NO: 808161 - RNA, 22 nt, Human
aaggcaguucacucacgcagcc

SEQ ID NO: 808162 - RNA, 22 nt, Human
gcggcccgagcaggacgggugg

SEQ ID NO: 808163 - RNA, 22 nt, Human
uugcaaauauguucuccuauuc

SEQ ID NO: 808164 - RNA, 20 nt, Human
cagucccaauccagggccag

SEQ ID NO: 808165 - RNA, 22 nt, Human
ccucagggaggccucuguggcu

SEQ ID NO: 808166 - RNA, 22 nt, Human
aaggcaguagguguuucaaacu

SEQ ID NO: 808167 - RNA, 22 nt, Human
auuuauuaagcaucugcuaugu

SEQ ID NO: 808168 - RNA, 22 nt, Human
uaagcaaaguuuauaaggcucu

SEQ ID NO: 808169 - RNA, 22 nt, Human
aggaaaaaagucugugauuaua

SEQ ID NO: 808170 - RNA, 22 nt, Human
gggagacacgcugcaggcauaa

SEQ ID NO: 808171 - RNA, 22 nt, Human
uguuuaaauagaacauacugca

SEQ ID NO: 808172 - RNA, 22 nt, Human
guccauacaguggcacacaucu

SEQ ID NO: 808173 - RNA, 22 nt, Human
cuacauucugggaaaucagaug

SEQ ID NO: 808174 - RNA, 14 nt, Human
gcaggcggaucacu

SEQ ID NO: 808175 - RNA, 22 nt, Human
uucauugucucuguuugccuuc

SEQ ID NO: 808176 - RNA, 22 nt, Human
gagggccagaaaguuauugaga

SEQ ID NO: 808177 - RNA, 22 nt, Human
aacagacagaaaaaugugaucu

SEQ ID NO: 808178 - RNA, 22 nt, Human
ccacagugaaaucuugauggag

SEQ ID NO: 808179 - RNA, 19 nt, Human
uuuuccacagaaauauguu

SEQ ID NO: 808180 - RNA, 22 nt, Human
agcugcaggccucuccugggga

SEQ ID NO: 808181 - RNA, 18 nt, Human
ggagggcuuuggggacug

SEQ ID NO: 808182 - RNA, 22 nt, Human
uuucacaguagaaaucauuaug

SEQ ID NO: 808183 - RNA, 22 nt, Human
aauauuucaaaaggaaacacag

SEQ ID NO: 808184 - RNA, 23 nt, Human
gcauuguagaauguuuagcagca

SEQ ID NO: 808185 - RNA, 22 nt, Human
uuaaauuucuacgugauccagg

SEQ ID NO: 808186 - RNA, 22 nt, Human
uuccaggaugggcuguccuacu

SEQ ID NO: 808187 - RNA, 22 nt, Human
aucagaauguuuuggugugcuc

SEQ ID NO: 808188 - RNA, 21 nt, Human
acugccugucuccauagucua

SEQ ID NO: 808189 - RNA, 22 nt, Human
ccccagccuuccaugggaauug

SEQ ID NO: 808190 - RNA, 22 nt, Human
uuucagaaagcaucaucaaagu

SEQ ID NO: 808191 - RNA, 22 nt, Human
uaaaugaaaggguuuaauuuau

SEQ ID NO: 808192 - RNA, 22 nt, Human
gucugagggacagaguccuggc

SEQ ID NO: 808193 - RNA, 22 nt, Human
agggaccacauccccucugugg

SEQ ID NO: 808194 - RNA, 22 nt, Human
gucugaggcgaggccugagaac

SEQ ID NO: 808195 - RNA, 22 nt, Human
uuguuucuucaggcuuuuagga

SEQ ID NO: 808196 - RNA, 22 nt, Human
aguuaaaugucaguagcuuaac

SEQ ID NO: 808197 - RNA, 22 nt, Human
acaggagcaacagacuaagaca

SEQ ID NO: 808198 - RNA, 22 nt, Human
cgcgcuguuuacgugacuuaau

SEQ ID NO: 808199 - RNA, 22 nt, Human
ucaguaaauaacucagaugcuc

SEQ ID NO: 808200 - RNA, 22 nt, Human
uccacgugagcuucgugugcag

SEQ ID NO: 808201 - RNA, 22 nt, Human
aguuucuagccucacuguuuag

SEQ ID NO: 808202 - RNA, 22 nt, Human
gaaauuuacaacuuucucaugg

SEQ ID NO: 808203 - RNA, 22 nt, Human
aggcagccaguucagguuucuu

SEQ ID NO: 808204 - RNA, 22 nt, Human
ucucauuuacuuccacaggcug

SEQ ID NO: 808205 - RNA, 22 nt, Human
auguuuguguuucccauucagg

SEQ ID NO: 808206 - RNA, 22 nt, Human
aggagccagaauccagacucgg

SEQ ID NO: 808207 - RNA, 22 nt, Human
cugacuuugcucauaggucaaa

SEQ ID NO: 808208 - RNA, 22 nt, Human
auggagggaaaaguggagagcc

SEQ ID NO: 808209 - RNA, 22 nt, Human
acucauugaaacuuaagaucua

SEQ ID NO: 808210 - RNA, 22 nt, Human
uagccaggcaauuaugggugau

SEQ ID NO: 808211 - RNA, 22 nt, Human
cucccacauggaauagcaggga

SEQ ID NO: 808212 - RNA, 22 nt, Human
uugcugaucugugaaucagcca

SEQ ID NO: 808213 - RNA, 22 nt, Human
gcaagauguuaacauagggaga

SEQ ID NO: 808214 - RNA, 19 nt, Human
ccugggagucagcugaagg

SEQ ID NO: 808215 - RNA, 22 nt, Human
accaaaugcuuggcugcuguga

SEQ ID NO: 808216 - RNA, 22 nt, Human
aaugucauugagcuccaauccu

SEQ ID NO: 808217 - RNA, 23 nt, Human
caggaaaugaauccaggaggaug

SEQ ID NO: 808218 - RNA, 22 nt, Human
aggcucuggacagugaggaguu

SEQ ID NO: 808219 - RNA, 22 nt, Human
ucagaggcuacagucugggagu

SEQ ID NO: 808220 - RNA, 22 nt, Human
ugaacaaaugaaucaguguagc

SEQ ID NO: 808221 - RNA, 22 nt, Human
cagaagcugcagugaucuggga

SEQ ID NO: 808222 - RNA, 22 nt, Human
gccacccugagcugggccaggg

SEQ ID NO: 808223 - RNA, 22 nt, Human
aagaguuuuuggagugugaguu

SEQ ID NO: 808224 - RNA, 22 nt, Human
ccacaguuuaggaagucacucu

SEQ ID NO: 808225 - RNA, 22 nt, Human
cacaguggaaguccaggauccc

SEQ ID NO: 808226 - RNA, 22 nt, Human
acaaagcacgagugccauggac

SEQ ID NO: 808227 - RNA, 22 nt, Human
cugcauccauguugcugcaaag

SEQ ID NO: 808228 - RNA, 22 nt, Human
ggcagggucuggacugaaagcu

SEQ ID NO: 808229 - RNA, 22 nt, Human
aucucauuuugguuucuacuua

SEQ ID NO: 808230 - RNA, 20 nt, Human
cugcaagcagguuauuccag

SEQ ID NO: 808231 - RNA, 22 nt, Human
caucuuuauuuauauagacagg

SEQ ID NO: 808232 - RNA, 22 nt, Human
ccugagggaaggaugcuaccca

SEQ ID NO: 808233 - RNA, 19 nt, Human
uuggggugaaugccagaca

SEQ ID NO: 808234 - RNA, 22 nt, Human
agaaauaugcugauuagaugaa

SEQ ID NO: 808235 - RNA, 22 nt, Human
agaaaauuacuccagagacaag

SEQ ID NO: 808236 - RNA, 22 nt, Human
uuggcccagcaugcgggucugu

SEQ ID NO: 808237 - RNA, 22 nt, Human
uugaaaugaucuauuucaguag

SEQ ID NO: 808238 - RNA, 22 nt, Human
auguuauuaaaguacagauucu

SEQ ID NO: 808239 - RNA, 22 nt, Human
uagcaaaggaugacuauguacc

SEQ ID NO: 808240 - RNA, 22 nt, Human
guucuggguucaaaccccggcc

SEQ ID NO: 808241 - RNA, 22 nt, Human
cccugaggcaaaggcuagaguu

SEQ ID NO: 808242 - RNA, 22 nt, Human
ucaagauaccaccauuauaugu

SEQ ID NO: 808243 - RNA, 22 nt, Human
cagcagcaucaggucugugguu

SEQ ID NO: 808244 - RNA, 21 nt, Human
ugccagcugcugcaucugucu

SEQ ID NO: 808245 - RNA, 22 nt, Human
ccaaaugugccuguuucaacaa

SEQ ID NO: 808246 - RNA, 22 nt, Human
agucuauugccuaacagagagg

SEQ ID NO: 808247 - RNA, 22 nt, Human
gcuggggucugugaggagggcu

SEQ ID NO: 808248 - RNA, 22 nt, Human
gucuccuggaaauaugcccaua

SEQ ID NO: 808249 - RNA, 22 nt, Human
auauuuugaaguuaauaaugug

SEQ ID NO: 808250 - RNA, 22 nt, Human
cauuuacagugagaguuuuuac

SEQ ID NO: 808251 - RNA, 22 nt, Human
uugaaguugcacauuauaauuu

SEQ ID NO: 808252 - RNA, 22 nt, Human
cuacaagauuuuuaaaacugua

SEQ ID NO: 808253 - RNA, 22 nt, Human
gcaggcaggagcccaacugccu

SEQ ID NO: 808254 - RNA, 22 nt, Human
caggacagcucaacaccuccuc

SEQ ID NO: 808255 - RNA, 22 nt, Human
ugccuucauccauguuauagug

SEQ ID NO: 808256 - RNA, 21 nt, Human
caaaaggauaggaaauuaggg

SEQ ID NO: 808257 - RNA, 22 nt, Human
aaacaagguccuucugugacau

SEQ ID NO: 808258 - RNA, 22 nt, Human
gcccaaagccagugugcucucc

SEQ ID NO: 808259 - RNA, 22 nt, Human
ccuggagccccucuggccagcc

SEQ ID NO: 808260 - RNA, 22 nt, Human
gggugaggccuugcugccauca

SEQ ID NO: 808261 - RNA, 22 nt, Human
ucagaauuuugguuugguuggu

SEQ ID NO: 808262 - RNA, 22 nt, Human
gugcauuaguuuccuauugcug

SEQ ID NO: 808263 - RNA, 22 nt, Human
ccucucagccggacugucaggc

SEQ ID NO: 808264 - RNA, 22 nt, Human
aagucauagucuaacccagcca

SEQ ID NO: 808265 - RNA, 22 nt, Human
cugggcuguaauguggcacuga

SEQ ID NO: 808266 - RNA, 22 nt, Human
gagcaggcaacucugcagugcc

SEQ ID NO: 808267 - RNA, 22 nt, Human
uguuuauaaauuuucuugccau

SEQ ID NO: 808268 - RNA, 22 nt, Human
ucugcugguuccgaauuaggcc

SEQ ID NO: 808269 - RNA, 22 nt, Human
acacuaguggaaauugauuugu

SEQ ID NO: 808270 - RNA, 22 nt, Human
auacuacauacuauguaaacau

SEQ ID NO: 808271 - RNA, 19 nt, Human
ggagccuggcaggggcgug

SEQ ID NO: 808272 - RNA, 22 nt, Human
ucugcaggcuuauaggaugggu

SEQ ID NO: 808273 - RNA, 21 nt, Human
ucccagggucuuaugggaugu

SEQ ID NO: 808274 - RNA, 22 nt, Human
cgcgguggcggccuccagcgcc

SEQ ID NO: 808275 - RNA, 22 nt, Human
agggaagcuuguuacugagaag

SEQ ID NO: 808276 - RNA, 22 nt, Human
agaagucagccacagugggaga

SEQ ID NO: 808277 - RNA, 22 nt, Human
acagggcaaccucugggagacu

SEQ ID NO: 808278 - RNA, 19 nt, Human
cugucccagacucugcucu

SEQ ID NO: 808279 - RNA, 22 nt, Human
uggugcugacaguucugagugc

SEQ ID NO: 808280 - RNA, 22 nt, Human
aagucuuuuugaaucuauaacu

SEQ ID NO: 808281 - RNA, 22 nt, Human
gaggaggcacuaguuagugaca

SEQ ID NO: 808282 - RNA, 22 nt, Human
uagcuucagggaaaccacugcu

SEQ ID NO: 808283 - RNA, 22 nt, Human
uguccagggggcuuaccuggag

SEQ ID NO: 808284 - RNA, 22 nt, Human
uuucauuacguguuugacuugu

SEQ ID NO: 808285 - RNA, 22 nt, Human
caggaggagcauuagcgucuca

SEQ ID NO: 808286 - RNA, 22 nt, Human
gaugauuuuguuggugauucaa

SEQ ID NO: 808287 - RNA, 22 nt, Human
aggacuggugccagacaaggua

SEQ ID NO: 808288 - RNA, 22 nt, Human
acugaaauauuuagaagugaag

SEQ ID NO: 808289 - RNA, 22 nt, Human
gccaaggaaggcuuccuggaag

SEQ ID NO: 808290 - RNA, 22 nt, Human
auuagacaucauaugauucagc

SEQ ID NO: 808291 - RNA, 22 nt, Human
gaugaaauccagaucacaggug

SEQ ID NO: 808292 - RNA, 22 nt, Human
aaauacaguguguguucuuuga

SEQ ID NO: 808293 - RNA, 22 nt, Human
gcacccuguuuauccugaguuc

SEQ ID NO: 808294 - RNA, 22 nt, Human
aucuagaacuuaaagucaguca

SEQ ID NO: 808295 - RNA, 22 nt, Human
agggccaccagggagucucagg

SEQ ID NO: 808296 - RNA, 22 nt, Human
ugcaggcugcuggcaguagcuu

SEQ ID NO: 808297 - RNA, 22 nt, Human
caggcacaagaucggcuagaua

SEQ ID NO: 808298 - RNA, 22 nt, Human
aaaggcaggacugcagcauagg

SEQ ID NO: 808299 - RNA, 17 nt, Human
ugccugccagcauugga

SEQ ID NO: 808300 - RNA, 22 nt, Human
guuucugagcacuuuuauugca

SEQ ID NO: 808301 - RNA, 22 nt, Human
cucccuggcacagcgagagguu

SEQ ID NO: 808302 - RNA, 22 nt, Human
cauucacaacugagcauuguug

SEQ ID NO: 808303 - RNA, 22 nt, Human
aaaguuacacaucuaguaagug

SEQ ID NO: 808304 - RNA, 22 nt, Human
uuuaagguggacaucuaaguca

SEQ ID NO: 808305 - RNA, 22 nt, Human
acuccugugggcauggcacccc

SEQ ID NO: 808306 - RNA, 22 nt, Human
ugguuagacacaugcaugucau

SEQ ID NO: 808307 - RNA, 22 nt, Human
gggcuggcuaagacuuuucugu

SEQ ID NO: 808308 - RNA, 22 nt, Human
uagcuuugggaaugcucuccug

SEQ ID NO: 808309 - RNA, 16 nt, Human
ggugggaggugaggug

SEQ ID NO: 808310 - RNA, 22 nt, Human
ugcuuaaaaagcuccaucaaua

SEQ ID NO: 808311 - RNA, 22 nt, Human
caagcuggcugggagaggcacg

SEQ ID NO: 808312 - RNA, 22 nt, Human
uuuuauuggagugauaccaagc

SEQ ID NO: 808313 - RNA, 22 nt, Human
gggcccuggacguggcggcaga

SEQ ID NO: 808314 - RNA, 19 nt, Human
uagcccuggccaucaugag

SEQ ID NO: 808315 - RNA, 22 nt, Human
cugagccacugcuuguucagug

SEQ ID NO: 808316 - RNA, 22 nt, Human
aauucacaguucugcaccuuac

SEQ ID NO: 808317 - RNA, 22 nt, Human
ugggccucaguuugcuuaaugu

SEQ ID NO: 808318 - RNA, 22 nt, Human
ugacaggauugguugcuucuga

SEQ ID NO: 808319 - RNA, 22 nt, Human
gggcaguguggucgugccuuug

SEQ ID NO: 808320 - RNA, 22 nt, Human
cucaguguuggagaccuucagg

SEQ ID NO: 808321 - RNA, 22 nt, Human
ggaccaggagcucagagcccuc

SEQ ID NO: 808322 - RNA, 22 nt, Human
cuggagccccagacagggagag

SEQ ID NO: 808323 - RNA, 22 nt, Human
gccugugccucagccugcagcc

SEQ ID NO: 808324 - RNA, 22 nt, Human
aggaauuauuugucuuagucuu

SEQ ID NO: 808325 - RNA, 22 nt, Human
cuuguuuuuaagagauguuuac

SEQ ID NO: 808326 - RNA, 22 nt, Human
ggcaggugcuaagagagguaaa

SEQ ID NO: 808327 - RNA, 22 nt, Human
acagugauuucugcaagggcuc

SEQ ID NO: 808328 - RNA, 22 nt, Human
ggcugcuggcagauguaguuua

SEQ ID NO: 808329 - RNA, 22 nt, Human
gcuucccaaugugcuaguuucu

SEQ ID NO: 808330 - RNA, 22 nt, Human
cccuggaggucagaggccuggg

SEQ ID NO: 808331 - RNA, 22 nt, Human
gucccaggcuccauggcagcca

SEQ ID NO: 808332 - RNA, 22 nt, Human
uugagaacuacuuuauuauucu

SEQ ID NO: 808333 - RNA, 22 nt, Human
uuucuaaacuggauucagccug

SEQ ID NO: 808334 - RNA, 22 nt, Human
uugaucaagugggaaauaguaa

SEQ ID NO: 808335 - RNA, 22 nt, Human
ugccagcaagaauagacaguaa

SEQ ID NO: 808336 - RNA, 20 nt, Human
ucugcagcacuugacaaugu

SEQ ID NO: 808337 - RNA, 22 nt, Human
aauagaggagcuuuggacuccc

SEQ ID NO: 808338 - RNA, 22 nt, Human
aagccagggauuccugagggag

SEQ ID NO: 808339 - RNA, 22 nt, Human
uaaaaugguaacuuucauuugc

SEQ ID NO: 808340 - RNA, 21 nt, Human
gccagccuguuuaccuguggu

SEQ ID NO: 808341 - RNA, 23 nt, Human
aagcacagaaugguuuaggaguu

SEQ ID NO: 808342 - RNA, 22 nt, Human
gcuggaguuggcaaggcaugua

SEQ ID NO: 808343 - RNA, 22 nt, Human
uuuuaagaugcuaguauuucag

SEQ ID NO: 808344 - RNA, 19 nt, Human
acagauggaggaaucuggg

SEQ ID NO: 808345 - RNA, 22 nt, Human
aaaauucauagaacuguacgcu

SEQ ID NO: 808346 - RNA, 22 nt, Human
aagauaauauucauuaacuaga

SEQ ID NO: 808347 - RNA, 22 nt, Human
ucuaaaaugcagaucuacuggu

SEQ ID NO: 808348 - RNA, 22 nt, Human
gggcuucaggguacuuccuccu

SEQ ID NO: 808349 - RNA, 22 nt, Human
ugcagaggcgccgugggugggg

SEQ ID NO: 808350 - RNA, 22 nt, Human
agugcagaggcugggaaaugcu

SEQ ID NO: 808351 - RNA, 22 nt, Human
uccugggcaaagaggggcagug

SEQ ID NO: 808352 - RNA, 22 nt, Human
aaacucaagucuaugaacaagg

SEQ ID NO: 808353 - RNA, 22 nt, Human
gccagcagcucuugggcgggca

SEQ ID NO: 808354 - RNA, 22 nt, Human
gagggcagaaaauuaugcggug

SEQ ID NO: 808355 - RNA, 22 nt, Human
guacaauaacuagucuuauagu

SEQ ID NO: 808356 - RNA, 22 nt, Human
gcucagcucuauggacacaaag

SEQ ID NO: 808357 - RNA, 23 nt, Human
uucuucauuuucagaguugagca

SEQ ID NO: 808358 - RNA, 22 nt, Human
uggauaaaaucuguaaggcuca

SEQ ID NO: 808359 - RNA, 22 nt, Human
cucuccaggacuuuggcccaau

SEQ ID NO: 808360 - RNA, 19 nt, Human
cagggauggguagggacuc

SEQ ID NO: 808361 - RNA, 22 nt, Human
ccagcaggguugguuucuucug

SEQ ID NO: 808362 - RNA, 22 nt, Human
agcaggcuuaugguugaaggga

SEQ ID NO: 808363 - RNA, 22 nt, Human
gcccuggagagggauauggcau

SEQ ID NO: 808364 - RNA, 22 nt, Human
uaggaaggaggccaucuuggcg

SEQ ID NO: 808365 - RNA, 23 nt, Human
uuucucauccagagagucagucc

SEQ ID NO: 808366 - RNA, 22 nt, Human
aguggcaauguagagagugauc

SEQ ID NO: 808367 - RNA, 22 nt, Human
ugucaugucuguaaauacacca

SEQ ID NO: 808368 - RNA, 17 nt, Human
uuucaaagcagucagga

SEQ ID NO: 808369 - RNA, 22 nt, Human
agcagagucuucaagggcaggc

SEQ ID NO: 808370 - RNA, 22 nt, Human
uggcuggacagugggcagugga

SEQ ID NO: 808371 - RNA, 22 nt, Human
aggcuucaccugcaccugagcu

SEQ ID NO: 808372 - RNA, 22 nt, Human
caguuucuuaucuucaaaauug

SEQ ID NO: 808373 - RNA, 17 nt, Human
cagugcuucugcuucuu

SEQ ID NO: 808374 - RNA, 22 nt, Human
gugcuuaugugggagggagagg

SEQ ID NO: 808375 - RNA, 23 nt, Human
ugggcagcuucugcaugcccacc

SEQ ID NO: 808376 - RNA, 22 nt, Human
ccugcccacuccaggagcaacu

SEQ ID NO: 808377 - RNA, 22 nt, Human
uugguuuucaggggcaggauaa

SEQ ID NO: 808378 - RNA, 22 nt, Human
ugggccaggucugcggucauuu

SEQ ID NO: 808379 - RNA, 22 nt, Human
agcuggcuggccccuuccugcc

SEQ ID NO: 808380 - RNA, 22 nt, Human
ccucugcaaagaauuugucucc

SEQ ID NO: 808381 - RNA, 22 nt, Human
agguggagugaaggaaaggcag

SEQ ID NO: 808382 - RNA, 22 nt, Human
auuucaugaguuauuauagugg

SEQ ID NO: 808383 - RNA, 22 nt, Human
cuguuuuugugcugugucuccc

SEQ ID NO: 808384 - RNA, 22 nt, Human
cuggcaguuugccaggagcucg

SEQ ID NO: 808385 - RNA, 18 nt, Human
cacaggagaugaccugac

SEQ ID NO: 808386 - RNA, 19 nt, Human
ucagaacucagaaugugua

SEQ ID NO: 808387 - RNA, 22 nt, Human
ucaggcuguaaauggugugggu

SEQ ID NO: 808388 - RNA, 22 nt, Human
cugggcucuagaaaggaaagaa

SEQ ID NO: 808389 - RNA, 22 nt, Human
agggugguggcgaugaggacau

SEQ ID NO: 808390 - RNA, 22 nt, Human
gcuaggcucggaagcagcaggg

SEQ ID NO: 808391 - RNA, 22 nt, Human
aacacaaagaagcugcaggauc

SEQ ID NO: 808392 - RNA, 22 nt, Human
ucagagaauucucagaugacuc

SEQ ID NO: 808393 - RNA, 22 nt, Human
agcuucaugccuaaagacagcg

SEQ ID NO: 808394 - RNA, 23 nt, Human
ugcaauaugucagugcaaagugg

SEQ ID NO: 808395 - RNA, 22 nt, Human
uuuguucaccuagcaaacuuuu

SEQ ID NO: 808396 - RNA, 22 nt, Human
cacccccagcagggaaaggagg

SEQ ID NO: 808397 - RNA, 22 nt, Human
cccaggaggucgaagcugcagu

SEQ ID NO: 808398 - RNA, 22 nt, Human
caggaggaggguacaccaucag

SEQ ID NO: 808399 - RNA, 22 nt, Human
agaagcuauaacaacaauuaua

SEQ ID NO: 808400 - RNA, 22 nt, Human
augcaaaugucaccacuucuaa

SEQ ID NO: 808401 - RNA, 22 nt, Human
cgaggaagaaguuugagucaag

SEQ ID NO: 808402 - RNA, 22 nt, Human
cugcccugucugcagccuggcu

SEQ ID NO: 808403 - RNA, 22 nt, Human
gauaucaugggaagguguacuu

SEQ ID NO: 808404 - RNA, 22 nt, Human
uuucauagucaaguguguauga

SEQ ID NO: 808405 - RNA, 22 nt, Human
aucucauaaacacacauauaug

SEQ ID NO: 808406 - RNA, 22 nt, Human
gaaggcuucaaaagguguaauu

SEQ ID NO: 808407 - RNA, 22 nt, Human
agcagaaaugaugguaugggac

SEQ ID NO: 808408 - RNA, 22 nt, Human
uaaaccuuauuugaauaccaac

SEQ ID NO: 808409 - RNA, 22 nt, Human
uuggucagcuaauaaggacagg

SEQ ID NO: 808410 - RNA, 22 nt, Human
cuuacaaaggagaggagauagg

SEQ ID NO: 808411 - RNA, 22 nt, Human
aaaucacagggucucuaaguau

SEQ ID NO: 808412 - RNA, 22 nt, Human
augaaauaucuugaagaaauuc

SEQ ID NO: 808413 - RNA, 22 nt, Human
aggugccagcucucaggcagga

SEQ ID NO: 808414 - RNA, 22 nt, Human
cacagugcucggguuuuauguc

SEQ ID NO: 808415 - RNA, 22 nt, Human
uguccagguggccucugcugcu

SEQ ID NO: 808416 - RNA, 17 nt, Human
ugaaacaccaagacugu

SEQ ID NO: 808417 - RNA, 22 nt, Human
auagaguuuuauuuuccaauaa

SEQ ID NO: 808418 - RNA, 22 nt, Human
aggcugcagugcagguaggauu

SEQ ID NO: 808419 - RNA, 22 nt, Human
cagcuggcugcaugaugccaaa

SEQ ID NO: 808420 - RNA, 22 nt, Human
ugccaggguccugagggccuug

SEQ ID NO: 808421 - RNA, 22 nt, Human
caagauggagaagcagcaaggg

SEQ ID NO: 808422 - RNA, 22 nt, Human
gggcagagacucagaaacagaa

SEQ ID NO: 808423 - RNA, 22 nt, Human
ccuguaggcgagggauggacag

SEQ ID NO: 808424 - RNA, 22 nt, Human
agaaaugucaggaaagaagucc

SEQ ID NO: 808425 - RNA, 22 nt, Human
agaacagccuauaguggccuuu

SEQ ID NO: 808426 - RNA, 22 nt, Human
uucaacaaauauuuauugagcu

SEQ ID NO: 808427 - RNA, 22 nt, Human
gaagccuugaacugcaaacccc

SEQ ID NO: 808428 - RNA, 22 nt, Human
ucaaaguauaucccuucgaaac

SEQ ID NO: 808429 - RNA, 20 nt, Human
ugcagaagaacguucugguu

SEQ ID NO: 808430 - RNA, 22 nt, Human
cugggcaggauacuucauggga

SEQ ID NO: 808431 - RNA, 22 nt, Human
ucaggaaauggacaucuuugcu

SEQ ID NO: 808432 - RNA, 22 nt, Human
agcaaauaaagacaauuauguc

SEQ ID NO: 808433 - RNA, 21 nt, Human
agcugaaaaguuguuuacaag

SEQ ID NO: 808434 - RNA, 22 nt, Human
cauggcaggcuucuucagccuu

SEQ ID NO: 808435 - RNA, 22 nt, Human
gcagggcaucccugagcgggug

SEQ ID NO: 808436 - RNA, 22 nt, Human
gaggccaggggucagcaauugg

SEQ ID NO: 808437 - RNA, 22 nt, Human
cuuaauaauaggugaggcuaug

SEQ ID NO: 808438 - RNA, 22 nt, Human
uggggccagagcugcagggagc

SEQ ID NO: 808439 - RNA, 22 nt, Human
uuuuucccaaaggcaauugccu

SEQ ID NO: 808440 - RNA, 22 nt, Human
uuuccuagagucucuagaagaa

SEQ ID NO: 808441 - RNA, 22 nt, Human
gguggcccuaaccgcagccucc

SEQ ID NO: 808442 - RNA, 22 nt, Human
gcagcugccccgacugugaguc

SEQ ID NO: 808443 - RNA, 22 nt, Human
auacaaauuuauagaugcauuu

SEQ ID NO: 808444 - RNA, 22 nt, Human
agggaggcaggaaaguugucug

SEQ ID NO: 808445 - RNA, 22 nt, Human
ucacaagagcuggacugucuuu

SEQ ID NO: 808446 - RNA, 22 nt, Human
ucccucucccuauugccuggag

SEQ ID NO: 808447 - RNA, 22 nt, Human
gagaagccgagucagcugagcc

SEQ ID NO: 808448 - RNA, 22 nt, Human
uagauuucaggagacaaaaugg

SEQ ID NO: 808449 - RNA, 22 nt, Human
uuacauauuauccaaaacugcu

SEQ ID NO: 808450 - RNA, 22 nt, Human
ugucauggagcuuauauuccag

SEQ ID NO: 808451 - RNA, 22 nt, Human
acagagagaggcccgaggcugc

SEQ ID NO: 808452 - RNA, 19 nt, Human
ccuggccagacuucugccc

SEQ ID NO: 808453 - RNA, 22 nt, Human
aagcuuuaugacuuggagacag

SEQ ID NO: 808454 - RNA, 22 nt, Human
cccagcuccagagccagaaaca

SEQ ID NO: 808455 - RNA, 22 nt, Human
aguguuucuggcaaaugaaagu

SEQ ID NO: 808456 - RNA, 22 nt, Human
ggaggagcacuugacggggucu

SEQ ID NO: 808457 - RNA, 22 nt, Human
acagaaaaugccagaagggugg

SEQ ID NO: 808458 - RNA, 22 nt, Human
acagaaaugauguuuggcaaua

SEQ ID NO: 808459 - RNA, 22 nt, Human
cagugggauaugggggcagcau

SEQ ID NO: 808460 - RNA, 22 nt, Human
gccacccuggaccacccugggc

SEQ ID NO: 808461 - RNA, 22 nt, Human
uuucugaacaaagccauuauca

SEQ ID NO: 808462 - RNA, 22 nt, Human
cuauucaacuugacuguuucac

SEQ ID NO: 808463 - RNA, 22 nt, Human
acacaggaagucagcacugaug

SEQ ID NO: 808464 - RNA, 22 nt, Human
aagaacaugaacacaauguuua

SEQ ID NO: 808465 - RNA, 18 nt, Human
ccagagcuggcuccucgc

SEQ ID NO: 808466 - RNA, 22 nt, Human
acacaguucuuucacuguuggu

SEQ ID NO: 808467 - RNA, 22 nt, Human
cuuguuuuggaacagagugaau

SEQ ID NO: 808468 - RNA, 23 nt, Human
ccuuaaauaucuacccuguggca

SEQ ID NO: 808469 - RNA, 22 nt, Human
gcaggggcuacucugagcuucc

SEQ ID NO: 808470 - RNA, 20 nt, Human
cauuucauugugucuucacu

SEQ ID NO: 808471 - RNA, 22 nt, Human
ucaaguauuauuacagauguag

SEQ ID NO: 808472 - RNA, 22 nt, Human
cccucagucuggcugggaagac

SEQ ID NO: 808473 - RNA, 22 nt, Human
cuuauggaagaaaccucagaga

SEQ ID NO: 808474 - RNA, 22 nt, Human
cugaggugugagccacuucccc

SEQ ID NO: 808475 - RNA, 22 nt, Human
uagcaaaugucugaaggaauag

SEQ ID NO: 808476 - RNA, 22 nt, Human
caugagugaguaucucaagaua

SEQ ID NO: 808477 - RNA, 22 nt, Human
gaagcaguauccugacagcacc

SEQ ID NO: 808478 - RNA, 22 nt, Human
ggcuuugggauucagcaugaga

SEQ ID NO: 808479 - RNA, 18 nt, Human
aaaaugcaggcgacaugg

SEQ ID NO: 808480 - RNA, 22 nt, Human
uaaaccuucaugauggucauua

SEQ ID NO: 808481 - RNA, 22 nt, Human
uccugaaaugugcacaugacau

SEQ ID NO: 808482 - RNA, 22 nt, Human
guuuuuccugcugacuuggguc

SEQ ID NO: 808483 - RNA, 22 nt, Human
gcugcccaguucugcugcugcc

SEQ ID NO: 808484 - RNA, 22 nt, Human
gaagauaauuccuacuuauaac

SEQ ID NO: 808485 - RNA, 21 nt, Human
ggacuuggaugguggcaguag

SEQ ID NO: 808486 - RNA, 22 nt, Human
uacuauuuuugcaacguauaca

SEQ ID NO: 808487 - RNA, 22 nt, Human
cagguggguguaugaaugcaaa

SEQ ID NO: 808488 - RNA, 22 nt, Human
gccuagugcacuggcagggcuc

SEQ ID NO: 808489 - RNA, 21 nt, Human
gccugcugccuguggccgguc

SEQ ID NO: 808490 - RNA, 22 nt, Human
cccaggcaggagugugguggcu

SEQ ID NO: 808491 - RNA, 22 nt, Human
agcagggcaaagucaggcuaac

SEQ ID NO: 808492 - RNA, 22 nt, Human
gcaaagacaaauuagaacuccu

SEQ ID NO: 808493 - RNA, 22 nt, Human
aaauacuauugaccaggucucu

SEQ ID NO: 808494 - RNA, 22 nt, Human
gcacauuugccacugagcuccu

SEQ ID NO: 808495 - RNA, 22 nt, Human
auuaguaguaguuagcagccuc

SEQ ID NO: 808496 - RNA, 22 nt, Human
ccuccuggggugaaggauggga

SEQ ID NO: 808497 - RNA, 22 nt, Human
ugagcuggaggacaggagggua

SEQ ID NO: 808498 - RNA, 22 nt, Human
ugggcucauggcccagcacugg

SEQ ID NO: 808499 - RNA, 22 nt, Human
cuuugcaggaguaugugauaau

SEQ ID NO: 808500 - RNA, 22 nt, Human
cacacuugugaccgauauaaug

SEQ ID NO: 808501 - RNA, 22 nt, Human
uuucucagugcaguuucuacgu

SEQ ID NO: 808502 - RNA, 22 nt, Human
gauuuugaauauuaaagaagag

SEQ ID NO: 808503 - RNA, 22 nt, Human
agcuucucaggagucugaggca

SEQ ID NO: 808504 - RNA, 22 nt, Human
agcaggugggaucaagcuggca

SEQ ID NO: 808505 - RNA, 22 nt, Human
uaaagugggcaaacucucaugg

SEQ ID NO: 808506 - RNA, 22 nt, Human
agauauuuaaaucagacaaaga

SEQ ID NO: 808507 - RNA, 22 nt, Human
aggcccaguccucugccgucug

SEQ ID NO: 808508 - RNA, 22 nt, Human
uuccaacaauguguuauuguuc

SEQ ID NO: 808509 - RNA, 22 nt, Human
agcagcuuaucuuggagaggca

SEQ ID NO: 808510 - RNA, 22 nt, Human
aaguccugggugagaacugucc

SEQ ID NO: 808511 - RNA, 22 nt, Human
cacuuuuaacaggagaauuccc

SEQ ID NO: 808512 - RNA, 22 nt, Human
aaagugcaaggauuacaggcau

SEQ ID NO: 808513 - RNA, 22 nt, Human
cucucuuugauguauaaauaau

SEQ ID NO: 808514 - RNA, 22 nt, Human
uggggugaaucuuuguuguccg

SEQ ID NO: 808515 - RNA, 22 nt, Human
uguuuugugcauuuacaacaug

SEQ ID NO: 808516 - RNA, 22 nt, Human
agucagucaccauuuaagaaca

SEQ ID NO: 808517 - RNA, 22 nt, Human
augcaaauaaagcaacuauaca

SEQ ID NO: 808518 - RNA, 22 nt, Human
cuggaagcuuguuugccagucu

SEQ ID NO: 808519 - RNA, 22 nt, Human
cacaggagcccugaggccuccc

SEQ ID NO: 808520 - RNA, 22 nt, Human
ugcagaaguauuccaggcccca

SEQ ID NO: 808521 - RNA, 22 nt, Human
gugcccaguugaggccaggacu

SEQ ID NO: 808522 - RNA, 22 nt, Human
augacaaaagaagacaugaggu

SEQ ID NO: 808523 - RNA, 22 nt, Human
gcagauguuguugcugggaguu

SEQ ID NO: 808524 - RNA, 22 nt, Human
ugcagcagcagggaggaggcuc

SEQ ID NO: 808525 - RNA, 22 nt, Human
acacauuucucccagucuccau

SEQ ID NO: 808526 - RNA, 22 nt, Human
uuauuaauacaugcaccugcau

SEQ ID NO: 808527 - RNA, 22 nt, Human
uagugucaaauagccugagcuu

SEQ ID NO: 808528 - RNA, 22 nt, Human
cuggagcauuuucugcuucugc

SEQ ID NO: 808529 - RNA, 17 nt, Human
uccuuggcaaccaguuc

SEQ ID NO: 808530 - RNA, 22 nt, Human
uuauaugauugaagugcauaag

SEQ ID NO: 808531 - RNA, 22 nt, Human
caacuacauccacacuuuguua

SEQ ID NO: 808532 - RNA, 22 nt, Human
aguuguaagagacagauauaaa

SEQ ID NO: 808533 - RNA, 22 nt, Human
aucuagaagucauggcuuucuu

SEQ ID NO: 808534 - RNA, 19 nt, Human
auaaauaaaaagugggaga

SEQ ID NO: 808535 - RNA, 17 nt, Human
aggcagcucagaacauc

SEQ ID NO: 808536 - RNA, 22 nt, Human
uguuuucuauuaccugagauug

SEQ ID NO: 808537 - RNA, 18 nt, Human
aaauggcagaauggauag

SEQ ID NO: 808538 - RNA, 21 nt, Human
uauacaugugcacacacaugc

SEQ ID NO: 808539 - RNA, 18 nt, Human
uuggcuuugagaacuggu

SEQ ID NO: 808540 - RNA, 22 nt, Human
gagaaacaacacuugaugccuu

SEQ ID NO: 808541 - RNA, 22 nt, Human
uuggcugaccagaaccugcccc

SEQ ID NO: 808542 - RNA, 22 nt, Human
cugaagcaggaggggaggcgcu

SEQ ID NO: 808543 - RNA, 22 nt, Human
ucuuaaaaguaugccaauugga

SEQ ID NO: 808544 - RNA, 22 nt, Human
uucuaaacugaaguauuuuaaa

SEQ ID NO: 808545 - RNA, 22 nt, Human
uagcccagaugauugaaccaug

SEQ ID NO: 808546 - RNA, 22 nt, Human
uuucauguguugaauguguaca

SEQ ID NO: 808547 - RNA, 20 nt, Human
ucaggagccuaggacaugau

SEQ ID NO: 808548 - RNA, 21 nt, Human
auucaacuagaugauuauuuc

SEQ ID NO: 808549 - RNA, 23 nt, Human
agcuccugaggccagccucuccu

SEQ ID NO: 808550 - RNA, 22 nt, Human
ggcagagcuaguggcuucucuu

SEQ ID NO: 808551 - RNA, 22 nt, Human
ucagauauucucuaagaacaau

SEQ ID NO: 808552 - RNA, 22 nt, Human
aggagaggcucuaacucugugu

SEQ ID NO: 808553 - RNA, 22 nt, Human
cagagcugucauuugccaguga

SEQ ID NO: 808554 - RNA, 18 nt, Human
ggcugagguugacuagaa

SEQ ID NO: 808555 - RNA, 22 nt, Human
cuggagccuucaccaggggaaa

SEQ ID NO: 808556 - RNA, 22 nt, Human
cccuggaaaugaggcaugugcg

SEQ ID NO: 808557 - RNA, 22 nt, Human
uucagaaugcuauuucugaaau

SEQ ID NO: 808558 - RNA, 22 nt, Human
ugcuggagcggaggugagccag

SEQ ID NO: 808559 - RNA, 22 nt, Human
agcccuggcagagccagguagu

SEQ ID NO: 808560 - RNA, 22 nt, Human
augcauauugauuauagauuca

SEQ ID NO: 808561 - RNA, 22 nt, Human
gaggcagcagggcugguuccuu

SEQ ID NO: 808562 - RNA, 23 nt, Human
acugccugcuacuaugcccacgg

SEQ ID NO: 808563 - RNA, 22 nt, Human
acuggcccgggagcagaggccu

SEQ ID NO: 808564 - RNA, 22 nt, Human
agagccugcaguggagaccuug

SEQ ID NO: 808565 - RNA, 22 nt, Human
agauuucaauggauauugcaag

SEQ ID NO: 808566 - RNA, 22 nt, Human
uggacagguugaguaggaggag

SEQ ID NO: 808567 - RNA, 21 nt, Human
ggugacacguggccccgcucu

SEQ ID NO: 808568 - RNA, 19 nt, Human
acuggcagggcugcggugg

SEQ ID NO: 808569 - RNA, 22 nt, Human
cagagggcuguguaaggauguu

SEQ ID NO: 808570 - RNA, 22 nt, Human
uggccucaaccguccuaagcac

SEQ ID NO: 808571 - RNA, 22 nt, Human
cauugucacccaaagcucauag

SEQ ID NO: 808572 - RNA, 22 nt, Human
gucuuauaguacaauuugaagu

SEQ ID NO: 808573 - RNA, 22 nt, Human
aggauggcuugcaggaggcugu

SEQ ID NO: 808574 - RNA, 22 nt, Human
ucaggaagccacuccacagaga

SEQ ID NO: 808575 - RNA, 22 nt, Human
aggggagcaaggccguggugua

SEQ ID NO: 808576 - RNA, 22 nt, Human
cuggagggacuuucucacggau

SEQ ID NO: 808577 - RNA, 22 nt, Human
uggcugaagugggcaggaggga

SEQ ID NO: 808578 - RNA, 22 nt, Human
gcagcugcagacccucagugcu

SEQ ID NO: 808579 - RNA, 22 nt, Human
auggcagcuggcuugggcaccu

SEQ ID NO: 808580 - RNA, 22 nt, Human
uccaggccaauguagcaggccc

SEQ ID NO: 808581 - RNA, 22 nt, Human
uagagaugaauucugcagucuu

SEQ ID NO: 808582 - RNA, 22 nt, Human
uuaacacauauuuaucaauugc

SEQ ID NO: 808583 - RNA, 22 nt, Human
uccaggagauacacugcaccag

SEQ ID NO: 808584 - RNA, 22 nt, Human
agcagcuuuccucuggggucag

SEQ ID NO: 808585 - RNA, 22 nt, Human
ggagggcugagacuggggucug

SEQ ID NO: 808586 - RNA, 22 nt, Human
auauacaaagggcaaccucgcu

SEQ ID NO: 808587 - RNA, 22 nt, Human
aacaguaaaaaucauuuaguug

SEQ ID NO: 808588 - RNA, 22 nt, Human
aagagagagcauucuucuguua

SEQ ID NO: 808589 - RNA, 22 nt, Human
gaguggggcuuuaaaggcucag

SEQ ID NO: 808590 - RNA, 22 nt, Human
gaaauguuaugagauauguacu

SEQ ID NO: 808591 - RNA, 22 nt, Human
ccccuucucugcaagccugcuc

SEQ ID NO: 808592 - RNA, 22 nt, Human
agcugaggcauggacaggcugc

SEQ ID NO: 808593 - RNA, 22 nt, Human
aauguugcagagugauugucca

SEQ ID NO: 808594 - RNA, 22 nt, Human
cccugcaguccuuucuuggcuc

SEQ ID NO: 808595 - RNA, 22 nt, Human
cuuucuuugcagugagccagag

SEQ ID NO: 808596 - RNA, 22 nt, Human
gaggcuggcagaaaagcacagg

SEQ ID NO: 808597 - RNA, 17 nt, Human
acagcaggcccggaggg

SEQ ID NO: 808598 - RNA, 23 nt, Human
uuuuaauuuggacauaagaagau

SEQ ID NO: 808599 - RNA, 20 nt, Human
uggccucuguagaggccaag

SEQ ID NO: 808600 - RNA, 22 nt, Human
ucaauucugccucuaaauauuu

SEQ ID NO: 808601 - RNA, 22 nt, Human
cucagggaggcccugggacccu

SEQ ID NO: 808602 - RNA, 22 nt, Human
ggcugugcagggcagagucuca

SEQ ID NO: 808603 - RNA, 22 nt, Human
ugagcaguggcaccaggucacc

SEQ ID NO: 808604 - RNA, 22 nt, Human
gagguggcugcuugcugggaaa

SEQ ID NO: 808605 - RNA, 22 nt, Human
uaaaggaacugcugcuauggaa

SEQ ID NO: 808606 - RNA, 22 nt, Human
ccucgaccuccccaggcucagg

SEQ ID NO: 808607 - RNA, 18 nt, Human
acgugcugugccuuuugc

SEQ ID NO: 808608 - RNA, 22 nt, Human
cugcugugucagaguccagggg

SEQ ID NO: 808609 - RNA, 22 nt, Human
ggccagcagaccucagggacuc

SEQ ID NO: 808610 - RNA, 17 nt, Human
ggcuggaggggacccgg

SEQ ID NO: 808611 - RNA, 22 nt, Human
ccaucagauuagcaaaauccag

SEQ ID NO: 808612 - RNA, 22 nt, Human
caacaauaugcugaguuuuuca

SEQ ID NO: 808613 - RNA, 22 nt, Human
cagucacacaaguggacuuggg

SEQ ID NO: 808614 - RNA, 18 nt, Human
guccacagcccucacagc

SEQ ID NO: 808615 - RNA, 22 nt, Human
auguccaauuucagagucucau

SEQ ID NO: 808616 - RNA, 22 nt, Human
caggagccacauuccaccuuga

SEQ ID NO: 808617 - RNA, 22 nt, Human
uuuacagaugaggauacugagg

SEQ ID NO: 808618 - RNA, 19 nt, Human
ggaaggagagaaaugcaug

SEQ ID NO: 808619 - RNA, 20 nt, Human
uguccaggggaucguuggcc

SEQ ID NO: 808620 - RNA, 22 nt, Human
caggcacaaugagcgccaucuu

SEQ ID NO: 808621 - RNA, 22 nt, Human
aacaguaagagauguuuuaucu

SEQ ID NO: 808622 - RNA, 22 nt, Human
uccugcuggaaguagggaauga

SEQ ID NO: 808623 - RNA, 22 nt, Human
uuacaugacugcccuugucagg

SEQ ID NO: 808624 - RNA, 22 nt, Human
gcaggccucuguugagggccuu

SEQ ID NO: 808625 - RNA, 22 nt, Human
ucucucuugucaccccaucugc

SEQ ID NO: 808626 - RNA, 22 nt, Human
agucaguagauccaaacuuuug

SEQ ID NO: 808627 - RNA, 22 nt, Human
uggcccugacuuggaggccuga

SEQ ID NO: 808628 - RNA, 22 nt, Human
ucuccugggugcuuuaucagaa

SEQ ID NO: 808629 - RNA, 18 nt, Human
cuccuuggagaagaggcc

SEQ ID NO: 808630 - RNA, 22 nt, Human
aaauuuuccugguaaagaugga

SEQ ID NO: 808631 - RNA, 22 nt, Human
augaaacaguguguauagcaaa

SEQ ID NO: 808632 - RNA, 22 nt, Human
uaucagaugacaucuucuaugg

SEQ ID NO: 808633 - RNA, 22 nt, Human
ggagugacucucggggccacua

SEQ ID NO: 808634 - RNA, 22 nt, Human
ugucuuuacuuaauaaauauac

SEQ ID NO: 808635 - RNA, 22 nt, Human
acaggggcaggcaggacccuuu

SEQ ID NO: 808636 - RNA, 22 nt, Human
ccacauuucuucacuuguccca

SEQ ID NO: 808637 - RNA, 22 nt, Human
uuacaaguuucuggcuucaucc

SEQ ID NO: 808638 - RNA, 22 nt, Human
uucauaugcagauuaacaaaua

SEQ ID NO: 808639 - RNA, 22 nt, Human
cuuuacuucagcaagcuuuccu

SEQ ID NO: 808640 - RNA, 22 nt, Human
aguggcugauguaggcaguggg

SEQ ID NO: 808641 - RNA, 22 nt, Human
agugggcaggcagggugcgcag

SEQ ID NO: 808642 - RNA, 22 nt, Human
caagggugaaggcuccuccagg

SEQ ID NO: 808643 - RNA, 22 nt, Human
aucccccucuuggauggcggca

SEQ ID NO: 808644 - RNA, 22 nt, Human
guacauucuguggacuuggaca

SEQ ID NO: 808645 - RNA, 22 nt, Human
aauagcuuaugggauagauguu

SEQ ID NO: 808646 - RNA, 22 nt, Human
gccacaggaaagcacccuggag

SEQ ID NO: 808647 - RNA, 22 nt, Human
auuuguaagcuagagccaugau

SEQ ID NO: 808648 - RNA, 22 nt, Human
uguuuacauggagguuuucagc

SEQ ID NO: 808649 - RNA, 22 nt, Human
cuacagaaaccuuuuucauaca

SEQ ID NO: 808650 - RNA, 22 nt, Human
guauuacaaauaaauguuacug

SEQ ID NO: 808651 - RNA, 22 nt, Human
agacaauauauaauuuuaguug

SEQ ID NO: 808652 - RNA, 22 nt, Human
aaaggaagauugagcuuuucca

SEQ ID NO: 808653 - RNA, 22 nt, Human
aucuaacugggcuauuuuauug

SEQ ID NO: 808654 - RNA, 22 nt, Human
agagucaagguggcauuuagcu

SEQ ID NO: 808655 - RNA, 22 nt, Human
ucuggcuggcagugauggugug

SEQ ID NO: 808656 - RNA, 22 nt, Human
guucacauggcauuuucacauc

SEQ ID NO: 808657 - RNA, 22 nt, Human
acaaaaaccguggauucagcau

SEQ ID NO: 808658 - RNA, 22 nt, Human
ccagggcaaaugagaucauagc

SEQ ID NO: 808659 - RNA, 22 nt, Human
gccagcucccaagugagccccu

SEQ ID NO: 808660 - RNA, 22 nt, Human
caacaauaugccagacucaauu

SEQ ID NO: 808661 - RNA, 22 nt, Human
acaaaguaggcagugggcugga

SEQ ID NO: 808662 - RNA, 22 nt, Human
ccagcucaucucagugaaaugc

SEQ ID NO: 808663 - RNA, 22 nt, Human
uuacugauacacauaagaauuu

SEQ ID NO: 808664 - RNA, 22 nt, Human
uccagcacccaauguggcuaag

SEQ ID NO: 808665 - RNA, 22 nt, Human
uuugugcuaaugcuagauuacu

SEQ ID NO: 808666 - RNA, 22 nt, Human
aaauaucuuaggaguauaugag

SEQ ID NO: 808667 - RNA, 22 nt, Human
uuucagaguugucuucuugacc

SEQ ID NO: 808668 - RNA, 21 nt, Human
gcagagcuggaaccaggaccc

SEQ ID NO: 808669 - RNA, 22 nt, Human
uuugcaaauuucgucuccucag

SEQ ID NO: 808670 - RNA, 22 nt, Human
uuuuuaaccuaccuuaagagca

SEQ ID NO: 808671 - RNA, 22 nt, Human
aggcuaggggaacacuagaauc

SEQ ID NO: 808672 - RNA, 22 nt, Human
gccagcaguggccaccaccagg

SEQ ID NO: 808673 - RNA, 22 nt, Human
uucguuuucuaggaccaacaga

SEQ ID NO: 808674 - RNA, 22 nt, Human
uccagcagacucaucagcaagg

SEQ ID NO: 808675 - RNA, 22 nt, Human
gaauucuaccagggcaagaggg

SEQ ID NO: 808676 - RNA, 22 nt, Human
gauuguaaaacagaucauuauc

SEQ ID NO: 808677 - RNA, 22 nt, Human
ccugccaggccagugagcuucc

SEQ ID NO: 808678 - RNA, 22 nt, Human
uuaaacaguauaucugagcaag

SEQ ID NO: 808679 - RNA, 22 nt, Human
cuuuccucuggcacugucuggu

SEQ ID NO: 808680 - RNA, 22 nt, Human
auguuuuugagauacaaacaga

SEQ ID NO: 808681 - RNA, 22 nt, Human
aacagauauaggcagaacuuug

SEQ ID NO: 808682 - RNA, 22 nt, Human
gagcuuuuacugcuguauugaa

SEQ ID NO: 808683 - RNA, 22 nt, Human
aagauauagauaaaacuaugca

SEQ ID NO: 808684 - RNA, 22 nt, Human
gcagaggcuguagggaagguug

SEQ ID NO: 808685 - RNA, 22 nt, Human
ccagggugggguccaggaacca

SEQ ID NO: 808686 - RNA, 22 nt, Human
ucauuucuccgaccugcugucc

SEQ ID NO: 808687 - RNA, 22 nt, Human
cuccuagaugucuucagagaaa

SEQ ID NO: 808688 - RNA, 22 nt, Human
gccaggacugagaaugggagca

SEQ ID NO: 808689 - RNA, 22 nt, Human
agcuggccggccuccaggugga

SEQ ID NO: 808690 - RNA, 22 nt, Human
gggugggccugucuggccaugu

SEQ ID NO: 808691 - RNA, 22 nt, Human
uuucucuaaauagggaggcuua

SEQ ID NO: 808692 - RNA, 22 nt, Human
cugugcuugacagugggaagca

SEQ ID NO: 808693 - RNA, 22 nt, Human
aacuacagaaaagguaagcucu

SEQ ID NO: 808694 - RNA, 22 nt, Human
aagcaggagagccugggcgagc

SEQ ID NO: 808695 - RNA, 21 nt, Human
cucuucaguggugagcucuuc

SEQ ID NO: 808696 - RNA, 22 nt, Human
cagcaggcggcccgcgggcccg

SEQ ID NO: 808697 - RNA, 22 nt, Human
gcggcggagacagcaggaagcc

SEQ ID NO: 808698 - RNA, 22 nt, Human
cugggcugcuugcugaaggggu

SEQ ID NO: 808699 - RNA, 22 nt, Human
aguacaaaaugcagcaucauca

SEQ ID NO: 808700 - RNA, 22 nt, Human
ucaaaguaccauuaucagugga

SEQ ID NO: 808701 - RNA, 22 nt, Human
aagccaguggugagaagauagc

SEQ ID NO: 808702 - RNA, 23 nt, Human
cuguccaggauucuugagagaac

SEQ ID NO: 808703 - RNA, 22 nt, Human
augcaauaccuucugaaaauaa

SEQ ID NO: 808704 - RNA, 22 nt, Human
ucagaauuggacaauagaagca

SEQ ID NO: 808705 - RNA, 22 nt, Human
uagaaacccaggauuuguauuu

SEQ ID NO: 808706 - RNA, 22 nt, Human
ugcagguggcagcggggcacca

SEQ ID NO: 808707 - RNA, 22 nt, Human
uauucaaaguaccuucauugcc

SEQ ID NO: 808708 - RNA, 22 nt, Human
uccauggagauggaugacugua

SEQ ID NO: 808709 - RNA, 22 nt, Human
ggcagaccucuccagccccaca

SEQ ID NO: 808710 - RNA, 22 nt, Human
gccucugcaucuucgccgcacu

SEQ ID NO: 808711 - RNA, 22 nt, Human
caagaggcaaauugucuagaag

SEQ ID NO: 808712 - RNA, 22 nt, Human
gaagaauauauaaugauuuugu

SEQ ID NO: 808713 - RNA, 21 nt, Human
cauuucuauugaugagaaaag

SEQ ID NO: 808714 - RNA, 22 nt, Human
aaauucuggccuaucacaguga

SEQ ID NO: 808715 - RNA, 22 nt, Human
uuaaauuccagccucauaauag

SEQ ID NO: 808716 - RNA, 22 nt, Human
gcucaaauuucagacucaugaa

SEQ ID NO: 808717 - RNA, 22 nt, Human
aaaucaaaagacauguguuuua

SEQ ID NO: 808718 - RNA, 21 nt, Human
ucagcuguagagauuacauuc

SEQ ID NO: 808719 - RNA, 22 nt, Human
cacauuuagagguuagcauggu

SEQ ID NO: 808720 - RNA, 22 nt, Human
guucacaucccagaaagagcau

SEQ ID NO: 808721 - RNA, 20 nt, Human
agcuacaaugcgaagcuggc

SEQ ID NO: 808722 - RNA, 22 nt, Human
aaggcuggaccuggaugaaucu

SEQ ID NO: 808723 - RNA, 22 nt, Human
auugaaugcuugcuaacacuuu

SEQ ID NO: 808724 - RNA, 22 nt, Human
aucuuuggggcauccaggaaaa

SEQ ID NO: 808725 - RNA, 22 nt, Human
ccaucuccacugucccugucaa

SEQ ID NO: 808726 - RNA, 22 nt, Human
aggcccugagcauccgagggca

SEQ ID NO: 808727 - RNA, 22 nt, Human
uucacaaacaccagaauggcua

SEQ ID NO: 808728 - RNA, 22 nt, Human
aggaggcccuagagcucuagag

SEQ ID NO: 808729 - RNA, 22 nt, Human
auaugcauauaaagcuuuuagu

SEQ ID NO: 808730 - RNA, 22 nt, Human
uuaaagagaacucaaugaauga

SEQ ID NO: 808731 - RNA, 21 nt, Human
ugaaacagauggaaguauuug

SEQ ID NO: 808732 - RNA, 22 nt, Human
cuaaaauuaucaagauaauucc

SEQ ID NO: 808733 - RNA, 22 nt, Human
gcaggagcaauggccuaucaga

SEQ ID NO: 808734 - RNA, 22 nt, Human
gaggagcugaggcugaggccuc

SEQ ID NO: 808735 - RNA, 22 nt, Human
gggaggaaagagaaguggucca

SEQ ID NO: 808736 - RNA, 22 nt, Human
gugugcagugagcaaaagaucu

SEQ ID NO: 808737 - RNA, 22 nt, Human
aaucaaguauuuuccaguggca

SEQ ID NO: 808738 - RNA, 22 nt, Human
cugucuuuaguacaaaaaaugu

SEQ ID NO: 808739 - RNA, 22 nt, Human
ccaggcacucacggggcacugg

SEQ ID NO: 808740 - RNA, 22 nt, Human
ucuaggaguugauaaaagggcu

SEQ ID NO: 808741 - RNA, 22 nt, Human
gaagaaacaggggcuuggggag

SEQ ID NO: 808742 - RNA, 22 nt, Human
uuucugaaaacugaaguagugc

SEQ ID NO: 808743 - RNA, 22 nt, Human
auuucuguaacuuaugaaaguu

SEQ ID NO: 808744 - RNA, 22 nt, Human
gcugccuccugagauuugggca

SEQ ID NO: 808745 - RNA, 22 nt, Human
gccacagucaggacggggagag

SEQ ID NO: 808746 - RNA, 22 nt, Human
ggaacuuauacugccagauucu

SEQ ID NO: 808747 - RNA, 22 nt, Human
aguggcaggcggagauguagga

SEQ ID NO: 808748 - RNA, 22 nt, Human
cuuuacaauucaagggaacucu

SEQ ID NO: 808749 - RNA, 22 nt, Human
auuuccauuaucaugacaaauu

SEQ ID NO: 808750 - RNA, 22 nt, Human
caaggcagcccgcugaaccaca

SEQ ID NO: 808751 - RNA, 22 nt, Human
aguggcagacacaaugugggca

SEQ ID NO: 808752 - RNA, 22 nt, Human
ccacagcuccucagccucuuuc

SEQ ID NO: 808753 - RNA, 22 nt, Human
cugacuuuagaacccaaaaagu

SEQ ID NO: 808754 - RNA, 22 nt, Human
cuuauauuugucaacuuuacaa

SEQ ID NO: 808755 - RNA, 22 nt, Human
ugcagcagucagucaggccugg

SEQ ID NO: 808756 - RNA, 22 nt, Human
uucaguguuuguagagauaacu

SEQ ID NO: 808757 - RNA, 22 nt, Human
ugucauuauuugccuacugacu

SEQ ID NO: 808758 - RNA, 22 nt, Human
ugcaaaugggugaggguuagga

SEQ ID NO: 808759 - RNA, 22 nt, Human
aggcagugcucaagacagcagc

SEQ ID NO: 808760 - RNA, 22 nt, Human
ucucacagugcaggucugucuc

SEQ ID NO: 808761 - RNA, 22 nt, Human
auuucucagugaaaugacaggc

SEQ ID NO: 808762 - RNA, 20 nt, Human
auuuauguauagcuuguugu

SEQ ID NO: 808763 - RNA, 22 nt, Human
ugauucaaauauuguguaugau

SEQ ID NO: 808764 - RNA, 21 nt, Human
cccaggaggcugagaagagca

SEQ ID NO: 808765 - RNA, 22 nt, Human
aaacaucuacuguaggcuggag

SEQ ID NO: 808766 - RNA, 21 nt, Human
acagucuccccagaucucucc

SEQ ID NO: 808767 - RNA, 22 nt, Human
agggcagcacagcugugcuccu

SEQ ID NO: 808768 - RNA, 22 nt, Human
ccuggcagacugugagggcagg

SEQ ID NO: 808769 - RNA, 22 nt, Human
uggagcagcauucauccagcag

SEQ ID NO: 808770 - RNA, 22 nt, Human
aaaucauguuggcacaauaaaa

SEQ ID NO: 808771 - RNA, 22 nt, Human
gccagcagggaagccuugggcu

SEQ ID NO: 808772 - RNA, 22 nt, Human
gaaacauauuaauccagugaaa

SEQ ID NO: 808773 - RNA, 22 nt, Human
agcaccugugcccugauggaga

SEQ ID NO: 808774 - RNA, 22 nt, Human
gggaagagaggaggugguuucg

SEQ ID NO: 808775 - RNA, 22 nt, Human
cgcaccacugaauuccagccug

SEQ ID NO: 808776 - RNA, 22 nt, Human
aagugcauaaguaugauuauuu

SEQ ID NO: 808777 - RNA, 22 nt, Human
aauuuuaaucaguggugcugag

SEQ ID NO: 808778 - RNA, 22 nt, Human
agaggccagaaggcgcaccccg

SEQ ID NO: 808779 - RNA, 22 nt, Human
gaaacauuuguugaguacuugc

SEQ ID NO: 808780 - RNA, 22 nt, Human
aggccaggaccauuagcccaga

SEQ ID NO: 808781 - RNA, 22 nt, Human
caagugcaugguggcaaagaau

SEQ ID NO: 808782 - RNA, 22 nt, Human
caggaaaucacucugauuuugg

SEQ ID NO: 808783 - RNA, 22 nt, Human
caggaagggaaaauaguucggg

SEQ ID NO: 808784 - RNA, 22 nt, Human
ugcuuauaauguuacugacaac

SEQ ID NO: 808785 - RNA, 22 nt, Human
aaaugcaguugguggggauaug

SEQ ID NO: 808786 - RNA, 18 nt, Human
cagucccaaaccuuagga

SEQ ID NO: 808787 - RNA, 22 nt, Human
aagccaagguuuuggucacagc

SEQ ID NO: 808788 - RNA, 22 nt, Human
gggcaguguugugguucucuau

SEQ ID NO: 808789 - RNA, 22 nt, Human
ccuucccaggcuagaccaacau

SEQ ID NO: 808790 - RNA, 22 nt, Human
cucugcacccccggcuccucgu

SEQ ID NO: 808791 - RNA, 22 nt, Human
aggaggcugaacuagggucugg

SEQ ID NO: 808792 - RNA, 22 nt, Human
gucaaauauaugcaaaacuauu

SEQ ID NO: 808793 - RNA, 22 nt, Human
uaaggcaaguuuuuaguggaca

SEQ ID NO: 808794 - RNA, 22 nt, Human
aaaugcagacagcuucacacac

SEQ ID NO: 808795 - RNA, 22 nt, Human
cuggagggggaaauguucauug

SEQ ID NO: 808796 - RNA, 22 nt, Human
agagccccugguggagugagaa

SEQ ID NO: 808797 - RNA, 22 nt, Human
aaaugugucaguuucauucucu

SEQ ID NO: 808798 - RNA, 20 nt, Human
ugcagcacgggcccuuucca

SEQ ID NO: 808799 - RNA, 22 nt, Human
aacugcaacuucguaaagugag

SEQ ID NO: 808800 - RNA, 22 nt, Human
uuugauuuacuauaagcagcac

SEQ ID NO: 808801 - RNA, 22 nt, Human
caggcaggcugcuuuuuguuca

SEQ ID NO: 808802 - RNA, 22 nt, Human
aacuguggacuugagacugaug

SEQ ID NO: 808803 - RNA, 22 nt, Human
agagguggagcucuuggcauca

SEQ ID NO: 808804 - RNA, 22 nt, Human
guagaggcugaaaucugagggc

SEQ ID NO: 808805 - RNA, 22 nt, Human
auucuacaacccaauaauaauu

SEQ ID NO: 808806 - RNA, 22 nt, Human
aacaguaaagacagaauuuauc

SEQ ID NO: 808807 - RNA, 22 nt, Human
aaccaguuggcaaccagcaguu

SEQ ID NO: 808808 - RNA, 22 nt, Human
ugucauuuaauagauaugaugg

SEQ ID NO: 808809 - RNA, 22 nt, Human
aucauuuuauggcugagaggac

SEQ ID NO: 808810 - RNA, 22 nt, Human
ggccucagagaaggcugugcgg

SEQ ID NO: 808811 - RNA, 22 nt, Human
uucuuuauugagacuucauugu

SEQ ID NO: 808812 - RNA, 22 nt, Human
gacacaggggggcgcuagaaga

SEQ ID NO: 808813 - RNA, 22 nt, Human
ucauauaucugcaaagcaguau

SEQ ID NO: 808814 - RNA, 22 nt, Human
ugcuggcuuccugugcacagca

SEQ ID NO: 808815 - RNA, 22 nt, Human
uggaagcagugauucuugucug

SEQ ID NO: 808816 - RNA, 22 nt, Human
accccagggcugccagccuccu

SEQ ID NO: 808817 - RNA, 22 nt, Human
cuaaacauguuggugcuuuaaa

SEQ ID NO: 808818 - RNA, 22 nt, Human
ucuggaguaggaccugaaaaua

SEQ ID NO: 808819 - RNA, 22 nt, Human
cugggcugucaauggcccucug

SEQ ID NO: 808820 - RNA, 22 nt, Human
caggauggucucgaucuccuga

SEQ ID NO: 808821 - RNA, 19 nt, Human
agucacagaccuugucucc

SEQ ID NO: 808822 - RNA, 22 nt, Human
cuuaucugagaaagaugcuaca

SEQ ID NO: 808823 - RNA, 22 nt, Human
uuccuggguugugcauuguaca

SEQ ID NO: 808824 - RNA, 22 nt, Human
acaggauggccagcugauauug

SEQ ID NO: 808825 - RNA, 22 nt, Human
gugccaggugcuaagcugugcu

SEQ ID NO: 808826 - RNA, 22 nt, Human
ugucaugguauuugugagcugc

SEQ ID NO: 808827 - RNA, 22 nt, Human
aaugucaagggaagcaggaaau

SEQ ID NO: 808828 - RNA, 22 nt, Human
guuagagggcugccuuuuguuu

SEQ ID NO: 808829 - RNA, 22 nt, Human
ccagaggugaacaggaggcugu

SEQ ID NO: 808830 - RNA, 22 nt, Human
ggcaagugugagaagggacugg

SEQ ID NO: 808831 - RNA, 22 nt, Human
uucauuuguaacucuguuaggg

SEQ ID NO: 808832 - RNA, 21 nt, Human
aguuuuauauuauaagcuaaa

SEQ ID NO: 808833 - RNA, 22 nt, Human
aacauucuucaaauaucacucu

SEQ ID NO: 808834 - RNA, 22 nt, Human
caguuugugcuaggcacuauuu

SEQ ID NO: 808835 - RNA, 22 nt, Human
gaacacagguggcccggcaggg

SEQ ID NO: 808836 - RNA, 22 nt, Human
agcagcagagcucuggucugca

SEQ ID NO: 808837 - RNA, 22 nt, Human
acuguuuugugccuuaguuucc

SEQ ID NO: 808838 - RNA, 22 nt, Human
caggaggaaacuggauucacuu

SEQ ID NO: 808839 - RNA, 22 nt, Human
ugugucaaaguguggaguauuu

SEQ ID NO: 808840 - RNA, 22 nt, Human
agucuuuauuuagaguuaggac

SEQ ID NO: 808841 - RNA, 22 nt, Human
ucugagggugggagaaggagcu

SEQ ID NO: 808842 - RNA, 22 nt, Human
gaaggcuuuucuaccagaucuu

SEQ ID NO: 808843 - RNA, 22 nt, Human
uauuuucauucugugugacugu

SEQ ID NO: 808844 - RNA, 22 nt, Human
aguuguaagaggcacaaggaag

SEQ ID NO: 808845 - RNA, 22 nt, Human
ggugacggggcccagguuuccu

SEQ ID NO: 808846 - RNA, 22 nt, Human
caggaaauguauaauuuuauaa

SEQ ID NO: 808847 - RNA, 22 nt, Human
gaagagcugugauucaggcuua

SEQ ID NO: 808848 - RNA, 22 nt, Human
aaaagcucuuucugcuguagau

SEQ ID NO: 808849 - RNA, 22 nt, Human
aggcucuggcuacuacagagcu

SEQ ID NO: 808850 - RNA, 22 nt, Human
ugggagaaacugucucucccac

SEQ ID NO: 808851 - RNA, 19 nt, Human
auuuauuguaugauuccau

SEQ ID NO: 808852 - RNA, 22 nt, Human
cagcucacagccacgccauucc

SEQ ID NO: 808853 - RNA, 22 nt, Human
caggacagguguucuagaucag

SEQ ID NO: 808854 - RNA, 22 nt, Human
uagggguguuucgagagagguu

SEQ ID NO: 808855 - RNA, 22 nt, Human
uccagcagccacaccucuggac

SEQ ID NO: 808856 - RNA, 19 nt, Human
ugaguuuaaugcaaaacug

SEQ ID NO: 808857 - RNA, 18 nt, Human
ucuccuggguaggggccu

SEQ ID NO: 808858 - RNA, 22 nt, Human
uaguaaaaagcaauggugagua

SEQ ID NO: 808859 - RNA, 22 nt, Human
ccuuuuucaauauagaauugca

SEQ ID NO: 808860 - RNA, 22 nt, Human
auaugcauaugucaaaacuuau

SEQ ID NO: 808861 - RNA, 22 nt, Human
aagcugcccaagacugaagcau

SEQ ID NO: 808862 - RNA, 22 nt, Human
aggcugugaugagccucaugga

SEQ ID NO: 808863 - RNA, 22 nt, Human
cugggaggacaacuuggagcuc

SEQ ID NO: 808864 - RNA, 22 nt, Human
uugggcugaucuguggaagaag

SEQ ID NO: 808865 - RNA, 22 nt, Human
cccuucucuuucacucacuauu

SEQ ID NO: 808866 - RNA, 22 nt, Human
acacuguuccacacuaagaagg

SEQ ID NO: 808867 - RNA, 22 nt, Human
guggcccacacagacagcaucu

SEQ ID NO: 808868 - RNA, 23 nt, Human
aaacuugcuauggcugaaaucau

SEQ ID NO: 808869 - RNA, 22 nt, Human
uccccaggaaggcccuuccugg

SEQ ID NO: 808870 - RNA, 22 nt, Human
agcugcugagccaggcugaugu

SEQ ID NO: 808871 - RNA, 22 nt, Human
ccagcagguguagggcucaugg

SEQ ID NO: 808872 - RNA, 22 nt, Human
gauggcagcagcagccagggau

SEQ ID NO: 808873 - RNA, 17 nt, Human
acuccuggucugaaggg

SEQ ID NO: 808874 - RNA, 22 nt, Human
guuuccaggcacuuuuucugcu

SEQ ID NO: 808875 - RNA, 22 nt, Human
ucuggcuguuuuagaugagcuc

SEQ ID NO: 808876 - RNA, 22 nt, Human
cugggacacccaaggaaagagc

SEQ ID NO: 808877 - RNA, 23 nt, Human
acuauaaaguuguucugauuuac

SEQ ID NO: 808878 - RNA, 22 nt, Human
uggacaaauagcaugacacuug

SEQ ID NO: 808879 - RNA, 22 nt, Human
agagaugcaggguacauggaau

SEQ ID NO: 808880 - RNA, 22 nt, Human
uucuguuuacucagaaauacaa

SEQ ID NO: 808881 - RNA, 22 nt, Human
augcaacagagaaaauauugag

SEQ ID NO: 808882 - RNA, 22 nt, Human
aacuuauugaacauucucgaau

SEQ ID NO: 808883 - RNA, 22 nt, Human
gaggcugaggguuagagaguca

SEQ ID NO: 808884 - RNA, 21 nt, Human
ccuggccaaucugauaggguu

SEQ ID NO: 808885 - RNA, 22 nt, Human
agggucaccaguucauaggcac

SEQ ID NO: 808886 - RNA, 22 nt, Human
uauggucauuuguuagugcuuu

SEQ ID NO: 808887 - RNA, 22 nt, Human
ugucauuuaguccucugugugu

SEQ ID NO: 808888 - RNA, 22 nt, Human
aggcccugcccagugccacaag

SEQ ID NO: 808889 - RNA, 22 nt, Human
gcccucagaggacagcugacuu

SEQ ID NO: 808890 - RNA, 22 nt, Human
aggaaccugagucugaucauuu

SEQ ID NO: 808891 - RNA, 19 nt, Human
cugagcagcggcagcacuu

SEQ ID NO: 808892 - RNA, 22 nt, Human
cugggaagaagugggcuacauu

SEQ ID NO: 808893 - RNA, 22 nt, Human
aggaaacauccuuaucuauucu

SEQ ID NO: 808894 - RNA, 22 nt, Human
ccugccaggagcuggugcugca

SEQ ID NO: 808895 - RNA, 17 nt, Human
uccuccccgcaguugca

SEQ ID NO: 808896 - RNA, 22 nt, Human
ucuggcucagggcucugaggga

SEQ ID NO: 808897 - RNA, 19 nt, Human
ucugccucuggucaggcuc

SEQ ID NO: 808898 - RNA, 22 nt, Human
cugcucuggggaagccagaugu

SEQ ID NO: 808899 - RNA, 22 nt, Human
aagugucaauauuuuuguaggu

SEQ ID NO: 808900 - RNA, 22 nt, Human
acaggaagaaagugcaguagau

SEQ ID NO: 808901 - RNA, 22 nt, Human
ucuagaaaaacaaaguaucuga

SEQ ID NO: 808902 - RNA, 22 nt, Human
uauugacagugacuauugguag

SEQ ID NO: 808903 - RNA, 22 nt, Human
cugccuggcauagucuggucga

SEQ ID NO: 808904 - RNA, 22 nt, Human
cagcccugaaacaaccuccucu

SEQ ID NO: 808905 - RNA, 16 nt, Human
uagcuuuguguugugg

SEQ ID NO: 808906 - RNA, 22 nt, Human
ggaagcuccccaagccugcccu

SEQ ID NO: 808907 - RNA, 22 nt, Human
uuguuaguuuauauaauguagu

SEQ ID NO: 808908 - RNA, 20 nt, Human
gggcuggcgcauggggaaag

SEQ ID NO: 808909 - RNA, 22 nt, Human
uccucccacauaggacaauggg

SEQ ID NO: 808910 - RNA, 19 nt, Human
ugagaaauuccacaggaug

SEQ ID NO: 808911 - RNA, 22 nt, Human
agcugaaacuucccauuaauug

SEQ ID NO: 808912 - RNA, 22 nt, Human
aggcaggagcaagcccuacaag

SEQ ID NO: 808913 - RNA, 22 nt, Human
aucagucauauccaaauuagca

SEQ ID NO: 808914 - RNA, 19 nt, Human
agcugcuggcccagggacc

SEQ ID NO: 808915 - RNA, 22 nt, Human
aauacauaauaaguuuugucug

SEQ ID NO: 808916 - RNA, 22 nt, Human
uuuuucauauuccccucucugg

SEQ ID NO: 808917 - RNA, 22 nt, Human
gcagcgcuguaggcccaaggca

SEQ ID NO: 808918 - RNA, 22 nt, Human
ucugcccuggggucagccucca

SEQ ID NO: 808919 - RNA, 22 nt, Human
uacuuuuaaaauucacagguau

SEQ ID NO: 808920 - RNA, 22 nt, Human
ucagcaggcagaaaucugcaga

SEQ ID NO: 808921 - RNA, 22 nt, Human
aacccuggggcagcugcuaggg

SEQ ID NO: 808922 - RNA, 22 nt, Human
uucuucugauugccuucugcaa

SEQ ID NO: 808923 - RNA, 22 nt, Human
gcagggcagagggagaaucucu

SEQ ID NO: 808924 - RNA, 19 nt, Human
augcaaauagauuuggaau

SEQ ID NO: 808925 - RNA, 22 nt, Human
ugaguggagaacagaggcucuc

SEQ ID NO: 808926 - RNA, 22 nt, Human
uccagaggggcagcccugugcu

SEQ ID NO: 808927 - RNA, 22 nt, Human
ggccccaggccuuuggucuggc

SEQ ID NO: 808928 - RNA, 22 nt, Human
cugaggaaagcugcagcgguac

SEQ ID NO: 808929 - RNA, 21 nt, Human
uacaguaaguugggugguccu

SEQ ID NO: 808930 - RNA, 22 nt, Human
gcagcgcuacucacagcucuga

SEQ ID NO: 808931 - RNA, 22 nt, Human
cuugucuugcacacgguugcca

SEQ ID NO: 808932 - RNA, 22 nt, Human
cagagggcucggcggccgcucc

SEQ ID NO: 808933 - RNA, 22 nt, Human
uggaggagugugauugucugcc

SEQ ID NO: 808934 - RNA, 22 nt, Human
ggaccagcuaucaaugccaggg

SEQ ID NO: 808935 - RNA, 22 nt, Human
agagaagagcaaugauaaauuu

SEQ ID NO: 808936 - RNA, 22 nt, Human
auuuguuucagggccuugguau

SEQ ID NO: 808937 - RNA, 22 nt, Human
uauugugcucaccauuacaucc

SEQ ID NO: 808938 - RNA, 22 nt, Human
uaggaaauucucuugcuaaguu

SEQ ID NO: 808939 - RNA, 22 nt, Human
aggaggaacucagaaagaaggu

SEQ ID NO: 808940 - RNA, 22 nt, Human
gaacaauagugguaacaaagcc

SEQ ID NO: 808941 - RNA, 22 nt, Human
gggcccuggccgaaucccucug

SEQ ID NO: 808942 - RNA, 22 nt, Human
uagguagcuuuggcguuucuug

SEQ ID NO: 808943 - RNA, 22 nt, Human
uugagaaccacugaguuagaua

SEQ ID NO: 808944 - RNA, 22 nt, Human
gaaggcuucuccagggcuuacu

SEQ ID NO: 808945 - RNA, 22 nt, Human
aaugagaaaacacagaggaggu

SEQ ID NO: 808946 - RNA, 22 nt, Human
ccugggcuuccacgagcagagg

SEQ ID NO: 808947 - RNA, 22 nt, Human
ugaguuaaaugagaacaugaaa

SEQ ID NO: 808948 - RNA, 22 nt, Human
ggcagaggagcuggaaacaugg

SEQ ID NO: 808949 - RNA, 18 nt, Human
aggcagcagcaucuucuc

SEQ ID NO: 808950 - RNA, 22 nt, Human
caaagcaaggcucaguuugaac

SEQ ID NO: 808951 - RNA, 22 nt, Human
gguaacugaggccauauucuga

SEQ ID NO: 808952 - RNA, 22 nt, Human
cucagagggucuccuccagaau

SEQ ID NO: 808953 - RNA, 22 nt, Human
gcuuacaaucauuucaguuuag

SEQ ID NO: 808954 - RNA, 22 nt, Human
augcaaaugcagccauugcaga

SEQ ID NO: 808955 - RNA, 22 nt, Human
gcagugcuaaggauucugccuu

SEQ ID NO: 808956 - RNA, 22 nt, Human
gccuggagcucaugugggcauu

SEQ ID NO: 808957 - RNA, 22 nt, Human
cuacauuuguucuauagcuuuu

SEQ ID NO: 808958 - RNA, 22 nt, Human
gcuggcagcuggaaguugggcu

SEQ ID NO: 808959 - RNA, 22 nt, Human
aggauggcgauucgagcaccuc

SEQ ID NO: 808960 - RNA, 22 nt, Human
ugucugaauucaagaaauucaa

SEQ ID NO: 808961 - RNA, 22 nt, Human
gugccagcucuccccacaucug

SEQ ID NO: 808962 - RNA, 22 nt, Human
cccaggcaucccauuaaggagc

SEQ ID NO: 808963 - RNA, 22 nt, Human
uaggaaaugcuccauugcauaa

SEQ ID NO: 808964 - RNA, 22 nt, Human
ccuauuuguaggcugggccagu

SEQ ID NO: 808965 - RNA, 22 nt, Human
caauaauuuacauuggauacca

SEQ ID NO: 808966 - RNA, 22 nt, Human
cucugauuuauauuauaaagug

SEQ ID NO: 808967 - RNA, 22 nt, Human
auacagauguugaauguuauau

SEQ ID NO: 808968 - RNA, 22 nt, Human
ccaggacaggaguuggcuucgc

SEQ ID NO: 808969 - RNA, 22 nt, Human
uauucacaggcacgaaauauug

SEQ ID NO: 808970 - RNA, 22 nt, Human
gaauauuuuuaaagggacuaau

SEQ ID NO: 808971 - RNA, 19 nt, Human
uaaggccaaaaguaagugu

SEQ ID NO: 808972 - RNA, 22 nt, Human
acauucugugagucauguuuua

SEQ ID NO: 808973 - RNA, 22 nt, Human
agcugcugagagucugccgggc

SEQ ID NO: 808974 - RNA, 21 nt, Human
gcaugccugcaucuuaguguu

SEQ ID NO: 808975 - RNA, 22 nt, Human
caggccuccacuccacgcagac

SEQ ID NO: 808976 - RNA, 22 nt, Human
cuaaaugucauggaguuguaga

SEQ ID NO: 808977 - RNA, 22 nt, Human
gugauucugccuggaagguccu

SEQ ID NO: 808978 - RNA, 22 nt, Human
gcaagcugaugugauagugaaa

SEQ ID NO: 808979 - RNA, 22 nt, Human
aggcucaguauagcuggcaagu

SEQ ID NO: 808980 - RNA, 22 nt, Human
gagccugaaauacaggucacug

SEQ ID NO: 808981 - RNA, 22 nt, Human
cuugaauguccuguggcaaagu

SEQ ID NO: 808982 - RNA, 23 nt, Human
ugguggucagcccuuucuggagg

SEQ ID NO: 808983 - RNA, 22 nt, Human
aguguuaaugguguauauuagg

SEQ ID NO: 808984 - RNA, 22 nt, Human
cuccuggcuuucccagaccagg

SEQ ID NO: 808985 - RNA, 20 nt, Human
ucccaucacgccugugccag

SEQ ID NO: 808986 - RNA, 21 nt, Human
ucaguguauuuaagaauguug

SEQ ID NO: 808987 - RNA, 22 nt, Human
aacccaggaguuggaggcugug

SEQ ID NO: 808988 - RNA, 22 nt, Human
cagucagucaauacucuuugag

SEQ ID NO: 808989 - RNA, 22 nt, Human
gcccugggauuggguggaggcu

SEQ ID NO: 808990 - RNA, 23 nt, Human
uauuugcuacugguaauucugga

SEQ ID NO: 808991 - RNA, 22 nt, Human
caguuuauauauaagcacauug

SEQ ID NO: 808992 - RNA, 22 nt, Human
uguaugcaccauuguauuaccu

SEQ ID NO: 808993 - RNA, 22 nt, Human
gcccaggaguucaaggcugcag

SEQ ID NO: 808994 - RNA, 20 nt, Human
aaaauauguauaacucuucu

SEQ ID NO: 808995 - RNA, 22 nt, Human
agaaauguauucuguauguuuu

SEQ ID NO: 808996 - RNA, 22 nt, Human
caaacauugggggcuucaacac

SEQ ID NO: 808997 - RNA, 22 nt, Human
agacucuggaggggcugguccu

SEQ ID NO: 808998 - RNA, 23 nt, Human
aaauagagauaggccagcuuugc

SEQ ID NO: 808999 - RNA, 22 nt, Human
uguccaggcucccuuggugcug

SEQ ID NO: 809000 - RNA, 22 nt, Human
cuuguauuccccuaucucuaaa

SEQ ID NO: 809001 - RNA, 22 nt, Human
auuauuugacuugagaacaggu

SEQ ID NO: 809002 - RNA, 22 nt, Human
cugacauguauaagcuuuaagu

SEQ ID NO: 809003 - RNA, 22 nt, Human
cacaugagagcccccaagagca

SEQ ID NO: 809004 - RNA, 22 nt, Human
gauuuacagcuauacccaaugg

SEQ ID NO: 809005 - RNA, 22 nt, Human
acaguuaucuuugaaauagaga

SEQ ID NO: 809006 - RNA, 18 nt, Human
ggguggugugcucuucgc

SEQ ID NO: 809007 - RNA, 22 nt, Human
gcagggcuuagaaaugguggcu

SEQ ID NO: 809008 - RNA, 22 nt, Human
uuguauuuccuauaaccuuucu

SEQ ID NO: 809009 - RNA, 22 nt, Human
acauguaaaaauuaagguaaga

SEQ ID NO: 809010 - RNA, 22 nt, Human
uccuuccuggggucucugcugc

SEQ ID NO: 809011 - RNA, 22 nt, Human
agaaugauuuuggacaauaugg

SEQ ID NO: 809012 - RNA, 22 nt, Human
ugugaaaagcguguguucuagg

SEQ ID NO: 809013 - RNA, 22 nt, Human
uucuuacacucuuaaaaaucau

SEQ ID NO: 809014 - RNA, 22 nt, Human
uugauuucuauucagauguaga

SEQ ID NO: 809015 - RNA, 22 nt, Human
uuugcaaagaaauuauugcugu

SEQ ID NO: 809016 - RNA, 22 nt, Human
auugcaaaggucccauucaaga

SEQ ID NO: 809017 - RNA, 22 nt, Human
aauuguaagugcugaguuaagg

SEQ ID NO: 809018 - RNA, 22 nt, Human
cuggcugguuggggagaagaca

SEQ ID NO: 809019 - RNA, 20 nt, Human
aaaugccagugauucugcuu

SEQ ID NO: 809020 - RNA, 22 nt, Human
ggagggcaucaaucaggccugg

SEQ ID NO: 809021 - RNA, 20 nt, Human
ugcagcugcaggaggguggg

SEQ ID NO: 809022 - RNA, 22 nt, Human
gauuacauucuccuuguauuag

SEQ ID NO: 809023 - RNA, 22 nt, Human
gggaaggcagugggaggaacug

SEQ ID NO: 809024 - RNA, 22 nt, Human
auaguauuuccagaaauagucu

SEQ ID NO: 809025 - RNA, 22 nt, Human
acagaggccucguagguacaac

SEQ ID NO: 809026 - RNA, 22 nt, Human
agucuggaauuuggccugagca

SEQ ID NO: 809027 - RNA, 22 nt, Human
gauuaaguggaaugaguauuug

SEQ ID NO: 809028 - RNA, 22 nt, Human
ccucaggauacaggagccacag

SEQ ID NO: 809029 - RNA, 22 nt, Human
cuaucuguaaauuugagguucu

SEQ ID NO: 809030 - RNA, 22 nt, Human
gugggcaggccccaaagcaggg

SEQ ID NO: 809031 - RNA, 22 nt, Human
caggguucagugggcccucuug

SEQ ID NO: 809032 - RNA, 18 nt, Human
aggccugggaagcugagg

SEQ ID NO: 809033 - RNA, 22 nt, Human
ucugcaggagcagggcguggag

SEQ ID NO: 809034 - RNA, 22 nt, Human
cagucccagacauaguaaggga

SEQ ID NO: 809035 - RNA, 22 nt, Human
ucacaggagucauaauuacagu

SEQ ID NO: 809036 - RNA, 22 nt, Human
auagccuugguccuugcuccac

SEQ ID NO: 809037 - RNA, 22 nt, Human
ccaggagcaacuugaaggcaag

SEQ ID NO: 809038 - RNA, 22 nt, Human
uccagcuccugaguucacugcu

SEQ ID NO: 809039 - RNA, 22 nt, Human
acaugcaacaaaguaccugcaa

SEQ ID NO: 809040 - RNA, 22 nt, Human
ucacaggaaccaucagagaaau

SEQ ID NO: 809041 - RNA, 22 nt, Human
uucagaaugagaauggaugggu

SEQ ID NO: 809042 - RNA, 22 nt, Human
cuccuggacauggagcggagga

SEQ ID NO: 809043 - RNA, 22 nt, Human
auggcauuguuuauagauugca

SEQ ID NO: 809044 - RNA, 22 nt, Human
caacuauauagaaauugauugu

SEQ ID NO: 809045 - RNA, 22 nt, Human
uuggcagggcugcuugucuagg

SEQ ID NO: 809046 - RNA, 22 nt, Human
ggccucaguuucuccauggguu

SEQ ID NO: 809047 - RNA, 22 nt, Human
gauuaauagacacaaccaagcu

SEQ ID NO: 809048 - RNA, 22 nt, Human
aguauauugguguuauuccuca

SEQ ID NO: 809049 - RNA, 22 nt, Human
uucaaagugcuuuuaaccuuua

SEQ ID NO: 809050 - RNA, 22 nt, Human
agaauuucaaaaggaagccagc

SEQ ID NO: 809051 - RNA, 22 nt, Human
ugggugcucugcgaccguaggg

SEQ ID NO: 809052 - RNA, 22 nt, Human
ggacuuggggaaggcacaguua

SEQ ID NO: 809053 - RNA, 22 nt, Human
ggaaaacugaggcucucagcag

SEQ ID NO: 809054 - RNA, 22 nt, Human
gacacagagauaggccuguguu

SEQ ID NO: 809055 - RNA, 22 nt, Human
aggccacaguacuuugcagacc

SEQ ID NO: 809056 - RNA, 22 nt, Human
ggcuggcuggcugguagacaag

SEQ ID NO: 809057 - RNA, 22 nt, Human
acccagggucaccccguagggu

SEQ ID NO: 809058 - RNA, 22 nt, Human
uugauucaguaaagcuaaauuu

SEQ ID NO: 809059 - RNA, 22 nt, Human
cucugcacacaaguaauuucau

SEQ ID NO: 809060 - RNA, 22 nt, Human
agacaaauugggacauuguguu

SEQ ID NO: 809061 - RNA, 17 nt, Human
uuuuguucaucuucaaa

SEQ ID NO: 809062 - RNA, 22 nt, Human
caggccucaccagcggagcugc

SEQ ID NO: 809063 - RNA, 22 nt, Human
ggcagggcagcgcugauuaggg

SEQ ID NO: 809064 - RNA, 20 nt, Human
ccucaaauaagugccagcau

SEQ ID NO: 809065 - RNA, 22 nt, Human
aguuuucucacaucaaaaauga

SEQ ID NO: 809066 - RNA, 22 nt, Human
aaagagaugugccaaauagccu

SEQ ID NO: 809067 - RNA, 22 nt, Human
ccugugucuuccccacuggugu

SEQ ID NO: 809068 - RNA, 22 nt, Human
aaggcuccacccucauggaugc

SEQ ID NO: 809069 - RNA, 22 nt, Human
agcaggugacagggcuguggug

SEQ ID NO: 809070 - RNA, 22 nt, Human
uucagugucccuaguagaaguu

SEQ ID NO: 809071 - RNA, 22 nt, Human
uuuuuauacuuugcucaagauu

SEQ ID NO: 809072 - RNA, 22 nt, Human
gaggcuccauggaggaguaugg

SEQ ID NO: 809073 - RNA, 22 nt, Human
ccacucugauuucaagggagau

SEQ ID NO: 809074 - RNA, 22 nt, Human
aaggaagcagcaaugcaugauu

SEQ ID NO: 809075 - RNA, 22 nt, Human
uuuucuauuaacucauuuugca

SEQ ID NO: 809076 - RNA, 22 nt, Human
gcccagggugaagugcaguugu

SEQ ID NO: 809077 - RNA, 22 nt, Human
acccagggcucaagcguaggca

SEQ ID NO: 809078 - RNA, 22 nt, Human
aagccaggguuuguggaucuau

SEQ ID NO: 809079 - RNA, 22 nt, Human
cagggaugagaaagcucucuaa

SEQ ID NO: 809080 - RNA, 22 nt, Human
accagggcuuacagcaguagcu

SEQ ID NO: 809081 - RNA, 22 nt, Human
uuuguucaugccuauauucuca

SEQ ID NO: 809082 - RNA, 22 nt, Human
uccuuaaaugugaucuagauuu

SEQ ID NO: 809083 - RNA, 19 nt, Human
cucuuuggagauccuugga

SEQ ID NO: 809084 - RNA, 23 nt, Human
auugauucccucuuggaagggau

SEQ ID NO: 809085 - RNA, 22 nt, Human
aaucauaauuguauacauucau

SEQ ID NO: 809086 - RNA, 22 nt, Human
uuugcuauaaaagggucacacg

SEQ ID NO: 809087 - RNA, 22 nt, Human
gcugaaauucagauuccuaggc

SEQ ID NO: 809088 - RNA, 23 nt, Human
cagcccugaaaucgaggugacac

SEQ ID NO: 809089 - RNA, 22 nt, Human
ccuggcugggccugauuucuca

SEQ ID NO: 809090 - RNA, 22 nt, Human
ucagccuccgaaagugcuggga

SEQ ID NO: 809091 - RNA, 22 nt, Human
ggaagauucaguuaucucauga

SEQ ID NO: 809092 - RNA, 22 nt, Human
guuccaaagucucugagcugag

SEQ ID NO: 809093 - RNA, 22 nt, Human
auguuuguugaacaucuacugc

SEQ ID NO: 809094 - RNA, 22 nt, Human
uagauuuugcauuucuaacaag

SEQ ID NO: 809095 - RNA, 22 nt, Human
cagggcagggccacacccccug

SEQ ID NO: 809096 - RNA, 22 nt, Human
uuuauuuauaagccacuugcug

SEQ ID NO: 809097 - RNA, 22 nt, Human
uuugcauuauauuuauagaaga

SEQ ID NO: 809098 - RNA, 22 nt, Human
cagggacagccuugggguggcg

SEQ ID NO: 809099 - RNA, 22 nt, Human
ugccauguuuaaaguugaaggg

SEQ ID NO: 809100 - RNA, 22 nt, Human
uggguuggaagcaggaggcacc

SEQ ID NO: 809101 - RNA, 19 nt, Human
uugaaauuguuugauaugg

SEQ ID NO: 809102 - RNA, 21 nt, Human
ccaggcaugacugcagagagc

SEQ ID NO: 809103 - RNA, 22 nt, Human
cugagacacggagaggcugugu

SEQ ID NO: 809104 - RNA, 20 nt, Human
uuacaaagaggcaucgcuuu

SEQ ID NO: 809105 - RNA, 22 nt, Human
cagaaagugauuugcuauucca

SEQ ID NO: 809106 - RNA, 22 nt, Human
ucagcaggcccauccuccaggc

SEQ ID NO: 809107 - RNA, 22 nt, Human
cagaggcacaagaaagcaaggc

SEQ ID NO: 809108 - RNA, 22 nt, Human
gcuuggcuccuggcucacaggu

SEQ ID NO: 809109 - RNA, 22 nt, Human
ggaggcagaauagagugugggu

SEQ ID NO: 809110 - RNA, 22 nt, Human
gauuucuguugagaaacauggg

SEQ ID NO: 809111 - RNA, 17 nt, Human
ugcuggaggcgggguau

SEQ ID NO: 809112 - RNA, 22 nt, Human
ggccaggugcgguggcucacac

SEQ ID NO: 809113 - RNA, 22 nt, Human
cuguuucacguguuuaagccca

SEQ ID NO: 809114 - RNA, 22 nt, Human
uggcagagagagugcagucgac

SEQ ID NO: 809115 - RNA, 22 nt, Human
ucugacauuagauuaauuggaa

SEQ ID NO: 809116 - RNA, 22 nt, Human
aaaggcaugcauggucugcucc

SEQ ID NO: 809117 - RNA, 22 nt, Human
ccuggccauagggcccaggaaa

SEQ ID NO: 809118 - RNA, 23 nt, Human
ccaggcaguagcuauugaaguga

SEQ ID NO: 809119 - RNA, 22 nt, Human
cagugcaggcuuguggccgcag

SEQ ID NO: 809120 - RNA, 22 nt, Human
gaagaaacugaaagggguuggu

SEQ ID NO: 809121 - RNA, 22 nt, Human
ggcagggacaggauaggguuuu

SEQ ID NO: 809122 - RNA, 22 nt, Human
uaucaaaguuguccugugaagu

SEQ ID NO: 809123 - RNA, 22 nt, Human
ggccccagggauuaggccaacc

SEQ ID NO: 809124 - RNA, 18 nt, Human
acaguaaagaaaggaauu

SEQ ID NO: 809125 - RNA, 22 nt, Human
ugcaggaauagcuacagagcug

SEQ ID NO: 809126 - RNA, 22 nt, Human
uuccagaggcucuaggggagaa

SEQ ID NO: 809127 - RNA, 22 nt, Human
ugggcagcagcaaagccagacu

SEQ ID NO: 809128 - RNA, 22 nt, Human
ugccuaggaaaccucaugcuuc

SEQ ID NO: 809129 - RNA, 22 nt, Human
caggccagugggaaauagggau

SEQ ID NO: 809130 - RNA, 22 nt, Human
gcugcagccuucuugccauuaa

SEQ ID NO: 809131 - RNA, 22 nt, Human
ugggccucaugcccagccaccc

SEQ ID NO: 809132 - RNA, 22 nt, Human
cggucaggugcagcguuggcac

SEQ ID NO: 809133 - RNA, 22 nt, Human
agcuccuguggcugaaagagga

SEQ ID NO: 809134 - RNA, 22 nt, Human
agagcugguuuacucaggaauu

SEQ ID NO: 809135 - RNA, 22 nt, Human
ugaaaaacacuaauuggaaagc

SEQ ID NO: 809136 - RNA, 22 nt, Human
gcugagucuugagcacugagca

SEQ ID NO: 809137 - RNA, 23 nt, Human
ggacccuguggagggugagaguc

SEQ ID NO: 809138 - RNA, 22 nt, Human
caggcagauuugcugcccucca

SEQ ID NO: 809139 - RNA, 22 nt, Human
acaugacaaaaugcacaggauu

SEQ ID NO: 809140 - RNA, 22 nt, Human
aagaauacguaucaacaauggu

SEQ ID NO: 809141 - RNA, 22 nt, Human
ggugucaaauuauugaguuuca

SEQ ID NO: 809142 - RNA, 22 nt, Human
gcugggagcaaguacucaucuu

SEQ ID NO: 809143 - RNA, 22 nt, Human
aaagccagaauucguccagccu

SEQ ID NO: 809144 - RNA, 22 nt, Human
ccagcaggcagucauauccuuu

SEQ ID NO: 809145 - RNA, 22 nt, Human
ccucagccuuggccccaggcag

SEQ ID NO: 809146 - RNA, 22 nt, Human
guacauaagaaauuacuacaga

SEQ ID NO: 809147 - RNA, 22 nt, Human
caguuucucagacuucccuugu

SEQ ID NO: 809148 - RNA, 22 nt, Human
ucccagccacagguguagcccu

SEQ ID NO: 809149 - RNA, 22 nt, Human
ggggucggggcauagccacuua

SEQ ID NO: 809150 - RNA, 22 nt, Human
ggccuugggauguggcugcagc

SEQ ID NO: 809151 - RNA, 22 nt, Human
ugccuggcacagagcagguggc

SEQ ID NO: 809152 - RNA, 22 nt, Human
agucuuugguuauaagagacag

SEQ ID NO: 809153 - RNA, 22 nt, Human
ugguuagaggcuucuugcuugg

SEQ ID NO: 809154 - RNA, 22 nt, Human
ggcaucuuguugcucaaaucua

SEQ ID NO: 809155 - RNA, 22 nt, Human
acaguguuuuagaaaagcuuga

SEQ ID NO: 809156 - RNA, 22 nt, Human
uucaguaugacagacgcauugg

SEQ ID NO: 809157 - RNA, 22 nt, Human
aauaauguacauacauauuucg

SEQ ID NO: 809158 - RNA, 22 nt, Human
cugccguccaucuacgucucag

SEQ ID NO: 809159 - RNA, 23 nt, Human
acaaaguaauuccugcuuccaaa

SEQ ID NO: 809160 - RNA, 20 nt, Human
caauaauuuacuucccuauu

SEQ ID NO: 809161 - RNA, 22 nt, Human
gaagccagauuuggggcauauc

SEQ ID NO: 809162 - RNA, 22 nt, Human
gucccugcaucugcaggccaug

SEQ ID NO: 809163 - RNA, 22 nt, Human
aagaacauaacagaagcugugu

SEQ ID NO: 809164 - RNA, 22 nt, Human
uuccagcccgcgacuuguucag

SEQ ID NO: 809165 - RNA, 22 nt, Human
guucauuuuuagaaugcuagua

SEQ ID NO: 809166 - RNA, 22 nt, Human
aggagucuguugaaaugucuau

SEQ ID NO: 809167 - RNA, 22 nt, Human
acagugaucaguuacugucugu

SEQ ID NO: 809168 - RNA, 22 nt, Human
auuauuauaaagugcaugaccu

SEQ ID NO: 809169 - RNA, 21 nt, Human
aacugcaaaugaugcuggaga

SEQ ID NO: 809170 - RNA, 22 nt, Human
gugggugauguacuggaggcca

SEQ ID NO: 809171 - RNA, 22 nt, Human
aucuacaaccccucaaacugug

SEQ ID NO: 809172 - RNA, 18 nt, Human
aggagaaagggaccaggg

SEQ ID NO: 809173 - RNA, 18 nt, Human
ggagccagucugucucug

SEQ ID NO: 809174 - RNA, 22 nt, Human
caggcacaaauuucuagauaag

SEQ ID NO: 809175 - RNA, 22 nt, Human
cucaaguaauuagcaacaaaua

SEQ ID NO: 809176 - RNA, 22 nt, Human
gaccagcucucugaagaaagag

SEQ ID NO: 809177 - RNA, 22 nt, Human
auaggacagcagacaauuagua

SEQ ID NO: 809178 - RNA, 22 nt, Human
agggagcaugggugaagcaggc

SEQ ID NO: 809179 - RNA, 21 nt, Human
caaauacuuagaaacuuaaga

SEQ ID NO: 809180 - RNA, 22 nt, Human
cugcaggcaucuaacugugggc

SEQ ID NO: 809181 - RNA, 22 nt, Human
ugccuggcaaugccagaagcca

SEQ ID NO: 809182 - RNA, 22 nt, Human
aguaaugaagauuuguugcaca

SEQ ID NO: 809183 - RNA, 22 nt, Human
agcaggcugggcaauaugggca

SEQ ID NO: 809184 - RNA, 22 nt, Human
guuguuuuuguucucuauagcu

SEQ ID NO: 809185 - RNA, 20 nt, Human
uuguuuuaaauccuggauga

SEQ ID NO: 809186 - RNA, 22 nt, Human
aggccugggacgggagccguga

SEQ ID NO: 809187 - RNA, 22 nt, Human
ccucagaccccugcugagcuuc

SEQ ID NO: 809188 - RNA, 22 nt, Human
cauauaaauacaacauguguua

SEQ ID NO: 809189 - RNA, 22 nt, Human
uuucuucugagaucagggagaa

SEQ ID NO: 809190 - RNA, 22 nt, Human
ccugggugucaugggcagcugg

SEQ ID NO: 809191 - RNA, 22 nt, Human
aauuuacaggugcacucgccau

SEQ ID NO: 809192 - RNA, 22 nt, Human
aaaagcaagaggcuggauuaaa

SEQ ID NO: 809193 - RNA, 22 nt, Human
uaaagugcuuccuaacccagag

SEQ ID NO: 809194 - RNA, 22 nt, Human
ucuguaaaacuucuuuguaaau

SEQ ID NO: 809195 - RNA, 22 nt, Human
agcuggccagcaccuccagguc

SEQ ID NO: 809196 - RNA, 22 nt, Human
gaggggaguguccuccgggccc

SEQ ID NO: 809197 - RNA, 22 nt, Human
aggcuggcccuacuggcugccu

SEQ ID NO: 809198 - RNA, 22 nt, Human
ugcaaauauuagcauucgauau

SEQ ID NO: 809199 - RNA, 22 nt, Human
gcacugggaaugcugaugggcu

SEQ ID NO: 809200 - RNA, 22 nt, Human
guggucagaaaucucaguggca

SEQ ID NO: 809201 - RNA, 21 nt, Human
gcucaggcucagguucagguu

SEQ ID NO: 809202 - RNA, 22 nt, Human
gaccacagcuacaagggcaagg

SEQ ID NO: 809203 - RNA, 22 nt, Human
aaagucauggaaaaucuuggaa

SEQ ID NO: 809204 - RNA, 22 nt, Human
acuuucaagcccucuagagaca

SEQ ID NO: 809205 - RNA, 22 nt, Human
auuugacauugacacaccuaug

SEQ ID NO: 809206 - RNA, 22 nt, Human
cagcuggccugaucccuguggc

SEQ ID NO: 809207 - RNA, 22 nt, Human
cauggcuuagaaguuccagccc

SEQ ID NO: 809208 - RNA, 22 nt, Human
auuagaauuaugcuugcuaaug

SEQ ID NO: 809209 - RNA, 22 nt, Human
augguggauuugugauucagcu

SEQ ID NO: 809210 - RNA, 16 nt, Human
uuuauuuacuaguguu

SEQ ID NO: 809211 - RNA, 19 nt, Human
aaggcugguaccauagguu

SEQ ID NO: 809212 - RNA, 22 nt, Human
accuuaaaugugacauagucua

SEQ ID NO: 809213 - RNA, 17 nt, Human
auuuagcaaguagacag

SEQ ID NO: 809214 - RNA, 22 nt, Human
ugaggaagugguuguaugguuu

SEQ ID NO: 809215 - RNA, 22 nt, Human
agguccugucuuaucucuguaa

SEQ ID NO: 809216 - RNA, 22 nt, Human
uagcaccuuaacucugcugcgu

SEQ ID NO: 809217 - RNA, 22 nt, Human
uucacaguggcugugccauuug

SEQ ID NO: 809218 - RNA, 22 nt, Human
uccugccuugccugggacauca

SEQ ID NO: 809219 - RNA, 22 nt, Human
aaguccugugugcuuacacuug

SEQ ID NO: 809220 - RNA, 22 nt, Human
uuagcuuucaugaaccuggucg

SEQ ID NO: 809221 - RNA, 22 nt, Human
caggcaggagacauuugguugg

SEQ ID NO: 809222 - RNA, 21 nt, Human
auacacauacacauaaaugug

SEQ ID NO: 809223 - RNA, 18 nt, Human
agucuuguucuguugccc

SEQ ID NO: 809224 - RNA, 22 nt, Human
gcucaaagaccagacagaggag

SEQ ID NO: 809225 - RNA, 22 nt, Human
uagugaaaugauaacagagcag

SEQ ID NO: 809226 - RNA, 22 nt, Human
gccaggcagcagcgaggauggu

SEQ ID NO: 809227 - RNA, 22 nt, Human
uccauugugauuauauacaaaa

SEQ ID NO: 809228 - RNA, 22 nt, Human
uacacauuacauaauacuaucu

SEQ ID NO: 809229 - RNA, 22 nt, Human
caaacaauuugcauuuccuuag

SEQ ID NO: 809230 - RNA, 22 nt, Human
auccaaaauuuacuguagcauu

SEQ ID NO: 809231 - RNA, 22 nt, Human
acaggcaaggccagugagaaau

SEQ ID NO: 809232 - RNA, 21 nt, Human
aauauaugcaaugcuuucugc

SEQ ID NO: 809233 - RNA, 22 nt, Human
uccaggagguuuggaggaagca

SEQ ID NO: 809234 - RNA, 20 nt, Human
ugcacagggugggaagcaac

SEQ ID NO: 809235 - RNA, 22 nt, Human
aggcaggcucaggcccaugcuu

SEQ ID NO: 809236 - RNA, 22 nt, Human
ugccuuccuggagcugaaggcu

SEQ ID NO: 809237 - RNA, 20 nt, Human
acucuugagaaauucucugu

SEQ ID NO: 809238 - RNA, 22 nt, Human
gaggcucuuuucugcugugucu

SEQ ID NO: 809239 - RNA, 22 nt, Human
gagaggcuggguuggagaucga

SEQ ID NO: 809240 - RNA, 22 nt, Human
ggagccugguuacuagagccug

SEQ ID NO: 809241 - RNA, 22 nt, Human
aaaucugggucaagguggagug

SEQ ID NO: 809242 - RNA, 22 nt, Human
uugauucagagaagauuggccc

SEQ ID NO: 809243 - RNA, 22 nt, Human
caguuucuacgacuuaagcaca

SEQ ID NO: 809244 - RNA, 22 nt, Human
uuaaggcuguggggauuacugc

SEQ ID NO: 809245 - RNA, 22 nt, Human
uaagacaauucuucagucacaa

SEQ ID NO: 809246 - RNA, 22 nt, Human
acuaaagaugucuaaauauauu

SEQ ID NO: 809247 - RNA, 22 nt, Human
cgucccaguuccagccgcgcug

SEQ ID NO: 809248 - RNA, 21 nt, Human
uuacuuuugcaccaaccuaau

SEQ ID NO: 809249 - RNA, 22 nt, Human
caaaaccaagaacauucauuuc

SEQ ID NO: 809250 - RNA, 22 nt, Human
gaggccucugucccgccaggga

SEQ ID NO: 809251 - RNA, 22 nt, Human
ucucaagcuuguugguauguuu

SEQ ID NO: 809252 - RNA, 22 nt, Human
ccugccugcaccuucucugggg

SEQ ID NO: 809253 - RNA, 22 nt, Human
ucagcaggcacggacaggcugc

SEQ ID NO: 809254 - RNA, 22 nt, Human
ggcagcccuuucuggccagcuc

SEQ ID NO: 809255 - RNA, 22 nt, Human
cccuggagggauuucucaauca

SEQ ID NO: 809256 - RNA, 22 nt, Human
acaaguuuauuugauuagaaca

SEQ ID NO: 809257 - RNA, 22 nt, Human
ucugaagauucuuuccacuauu

SEQ ID NO: 809258 - RNA, 22 nt, Human
ggcaggcuccaagcauccuaug

SEQ ID NO: 809259 - RNA, 23 nt, Human
caaauucuaggcaggcucuuuug

SEQ ID NO: 809260 - RNA, 22 nt, Human
ggcaggaggugaguggcgggug

SEQ ID NO: 809261 - RNA, 22 nt, Human
aaaugcagugguucuacuucuc

SEQ ID NO: 809262 - RNA, 21 nt, Human
ggcagcguguggacaggaagg

SEQ ID NO: 809263 - RNA, 19 nt, Human
aaaggcaguggguggcgug

SEQ ID NO: 809264 - RNA, 22 nt, Human
gccugccuagaauugcagcuuu

SEQ ID NO: 809265 - RNA, 22 nt, Human
ucaguucuaacaguuuagaaca

SEQ ID NO: 809266 - RNA, 22 nt, Human
gcuggcugaggucuagcucuuu

SEQ ID NO: 809267 - RNA, 22 nt, Human
cacagagcugaaccugggucau

SEQ ID NO: 809268 - RNA, 22 nt, Human
uguucuaaguguuuuguucaug

SEQ ID NO: 809269 - RNA, 22 nt, Human
uucauauauaugcacuacguac

SEQ ID NO: 809270 - RNA, 22 nt, Human
gucuccuggcugcagcuaagac

SEQ ID NO: 809271 - RNA, 22 nt, Human
uaauaccuagagaugauacaaa

SEQ ID NO: 809272 - RNA, 22 nt, Human
cuagaacagaaaguacaggaaa

SEQ ID NO: 809273 - RNA, 22 nt, Human
caggacaggcccuguggggucu

SEQ ID NO: 809274 - RNA, 22 nt, Human
uggcccugccgcacuauccuca

SEQ ID NO: 809275 - RNA, 22 nt, Human
ucaauuaugccauugcaauauu

SEQ ID NO: 809276 - RNA, 21 nt, Human
aaaugaaugugguagugcaag

SEQ ID NO: 809277 - RNA, 22 nt, Human
aaacagcugucauuguuuuaaa

SEQ ID NO: 809278 - RNA, 22 nt, Human
agcacuguaguuauagcuaaca

SEQ ID NO: 809279 - RNA, 23 nt, Human
gcagagcugcccuauugccuugg

SEQ ID NO: 809280 - RNA, 20 nt, Human
ugccagggccagcagaggcu

SEQ ID NO: 809281 - RNA, 22 nt, Human
gcugcuguccuucaagucugcg

SEQ ID NO: 809282 - RNA, 22 nt, Human
uuucaacagcucucaaaugauc

SEQ ID NO: 809283 - RNA, 22 nt, Human
gcugggaagugcaagaucaagg

SEQ ID NO: 809284 - RNA, 20 nt, Human
ggcagcaggaguuuccucuu

SEQ ID NO: 809285 - RNA, 22 nt, Human
aaagucaucuguccuaggcucu

SEQ ID NO: 809286 - RNA, 22 nt, Human
uggcacauaguaggugcucaau

SEQ ID NO: 809287 - RNA, 22 nt, Human
aaggccagauucacuuuacaau

SEQ ID NO: 809288 - RNA, 22 nt, Human
gcacuggggucauagccuccag

SEQ ID NO: 809289 - RNA, 22 nt, Human
uugaaugaauaaaagaguaagg

SEQ ID NO: 809290 - RNA, 22 nt, Human
uuucauuggcagagccuguuuu

SEQ ID NO: 809291 - RNA, 22 nt, Human
agcagggccaacaguaaacacc

SEQ ID NO: 809292 - RNA, 22 nt, Human
aaaaauuuaugguucuucucug

SEQ ID NO: 809293 - RNA, 23 nt, Human
cagcugguugugggaguggcugc

SEQ ID NO: 809294 - RNA, 22 nt, Human
uggcuggcuuucuuguauuuac

SEQ ID NO: 809295 - RNA, 23 nt, Human
aagucagagccaagucaaugaga

SEQ ID NO: 809296 - RNA, 22 nt, Human
uggccucucuaccaggcagccu

SEQ ID NO: 809297 - RNA, 22 nt, Human
aauuacugggucugagauuaau

SEQ ID NO: 809298 - RNA, 22 nt, Human
ugccugugcccuucuuggcauu

SEQ ID NO: 809299 - RNA, 22 nt, Human
cacaggagggagcgggcagcca

SEQ ID NO: 809300 - RNA, 22 nt, Human
gccucugcaauuacauugugcc

SEQ ID NO: 809301 - RNA, 23 nt, Human
uuguggagugguuguuuucuagg

SEQ ID NO: 809302 - RNA, 22 nt, Human
cagucacauugcccugcauuua

SEQ ID NO: 809303 - RNA, 22 nt, Human
ccaugccuuccuuucccuggaa

SEQ ID NO: 809304 - RNA, 22 nt, Human
agccucuccagagccuggcaga

SEQ ID NO: 809305 - RNA, 22 nt, Human
uguguagaaagaucuccaagau

SEQ ID NO: 809306 - RNA, 22 nt, Human
aaagcugcugccaaucaggcuu

SEQ ID NO: 809307 - RNA, 22 nt, Human
uuuucuguuacaaaguacagcg

SEQ ID NO: 809308 - RNA, 22 nt, Human
accuuucacgguaucagacauc

SEQ ID NO: 809309 - RNA, 22 nt, Human
uuggccucauggacagcucauc

SEQ ID NO: 809310 - RNA, 22 nt, Human
gacacuacguggcucacauuuc

SEQ ID NO: 809311 - RNA, 17 nt, Human
gcaggcacugcugccug

SEQ ID NO: 809312 - RNA, 22 nt, Human
ugcuggggucucuccggugccc

SEQ ID NO: 809313 - RNA, 22 nt, Human
auaaaaaugagggcgguagcua

SEQ ID NO: 809314 - RNA, 22 nt, Human
acaggugguaaaauggacuguc

SEQ ID NO: 809315 - RNA, 22 nt, Human
uuaaaauagccagugccccucu

SEQ ID NO: 809316 - RNA, 22 nt, Human
caucuuaaaaugugucauaacu

SEQ ID NO: 809317 - RNA, 22 nt, Human
ugccucuuggagccuuuccucu

SEQ ID NO: 809318 - RNA, 21 nt, Human
gggccuggcugcgcaggacgg

SEQ ID NO: 809319 - RNA, 22 nt, Human
gauccagcuucuacacagagcu

SEQ ID NO: 809320 - RNA, 21 nt, Human
uuuguucauagcucacucuuu

SEQ ID NO: 809321 - RNA, 22 nt, Human
gauuguaauuuucaagagguaa

SEQ ID NO: 809322 - RNA, 22 nt, Human
gccuggcuccuaagagcacaac

SEQ ID NO: 809323 - RNA, 18 nt, Human
gcagcugacacuggaguu

SEQ ID NO: 809324 - RNA, 21 nt, Human
agcagguguaaaggaggaaau

SEQ ID NO: 809325 - RNA, 22 nt, Human
uaggaaaugaaugcaggcuccc

SEQ ID NO: 809326 - RNA, 22 nt, Human
ggagcuggagaguacagaguuu

SEQ ID NO: 809327 - RNA, 22 nt, Human
uuauauuguguaauaagugaag

SEQ ID NO: 809328 - RNA, 22 nt, Human
aaaaguauuuuggaucucagau

SEQ ID NO: 809329 - RNA, 22 nt, Human
uuucuggaaccacaaaaguaug

SEQ ID NO: 809330 - RNA, 22 nt, Human
gaaaggccacgugccaagauua

SEQ ID NO: 809331 - RNA, 22 nt, Human
uguggcaggcauucugaggcug

SEQ ID NO: 809332 - RNA, 22 nt, Human
cccaggccccagggcuugucag

SEQ ID NO: 809333 - RNA, 22 nt, Human
gccugagccgccugagcggcgg

SEQ ID NO: 809334 - RNA, 22 nt, Human
gcaagcaggguuccuuagggca

SEQ ID NO: 809335 - RNA, 22 nt, Human
augcuucugguauaagaaaaau

SEQ ID NO: 809336 - RNA, 22 nt, Human
aaucaggaaacuaucaacacau

SEQ ID NO: 809337 - RNA, 22 nt, Human
cagccugcagggcugccuguug

SEQ ID NO: 809338 - RNA, 22 nt, Human
ucacugacguggggcuacuuga

SEQ ID NO: 809339 - RNA, 22 nt, Human
aaggacaggcacagugguggag

SEQ ID NO: 809340 - RNA, 22 nt, Human
auucuucugccuacuuucaucc

SEQ ID NO: 809341 - RNA, 22 nt, Human
caggccauuaccgcugagaccc

SEQ ID NO: 809342 - RNA, 22 nt, Human
cggggcaccgaccuccugccgc

SEQ ID NO: 809343 - RNA, 22 nt, Human
gggauggacugacgguagcgcg

SEQ ID NO: 809344 - RNA, 21 nt, Human
agggccucucauuugugccag

SEQ ID NO: 809345 - RNA, 22 nt, Human
cauggcaggaggcugcuggcag

SEQ ID NO: 809346 - RNA, 22 nt, Human
uccauauaaugggauuccuuau

SEQ ID NO: 809347 - RNA, 22 nt, Human
caugcacagagcuuggucauug

SEQ ID NO: 809348 - RNA, 22 nt, Human
agccacagucuguagccagcuu

SEQ ID NO: 809349 - RNA, 22 nt, Human
ucuuucccuuagaacauuaaca

SEQ ID NO: 809350 - RNA, 22 nt, Human
ccagggccugagggcgacgccc

SEQ ID NO: 809351 - RNA, 22 nt, Human
cugccuggcauggagaagagaa

SEQ ID NO: 809352 - RNA, 22 nt, Human
cagggcucaggcucugggauuc

SEQ ID NO: 809353 - RNA, 22 nt, Human
cuguuuuaauggagacugaugu

SEQ ID NO: 809354 - RNA, 22 nt, Human
uagcauaacagguaagagugag

SEQ ID NO: 809355 - RNA, 22 nt, Human
uuggcuucuguuuuggcucugu

SEQ ID NO: 809356 - RNA, 22 nt, Human
aggcagguccccuggaaggcac

SEQ ID NO: 809357 - RNA, 22 nt, Human
uucucucuguggucccauuuug

SEQ ID NO: 809358 - RNA, 22 nt, Human
accucagagaccucucaggugc

SEQ ID NO: 809359 - RNA, 22 nt, Human
cagcagaguauggcacucaacu

SEQ ID NO: 809360 - RNA, 22 nt, Human
aaacugcacaagggugcauagc

SEQ ID NO: 809361 - RNA, 22 nt, Human
uccauuuacuauucucauaucg

SEQ ID NO: 809362 - RNA, 22 nt, Human
agcuguggggaggaggcuagca

SEQ ID NO: 809363 - RNA, 22 nt, Human
uucagaaguagcuaagcaguca

SEQ ID NO: 809364 - RNA, 22 nt, Human
agauaauaaauguuuuagguuu

SEQ ID NO: 809365 - RNA, 22 nt, Human
cugugccacugccccaggccuc

SEQ ID NO: 809366 - RNA, 22 nt, Human
auucacauuuagccucugacau

SEQ ID NO: 809367 - RNA, 22 nt, Human
gcagggcacaaggacgcacagg

SEQ ID NO: 809368 - RNA, 22 nt, Human
aacagugagaagguggacagga

SEQ ID NO: 809369 - RNA, 22 nt, Human
ugagugcuuuaaauguuauuuu

SEQ ID NO: 809370 - RNA, 22 nt, Human
uuuguacacugucuacuaugaa

SEQ ID NO: 809371 - RNA, 19 nt, Human
cuugccuguuccuacagcu

SEQ ID NO: 809372 - RNA, 22 nt, Human
ccaguuuagguacuaggcucua

SEQ ID NO: 809373 - RNA, 22 nt, Human
aauagcuuaguccugauucugu

SEQ ID NO: 809374 - RNA, 22 nt, Human
gcugcuggagagcgagacuguu

SEQ ID NO: 809375 - RNA, 22 nt, Human
ugccaaaauggccaaaagcuag

SEQ ID NO: 809376 - RNA, 22 nt, Human
uagauguuccacauauauaugu

SEQ ID NO: 809377 - RNA, 22 nt, Human
agaggagcugggaggcccucgu

SEQ ID NO: 809378 - RNA, 22 nt, Human
cagggggcuguggcuguccagu

SEQ ID NO: 809379 - RNA, 22 nt, Human
ggagugacucacagcugggaca

SEQ ID NO: 809380 - RNA, 22 nt, Human
ccugggaggcuguuuccagccu

SEQ ID NO: 809381 - RNA, 22 nt, Human
gacacagguagaauaaaguacu

SEQ ID NO: 809382 - RNA, 22 nt, Human
agggagaguagauaucaggugu

SEQ ID NO: 809383 - RNA, 21 nt, Human
aaggcuggagaugcaggucug

SEQ ID NO: 809384 - RNA, 22 nt, Human
gcuggcucugaugggcuccagg

SEQ ID NO: 809385 - RNA, 22 nt, Human
aggugggcacaccucccuucuc

SEQ ID NO: 809386 - RNA, 22 nt, Human
aaaaagagaaaugcucuagucc

SEQ ID NO: 809387 - RNA, 20 nt, Human
caacagaggggucuggagua

SEQ ID NO: 809388 - RNA, 22 nt, Human
gugguucagugucauauuaacg

SEQ ID NO: 809389 - RNA, 22 nt, Human
uucaaauacauucuuugccacu

SEQ ID NO: 809390 - RNA, 22 nt, Human
ugaagaaacgcagagagguagg

SEQ ID NO: 809391 - RNA, 22 nt, Human
ugagaguagagucuucaucugu

SEQ ID NO: 809392 - RNA, 22 nt, Human
ccaggcugggcuacaaguugag

SEQ ID NO: 809393 - RNA, 22 nt, Human
acauaguucagagcagcagacc

SEQ ID NO: 809394 - RNA, 22 nt, Human
accugggauggggccagguuua

SEQ ID NO: 809395 - RNA, 22 nt, Human
agauauaguuguugagaagaac

SEQ ID NO: 809396 - RNA, 22 nt, Human
uuccacagguuucagacuguuc

SEQ ID NO: 809397 - RNA, 22 nt, Human
gcagggacaaggcagguguucu

SEQ ID NO: 809398 - RNA, 22 nt, Human
gaggaaaugguuguucaggugg

SEQ ID NO: 809399 - RNA, 20 nt, Human
gcuccccuucucugggccuc

SEQ ID NO: 809400 - RNA, 22 nt, Human
cugccaggcacgugcagcauca

SEQ ID NO: 809401 - RNA, 22 nt, Human
uacucaaacucacuaagacaga

SEQ ID NO: 809402 - RNA, 22 nt, Human
cccuggagggcagacagaugcc

SEQ ID NO: 809403 - RNA, 22 nt, Human
aaauagagcuggguuaaacuuu

SEQ ID NO: 809404 - RNA, 22 nt, Human
cagcaggaagguuuccccugca

SEQ ID NO: 809405 - RNA, 22 nt, Human
cuuaaagaugucaaggcuguuu

SEQ ID NO: 809406 - RNA, 22 nt, Human
ggcucuggcuccuggcuuugug

SEQ ID NO: 809407 - RNA, 22 nt, Human
uaacaacuugcuuuuaucuuag

SEQ ID NO: 809408 - RNA, 22 nt, Human
ccagcugcuugggaaaaugucu

SEQ ID NO: 809409 - RNA, 22 nt, Human
aggaggagcagcuuuuugucuc

SEQ ID NO: 809410 - RNA, 22 nt, Human
ucuggagugcccugcucugccc

SEQ ID NO: 809411 - RNA, 22 nt, Human
aaccagagugacacucuacaga

SEQ ID NO: 809412 - RNA, 22 nt, Human
uacaacaggaauuucaacuuug

SEQ ID NO: 809413 - RNA, 22 nt, Human
ucuucuuccucauuuauacaua

SEQ ID NO: 809414 - RNA, 22 nt, Human
aggccccaaagcagugcaagua

SEQ ID NO: 809415 - RNA, 22 nt, Human
agccuauucaucugaucuugaa

SEQ ID NO: 809416 - RNA, 22 nt, Human
auauauagagcuagauguuaaa

SEQ ID NO: 809417 - RNA, 22 nt, Human
ugcuggagugagugguuucuua

SEQ ID NO: 809418 - RNA, 22 nt, Human
aucugccuccaaguccaugugu

SEQ ID NO: 809419 - RNA, 22 nt, Human
ccucagcugcuucccuggagcc

SEQ ID NO: 809420 - RNA, 22 nt, Human
cagaacuggccuuucaucaguc

SEQ ID NO: 809421 - RNA, 22 nt, Human
ugucugaaagaggacgagcugg

SEQ ID NO: 809422 - RNA, 22 nt, Human
ccucuccagcggccucagggcc

SEQ ID NO: 809423 - RNA, 22 nt, Human
agaaaacagaaagucauuggug

SEQ ID NO: 809424 - RNA, 18 nt, Human
ugguccaguucagauaua

SEQ ID NO: 809425 - RNA, 22 nt, Human
aucacauucuuucaaagcaguc

SEQ ID NO: 809426 - RNA, 22 nt, Human
auuuacuaaugucauaucgcgu

SEQ ID NO: 809427 - RNA, 22 nt, Human
cuuacauacugagaaaauaucc

SEQ ID NO: 809428 - RNA, 22 nt, Human
gagccagguuugaaucucaguc

SEQ ID NO: 809429 - RNA, 22 nt, Human
uagcaccugcaggaugugcaca

SEQ ID NO: 809430 - RNA, 22 nt, Human
ggcacagcucaggucccagcuc

SEQ ID NO: 809431 - RNA, 22 nt, Human
ccugggcucgcgcacuucaccc

SEQ ID NO: 809432 - RNA, 22 nt, Human
guccugcggccucaguggugag

SEQ ID NO: 809433 - RNA, 22 nt, Human
augcaauauguguuucuguuua

SEQ ID NO: 809434 - RNA, 22 nt, Human
uuucaaguaagauacauuucag

SEQ ID NO: 809435 - RNA, 22 nt, Human
gcccagagagaugaagugaugg

SEQ ID NO: 809436 - RNA, 22 nt, Human
ugcccucuuaggucugcgcagc

SEQ ID NO: 809437 - RNA, 22 nt, Human
acuaaauaguuuugacagaaca

SEQ ID NO: 809438 - RNA, 21 nt, Human
cagugcagggguuagcgugua

SEQ ID NO: 809439 - RNA, 22 nt, Human
ccaccaggcacucacagggaag

SEQ ID NO: 809440 - RNA, 22 nt, Human
agcucuuuugugagcauuuggc

SEQ ID NO: 809441 - RNA, 22 nt, Human
cagaaaaggguguuuguucagg

SEQ ID NO: 809442 - RNA, 22 nt, Human
uccuggaagaucucugugagau

SEQ ID NO: 809443 - RNA, 22 nt, Human
acaugcaaaaauauauuuauga

SEQ ID NO: 809444 - RNA, 22 nt, Human
gucaacaaagaaaauuguuaau

SEQ ID NO: 809445 - RNA, 19 nt, Human
agccuggcuuugcucugcu

SEQ ID NO: 809446 - RNA, 22 nt, Human
agggccuccagggcagcagugg

SEQ ID NO: 809447 - RNA, 22 nt, Human
ucaaagaugaugcugaaguuau

SEQ ID NO: 809448 - RNA, 22 nt, Human
aucuucucauguguaaugaggu

SEQ ID NO: 809449 - RNA, 22 nt, Human
ccacagcaggacuggagccgcc

SEQ ID NO: 809450 - RNA, 22 nt, Human
gcaggcugauagaggauuccau

SEQ ID NO: 809451 - RNA, 22 nt, Human
gcuggcugccuuacuuugugga

SEQ ID NO: 809452 - RNA, 22 nt, Human
augucugauaaauaaugcauaa

SEQ ID NO: 809453 - RNA, 22 nt, Human
auucaaaagaccaugcagacuc

SEQ ID NO: 809454 - RNA, 19 nt, Human
aaacacagauuucuuacca

SEQ ID NO: 809455 - RNA, 22 nt, Human
aagaggaggauugaugugggag

SEQ ID NO: 809456 - RNA, 22 nt, Human
uacauucuacuuuuucacuccc

SEQ ID NO: 809457 - RNA, 22 nt, Human
cccagccucagcuuuacuucca

SEQ ID NO: 809458 - RNA, 22 nt, Human
uagaaaauggccaagcaggacu

SEQ ID NO: 809459 - RNA, 22 nt, Human
gugcagcugugugagagcucca

SEQ ID NO: 809460 - RNA, 22 nt, Human
acacauuuauuacaugcaugug

SEQ ID NO: 809461 - RNA, 22 nt, Human
ggucccagcuggucacugucag

SEQ ID NO: 809462 - RNA, 22 nt, Human
cuuaagaagcaagucucagcaa

SEQ ID NO: 809463 - RNA, 22 nt, Human
ugcauucuuggaagaagcucuc

SEQ ID NO: 809464 - RNA, 22 nt, Human
caggcaagauccagaggcugcu

SEQ ID NO: 809465 - RNA, 22 nt, Human
gggcagguacuggguggugagc

SEQ ID NO: 809466 - RNA, 22 nt, Human
uuucuccuaacucaaauuuaag

SEQ ID NO: 809467 - RNA, 22 nt, Human
ggcuggcacucuguccaguguc

SEQ ID NO: 809468 - RNA, 22 nt, Human
ugaguucuaguggcugcagauu

SEQ ID NO: 809469 - RNA, 22 nt, Human
aaggccuccgccaauggcagag

SEQ ID NO: 809470 - RNA, 20 nt, Human
ucaaagcacugccugucauc

SEQ ID NO: 809471 - RNA, 22 nt, Human
uuuucacuuaaggaauuucaug

SEQ ID NO: 809472 - RNA, 22 nt, Human
cgcugccuucaucccacgccua

SEQ ID NO: 809473 - RNA, 22 nt, Human
agacaaugcaagcagggagugg

SEQ ID NO: 809474 - RNA, 22 nt, Human
uauuucucuucaaaauugaugu

SEQ ID NO: 809475 - RNA, 22 nt, Human
uuacaagacagugugguaaaua

SEQ ID NO: 809476 - RNA, 22 nt, Human
acaacagagcuggacugagagg

SEQ ID NO: 809477 - RNA, 22 nt, Human
ucauaaauuagcugucuuugaa

SEQ ID NO: 809478 - RNA, 22 nt, Human
cuccagugagugagcaggcgac

SEQ ID NO: 809479 - RNA, 22 nt, Human
uggcgcaguuucucugcugccu

SEQ ID NO: 809480 - RNA, 21 nt, Human
aacauuucaggauccaaauug

SEQ ID NO: 809481 - RNA, 22 nt, Human
uaaucugaagaaacaggacuug

SEQ ID NO: 809482 - RNA, 22 nt, Human
uuacauucuuggaaucuuguuu

SEQ ID NO: 809483 - RNA, 22 nt, Human
ucucagcucuuuuuucacagaa

SEQ ID NO: 809484 - RNA, 22 nt, Human
gccagccccuuagggcucuccc

SEQ ID NO: 809485 - RNA, 18 nt, Human
augcuucugauagaagca

SEQ ID NO: 809486 - RNA, 22 nt, Human
uacauuaucuuguuaucuuuca

SEQ ID NO: 809487 - RNA, 22 nt, Human
aaagugcacuagaauccagauu

SEQ ID NO: 809488 - RNA, 22 nt, Human
agugaagauauacuguuguccu

SEQ ID NO: 809489 - RNA, 16 nt, Human
gaggcuggcagauguc

SEQ ID NO: 809490 - RNA, 22 nt, Human
cucuugcaugagauccaggagu

SEQ ID NO: 809491 - RNA, 22 nt, Human
uccucaguauuguggagcagau

SEQ ID NO: 809492 - RNA, 22 nt, Human
aaacuugacaguagacagauua

SEQ ID NO: 809493 - RNA, 22 nt, Human
cucagccaggagaguguucaca

SEQ ID NO: 809494 - RNA, 22 nt, Human
ucccagcacuguaauucuuugg

SEQ ID NO: 809495 - RNA, 22 nt, Human
uuacaaacugucauauaguauu

SEQ ID NO: 809496 - RNA, 22 nt, Human
gggcuucucccuaaggacucug

SEQ ID NO: 809497 - RNA, 22 nt, Human
aagggcaggugggcauuucugg

SEQ ID NO: 809498 - RNA, 22 nt, Human
gccaggaaggcucccuggucac

SEQ ID NO: 809499 - RNA, 22 nt, Human
ggcaaaaaccacaauuacuuuu

SEQ ID NO: 809500 - RNA, 22 nt, Human
gaggucaggcuugcagcagggu

SEQ ID NO: 809501 - RNA, 20 nt, Human
uagcaugggugaggguagag

SEQ ID NO: 809502 - RNA, 22 nt, Human
aagucagaaauuauucaggaau

SEQ ID NO: 809503 - RNA, 22 nt, Human
cuauuuauuguggguauccagg

SEQ ID NO: 809504 - RNA, 22 nt, Human
aagugcauacacuaguuaauug

SEQ ID NO: 809505 - RNA, 22 nt, Human
acagugauuauuaguugguggu

SEQ ID NO: 809506 - RNA, 22 nt, Human
gagguggguguaucacagguca

SEQ ID NO: 809507 - RNA, 22 nt, Human
gcuggagugcaguugcacaguc

SEQ ID NO: 809508 - RNA, 22 nt, Human
gcugaggauauagcaggaacaa

SEQ ID NO: 809509 - RNA, 22 nt, Human
guaaaauucuagcaucugaaag

SEQ ID NO: 809510 - RNA, 22 nt, Human
gaggcugguaggaaaggaaaca

SEQ ID NO: 809511 - RNA, 22 nt, Human
ggcaggcauugcaacauguaca

SEQ ID NO: 809512 - RNA, 22 nt, Human
aacuguagugcuuauagacucu

SEQ ID NO: 809513 - RNA, 22 nt, Human
cugcagggcuuaccuugcucug

SEQ ID NO: 809514 - RNA, 22 nt, Human
ccagccuggggaggcagcuucu

SEQ ID NO: 809515 - RNA, 22 nt, Human
agugggagcggcagucggggac

SEQ ID NO: 809516 - RNA, 22 nt, Human
aaauagcagaagcagagggggu

SEQ ID NO: 809517 - RNA, 22 nt, Human
ugccagggccauagggagucua

SEQ ID NO: 809518 - RNA, 22 nt, Human
uucuuacaaguauuccaggucc

SEQ ID NO: 809519 - RNA, 22 nt, Human
uacagaggggacauggaagaca

SEQ ID NO: 809520 - RNA, 22 nt, Human
guggggggacguuggucacuuu

SEQ ID NO: 809521 - RNA, 22 nt, Human
cugaaagcaaauacaugaaucu

SEQ ID NO: 809522 - RNA, 22 nt, Human
aggcaaagcgauaccagagcua

SEQ ID NO: 809523 - RNA, 22 nt, Human
ucaggcucuacacuugacacac

SEQ ID NO: 809524 - RNA, 22 nt, Human
uggcccuggcugaguuagauuu

SEQ ID NO: 809525 - RNA, 22 nt, Human
ugcauuuuuaacaaggcuaauu

SEQ ID NO: 809526 - RNA, 22 nt, Human
uccccaggaaucaggugguugc

SEQ ID NO: 809527 - RNA, 22 nt, Human
aaguccuguuccucauacuucc

SEQ ID NO: 809528 - RNA, 22 nt, Human
gccugccuucggugcgcagcgg

SEQ ID NO: 809529 - RNA, 22 nt, Human
gcaggcugaguauuacccuagu

SEQ ID NO: 809530 - RNA, 21 nt, Human
auucugaguugucagucuuca

SEQ ID NO: 809531 - RNA, 22 nt, Human
cuggccucauagccaagcugug

SEQ ID NO: 809532 - RNA, 21 nt, Human
cuugucuugcuuagaauagac

SEQ ID NO: 809533 - RNA, 22 nt, Human
ucuuuaugagaaaaagauugua

SEQ ID NO: 809534 - RNA, 22 nt, Human
gcuuaaugagcagagaaucuac

SEQ ID NO: 809535 - RNA, 22 nt, Human
aggugcuggcgccccaggagac

SEQ ID NO: 809536 - RNA, 22 nt, Human
gcacugggagcugccugccggu

SEQ ID NO: 809537 - RNA, 22 nt, Human
aguuaauaauggaaagacacau

SEQ ID NO: 809538 - RNA, 22 nt, Human
ccauccagaaggguuugaaaga

SEQ ID NO: 809539 - RNA, 22 nt, Human
ggccugccucacagucagcacc

SEQ ID NO: 809540 - RNA, 18 nt, Human
uugauaaacaauuucauu

SEQ ID NO: 809541 - RNA, 22 nt, Human
uguuuuaucaagauggcauguc

SEQ ID NO: 809542 - RNA, 22 nt, Human
ucagcucuguguacaguuagca

SEQ ID NO: 809543 - RNA, 23 nt, Human
cagaugagguuggcagcaugguc

SEQ ID NO: 809544 - RNA, 22 nt, Human
gggggaaagcucaggagccugu

SEQ ID NO: 809545 - RNA, 22 nt, Human
ccagcaggagaugccugugucu

SEQ ID NO: 809546 - RNA, 22 nt, Human
gaaaggccaccaugccagggac

SEQ ID NO: 809547 - RNA, 17 nt, Human
uccagccuccucugcug

SEQ ID NO: 809548 - RNA, 22 nt, Human
cugcagggacccaagucuuugg

SEQ ID NO: 809549 - RNA, 22 nt, Human
aggcuggggaauugaauuugcu

SEQ ID NO: 809550 - RNA, 21 nt, Human
ucuugugugggaaacaauuug

SEQ ID NO: 809551 - RNA, 22 nt, Human
gugcauuacauguaauaaaaua

SEQ ID NO: 809552 - RNA, 22 nt, Human
cgcacuggagcuggaacgaguc

SEQ ID NO: 809553 - RNA, 22 nt, Human
uaaaugaagaaauggagauugu

SEQ ID NO: 809554 - RNA, 22 nt, Human
cguggcaguggaaggcugggug

SEQ ID NO: 809555 - RNA, 22 nt, Human
ccuggcuccugcacagaucuuu

SEQ ID NO: 809556 - RNA, 22 nt, Human
gggagacaagaaguagccugcu

SEQ ID NO: 809557 - RNA, 22 nt, Human
uacagcaaugguucuaagaguc

SEQ ID NO: 809558 - RNA, 22 nt, Human
acaugcauaaacuacuucuuau

SEQ ID NO: 809559 - RNA, 22 nt, Human
aagccaguguuuuugagaguug

SEQ ID NO: 809560 - RNA, 22 nt, Human
uuccaggacuucauggcucuga

SEQ ID NO: 809561 - RNA, 22 nt, Human
uuacauuuuaguuaaccuguga

SEQ ID NO: 809562 - RNA, 22 nt, Human
uuucauguuaguugguucuugg

SEQ ID NO: 809563 - RNA, 22 nt, Human
ggcagcucaccucugguccagg

SEQ ID NO: 809564 - RNA, 22 nt, Human
auucuuugaacaguuuuccugu

SEQ ID NO: 809565 - RNA, 22 nt, Human
caguggcgugaucucugcucac

SEQ ID NO: 809566 - RNA, 22 nt, Human
aaugccaguguguugauuccag

SEQ ID NO: 809567 - RNA, 22 nt, Human
ccugguggcuucuggguggacg

SEQ ID NO: 809568 - RNA, 22 nt, Human
ccaggcagccaagugugugugu

SEQ ID NO: 809569 - RNA, 22 nt, Human
ugcagggugcacaguggggugc

SEQ ID NO: 809570 - RNA, 22 nt, Human
aacauuuguguuugcuaaaaau

SEQ ID NO: 809571 - RNA, 22 nt, Human
uacaguaaucuggacaugauuu

SEQ ID NO: 809572 - RNA, 22 nt, Human
auuuuguuauagaacucuguga

SEQ ID NO: 809573 - RNA, 22 nt, Human
uagaaaagaagucuggccggga

SEQ ID NO: 809574 - RNA, 22 nt, Human
cuccagccagagugccucuguu

SEQ ID NO: 809575 - RNA, 22 nt, Human
ugcagaaagcauugacucuucc

SEQ ID NO: 809576 - RNA, 22 nt, Human
ggaaauauuuugucuaauuugu

SEQ ID NO: 809577 - RNA, 22 nt, Human
gcaggguacauugggaugggau

SEQ ID NO: 809578 - RNA, 22 nt, Human
uuugcaaauaccaugaaacuug

SEQ ID NO: 809579 - RNA, 22 nt, Human
agcucuuugacuaaucuugcuu

SEQ ID NO: 809580 - RNA, 22 nt, Human
caggcagccuucucgucucaca

SEQ ID NO: 809581 - RNA, 23 nt, Human
ccucagggucuagcagagagaag

SEQ ID NO: 809582 - RNA, 22 nt, Human
ucaagagagugcugcuuggggu

SEQ ID NO: 809583 - RNA, 22 nt, Human
uccucugcuguucugguucuuu

SEQ ID NO: 809584 - RNA, 22 nt, Human
agcccagguucuaaagccaaac

SEQ ID NO: 809585 - RNA, 22 nt, Human
gcuggguuuucuuccgggccua

SEQ ID NO: 809586 - RNA, 22 nt, Human
agcugugguuagauagaguccu

SEQ ID NO: 809587 - RNA, 22 nt, Human
auuugcuuuuacuauguuaaaa

SEQ ID NO: 809588 - RNA, 22 nt, Human
auacucaauuuguuggaaagca

SEQ ID NO: 809589 - RNA, 22 nt, Human
uuuuuauaacucuuuugugaca

SEQ ID NO: 809590 - RNA, 22 nt, Human
gaagagcugucagaaaagcuaa

SEQ ID NO: 809591 - RNA, 22 nt, Human
ucccagggcuuuucucaugcuu

SEQ ID NO: 809592 - RNA, 22 nt, Human
ucuuacaagaaggaaaagggag

SEQ ID NO: 809593 - RNA, 22 nt, Human
cuuacauaugcaagacaaaggg

SEQ ID NO: 809594 - RNA, 22 nt, Human
uuccuguguguugguggcagaa

SEQ ID NO: 809595 - RNA, 22 nt, Human
gccagccacuucccagacuggc

SEQ ID NO: 809596 - RNA, 22 nt, Human
ggcaccaggcugggcauaggcc

SEQ ID NO: 809597 - RNA, 22 nt, Human
gacugagguauuaagauggcuu

SEQ ID NO: 809598 - RNA, 22 nt, Human
augcaggcagacacugugggca

SEQ ID NO: 809599 - RNA, 22 nt, Human
caaaugccaggaaucucugaag

SEQ ID NO: 809600 - RNA, 18 nt, Human
uccagcucacagaugggc

SEQ ID NO: 809601 - RNA, 22 nt, Human
ugggccuccugcccuggccuag

SEQ ID NO: 809602 - RNA, 22 nt, Human
uacaguaaccuuauuugucauu

SEQ ID NO: 809603 - RNA, 22 nt, Human
uacauacagagaugcuaguuaa

SEQ ID NO: 809604 - RNA, 22 nt, Human
cagcucugaagaaaggugucua

SEQ ID NO: 809605 - RNA, 22 nt, Human
agagccaggcucccauggggca

SEQ ID NO: 809606 - RNA, 22 nt, Human
gcccuccccucuggguggugag

SEQ ID NO: 809607 - RNA, 22 nt, Human
ccauuuggcaagaaagagucau

SEQ ID NO: 809608 - RNA, 22 nt, Human
gggccugcagguucugagaggc

SEQ ID NO: 809609 - RNA, 22 nt, Human
uuccugugugaccgagacagug

SEQ ID NO: 809610 - RNA, 22 nt, Human
cuccauuguucgcgcagcugca

SEQ ID NO: 809611 - RNA, 23 nt, Human
acauacauggagauaaagugaug

SEQ ID NO: 809612 - RNA, 22 nt, Human
ucuacugccacuuaagacauuu

SEQ ID NO: 809613 - RNA, 22 nt, Human
ucugggugacccugggcaaggc

SEQ ID NO: 809614 - RNA, 22 nt, Human
acucuguaucccucucaaauug

SEQ ID NO: 809615 - RNA, 22 nt, Human
cugccagcagaggccagcgcug

SEQ ID NO: 809616 - RNA, 22 nt, Human
accgugucugacacuuugggcg

SEQ ID NO: 809617 - RNA, 22 nt, Human
guggcuuggaccagucacagug

SEQ ID NO: 809618 - RNA, 22 nt, Human
cuucaguauccuccacauguua

SEQ ID NO: 809619 - RNA, 23 nt, Human
auccaugcuuaaguaaucauuug

SEQ ID NO: 809620 - RNA, 22 nt, Human
gaaggcuguggcuggucucagu

SEQ ID NO: 809621 - RNA, 20 nt, Human
ugggugagaguguuugcucu

SEQ ID NO: 809622 - RNA, 22 nt, Human
ccauggcagccaugggagccac

SEQ ID NO: 809623 - RNA, 22 nt, Human
agcagcacgaguccacaaaucc

SEQ ID NO: 809624 - RNA, 22 nt, Human
cagguggggagaguguggagca

SEQ ID NO: 809625 - RNA, 22 nt, Human
ucuuauuuuguuagaugcugua

SEQ ID NO: 809626 - RNA, 22 nt, Human
augacucaaaauuauuguuuug

SEQ ID NO: 809627 - RNA, 22 nt, Human
uagcuuugccaucugucacaua

SEQ ID NO: 809628 - RNA, 22 nt, Human
uccuggcaggucagcaggagca

SEQ ID NO: 809629 - RNA, 22 nt, Human
gauaaaauucuuauuuuacccg

SEQ ID NO: 809630 - RNA, 23 nt, Human
cauuucugggagauuuauaaaau

SEQ ID NO: 809631 - RNA, 22 nt, Human
uaacaaggagauggugggucau

SEQ ID NO: 809632 - RNA, 22 nt, Human
gacaguaaaugcagucuagcac

SEQ ID NO: 809633 - RNA, 22 nt, Human
auugagaaauauaaucuggaaa

SEQ ID NO: 809634 - RNA, 22 nt, Human
ucugaagcacagcaggaagggu

SEQ ID NO: 809635 - RNA, 22 nt, Human
ucacaugucaagaagauaauuu

SEQ ID NO: 809636 - RNA, 22 nt, Human
ggcagguggauuuucuacucua

SEQ ID NO: 809637 - RNA, 22 nt, Human
ucagcauuguggcagagaaugg

SEQ ID NO: 809638 - RNA, 22 nt, Human
auucauuuagguauucacuuac

SEQ ID NO: 809639 - RNA, 22 nt, Human
auggcuggaagagucgaagagu

SEQ ID NO: 809640 - RNA, 22 nt, Human
aggcugugacagggucauggag

SEQ ID NO: 809641 - RNA, 20 nt, Human
gcagugcuggugccucugcu

SEQ ID NO: 809642 - RNA, 22 nt, Human
ggggggcagcuguccuggccau

SEQ ID NO: 809643 - RNA, 22 nt, Human
uaaaugagggcugacaugauug

SEQ ID NO: 809644 - RNA, 22 nt, Human
aaacagauaagggacaauuuca

SEQ ID NO: 809645 - RNA, 22 nt, Human
uugauauuagaguauuuguuug

SEQ ID NO: 809646 - RNA, 22 nt, Human
aaauuugauaagccauuguuac

SEQ ID NO: 809647 - RNA, 22 nt, Human
auguuucaccagcaaauuaccu

SEQ ID NO: 809648 - RNA, 22 nt, Human
acauguuuugugccuugacuag

SEQ ID NO: 809649 - RNA, 22 nt, Human
gcagaggaucaggcucuggaaa

SEQ ID NO: 809650 - RNA, 22 nt, Human
uggcccaagucugcuagaagag

SEQ ID NO: 809651 - RNA, 22 nt, Human
aggcucagugcaaaucauucug

SEQ ID NO: 809652 - RNA, 22 nt, Human
auuuuccuucuaagaggaaggu

SEQ ID NO: 809653 - RNA, 22 nt, Human
uuuauucacuggggucugcccg

SEQ ID NO: 809654 - RNA, 22 nt, Human
uguuuccuucugucucuuugga

SEQ ID NO: 809655 - RNA, 22 nt, Human
uuucauuguccccaggcaagac

SEQ ID NO: 809656 - RNA, 22 nt, Human
ccagcacuguucuaaggaaaca

SEQ ID NO: 809657 - RNA, 22 nt, Human
ugauuuacaguagugucuaaac

SEQ ID NO: 809658 - RNA, 22 nt, Human
cauaacauuaagccucuauuuc

SEQ ID NO: 809659 - RNA, 22 nt, Human
aggcucugucaggcggagcagc

SEQ ID NO: 809660 - RNA, 22 nt, Human
uaccacaggccaaauuugaggu

SEQ ID NO: 809661 - RNA, 21 nt, Human
ggccagcugcauaugucacug

SEQ ID NO: 809662 - RNA, 22 nt, Human
ggaggccaugaggcucuaggug

SEQ ID NO: 809663 - RNA, 22 nt, Human
uugcacauguugguucuugaaa

SEQ ID NO: 809664 - RNA, 22 nt, Human
gcugccugccuugccuggagga

SEQ ID NO: 809665 - RNA, 22 nt, Human
caagcugccaccagaagagcau

SEQ ID NO: 809666 - RNA, 22 nt, Human
agagucagaaagcagacagggg

SEQ ID NO: 809667 - RNA, 22 nt, Human
uuuguuuucaaugugucauuca

SEQ ID NO: 809668 - RNA, 22 nt, Human
uuugaaaagaaccaucgccuua

SEQ ID NO: 809669 - RNA, 22 nt, Human
ucuuuauaaaagucauuauguc

SEQ ID NO: 809670 - RNA, 21 nt, Human
uccagccuuucccucacuucc

SEQ ID NO: 809671 - RNA, 22 nt, Human
uccccaggggcaucucucugcu

SEQ ID NO: 809672 - RNA, 22 nt, Human
uuuaugauuauuuuaaagcagc

SEQ ID NO: 809673 - RNA, 22 nt, Human
ggccaguuuccaugcacuauuu

SEQ ID NO: 809674 - RNA, 22 nt, Human
gggcuugguggagagaaugcug

SEQ ID NO: 809675 - RNA, 22 nt, Human
acuacuuugggccauuuguuua

SEQ ID NO: 809676 - RNA, 20 nt, Human
caggcagaggaugcugacca

SEQ ID NO: 809677 - RNA, 22 nt, Human
cagggagcagccccuagaagua

SEQ ID NO: 809678 - RNA, 19 nt, Human
agcaaauauaauaguguuc

SEQ ID NO: 809679 - RNA, 22 nt, Human
ucccagccuuaucuccccuggc

SEQ ID NO: 809680 - RNA, 22 nt, Human
cuggcuuuaaugucaucuuucu

SEQ ID NO: 809681 - RNA, 22 nt, Human
ucaguuuuguauguuguaaguc

SEQ ID NO: 809682 - RNA, 19 nt, Human
caguuuaacuaauuuuauc

SEQ ID NO: 809683 - RNA, 22 nt, Human
uggcacagaaaaaugcuccauu

SEQ ID NO: 809684 - RNA, 22 nt, Human
agcugcaggcccaugcucaguc

SEQ ID NO: 809685 - RNA, 22 nt, Human
uaaagcaauuugagcaaguucu

SEQ ID NO: 809686 - RNA, 22 nt, Human
ccuggggaaucuugcaggggaa

SEQ ID NO: 809687 - RNA, 21 nt, Human
ugguaucaaacuauacaauau

SEQ ID NO: 809688 - RNA, 22 nt, Human
uacugaaagaauacauaauuuc

SEQ ID NO: 809689 - RNA, 22 nt, Human
gugugcagaagacacaagacau

SEQ ID NO: 809690 - RNA, 23 nt, Human
gggcccagcacaggaccuggcag

SEQ ID NO: 809691 - RNA, 22 nt, Human
uuuaauguuugagucaguauau

SEQ ID NO: 809692 - RNA, 22 nt, Human
agggcagcucucaccucuggcc

SEQ ID NO: 809693 - RNA, 22 nt, Human
uauuucuucgggauucaagcua

SEQ ID NO: 809694 - RNA, 22 nt, Human
uauagcaacuccaaagagacuu

SEQ ID NO: 809695 - RNA, 22 nt, Human
ugcagauggggaucaguggcuc

SEQ ID NO: 809696 - RNA, 22 nt, Human
aaucuuuaaggacucagucucu

SEQ ID NO: 809697 - RNA, 22 nt, Human
agacccaggauuggggcugccg

SEQ ID NO: 809698 - RNA, 22 nt, Human
acagcagcgucaacuuaaaauu

SEQ ID NO: 809699 - RNA, 22 nt, Human
aaaugucuaucuggcauauucc

SEQ ID NO: 809700 - RNA, 22 nt, Human
aagcuguagaggcaguacauuu

SEQ ID NO: 809701 - RNA, 22 nt, Human
aaacauuccauuucuauguaag

SEQ ID NO: 809702 - RNA, 22 nt, Human
ggagcugcuuugaucugaagaa

SEQ ID NO: 809703 - RNA, 22 nt, Human
ucuccugguacccuuccuagca

SEQ ID NO: 809704 - RNA, 22 nt, Human
gcauguggcccaaggaggcugu

SEQ ID NO: 809705 - RNA, 22 nt, Human
aacauucugucaauugaugacc

SEQ ID NO: 809706 - RNA, 22 nt, Human
acagcuauagacgauguauaga

SEQ ID NO: 809707 - RNA, 22 nt, Human
ucagaaaggaguuagaggucuc

SEQ ID NO: 809708 - RNA, 22 nt, Human
uucauuugucugcuauagaucc

SEQ ID NO: 809709 - RNA, 22 nt, Human
ugauuaaauuaauuaagaugag

SEQ ID NO: 809710 - RNA, 22 nt, Human
aggccagugcagcuggaacaga

SEQ ID NO: 809711 - RNA, 22 nt, Human
auuuguuccacacauauuuacu

SEQ ID NO: 809712 - RNA, 22 nt, Human
ucaggacaauagugauuuuuac

SEQ ID NO: 809713 - RNA, 22 nt, Human
uuucauucauuauacaguagag

SEQ ID NO: 809714 - RNA, 23 nt, Human
ccucccaccuauuucacuuucuu

SEQ ID NO: 809715 - RNA, 22 nt, Human
uauuucuuucagguauguguug

SEQ ID NO: 809716 - RNA, 22 nt, Human
uaagaaacuauggagaagaacu

SEQ ID NO: 809717 - RNA, 21 nt, Human
aggcccuggaggucagagaaa

SEQ ID NO: 809718 - RNA, 22 nt, Human
caggaaauuuugugaucuguuc

SEQ ID NO: 809719 - RNA, 22 nt, Human
uuucaaguucuguuccuaaacu

SEQ ID NO: 809720 - RNA, 22 nt, Human
gaggaccacagaugagccugca

SEQ ID NO: 809721 - RNA, 22 nt, Human
uggcuggcuagugggcaggauu

SEQ ID NO: 809722 - RNA, 22 nt, Human
augucuguggcaauuguugaug

SEQ ID NO: 809723 - RNA, 23 nt, Human
ccucuccagacacugggccuugu

SEQ ID NO: 809724 - RNA, 22 nt, Human
auacuuuggggguuaguguaga

SEQ ID NO: 809725 - RNA, 22 nt, Human
cccugccuugggguccacaccg

SEQ ID NO: 809726 - RNA, 22 nt, Human
agacagugugguuggugguucc

SEQ ID NO: 809727 - RNA, 22 nt, Human
agaggcucuaauaccagcaugg

SEQ ID NO: 809728 - RNA, 22 nt, Human
aagcacaguucuuagaguuaca

SEQ ID NO: 809729 - RNA, 22 nt, Human
cuggaauggcaaugggaagucc

SEQ ID NO: 809730 - RNA, 22 nt, Human
gugaucuuguaauugggcaaug

SEQ ID NO: 809731 - RNA, 22 nt, Human
uucuuacauuagucugugcuuu

SEQ ID NO: 809732 - RNA, 22 nt, Human
aggccacagagagugcaugugc

SEQ ID NO: 809733 - RNA, 22 nt, Human
augcuucuguguauguuucagg

SEQ ID NO: 809734 - RNA, 22 nt, Human
cugccuggaaggagcaagggga

SEQ ID NO: 809735 - RNA, 22 nt, Human
cucuuguauuggaguuaguggg

SEQ ID NO: 809736 - RNA, 22 nt, Human
uggcccugacugauguggaggg

SEQ ID NO: 809737 - RNA, 22 nt, Human
gcaaggcugcugccacccaucu

SEQ ID NO: 809738 - RNA, 22 nt, Human
caucaaaugccauauaugguug

SEQ ID NO: 809739 - RNA, 22 nt, Human
ggccugcugggccccacagucc

SEQ ID NO: 809740 - RNA, 22 nt, Human
ugaggcuuggcaaaagaguggu

SEQ ID NO: 809741 - RNA, 22 nt, Human
ugaaugaugaggggagaauaau

SEQ ID NO: 809742 - RNA, 22 nt, Human
cacauuucugugagucaauauu

SEQ ID NO: 809743 - RNA, 21 nt, Human
acagccugucaucucaugguc

SEQ ID NO: 809744 - RNA, 22 nt, Human
ccuccuggugacaaggcaaagc

SEQ ID NO: 809745 - RNA, 22 nt, Human
uuuucuuuaaucugguggggug

SEQ ID NO: 809746 - RNA, 22 nt, Human
cagcagccugccuugggagcuu

SEQ ID NO: 809747 - RNA, 22 nt, Human
gcugcacauggcagaggccuuu

SEQ ID NO: 809748 - RNA, 22 nt, Human
ggucaggaaaagacuccccaga

SEQ ID NO: 809749 - RNA, 22 nt, Human
caaaguggaggcucuggggcca

SEQ ID NO: 809750 - RNA, 22 nt, Human
gccucugcaggugcgguuaucc

SEQ ID NO: 809751 - RNA, 22 nt, Human
ugaccaggauacugcagggaug

SEQ ID NO: 809752 - RNA, 22 nt, Human
agcagccaggaaucugcagagc

SEQ ID NO: 809753 - RNA, 22 nt, Human
ggcaggcaccagcucagcaaua

SEQ ID NO: 809754 - RNA, 22 nt, Human
uaggacagaguucccugauggc

SEQ ID NO: 809755 - RNA, 22 nt, Human
gugcccagcuccaccucacaga

SEQ ID NO: 809756 - RNA, 19 nt, Human
aggcccagcgcugggggcu

SEQ ID NO: 809757 - RNA, 19 nt, Human
uccaugcccaggcaccaag

SEQ ID NO: 809758 - RNA, 22 nt, Human
cacuugaaaaucagaggaaauu

SEQ ID NO: 809759 - RNA, 22 nt, Human
cuuccaggacaccaggguagua

SEQ ID NO: 809760 - RNA, 22 nt, Human
uuucauugagaauauaagauuu

SEQ ID NO: 809761 - RNA, 22 nt, Human
ugaggcucagagaagugcuguu

SEQ ID NO: 809762 - RNA, 22 nt, Human
uugcuaauagaagauuugggaa

SEQ ID NO: 809763 - RNA, 22 nt, Human
aggcccugaccugggagaucua

SEQ ID NO: 809764 - RNA, 22 nt, Human
ugccagcuuguggucagaggcu

SEQ ID NO: 809765 - RNA, 22 nt, Human
aagcuggccucaaacuccuagc

SEQ ID NO: 809766 - RNA, 22 nt, Human
agucuauuuucagaagcaguuu

SEQ ID NO: 809767 - RNA, 22 nt, Human
uagcuguguaacaugagaaugu

SEQ ID NO: 809768 - RNA, 22 nt, Human
agcagagcauggugggaagggc

SEQ ID NO: 809769 - RNA, 22 nt, Human
ugucacauaauuuaucuguagg

SEQ ID NO: 809770 - RNA, 22 nt, Human
caaaguuuuaguaaacauauau

SEQ ID NO: 809771 - RNA, 22 nt, Human
uguggcugacuccuggucccca

SEQ ID NO: 809772 - RNA, 22 nt, Human
uccugcagccacugcaggcaga

SEQ ID NO: 809773 - RNA, 22 nt, Human
ggcuggcucagggcuugagaga

SEQ ID NO: 809774 - RNA, 22 nt, Human
ugaaugaucuccgauuaguccu

SEQ ID NO: 809775 - RNA, 22 nt, Human
gcuccuggauguucaagucggc

SEQ ID NO: 809776 - RNA, 22 nt, Human
auucaagguuggcucaggaauu

SEQ ID NO: 809777 - RNA, 22 nt, Human
gagaggaguaggcugauggugc

SEQ ID NO: 809778 - RNA, 22 nt, Human
ccagccagaugauaagcucuau

SEQ ID NO: 809779 - RNA, 22 nt, Human
guacauuucucccaacacuaaa

SEQ ID NO: 809780 - RNA, 22 nt, Human
ucaggcugaccagguuuugcuc

SEQ ID NO: 809781 - RNA, 22 nt, Human
auggcccaaaaccuccucccuc

SEQ ID NO: 809782 - RNA, 22 nt, Human
gccucuccuggagaaggcaggg

SEQ ID NO: 809783 - RNA, 22 nt, Human
uccuggccuagcucacccugga

SEQ ID NO: 809784 - RNA, 22 nt, Human
uucccucugcgcauugaauuuc

SEQ ID NO: 809785 - RNA, 22 nt, Human
gccacagucacugcugcagggg

SEQ ID NO: 809786 - RNA, 22 nt, Human
uuucaaguguccugauuaaugg

SEQ ID NO: 809787 - RNA, 22 nt, Human
cccagggugcuaauuaaauaug

SEQ ID NO: 809788 - RNA, 22 nt, Human
ugucaaagacagaaggaaaugg

SEQ ID NO: 809789 - RNA, 22 nt, Human
caggaggaaaguuccacucaac

SEQ ID NO: 809790 - RNA, 22 nt, Human
uaguuucuagucaaucuucuuu

SEQ ID NO: 809791 - RNA, 22 nt, Human
gaaggcuggggccuucucaucu

SEQ ID NO: 809792 - RNA, 22 nt, Human
aaaguucuggagaaaauaauga

SEQ ID NO: 809793 - RNA, 22 nt, Human
ugcaggcuguaaucugaggcua

SEQ ID NO: 809794 - RNA, 23 nt, Human
uucuggauguucuagucugagag

SEQ ID NO: 809795 - RNA, 21 nt, Human
cuacagaaucgagcauucugg

SEQ ID NO: 809796 - RNA, 22 nt, Human
gucuaaacacaaugcaagaagu

SEQ ID NO: 809797 - RNA, 22 nt, Human
gaggagaaagcagugauuugug

SEQ ID NO: 809798 - RNA, 22 nt, Human
ucugagcuuacucagggauaca

SEQ ID NO: 809799 - RNA, 18 nt, Human
ugagaggcagguagagga

SEQ ID NO: 809800 - RNA, 22 nt, Human
acuugaauaggugucaaggcca

SEQ ID NO: 809801 - RNA, 22 nt, Human
guaaacaggaauguggucaugg

SEQ ID NO: 809802 - RNA, 22 nt, Human
ugaaacauuugaugaucuuugg

SEQ ID NO: 809803 - RNA, 22 nt, Human
uacaaagugggaaacgaagguu

SEQ ID NO: 809804 - RNA, 22 nt, Human
uccuuucuucuucugcccaugg

SEQ ID NO: 809805 - RNA, 22 nt, Human
uggcagaguucgcugugccuuu

SEQ ID NO: 809806 - RNA, 21 nt, Human
uuucuaaguaacuggcagcau

SEQ ID NO: 809807 - RNA, 22 nt, Human
ucaaacagaggaacaauuguuu

SEQ ID NO: 809808 - RNA, 22 nt, Human
agaaaacacugcccccucucuc

SEQ ID NO: 809809 - RNA, 22 nt, Human
agauuccaggccuggggccaag

SEQ ID NO: 809810 - RNA, 22 nt, Human
uuagcugucaagguggcugcag

SEQ ID NO: 809811 - RNA, 22 nt, Human
agagaacaaauuaaaggugguu

SEQ ID NO: 809812 - RNA, 22 nt, Human
uccagccugaacuuuguccaga

SEQ ID NO: 809813 - RNA, 22 nt, Human
auaacuuagaguaggcaaaagu

SEQ ID NO: 809814 - RNA, 22 nt, Human
uuacuaaguuuuaugcaacuua

SEQ ID NO: 809815 - RNA, 17 nt, Human
ugcauguccuuuguucc

SEQ ID NO: 809816 - RNA, 22 nt, Human
acaauacucaugcucuuuuucu

SEQ ID NO: 809817 - RNA, 22 nt, Human
uguacaaauucaguucuagggu

SEQ ID NO: 809818 - RNA, 22 nt, Human
ccuuucucuaucgacccaucgc

SEQ ID NO: 809819 - RNA, 22 nt, Human
ccuggcuccaaagcugugacuc

SEQ ID NO: 809820 - RNA, 22 nt, Human
cucuuuggccagaaaauguuuu

SEQ ID NO: 809821 - RNA, 22 nt, Human
uucaguguuaaucuugggagaa

SEQ ID NO: 809822 - RNA, 22 nt, Human
caggacagaaauaaggaauaua

SEQ ID NO: 809823 - RNA, 22 nt, Human
uccugguguuacuaaauugaaa

SEQ ID NO: 809824 - RNA, 22 nt, Human
uacacaaaggcacucuguuguu

SEQ ID NO: 809825 - RNA, 22 nt, Human
aaggcagaaauucaacuacugg

SEQ ID NO: 809826 - RNA, 22 nt, Human
ucacauuugcaauugcauuguu

SEQ ID NO: 809827 - RNA, 22 nt, Human
ggggugagcugggccugugccu

SEQ ID NO: 809828 - RNA, 23 nt, Human
ugcaaagaaaucugggucauugu

SEQ ID NO: 809829 - RNA, 22 nt, Human
uugccuuguuauucucucagaa

SEQ ID NO: 809830 - RNA, 22 nt, Human
aaauaagcacuuaacuguauca

SEQ ID NO: 809831 - RNA, 22 nt, Human
ucagugucuugaccugggugug

SEQ ID NO: 809832 - RNA, 22 nt, Human
acucuguagaguauaccaaugu

SEQ ID NO: 809833 - RNA, 17 nt, Human
uuuagaauacaauguuu

SEQ ID NO: 809834 - RNA, 22 nt, Human
uccagccugguugcgggcaucc

SEQ ID NO: 809835 - RNA, 22 nt, Human
aggcccuggucaggucuggcug

SEQ ID NO: 809836 - RNA, 22 nt, Human
uagcauaggaaaguacugggaa

SEQ ID NO: 809837 - RNA, 22 nt, Human
aucuaaaaugugguuaguuggu

SEQ ID NO: 809838 - RNA, 22 nt, Human
aaaugcuguagaucagugaguu

SEQ ID NO: 809839 - RNA, 22 nt, Human
caaguuuacaauguguaugugu

SEQ ID NO: 809840 - RNA, 22 nt, Human
uuuucuuacugucugugauccu

SEQ ID NO: 809841 - RNA, 22 nt, Human
cugacagcuccuagugcucacu

SEQ ID NO: 809842 - RNA, 20 nt, Human
uccucccccaccuuugcagc

SEQ ID NO: 809843 - RNA, 22 nt, Human
ugccuucucccuuggacccuga

SEQ ID NO: 809844 - RNA, 22 nt, Human
agaaaacucuacaucuguaugu

SEQ ID NO: 809845 - RNA, 22 nt, Human
uuucaaagaccauuaacuauca

SEQ ID NO: 809846 - RNA, 22 nt, Human
gcugcugugaauuuuuuaaaug

SEQ ID NO: 809847 - RNA, 19 nt, Human
ucugcuggcagaauucccu

SEQ ID NO: 809848 - RNA, 22 nt, Human
aaggaagggaaauagugauguc

SEQ ID NO: 809849 - RNA, 22 nt, Human
caggagccccaggcugacaaua

SEQ ID NO: 809850 - RNA, 22 nt, Human
ucagggaggugucugccagaga

SEQ ID NO: 809851 - RNA, 22 nt, Human
augcacaagaggcuagaaaaga

SEQ ID NO: 809852 - RNA, 22 nt, Human
gccucaggacuggcauacucau

SEQ ID NO: 809853 - RNA, 22 nt, Human
gagcacagcuggagguagcauu

SEQ ID NO: 809854 - RNA, 22 nt, Human
cagcccugagagaaccaucuau

SEQ ID NO: 809855 - RNA, 22 nt, Human
aguagcagugacagcugaggua

SEQ ID NO: 809856 - RNA, 22 nt, Human
uaguuucuugauuagccacuuu

SEQ ID NO: 809857 - RNA, 22 nt, Human
aguauguugaguuuugcuuuag

SEQ ID NO: 809858 - RNA, 21 nt, Human
uuuuaacaaggauuucccuag

SEQ ID NO: 809859 - RNA, 22 nt, Human
aagacaagcaucaaaucaggca

SEQ ID NO: 809860 - RNA, 22 nt, Human
auaauguuuuuguauaagcaug

SEQ ID NO: 809861 - RNA, 18 nt, Human
aggccagcccugcuacug

SEQ ID NO: 809862 - RNA, 22 nt, Human
uugcaaauauuguuuaccuuuc

SEQ ID NO: 809863 - RNA, 22 nt, Human
uuuuagcacuaagugauaugcu

SEQ ID NO: 809864 - RNA, 22 nt, Human
agcaaauucagaagcagaaugg

SEQ ID NO: 809865 - RNA, 19 nt, Human
guggccagggcaggggcug

SEQ ID NO: 809866 - RNA, 22 nt, Human
uuuguuuugaacuagcucagaa

SEQ ID NO: 809867 - RNA, 22 nt, Human
uuugacaauaauugcauuuaua

SEQ ID NO: 809868 - RNA, 22 nt, Human
ucaggcagagcuguggagcucu

SEQ ID NO: 809869 - RNA, 22 nt, Human
aaaugcagaaugauuucaucua

SEQ ID NO: 809870 - RNA, 22 nt, Human
uggucaaggcuuggagauagua

SEQ ID NO: 809871 - RNA, 22 nt, Human
ggggccuuuucugaauguggaa

SEQ ID NO: 809872 - RNA, 22 nt, Human
auuucacuuaguguaaugucuu

SEQ ID NO: 809873 - RNA, 22 nt, Human
agccucuguagaaagcagugug

SEQ ID NO: 809874 - RNA, 22 nt, Human
aaauguuuugcucccauguggu

SEQ ID NO: 809875 - RNA, 22 nt, Human
uauaccuugagcagggcggccc

SEQ ID NO: 809876 - RNA, 22 nt, Human
agaggccaccagagguggugcc

SEQ ID NO: 809877 - RNA, 22 nt, Human
cucuauuuauggcaucuuuaug

SEQ ID NO: 809878 - RNA, 22 nt, Human
uaugagauacuacagauuguga

SEQ ID NO: 809879 - RNA, 22 nt, Human
accugccuaucagcugccugcu

SEQ ID NO: 809880 - RNA, 22 nt, Human
gucugcacgugccagggagggg

SEQ ID NO: 809881 - RNA, 22 nt, Human
uucagugacuuaccuggagcca

SEQ ID NO: 809882 - RNA, 22 nt, Human
aggcagcauuugaauccagguc

SEQ ID NO: 809883 - RNA, 22 nt, Human
gaaggcuugccgggaagcggca

SEQ ID NO: 809884 - RNA, 21 nt, Human
uccagggaacuucucaggaau

SEQ ID NO: 809885 - RNA, 22 nt, Human
aucaaagagugagauuuuuacu

SEQ ID NO: 809886 - RNA, 22 nt, Human
ucaggcucucagaccaacagca

SEQ ID NO: 809887 - RNA, 22 nt, Human
caagagcaucccugcauccagc

SEQ ID NO: 809888 - RNA, 22 nt, Human
uaaaguaauccuucauaaggag

SEQ ID NO: 809889 - RNA, 22 nt, Human
aagucaaagcuuucagaggaaa

SEQ ID NO: 809890 - RNA, 22 nt, Human
acauacuuaugcuaaaaauaua

SEQ ID NO: 809891 - RNA, 22 nt, Human
ucccagcagucagagcuaugug

SEQ ID NO: 809892 - RNA, 22 nt, Human
aaagucauuuagccuuaucucc

SEQ ID NO: 809893 - RNA, 23 nt, Human
ugaaacauuuaggguagaauuuc

SEQ ID NO: 809894 - RNA, 22 nt, Human
aagucagaauaauguuucuuuu

SEQ ID NO: 809895 - RNA, 21 nt, Human
uucauuuguuauagacaaagu

SEQ ID NO: 809896 - RNA, 22 nt, Human
guaucacuuuugagagugagaa

SEQ ID NO: 809897 - RNA, 23 nt, Human
uggcccugaaucuguccuggagg

SEQ ID NO: 809898 - RNA, 22 nt, Human
uauguuucaucaggcauggagu

SEQ ID NO: 809899 - RNA, 22 nt, Human
ccuuuggcccugagagaugauu

SEQ ID NO: 809900 - RNA, 22 nt, Human
caauauauaaugaguacuuucc

SEQ ID NO: 809901 - RNA, 21 nt, Human
gcaggguccuuuccauuccua

SEQ ID NO: 809902 - RNA, 22 nt, Human
gcugagcugaggcagggcuggg

SEQ ID NO: 809903 - RNA, 22 nt, Human
ugugauauuugaguauugucaa

SEQ ID NO: 809904 - RNA, 22 nt, Human
ugucaugggguuguuuuguaca

SEQ ID NO: 809905 - RNA, 22 nt, Human
ugcaggcuggcagugcugaaau

SEQ ID NO: 809906 - RNA, 22 nt, Human
uauguauaaucacagaguguca

SEQ ID NO: 809907 - RNA, 22 nt, Human
ugggguggaacccuucugcugg

SEQ ID NO: 809908 - RNA, 22 nt, Human
uacaguaagaugaaauagcaau

SEQ ID NO: 809909 - RNA, 22 nt, Human
uuucacagaggaggaagcugag

SEQ ID NO: 809910 - RNA, 22 nt, Human
uugucucuaagugugaucuuca

SEQ ID NO: 809911 - RNA, 22 nt, Human
ccugggcaggaugggcccggug

SEQ ID NO: 809912 - RNA, 22 nt, Human
gucuaugauauuuuguuauagc

SEQ ID NO: 809913 - RNA, 23 nt, Human
uguaaauuuuguagucacauuuu

SEQ ID NO: 809914 - RNA, 22 nt, Human
ucagaagguacugaagacaugg

SEQ ID NO: 809915 - RNA, 22 nt, Human
ucuggaguaacucuguuucugg

SEQ ID NO: 809916 - RNA, 22 nt, Human
aauagcauguucaugauaaaau

SEQ ID NO: 809917 - RNA, 22 nt, Human
caggcagaguuagagcaacugg

SEQ ID NO: 809918 - RNA, 22 nt, Human
gcugcagcuguaggacacaauu

SEQ ID NO: 809919 - RNA, 22 nt, Human
aauuauacaauugucaaguucu

SEQ ID NO: 809920 - RNA, 22 nt, Human
uauuucugaauccaaaagguca

SEQ ID NO: 809921 - RNA, 22 nt, Human
agguuugggaguagaaaucaga

SEQ ID NO: 809922 - RNA, 22 nt, Human
gcuggcuggaggugaggaagaa

SEQ ID NO: 809923 - RNA, 22 nt, Human
cagagacaggaucucgaagacu

SEQ ID NO: 809924 - RNA, 22 nt, Human
gaggagagaugguagauugggu

SEQ ID NO: 809925 - RNA, 22 nt, Human
uggggcacagcugagaaagcac

SEQ ID NO: 809926 - RNA, 17 nt, Human
gugcuggccuggggcuc

SEQ ID NO: 809927 - RNA, 22 nt, Human
aucugucaucagcaccacaggu

SEQ ID NO: 809928 - RNA, 20 nt, Human
ugcuggcacggguggacucc

SEQ ID NO: 809929 - RNA, 22 nt, Human
aauucacaaaaguuagauccau

SEQ ID NO: 809930 - RNA, 22 nt, Human
uuugcaaauaaauaagugcucg

SEQ ID NO: 809931 - RNA, 18 nt, Human
cucucugggugaggacaa

SEQ ID NO: 809932 - RNA, 22 nt, Human
gcauagcuuugaugcugccuua

SEQ ID NO: 809933 - RNA, 22 nt, Human
ucuucacaugaccuucaugucu

SEQ ID NO: 809934 - RNA, 22 nt, Human
cauuuguaucugggcugcugug

SEQ ID NO: 809935 - RNA, 22 nt, Human
uuuauucuauaggcauuaagca

SEQ ID NO: 809936 - RNA, 22 nt, Human
auaaggaaccugggcuuaagag

SEQ ID NO: 809937 - RNA, 21 nt, Human
ccagcuuucccaagucccuuu

SEQ ID NO: 809938 - RNA, 22 nt, Human
caaaguauauuucauagucuca

SEQ ID NO: 809939 - RNA, 22 nt, Human
ucaggcugaaaggacuccaguu

SEQ ID NO: 809940 - RNA, 22 nt, Human
augcagaugguggauggagaaa

SEQ ID NO: 809941 - RNA, 21 nt, Human
agaaggcaaaagcagacaucu

SEQ ID NO: 809942 - RNA, 22 nt, Human
uuggucuguguuacaucauuua

SEQ ID NO: 809943 - RNA, 22 nt, Human
cgguccuggcacuugcggcucc

SEQ ID NO: 809944 - RNA, 22 nt, Human
gaaugagacuaugcgaguguga

SEQ ID NO: 809945 - RNA, 22 nt, Human
cccugcugacaacuugauuuug

SEQ ID NO: 809946 - RNA, 22 nt, Human
ucaggcugggcuccucucccca

SEQ ID NO: 809947 - RNA, 22 nt, Human
ugcugccuccuuccugccagga

SEQ ID NO: 809948 - RNA, 21 nt, Human
guuuucaugauagagucugua

SEQ ID NO: 809949 - RNA, 19 nt, Human
ucacaggcaucuccccaga

SEQ ID NO: 809950 - RNA, 22 nt, Human
uuccauacgacugaggucucgg

SEQ ID NO: 809951 - RNA, 23 nt, Human
gaagucagcccuacagagagcag

SEQ ID NO: 809952 - RNA, 22 nt, Human
ggcccaugcauccugugcagcc

SEQ ID NO: 809953 - RNA, 22 nt, Human
uuuuauaagcaagaaagggaaa

SEQ ID NO: 809954 - RNA, 22 nt, Human
uuguuguuauaggugguacaag

SEQ ID NO: 809955 - RNA, 22 nt, Human
auguuucaggcgaacuaacaug

SEQ ID NO: 809956 - RNA, 22 nt, Human
cuccaggcuggggugcagguug

SEQ ID NO: 809957 - RNA, 22 nt, Human
gcaaagcaaucaggaguagcau

SEQ ID NO: 809958 - RNA, 22 nt, Human
ucuugaaagcauuuucuucauc

SEQ ID NO: 809959 - RNA, 22 nt, Human
aacuauacauauuuacauagac

SEQ ID NO: 809960 - RNA, 22 nt, Human
cacaggagguuaggaagugguc

SEQ ID NO: 809961 - RNA, 22 nt, Human
gcagguggugggggagccguuc

SEQ ID NO: 809962 - RNA, 22 nt, Human
caaggaaacaugaaaugcauug

SEQ ID NO: 809963 - RNA, 22 nt, Human
gggagccagagucaccuagaga

SEQ ID NO: 809964 - RNA, 22 nt, Human
ucaagaaaugugcuuggauaua

SEQ ID NO: 809965 - RNA, 22 nt, Human
uaugccagcacuuagaugagau

SEQ ID NO: 809966 - RNA, 22 nt, Human
ucauauaaguuuaaaacuaucu

SEQ ID NO: 809967 - RNA, 22 nt, Human
uccuggcccgaucccugugaag

SEQ ID NO: 809968 - RNA, 22 nt, Human
cacacgugugagagcuguggca

SEQ ID NO: 809969 - RNA, 22 nt, Human
uuucacaucccgcgcgcccuua

SEQ ID NO: 809970 - RNA, 22 nt, Human
ucacaagacaagacaaauugca

SEQ ID NO: 809971 - RNA, 22 nt, Human
uuuccuuccuaaggugaagcaa

SEQ ID NO: 809972 - RNA, 22 nt, Human
ugugggaggaauuagaauggga

SEQ ID NO: 809973 - RNA, 21 nt, Human
guuuaugaaucuuguccugcu

SEQ ID NO: 809974 - RNA, 22 nt, Human
aauaguaaaagauacagcuaau

SEQ ID NO: 809975 - RNA, 22 nt, Human
ucacuuuugaucccuaugcagu

SEQ ID NO: 809976 - RNA, 22 nt, Human
agcucugggucacggcugccga

SEQ ID NO: 809977 - RNA, 22 nt, Human
cuuuauggagugacacaauggg

SEQ ID NO: 809978 - RNA, 22 nt, Human
guuuuauaguucgggaccuguu

SEQ ID NO: 809979 - RNA, 22 nt, Human
cuucuucaauagcaagcgcaua

SEQ ID NO: 809980 - RNA, 22 nt, Human
gagaagcaaucgugacaucucc

SEQ ID NO: 809981 - RNA, 22 nt, Human
aaggaaaugaagcugauguugg

SEQ ID NO: 809982 - RNA, 22 nt, Human
gcccucagcuccuggacacaug

SEQ ID NO: 809983 - RNA, 22 nt, Human
gagcugccuguugcauagcaac

SEQ ID NO: 809984 - RNA, 22 nt, Human
agggauguuaguugugagcuca

SEQ ID NO: 809985 - RNA, 22 nt, Human
gccagccuucuguggccugcaa

SEQ ID NO: 809986 - RNA, 22 nt, Human
aggccugagguuccugugcuca

SEQ ID NO: 809987 - RNA, 22 nt, Human
agugcauacccuucuaaaaagu

SEQ ID NO: 809988 - RNA, 19 nt, Human
gcagugucaugguaggagc

SEQ ID NO: 809989 - RNA, 22 nt, Human
aggcccugcccagagcuccucg

SEQ ID NO: 809990 - RNA, 22 nt, Human
gagcuggcaggaggcuccccga

SEQ ID NO: 809991 - RNA, 22 nt, Human
ugcacacacaggagucuccucc

SEQ ID NO: 809992 - RNA, 22 nt, Human
uucugccacgagcaguuucuuc

SEQ ID NO: 809993 - RNA, 22 nt, Human
guuauucaauggcuuauaagga

SEQ ID NO: 809994 - RNA, 22 nt, Human
cccugagcccauaguugacauu

SEQ ID NO: 809995 - RNA, 22 nt, Human
auaaggaaaauuggagaaauug

SEQ ID NO: 809996 - RNA, 22 nt, Human
uaagagaauguuguggcuaggu

SEQ ID NO: 809997 - RNA, 22 nt, Human
gcacugggggcagcagugaggg

SEQ ID NO: 809998 - RNA, 21 nt, Human
aaagaaaucucccauugguag

SEQ ID NO: 809999 - RNA, 22 nt, Human
uauuuagcuggagucagugcuu

SEQ ID NO: 810000 - RNA, 22 nt, Human
guuuauauucaacggaguaucu

SEQ ID NO: 810001 - RNA, 22 nt, Human
uagucacaguacaggauaaaga

SEQ ID NO: 810002 - RNA, 22 nt, Human
uucuggaagccccagagucaga

SEQ ID NO: 810003 - RNA, 22 nt, Human
gcacacaguagggauucaauga

SEQ ID NO: 810004 - RNA, 22 nt, Human
ggcugggagccccacagaguca

SEQ ID NO: 810005 - RNA, 22 nt, Human
acuucagugugguauaaaacgu

SEQ ID NO: 810006 - RNA, 22 nt, Human
aggagcuggccuagaaaggaga

SEQ ID NO: 810007 - RNA, 22 nt, Human
caagauguggugggcugaguuu

SEQ ID NO: 810008 - RNA, 22 nt, Human
uccaggaguuugagacugcagu

SEQ ID NO: 810009 - RNA, 22 nt, Human
uuccuagaaugguuagaaaaua

SEQ ID NO: 810010 - RNA, 22 nt, Human
ucacauuucuuuauguagucuu

SEQ ID NO: 810011 - RNA, 22 nt, Human
aauaauuauuugagagcagacc

SEQ ID NO: 810012 - RNA, 22 nt, Human
caaguuuaaggcacugauaagu

SEQ ID NO: 810013 - RNA, 22 nt, Human
gaauguaagugggcagaagaca

SEQ ID NO: 810014 - RNA, 22 nt, Human
gagaugaauguaaacaaaggca

SEQ ID NO: 810015 - RNA, 22 nt, Human
uuggccagagguuucucucaug

SEQ ID NO: 810016 - RNA, 19 nt, Human
ccuuuuuuaacuucagcaa

SEQ ID NO: 810017 - RNA, 22 nt, Human
auuugcauuuagaaagaucacu

SEQ ID NO: 810018 - RNA, 22 nt, Human
ugggcagaaugugggauccaga

SEQ ID NO: 810019 - RNA, 22 nt, Human
ccauaaucuggcuuugagagag

SEQ ID NO: 810020 - RNA, 22 nt, Human
ugcuugugagaguuuuuucaga

SEQ ID NO: 810021 - RNA, 22 nt, Human
aagaacaugauggccaugugca

SEQ ID NO: 810022 - RNA, 22 nt, Human
uaggcagaguuuaaugguuaag

SEQ ID NO: 810023 - RNA, 22 nt, Human
ugcagcuguaacagaggccuca

SEQ ID NO: 810024 - RNA, 22 nt, Human
cccagcagccuugucccuucuc

SEQ ID NO: 810025 - RNA, 22 nt, Human
gcugcuggggucacaugguaag

SEQ ID NO: 810026 - RNA, 22 nt, Human
ggcagcauauauucagugggca

SEQ ID NO: 810027 - RNA, 22 nt, Human
aauaccuuuccugccauucacu

SEQ ID NO: 810028 - RNA, 22 nt, Human
ugccacaggcaaucccugcacg

SEQ ID NO: 810029 - RNA, 22 nt, Human
ucuuucccgccagagcaugagu

SEQ ID NO: 810030 - RNA, 19 nt, Human
gacaauuagagaucacuca

SEQ ID NO: 810031 - RNA, 22 nt, Human
acuugccuaaggucaugcaacu

SEQ ID NO: 810032 - RNA, 22 nt, Human
cuggcagcagcuucuggaucga

SEQ ID NO: 810033 - RNA, 22 nt, Human
ccuggcagcccagagcgccgcu

SEQ ID NO: 810034 - RNA, 22 nt, Human
aggugccaagaugucacagaca

SEQ ID NO: 810035 - RNA, 22 nt, Human
gucaggaaaaauugauaauuuu

SEQ ID NO: 810036 - RNA, 22 nt, Human
ucaagagaaggggaaauagacu

SEQ ID NO: 810037 - RNA, 22 nt, Human
cucugagguccuacagugaccc

SEQ ID NO: 810038 - RNA, 22 nt, Human
ucacauuugcuaucccacuccu

SEQ ID NO: 810039 - RNA, 22 nt, Human
caaguccaggugggcaaauaaa

SEQ ID NO: 810040 - RNA, 22 nt, Human
uauuuugacuauuaaaccaaca

SEQ ID NO: 810041 - RNA, 22 nt, Human
cacaaggcuuucaucuggcaua

SEQ ID NO: 810042 - RNA, 22 nt, Human
acaugccagccucagcagcagu

SEQ ID NO: 810043 - RNA, 22 nt, Human
uggcagcaguggagguagaaag

SEQ ID NO: 810044 - RNA, 22 nt, Human
auuucccagggcccucauaguu

SEQ ID NO: 810045 - RNA, 22 nt, Human
ccuuggcuugcacacggccacc

SEQ ID NO: 810046 - RNA, 22 nt, Human
augcuucagugcuaccuucaaa

SEQ ID NO: 810047 - RNA, 22 nt, Human
caaauacuuuauauacuucaaa

SEQ ID NO: 810048 - RNA, 22 nt, Human
agugggcccuugucacacugau

SEQ ID NO: 810049 - RNA, 22 nt, Human
uagugucaggagggaaaugcaa

SEQ ID NO: 810050 - RNA, 22 nt, Human
acauuccuuucuugagcacagu

SEQ ID NO: 810051 - RNA, 22 nt, Human
gaucaggagauggccucagacc

SEQ ID NO: 810052 - RNA, 22 nt, Human
uccccuuggcuuggucaagagg

SEQ ID NO: 810053 - RNA, 22 nt, Human
ugcuggagcaucugagagcauc

SEQ ID NO: 810054 - RNA, 22 nt, Human
aacauacuuauacuaaauaaug

SEQ ID NO: 810055 - RNA, 22 nt, Human
auccagagacccaaggacagaa

SEQ ID NO: 810056 - RNA, 18 nt, Human
uuugaggaaauguccuga

SEQ ID NO: 810057 - RNA, 22 nt, Human
agagaggcugcuggacuauaug

SEQ ID NO: 810058 - RNA, 22 nt, Human
cagcuucucgggagcgcaugug

SEQ ID NO: 810059 - RNA, 22 nt, Human
ucuguugguucuguuucucuga

SEQ ID NO: 810060 - RNA, 22 nt, Human
cuggcucuaagugucagcuccc

SEQ ID NO: 810061 - RNA, 22 nt, Human
uguuuacauaguagcugcccug

SEQ ID NO: 810062 - RNA, 22 nt, Human
aaaacauaaacugacagcccau

SEQ ID NO: 810063 - RNA, 22 nt, Human
cuggagcuccagggucuccucu

SEQ ID NO: 810064 - RNA, 22 nt, Human
cagaggcauauaauugcugggg

SEQ ID NO: 810065 - RNA, 19 nt, Human
uaccaaauugcauuauggc

SEQ ID NO: 810066 - RNA, 22 nt, Human
guuaauaaagguauagaaucag

SEQ ID NO: 810067 - RNA, 22 nt, Human
acaacuuuguagcaauuccacg

SEQ ID NO: 810068 - RNA, 22 nt, Human
agaggcacaacagucccauugu

SEQ ID NO: 810069 - RNA, 22 nt, Human
cuugcuuaccuaguuagcucca

SEQ ID NO: 810070 - RNA, 22 nt, Human
agucuucagcauagcauauggc

SEQ ID NO: 810071 - RNA, 22 nt, Human
cugaagcagauguggcugagau

SEQ ID NO: 810072 - RNA, 22 nt, Human
cuggagucacucauguagcugc

SEQ ID NO: 810073 - RNA, 22 nt, Human
gaggaaaauauucagggagguu

SEQ ID NO: 810074 - RNA, 19 nt, Human
uccugggcugcgucuugcc

SEQ ID NO: 810075 - RNA, 22 nt, Human
aguggagaccccacuucuacau

SEQ ID NO: 810076 - RNA, 22 nt, Human
ggagaaagcuaugugggggagu

SEQ ID NO: 810077 - RNA, 22 nt, Human
gaaugcagugacggaggcuuac

SEQ ID NO: 810078 - RNA, 22 nt, Human
gaguccaggauuugagcucugu

SEQ ID NO: 810079 - RNA, 22 nt, Human
agggaaggaggccauguguccc

SEQ ID NO: 810080 - RNA, 19 nt, Human
uuacaucugcaacacuggu

SEQ ID NO: 810081 - RNA, 22 nt, Human
uuuguguaccuuguacauuugu

SEQ ID NO: 810082 - RNA, 22 nt, Human
uguacagcugccuuuuuuacuu

SEQ ID NO: 810083 - RNA, 22 nt, Human
aggugccuuccgcggagcucgc

SEQ ID NO: 810084 - RNA, 22 nt, Human
ucacagccuggucacucugccc

SEQ ID NO: 810085 - RNA, 22 nt, Human
ggcaggcaguguggugugaaac

SEQ ID NO: 810086 - RNA, 22 nt, Human
acaagagucugcauuucuaaca

SEQ ID NO: 810087 - RNA, 22 nt, Human
gggcugcacguauucugcucac

SEQ ID NO: 810088 - RNA, 22 nt, Human
gcugggcaaggcugaagcuacc

SEQ ID NO: 810089 - RNA, 22 nt, Human
aaacuguauagggaaaaguaga

SEQ ID NO: 810090 - RNA, 22 nt, Human
uggggucgaggguucucuggca

SEQ ID NO: 810091 - RNA, 22 nt, Human
uucauauuugaaacagaaguua

SEQ ID NO: 810092 - RNA, 22 nt, Human
ugaagccacacuagcuuguccu

SEQ ID NO: 810093 - RNA, 23 nt, Human
gcagauggccccagagugcugcc

SEQ ID NO: 810094 - RNA, 22 nt, Human
uuacauucagaaagauuugagu

SEQ ID NO: 810095 - RNA, 22 nt, Human
aacagaaaagguagguggcuuu

SEQ ID NO: 810096 - RNA, 22 nt, Human
aaagccagcucugagcugcacc

SEQ ID NO: 810097 - RNA, 22 nt, Human
cucuggagguggagguugcagu

SEQ ID NO: 810098 - RNA, 22 nt, Human
uuacacaauuacucacuccugg

SEQ ID NO: 810099 - RNA, 22 nt, Human
uagcuucugggaguguuuacua

SEQ ID NO: 810100 - RNA, 22 nt, Human
agcugggaugauaaccucaguc

SEQ ID NO: 810101 - RNA, 22 nt, Human
ucaauuuauguggcuauucauu

SEQ ID NO: 810102 - RNA, 22 nt, Human
cucagccaugggguggaucagc

SEQ ID NO: 810103 - RNA, 22 nt, Human
uauacauguuuuacauaaguga

SEQ ID NO: 810104 - RNA, 22 nt, Human
uuggaacacaauguuucuuuca

SEQ ID NO: 810105 - RNA, 22 nt, Human
aggcagaggagaaugaucuucc

SEQ ID NO: 810106 - RNA, 22 nt, Human
uguccuagagacaucagauguu

SEQ ID NO: 810107 - RNA, 22 nt, Human
aacuuguuucuuccauucaaca

SEQ ID NO: 810108 - RNA, 22 nt, Human
ugaugaaaauguucagcaauua

SEQ ID NO: 810109 - RNA, 23 nt, Human
agcccagcagagaaccuaggucc

SEQ ID NO: 810110 - RNA, 23 nt, Human
ucacuugaagcuagaaucugccc

SEQ ID NO: 810111 - RNA, 22 nt, Human
cugcagcuuuggaaaccuguuu

SEQ ID NO: 810112 - RNA, 22 nt, Human
aauacuauguagccaaaauaau

SEQ ID NO: 810113 - RNA, 22 nt, Human
uuugcaaaugcucugcagagcu

SEQ ID NO: 810114 - RNA, 22 nt, Human
acauucaacauggcuggucuag

SEQ ID NO: 810115 - RNA, 22 nt, Human
aaacacaucauucaugucguca

SEQ ID NO: 810116 - RNA, 22 nt, Human
ccacagugguucucaaccaggg

SEQ ID NO: 810117 - RNA, 22 nt, Human
gggcagcugccagaggccaugg

SEQ ID NO: 810118 - RNA, 21 nt, Human
aaaguucaugcuuuaauauuc

SEQ ID NO: 810119 - RNA, 22 nt, Human
cugcuccaggaacagagcugcu

SEQ ID NO: 810120 - RNA, 22 nt, Human
cgcaggcuggcgcggaguggca

SEQ ID NO: 810121 - RNA, 22 nt, Human
cagaaacuauguaagaaaguga

SEQ ID NO: 810122 - RNA, 22 nt, Human
ccugggucaccaggcccaggca

SEQ ID NO: 810123 - RNA, 22 nt, Human
uguagaaaauuggagcauucau

SEQ ID NO: 810124 - RNA, 22 nt, Human
agggccaguaaauguuuccuca

SEQ ID NO: 810125 - RNA, 22 nt, Human
uugcuuuguggugguucuucca

SEQ ID NO: 810126 - RNA, 19 nt, Human
cugucaggggcuggauguu

SEQ ID NO: 810127 - RNA, 22 nt, Human
cagcuuugagaguugcauuuua

SEQ ID NO: 810128 - RNA, 20 nt, Human
cuggcccaucuaccgcucug

SEQ ID NO: 810129 - RNA, 22 nt, Human
ugcuucuggggacaggcugccu

SEQ ID NO: 810130 - RNA, 22 nt, Human
cagugcagaggugcaagcaugu

SEQ ID NO: 810131 - RNA, 22 nt, Human
acagugauugguuuggggguga

SEQ ID NO: 810132 - RNA, 21 nt, Human
cugccaggauagcaugcaggc

SEQ ID NO: 810133 - RNA, 22 nt, Human
gcugccuggagaggcagggaug

SEQ ID NO: 810134 - RNA, 22 nt, Human
ccuuggcugaggagggagcuga

SEQ ID NO: 810135 - RNA, 22 nt, Human
aaggcagcccuggcucagccug

SEQ ID NO: 810136 - RNA, 22 nt, Human
ggaggcucagugaggaaaugga

SEQ ID NO: 810137 - RNA, 17 nt, Human
agcugccagggagugug

SEQ ID NO: 810138 - RNA, 22 nt, Human
agucuuaauagagaaaaacugu

SEQ ID NO: 810139 - RNA, 22 nt, Human
cugccaggcgauggauuggcug

SEQ ID NO: 810140 - RNA, 21 nt, Human
ugggccucaggcagcugugac

SEQ ID NO: 810141 - RNA, 22 nt, Human
gaugaaauagaauuaauuuagg

SEQ ID NO: 810142 - RNA, 22 nt, Human
gcuuaaaguuguaaauuagaga

SEQ ID NO: 810143 - RNA, 22 nt, Human
cugggauccacgggcucccaag

SEQ ID NO: 810144 - RNA, 22 nt, Human
augaaauaaauacccacacaua

SEQ ID NO: 810145 - RNA, 22 nt, Human
uggcacagagggacccagcagc

SEQ ID NO: 810146 - RNA, 22 nt, Human
ggccuuggauccaagcugcggc

SEQ ID NO: 810147 - RNA, 22 nt, Human
caugagcugcugggagccuguc

SEQ ID NO: 810148 - RNA, 21 nt, Human
cuggaggguagaguugggcug

SEQ ID NO: 810149 - RNA, 22 nt, Human
aggcugaguuucucauucucgc

SEQ ID NO: 810150 - RNA, 22 nt, Human
aaagaacuaaugugcaagguuu

SEQ ID NO: 810151 - RNA, 22 nt, Human
gguggcagaggugcaucagccc

SEQ ID NO: 810152 - RNA, 22 nt, Human
caguggcaguuagaaaauauuc

SEQ ID NO: 810153 - RNA, 22 nt, Human
cucugcaacuucuagcaguguc

SEQ ID NO: 810154 - RNA, 22 nt, Human
aggcuccaccagucaggugcau

SEQ ID NO: 810155 - RNA, 20 nt, Human
uacaaagaaugagguucagg

SEQ ID NO: 810156 - RNA, 22 nt, Human
uucugaaaugagauauaaggua

SEQ ID NO: 810157 - RNA, 22 nt, Human
cagguguuggaagggcaguggg

SEQ ID NO: 810158 - RNA, 22 nt, Human
cugaagcugaaaacuuccagca

SEQ ID NO: 810159 - RNA, 18 nt, Human
ggccagagggaggguccc

SEQ ID NO: 810160 - RNA, 22 nt, Human
agcaggggcuccuccacagcca

SEQ ID NO: 810161 - RNA, 22 nt, Human
uucuauugaaugauaaucuaua

SEQ ID NO: 810162 - RNA, 22 nt, Human
guacaaaaguuauugcgguuuu

SEQ ID NO: 810163 - RNA, 22 nt, Human
ucauauaagagcuuuagaguca

SEQ ID NO: 810164 - RNA, 22 nt, Human
uuuauauguuuguacaauuaag

SEQ ID NO: 810165 - RNA, 22 nt, Human
cuuugacuccaucucucuuugu

SEQ ID NO: 810166 - RNA, 22 nt, Human
uuucaggccauagcacagggaa

SEQ ID NO: 810167 - RNA, 22 nt, Human
caauaauugcuuuccagaguua

SEQ ID NO: 810168 - RNA, 22 nt, Human
ggcaggaaaugggauaagggcu

SEQ ID NO: 810169 - RNA, 22 nt, Human
gcuggcugugggcuccacgcuc

SEQ ID NO: 810170 - RNA, 22 nt, Human
aggacagguguagugggcucug

SEQ ID NO: 810171 - RNA, 22 nt, Human
aaaucacugauuaaaguuagaa

SEQ ID NO: 810172 - RNA, 22 nt, Human
ucaggaaggcgccccaucagga

SEQ ID NO: 810173 - RNA, 22 nt, Human
ccugcccuaugaccagcuucac

SEQ ID NO: 810174 - RNA, 22 nt, Human
acacaaaaucaaaguccuaggc

SEQ ID NO: 810175 - RNA, 22 nt, Human
uggcacagcccauucagagaag

SEQ ID NO: 810176 - RNA, 22 nt, Human
auauuacauaaacaugagugaa

SEQ ID NO: 810177 - RNA, 22 nt, Human
gacuauuuaguuucagauuagu

SEQ ID NO: 810178 - RNA, 22 nt, Human
aggaagaguguuaccuaugggu

SEQ ID NO: 810179 - RNA, 22 nt, Human
cacaugcucauuggcacuguuc

SEQ ID NO: 810180 - RNA, 22 nt, Human
cagaauuucagugauguuuucu

SEQ ID NO: 810181 - RNA, 22 nt, Human
agacaauguuuggucuacacuu

SEQ ID NO: 810182 - RNA, 22 nt, Human
ggcuggagugggcuccagaguu

SEQ ID NO: 810183 - RNA, 19 nt, Human
gcuucccaccagccagccc

SEQ ID NO: 810184 - RNA, 22 nt, Human
gaggcugcuuugaugacaggag

SEQ ID NO: 810185 - RNA, 22 nt, Human
gaauuuuaaguguucgccucuu

SEQ ID NO: 810186 - RNA, 22 nt, Human
agagcucaagacgcucacagua

SEQ ID NO: 810187 - RNA, 22 nt, Human
gcugagguaggagguugcagug

SEQ ID NO: 810188 - RNA, 22 nt, Human
aggugggaacccagcagggccc

SEQ ID NO: 810189 - RNA, 22 nt, Human
acuuaaaaccagacagcgucau

SEQ ID NO: 810190 - RNA, 22 nt, Human
ggcugcaggcuucccuccagca

SEQ ID NO: 810191 - RNA, 18 nt, Human
uggcucagauggcuuuaa

SEQ ID NO: 810192 - RNA, 22 nt, Human
ugggaggcagguaggugaugau

SEQ ID NO: 810193 - RNA, 22 nt, Human
ggccagccuggggcucccagac

SEQ ID NO: 810194 - RNA, 22 nt, Human
agcagcuuccugcucuucgccu

SEQ ID NO: 810195 - RNA, 22 nt, Human
ucaggaugguguggaggaaaua

SEQ ID NO: 810196 - RNA, 19 nt, Human
aagaacuaugugauuacag

SEQ ID NO: 810197 - RNA, 22 nt, Human
gacuuauucacgcagcuauacu

SEQ ID NO: 810198 - RNA, 22 nt, Human
ggcugggcuccgggagcaugcg

SEQ ID NO: 810199 - RNA, 22 nt, Human
cagccaggagccucugcaacua

SEQ ID NO: 810200 - RNA, 21 nt, Human
ugcauuccuccauccaacagg

SEQ ID NO: 810201 - RNA, 22 nt, Human
ugagaaccaagaccaagggccu

SEQ ID NO: 810202 - RNA, 22 nt, Human
uucuuacagauuuggugaauga

SEQ ID NO: 810203 - RNA, 22 nt, Human
cccccaccugaggacagucuua

SEQ ID NO: 810204 - RNA, 22 nt, Human
gagcagugggaaggaacagggu

SEQ ID NO: 810205 - RNA, 22 nt, Human
cagacugggcugguggaaagcu

SEQ ID NO: 810206 - RNA, 22 nt, Human
gaaggcuuuagagagauauaaa

SEQ ID NO: 810207 - RNA, 22 nt, Human
aacauaucuacggauacgauua

SEQ ID NO: 810208 - RNA, 22 nt, Human
ccuggccugugaaucugagagc

SEQ ID NO: 810209 - RNA, 22 nt, Human
gcuggcagggugguugagagag

SEQ ID NO: 810210 - RNA, 22 nt, Human
cccaggaggguggccucugccc

SEQ ID NO: 810211 - RNA, 22 nt, Human
aaagucaaugauuucuccugga

SEQ ID NO: 810212 - RNA, 22 nt, Human
cugaguccagggacagaggcgu

SEQ ID NO: 810213 - RNA, 22 nt, Human
ugugcccaucccucuggagugu

SEQ ID NO: 810214 - RNA, 22 nt, Human
uaguuuaggucguacaagcaaa

SEQ ID NO: 810215 - RNA, 22 nt, Human
gggcuuggcucauaaguggaug

SEQ ID NO: 810216 - RNA, 22 nt, Human
ccacaggaggauguucagacaa

SEQ ID NO: 810217 - RNA, 22 nt, Human
ucuaccaugugcugugcauugg

SEQ ID NO: 810218 - RNA, 22 nt, Human
aggcaguggagaagguuuguga

SEQ ID NO: 810219 - RNA, 22 nt, Human
gggcugccuuucuucugggagc

SEQ ID NO: 810220 - RNA, 22 nt, Human
uucauugcauuccagccugggu

SEQ ID NO: 810221 - RNA, 22 nt, Human
caggguggaacaggcaauacuu

SEQ ID NO: 810222 - RNA, 22 nt, Human
cuuguauucugccuaaccuuca

SEQ ID NO: 810223 - RNA, 20 nt, Human
aacagggcagaagcggagac

SEQ ID NO: 810224 - RNA, 22 nt, Human
gcuggacuuagagguggaaaag

SEQ ID NO: 810225 - RNA, 22 nt, Human
gcugccugaagugucuacacug

SEQ ID NO: 810226 - RNA, 22 nt, Human
accugucaaguccagcgcaaca

SEQ ID NO: 810227 - RNA, 20 nt, Human
guuaggagguuggacaugga

SEQ ID NO: 810228 - RNA, 22 nt, Human
gcagcagcaggcgcucggccgu

SEQ ID NO: 810229 - RNA, 22 nt, Human
gcugggagcaaagccaugcaua

SEQ ID NO: 810230 - RNA, 22 nt, Human
agggcagcuaaggugcugacug

SEQ ID NO: 810231 - RNA, 22 nt, Human
aguccuagacuuuucugccacu

SEQ ID NO: 810232 - RNA, 22 nt, Human
agagauauuauuuaccaaguua

SEQ ID NO: 810233 - RNA, 21 nt, Human
agaaaaacacgauauaagccc

SEQ ID NO: 810234 - RNA, 22 nt, Human
uuguauucuuccuuagcaguac

SEQ ID NO: 810235 - RNA, 22 nt, Human
gauuauuuugugcaauaaucgg

SEQ ID NO: 810236 - RNA, 22 nt, Human
uauaaaacagaaagcacuaccu

SEQ ID NO: 810237 - RNA, 22 nt, Human
uaacacauauuucaagaguagu

SEQ ID NO: 810238 - RNA, 22 nt, Human
aggaagcuuggggcagggcuac

SEQ ID NO: 810239 - RNA, 22 nt, Human
uacaguaacauguuguacaagc

SEQ ID NO: 810240 - RNA, 22 nt, Human
aaguuacagucagagguuaaca

SEQ ID NO: 810241 - RNA, 22 nt, Human
uuccaauaaaauguuauuugca

SEQ ID NO: 810242 - RNA, 22 nt, Human
ccugcuggcggggacccaguga

SEQ ID NO: 810243 - RNA, 22 nt, Human
uucucaggccccugccuggacu

SEQ ID NO: 810244 - RNA, 22 nt, Human
ccuggcucccggaacagggucu

SEQ ID NO: 810245 - RNA, 22 nt, Human
uuuguaagugguagaucuaaga

SEQ ID NO: 810246 - RNA, 22 nt, Human
gcuaggcuucaaaaucucccug

SEQ ID NO: 810247 - RNA, 22 nt, Human
ccucugcaccauagccuucagc

SEQ ID NO: 810248 - RNA, 19 nt, Human
caaaguaccuggcacagug

SEQ ID NO: 810249 - RNA, 22 nt, Human
gggagccagcagggcauggagc

SEQ ID NO: 810250 - RNA, 22 nt, Human
uaaacuacccaugacaguuuca

SEQ ID NO: 810251 - RNA, 22 nt, Human
aggcugaggcgggaggaucacu

SEQ ID NO: 810252 - RNA, 22 nt, Human
aggcaggcaaccaccugggaag

SEQ ID NO: 810253 - RNA, 22 nt, Human
uuucagagaacugaguccuugc

SEQ ID NO: 810254 - RNA, 22 nt, Human
acacaauuucauaaacaccaug

SEQ ID NO: 810255 - RNA, 22 nt, Human
cuuggccugcccagccagaagg

SEQ ID NO: 810256 - RNA, 22 nt, Human
gacauacaagcugguaccuccu

SEQ ID NO: 810257 - RNA, 22 nt, Human
ugcuggcuacugauggcaggcc

SEQ ID NO: 810258 - RNA, 22 nt, Human
uacaauauguggccuuuuguga

SEQ ID NO: 810259 - RNA, 22 nt, Human
cuguuuaucccuuuggucagca

SEQ ID NO: 810260 - RNA, 22 nt, Human
ucuggagagucacagugccaga

SEQ ID NO: 810261 - RNA, 22 nt, Human
cccuggagguggagguugcagg

SEQ ID NO: 810262 - RNA, 22 nt, Human
augagguuugagccucuugacc

SEQ ID NO: 810263 - RNA, 22 nt, Human
caggagcccugguggguggaca

SEQ ID NO: 810264 - RNA, 22 nt, Human
ugcugggauauagcuucuaggg

SEQ ID NO: 810265 - RNA, 22 nt, Human
uuuuguauagucaaagacaaga

SEQ ID NO: 810266 - RNA, 22 nt, Human
auacauaauuacuuccgauguu

SEQ ID NO: 810267 - RNA, 22 nt, Human
cugagccagcuggcaugugcua

SEQ ID NO: 810268 - RNA, 22 nt, Human
gcuggaucccugugggaguggu

SEQ ID NO: 810269 - RNA, 22 nt, Human
aaggcccugucuccaaauacag

SEQ ID NO: 810270 - RNA, 22 nt, Human
guccagcccgggcuccgccagc

SEQ ID NO: 810271 - RNA, 19 nt, Human
aaagugauuuuuucuggca

SEQ ID NO: 810272 - RNA, 22 nt, Human
ggcuucccagucccugcucuca

SEQ ID NO: 810273 - RNA, 22 nt, Human
gcacggcaagacggggccuccu

SEQ ID NO: 810274 - RNA, 22 nt, Human
ucagaauuuuaaaccaaggaaa

SEQ ID NO: 810275 - RNA, 22 nt, Human
auauaguuuaagaaaguacagu

SEQ ID NO: 810276 - RNA, 22 nt, Human
ugcaggcucaucucaagaguag

SEQ ID NO: 810277 - RNA, 22 nt, Human
ucucccucucagauuuauucac

SEQ ID NO: 810278 - RNA, 22 nt, Human
agcccugaagcuggccaugucc

SEQ ID NO: 810279 - RNA, 23 nt, Human
gggagccaggaccucgcgcccca

SEQ ID NO: 810280 - RNA, 22 nt, Human
agcagagcugcaguggccugcu

SEQ ID NO: 810281 - RNA, 22 nt, Human
agacaaaccuuguuuuaugaug

SEQ ID NO: 810282 - RNA, 22 nt, Human
cugcagcugcgggaccggagcg

SEQ ID NO: 810283 - RNA, 22 nt, Human
agcccagggacagggcggaugu

SEQ ID NO: 810284 - RNA, 22 nt, Human
gaccugcccacucugaggacau

SEQ ID NO: 810285 - RNA, 22 nt, Human
aacauaucauaggaugucauug

SEQ ID NO: 810286 - RNA, 22 nt, Human
gccagagcaugcacugccugca

SEQ ID NO: 810287 - RNA, 22 nt, Human
uucaaaguaccguacuuaaugg

SEQ ID NO: 810288 - RNA, 22 nt, Human
cccucccuuugcagcagugcau

SEQ ID NO: 810289 - RNA, 22 nt, Human
uuguuacagcagcaauagaaaa

SEQ ID NO: 810290 - RNA, 22 nt, Human
ucuuaaugaaagugaaauauca

SEQ ID NO: 810291 - RNA, 22 nt, Human
aggcaguguggagggcuguugc

SEQ ID NO: 810292 - RNA, 22 nt, Human
uucugaaggucagcagcuuggu

SEQ ID NO: 810293 - RNA, 22 nt, Human
uaaugucuaugggccagauaau

SEQ ID NO: 810294 - RNA, 19 nt, Human
agaagcccagaucccagcc

SEQ ID NO: 810295 - RNA, 22 nt, Human
auuccugguggcagaaacauga

SEQ ID NO: 810296 - RNA, 22 nt, Human
cagcuggcagaaccugcaucca

SEQ ID NO: 810297 - RNA, 22 nt, Human
ccaggcagagggauccccaucc

SEQ ID NO: 810298 - RNA, 22 nt, Human
uaacauuuaaauuuuucacaua

SEQ ID NO: 810299 - RNA, 22 nt, Human
cagggcacagaucggggcgcac

SEQ ID NO: 810300 - RNA, 22 nt, Human
uucuggaucagcaucaugagau

SEQ ID NO: 810301 - RNA, 22 nt, Human
cuggauccaucgggucccgagu

SEQ ID NO: 810302 - RNA, 22 nt, Human
acauuucucuugaugucucuau

SEQ ID NO: 810303 - RNA, 22 nt, Human
gcagcuucagccagagggccag

SEQ ID NO: 810304 - RNA, 22 nt, Human
ucacaguaaauccagaagaaau

SEQ ID NO: 810305 - RNA, 22 nt, Human
gccagaggaacgcugcgcgccc

SEQ ID NO: 810306 - RNA, 22 nt, Human
auaaagcuucugagucuagauc

SEQ ID NO: 810307 - RNA, 22 nt, Human
uuuuucauugcagccucucucc

SEQ ID NO: 810308 - RNA, 23 nt, Human
cagcuucuuugggauucuuuaua

SEQ ID NO: 810309 - RNA, 16 nt, Human
uggcuucccagagaua

SEQ ID NO: 810310 - RNA, 22 nt, Human
uaauacaucauucaucuaagga

SEQ ID NO: 810311 - RNA, 22 nt, Human
cacagcagggcauggcuguugu

SEQ ID NO: 810312 - RNA, 22 nt, Human
ucuucccucuucugccaaauac

SEQ ID NO: 810313 - RNA, 22 nt, Human
uuauuauaaugagggauaaaaa

SEQ ID NO: 810314 - RNA, 22 nt, Human
acaacaucagcugagaccuuca

SEQ ID NO: 810315 - RNA, 22 nt, Human
gccaggucuggguagcagagga

SEQ ID NO: 810316 - RNA, 22 nt, Human
caggaaauucuuuuuaacagaa

SEQ ID NO: 810317 - RNA, 22 nt, Human
ggcaggcagaggcugagacagg

SEQ ID NO: 810318 - RNA, 22 nt, Human
cagcuggcgccuggggaccaga

SEQ ID NO: 810319 - RNA, 22 nt, Human
caguguuuugagaagggcacgu

SEQ ID NO: 810320 - RNA, 22 nt, Human
ucacaggcucuagggauuaaga

SEQ ID NO: 810321 - RNA, 22 nt, Human
cauagcuuagggguuaaacuca

SEQ ID NO: 810322 - RNA, 22 nt, Human
cugcaaauugguggugaggcaa

SEQ ID NO: 810323 - RNA, 22 nt, Human
ucagcagggccaugcucucucu

SEQ ID NO: 810324 - RNA, 22 nt, Human
cugccucuugacagaucguggc

SEQ ID NO: 810325 - RNA, 22 nt, Human
augccaaagggagcacuuuggg

SEQ ID NO: 810326 - RNA, 22 nt, Human
ugauuauauucuaacuucauaa

SEQ ID NO: 810327 - RNA, 22 nt, Human
acaagcacuucacuguccucug

SEQ ID NO: 810328 - RNA, 20 nt, Human
cuggggaggaggauguguuc

SEQ ID NO: 810329 - RNA, 22 nt, Human
aaucaggagagcugcgaacguu

SEQ ID NO: 810330 - RNA, 22 nt, Human
cccaggcagaauuaguguuuca

SEQ ID NO: 810331 - RNA, 22 nt, Human
cacagaggugauaguggucaag

SEQ ID NO: 810332 - RNA, 19 nt, Human
ugaggccaaggucacagau

SEQ ID NO: 810333 - RNA, 22 nt, Human
ggaugucgaggaugggguagca

SEQ ID NO: 810334 - RNA, 22 nt, Human
ccacuggcuuuuccuaggucuc

SEQ ID NO: 810335 - RNA, 22 nt, Human
ccugggccuugaccucgugggc

SEQ ID NO: 810336 - RNA, 20 nt, Human
cgcccagugcgguucugacc

SEQ ID NO: 810337 - RNA, 22 nt, Human
uuauugcuggcaccuucaauuc

SEQ ID NO: 810338 - RNA, 22 nt, Human
auuucacauuaauuugaugcuc

SEQ ID NO: 810339 - RNA, 22 nt, Human
gcgagaaacuaagugcccuuug

SEQ ID NO: 810340 - RNA, 22 nt, Human
aacauuuguacuaaagaaguuc

SEQ ID NO: 810341 - RNA, 22 nt, Human
agcccagcacugggggcccagc

SEQ ID NO: 810342 - RNA, 22 nt, Human
agccugagagccaagcugugca

SEQ ID NO: 810343 - RNA, 22 nt, Human
agguuugguuugacaagacuga

SEQ ID NO: 810344 - RNA, 22 nt, Human
uccacaggcaagucucuuggca

SEQ ID NO: 810345 - RNA, 22 nt, Human
cugggccagauccagccucaca

SEQ ID NO: 810346 - RNA, 22 nt, Human
gugcaaauguaauugccauuga

SEQ ID NO: 810347 - RNA, 22 nt, Human
cagcucauuccucaaucuagga

SEQ ID NO: 810348 - RNA, 18 nt, Human
agcccaggcaucgucugc

SEQ ID NO: 810349 - RNA, 22 nt, Human
uggcuuccuguuucccagaaag

SEQ ID NO: 810350 - RNA, 22 nt, Human
cugcacagggauauggggagcu

SEQ ID NO: 810351 - RNA, 22 nt, Human
caaggcagcguuccuuucugga

SEQ ID NO: 810352 - RNA, 22 nt, Human
guuuuauaugucucugcugaca

SEQ ID NO: 810353 - RNA, 22 nt, Human
aaaucucugaacuuaauaaugc

SEQ ID NO: 810354 - RNA, 18 nt, Human
ucucauuacaaucuuugu

SEQ ID NO: 810355 - RNA, 22 nt, Human
ucucuccuuaucauuguguuua

SEQ ID NO: 810356 - RNA, 22 nt, Human
cccuggaggcuggaggcaguag

SEQ ID NO: 810357 - RNA, 22 nt, Human
uggcaguggcaucaccccaaua

SEQ ID NO: 810358 - RNA, 21 nt, Human
uccugggggguaggugaguuu

SEQ ID NO: 810359 - RNA, 22 nt, Human
uaacacauuuuccucauacgga

SEQ ID NO: 810360 - RNA, 22 nt, Human
agcaggcaggaaggcagcacug

SEQ ID NO: 810361 - RNA, 22 nt, Human
uccccaggacuaaguugcaauc

SEQ ID NO: 810362 - RNA, 22 nt, Human
ccaggcguggcuucagcagccc

SEQ ID NO: 810363 - RNA, 20 nt, Human
aagaaacuugaaaguacaag

SEQ ID NO: 810364 - RNA, 22 nt, Human
uggggugaggcagccacauuua

SEQ ID NO: 810365 - RNA, 21 nt, Human
uaggacagccccccugcccuc

SEQ ID NO: 810366 - RNA, 22 nt, Human
acucagagccucgagggacugc

SEQ ID NO: 810367 - RNA, 22 nt, Human
uagagaaauaagcuuugccuug

SEQ ID NO: 810368 - RNA, 22 nt, Human
uuccagaguugggggagugguu

SEQ ID NO: 810369 - RNA, 22 nt, Human
acuguugaagugccagcuugau

SEQ ID NO: 810370 - RNA, 19 nt, Human
aggcuuggaacagccuuau

SEQ ID NO: 810371 - RNA, 22 nt, Human
uguauacaggcauaagagauac

SEQ ID NO: 810372 - RNA, 22 nt, Human
uucauauuaugauuugaaaugc

SEQ ID NO: 810373 - RNA, 22 nt, Human
cacugagagaugugucacagca

SEQ ID NO: 810374 - RNA, 22 nt, Human
ccaugcaagggucugguccugc

SEQ ID NO: 810375 - RNA, 22 nt, Human
uggggaaagacauucauacagu

SEQ ID NO: 810376 - RNA, 21 nt, Human
caggcucugcugggugcuggg

SEQ ID NO: 810377 - RNA, 22 nt, Human
cugccuggguucaaguccuguu

SEQ ID NO: 810378 - RNA, 22 nt, Human
agcuggcuuuugugaagguuuu

SEQ ID NO: 810379 - RNA, 22 nt, Human
ucuuaggaguagaauucucaca

SEQ ID NO: 810380 - RNA, 22 nt, Human
gcuggcagucccaucagcuggg

SEQ ID NO: 810381 - RNA, 18 nt, Human
acauuucuaugcuucugg

SEQ ID NO: 810382 - RNA, 22 nt, Human
ucaaaggaguuuaaguuacugg

SEQ ID NO: 810383 - RNA, 22 nt, Human
ugagcuuuuaauauacaggugu

SEQ ID NO: 810384 - RNA, 22 nt, Human
auccacagucagaacgggccua

SEQ ID NO: 810385 - RNA, 16 nt, Human
gugagggacauagcuu

SEQ ID NO: 810386 - RNA, 20 nt, Human
acacauauagcagcauaaac

SEQ ID NO: 810387 - RNA, 22 nt, Human
uccaagagaauacuggagagua

SEQ ID NO: 810388 - RNA, 18 nt, Human
guuugcuacauucacuug

SEQ ID NO: 810389 - RNA, 22 nt, Human
uccugggcuugcuccuccagcu

SEQ ID NO: 810390 - RNA, 22 nt, Human
ucuggcuguguaagguagcacc

SEQ ID NO: 810391 - RNA, 22 nt, Human
cagcuuuauuaaugauugucuu

SEQ ID NO: 810392 - RNA, 23 nt, Human
cagcacaguacauuuccugucuc

SEQ ID NO: 810393 - RNA, 22 nt, Human
ucucccaggcugcccuguggac

SEQ ID NO: 810394 - RNA, 22 nt, Human
ugucauuuauuuugcugucugu

SEQ ID NO: 810395 - RNA, 23 nt, Human
agcugcugggccugccguggccu

SEQ ID NO: 810396 - RNA, 22 nt, Human
ccagggcuccccagaaguaccc

SEQ ID NO: 810397 - RNA, 22 nt, Human
gcaccccugcgugccuucccuu

SEQ ID NO: 810398 - RNA, 22 nt, Human
caggaggaaaugugacccugcu

SEQ ID NO: 810399 - RNA, 22 nt, Human
uaggaaaugcugucuuauugua

SEQ ID NO: 810400 - RNA, 20 nt, Human
ugggccucuggugccucugg

SEQ ID NO: 810401 - RNA, 22 nt, Human
ugccacagacaggacagaacag

SEQ ID NO: 810402 - RNA, 22 nt, Human
acugugagagagguucuuggua

SEQ ID NO: 810403 - RNA, 21 nt, Human
ugaaacuaccuacaagcuacc

SEQ ID NO: 810404 - RNA, 22 nt, Human
ucuuuacaguccucugucaauc

SEQ ID NO: 810405 - RNA, 18 nt, Human
agaugaaagcaaaugaca

SEQ ID NO: 810406 - RNA, 22 nt, Human
uauuuucaccuucucuggauau

SEQ ID NO: 810407 - RNA, 22 nt, Human
cccucugcucaggugcauaggc

SEQ ID NO: 810408 - RNA, 22 nt, Human
agcuuuaugcuuccuacaagcu

SEQ ID NO: 810409 - RNA, 17 nt, Human
ucuggaugucauggaag

SEQ ID NO: 810410 - RNA, 22 nt, Human
ggcagggaaacagcugauccca

SEQ ID NO: 810411 - RNA, 22 nt, Human
ggcacuuuccagucuauagagc

SEQ ID NO: 810412 - RNA, 23 nt, Human
ugccagggcccugugugcaaugc

SEQ ID NO: 810413 - RNA, 22 nt, Human
gaggccaggacaugaaagcuga

SEQ ID NO: 810414 - RNA, 19 nt, Human
gauaaguuuccagguaacu

SEQ ID NO: 810415 - RNA, 22 nt, Human
gagaagggauauggcuucuuga

SEQ ID NO: 810416 - RNA, 21 nt, Human
agcugccugcucuggaccugg

SEQ ID NO: 810417 - RNA, 22 nt, Human
acacuguugcuggcacagacag

SEQ ID NO: 810418 - RNA, 22 nt, Human
ugggagagaauucuggugacug

SEQ ID NO: 810419 - RNA, 20 nt, Human
aauuagauguuuaaucaaua

SEQ ID NO: 810420 - RNA, 22 nt, Human
uuucuauugaucuaauaaacau

SEQ ID NO: 810421 - RNA, 22 nt, Human
uugaaugauuaaagucaucuga

SEQ ID NO: 810422 - RNA, 22 nt, Human
cugcagugcaagcccagaugga

SEQ ID NO: 810423 - RNA, 22 nt, Human
cuuguuuaaauaagauagcagu

SEQ ID NO: 810424 - RNA, 22 nt, Human
ugggagaagcagcagccaagug

SEQ ID NO: 810425 - RNA, 22 nt, Human
ugggucaccacuucagaggaga

SEQ ID NO: 810426 - RNA, 20 nt, Human
cagcagagacccauggggag

SEQ ID NO: 810427 - RNA, 22 nt, Human
acagucuuaauggauaggagcu

SEQ ID NO: 810428 - RNA, 22 nt, Human
agugcaggccccaggccaggcc

SEQ ID NO: 810429 - RNA, 22 nt, Human
ugaauaaauugagagcgaaugu

SEQ ID NO: 810430 - RNA, 19 nt, Human
agcaggcuaggcugccucu

SEQ ID NO: 810431 - RNA, 22 nt, Human
gcagcugccuauucagggcuug

SEQ ID NO: 810432 - RNA, 22 nt, Human
uucacauuugcccuuaugugug

SEQ ID NO: 810433 - RNA, 22 nt, Human
caggcccagugaucagggcucu

SEQ ID NO: 810434 - RNA, 22 nt, Human
ugagaagauuugcucuucugag

SEQ ID NO: 810435 - RNA, 21 nt, Human
ucauuuuuauugcuaccuugc

SEQ ID NO: 810436 - RNA, 22 nt, Human
gagagcacggucuugggcaugg

SEQ ID NO: 810437 - RNA, 22 nt, Human
auagcuuuuugucauagagucu

SEQ ID NO: 810438 - RNA, 22 nt, Human
uugacuuuauguguauguuuac

SEQ ID NO: 810439 - RNA, 22 nt, Human
gcagaugccacuaggugaagug

SEQ ID NO: 810440 - RNA, 22 nt, Human
aaaggcucagaaucggcagacc

SEQ ID NO: 810441 - RNA, 22 nt, Human
ucagaggccugaaagaauuugg

SEQ ID NO: 810442 - RNA, 22 nt, Human
uuacaaagcaggucagcugaaa

SEQ ID NO: 810443 - RNA, 22 nt, Human
cuggcagcauuaacagagagca

SEQ ID NO: 810444 - RNA, 22 nt, Human
aagauuuaccacuuuauucaag

SEQ ID NO: 810445 - RNA, 22 nt, Human
aaaauagcauauugcuuucuuu

SEQ ID NO: 810446 - RNA, 22 nt, Human
gucuuauuagguuaacccugcu

SEQ ID NO: 810447 - RNA, 22 nt, Human
auaucaaagcuaguggaaauuu

SEQ ID NO: 810448 - RNA, 22 nt, Human
cuccaggccagggaaguggaca

SEQ ID NO: 810449 - RNA, 22 nt, Human
ugcaggguguccggaggaucac

SEQ ID NO: 810450 - RNA, 22 nt, Human
cuuuuguucuacagcuggggaa

SEQ ID NO: 810451 - RNA, 22 nt, Human
agcccagcaguaagauuagaga

SEQ ID NO: 810452 - RNA, 22 nt, Human
gcagccagggcuaagcugggga

SEQ ID NO: 810453 - RNA, 22 nt, Human
caggggccuggcugucuaggaa

SEQ ID NO: 810454 - RNA, 22 nt, Human
guucuacaguuccuauuacuua

SEQ ID NO: 810455 - RNA, 22 nt, Human
uagaauaaguugaugauauaug

SEQ ID NO: 810456 - RNA, 22 nt, Human
gcagcuggauuucaagagggag

SEQ ID NO: 810457 - RNA, 22 nt, Human
gcuggcagagcucugggcuggg

SEQ ID NO: 810458 - RNA, 22 nt, Human
cuggaaugagcagggcuuaugg

SEQ ID NO: 810459 - RNA, 22 nt, Human
agcccagcuuucaccccucugg

SEQ ID NO: 810460 - RNA, 22 nt, Human
cuggcacauaguaggugcacag

SEQ ID NO: 810461 - RNA, 22 nt, Human
ucguucuugucaguuuauaaag

SEQ ID NO: 810462 - RNA, 22 nt, Human
ugcuggcuggagugccucugga

SEQ ID NO: 810463 - RNA, 22 nt, Human
uguguuucucugaggggucccu

SEQ ID NO: 810464 - RNA, 21 nt, Human
cacaggugggucagugaggcc

SEQ ID NO: 810465 - RNA, 22 nt, Human
ggcccucugccugugcuggcga

SEQ ID NO: 810466 - RNA, 22 nt, Human
caugaaauucagcaggugagua

SEQ ID NO: 810467 - RNA, 22 nt, Human
ucuaaagauguuuauugacaua

SEQ ID NO: 810468 - RNA, 22 nt, Human
guuuuucuuugugugaagacaa

SEQ ID NO: 810469 - RNA, 22 nt, Human
agaaggccaagaagaagccuau

SEQ ID NO: 810470 - RNA, 22 nt, Human
ugaggcugagauaucagggagg

SEQ ID NO: 810471 - RNA, 22 nt, Human
gggaagagauuuccacaucauu

SEQ ID NO: 810472 - RNA, 23 nt, Human
auuugacagagcauagcauuucu

SEQ ID NO: 810473 - RNA, 19 nt, Human
gucccugggcagaggcacc

SEQ ID NO: 810474 - RNA, 22 nt, Human
aucuuugguacuauucuuauca

SEQ ID NO: 810475 - RNA, 22 nt, Human
ugcccagcuauuccuuucuuag

SEQ ID NO: 810476 - RNA, 22 nt, Human
caagucaaagacuagaacuagu

SEQ ID NO: 810477 - RNA, 22 nt, Human
ucuaggagcuuaaaggaggcca

SEQ ID NO: 810478 - RNA, 22 nt, Human
gccugcagaggugcugcuagcu

SEQ ID NO: 810479 - RNA, 18 nt, Human
gugcaaauacuugcugac

SEQ ID NO: 810480 - RNA, 22 nt, Human
ggcuuaaagaauuaacagagau

SEQ ID NO: 810481 - RNA, 22 nt, Human
gcaggaacuggagcuggauguu

SEQ ID NO: 810482 - RNA, 22 nt, Human
gugaggugggcugggcucuaug

SEQ ID NO: 810483 - RNA, 22 nt, Human
ucugaggaaucuugacacauuu

SEQ ID NO: 810484 - RNA, 22 nt, Human
aaguccagcucuaaauaucuga

SEQ ID NO: 810485 - RNA, 22 nt, Human
ugaaggccagcagagugaaggc

SEQ ID NO: 810486 - RNA, 22 nt, Human
uucuucaugcuguugcugcuug

SEQ ID NO: 810487 - RNA, 22 nt, Human
uucaguuuccacuuacauuuaa

SEQ ID NO: 810488 - RNA, 23 nt, Human
gccagccagaauuucuccacugu

SEQ ID NO: 810489 - RNA, 22 nt, Human
aacaucuuguacugcacauuuu

SEQ ID NO: 810490 - RNA, 22 nt, Human
agggaccaaucaccgacaggcu

SEQ ID NO: 810491 - RNA, 22 nt, Human
aagaacuugggcugagugaaag

SEQ ID NO: 810492 - RNA, 22 nt, Human
guccccagcugugacgagagcc

SEQ ID NO: 810493 - RNA, 22 nt, Human
gagggagccgccacagacuggg

SEQ ID NO: 810494 - RNA, 22 nt, Human
agaugaaaauacgugacuuuaa

SEQ ID NO: 810495 - RNA, 22 nt, Human
cucugcugaucucagcugggcu

SEQ ID NO: 810496 - RNA, 22 nt, Human
aacagauuguaaccugauagcc

SEQ ID NO: 810497 - RNA, 22 nt, Human
uuguugucauuguagaggauuu

SEQ ID NO: 810498 - RNA, 23 nt, Human
gggagccauggguggucauggag

SEQ ID NO: 810499 - RNA, 22 nt, Human
ugucucuuacuuugauucuugg

SEQ ID NO: 810500 - RNA, 22 nt, Human
ggcaguggcauguggguagugg

SEQ ID NO: 810501 - RNA, 22 nt, Human
gcaccccucagcuuguuuacua

SEQ ID NO: 810502 - RNA, 19 nt, Human
uacauacuuauucuaaaag

SEQ ID NO: 810503 - RNA, 22 nt, Human
uccagggagauacuggcugcca

SEQ ID NO: 810504 - RNA, 22 nt, Human
ugucauggggaaaauaacagac

SEQ ID NO: 810505 - RNA, 22 nt, Human
ugcuggagcccaggcggccuuu

SEQ ID NO: 810506 - RNA, 22 nt, Human
uuuaccacaauuuuaaacaaug

SEQ ID NO: 810507 - RNA, 22 nt, Human
uaggccaggaaucagcaagcuu

SEQ ID NO: 810508 - RNA, 22 nt, Human
gaggaaagaaccccagucaaua

SEQ ID NO: 810509 - RNA, 22 nt, Human
ggcaagaaggcuucagguagcu

SEQ ID NO: 810510 - RNA, 22 nt, Human
uaugagaacugacagagugcca

SEQ ID NO: 810511 - RNA, 22 nt, Human
aguauauaugaggaaccacaaa

SEQ ID NO: 810512 - RNA, 22 nt, Human
gcugcugucacccacaucuguc

SEQ ID NO: 810513 - RNA, 22 nt, Human
cagggguggcugcagcagaggu

SEQ ID NO: 810514 - RNA, 22 nt, Human
gagguggcccuugcucagccuu

SEQ ID NO: 810515 - RNA, 22 nt, Human
guuacaaagcacuucaagugaa

SEQ ID NO: 810516 - RNA, 22 nt, Human
ucagugcauuaauaauaucagu

SEQ ID NO: 810517 - RNA, 22 nt, Human
gcuggagaacccaggaggaaga

SEQ ID NO: 810518 - RNA, 22 nt, Human
agcugaggccacgagugaaggg

SEQ ID NO: 810519 - RNA, 22 nt, Human
uggcaucuccgacagucuugau

SEQ ID NO: 810520 - RNA, 22 nt, Human
gcucaggaaacagcagggcuug

SEQ ID NO: 810521 - RNA, 18 nt, Human
uauguauaacauaguuca

SEQ ID NO: 810522 - RNA, 21 nt, Human
ccacucugaguguugaacaga

SEQ ID NO: 810523 - RNA, 22 nt, Human
aaaugcauguagaauaauagag

SEQ ID NO: 810524 - RNA, 22 nt, Human
accaggaguugggggugggacc

SEQ ID NO: 810525 - RNA, 22 nt, Human
uuacuuuugcaccaaacuaaua

SEQ ID NO: 810526 - RNA, 22 nt, Human
ccagggcccacggccagaauag

SEQ ID NO: 810527 - RNA, 22 nt, Human
uuaaugacaggauaggcucuga

SEQ ID NO: 810528 - RNA, 22 nt, Human
guuuacauguaauguguuauug

SEQ ID NO: 810529 - RNA, 22 nt, Human
aggccagaguuaaggagaacag

SEQ ID NO: 810530 - RNA, 22 nt, Human
ugggagugcaccugggacacga

SEQ ID NO: 810531 - RNA, 22 nt, Human
uguggcucuccuccugcugccc

SEQ ID NO: 810532 - RNA, 21 nt, Human
ccagccucagaucagggagcu

SEQ ID NO: 810533 - RNA, 22 nt, Human
ccugggaagucagccaaggacg

SEQ ID NO: 810534 - RNA, 22 nt, Human
agaaggccuaacuugggggcaa

SEQ ID NO: 810535 - RNA, 22 nt, Human
ccaucccuucucuggccagcag

SEQ ID NO: 810536 - RNA, 22 nt, Human
gcacagggcugccaggcggcuu

SEQ ID NO: 810537 - RNA, 22 nt, Human
ccacuggcauccagcugccauc

SEQ ID NO: 810538 - RNA, 22 nt, Human
aaacagugccaggcagaugcca

SEQ ID NO: 810539 - RNA, 22 nt, Human
acugcaaucuggauccuagaag

SEQ ID NO: 810540 - RNA, 22 nt, Human
auguguuuugguaauuucugcu

SEQ ID NO: 810541 - RNA, 21 nt, Human
ucaggagagcccaucuacaaa

SEQ ID NO: 810542 - RNA, 22 nt, Human
cugagaggaacaucuuaugcuu

SEQ ID NO: 810543 - RNA, 22 nt, Human
aggcccaguguggcuuccugga

SEQ ID NO: 810544 - RNA, 22 nt, Human
uaguauagauugaagcagauca

SEQ ID NO: 810545 - RNA, 21 nt, Human
uggccagcuggagucuccaca

SEQ ID NO: 810546 - RNA, 22 nt, Human
aauguauaaccauaggaaauuu

SEQ ID NO: 810547 - RNA, 22 nt, Human
ugccagggugucaggagagcua

SEQ ID NO: 810548 - RNA, 22 nt, Human
cugguucaugguggaaugacau

SEQ ID NO: 810549 - RNA, 22 nt, Human
auguuuguguuacacucugcag

SEQ ID NO: 810550 - RNA, 22 nt, Human
ggccccaguucacuccuggccg

SEQ ID NO: 810551 - RNA, 22 nt, Human
gggugguggcggaggcuccagg

SEQ ID NO: 810552 - RNA, 22 nt, Human
cugccaaaaggugcaccugcug

SEQ ID NO: 810553 - RNA, 22 nt, Human
ucucugucugagccuggcagac

SEQ ID NO: 810554 - RNA, 22 nt, Human
uucccuuccucacucuacuugu

SEQ ID NO: 810555 - RNA, 22 nt, Human
gucccagggagguucagggcuu

SEQ ID NO: 810556 - RNA, 22 nt, Human
gauggcagucaaccaggugagg

SEQ ID NO: 810557 - RNA, 22 nt, Human
cuccagaggaaagcacauagug

SEQ ID NO: 810558 - RNA, 22 nt, Human
auuucuuuucaagagggugcuu

SEQ ID NO: 810559 - RNA, 22 nt, Human
gcaguaagauguuucccagagc

SEQ ID NO: 810560 - RNA, 22 nt, Human
aguauuuucaaccauagccugg

SEQ ID NO: 810561 - RNA, 21 nt, Human
uaucacaguagaauaggaucu

SEQ ID NO: 810562 - RNA, 22 nt, Human
cugaggagaaagaugguccaag

SEQ ID NO: 810563 - RNA, 22 nt, Human
uggcagaaguacacaagcaugc

SEQ ID NO: 810564 - RNA, 21 nt, Human
accaguuuggggggcuuccug

SEQ ID NO: 810565 - RNA, 22 nt, Human
gaggccuggugcuguguccaca

SEQ ID NO: 810566 - RNA, 22 nt, Human
ggcagcuuccugagccagcagc

SEQ ID NO: 810567 - RNA, 22 nt, Human
ucaguguuuguggcaaauguua

SEQ ID NO: 810568 - RNA, 22 nt, Human
ccuuggguuccaagucacugaa

SEQ ID NO: 810569 - RNA, 22 nt, Human
uucauugauaguuuuauguaug

SEQ ID NO: 810570 - RNA, 22 nt, Human
uuugaaauaugugaugagagag

SEQ ID NO: 810571 - RNA, 22 nt, Human
aauacuugaauuucaugucagg

SEQ ID NO: 810572 - RNA, 22 nt, Human
cgaaaauagaucuguuucccag

SEQ ID NO: 810573 - RNA, 22 nt, Human
uaugaaaauuuagcugaagcau

SEQ ID NO: 810574 - RNA, 23 nt, Human
ucagugucuaguuguggaauuga

SEQ ID NO: 810575 - RNA, 23 nt, Human
ccaggccucucagagggugugcc

SEQ ID NO: 810576 - RNA, 22 nt, Human
gcagcuuuuuggaugucaguua

SEQ ID NO: 810577 - RNA, 22 nt, Human
cagcagaagcaacauucaggcu

SEQ ID NO: 810578 - RNA, 22 nt, Human
ccugugcuucagcuggaggagg

SEQ ID NO: 810579 - RNA, 22 nt, Human
gugcaaauguaauugugguuuu

SEQ ID NO: 810580 - RNA, 22 nt, Human
cccuggagcugcuugcauguug

SEQ ID NO: 810581 - RNA, 22 nt, Human
uauugauucugucccaaguuga

SEQ ID NO: 810582 - RNA, 22 nt, Human
uacaagaaggauggagcccacu

SEQ ID NO: 810583 - RNA, 19 nt, Human
ugugugcaaauggaagcca

SEQ ID NO: 810584 - RNA, 22 nt, Human
ucacauuuaaacaggaggauua

SEQ ID NO: 810585 - RNA, 22 nt, Human
gacccguggcaggcugccugcu

SEQ ID NO: 810586 - RNA, 22 nt, Human
uccauaaaccagaaaaucaaga

SEQ ID NO: 810587 - RNA, 22 nt, Human
cugguagggccccacauccuua

SEQ ID NO: 810588 - RNA, 22 nt, Human
aagucagacagcugagcugccu

SEQ ID NO: 810589 - RNA, 22 nt, Human
gcuccagcucguggcucccagc

SEQ ID NO: 810590 - RNA, 22 nt, Human
uccccaggagcaaugauucagu

SEQ ID NO: 810591 - RNA, 22 nt, Human
aagaacauguuaaaagauucac

SEQ ID NO: 810592 - RNA, 22 nt, Human
agaguugcuauagaaggaugga

SEQ ID NO: 810593 - RNA, 22 nt, Human
uaaaaggcacuuggaugcugag

SEQ ID NO: 810594 - RNA, 22 nt, Human
acuguucugccaagaucaacgu

SEQ ID NO: 810595 - RNA, 19 nt, Human
agauuauugcacauucaug

SEQ ID NO: 810596 - RNA, 22 nt, Human
aagccaggggcugcuuaggaga

SEQ ID NO: 810597 - RNA, 22 nt, Human
guaauuacaugaguacuguaag

SEQ ID NO: 810598 - RNA, 22 nt, Human
gagcugaguguccuaggcaugg

SEQ ID NO: 810599 - RNA, 22 nt, Human
aggcagcugcccucuccuuccu

SEQ ID NO: 810600 - RNA, 22 nt, Human
cuuuccccaagcaccacagugc

SEQ ID NO: 810601 - RNA, 22 nt, Human
gaaggcaggcuucugauuaggu

SEQ ID NO: 810602 - RNA, 20 nt, Human
cagaugcuggaucuuggucc

SEQ ID NO: 810603 - RNA, 22 nt, Human
cuccugguucagagagcugaga

SEQ ID NO: 810604 - RNA, 22 nt, Human
uggcuggaugugagaucaagag

SEQ ID NO: 810605 - RNA, 22 nt, Human
agccuggguggggguucggaga

SEQ ID NO: 810606 - RNA, 22 nt, Human
cugagcagaccauggcagaggu

SEQ ID NO: 810607 - RNA, 22 nt, Human
uaguccugaccagcuggauguu

SEQ ID NO: 810608 - RNA, 22 nt, Human
gggacacuggacccagugucca

SEQ ID NO: 810609 - RNA, 22 nt, Human
agcccagggcuaauaggaacca

SEQ ID NO: 810610 - RNA, 22 nt, Human
agcuggcucagccggguggucu

SEQ ID NO: 810611 - RNA, 22 nt, Human
caaaauuagggagugagcugga

SEQ ID NO: 810612 - RNA, 22 nt, Human
aauggaauaccuagguggccca

SEQ ID NO: 810613 - RNA, 22 nt, Human
ucacagaacaagccugguggag

SEQ ID NO: 810614 - RNA, 22 nt, Human
ccagaggaucaguacuggcugg

SEQ ID NO: 810615 - RNA, 22 nt, Human
cagucccaucucccagguggcu

SEQ ID NO: 810616 - RNA, 22 nt, Human
caugcaugccgggcugacagag

SEQ ID NO: 810617 - RNA, 22 nt, Human
uugcaacauuguaaguuuauau

SEQ ID NO: 810618 - RNA, 22 nt, Human
ucccacaugugaauccucaggu

SEQ ID NO: 810619 - RNA, 22 nt, Human
aucugccucuucuucauugcga

SEQ ID NO: 810620 - RNA, 20 nt, Human
aagggagaauaaugauugua

SEQ ID NO: 810621 - RNA, 22 nt, Human
caggagccagaggcggauggag

SEQ ID NO: 810622 - RNA, 22 nt, Human
gcuggcagggacagcugcgugu

SEQ ID NO: 810623 - RNA, 22 nt, Human
augaaauguaugagucuggguu

SEQ ID NO: 810624 - RNA, 22 nt, Human
agcugcucauuacuuucuguug

SEQ ID NO: 810625 - RNA, 22 nt, Human
ggcuucuccagguacugagcau

SEQ ID NO: 810626 - RNA, 22 nt, Human
cuggggggagcugcguccagca

SEQ ID NO: 810627 - RNA, 22 nt, Human
ucacuuuagaggaaacauugag

SEQ ID NO: 810628 - RNA, 22 nt, Human
uggccagugccugccagugcag

SEQ ID NO: 810629 - RNA, 22 nt, Human
ucagaguccaugguacuuaauu

SEQ ID NO: 810630 - RNA, 22 nt, Human
ccuuccagaggcgugacacccu

SEQ ID NO: 810631 - RNA, 19 nt, Human
aggaauggaauuaauucug

SEQ ID NO: 810632 - RNA, 22 nt, Human
uauacaauggcugaaucaucca

SEQ ID NO: 810633 - RNA, 22 nt, Human
agcaaauaauugucuuugaggg

SEQ ID NO: 810634 - RNA, 22 nt, Human
uauugacauuuuuauagcuuga

SEQ ID NO: 810635 - RNA, 22 nt, Human
gcagguggcagaggugggaucu

SEQ ID NO: 810636 - RNA, 22 nt, Human
ggcaguguggccugaguaaguc

SEQ ID NO: 810637 - RNA, 22 nt, Human
aauccacacaucuggcauguga

SEQ ID NO: 810638 - RNA, 20 nt, Human
ucuccuggucugguccgugc

SEQ ID NO: 810639 - RNA, 22 nt, Human
uaccacaguuuaucuauucagc

SEQ ID NO: 810640 - RNA, 22 nt, Human
cauuuccacuucugaaaacugg

SEQ ID NO: 810641 - RNA, 22 nt, Human
gucaaguuuauccgcucauuca

SEQ ID NO: 810642 - RNA, 22 nt, Human
uggcagauguggcauagagcau

SEQ ID NO: 810643 - RNA, 22 nt, Human
ccaggaagcucugcuccacggg

SEQ ID NO: 810644 - RNA, 22 nt, Human
aggcugugaguaguucuuguug

SEQ ID NO: 810645 - RNA, 22 nt, Human
auguacaagcuguuuuacugca

SEQ ID NO: 810646 - RNA, 22 nt, Human
cuggaagguuccucccagcucc

SEQ ID NO: 810647 - RNA, 21 nt, Human
aauuuugaaggaagauuaagg

SEQ ID NO: 810648 - RNA, 22 nt, Human
aaagucauugcuguuaucaaug

SEQ ID NO: 810649 - RNA, 22 nt, Human
acagucuuucuacauucugugc

SEQ ID NO: 810650 - RNA, 22 nt, Human
ucccagccuuccuuguggugaa

SEQ ID NO: 810651 - RNA, 22 nt, Human
ucaagucuggagaucuggaacu

SEQ ID NO: 810652 - RNA, 22 nt, Human
gcagcuguacuggcagcauugu

SEQ ID NO: 810653 - RNA, 22 nt, Human
gggcccugggauucagagcaag

SEQ ID NO: 810654 - RNA, 22 nt, Human
aaagcaggguccaaggagaugu

SEQ ID NO: 810655 - RNA, 22 nt, Human
gucauaaagacagaaacauucc

SEQ ID NO: 810656 - RNA, 23 nt, Human
cuucacaaucaaaaucaguucug

SEQ ID NO: 810657 - RNA, 22 nt, Human
ucuggaguguccaguucuacuc

SEQ ID NO: 810658 - RNA, 22 nt, Human
agagaacaugacguaauagugg

SEQ ID NO: 810659 - RNA, 22 nt, Human
ucacaguacugugacuauugac

SEQ ID NO: 810660 - RNA, 22 nt, Human
ugagugucuggucauggcaggc

SEQ ID NO: 810661 - RNA, 22 nt, Human
accagcagaguugaggaggaca

SEQ ID NO: 810662 - RNA, 22 nt, Human
caggcagagacccucuccuaaa

SEQ ID NO: 810663 - RNA, 19 nt, Human
cgcaggcuucgggucgcuc

SEQ ID NO: 810664 - RNA, 23 nt, Human
auugagaaggauacauuguucuc

SEQ ID NO: 810665 - RNA, 22 nt, Human
cacagagaucggaacagaagua

SEQ ID NO: 810666 - RNA, 22 nt, Human
cucacagguucugcagcucaca

SEQ ID NO: 810667 - RNA, 22 nt, Human
ugacaauggauauuaguugugg

SEQ ID NO: 810668 - RNA, 22 nt, Human
ugacaggaaacaugcagugauu

SEQ ID NO: 810669 - RNA, 19 nt, Human
gcuccuggaugaccugugg

SEQ ID NO: 810670 - RNA, 22 nt, Human
uucuacaauaugaauaaugaag

SEQ ID NO: 810671 - RNA, 22 nt, Human
cuaggcuugcaggguggacaug

SEQ ID NO: 810672 - RNA, 22 nt, Human
gcagcccucuuggucacuaggc

SEQ ID NO: 810673 - RNA, 22 nt, Human
ugguggcagagcaagagcugga

SEQ ID NO: 810674 - RNA, 22 nt, Human
agagcuguuuggacaucugagu

SEQ ID NO: 810675 - RNA, 19 nt, Human
acagugucuguauauaaau

SEQ ID NO: 810676 - RNA, 22 nt, Human
gaaaaccaccucccaucaagca

SEQ ID NO: 810677 - RNA, 22 nt, Human
uuuagguuuuuucacguggcua

SEQ ID NO: 810678 - RNA, 22 nt, Human
gaggagagaagcuaacggugcu

SEQ ID NO: 810679 - RNA, 22 nt, Human
gguggugaagacaaguggaagu

SEQ ID NO: 810680 - RNA, 22 nt, Human
uauugcaucucuucauaucugu

SEQ ID NO: 810681 - RNA, 17 nt, Human
uggggaagcucagauuu

SEQ ID NO: 810682 - RNA, 22 nt, Human
gucuuucuuaaacaacagaaca

SEQ ID NO: 810683 - RNA, 22 nt, Human
agcucuuucuacaagcaggcag

SEQ ID NO: 810684 - RNA, 22 nt, Human
ucugcaggaggcuggcugcagg

SEQ ID NO: 810685 - RNA, 22 nt, Human
agaggccaccuucucuugagaa

SEQ ID NO: 810686 - RNA, 22 nt, Human
uggcccugaaggccuugagcau

SEQ ID NO: 810687 - RNA, 22 nt, Human
agggccagcugaugagaaugag

SEQ ID NO: 810688 - RNA, 22 nt, Human
cuggcaggagcuguggccguag

SEQ ID NO: 810689 - RNA, 22 nt, Human
ggggaggaagcucucaguucca

SEQ ID NO: 810690 - RNA, 22 nt, Human
gucccugggucuaaggcaguaa

SEQ ID NO: 810691 - RNA, 19 nt, Human
agcagcagcaccagggauu

SEQ ID NO: 810692 - RNA, 22 nt, Human
cuacuauaaaauacacaucugu

SEQ ID NO: 810693 - RNA, 22 nt, Human
gcuggcugguccagcaggggcu

SEQ ID NO: 810694 - RNA, 22 nt, Human
cuaaaucaggccuuacagcuuc

SEQ ID NO: 810695 - RNA, 22 nt, Human
gccagcugaggccgugcaggcu

SEQ ID NO: 810696 - RNA, 21 nt, Human
cagcaaaucauugggcagacu

SEQ ID NO: 810697 - RNA, 18 nt, Human
aaugcacacauuuacucc

SEQ ID NO: 810698 - RNA, 22 nt, Human
auuuuagauuuaagaauaaggu

SEQ ID NO: 810699 - RNA, 22 nt, Human
gccagagcagaauagaguggcc

SEQ ID NO: 810700 - RNA, 22 nt, Human
uuuagcuucaguucuagcuucu

SEQ ID NO: 810701 - RNA, 20 nt, Human
ucugucucugagcuagacuu

SEQ ID NO: 810702 - RNA, 22 nt, Human
gcugcuggaacaaaucacccca

SEQ ID NO: 810703 - RNA, 22 nt, Human
ggacauuuagaacagaguauuu

SEQ ID NO: 810704 - RNA, 22 nt, Human
agcagagcggggccuccggaag

SEQ ID NO: 810705 - RNA, 22 nt, Human
ggcccugggacacaacaccgaa

SEQ ID NO: 810706 - RNA, 22 nt, Human
agcugugucauccuggaaaaug

SEQ ID NO: 810707 - RNA, 22 nt, Human
agaggccagcacugcagggaag

SEQ ID NO: 810708 - RNA, 22 nt, Human
ggcuagggaaaaugauuggaua

SEQ ID NO: 810709 - RNA, 22 nt, Human
uuuacugucucagagagacaaa

SEQ ID NO: 810710 - RNA, 22 nt, Human
ucugaagaacugaguaaacaug

SEQ ID NO: 810711 - RNA, 22 nt, Human
gacacagggggauguguggacg

SEQ ID NO: 810712 - RNA, 22 nt, Human
aguuuacacuuuugauucuuau

SEQ ID NO: 810713 - RNA, 22 nt, Human
aggccagcaccagagucaagaa

SEQ ID NO: 810714 - RNA, 22 nt, Human
cucuggauugcugugagaugcu

SEQ ID NO: 810715 - RNA, 22 nt, Human
ugcaggugucuccagggcaggu

SEQ ID NO: 810716 - RNA, 22 nt, Human
agcugcugugugcucaggcagg

SEQ ID NO: 810717 - RNA, 22 nt, Human
ugcaggagggaggguuacaguu

SEQ ID NO: 810718 - RNA, 22 nt, Human
aauauaguguuagcucauuuga

SEQ ID NO: 810719 - RNA, 22 nt, Human
aggagcugggcugcugcuggga

SEQ ID NO: 810720 - RNA, 22 nt, Human
uagcaguauggagcgaggccca

SEQ ID NO: 810721 - RNA, 22 nt, Human
ucaaaguaaaaguauagaguuu

SEQ ID NO: 810722 - RNA, 22 nt, Human
ucuacaaauaaauuacuaugua

SEQ ID NO: 810723 - RNA, 22 nt, Human
ggggaaaggccauggcaagaac

SEQ ID NO: 810724 - RNA, 22 nt, Human
aggugccaauuuucagugaaca

SEQ ID NO: 810725 - RNA, 22 nt, Human
uguccugggaaugggaugcagu

SEQ ID NO: 810726 - RNA, 22 nt, Human
ugacagggacaguggagaugga

SEQ ID NO: 810727 - RNA, 22 nt, Human
agggucuaucucucugccuuug

SEQ ID NO: 810728 - RNA, 22 nt, Human
uuucacauacaguguauaguag

SEQ ID NO: 810729 - RNA, 17 nt, Human
agcaggcacgucagcac

SEQ ID NO: 810730 - RNA, 22 nt, Human
ggagugaguacuggaguagcug

SEQ ID NO: 810731 - RNA, 22 nt, Human
agguggcuaugaggaugcaguc

SEQ ID NO: 810732 - RNA, 22 nt, Human
ucaugcaagcaggcacugggaa

SEQ ID NO: 810733 - RNA, 22 nt, Human
aaagucaucuaggagcagauuu

SEQ ID NO: 810734 - RNA, 22 nt, Human
agaaggcuggccauggugcccu

SEQ ID NO: 810735 - RNA, 22 nt, Human
aucuuuggaucgcucccccuuc

SEQ ID NO: 810736 - RNA, 22 nt, Human
gaacacagucaagggcugcugu

SEQ ID NO: 810737 - RNA, 22 nt, Human
aaucaaaaccuacagagguaau

SEQ ID NO: 810738 - RNA, 22 nt, Human
gcagagccccucaagccagccu

SEQ ID NO: 810739 - RNA, 22 nt, Human
aaaacauguccauacagaaacu

SEQ ID NO: 810740 - RNA, 22 nt, Human
uccucuggggcgugguccugga

SEQ ID NO: 810741 - RNA, 22 nt, Human
caagccauacugggugaaauca

SEQ ID NO: 810742 - RNA, 17 nt, Human
cugagccccgggcagcu

SEQ ID NO: 810743 - RNA, 22 nt, Human
ugccugucuucaggagugucac

SEQ ID NO: 810744 - RNA, 22 nt, Human
auuauuuagaaaucgauugaaa

SEQ ID NO: 810745 - RNA, 22 nt, Human
auaacuuauuagauuggagcug

SEQ ID NO: 810746 - RNA, 22 nt, Human
gcuucagaaguugggcucugac

SEQ ID NO: 810747 - RNA, 22 nt, Human
uggggacaggagacuuacagcu

SEQ ID NO: 810748 - RNA, 22 nt, Human
gagcuuuguuccgugguggcac

SEQ ID NO: 810749 - RNA, 22 nt, Human
aucagaauagugggggacaguc

SEQ ID NO: 810750 - RNA, 22 nt, Human
cauuguaagaggcuuugcagca

SEQ ID NO: 810751 - RNA, 22 nt, Human
ucacacagcuaguaagggccga

SEQ ID NO: 810752 - RNA, 22 nt, Human
gggcucagcuccuuccuuccua

SEQ ID NO: 810753 - RNA, 22 nt, Human
auaaacacuucuagggcacaca

SEQ ID NO: 810754 - RNA, 22 nt, Human
agagccugagccugaucuugaa

SEQ ID NO: 810755 - RNA, 22 nt, Human
ugaguucuccaagagaagguaa

SEQ ID NO: 810756 - RNA, 22 nt, Human
aggacaggauuccuugccuugc

SEQ ID NO: 810757 - RNA, 18 nt, Human
ggggaaaagccagguguc

SEQ ID NO: 810758 - RNA, 22 nt, Human
agaggccacuuugccugugaug

SEQ ID NO: 810759 - RNA, 23 nt, Human
ugcaaauaacaaggaguuuaagg

SEQ ID NO: 810760 - RNA, 17 nt, Human
acacaucuuggcuuugc

SEQ ID NO: 810761 - RNA, 22 nt, Human
gcugcaagucauggcuuuugca

SEQ ID NO: 810762 - RNA, 22 nt, Human
uucuggauagggguauggagcu

SEQ ID NO: 810763 - RNA, 22 nt, Human
acuauauaagauuggcauuuuu

SEQ ID NO: 810764 - RNA, 17 nt, Human
gccucugcuugugucau

SEQ ID NO: 810765 - RNA, 22 nt, Human
aaggagaaggguaaucaacaca

SEQ ID NO: 810766 - RNA, 22 nt, Human
uggguccauggaacagaggugc

SEQ ID NO: 810767 - RNA, 22 nt, Human
ggcagccuccagggcacuggug

SEQ ID NO: 810768 - RNA, 22 nt, Human
auacaguauuaccuguucagga

SEQ ID NO: 810769 - RNA, 22 nt, Human
cuuggggaagccacugaucccu

SEQ ID NO: 810770 - RNA, 21 nt, Human
ugccaggccugagcugggguc

SEQ ID NO: 810771 - RNA, 22 nt, Human
cuaggcagggugcugugccaug

SEQ ID NO: 810772 - RNA, 22 nt, Human
cuggagagggagcuguuggaag

SEQ ID NO: 810773 - RNA, 22 nt, Human
agccacuuuacuuucauauuuu

SEQ ID NO: 810774 - RNA, 22 nt, Human
ugcuggcaucuuaauguucugu

SEQ ID NO: 810775 - RNA, 22 nt, Human
agaggcucuuugagcugggaga

SEQ ID NO: 810776 - RNA, 22 nt, Human
acugugcugcucuccgcagccc

SEQ ID NO: 810777 - RNA, 22 nt, Human
gggcacuuaaugggcacagaga

SEQ ID NO: 810778 - RNA, 22 nt, Human
gucucuuagucaauauuuucug

SEQ ID NO: 810779 - RNA, 22 nt, Human
aaagccaggggagggauuccca

SEQ ID NO: 810780 - RNA, 22 nt, Human
aaugucauuuuuaaaugugaga

SEQ ID NO: 810781 - RNA, 22 nt, Human
ccaggaagccugugucucugga

SEQ ID NO: 810782 - RNA, 22 nt, Human
uggcuggcaaggcuggagucag

SEQ ID NO: 810783 - RNA, 22 nt, Human
agaugguggacuaucugacuug

SEQ ID NO: 810784 - RNA, 22 nt, Human
cuuuccaguuucuaaguacagu

SEQ ID NO: 810785 - RNA, 22 nt, Human
uggagcugagagccaggcuggc

SEQ ID NO: 810786 - RNA, 22 nt, Human
cacagggcagagaccugggugc

SEQ ID NO: 810787 - RNA, 22 nt, Human
ucuguuuaggcaaaauagcuac

SEQ ID NO: 810788 - RNA, 22 nt, Human
gugcugagcaucaugaggcacu

SEQ ID NO: 810789 - RNA, 22 nt, Human
uacaaagugcuuuagaaaugaa

SEQ ID NO: 810790 - RNA, 22 nt, Human
cacuggcaucuaguggguugag

SEQ ID NO: 810791 - RNA, 22 nt, Human
uagaaacaugagagaaacucuu

SEQ ID NO: 810792 - RNA, 20 nt, Human
cucugcuuuaggagagucag

SEQ ID NO: 810793 - RNA, 22 nt, Human
gagcccaggaugguguauggcu

SEQ ID NO: 810794 - RNA, 22 nt, Human
ugggaccagauaaagggagguc

SEQ ID NO: 810795 - RNA, 22 nt, Human
aaacauguaaguucagaucacc

SEQ ID NO: 810796 - RNA, 22 nt, Human
uaaaauguguuucuguaugguu

SEQ ID NO: 810797 - RNA, 22 nt, Human
agagcaggggcaauguguugca

SEQ ID NO: 810798 - RNA, 19 nt, Human
aauacaguguuauagaauu

SEQ ID NO: 810799 - RNA, 22 nt, Human
guuuauuagaguuuucugucug

SEQ ID NO: 810800 - RNA, 22 nt, Human
uuacauucccagugugcagcau

SEQ ID NO: 810801 - RNA, 22 nt, Human
agcugagcauuugauccaccuc

SEQ ID NO: 810802 - RNA, 22 nt, Human
caagaaauguuuacugagcauc

SEQ ID NO: 810803 - RNA, 22 nt, Human
acaggcugcugggcuccgugcu

SEQ ID NO: 810804 - RNA, 22 nt, Human
cuggggcugcggacgggagccc

SEQ ID NO: 810805 - RNA, 18 nt, Human
uaacauguuuucauuaag

SEQ ID NO: 810806 - RNA, 22 nt, Human
gcugugcuugcaugagugucug

SEQ ID NO: 810807 - RNA, 22 nt, Human
ccaggccuucugaggacacucu

SEQ ID NO: 810808 - RNA, 22 nt, Human
cuacauuuguucaaauaagcug

SEQ ID NO: 810809 - RNA, 21 nt, Human
ugcccaggggccaaccgcugc

SEQ ID NO: 810810 - RNA, 22 nt, Human
uucaacaaaauauauuuuucca

SEQ ID NO: 810811 - RNA, 22 nt, Human
uucacagauuucccugcacaug

SEQ ID NO: 810812 - RNA, 21 nt, Human
ucuuguauuggaucugugugu

SEQ ID NO: 810813 - RNA, 22 nt, Human
ugcacagagcaggcaccagcgg

SEQ ID NO: 810814 - RNA, 22 nt, Human
ugaacuugaauuuuggaaauac

SEQ ID NO: 810815 - RNA, 22 nt, Human
cauuguaagcuguugaauccuc

SEQ ID NO: 810816 - RNA, 22 nt, Human
ggcacuguuuuuguauucaguu

SEQ ID NO: 810817 - RNA, 21 nt, Human
uauuaauaugucuaagcugau

SEQ ID NO: 810818 - RNA, 22 nt, Human
agagggagcuuuauuuuucugu

SEQ ID NO: 810819 - RNA, 22 nt, Human
auagaaauguauuuuggacuag

SEQ ID NO: 810820 - RNA, 22 nt, Human
aagccagugugacaggaaacuu

SEQ ID NO: 810821 - RNA, 22 nt, Human
gaguggagaucgugccacugca

SEQ ID NO: 810822 - RNA, 22 nt, Human
acuggcugauauggcuaggaag

SEQ ID NO: 810823 - RNA, 22 nt, Human
cuggcaggcucucuggucgguu

SEQ ID NO: 810824 - RNA, 22 nt, Human
caggaaauaaaugguaaugcau

SEQ ID NO: 810825 - RNA, 22 nt, Human
uagauaaauuagaaaguuuacu

SEQ ID NO: 810826 - RNA, 22 nt, Human
cccagagaagugaagugacuug

SEQ ID NO: 810827 - RNA, 22 nt, Human
auucuacaaaagaacuggaucu

SEQ ID NO: 810828 - RNA, 22 nt, Human
cuuggcccggagccccaugaag

SEQ ID NO: 810829 - RNA, 22 nt, Human
aaguaacaucugaacaugaugu

SEQ ID NO: 810830 - RNA, 22 nt, Human
augcagauguuccuacuguguu

SEQ ID NO: 810831 - RNA, 22 nt, Human
gaagaaauugaauucaugagcu

SEQ ID NO: 810832 - RNA, 22 nt, Human
aggucuggaggcggagucagga

SEQ ID NO: 810833 - RNA, 22 nt, Human
uccaaaggaagaggcugucagu

SEQ ID NO: 810834 - RNA, 22 nt, Human
uucauugagugguuuauucuaa

SEQ ID NO: 810835 - RNA, 22 nt, Human
agccaauaaauuuacaacuaga

SEQ ID NO: 810836 - RNA, 22 nt, Human
uauucacauucucaggccuggu

SEQ ID NO: 810837 - RNA, 22 nt, Human
auuacaguaacagcuacaaugc

SEQ ID NO: 810838 - RNA, 22 nt, Human
ggcaggacaggggaauguuugg

SEQ ID NO: 810839 - RNA, 22 nt, Human
ccagggcuuugccaaaguccag

SEQ ID NO: 810840 - RNA, 22 nt, Human
uuugggcauauagcuguucccu

SEQ ID NO: 810841 - RNA, 22 nt, Human
ccaggcucaccuggagccccug

SEQ ID NO: 810842 - RNA, 22 nt, Human
cccugccucugaagcugcucag

SEQ ID NO: 810843 - RNA, 18 nt, Human
gcuccuggaccaggucac

SEQ ID NO: 810844 - RNA, 22 nt, Human
aaagcagucuguuuuaaccuga

SEQ ID NO: 810845 - RNA, 20 nt, Human
ugaguggccacugggucgca

SEQ ID NO: 810846 - RNA, 22 nt, Human
ccccagccagcuuguaguagaa

SEQ ID NO: 810847 - RNA, 20 nt, Human
ucaccuaaaccagcaguuuc

SEQ ID NO: 810848 - RNA, 22 nt, Human
ugcaaacuauugguagagaugg

SEQ ID NO: 810849 - RNA, 22 nt, Human
agcccagaggguagcagaagaa

SEQ ID NO: 810850 - RNA, 22 nt, Human
ggggaaggauaugauuagacua

SEQ ID NO: 810851 - RNA, 22 nt, Human
cagaaagguaugugugccuuug

SEQ ID NO: 810852 - RNA, 22 nt, Human
uucauacauguguacuguucca

SEQ ID NO: 810853 - RNA, 22 nt, Human
cuuauucaaugcuggaaauguu

SEQ ID NO: 810854 - RNA, 22 nt, Human
agugccagcuccacacagcagc

SEQ ID NO: 810855 - RNA, 22 nt, Human
uaggaagaugaguaucaacuug

SEQ ID NO: 810856 - RNA, 22 nt, Human
acugcacaccuccagggcacua

SEQ ID NO: 810857 - RNA, 22 nt, Human
aaacaacucggcaacugcuuuu

SEQ ID NO: 810858 - RNA, 22 nt, Human
aagggggcggcagccaguggaa

SEQ ID NO: 810859 - RNA, 22 nt, Human
cacagagaauucccauauguga

SEQ ID NO: 810860 - RNA, 22 nt, Human
ccccaggcagggccuaacagag

SEQ ID NO: 810861 - RNA, 22 nt, Human
gcagcagguccgcaucaucauc

SEQ ID NO: 810862 - RNA, 16 nt, Human
cucuuuggcuuccaag

SEQ ID NO: 810863 - RNA, 22 nt, Human
gagccacuguugggcacuuucc

SEQ ID NO: 810864 - RNA, 22 nt, Human
agauuucugucaccuucuaugc

SEQ ID NO: 810865 - RNA, 22 nt, Human
ucuucaggagcugaaagccugc

SEQ ID NO: 810866 - RNA, 22 nt, Human
uugcaaaugugaguuuagacug

SEQ ID NO: 810867 - RNA, 22 nt, Human
uuucaggaucaaaugaaaucgu

SEQ ID NO: 810868 - RNA, 22 nt, Human
gagagaagaauguuccgaggcc

SEQ ID NO: 810869 - RNA, 20 nt, Human
uggcccuguuuucuccaggc

SEQ ID NO: 810870 - RNA, 22 nt, Human
cuucccaagacuguauugcaag

SEQ ID NO: 810871 - RNA, 22 nt, Human
gccccuggcuggccagcuccuc

SEQ ID NO: 810872 - RNA, 22 nt, Human
gaggagcacaugaggcugaggg

SEQ ID NO: 810873 - RNA, 22 nt, Human
aauaacuuguaugguuauucca

SEQ ID NO: 810874 - RNA, 22 nt, Human
gcuuuuguggcugucuucauug

SEQ ID NO: 810875 - RNA, 22 nt, Human
aguuucauuucuuaguaccagu

SEQ ID NO: 810876 - RNA, 22 nt, Human
cuaguucuagaucccugaggaa

SEQ ID NO: 810877 - RNA, 22 nt, Human
ccuggccauuugaacuucagac

SEQ ID NO: 810878 - RNA, 22 nt, Human
ccugauggagcccugcugcaug

SEQ ID NO: 810879 - RNA, 23 nt, Human
cccagcagagaugaggagggguc

SEQ ID NO: 810880 - RNA, 22 nt, Human
uauuaauucuugccaauucucc

SEQ ID NO: 810881 - RNA, 16 nt, Human
uggggauggggaagag

SEQ ID NO: 810882 - RNA, 21 nt, Human
ccagcccagcugugucccagc

SEQ ID NO: 810883 - RNA, 22 nt, Human
guggccagucccgaugcuuguu

SEQ ID NO: 810884 - RNA, 22 nt, Human
gcugagagaucaaggcaggauu

SEQ ID NO: 810885 - RNA, 22 nt, Human
auaugaaaguaagcaugugugu

SEQ ID NO: 810886 - RNA, 23 nt, Human
cagaggugucagugcccaguguc

SEQ ID NO: 810887 - RNA, 20 nt, Human
uuugauuucacaaggccagu

SEQ ID NO: 810888 - RNA, 22 nt, Human
ccugagucuguguuuuccuaag

SEQ ID NO: 810889 - RNA, 22 nt, Human
uuggcaggaggcuucaguuccu

SEQ ID NO: 810890 - RNA, 22 nt, Human
gagcaggcauucuaguggcuga

SEQ ID NO: 810891 - RNA, 22 nt, Human
cccacccugggcuacacaucca

SEQ ID NO: 810892 - RNA, 22 nt, Human
gugcgcacccucccggcauccc

SEQ ID NO: 810893 - RNA, 22 nt, Human
caccaggcugcccaggacaggg

SEQ ID NO: 810894 - RNA, 23 nt, Human
ucacauaucaagaaagugguaga

SEQ ID NO: 810895 - RNA, 19 nt, Human
agccagggugagaaggagc

SEQ ID NO: 810896 - RNA, 22 nt, Human
caggacagacagaaugccuaac

SEQ ID NO: 810897 - RNA, 22 nt, Human
ucaggguugugaaggaaagggg

SEQ ID NO: 810898 - RNA, 22 nt, Human
gcagcaggugugcuuuuaauga

SEQ ID NO: 810899 - RNA, 22 nt, Human
aaggggcaugcuuuugccagga

SEQ ID NO: 810900 - RNA, 23 nt, Human
uaggacagaaugcagaaaaauac

SEQ ID NO: 810901 - RNA, 22 nt, Human
cauuucuguucucuuccuguac

SEQ ID NO: 810902 - RNA, 22 nt, Human
uguaguagcauucacgaagugu

SEQ ID NO: 810903 - RNA, 22 nt, Human
uuuccucugacugcuccccugc

SEQ ID NO: 810904 - RNA, 22 nt, Human
gcuaggaggcccugcacgcuua

SEQ ID NO: 810905 - RNA, 22 nt, Human
aguguccuuguuauuacugcuc

SEQ ID NO: 810906 - RNA, 22 nt, Human
cuuugaaaacuuaaauaacagc

SEQ ID NO: 810907 - RNA, 22 nt, Human
ugccaaaugccaccacagcugc

SEQ ID NO: 810908 - RNA, 22 nt, Human
gcacagggcaacaggucuguua

SEQ ID NO: 810909 - RNA, 22 nt, Human
aaggcccacagaacugucucca

SEQ ID NO: 810910 - RNA, 22 nt, Human
auuucuugccccugcucccuga

SEQ ID NO: 810911 - RNA, 22 nt, Human
ucacauuuauuucaaaguuacu

SEQ ID NO: 810912 - RNA, 22 nt, Human
uguggcaguauaagagcuagaa

SEQ ID NO: 810913 - RNA, 22 nt, Human
ggcagggcuugucucugugaug

SEQ ID NO: 810914 - RNA, 22 nt, Human
ccugagugcuuccagagucaug

SEQ ID NO: 810915 - RNA, 22 nt, Human
ccuccagccuuccugaagagcc

SEQ ID NO: 810916 - RNA, 22 nt, Human
acuuccuguauuuauccauagc

SEQ ID NO: 810917 - RNA, 22 nt, Human
auguuaugucugggaaggggua

SEQ ID NO: 810918 - RNA, 22 nt, Human
uauggcaauauguaucaagauc

SEQ ID NO: 810919 - RNA, 21 nt, Human
agaaaaaccagcauguuuuca

SEQ ID NO: 810920 - RNA, 22 nt, Human
guugagaguuaagcgggcuaau

SEQ ID NO: 810921 - RNA, 22 nt, Human
gguggugggagagcuuucugga

SEQ ID NO: 810922 - RNA, 22 nt, Human
uuagaguuuuaucauugccuua

SEQ ID NO: 810923 - RNA, 22 nt, Human
acaggcaguugagguuugugug

SEQ ID NO: 810924 - RNA, 22 nt, Human
agugaaauugcuguaagaggaa

SEQ ID NO: 810925 - RNA, 20 nt, Human
ggcuggaaguguggguuugg

SEQ ID NO: 810926 - RNA, 22 nt, Human
ccaggggcugcagauccauggu

SEQ ID NO: 810927 - RNA, 22 nt, Human
ggaggccuagaaaagugguucu

SEQ ID NO: 810928 - RNA, 22 nt, Human
cccugguguccacuggaggaag

SEQ ID NO: 810929 - RNA, 20 nt, Human
ggcaggcuuuauauggaggg

SEQ ID NO: 810930 - RNA, 21 nt, Human
uuacaggucauccaagucacc

SEQ ID NO: 810931 - RNA, 22 nt, Human
cagcuuggcuuccgcuuuacug

SEQ ID NO: 810932 - RNA, 23 nt, Human
ccugcagcugccacgcccugcuc

SEQ ID NO: 810933 - RNA, 22 nt, Human
aagugcauaguaauggagucaa

SEQ ID NO: 810934 - RNA, 20 nt, Human
ucacuguaacauuugggggg

SEQ ID NO: 810935 - RNA, 22 nt, Human
ccagcuggaagagugcagaacu

SEQ ID NO: 810936 - RNA, 22 nt, Human
gcugcucucagagcucaugcug

SEQ ID NO: 810937 - RNA, 22 nt, Human
uguaagauuugcuauguguugu

SEQ ID NO: 810938 - RNA, 22 nt, Human
aucaguguuugcaugggagcuu

SEQ ID NO: 810939 - RNA, 22 nt, Human
accaggcagagcugggccuuaa

SEQ ID NO: 810940 - RNA, 22 nt, Human
ugccagcuccugcagcuccugu

SEQ ID NO: 810941 - RNA, 22 nt, Human
augacugcucugggcucccaug

SEQ ID NO: 810942 - RNA, 22 nt, Human
ucuuauuauuguuguaaaagca

SEQ ID NO: 810943 - RNA, 22 nt, Human
uaauaauagcaguagcugccac

SEQ ID NO: 810944 - RNA, 22 nt, Human
cucccugguguccccuccagga

SEQ ID NO: 810945 - RNA, 22 nt, Human
uuguuuucagggugucauucac

SEQ ID NO: 810946 - RNA, 22 nt, Human
aacugaaacggugaucuuuuaa

SEQ ID NO: 810947 - RNA, 19 nt, Human
gcaggcuugggucucccca

SEQ ID NO: 810948 - RNA, 22 nt, Human
cccaggaggcagagguuggagc

SEQ ID NO: 810949 - RNA, 22 nt, Human
agaauacaguaugcaaaaagau

SEQ ID NO: 810950 - RNA, 22 nt, Human
auguuucugaguguauauacau

SEQ ID NO: 810951 - RNA, 22 nt, Human
acccuugguuuugcagagcugu

SEQ ID NO: 810952 - RNA, 22 nt, Human
ggcacuggagacuguuaugaga

SEQ ID NO: 810953 - RNA, 20 nt, Human
uggacacagcccuguugagu

SEQ ID NO: 810954 - RNA, 20 nt, Human
cagagccaagagcagcaucu

SEQ ID NO: 810955 - RNA, 22 nt, Human
acacuuuuaagacuuuaaugaa

SEQ ID NO: 810956 - RNA, 22 nt, Human
gaggcaaggccgcacgucucag

SEQ ID NO: 810957 - RNA, 22 nt, Human
agcagcaggcuagggaacugcu

SEQ ID NO: 810958 - RNA, 22 nt, Human
gccuuggcugccaagcugcuga

SEQ ID NO: 810959 - RNA, 22 nt, Human
gcaacagcccagguucugugug

SEQ ID NO: 810960 - RNA, 22 nt, Human
uugggguguuggauggagcaag

SEQ ID NO: 810961 - RNA, 22 nt, Human
aggagcuggccacuaggaugca

SEQ ID NO: 810962 - RNA, 22 nt, Human
gcuggcagaauuucuucuugcu

SEQ ID NO: 810963 - RNA, 21 nt, Human
gagugucagcaagagguuugg

SEQ ID NO: 810964 - RNA, 22 nt, Human
acaggugugagaacaugccuug

SEQ ID NO: 810965 - RNA, 22 nt, Human
gaguccugcuuucaauucuuuu

SEQ ID NO: 810966 - RNA, 22 nt, Human
uuuuauguaauccuuacugucg

SEQ ID NO: 810967 - RNA, 22 nt, Human
ucaggggaaaucucucagcgaa

SEQ ID NO: 810968 - RNA, 22 nt, Human
uaagcucuccaggugaucauga

SEQ ID NO: 810969 - RNA, 22 nt, Human
gcuguggcuguacagagaccau

SEQ ID NO: 810970 - RNA, 18 nt, Human
uccagagagggagaagug

SEQ ID NO: 810971 - RNA, 22 nt, Human
caagcauacugugagaguuuua

SEQ ID NO: 810972 - RNA, 22 nt, Human
ucugcacaccgccaggcugacu

SEQ ID NO: 810973 - RNA, 22 nt, Human
gcuggcucccagaggccccagc

SEQ ID NO: 810974 - RNA, 22 nt, Human
uuucuaaguguauugagcuugg

SEQ ID NO: 810975 - RNA, 22 nt, Human
aguuauuacucuuuaacauauu

SEQ ID NO: 810976 - RNA, 22 nt, Human
gaggaaaucuuaggccccaacc

SEQ ID NO: 810977 - RNA, 19 nt, Human
gcuccugggccucacucau

SEQ ID NO: 810978 - RNA, 22 nt, Human
gugcccaguccugccuugacag

SEQ ID NO: 810979 - RNA, 22 nt, Human
ccaggaagcauaauguaguggg

SEQ ID NO: 810980 - RNA, 17 nt, Human
cuuguggccaguuuuua

SEQ ID NO: 810981 - RNA, 22 nt, Human
uuggagaauguuuuccugcagu

SEQ ID NO: 810982 - RNA, 22 nt, Human
ggaaggugcucccuggacagag

SEQ ID NO: 810983 - RNA, 22 nt, Human
aucaucuuaaaucuagaaugug

SEQ ID NO: 810984 - RNA, 22 nt, Human
cagcccaggccgacaguuccuc

SEQ ID NO: 810985 - RNA, 22 nt, Human
ugcagcugguuuagaacuagau

SEQ ID NO: 810986 - RNA, 22 nt, Human
gaguuaauacugaguuuauuaa

SEQ ID NO: 810987 - RNA, 22 nt, Human
agcaccugugugagcuagaugu

SEQ ID NO: 810988 - RNA, 22 nt, Human
acacauuuacauguuuacguau

SEQ ID NO: 810989 - RNA, 22 nt, Human
cauuuuauguuuauggagugcu

SEQ ID NO: 810990 - RNA, 22 nt, Human
gcucaagagagaugcaguucuu

SEQ ID NO: 810991 - RNA, 20 nt, Human
gcuuccuucccagcccccac

SEQ ID NO: 810992 - RNA, 22 nt, Human
cugagaggggaccaggguguuu

SEQ ID NO: 810993 - RNA, 22 nt, Human
uagccggguguugugucaugca

SEQ ID NO: 810994 - RNA, 22 nt, Human
auaaagcaaauaggacuauugc

SEQ ID NO: 810995 - RNA, 22 nt, Human
gauguagacacuuggaggcuua

SEQ ID NO: 810996 - RNA, 22 nt, Human
guccagagguccaggaucaagg

SEQ ID NO: 810997 - RNA, 22 nt, Human
auggcagacgaggcagcagggg

SEQ ID NO: 810998 - RNA, 23 nt, Human
gcaggacaacagagugggaaggc

SEQ ID NO: 810999 - RNA, 20 nt, Human
uaguugccaaaaugcccugc

SEQ ID NO: 811000 - RNA, 21 nt, Human
ccuggacuaaaaccaggccac

SEQ ID NO: 811001 - RNA, 22 nt, Human
uuaaugaccuggaagaagugau

SEQ ID NO: 811002 - RNA, 22 nt, Human
uuguauuuggguaguauagaga

SEQ ID NO: 811003 - RNA, 22 nt, Human
ucaauuauuugauaugaaaggg

SEQ ID NO: 811004 - RNA, 22 nt, Human
accauucugucucuuuacaaau

SEQ ID NO: 811005 - RNA, 22 nt, Human
gcucugcugcuuacuagauggu

SEQ ID NO: 811006 - RNA, 22 nt, Human
uauauuaccugccugaucuaua

SEQ ID NO: 811007 - RNA, 22 nt, Human
ugcagaaacagucauuaaugua

SEQ ID NO: 811008 - RNA, 22 nt, Human
uuuucaguaaugucuacauaau

SEQ ID NO: 811009 - RNA, 22 nt, Human
ucagggaaaagucacacugggu

SEQ ID NO: 811010 - RNA, 22 nt, Human
uucaaagugcuguucaaaguag

SEQ ID NO: 811011 - RNA, 22 nt, Human
aucagaaugcagccagcaguua

SEQ ID NO: 811012 - RNA, 22 nt, Human
gagucagaugaagauaaaaggg

SEQ ID NO: 811013 - RNA, 18 nt, Human
gccagcugcacggcccuc

SEQ ID NO: 811014 - RNA, 17 nt, Human
ucacaguuggucucagu

SEQ ID NO: 811015 - RNA, 22 nt, Human
caggaaauaguucagucaaacu

SEQ ID NO: 811016 - RNA, 22 nt, Human
uggggacacagagguucguugg

SEQ ID NO: 811017 - RNA, 18 nt, Human
ggacccagggccucaccc

SEQ ID NO: 811018 - RNA, 22 nt, Human
cugccauccucaccagagcagc

SEQ ID NO: 811019 - RNA, 22 nt, Human
cacaucaagcauccaugaguuu

SEQ ID NO: 811020 - RNA, 22 nt, Human
acacacaacucauuguguaaua

SEQ ID NO: 811021 - RNA, 22 nt, Human
ucucuuuaaaaauagugaaaua

SEQ ID NO: 811022 - RNA, 22 nt, Human
ggucucuguugccuccaucaag

SEQ ID NO: 811023 - RNA, 22 nt, Human
ucugacuuggcgcucuugucuu

SEQ ID NO: 811024 - RNA, 22 nt, Human
agcuguggucuucaaguugccu

SEQ ID NO: 811025 - RNA, 22 nt, Human
auuaagaucauuguagaagauu

SEQ ID NO: 811026 - RNA, 22 nt, Human
ucuucacaccgggcagcaggaa

SEQ ID NO: 811027 - RNA, 22 nt, Human
ugcuucuuuaaaugauagucaa

SEQ ID NO: 811028 - RNA, 22 nt, Human
gacagcaaagcagagccaaggc

SEQ ID NO: 811029 - RNA, 22 nt, Human
uacaguaacuggaauucuucuu

SEQ ID NO: 811030 - RNA, 21 nt, Human
uagggggcagugggaugcuua

SEQ ID NO: 811031 - RNA, 21 nt, Human
gcaggcuggucaaaccucagu

SEQ ID NO: 811032 - RNA, 22 nt, Human
aaaagccaagguccucuucaga

SEQ ID NO: 811033 - RNA, 22 nt, Human
gugcagagcaagggcugagggc

SEQ ID NO: 811034 - RNA, 22 nt, Human
ggucaagacgggcucugcccuu

SEQ ID NO: 811035 - RNA, 22 nt, Human
gguccagguauguggugugaau

SEQ ID NO: 811036 - RNA, 21 nt, Human
agaaauacagcagggaugauc

SEQ ID NO: 811037 - RNA, 22 nt, Human
ugcaaaugaugaaacuaacuuu

SEQ ID NO: 811038 - RNA, 22 nt, Human
cagcagcaacaauagcggucac

SEQ ID NO: 811039 - RNA, 22 nt, Human
agcuuucugguuacagucuuca

SEQ ID NO: 811040 - RNA, 22 nt, Human
guccucugcccaggucaagguu

SEQ ID NO: 811041 - RNA, 22 nt, Human
cauuucugugacacuuccaucu

SEQ ID NO: 811042 - RNA, 23 nt, Human
cgcccagccucagugaccugggc

SEQ ID NO: 811043 - RNA, 22 nt, Human
gcagugucagugccuggguggu

SEQ ID NO: 811044 - RNA, 22 nt, Human
ccagccugaaaugccucauccu

SEQ ID NO: 811045 - RNA, 22 nt, Human
uuucucuucacugugugccuca

SEQ ID NO: 811046 - RNA, 22 nt, Human
uucaaauuaccacauuugcuua

SEQ ID NO: 811047 - RNA, 22 nt, Human
auauuuuggggugaugugcauc

SEQ ID NO: 811048 - RNA, 18 nt, Human
ucacagugcucuugccua

SEQ ID NO: 811049 - RNA, 22 nt, Human
ccaaggagaaugacaccaugga

SEQ ID NO: 811050 - RNA, 23 nt, Human
ucacagggcacuggcugggguug

SEQ ID NO: 811051 - RNA, 22 nt, Human
uuucuagaaauagagauagagu

SEQ ID NO: 811052 - RNA, 20 nt, Human
cacaggccccaagaccugua

SEQ ID NO: 811053 - RNA, 20 nt, Human
gcuggcugaacugaaagcaa

SEQ ID NO: 811054 - RNA, 22 nt, Human
auauucaucguguagaaauacu

SEQ ID NO: 811055 - RNA, 22 nt, Human
aguuauaaucugcuacugauau

SEQ ID NO: 811056 - RNA, 22 nt, Human
ccagggaggguccuguggcuuc

SEQ ID NO: 811057 - RNA, 22 nt, Human
uaucugauacaacagaauaaca

SEQ ID NO: 811058 - RNA, 22 nt, Human
uaugagaucccuuuuccuagag

SEQ ID NO: 811059 - RNA, 22 nt, Human
aaacaugaauagauauuaaaca

SEQ ID NO: 811060 - RNA, 22 nt, Human
uuccugggcaggacgagagucu

SEQ ID NO: 811061 - RNA, 22 nt, Human
cagaagcacauguuuacaugua

SEQ ID NO: 811062 - RNA, 22 nt, Human
uuugcauucuagaaaaauuucu

SEQ ID NO: 811063 - RNA, 23 nt, Human
cucugcaccaggugguuuucagc

SEQ ID NO: 811064 - RNA, 22 nt, Human
acuggcugcguuccugugagac

SEQ ID NO: 811065 - RNA, 18 nt, Human
cuguucuagaacuccugu

SEQ ID NO: 811066 - RNA, 22 nt, Human
aaacugaaguagauucugaaau

SEQ ID NO: 811067 - RNA, 22 nt, Human
caguaaaagauggaaauagaau

SEQ ID NO: 811068 - RNA, 22 nt, Human
cuucacuguuugguucacagca

SEQ ID NO: 811069 - RNA, 22 nt, Human
agcagggcucuguggagggugg

SEQ ID NO: 811070 - RNA, 22 nt, Human
uccucugcuccaucuuuacugu

SEQ ID NO: 811071 - RNA, 22 nt, Human
agcagauguucccuggucccuu

SEQ ID NO: 811072 - RNA, 22 nt, Human
gcccuccaccagagcccuucuc

SEQ ID NO: 811073 - RNA, 22 nt, Human
uuuauauaacagagacugcuau

SEQ ID NO: 811074 - RNA, 22 nt, Human
gccuccuggauuuuagugccau

SEQ ID NO: 811075 - RNA, 22 nt, Human
uggcagcacggcauccacucuc

SEQ ID NO: 811076 - RNA, 22 nt, Human
cccgacuagcugggauuacagg

SEQ ID NO: 811077 - RNA, 22 nt, Human
gagagaaaaaugagcuucauug

SEQ ID NO: 811078 - RNA, 22 nt, Human
cuuggagugaaugggggcaggu

SEQ ID NO: 811079 - RNA, 18 nt, Human
guggccagccuggucuug

SEQ ID NO: 811080 - RNA, 22 nt, Human
caauuucaaugaggccacaggg

SEQ ID NO: 811081 - RNA, 22 nt, Human
ggagcugugggacgcuguccca

SEQ ID NO: 811082 - RNA, 22 nt, Human
agaagcacaccugaccucuagc

SEQ ID NO: 811083 - RNA, 19 nt, Human
ugaguucugugguucucaa

SEQ ID NO: 811084 - RNA, 20 nt, Human
ccacaguggagacuggagac

SEQ ID NO: 811085 - RNA, 22 nt, Human
cuuuauuccuacaagauuuucu

SEQ ID NO: 811086 - RNA, 22 nt, Human
ccucucaguauugaacuuuaua

SEQ ID NO: 811087 - RNA, 22 nt, Human
ccaggacuuuaaguccagcacu

SEQ ID NO: 811088 - RNA, 22 nt, Human
ggcaggaaaacaaugagccagg

SEQ ID NO: 811089 - RNA, 22 nt, Human
uaguccacagacucuacagcau

SEQ ID NO: 811090 - RNA, 22 nt, Human
aauguacaaaccuucuuuguag

SEQ ID NO: 811091 - RNA, 16 nt, Human
uacauucugaucacug

SEQ ID NO: 811092 - RNA, 22 nt, Human
ucucugaagagucagacauaac

SEQ ID NO: 811093 - RNA, 21 nt, Human
uucccuucugguuuugagaga

SEQ ID NO: 811094 - RNA, 22 nt, Human
guacauuuugagguuaaaacaa

SEQ ID NO: 811095 - RNA, 22 nt, Human
ggaguaggccccgggagagagu

SEQ ID NO: 811096 - RNA, 22 nt, Human
cccuggagugccggaaucaaga

SEQ ID NO: 811097 - RNA, 22 nt, Human
aaguuuguuuuagucuaaugau

SEQ ID NO: 811098 - RNA, 22 nt, Human
agagcagccugugaugaugcac

SEQ ID NO: 811099 - RNA, 22 nt, Human
ugggggagaguuuagaugauuu

SEQ ID NO: 811100 - RNA, 22 nt, Human
uccugcugaccaguaaaugaau

SEQ ID NO: 811101 - RNA, 22 nt, Human
ugcauucaguuggucagcuuuu

SEQ ID NO: 811102 - RNA, 22 nt, Human
accagagaggcugcagugugug

SEQ ID NO: 811103 - RNA, 22 nt, Human
uaaggcagcugagcuucuaaca

SEQ ID NO: 811104 - RNA, 22 nt, Human
ggccucugcuuaugcugaugac

SEQ ID NO: 811105 - RNA, 22 nt, Human
caaggcagcuauugucuccaua

SEQ ID NO: 811106 - RNA, 22 nt, Human
uaccugagcccagugcagcaua

SEQ ID NO: 811107 - RNA, 22 nt, Human
agaaguuuugggaaauacugau

SEQ ID NO: 811108 - RNA, 22 nt, Human
cagaggaagcuggguguggagu

SEQ ID NO: 811109 - RNA, 22 nt, Human
ggccaggaacuuuugggauggg

SEQ ID NO: 811110 - RNA, 23 nt, Human
uuucuguuccucuagcuuugcau

SEQ ID NO: 811111 - RNA, 22 nt, Human
gcucagaggguuuuggccaagu

SEQ ID NO: 811112 - RNA, 22 nt, Human
augagaaauuuauuacaagcua

SEQ ID NO: 811113 - RNA, 23 nt, Human
acaugauacacaauuagcaaacc

SEQ ID NO: 811114 - RNA, 22 nt, Human
aggcacagauuuggggaaagca

SEQ ID NO: 811115 - RNA, 22 nt, Human
acauagcuuaaaugagaagaua

SEQ ID NO: 811116 - RNA, 22 nt, Human
ggcugccuccugcugggcugga

SEQ ID NO: 811117 - RNA, 22 nt, Human
cuggcugggguaccaguugaac

SEQ ID NO: 811118 - RNA, 22 nt, Human
uaaaugucaaugugauuuauaa

SEQ ID NO: 811119 - RNA, 22 nt, Human
ccugggugguuccggcaaggag

SEQ ID NO: 811120 - RNA, 22 nt, Human
gggucuggagauccgggugaag

SEQ ID NO: 811121 - RNA, 19 nt, Human
aggcagcauucuggggcuu

SEQ ID NO: 811122 - RNA, 23 nt, Human
accuuggacuucccagcuuccag

SEQ ID NO: 811123 - RNA, 21 nt, Human
uuauaggcugggguuugcuuu

SEQ ID NO: 811124 - RNA, 22 nt, Human
ggggacugaggcacugaaggug

SEQ ID NO: 811125 - RNA, 23 nt, Human
uugauuucaaaugcagagaacac

SEQ ID NO: 811126 - RNA, 22 nt, Human
gcacuguucuaggugcagagcu

SEQ ID NO: 811127 - RNA, 22 nt, Human
ugcagaagacacaagguaacgu

SEQ ID NO: 811128 - RNA, 22 nt, Human
acagaaguuggaauuagauacu

SEQ ID NO: 811129 - RNA, 22 nt, Human
gccugcccacggggcuggcaua

SEQ ID NO: 811130 - RNA, 22 nt, Human
gagccuggauugucaccgacuu

SEQ ID NO: 811131 - RNA, 22 nt, Human
gagcuagggaggaggcuugcuc

SEQ ID NO: 811132 - RNA, 22 nt, Human
uuccagagguucucagcccugu

SEQ ID NO: 811133 - RNA, 22 nt, Human
gugcaggagccagggguaggaa

SEQ ID NO: 811134 - RNA, 22 nt, Human
auucuucaguauguguggauug

SEQ ID NO: 811135 - RNA, 22 nt, Human
uucuaguuaaaguauguauuag

SEQ ID NO: 811136 - RNA, 22 nt, Human
ugagcuggcaggggcucaggga

SEQ ID NO: 811137 - RNA, 22 nt, Human
acagcugcucuauaucucagcc

SEQ ID NO: 811138 - RNA, 22 nt, Human
ugcgcccagccaagucuggcac

SEQ ID NO: 811139 - RNA, 22 nt, Human
gcaggugaugugaugugagcau

SEQ ID NO: 811140 - RNA, 22 nt, Human
uaaggcaguuuugccugagaua

SEQ ID NO: 811141 - RNA, 22 nt, Human
aaaguacacacagagccaagaa

SEQ ID NO: 811142 - RNA, 22 nt, Human
agugucaugaaucaaagauuau

SEQ ID NO: 811143 - RNA, 22 nt, Human
uggauuuaacagaauaccaggu

SEQ ID NO: 811144 - RNA, 22 nt, Human
ggcccagagcucccuggcaccu

SEQ ID NO: 811145 - RNA, 22 nt, Human
ugggcaggggcccugcuuccgu

SEQ ID NO: 811146 - RNA, 22 nt, Human
cucaaaaugguuaauuuuaaua

SEQ ID NO: 811147 - RNA, 19 nt, Human
cugcugggugcugagggag

SEQ ID NO: 811148 - RNA, 22 nt, Human
aaaugccagcacacgucugugg

SEQ ID NO: 811149 - RNA, 22 nt, Human
agcuuuuaguacguuaaaauug

SEQ ID NO: 811150 - RNA, 22 nt, Human
caguccagagcccaccagagga

SEQ ID NO: 811151 - RNA, 21 nt, Human
agaagcuagucacuaaaucca

SEQ ID NO: 811152 - RNA, 22 nt, Human
uuuucugacucuauugagguau

SEQ ID NO: 811153 - RNA, 22 nt, Human
cuuuggauuuuuaucaggcaau

SEQ ID NO: 811154 - RNA, 22 nt, Human
uguauuucugcuuucucuagua

SEQ ID NO: 811155 - RNA, 18 nt, Human
guuucaugcaugugaaac

SEQ ID NO: 811156 - RNA, 16 nt, Human
ggggaaggcaagaggg

SEQ ID NO: 811157 - RNA, 22 nt, Human
ccuggcagucaggggaguccuu

SEQ ID NO: 811158 - RNA, 22 nt, Human
uggcagcugauuagauggugcc

SEQ ID NO: 811159 - RNA, 23 nt, Human
ccacaguucaucguucacucacc

SEQ ID NO: 811160 - RNA, 22 nt, Human
gguucacauauugagaguauuc

SEQ ID NO: 811161 - RNA, 22 nt, Human
uggccagcacuuagcccuuacc

SEQ ID NO: 811162 - RNA, 22 nt, Human
gccugccugcugucaucugccu

SEQ ID NO: 811163 - RNA, 22 nt, Human
ugcagaaauaacucauauugca

SEQ ID NO: 811164 - RNA, 22 nt, Human
ggguggcaggauuggcaggagu

SEQ ID NO: 811165 - RNA, 22 nt, Human
ccaggacucaaugaccacaggg

SEQ ID NO: 811166 - RNA, 22 nt, Human
aggcccaguuauccuacuuguu

SEQ ID NO: 811167 - RNA, 23 nt, Human
aggcagguuugggcucuucuugu

SEQ ID NO: 811168 - RNA, 22 nt, Human
ucugccaggccacacagggcac

SEQ ID NO: 811169 - RNA, 22 nt, Human
cuuguuuucuaaaacaucauuu

SEQ ID NO: 811170 - RNA, 22 nt, Human
agaggccccaugggauggcggu

SEQ ID NO: 811171 - RNA, 22 nt, Human
aauuuauuuccugccaguacac

SEQ ID NO: 811172 - RNA, 22 nt, Human
uucucucccaugaagcuucuau

SEQ ID NO: 811173 - RNA, 22 nt, Human
ccuuccccaggugcucacuguc

SEQ ID NO: 811174 - RNA, 21 nt, Human
uuucugaaggcaacaucuauc

SEQ ID NO: 811175 - RNA, 22 nt, Human
cagcuucugagcaagccagggg

SEQ ID NO: 811176 - RNA, 22 nt, Human
ggugagcaaagcuucaucugua

SEQ ID NO: 811177 - RNA, 18 nt, Human
uuugcuuuccuucuucag

SEQ ID NO: 811178 - RNA, 22 nt, Human
guccagccugaagagugggggc

SEQ ID NO: 811179 - RNA, 22 nt, Human
cucaaauauguggucagaaagc

SEQ ID NO: 811180 - RNA, 23 nt, Human
uggacaggacccccuucggaccc

SEQ ID NO: 811181 - RNA, 22 nt, Human
aacagcagcaugacagcugggu

SEQ ID NO: 811182 - RNA, 22 nt, Human
uggggaaaaugcagaagauuac

SEQ ID NO: 811183 - RNA, 22 nt, Human
aagauacacggucaacucucaa

SEQ ID NO: 811184 - RNA, 22 nt, Human
aauaaaucaauccuauugguag

SEQ ID NO: 811185 - RNA, 22 nt, Human
auucacacuguauacacaggau

SEQ ID NO: 811186 - RNA, 17 nt, Human
cauguauuugaaacaga

SEQ ID NO: 811187 - RNA, 18 nt, Human
gccagagguacuacugau

SEQ ID NO: 811188 - RNA, 22 nt, Human
gaaccauuguugaaaagaauag

SEQ ID NO: 811189 - RNA, 22 nt, Human
cuggcuggacuugugcauguca

SEQ ID NO: 811190 - RNA, 22 nt, Human
ucugggcccuaaaccagcucua

SEQ ID NO: 811191 - RNA, 22 nt, Human
ggccugcuaaccugaaacggag

SEQ ID NO: 811192 - RNA, 22 nt, Human
uuaagagaaggaaugaccuagc

SEQ ID NO: 811193 - RNA, 22 nt, Human
guuucaaguagcugcugauuau

SEQ ID NO: 811194 - RNA, 22 nt, Human
gcccagagggaagaggugucau

SEQ ID NO: 811195 - RNA, 22 nt, Human
gaugaaauuugaaaauaguguu

SEQ ID NO: 811196 - RNA, 22 nt, Human
uuauucauuaacagggaccaaa

SEQ ID NO: 811197 - RNA, 16 nt, Human
gaaggcuuacugcagg

SEQ ID NO: 811198 - RNA, 22 nt, Human
uucuaugugcuggagaauauuu

SEQ ID NO: 811199 - RNA, 21 nt, Human
uccaggacuugagaauuccag

SEQ ID NO: 811200 - RNA, 22 nt, Human
gaggcagagucacaaagagucu

SEQ ID NO: 811201 - RNA, 22 nt, Human
ggccagcugccaccagcccuau

SEQ ID NO: 811202 - RNA, 22 nt, Human
gcugcugccgcggccgcuggga

SEQ ID NO: 811203 - RNA, 22 nt, Human
gcaugcaacucccaguucugcc

SEQ ID NO: 811204 - RNA, 22 nt, Human
gggaugccaguccuggcccugc

SEQ ID NO: 811205 - RNA, 22 nt, Human
ccuggggagccgccugagcccc

SEQ ID NO: 811206 - RNA, 22 nt, Human
gaaaggaaauugagggacgcau

SEQ ID NO: 811207 - RNA, 22 nt, Human
gaagagagagcccugggguccg

SEQ ID NO: 811208 - RNA, 23 nt, Human
gugcgccaggacaaccugacgga

SEQ ID NO: 811209 - RNA, 23 nt, Human
augcaacauugccaguaugggca

SEQ ID NO: 811210 - RNA, 22 nt, Human
cuccuggcuaugacuacauuuc

SEQ ID NO: 811211 - RNA, 22 nt, Human
aggcucugcagugcuggaggac

SEQ ID NO: 811212 - RNA, 22 nt, Human
aaggugaacugguaaugacaga

SEQ ID NO: 811213 - RNA, 22 nt, Human
aguccauacauugagaauaaca

SEQ ID NO: 811214 - RNA, 22 nt, Human
acuucuugggacccuggcaccg

SEQ ID NO: 811215 - RNA, 22 nt, Human
gacaggguacgggcuaggcaca

SEQ ID NO: 811216 - RNA, 22 nt, Human
agcgcaggaacacgucugccuu

SEQ ID NO: 811217 - RNA, 22 nt, Human
gguggccuccagggcauaggug

SEQ ID NO: 811218 - RNA, 22 nt, Human
uauugcuuucucagacguuuag

SEQ ID NO: 811219 - RNA, 22 nt, Human
augcaaauguuuaaguuacuau

SEQ ID NO: 811220 - RNA, 22 nt, Human
caguccugucuuuaugacuuca

SEQ ID NO: 811221 - RNA, 22 nt, Human
ggaguggcagcuaggcugucag

SEQ ID NO: 811222 - RNA, 22 nt, Human
uaaacaauuccucucuaggcau

SEQ ID NO: 811223 - RNA, 18 nt, Human
gucagaggauggggaaau

SEQ ID NO: 811224 - RNA, 22 nt, Human
ugccugggagugaccaagacuc

SEQ ID NO: 811225 - RNA, 22 nt, Human
gagguggucgaggagggguacc

SEQ ID NO: 811226 - RNA, 22 nt, Human
uccuggggaggucgaggcugag

SEQ ID NO: 811227 - RNA, 22 nt, Human
ugcccuggaaaugagaggugug

SEQ ID NO: 811228 - RNA, 22 nt, Human
ucaggagcagggucuguuacca

SEQ ID NO: 811229 - RNA, 20 nt, Human
aggccccaggaaacucucag

SEQ ID NO: 811230 - RNA, 22 nt, Human
ugcagcugauuaaagggcagac

SEQ ID NO: 811231 - RNA, 20 nt, Human
cacaggcuauaugagagcca

SEQ ID NO: 811232 - RNA, 22 nt, Human
cuggcucaugugaugagggcaa

SEQ ID NO: 811233 - RNA, 22 nt, Human
auuuugcuuuauguaaauaugu

SEQ ID NO: 811234 - RNA, 22 nt, Human
ccagcucuagccccauguggcu

SEQ ID NO: 811235 - RNA, 22 nt, Human
gcuggugauugccucaggaggc

SEQ ID NO: 811236 - RNA, 20 nt, Human
cagggcucugggccuggccu

SEQ ID NO: 811237 - RNA, 22 nt, Human
cccagaggugcuucagaggugc

SEQ ID NO: 811238 - RNA, 22 nt, Human
uugaaugauccuaucuagcaca

SEQ ID NO: 811239 - RNA, 22 nt, Human
ggguagggugacuuaggcuggc

SEQ ID NO: 811240 - RNA, 22 nt, Human
uucuaaacacuacgggauuugg

SEQ ID NO: 811241 - RNA, 22 nt, Human
guggcagucggaagucaggaga

SEQ ID NO: 811242 - RNA, 22 nt, Human
auaacaugagccagauugaaag

SEQ ID NO: 811243 - RNA, 22 nt, Human
gacuccagguguccaggccucc

SEQ ID NO: 811244 - RNA, 22 nt, Human
ucuucccauuaguaaugaagug

SEQ ID NO: 811245 - RNA, 22 nt, Human
ggcuggagauaugucuggaaca

SEQ ID NO: 811246 - RNA, 22 nt, Human
uuuaagaaguuauguuauaaau

SEQ ID NO: 811247 - RNA, 22 nt, Human
uuagaucauuuugaacuaauuu

SEQ ID NO: 811248 - RNA, 22 nt, Human
gauaccuuuuguuggaauuucc

SEQ ID NO: 811249 - RNA, 22 nt, Human
gcagugauuggaucagagaugg

SEQ ID NO: 811250 - RNA, 21 nt, Human
aaauccaaacacuaguccaca

SEQ ID NO: 811251 - RNA, 22 nt, Human
uauguauucucagauuuacuaa

SEQ ID NO: 811252 - RNA, 22 nt, Human
agcuuagucacucuuaaauuua

SEQ ID NO: 811253 - RNA, 22 nt, Human
cuucuuucuuuugaucacaggu

SEQ ID NO: 811254 - RNA, 22 nt, Human
agcuuucacugauaugcuuuga

SEQ ID NO: 811255 - RNA, 22 nt, Human
uaaagugcuuaugauaaccaag

SEQ ID NO: 811256 - RNA, 22 nt, Human
uggcccaaagcagcccagcagg

SEQ ID NO: 811257 - RNA, 22 nt, Human
auuuccugaucuguaaaauagc

SEQ ID NO: 811258 - RNA, 22 nt, Human
agcuuugcuucugggagccaag

SEQ ID NO: 811259 - RNA, 22 nt, Human
cuggaagguucuuugugugccu

SEQ ID NO: 811260 - RNA, 22 nt, Human
ucauuuguuacagccacauacc

SEQ ID NO: 811261 - RNA, 22 nt, Human
ugggcagauguggcucuccuug

SEQ ID NO: 811262 - RNA, 22 nt, Human
agcaccagagcuaugggccugc

SEQ ID NO: 811263 - RNA, 18 nt, Human
ugguggugacagggucau

SEQ ID NO: 811264 - RNA, 22 nt, Human
cagggagaucuuggcuccuggu

SEQ ID NO: 811265 - RNA, 22 nt, Human
gaauauuuucaguacagauggu

SEQ ID NO: 811266 - RNA, 22 nt, Human
cuggguggaaagugcugagaau

SEQ ID NO: 811267 - RNA, 20 nt, Human
aggcuuggcuuggcaggaac

SEQ ID NO: 811268 - RNA, 22 nt, Human
aggcacuuaaccuacuaacuga

SEQ ID NO: 811269 - RNA, 22 nt, Human
ugcagagggagugacgguucac

SEQ ID NO: 811270 - RNA, 22 nt, Human
uuucaguguaucuuccaaaagc

SEQ ID NO: 811271 - RNA, 22 nt, Human
aggggcugccuggcuuggcacu

SEQ ID NO: 811272 - RNA, 22 nt, Human
ccauggaacucaguaaauuaua

SEQ ID NO: 811273 - RNA, 22 nt, Human
ggagcggcagauggagugggag

SEQ ID NO: 811274 - RNA, 22 nt, Human
auauuauaaguuauuucaaguu

SEQ ID NO: 811275 - RNA, 22 nt, Human
gggcagugaauauuggugggaa

SEQ ID NO: 811276 - RNA, 22 nt, Human
gaccacagauuccuaaguggca

SEQ ID NO: 811277 - RNA, 22 nt, Human
gggccugcuccccaucgcugcu

SEQ ID NO: 811278 - RNA, 22 nt, Human
acaggcagggaccucuugaguu

SEQ ID NO: 811279 - RNA, 17 nt, Human
uucuccucuguguccuu

SEQ ID NO: 811280 - RNA, 22 nt, Human
aaauuccagaaacucaguauau

SEQ ID NO: 811281 - RNA, 22 nt, Human
gggauccauccgugcagcagag

SEQ ID NO: 811282 - RNA, 22 nt, Human
aauuuuaucucuaagcaggcuu

SEQ ID NO: 811283 - RNA, 22 nt, Human
gccugcugaagccagagugugu

SEQ ID NO: 811284 - RNA, 22 nt, Human
augcagcugucagggagaacau

SEQ ID NO: 811285 - RNA, 22 nt, Human
guuucucaguuuggucugcaga

SEQ ID NO: 811286 - RNA, 22 nt, Human
agcuuugcaaccugaggccagu

SEQ ID NO: 811287 - RNA, 22 nt, Human
ugaaugauuugggugcauucag

SEQ ID NO: 811288 - RNA, 22 nt, Human
aagcagaacugggaaguagugg

SEQ ID NO: 811289 - RNA, 22 nt, Human
guucugggucuggacacacaga

SEQ ID NO: 811290 - RNA, 22 nt, Human
uuagcuuuuaagugugcuacau

SEQ ID NO: 811291 - RNA, 22 nt, Human
cuaagcaagaaugagugcaaca

SEQ ID NO: 811292 - RNA, 22 nt, Human
gaggaggcuaagugggcucugg

SEQ ID NO: 811293 - RNA, 22 nt, Human
aauaaaggcaccauaaggcaaa

SEQ ID NO: 811294 - RNA, 22 nt, Human
uggggacccggacuccuggguc

SEQ ID NO: 811295 - RNA, 22 nt, Human
cugcuguguuggcauuggauag

SEQ ID NO: 811296 - RNA, 22 nt, Human
ugcaauaacccaguaucuguga

SEQ ID NO: 811297 - RNA, 22 nt, Human
cucagggccaaggaugcuguug

SEQ ID NO: 811298 - RNA, 22 nt, Human
acaaauuuggugagaguaaaua

SEQ ID NO: 811299 - RNA, 22 nt, Human
cugagagaguaaaguagaauua

SEQ ID NO: 811300 - RNA, 22 nt, Human
ccauggccgccgcugcucagga

SEQ ID NO: 811301 - RNA, 22 nt, Human
gaaauucaaaaugucaguauag

SEQ ID NO: 811302 - RNA, 22 nt, Human
ccagcugugcuguuggcuuguc

SEQ ID NO: 811303 - RNA, 19 nt, Human
uuugauagggcauaauaua

SEQ ID NO: 811304 - RNA, 22 nt, Human
ugcuucaaggacacugacuuuu

SEQ ID NO: 811305 - RNA, 22 nt, Human
aauuuaucuuuaguaagcuucu

SEQ ID NO: 811306 - RNA, 22 nt, Human
cugggagugaaaggagggcugc

SEQ ID NO: 811307 - RNA, 22 nt, Human
gcagaaggauccgcaggugcaa

SEQ ID NO: 811308 - RNA, 22 nt, Human
aaaguguggcacaagucacauc

SEQ ID NO: 811309 - RNA, 22 nt, Human
acccaggcuggagugcaguggu

SEQ ID NO: 811310 - RNA, 22 nt, Human
uccagcagaaaagagguaggga

SEQ ID NO: 811311 - RNA, 23 nt, Human
ggucccaguggagaggccucacc

SEQ ID NO: 811312 - RNA, 22 nt, Human
ucaguguucuuauuuaauuagg

SEQ ID NO: 811313 - RNA, 18 nt, Human
gcugcugguggagggagc

SEQ ID NO: 811314 - RNA, 22 nt, Human
gagcagugagugaauguugccu

SEQ ID NO: 811315 - RNA, 23 nt, Human
aaacuacaacgccaggcacugag

SEQ ID NO: 811316 - RNA, 22 nt, Human
ugggccagaaguaugcauguuu

SEQ ID NO: 811317 - RNA, 22 nt, Human
auauacuuccccauuauggggg

SEQ ID NO: 811318 - RNA, 22 nt, Human
cagcccugaguuagcccacgga

SEQ ID NO: 811319 - RNA, 22 nt, Human
uaagaaacaugauuaauggcag

SEQ ID NO: 811320 - RNA, 23 nt, Human
agcuaaggaagcugaggcacagu

SEQ ID NO: 811321 - RNA, 22 nt, Human
uggcagaauuuuaaagacagau

SEQ ID NO: 811322 - RNA, 22 nt, Human
ccugugggagggagcggcugga

SEQ ID NO: 811323 - RNA, 22 nt, Human
ggugcaugugagaaagacuggg

SEQ ID NO: 811324 - RNA, 22 nt, Human
uagcuuuggauucuuuggggaa

SEQ ID NO: 811325 - RNA, 17 nt, Human
ggaccagggguugccau

SEQ ID NO: 811326 - RNA, 22 nt, Human
ugagccugcaauaagcacagcc

SEQ ID NO: 811327 - RNA, 22 nt, Human
acacuuaacuucugagaauaaa

SEQ ID NO: 811328 - RNA, 22 nt, Human
caggcagaggaagucugggucu

SEQ ID NO: 811329 - RNA, 22 nt, Human
uauccauaguuuauagaucaag

SEQ ID NO: 811330 - RNA, 22 nt, Human
caggacaguuugcuuugcccug

SEQ ID NO: 811331 - RNA, 22 nt, Human
uggcaggaaaaagggccagagg

SEQ ID NO: 811332 - RNA, 22 nt, Human
uagcuuaaggaguaccagauca

SEQ ID NO: 811333 - RNA, 22 nt, Human
cccagcagccagaaugaggagc

SEQ ID NO: 811334 - RNA, 22 nt, Human
acccaggguagaaccucagagc

SEQ ID NO: 811335 - RNA, 22 nt, Human
acuaaaaacuacugccaauagc

SEQ ID NO: 811336 - RNA, 22 nt, Human
cuggcugucuuggaggaaggag

SEQ ID NO: 811337 - RNA, 16 nt, Human
uugaaugacugugugc

SEQ ID NO: 811338 - RNA, 20 nt, Human
cuuuggagaaagcuaacaga

SEQ ID NO: 811339 - RNA, 22 nt, Human
aauauccuuuccagaguacagu

SEQ ID NO: 811340 - RNA, 22 nt, Human
uucaaagauaauuaccaaacau

SEQ ID NO: 811341 - RNA, 22 nt, Human
gagcucagagccuauaguuggu

SEQ ID NO: 811342 - RNA, 22 nt, Human
ucagcaggucugaggcggggcc

SEQ ID NO: 811343 - RNA, 22 nt, Human
uggcagccucagacaaggaccu

SEQ ID NO: 811344 - RNA, 22 nt, Human
cuuuaugguaaguauagaugac

SEQ ID NO: 811345 - RNA, 22 nt, Human
ggcaggguuucuccauucugcc

SEQ ID NO: 811346 - RNA, 22 nt, Human
guuucucaagcuugaaugcaca

SEQ ID NO: 811347 - RNA, 22 nt, Human
agcugccagaugacagugcuau

SEQ ID NO: 811348 - RNA, 22 nt, Human
cuacauuucccagcugccuucc

SEQ ID NO: 811349 - RNA, 22 nt, Human
uuugcaaaguccauugaaguua

SEQ ID NO: 811350 - RNA, 22 nt, Human
uuaaguguuuaguaagagaugu

SEQ ID NO: 811351 - RNA, 22 nt, Human
aacauugccaugguuaauuuua

SEQ ID NO: 811352 - RNA, 22 nt, Human
ucccgcuucuuccgaaucgcga

SEQ ID NO: 811353 - RNA, 22 nt, Human
aacacaguuuuccaaaauagag

SEQ ID NO: 811354 - RNA, 22 nt, Human
gaugaaaaauugcugugucaua

SEQ ID NO: 811355 - RNA, 22 nt, Human
ugucugaacaaacucugccucc

SEQ ID NO: 811356 - RNA, 20 nt, Human
agggucagagagcgugagug

SEQ ID NO: 811357 - RNA, 22 nt, Human
gggcagcuccuguggaauccac

SEQ ID NO: 811358 - RNA, 21 nt, Human
agccugggaggcggagguugc

SEQ ID NO: 811359 - RNA, 22 nt, Human
aacaaguuagggucuuuuacuu

SEQ ID NO: 811360 - RNA, 22 nt, Human
guuuugcagagugcaauaaauc

SEQ ID NO: 811361 - RNA, 23 nt, Human
acagaggcuuaaaugaguggcag

SEQ ID NO: 811362 - RNA, 22 nt, Human
ugcuggcuuuuugguccuugcu

SEQ ID NO: 811363 - RNA, 22 nt, Human
uuucaaaugcaugucuuuccuc

SEQ ID NO: 811364 - RNA, 22 nt, Human
caggguccggcugccuggcugu

SEQ ID NO: 811365 - RNA, 22 nt, Human
uucucacaggauuucuuuuagu

SEQ ID NO: 811366 - RNA, 22 nt, Human
uuuaccaagcuuuaauuacaua

SEQ ID NO: 811367 - RNA, 22 nt, Human
uuauuauuuuguguacagcaaa

SEQ ID NO: 811368 - RNA, 22 nt, Human
gaggcugcccaacuggagugga

SEQ ID NO: 811369 - RNA, 22 nt, Human
gcagggaagacccggagcagcg

SEQ ID NO: 811370 - RNA, 19 nt, Human
ugcaaauguaggaagaaua

SEQ ID NO: 811371 - RNA, 22 nt, Human
uauuucuaagcuguaagucuga

SEQ ID NO: 811372 - RNA, 22 nt, Human
gcagcagcucaguucugggagg

SEQ ID NO: 811373 - RNA, 22 nt, Human
gcagggauugugcagggggcua

SEQ ID NO: 811374 - RNA, 22 nt, Human
agcagggcuccauuucacugcc

SEQ ID NO: 811375 - RNA, 22 nt, Human
uuugacaaaggaaaaaugcaca

SEQ ID NO: 811376 - RNA, 22 nt, Human
uuucagaaauggcacugaaauc

SEQ ID NO: 811377 - RNA, 22 nt, Human
cugccucuguugggcauggucu

SEQ ID NO: 811378 - RNA, 22 nt, Human
gagcuuuguagcaggaaggaag

SEQ ID NO: 811379 - RNA, 22 nt, Human
aguggcuaugcaugacuggaau

SEQ ID NO: 811380 - RNA, 22 nt, Human
gagcaggcuugcagagaagggg

SEQ ID NO: 811381 - RNA, 22 nt, Human
uccaggagucuagccucaggcc

SEQ ID NO: 811382 - RNA, 22 nt, Human
cagugacguaaacugcaugugc

SEQ ID NO: 811383 - RNA, 22 nt, Human
aagccaggaauggagucuucgc

SEQ ID NO: 811384 - RNA, 22 nt, Human
guggcagagggugagcuggacu

SEQ ID NO: 811385 - RNA, 22 nt, Human
cacccucccgucagccccuggg

SEQ ID NO: 811386 - RNA, 22 nt, Human
augggcagaguggggacaggaa

SEQ ID NO: 811387 - RNA, 22 nt, Human
cuggcuccaucacugggugaug

SEQ ID NO: 811388 - RNA, 22 nt, Human
ucucauaauagcauuucucacc

SEQ ID NO: 811389 - RNA, 22 nt, Human
cuccagugcgcaggacagcccc

SEQ ID NO: 811390 - RNA, 22 nt, Human
ggccccagguagaagauauaga

SEQ ID NO: 811391 - RNA, 22 nt, Human
uggggaugaaacccaggcaucu

SEQ ID NO: 811392 - RNA, 22 nt, Human
cagggugcagugucgcugcuag

SEQ ID NO: 811393 - RNA, 22 nt, Human
uucuuauaaguuaauauuucca

SEQ ID NO: 811394 - RNA, 22 nt, Human
ugggcagaguagcucagaagaa

SEQ ID NO: 811395 - RNA, 22 nt, Human
aaggcuggguuugggaugugau

SEQ ID NO: 811396 - RNA, 22 nt, Human
uugcagcuguugcaaagucucu

SEQ ID NO: 811397 - RNA, 22 nt, Human
ccaucaguuuuaucugacaaaa

SEQ ID NO: 811398 - RNA, 22 nt, Human
gacaauaagaacagauacugug

SEQ ID NO: 811399 - RNA, 22 nt, Human
gcugugagccgcugcugagcau

SEQ ID NO: 811400 - RNA, 22 nt, Human
auuauuaaagcuacaucaagga

SEQ ID NO: 811401 - RNA, 22 nt, Human
aaaguacaggaaagccuagcca

SEQ ID NO: 811402 - RNA, 22 nt, Human
gugccugguauguagguagcgg

SEQ ID NO: 811403 - RNA, 22 nt, Human
uucuaguuuugccuuaucaaca

SEQ ID NO: 811404 - RNA, 22 nt, Human
ccugucuggccaccagggcgau

SEQ ID NO: 811405 - RNA, 22 nt, Human
caccccuaccugagucaggagu

SEQ ID NO: 811406 - RNA, 22 nt, Human
aggcugagccacggggcuggcu

SEQ ID NO: 811407 - RNA, 22 nt, Human
auuugucacugagagaguuaga

SEQ ID NO: 811408 - RNA, 22 nt, Human
aagaagaugguuaacuuucagu

SEQ ID NO: 811409 - RNA, 22 nt, Human
ucugcaagggguucuuuaggcc

SEQ ID NO: 811410 - RNA, 22 nt, Human
agcagcugucccuuaacaucag

SEQ ID NO: 811411 - RNA, 22 nt, Human
ugucuuuuaccuaaugagcugg

SEQ ID NO: 811412 - RNA, 20 nt, Human
gcagaugagacucacagagg

SEQ ID NO: 811413 - RNA, 22 nt, Human
ugcuggaggccagaagucugag

SEQ ID NO: 811414 - RNA, 22 nt, Human
cuacagagaacucagcugcccu

SEQ ID NO: 811415 - RNA, 22 nt, Human
cagcuuugauucacugccuagu

SEQ ID NO: 811416 - RNA, 23 nt, Human
ggacacagagauaagugagacaa

SEQ ID NO: 811417 - RNA, 22 nt, Human
gcagagccaggcuggggcaggu

SEQ ID NO: 811418 - RNA, 22 nt, Human
uugucugagagauggcagaggu

SEQ ID NO: 811419 - RNA, 22 nt, Human
uaccucaugcuguacagcacgu

SEQ ID NO: 811420 - RNA, 22 nt, Human
cucauugcagcugcauuacugu

SEQ ID NO: 811421 - RNA, 22 nt, Human
aaagacauuagcuuagauguca

SEQ ID NO: 811422 - RNA, 22 nt, Human
caaggaaggagagaugaugggu

SEQ ID NO: 811423 - RNA, 22 nt, Human
uacaguuaaaaaguucaauggu

SEQ ID NO: 811424 - RNA, 22 nt, Human
gagugcuccgucuuggacaggg

SEQ ID NO: 811425 - RNA, 22 nt, Human
aauucacagaaccauggugcuc

SEQ ID NO: 811426 - RNA, 22 nt, Human
aguuuacacuaugaaaagacua

SEQ ID NO: 811427 - RNA, 22 nt, Human
cugggaguuucuagagaaagac

SEQ ID NO: 811428 - RNA, 22 nt, Human
caggccucaggggcucaggcug

SEQ ID NO: 811429 - RNA, 22 nt, Human
ggcagcuguuuguccuccuguu

SEQ ID NO: 811430 - RNA, 17 nt, Human
accagccucuccugggg

SEQ ID NO: 811431 - RNA, 22 nt, Human
ggcuagggaucuagaccaggac

SEQ ID NO: 811432 - RNA, 22 nt, Human
agcugggaagacuggaagacag

SEQ ID NO: 811433 - RNA, 22 nt, Human
gggcuccagcccgggaccaggu

SEQ ID NO: 811434 - RNA, 23 nt, Human
ucacaucugccguaguguauucu

SEQ ID NO: 811435 - RNA, 22 nt, Human
aaacaguggccaauucuggaga

SEQ ID NO: 811436 - RNA, 22 nt, Human
cugagccaguagucagggacaa

SEQ ID NO: 811437 - RNA, 22 nt, Human
uuuucaguuauagaaugguaga

SEQ ID NO: 811438 - RNA, 22 nt, Human
uuucucagucacaugaaccaau

SEQ ID NO: 811439 - RNA, 21 nt, Human
uccuccuguagaggguccugg

SEQ ID NO: 811440 - RNA, 22 nt, Human
uucaugugucuguagcacauau

SEQ ID NO: 811441 - RNA, 20 nt, Human
cuccugguccaggagccuga

SEQ ID NO: 811442 - RNA, 22 nt, Human
ggcugcccucgucuacugccca

SEQ ID NO: 811443 - RNA, 22 nt, Human
gcuacugauugaccuuggagag

SEQ ID NO: 811444 - RNA, 22 nt, Human
cauucacagcaggucagcugaa

SEQ ID NO: 811445 - RNA, 18 nt, Human
aggucugaggaagagccu

SEQ ID NO: 811446 - RNA, 22 nt, Human
aguuuaacuuuggaaaacuaua

SEQ ID NO: 811447 - RNA, 22 nt, Human
gagaaaauagcauguguaguau

SEQ ID NO: 811448 - RNA, 22 nt, Human
agcagcuguacuuucaucuguu

SEQ ID NO: 811449 - RNA, 22 nt, Human
ucucuuugucugcucuuaguug

SEQ ID NO: 811450 - RNA, 22 nt, Human
ucagaggcaucauucauaguua

SEQ ID NO: 811451 - RNA, 22 nt, Human
gaggaaaucauuccagaaaagg

SEQ ID NO: 811452 - RNA, 22 nt, Human
uucuggaaguguuagaaucugg

SEQ ID NO: 811453 - RNA, 19 nt, Human
agcagggacauggaacuuu

SEQ ID NO: 811454 - RNA, 21 nt, Human
uaauaauuccacuacagagua

SEQ ID NO: 811455 - RNA, 22 nt, Human
cacuugaaaguaaugguugugc

SEQ ID NO: 811456 - RNA, 22 nt, Human
aucuucugggcagugaaaauug

SEQ ID NO: 811457 - RNA, 19 nt, Human
augucucuguagcacauac

SEQ ID NO: 811458 - RNA, 22 nt, Human
cagcccacgucagggccacuca

SEQ ID NO: 811459 - RNA, 22 nt, Human
aaaguacaugagauucaagggg

SEQ ID NO: 811460 - RNA, 22 nt, Human
ggcaggcacuguguuuuguguu

SEQ ID NO: 811461 - RNA, 22 nt, Human
cugggagccuggcaguugcuga

SEQ ID NO: 811462 - RNA, 22 nt, Human
gcugggcaccggagagacccca

SEQ ID NO: 811463 - RNA, 21 nt, Human
ugaucauuuguguaaaggaga

SEQ ID NO: 811464 - RNA, 22 nt, Human
ugggaagcugcauuuuaacaag

SEQ ID NO: 811465 - RNA, 22 nt, Human
agucagaauucgaucccagguc

SEQ ID NO: 811466 - RNA, 22 nt, Human
aguucaauagaaaaauauauua

SEQ ID NO: 811467 - RNA, 22 nt, Human
uggaagcucaaggcagggugag

SEQ ID NO: 811468 - RNA, 21 nt, Human
agagggagaguggcccuucca

SEQ ID NO: 811469 - RNA, 21 nt, Human
uguguaauauguauaagaaua

SEQ ID NO: 811470 - RNA, 22 nt, Human
gaggguggccuuuagagcccau

SEQ ID NO: 811471 - RNA, 22 nt, Human
gaaggcugcauggaggcugugg

SEQ ID NO: 811472 - RNA, 22 nt, Human
gccaccagugggggccugggca

SEQ ID NO: 811473 - RNA, 22 nt, Human
uuuacaaggaucaagggaucuc

SEQ ID NO: 811474 - RNA, 22 nt, Human
aggaaaggccucagcagaaacc

SEQ ID NO: 811475 - RNA, 22 nt, Human
cccugguguggaugugauuggc

SEQ ID NO: 811476 - RNA, 22 nt, Human
ugcagcugugccugaaaaguac

SEQ ID NO: 811477 - RNA, 22 nt, Human
cuggcugccuggagugagggag

SEQ ID NO: 811478 - RNA, 22 nt, Human
uccuggagagugggcgagcaca

SEQ ID NO: 811479 - RNA, 22 nt, Human
cugccuguuuccucuugcuccc

SEQ ID NO: 811480 - RNA, 22 nt, Human
uggcacagcuugucauaaacuc

SEQ ID NO: 811481 - RNA, 22 nt, Human
aaauagauuucucuggguuugu

SEQ ID NO: 811482 - RNA, 23 nt, Human
agugaucuguguuugaagaaugc

SEQ ID NO: 811483 - RNA, 23 nt, Human
gcaggaacucaggguaggcagca

SEQ ID NO: 811484 - RNA, 22 nt, Human
ggggaaggaaaguuauuagcag

SEQ ID NO: 811485 - RNA, 22 nt, Human
agcaggcuaggaaccucacugc

SEQ ID NO: 811486 - RNA, 22 nt, Human
ucucucauagagaaaaauauau

SEQ ID NO: 811487 - RNA, 21 nt, Human
caggaaaucagugugaauuag

SEQ ID NO: 811488 - RNA, 22 nt, Human
acagccugcagccccaggucgc

SEQ ID NO: 811489 - RNA, 21 nt, Human
ucauauuucucuugcuauugu

SEQ ID NO: 811490 - RNA, 22 nt, Human
cacagugaauuucaaguguugu

SEQ ID NO: 811491 - RNA, 22 nt, Human
uauggaaaguguuuucuucugu

SEQ ID NO: 811492 - RNA, 19 nt, Human
cugcuccaggagcugggga

SEQ ID NO: 811493 - RNA, 20 nt, Human
gugaagggagucaggugugc

SEQ ID NO: 811494 - RNA, 22 nt, Human
agccagggacgcugcaggcuac

SEQ ID NO: 811495 - RNA, 22 nt, Human
acugaaauuuauauuuugggca

SEQ ID NO: 811496 - RNA, 22 nt, Human
augguucauauuaugcaucuga

SEQ ID NO: 811497 - RNA, 22 nt, Human
uggcccugucccuggagccugg

SEQ ID NO: 811498 - RNA, 22 nt, Human
aaaugcagcugggcaugagagg

SEQ ID NO: 811499 - RNA, 22 nt, Human
caaagucuucaguugauucuga

SEQ ID NO: 811500 - RNA, 22 nt, Human
cagccagguucaaguccuuaua

SEQ ID NO: 811501 - RNA, 22 nt, Human
ggcaggcaacggaccacuaguc

SEQ ID NO: 811502 - RNA, 22 nt, Human
ucuaaacugcuagcugacugag

SEQ ID NO: 811503 - RNA, 22 nt, Human
cagcaccuguuagcauuaaaua

SEQ ID NO: 811504 - RNA, 22 nt, Human
uccuuuuuauaguuagagaaac

SEQ ID NO: 811505 - RNA, 22 nt, Human
uggcucucccaauaccuuucug

SEQ ID NO: 811506 - RNA, 22 nt, Human
uugagcaaguguacgagcaggc

SEQ ID NO: 811507 - RNA, 19 nt, Human
uuuuuacaaguagguguga

SEQ ID NO: 811508 - RNA, 22 nt, Human
gggcugaguuccugccucacuc

SEQ ID NO: 811509 - RNA, 22 nt, Human
gcucagcuggagagggacgggu

SEQ ID NO: 811510 - RNA, 22 nt, Human
aggagcaaaugaugagacagca

SEQ ID NO: 811511 - RNA, 22 nt, Human
ccaggacagggagacgggagcc

SEQ ID NO: 811512 - RNA, 22 nt, Human
ccaggaggaugaggggcauaga

SEQ ID NO: 811513 - RNA, 22 nt, Human
guucugaguggcccaagcccug

SEQ ID NO: 811514 - RNA, 22 nt, Human
gugauaaaauagaaacaguggu

SEQ ID NO: 811515 - RNA, 22 nt, Human
gggaaggcagugucugguugaa

SEQ ID NO: 811516 - RNA, 22 nt, Human
caggcacagcuaagacuggcca

SEQ ID NO: 811517 - RNA, 19 nt, Human
cagagcagugguuccugaa

SEQ ID NO: 811518 - RNA, 22 nt, Human
auccaguagugacuuuuacauu

SEQ ID NO: 811519 - RNA, 22 nt, Human
gcaaggcugagcacauuugcau

SEQ ID NO: 811520 - RNA, 22 nt, Human
ucucucccaaaucugcagauag

SEQ ID NO: 811521 - RNA, 22 nt, Human
agauacaaaggccuacagagca

SEQ ID NO: 811522 - RNA, 22 nt, Human
ucccagggacccagccugauac

SEQ ID NO: 811523 - RNA, 22 nt, Human
agagcccugaagcagagcuaaa

SEQ ID NO: 811524 - RNA, 22 nt, Human
uugauucagaaaaagauggaga

SEQ ID NO: 811525 - RNA, 22 nt, Human
agcagggcuuugcagacuuggg

SEQ ID NO: 811526 - RNA, 22 nt, Human
uggaggcaguuuaagucugaga

SEQ ID NO: 811527 - RNA, 22 nt, Human
agucccuugagggaguacuguu

SEQ ID NO: 811528 - RNA, 22 nt, Human
aagcugccagcugagcugaggc

SEQ ID NO: 811529 - RNA, 22 nt, Human
ggcagauguugcagugagcaga

SEQ ID NO: 811530 - RNA, 22 nt, Human
cugucucagcaggaagucauca

SEQ ID NO: 811531 - RNA, 22 nt, Human
cugaggcugggcauggggucca

SEQ ID NO: 811532 - RNA, 22 nt, Human
gaguuaaaugacuugguuaagg

SEQ ID NO: 811533 - RNA, 22 nt, Human
ugagccagguuuuccaucauuc

SEQ ID NO: 811534 - RNA, 22 nt, Human
ucaaggcuaaacuuucagagua

SEQ ID NO: 811535 - RNA, 20 nt, Human
uucuaguuuggaguuauuaa

SEQ ID NO: 811536 - RNA, 21 nt, Human
auuuuguacauagaauuuguc

SEQ ID NO: 811537 - RNA, 22 nt, Human
cagcuuugagcagccaguggca

SEQ ID NO: 811538 - RNA, 22 nt, Human
ugauuucccucaucauaacaga

SEQ ID NO: 811539 - RNA, 22 nt, Human
gaaaggaagaaaggucauuuua

SEQ ID NO: 811540 - RNA, 22 nt, Human
agccagcuuucacaaaugaaga

SEQ ID NO: 811541 - RNA, 22 nt, Human
gcugccccccggacucggcggg

SEQ ID NO: 811542 - RNA, 22 nt, Human
cauuuguaauacugacuugcag

SEQ ID NO: 811543 - RNA, 22 nt, Human
uucucuagguuuuagaugaaga

SEQ ID NO: 811544 - RNA, 22 nt, Human
agggaccagcgugagucugagg

SEQ ID NO: 811545 - RNA, 21 nt, Human
gcaggguuugugcugugaguu

SEQ ID NO: 811546 - RNA, 22 nt, Human
aggccagcagacgugggacuga

SEQ ID NO: 811547 - RNA, 22 nt, Human
cccagcucccauguucuccaau

SEQ ID NO: 811548 - RNA, 22 nt, Human
agcccccaggagucuccacgcc

SEQ ID NO: 811549 - RNA, 22 nt, Human
aaggaacuugccacagaaaaga

SEQ ID NO: 811550 - RNA, 22 nt, Human
aucauuuaugccccaauuagau

SEQ ID NO: 811551 - RNA, 22 nt, Human
gucccagggaagaaggcagcac

SEQ ID NO: 811552 - RNA, 22 nt, Human
uggcucagcuuuccccaucugg

SEQ ID NO: 811553 - RNA, 22 nt, Human
ugguggaguuucucuuucaaac

SEQ ID NO: 811554 - RNA, 22 nt, Human
acaggcuggaggaggaccaaga

SEQ ID NO: 811555 - RNA, 22 nt, Human
agcuccuggacgaacagggagu

SEQ ID NO: 811556 - RNA, 22 nt, Human
cugucuuuucauacuuucccuc

SEQ ID NO: 811557 - RNA, 22 nt, Human
cuuucucuucacugucaugauc

SEQ ID NO: 811558 - RNA, 20 nt, Human
agcuuucuccuuggagcucc

SEQ ID NO: 811559 - RNA, 23 nt, Human
aggaagagagagugccucuuucu

SEQ ID NO: 811560 - RNA, 22 nt, Human
aaguuucaagagguucuuugaa

SEQ ID NO: 811561 - RNA, 22 nt, Human
ggagggguggucgcgaagagca

SEQ ID NO: 811562 - RNA, 22 nt, Human
accugccuucucaaggacauga

SEQ ID NO: 811563 - RNA, 23 nt, Human
agcuccagcugacgugggcagcc

SEQ ID NO: 811564 - RNA, 22 nt, Human
ucacaucacuagcugguaauga

SEQ ID NO: 811565 - RNA, 20 nt, Human
gagauuaacugagaaucuag

SEQ ID NO: 811566 - RNA, 22 nt, Human
cuggcucaccuccgcuccagca

SEQ ID NO: 811567 - RNA, 22 nt, Human
gagcuuugucccuugggggcuc

SEQ ID NO: 811568 - RNA, 22 nt, Human
aggcucuucuuuuauuaacuga

SEQ ID NO: 811569 - RNA, 22 nt, Human
aacuauucuguggacucuuaua

SEQ ID NO: 811570 - RNA, 18 nt, Human
uuucucaaggcugacauu

SEQ ID NO: 811571 - RNA, 22 nt, Human
cgcgcugcagacagcggaggcc

SEQ ID NO: 811572 - RNA, 22 nt, Human
gaaacaaucaucaugugauuug

SEQ ID NO: 811573 - RNA, 22 nt, Human
agaagcugacagaugcagcagg

SEQ ID NO: 811574 - RNA, 22 nt, Human
guucacauccugcuuuuucccu

SEQ ID NO: 811575 - RNA, 22 nt, Human
caagagcaggugcugcuuccau

SEQ ID NO: 811576 - RNA, 22 nt, Human
uucauugagcuguacacuuagg

SEQ ID NO: 811577 - RNA, 22 nt, Human
aggcaguggcuuuuguuguguu

SEQ ID NO: 811578 - RNA, 22 nt, Human
aaucacauuuacauugcuaauu

SEQ ID NO: 811579 - RNA, 22 nt, Human
guuuucuuugaaugcuucuaga

SEQ ID NO: 811580 - RNA, 22 nt, Human
ggcccagugcuguucacccagu

SEQ ID NO: 811581 - RNA, 22 nt, Human
uuuuuauaugaaggauagugcg

SEQ ID NO: 811582 - RNA, 22 nt, Human
cucugcagaggcccaaggcuga

SEQ ID NO: 811583 - RNA, 22 nt, Human
caugaaaauaacauuguuguga

SEQ ID NO: 811584 - RNA, 22 nt, Human
ccacauuuacugauguauguau

SEQ ID NO: 811585 - RNA, 22 nt, Human
gcugggagccccgagccagcgc

SEQ ID NO: 811586 - RNA, 22 nt, Human
ucacugugaauguuaucaucuu

SEQ ID NO: 811587 - RNA, 22 nt, Human
augcaaauuaacauauaguaga

SEQ ID NO: 811588 - RNA, 22 nt, Human
cuaaaaauccacacuaggugaa

SEQ ID NO: 811589 - RNA, 22 nt, Human
gaaaauguuagcuucauaguca

SEQ ID NO: 811590 - RNA, 22 nt, Human
ucccacugagccccugcuggug

SEQ ID NO: 811591 - RNA, 22 nt, Human
acaccaggucccgucuguaccu

SEQ ID NO: 811592 - RNA, 22 nt, Human
cuaggcuggagugcaguggcau

SEQ ID NO: 811593 - RNA, 22 nt, Human
uaacacaugguuaguacacaau

SEQ ID NO: 811594 - RNA, 22 nt, Human
caguggccuuuccugcugcuca

SEQ ID NO: 811595 - RNA, 20 nt, Human
agagagcacaggcaggaaag

SEQ ID NO: 811596 - RNA, 22 nt, Human
aggcuaggaaucaagccuuucu

SEQ ID NO: 811597 - RNA, 22 nt, Human
acauuucauguuuuccagagca

SEQ ID NO: 811598 - RNA, 22 nt, Human
ggcuggcuggcuuagcagagga

SEQ ID NO: 811599 - RNA, 22 nt, Human
agcguggauguggggcgcggcu

SEQ ID NO: 811600 - RNA, 22 nt, Human
ucaggccugugcuggaggagau

SEQ ID NO: 811601 - RNA, 22 nt, Human
cccugccuucuuggccuuuaaa

SEQ ID NO: 811602 - RNA, 22 nt, Human
cauucacaaaaccacaugccau

SEQ ID NO: 811603 - RNA, 22 nt, Human
uggcucagccagcccuaggaac

SEQ ID NO: 811604 - RNA, 22 nt, Human
agugaaauuccuggucuuuguu

SEQ ID NO: 811605 - RNA, 22 nt, Human
agagucaagggugcagaggaag

SEQ ID NO: 811606 - RNA, 22 nt, Human
gaggacagugugaucugccagc

SEQ ID NO: 811607 - RNA, 22 nt, Human
cauagaaaucaggugagaaucu

SEQ ID NO: 811608 - RNA, 22 nt, Human
aggcuucacgaugggugaggug

SEQ ID NO: 811609 - RNA, 20 nt, Human
gucagugucuucaguaguga

SEQ ID NO: 811610 - RNA, 20 nt, Human
uacucacaaaugguuuagca

SEQ ID NO: 811611 - RNA, 22 nt, Human
gaggcugggaaguccaagauca

SEQ ID NO: 811612 - RNA, 22 nt, Human
agaugcuggauggaaaaugauc

SEQ ID NO: 811613 - RNA, 22 nt, Human
auucacacacauuuagagcaga

SEQ ID NO: 811614 - RNA, 22 nt, Human
caggcagagucagauuagacuu

SEQ ID NO: 811615 - RNA, 22 nt, Human
caaagaaucacucaucuuuagc

SEQ ID NO: 811616 - RNA, 22 nt, Human
gcugaggaagucagguggccca

SEQ ID NO: 811617 - RNA, 22 nt, Human
uggcagagacaaggccgggccu

SEQ ID NO: 811618 - RNA, 22 nt, Human
cuguccucuguccucagcagga

SEQ ID NO: 811619 - RNA, 22 nt, Human
agagcaggcauaaagcuuugaa

SEQ ID NO: 811620 - RNA, 22 nt, Human
agaauucugacaauagaauugg

SEQ ID NO: 811621 - RNA, 22 nt, Human
acauuuggcaucuuguaacacu

SEQ ID NO: 811622 - RNA, 22 nt, Human
agcaggcuuacuuucugauuag

SEQ ID NO: 811623 - RNA, 22 nt, Human
cacaggccaauacccucucucu

SEQ ID NO: 811624 - RNA, 22 nt, Human
caggaggcaucauggagcggac

SEQ ID NO: 811625 - RNA, 22 nt, Human
uaaauugcauaaguacaaauga

SEQ ID NO: 811626 - RNA, 22 nt, Human
caaacuauuuacaauggaauca

SEQ ID NO: 811627 - RNA, 22 nt, Human
acaaaaagcuccauuacugucc

SEQ ID NO: 811628 - RNA, 22 nt, Human
aagaggcauaaaauuuauaugg

SEQ ID NO: 811629 - RNA, 17 nt, Human
uaaauacacaaggguau

SEQ ID NO: 811630 - RNA, 22 nt, Human
uuucuuuaauucucacagcaau

SEQ ID NO: 811631 - RNA, 22 nt, Human
guggcaggaucacggcucacug

SEQ ID NO: 811632 - RNA, 22 nt, Human
uccaguccauggccucagucuu

SEQ ID NO: 811633 - RNA, 22 nt, Human
cugagaggugacagcgugcugg

SEQ ID NO: 811634 - RNA, 22 nt, Human
ucagaagguuuuuagcaaagga

SEQ ID NO: 811635 - RNA, 20 nt, Human
ugccugcccagguccugcac

SEQ ID NO: 811636 - RNA, 22 nt, Human
uugagagugccaagcauccucc

SEQ ID NO: 811637 - RNA, 22 nt, Human
cuuuguuuauauuucuccucga

SEQ ID NO: 811638 - RNA, 22 nt, Human
uucuacuucugacacuguuugu

SEQ ID NO: 811639 - RNA, 22 nt, Human
aggcuccacccuacagagcucc

SEQ ID NO: 811640 - RNA, 22 nt, Human
ucucucccuuuccuuaucaguu

SEQ ID NO: 811641 - RNA, 22 nt, Human
ucccaggccauaaaacucagag

SEQ ID NO: 811642 - RNA, 22 nt, Human
auuuuuccaugauacuuaucug

SEQ ID NO: 811643 - RNA, 22 nt, Human
gagcuuaaaacauagccagacu

SEQ ID NO: 811644 - RNA, 22 nt, Human
guuauauaauuccugugguagu

SEQ ID NO: 811645 - RNA, 22 nt, Human
ccuggcugguggcagcgacaag

SEQ ID NO: 811646 - RNA, 22 nt, Human
uugcauauccuccaacacaugg

SEQ ID NO: 811647 - RNA, 22 nt, Human
auaugcauuaacauuguaggag

SEQ ID NO: 811648 - RNA, 22 nt, Human
cuggagggcuucugcagguuac

SEQ ID NO: 811649 - RNA, 22 nt, Human
acaguaaaucaacagaauaucu

SEQ ID NO: 811650 - RNA, 22 nt, Human
gcugagcucccagcaguaucug

SEQ ID NO: 811651 - RNA, 22 nt, Human
uguuuucucuugaaaagcaguc

SEQ ID NO: 811652 - RNA, 22 nt, Human
caggagagcccggguccgggcu

SEQ ID NO: 811653 - RNA, 22 nt, Human
uauucacagcugccgcacucag

SEQ ID NO: 811654 - RNA, 22 nt, Human
uggcucaggggucuggcucugu

SEQ ID NO: 811655 - RNA, 22 nt, Human
aguguuaagagaaaauucugcu

SEQ ID NO: 811656 - RNA, 22 nt, Human
gugcagcugaaggcuggccagc

SEQ ID NO: 811657 - RNA, 23 nt, Human
agaggggagcaucugcuggcuga

SEQ ID NO: 811658 - RNA, 22 nt, Human
cuggucccagcagagcucugag

SEQ ID NO: 811659 - RNA, 22 nt, Human
augcagcucauuuguuuaaaag

SEQ ID NO: 811660 - RNA, 22 nt, Human
cccaggaggcagagcuugcagu

SEQ ID NO: 811661 - RNA, 22 nt, Human
aaauagauuuccuagcauugga

SEQ ID NO: 811662 - RNA, 21 nt, Human
cccugcaggccagggcugagc

SEQ ID NO: 811663 - RNA, 22 nt, Human
ggccaggagcaagccaggcucu

SEQ ID NO: 811664 - RNA, 22 nt, Human
ccugcucggggugcagugggcu

SEQ ID NO: 811665 - RNA, 18 nt, Human
caaagcucacguuccauc

SEQ ID NO: 811666 - RNA, 22 nt, Human
agcaggcaguguagagccuuca

SEQ ID NO: 811667 - RNA, 22 nt, Human
cccucaguuuuccagugugggc

SEQ ID NO: 811668 - RNA, 22 nt, Human
uacaagagcaguaagcuugucc

SEQ ID NO: 811669 - RNA, 22 nt, Human
gaaaagcuaggccaguucagcu

SEQ ID NO: 811670 - RNA, 22 nt, Human
agccuggcuguaaccucauggu

SEQ ID NO: 811671 - RNA, 22 nt, Human
uguagaaacuacacaugcaaca

SEQ ID NO: 811672 - RNA, 22 nt, Human
agucuggcuuuuugaugagcuu

SEQ ID NO: 811673 - RNA, 18 nt, Human
ugagaggcuauuuuuugc

SEQ ID NO: 811674 - RNA, 22 nt, Human
aacaggcacuaagcaugugggg

SEQ ID NO: 811675 - RNA, 22 nt, Human
acauuuaaauaugccuuauauu

SEQ ID NO: 811676 - RNA, 22 nt, Human
uauuucuguaugcauaaaagga

SEQ ID NO: 811677 - RNA, 22 nt, Human
auuuaaugucgagcuauuguag

SEQ ID NO: 811678 - RNA, 22 nt, Human
ccagugucuagcagaugacagg

SEQ ID NO: 811679 - RNA, 22 nt, Human
uugauucaaccacuuaauaauc

SEQ ID NO: 811680 - RNA, 22 nt, Human
uuucuaaucugauucuccuacc

SEQ ID NO: 811681 - RNA, 22 nt, Human
cuuccagcugauuggcauccag

SEQ ID NO: 811682 - RNA, 22 nt, Human
ggcacugggaaugcagugauga

SEQ ID NO: 811683 - RNA, 22 nt, Human
aagaaaaucaguucuggucagu

SEQ ID NO: 811684 - RNA, 22 nt, Human
agggccagaaucccucagucua

SEQ ID NO: 811685 - RNA, 22 nt, Human
aggcuccaccccgccagaccuu

SEQ ID NO: 811686 - RNA, 22 nt, Human
caugugcagacggugggcugga

SEQ ID NO: 811687 - RNA, 22 nt, Human
gccuccugaagugcugggauua

SEQ ID NO: 811688 - RNA, 22 nt, Human
ccacauuuugcuuugccuaggu

SEQ ID NO: 811689 - RNA, 22 nt, Human
aacacaggccagccugugcagu

SEQ ID NO: 811690 - RNA, 22 nt, Human
aucaacagguauggaugagauu

SEQ ID NO: 811691 - RNA, 22 nt, Human
uguuggagcccgagucagggag

SEQ ID NO: 811692 - RNA, 22 nt, Human
ucacugaauacuugucucaucc

SEQ ID NO: 811693 - RNA, 22 nt, Human
ucuuuggugauaucucuuuggu

SEQ ID NO: 811694 - RNA, 18 nt, Human
gaggaaacaaggcagagg

SEQ ID NO: 811695 - RNA, 22 nt, Human
ggcuggcagugugagagaggga

SEQ ID NO: 811696 - RNA, 22 nt, Human
agaggcugugcccaccaggcaa

SEQ ID NO: 811697 - RNA, 22 nt, Human
agaaacucuaggucaauugagg

SEQ ID NO: 811698 - RNA, 22 nt, Human
ggcuucccuguuugcugugccu

SEQ ID NO: 811699 - RNA, 22 nt, Human
auggcucugagaaccugagcua

SEQ ID NO: 811700 - RNA, 22 nt, Human
uuccucaugggguuccuucaga

SEQ ID NO: 811701 - RNA, 22 nt, Human
ucaaaugaggcugaugaaugug

SEQ ID NO: 811702 - RNA, 22 nt, Human
auauuucucucagacauggaag

SEQ ID NO: 811703 - RNA, 17 nt, Human
caaagggagcccaccaa

SEQ ID NO: 811704 - RNA, 22 nt, Human
cacaguggcaaaggggcuuggg

SEQ ID NO: 811705 - RNA, 22 nt, Human
gccuucugcgcucgugucuccg

SEQ ID NO: 811706 - RNA, 22 nt, Human
ucacaguacuccccaaaguuuc

SEQ ID NO: 811707 - RNA, 19 nt, Human
cugggaguucacugcugcc

SEQ ID NO: 811708 - RNA, 22 nt, Human
ugcccagguuugagugcccaag

SEQ ID NO: 811709 - RNA, 22 nt, Human
uggcagaugagccgcgcuccaa

SEQ ID NO: 811710 - RNA, 22 nt, Human
gagaggcugugugccauuguug

SEQ ID NO: 811711 - RNA, 22 nt, Human
gggcuggaggugagcaggacag

SEQ ID NO: 811712 - RNA, 22 nt, Human
uaaaugauuuauguaugugaaa

SEQ ID NO: 811713 - RNA, 22 nt, Human
aucucaacuaagccuaacuuuu

SEQ ID NO: 811714 - RNA, 22 nt, Human
cccagcagauggcuaugugcua

SEQ ID NO: 811715 - RNA, 22 nt, Human
aguuuacaugacguguauuuca

SEQ ID NO: 811716 - RNA, 22 nt, Human
gaggcucagagagguccacaua

SEQ ID NO: 811717 - RNA, 22 nt, Human
agacagcugcucgcagagcuau

SEQ ID NO: 811718 - RNA, 22 nt, Human
auuucuguuauaccuuucucag

SEQ ID NO: 811719 - RNA, 22 nt, Human
uugauucaaaacaggagguagg

SEQ ID NO: 811720 - RNA, 22 nt, Human
aacagugauaucaagacagaca

SEQ ID NO: 811721 - RNA, 22 nt, Human
gagaagggcuugggagucaaca

SEQ ID NO: 811722 - RNA, 22 nt, Human
aauucacaugcaugucugugca

SEQ ID NO: 811723 - RNA, 23 nt, Human
cagaaaugacaguaagcacccug

SEQ ID NO: 811724 - RNA, 22 nt, Human
caguauucaucuaaggagcuug

SEQ ID NO: 811725 - RNA, 23 nt, Human
ugcuggcuuccagcugcucccuc

SEQ ID NO: 811726 - RNA, 22 nt, Human
uguauuuucagaguggcauuuc

SEQ ID NO: 811727 - RNA, 22 nt, Human
uuacagagcucauuucuaaggg

SEQ ID NO: 811728 - RNA, 22 nt, Human
aaugaaauguagcuuauccaua

SEQ ID NO: 811729 - RNA, 22 nt, Human
cucaggccagguuucucccaca

SEQ ID NO: 811730 - RNA, 22 nt, Human
augggaagcugaccugcaugga

SEQ ID NO: 811731 - RNA, 22 nt, Human
ugcacacagcugggccuggcug

SEQ ID NO: 811732 - RNA, 22 nt, Human
acauuugacucuguucauauua

SEQ ID NO: 811733 - RNA, 22 nt, Human
uuucacauuuaggcgugaauug

SEQ ID NO: 811734 - RNA, 21 nt, Human
uuacaaagcaagugcuguguc

SEQ ID NO: 811735 - RNA, 21 nt, Human
gacagcaacuguaguccucuu

SEQ ID NO: 811736 - RNA, 19 nt, Human
ugagcugccgucuucccug

SEQ ID NO: 811737 - RNA, 22 nt, Human
ccugccaugccagcaugcccgu

SEQ ID NO: 811738 - RNA, 22 nt, Human
aaauuuucagagcacuagagaa

SEQ ID NO: 811739 - RNA, 22 nt, Human
aaaaucuggcaacacuaaguuu

SEQ ID NO: 811740 - RNA, 22 nt, Human
gcccagcaccucucucaggguu

SEQ ID NO: 811741 - RNA, 22 nt, Human
acucuucaucccuuuaucagga

SEQ ID NO: 811742 - RNA, 22 nt, Human
gcaggaaagguugagacuuugc

SEQ ID NO: 811743 - RNA, 22 nt, Human
uacaacagaaguguuuauuuag

SEQ ID NO: 811744 - RNA, 22 nt, Human
agacaaauggaguaugagcaac

SEQ ID NO: 811745 - RNA, 22 nt, Human
agaagcagcuuucaaggugauu

SEQ ID NO: 811746 - RNA, 22 nt, Human
cuggucacuggucucauccagc

SEQ ID NO: 811747 - RNA, 22 nt, Human
uucagaguaggauacuagcuua

SEQ ID NO: 811748 - RNA, 22 nt, Human
cuucugcaggcccugucugacc

SEQ ID NO: 811749 - RNA, 21 nt, Human
cuuggaguugguugaggaugc

SEQ ID NO: 811750 - RNA, 22 nt, Human
aaacuucauggauaauauaaag

SEQ ID NO: 811751 - RNA, 22 nt, Human
ugcucauuaggacugcaaauuc

SEQ ID NO: 811752 - RNA, 22 nt, Human
agagaccuuuguuauucuagga

SEQ ID NO: 811753 - RNA, 22 nt, Human
ucagaaucugaaaagcgcuugg

SEQ ID NO: 811754 - RNA, 22 nt, Human
aaaauugaggcucauguuaaau

SEQ ID NO: 811755 - RNA, 22 nt, Human
ugcaggcuccaugaggacaggc

SEQ ID NO: 811756 - RNA, 22 nt, Human
caaauacuguacugaacacugu

SEQ ID NO: 811757 - RNA, 17 nt, Human
aggugccagugauauac

SEQ ID NO: 811758 - RNA, 22 nt, Human
gaccugggguggaaggaaggca

SEQ ID NO: 811759 - RNA, 22 nt, Human
aggcugggaaaccugaaguugu

SEQ ID NO: 811760 - RNA, 22 nt, Human
guuucauuaccugacccaugag

SEQ ID NO: 811761 - RNA, 22 nt, Human
augcuucuguaaugugggaaug

SEQ ID NO: 811762 - RNA, 22 nt, Human
acauccaucuuaugagauaggu

SEQ ID NO: 811763 - RNA, 22 nt, Human
gcccuccagcuguugcgcgucg

SEQ ID NO: 811764 - RNA, 23 nt, Human
agggccucugucccccagcacuc

SEQ ID NO: 811765 - RNA, 22 nt, Human
uugguucaggacauauuugagu

SEQ ID NO: 811766 - RNA, 22 nt, Human
aucaaauuaugugcuacaagaa

SEQ ID NO: 811767 - RNA, 22 nt, Human
agcaucuggucaugagugagaa

SEQ ID NO: 811768 - RNA, 22 nt, Human
uggguggucuugcuucccagga

SEQ ID NO: 811769 - RNA, 22 nt, Human
guucauguuuguguauugcuca

SEQ ID NO: 811770 - RNA, 22 nt, Human
agugugacauuuucaugaauuu

SEQ ID NO: 811771 - RNA, 22 nt, Human
gccaggcugcuccagggaggcc

SEQ ID NO: 811772 - RNA, 22 nt, Human
uuguugcagagaugaaugacau

SEQ ID NO: 811773 - RNA, 22 nt, Human
uauuacaaauuauaaugggaga

SEQ ID NO: 811774 - RNA, 21 nt, Human
gggcucaguggaaaagagugu

SEQ ID NO: 811775 - RNA, 18 nt, Human
guucaagccaacaucaag

SEQ ID NO: 811776 - RNA, 22 nt, Human
auuuucucuuuguauaugcuag

SEQ ID NO: 811777 - RNA, 22 nt, Human
gaaccucuauauuugugacauc

SEQ ID NO: 811778 - RNA, 22 nt, Human
ggcagugaaugaaacagaggcu

SEQ ID NO: 811779 - RNA, 22 nt, Human
caguuguccccaaaauauacgg

SEQ ID NO: 811780 - RNA, 22 nt, Human
ugcauuaaaaugauggagaaau

SEQ ID NO: 811781 - RNA, 22 nt, Human
ucugaagguugagaagggcuga

SEQ ID NO: 811782 - RNA, 22 nt, Human
ugagagugaaaugucacauguc

SEQ ID NO: 811783 - RNA, 22 nt, Human
gucaggggccaugggccaagga

SEQ ID NO: 811784 - RNA, 22 nt, Human
gcagcugcuggagggaggcagg

SEQ ID NO: 811785 - RNA, 18 nt, Human
uuggggugaggccaggaa

SEQ ID NO: 811786 - RNA, 22 nt, Human
gguguggaucaucugaggucag

SEQ ID NO: 811787 - RNA, 22 nt, Human
uucauucuguuuggaaaggugg

SEQ ID NO: 811788 - RNA, 22 nt, Human
ccaggacacgauuuuuagucug

SEQ ID NO: 811789 - RNA, 22 nt, Human
uugcucugauuagguggaaaca

SEQ ID NO: 811790 - RNA, 22 nt, Human
uuacagagggcuucucugaacu

SEQ ID NO: 811791 - RNA, 22 nt, Human
aaggaaauacuucugcagagca

SEQ ID NO: 811792 - RNA, 22 nt, Human
uuugcaaaaugaggugaagagu

SEQ ID NO: 811793 - RNA, 22 nt, Human
caccuaggguuucgccuuucuu

SEQ ID NO: 811794 - RNA, 22 nt, Human
agcaggcuccuuccuucucugg

SEQ ID NO: 811795 - RNA, 22 nt, Human
aggggcuggcuuaucugagagu

SEQ ID NO: 811796 - RNA, 22 nt, Human
ccagccagccuugaucugagua

SEQ ID NO: 811797 - RNA, 20 nt, Human
uauuuacaacuuagagccuc

SEQ ID NO: 811798 - RNA, 22 nt, Human
guucuagaugacugagcagcug

SEQ ID NO: 811799 - RNA, 22 nt, Human
uaggccuggaucucugggagca

SEQ ID NO: 811800 - RNA, 22 nt, Human
caguuuaaagaaggaugggagu

SEQ ID NO: 811801 - RNA, 22 nt, Human
ggcugagcacuuuaggcaggag

SEQ ID NO: 811802 - RNA, 22 nt, Human
auuauuucucacucacauaaua

SEQ ID NO: 811803 - RNA, 22 nt, Human
caaagaaugagugaguacauaa

SEQ ID NO: 811804 - RNA, 21 nt, Human
auggagggaccagggaagcag

SEQ ID NO: 811805 - RNA, 22 nt, Human
gccugcucagaccuagcaggcc

SEQ ID NO: 811806 - RNA, 22 nt, Human
gccauguucuugaaucuggguc

SEQ ID NO: 811807 - RNA, 22 nt, Human
auacaaguuaaugagaaugaca

SEQ ID NO: 811808 - RNA, 22 nt, Human
uaaaaugacuuccuccaacauc

SEQ ID NO: 811809 - RNA, 22 nt, Human
ucugagcugggcacagaaggcg

SEQ ID NO: 811810 - RNA, 22 nt, Human
ccuggcucuucagagguuccua

SEQ ID NO: 811811 - RNA, 22 nt, Human
cagcccagagccaguucccgcu

SEQ ID NO: 811812 - RNA, 22 nt, Human
cccaggagguggagcuugcagu

SEQ ID NO: 811813 - RNA, 22 nt, Human
aauaggacuuugguccuagcuc

SEQ ID NO: 811814 - RNA, 22 nt, Human
cagagacaggagugcucccagu

SEQ ID NO: 811815 - RNA, 22 nt, Human
cauugagagaaucacauagaag

SEQ ID NO: 811816 - RNA, 22 nt, Human
uucacauaaucugcagcaagcg

SEQ ID NO: 811817 - RNA, 22 nt, Human
ucauaaaacacaccagguaguu

SEQ ID NO: 811818 - RNA, 22 nt, Human
ucccugggcaaguuuacucuuc

SEQ ID NO: 811819 - RNA, 22 nt, Human
agucagaguucuuggggagaca

SEQ ID NO: 811820 - RNA, 22 nt, Human
ucagcugcucuguugagcugaa

SEQ ID NO: 811821 - RNA, 18 nt, Human
ucuuuuccuuccacuucc

SEQ ID NO: 811822 - RNA, 22 nt, Human
ugggguugccucccgcccugga

SEQ ID NO: 811823 - RNA, 22 nt, Human
uagaaaccucagggaaaucuuu

SEQ ID NO: 811824 - RNA, 22 nt, Human
cuucuuugaaaaaggcagucag

SEQ ID NO: 811825 - RNA, 22 nt, Human
uaauuauuaugacaacaauugc

SEQ ID NO: 811826 - RNA, 22 nt, Human
uuuaaauuauaguuaaugucug

SEQ ID NO: 811827 - RNA, 22 nt, Human
cuacauuuuaauaagcugcuua

SEQ ID NO: 811828 - RNA, 21 nt, Human
gguuaaaagacacaucuguuu

SEQ ID NO: 811829 - RNA, 22 nt, Human
aaagucaagguuuagacuagag

SEQ ID NO: 811830 - RNA, 22 nt, Human
cccucuggcucuucucaggccg

SEQ ID NO: 811831 - RNA, 22 nt, Human
ccagugucuacuguggcauauc

SEQ ID NO: 811832 - RNA, 22 nt, Human
cagcaaggccauuggaugcagu

SEQ ID NO: 811833 - RNA, 22 nt, Human
guggcauuuggaaagagcacua

SEQ ID NO: 811834 - RNA, 22 nt, Human
cccacgucgaacuugcuccaga

SEQ ID NO: 811835 - RNA, 22 nt, Human
gcccuggacagugacggugacc

SEQ ID NO: 811836 - RNA, 23 nt, Human
guuuucaacacaauaaauguaac

SEQ ID NO: 811837 - RNA, 22 nt, Human
ggagaugcgacucgcggggcug

SEQ ID NO: 811838 - RNA, 22 nt, Human
auacauggaagaugcuuagcac

SEQ ID NO: 811839 - RNA, 22 nt, Human
ucuggaauuaaacucaggagac

SEQ ID NO: 811840 - RNA, 22 nt, Human
uaccacagacagauuucaguaa

SEQ ID NO: 811841 - RNA, 22 nt, Human
uugcagcuagaagauucacugu

SEQ ID NO: 811842 - RNA, 22 nt, Human
ucagagaacacagaggugaugu

SEQ ID NO: 811843 - RNA, 22 nt, Human
uacugucuggcaauuaagaauc

SEQ ID NO: 811844 - RNA, 22 nt, Human
aaagcugcccuugugaaacaag

SEQ ID NO: 811845 - RNA, 22 nt, Human
ugccagcuucuuacggcugccu

SEQ ID NO: 811846 - RNA, 22 nt, Human
ucagagaagcuuaagcuguaau

SEQ ID NO: 811847 - RNA, 22 nt, Human
uuuuuuccaggaagccacugga

SEQ ID NO: 811848 - RNA, 22 nt, Human
uuaaaaauauguagggcccgau

SEQ ID NO: 811849 - RNA, 22 nt, Human
gacagacaggagcucacaggca

SEQ ID NO: 811850 - RNA, 22 nt, Human
auugacaaaucugaacauacgg

SEQ ID NO: 811851 - RNA, 22 nt, Human
gggaccagaggcugugcacaau

SEQ ID NO: 811852 - RNA, 22 nt, Human
gugcauuaacaacccagaacuc

SEQ ID NO: 811853 - RNA, 22 nt, Human
gcaccugcuggaaucagucugu

SEQ ID NO: 811854 - RNA, 22 nt, Human
caguccuguuccuggaguaguu

SEQ ID NO: 811855 - RNA, 22 nt, Human
cucuuuggugcaccuugcaguc

SEQ ID NO: 811856 - RNA, 22 nt, Human
uguagggacugaggcuggagag

SEQ ID NO: 811857 - RNA, 22 nt, Human
aacuucugaccucaagaacugu

SEQ ID NO: 811858 - RNA, 22 nt, Human
cugacagcuauuuuuguagaua

SEQ ID NO: 811859 - RNA, 22 nt, Human
cgcuggcauuagggcaguggcc

SEQ ID NO: 811860 - RNA, 22 nt, Human
gucuuucuaugcauagagcaga

SEQ ID NO: 811861 - RNA, 22 nt, Human
ggagguggagguugcaaugagc

SEQ ID NO: 811862 - RNA, 22 nt, Human
cugacagcgagagaguugcccc

SEQ ID NO: 811863 - RNA, 22 nt, Human
guacauuucaguuuccuuaaga

SEQ ID NO: 811864 - RNA, 22 nt, Human
aacaaaacauuugucuuguuuc

SEQ ID NO: 811865 - RNA, 22 nt, Human
acagaggccucggccugcccag

SEQ ID NO: 811866 - RNA, 22 nt, Human
caggaaauaaaaaguaucuucu

SEQ ID NO: 811867 - RNA, 22 nt, Human
aggucaagggagcugagggcca

SEQ ID NO: 811868 - RNA, 22 nt, Human
cugugcccucuuugcuggccuu

SEQ ID NO: 811869 - RNA, 22 nt, Human
ugcauacauguuuguguauuuu

SEQ ID NO: 811870 - RNA, 22 nt, Human
aaacaauguacauuuauaaugc

SEQ ID NO: 811871 - RNA, 22 nt, Human
uucaauucaauucuaaauauau

SEQ ID NO: 811872 - RNA, 21 nt, Human
uaucagaagagaaagaaugau

SEQ ID NO: 811873 - RNA, 22 nt, Human
uggauuuauuagguuggugaaa

SEQ ID NO: 811874 - RNA, 23 nt, Human
ucagaggaucaucaaacguuuuc

SEQ ID NO: 811875 - RNA, 22 nt, Human
agggcagcagcuccuccuagcu

SEQ ID NO: 811876 - RNA, 22 nt, Human
acuguuugcugauagauauuua

SEQ ID NO: 811877 - RNA, 22 nt, Human
ugccacaguuguuugugcucua

SEQ ID NO: 811878 - RNA, 17 nt, Human
aagagaggcugagcugg

SEQ ID NO: 811879 - RNA, 22 nt, Human
acaguacaaaacccaccagagg

SEQ ID NO: 811880 - RNA, 22 nt, Human
ugccagcagaaauaaauacuug

SEQ ID NO: 811881 - RNA, 22 nt, Human
agugcagauuuuuagucagcuu

SEQ ID NO: 811882 - RNA, 22 nt, Human
gcugucuccauagcuguguguc

SEQ ID NO: 811883 - RNA, 22 nt, Human
augggcaguaacaguggcaguc

SEQ ID NO: 811884 - RNA, 22 nt, Human
caaguuauuccuuuacacuaua

SEQ ID NO: 811885 - RNA, 22 nt, Human
agucagagcaaacuggacagac

SEQ ID NO: 811886 - RNA, 22 nt, Human
ggagaaggaagaaagcuacuau

SEQ ID NO: 811887 - RNA, 22 nt, Human
auaaauuuucuugcuguacuua

SEQ ID NO: 811888 - RNA, 22 nt, Human
uauuaauaugugugugcaugua

SEQ ID NO: 811889 - RNA, 22 nt, Human
agcaggcuacuccuguguucgu

SEQ ID NO: 811890 - RNA, 19 nt, Human
acuggcagcuguagucugu

SEQ ID NO: 811891 - RNA, 20 nt, Human
acuccugguaacuuuuguga

SEQ ID NO: 811892 - RNA, 22 nt, Human
uucucucuuccaguucccacuu

SEQ ID NO: 811893 - RNA, 22 nt, Human
cagggaugagcagauggagcaa

SEQ ID NO: 811894 - RNA, 22 nt, Human
aauggcuggguuucauuuugua

SEQ ID NO: 811895 - RNA, 20 nt, Human
ucagaggcugccagcugggg

SEQ ID NO: 811896 - RNA, 22 nt, Human
uguguauuaccauuuuacagcu

SEQ ID NO: 811897 - RNA, 22 nt, Human
ggacacaguggaagacagcuug

SEQ ID NO: 811898 - RNA, 22 nt, Human
gcagaaguggauucuacaauuu

SEQ ID NO: 811899 - RNA, 22 nt, Human
ggagaggcuuccagagucgugc

SEQ ID NO: 811900 - RNA, 22 nt, Human
caggcagacuuugagaaugaug

SEQ ID NO: 811901 - RNA, 22 nt, Human
caagacaauggguaaguguaac

SEQ ID NO: 811902 - RNA, 22 nt, Human
uauauauaugcacacacaccua

SEQ ID NO: 811903 - RNA, 22 nt, Human
uuuugccugcacuguauauaua

SEQ ID NO: 811904 - RNA, 22 nt, Human
ucuucucucauguaggagggaa

SEQ ID NO: 811905 - RNA, 22 nt, Human
cacagagcuggaaaggcugggc

SEQ ID NO: 811906 - RNA, 22 nt, Human
gagcuagcuucuuccagguuuc

SEQ ID NO: 811907 - RNA, 22 nt, Human
uucagugucacaagagcaagcc

SEQ ID NO: 811908 - RNA, 22 nt, Human
uagaaguuaggaaauaggaaua

SEQ ID NO: 811909 - RNA, 22 nt, Human
cacaggcacgccucuggccagg

SEQ ID NO: 811910 - RNA, 18 nt, Human
gccaggaagaggaaugug

SEQ ID NO: 811911 - RNA, 22 nt, Human
ggcccagcgaggccaccuacag

SEQ ID NO: 811912 - RNA, 23 nt, Human
uguuccagauacgccuuuuccuc

SEQ ID NO: 811913 - RNA, 22 nt, Human
caaaggccugagaacugagggg

SEQ ID NO: 811914 - RNA, 22 nt, Human
aaguaaaauucaaucuucacug

SEQ ID NO: 811915 - RNA, 22 nt, Human
auauauaaccuggauaaggcuu

SEQ ID NO: 811916 - RNA, 22 nt, Human
cguuguuugagauuuucagaau

SEQ ID NO: 811917 - RNA, 22 nt, Human
ggagugcuuugaagccuucauu

SEQ ID NO: 811918 - RNA, 22 nt, Human
ugauuuacacaucaaagcagca

SEQ ID NO: 811919 - RNA, 22 nt, Human
caguguuuguauagaauaugca

SEQ ID NO: 811920 - RNA, 22 nt, Human
ggcugccugaacuuuggggaaa

SEQ ID NO: 811921 - RNA, 22 nt, Human
auugcuucaacuguucaauggg

SEQ ID NO: 811922 - RNA, 22 nt, Human
uggcuucucccgacacccuggc

SEQ ID NO: 811923 - RNA, 22 nt, Human
cccucucagucagagccagaua

SEQ ID NO: 811924 - RNA, 22 nt, Human
ccucccucuguuagagcugucu

SEQ ID NO: 811925 - RNA, 22 nt, Human
ggacccugggcuugcuccuggg

SEQ ID NO: 811926 - RNA, 17 nt, Human
acacagggagagggagc

SEQ ID NO: 811927 - RNA, 22 nt, Human
acugcuuacaaaaggaaagaau

SEQ ID NO: 811928 - RNA, 22 nt, Human
caucuuaauuucuaacaggcac

SEQ ID NO: 811929 - RNA, 22 nt, Human
agcaggcagccuaggaagugaa

SEQ ID NO: 811930 - RNA, 21 nt, Human
agagagaaggccauauggucc

SEQ ID NO: 811931 - RNA, 22 nt, Human
gcuggagugcugaggugcagug

SEQ ID NO: 811932 - RNA, 22 nt, Human
ggcaguggaggacccugugucu

SEQ ID NO: 811933 - RNA, 22 nt, Human
ucuggcuccacucugugcaugc

SEQ ID NO: 811934 - RNA, 21 nt, Human
auccauccaucuuggccuaac

SEQ ID NO: 811935 - RNA, 22 nt, Human
auacaucucauguaagagauaa

SEQ ID NO: 811936 - RNA, 22 nt, Human
uagcuuguacugcaguagagaa

SEQ ID NO: 811937 - RNA, 22 nt, Human
aggacugggugcagagggcauc

SEQ ID NO: 811938 - RNA, 22 nt, Human
gagagaagggggauaugagccu

SEQ ID NO: 811939 - RNA, 22 nt, Human
acacagggucuagaguuaggcc

SEQ ID NO: 811940 - RNA, 22 nt, Human
uuuccacaucaccaugagguga

SEQ ID NO: 811941 - RNA, 22 nt, Human
gaacaauacaggcuuuauuccu

SEQ ID NO: 811942 - RNA, 22 nt, Human
ugcuggcugaggccugagcggg

SEQ ID NO: 811943 - RNA, 22 nt, Human
auuuguaucuucuaauauuauc

SEQ ID NO: 811944 - RNA, 22 nt, Human
ucugaggcccaguucaacucuu

SEQ ID NO: 811945 - RNA, 22 nt, Human
uugguuuuaucuuaagauucuu

SEQ ID NO: 811946 - RNA, 22 nt, Human
cuuuuguuaggagaaaacauca

SEQ ID NO: 811947 - RNA, 22 nt, Human
aaguuuuaacaaguacuuacua

SEQ ID NO: 811948 - RNA, 17 nt, Human
gauggggcugacaucag

SEQ ID NO: 811949 - RNA, 22 nt, Human
uuucauauuguccagucagcgc

SEQ ID NO: 811950 - RNA, 22 nt, Human
ggcaguguuccagaccuucacc

SEQ ID NO: 811951 - RNA, 22 nt, Human
augaaauauuucagagcagagu

SEQ ID NO: 811952 - RNA, 22 nt, Human
cucugcaccuacacaacaggaa

SEQ ID NO: 811953 - RNA, 22 nt, Human
acagagcuucccagccugagca

SEQ ID NO: 811954 - RNA, 22 nt, Human
agucagauuuaaagcuguuuga

SEQ ID NO: 811955 - RNA, 22 nt, Human
ccucaaguuggaaauaaaaugu

SEQ ID NO: 811956 - RNA, 22 nt, Human
cuacauuuuucaccgagccucu

SEQ ID NO: 811957 - RNA, 22 nt, Human
augcuucuguugcuuaggaggu

SEQ ID NO: 811958 - RNA, 19 nt, Human
gccugccagauaguaauga

SEQ ID NO: 811959 - RNA, 22 nt, Human
ucagugcuguguaaauguauua

SEQ ID NO: 811960 - RNA, 22 nt, Human
uugaacauuagaauaaguaauu

SEQ ID NO: 811961 - RNA, 22 nt, Human
uuuuuuccuucaugacuuaaga

SEQ ID NO: 811962 - RNA, 20 nt, Human
ucccuggggcccuacuuccu

SEQ ID NO: 811963 - RNA, 22 nt, Human
agcagcaguguguggucauguu

SEQ ID NO: 811964 - RNA, 22 nt, Human
gaggcuggagauauuccaaucu

SEQ ID NO: 811965 - RNA, 22 nt, Human
gcccagcacauugcugaggacc

SEQ ID NO: 811966 - RNA, 22 nt, Human
ggaacacaaaugggagagcugg

SEQ ID NO: 811967 - RNA, 22 nt, Human
cuuuuuacucuguugucucagc

SEQ ID NO: 811968 - RNA, 22 nt, Human
guuuucaugucuauugggcaua

SEQ ID NO: 811969 - RNA, 22 nt, Human
aaagaaguguugaauuugcaag

SEQ ID NO: 811970 - RNA, 22 nt, Human
ggacccagaggggagucuggca

SEQ ID NO: 811971 - RNA, 22 nt, Human
aaaugcugaguguuuagagauc

SEQ ID NO: 811972 - RNA, 22 nt, Human
uagcuuuguguaugaugucugu

SEQ ID NO: 811973 - RNA, 22 nt, Human
ucucagugggaagggcacaguu

SEQ ID NO: 811974 - RNA, 22 nt, Human
ugcaacaaggccucauuucuug

SEQ ID NO: 811975 - RNA, 22 nt, Human
acaaauagguagauuugcaaca

SEQ ID NO: 811976 - RNA, 22 nt, Human
ugcuucccucacuucaccuggc

SEQ ID NO: 811977 - RNA, 22 nt, Human
aggccucaugucaaagcagcaa

SEQ ID NO: 811978 - RNA, 17 nt, Human
gagcagggaugcgguuc

SEQ ID NO: 811979 - RNA, 21 nt, Human
cucagggcuugguguccucau

SEQ ID NO: 811980 - RNA, 22 nt, Human
ggucacccaugaucacaucacc

SEQ ID NO: 811981 - RNA, 22 nt, Human
ccugccugcguccucugagggc

SEQ ID NO: 811982 - RNA, 22 nt, Human
caguuucuguuuuaaauagcag

SEQ ID NO: 811983 - RNA, 19 nt, Human
gaauuuuaggacuucagca

SEQ ID NO: 811984 - RNA, 22 nt, Human
ugcaggcuuggaucacaucucc

SEQ ID NO: 811985 - RNA, 22 nt, Human
acuauaaaaggauaaaccagaa

SEQ ID NO: 811986 - RNA, 21 nt, Human
uucaagucucuaggacuucuc

SEQ ID NO: 811987 - RNA, 22 nt, Human
gggcaucugguggagccucagg

SEQ ID NO: 811988 - RNA, 22 nt, Human
uaagucauggagcugggauuga

SEQ ID NO: 811989 - RNA, 22 nt, Human
aggcugaggcaagaggaucacu

SEQ ID NO: 811990 - RNA, 22 nt, Human
gcauggcaaauaucgagggcag

SEQ ID NO: 811991 - RNA, 22 nt, Human
aaaaaucuaugacugcuucucc

SEQ ID NO: 811992 - RNA, 22 nt, Human
uuucccaacagucucucucaaa

SEQ ID NO: 811993 - RNA, 22 nt, Human
cuggggugagcagaaacagggg

SEQ ID NO: 811994 - RNA, 22 nt, Human
cccaggcacacugaagugacau

SEQ ID NO: 811995 - RNA, 22 nt, Human
gcucagagaguuucacaaguuu

SEQ ID NO: 811996 - RNA, 22 nt, Human
ugaggccacaggaaagggcccg

SEQ ID NO: 811997 - RNA, 22 nt, Human
gcuucccauaguggaauucggg

SEQ ID NO: 811998 - RNA, 22 nt, Human
uuuuauugucaaugaagacaga

SEQ ID NO: 811999 - RNA, 22 nt, Human
cagcagcaacaacggaagccuu

SEQ ID NO: 812000 - RNA, 22 nt, Human
uucauuugccaucaguguaaug

SEQ ID NO: 812001 - RNA, 22 nt, Human
ugcaggcuauccuuugcugcaa

SEQ ID NO: 812002 - RNA, 22 nt, Human
cugacuuuuuucagccacagug

SEQ ID NO: 812003 - RNA, 22 nt, Human
gcacauccaaugauuguuuuga

SEQ ID NO: 812004 - RNA, 22 nt, Human
cugggccaugggccagcgaggc

SEQ ID NO: 812005 - RNA, 22 nt, Human
ggcuccuggaggcaccacuggu

SEQ ID NO: 812006 - RNA, 23 nt, Human
auacauggccggauaugauguuc

SEQ ID NO: 812007 - RNA, 22 nt, Human
guaaaaaggccaagcccuugug

SEQ ID NO: 812008 - RNA, 22 nt, Human
acuuuguuuggcuauuagaguc

SEQ ID NO: 812009 - RNA, 17 nt, Human
aggcuggcucacaggga

SEQ ID NO: 812010 - RNA, 22 nt, Human
ucaggaaauggcuucaugguuu

SEQ ID NO: 812011 - RNA, 22 nt, Human
aucuaugugccuuuguauagaa

SEQ ID NO: 812012 - RNA, 22 nt, Human
gggaaaggauuuacaguuugau

SEQ ID NO: 812013 - RNA, 22 nt, Human
aaggcagggaaaguggauuagg

SEQ ID NO: 812014 - RNA, 22 nt, Human
uuucugugaauuauaaaauuug

SEQ ID NO: 812015 - RNA, 22 nt, Human
uuuuauaaagagagucaguugg

SEQ ID NO: 812016 - RNA, 22 nt, Human
aggaggccgcugaugggcuccc

SEQ ID NO: 812017 - RNA, 22 nt, Human
ggaggggagucucccaaagccg

SEQ ID NO: 812018 - RNA, 22 nt, Human
auugucuuggaaccaaggucuu

SEQ ID NO: 812019 - RNA, 22 nt, Human
uauuuuacagacuacuuuagau

SEQ ID NO: 812020 - RNA, 22 nt, Human
ccuggcugagccuccaggaaga

SEQ ID NO: 812021 - RNA, 22 nt, Human
uugcauguaugugaucuguuca

SEQ ID NO: 812022 - RNA, 22 nt, Human
ucaugcaaggcugaaacauggu

SEQ ID NO: 812023 - RNA, 22 nt, Human
gggcagugacaaaggggaugaa

SEQ ID NO: 812024 - RNA, 22 nt, Human
gaggcuggacgugcauuucuac

SEQ ID NO: 812025 - RNA, 22 nt, Human
uuccggaagguucucuagaauu

SEQ ID NO: 812026 - RNA, 22 nt, Human
ggcacuggguuguaggaauuaa

SEQ ID NO: 812027 - RNA, 22 nt, Human
ucuaaacuaggguuaaaggaaa

SEQ ID NO: 812028 - RNA, 22 nt, Human
aucugggagacccuugcgggaa

SEQ ID NO: 812029 - RNA, 22 nt, Human
gaaauagacacuuucuaugaau

SEQ ID NO: 812030 - RNA, 22 nt, Human
uugguuuucuauccucugcaau

SEQ ID NO: 812031 - RNA, 22 nt, Human
aguaaggcaaugccacuaagau

SEQ ID NO: 812032 - RNA, 18 nt, Human
agccugggcucugccugg

SEQ ID NO: 812033 - RNA, 21 nt, Human
aaguaaaucagagaaauaacc

SEQ ID NO: 812034 - RNA, 22 nt, Human
gcccugagcacugcugcugggg

SEQ ID NO: 812035 - RNA, 22 nt, Human
uguuuacagcugaucaggcauc

SEQ ID NO: 812036 - RNA, 22 nt, Human
gcaauaaaauguaaugauuggg

SEQ ID NO: 812037 - RNA, 22 nt, Human
agcaaauauuuuguugaagugc

SEQ ID NO: 812038 - RNA, 22 nt, Human
uauuuauucauucagcaagcau

SEQ ID NO: 812039 - RNA, 22 nt, Human
gagugucacuugaugcagggca

SEQ ID NO: 812040 - RNA, 22 nt, Human
ucacauacacuaggauauuuuu

SEQ ID NO: 812041 - RNA, 20 nt, Human
uggugagagcaccugauggg

SEQ ID NO: 812042 - RNA, 22 nt, Human
caggucuggcaucagcugugug

SEQ ID NO: 812043 - RNA, 18 nt, Human
gagaggagccagaauuuu

SEQ ID NO: 812044 - RNA, 22 nt, Human
acagauaaagaaacaaucacag

SEQ ID NO: 812045 - RNA, 22 nt, Human
uggcagauacccaggcaaaugg

SEQ ID NO: 812046 - RNA, 22 nt, Human
agaggaaacauagguuuuuaaa

SEQ ID NO: 812047 - RNA, 22 nt, Human
ucaggacacuuggcacaagguc

SEQ ID NO: 812048 - RNA, 22 nt, Human
acuacacagggaugugacuacc

SEQ ID NO: 812049 - RNA, 22 nt, Human
uccaggagucagacagauggug

SEQ ID NO: 812050 - RNA, 22 nt, Human
ccaggagcuauguacacacuau

SEQ ID NO: 812051 - RNA, 22 nt, Human
cauuacuucucaugcuucaugc

SEQ ID NO: 812052 - RNA, 22 nt, Human
cuggcugcaggaugaggcugcc

SEQ ID NO: 812053 - RNA, 22 nt, Human
aguucccuggaugagcuaaaaa

SEQ ID NO: 812054 - RNA, 22 nt, Human
uuuccucuccggggccuccagg

SEQ ID NO: 812055 - RNA, 22 nt, Human
gcaugcaaaaaauguauuuguu

SEQ ID NO: 812056 - RNA, 22 nt, Human
caggaaaugaaagcuagcuaau

SEQ ID NO: 812057 - RNA, 22 nt, Human
agcaaggcuaaauuucaguuau

SEQ ID NO: 812058 - RNA, 22 nt, Human
ugggaggcuuccagaccuugcu

SEQ ID NO: 812059 - RNA, 22 nt, Human
aguccuggguccagcagguccu

SEQ ID NO: 812060 - RNA, 22 nt, Human
augcaacaauguauuuauguau

SEQ ID NO: 812061 - RNA, 22 nt, Human
cagccuccugggacacucaccg

SEQ ID NO: 812062 - RNA, 22 nt, Human
cacugcacaauguagcaaagaa

SEQ ID NO: 812063 - RNA, 21 nt, Human
ccccauggaguacaguugggc

SEQ ID NO: 812064 - RNA, 22 nt, Human
caggaggcccacaggccccugc

SEQ ID NO: 812065 - RNA, 22 nt, Human
gcucccacugcagcccugagcc

SEQ ID NO: 812066 - RNA, 22 nt, Human
ggcaggugcaccugagccaucu

SEQ ID NO: 812067 - RNA, 22 nt, Human
agggaccagccugcccagggcu

SEQ ID NO: 812068 - RNA, 22 nt, Human
aauggcacuuuauaaauguuaa

SEQ ID NO: 812069 - RNA, 19 nt, Human
uguuuacauguuucuucag

SEQ ID NO: 812070 - RNA, 22 nt, Human
guggcagguuccguagacagca

SEQ ID NO: 812071 - RNA, 22 nt, Human
uggcccagaucucugaccuuga

SEQ ID NO: 812072 - RNA, 22 nt, Human
cugggaccagugaagcaacuca

SEQ ID NO: 812073 - RNA, 22 nt, Human
aagaguuugucagaucugcacg

SEQ ID NO: 812074 - RNA, 22 nt, Human
uguagugaggaaagacugguug

SEQ ID NO: 812075 - RNA, 22 nt, Human
auggagucuacaaaguguugga

SEQ ID NO: 812076 - RNA, 22 nt, Human
agagaaaagaguucaggcuuug

SEQ ID NO: 812077 - RNA, 22 nt, Human
agcaggaguuugaugcuuuuau

SEQ ID NO: 812078 - RNA, 22 nt, Human
acauuugauaauuauaaagaca

SEQ ID NO: 812079 - RNA, 21 nt, Human
ugaagccugaggcauagcccc

SEQ ID NO: 812080 - RNA, 22 nt, Human
aggagccugaaucagaggguga

SEQ ID NO: 812081 - RNA, 22 nt, Human
cacaggagagcugggaggugcc

SEQ ID NO: 812082 - RNA, 22 nt, Human
cagagauggggccagcugcucc

SEQ ID NO: 812083 - RNA, 22 nt, Human
aucccagauggaggcuggucac

SEQ ID NO: 812084 - RNA, 20 nt, Human
gcugggggugugcugaguga

SEQ ID NO: 812085 - RNA, 22 nt, Human
ucucauuuggcuuuguuuuaaa

SEQ ID NO: 812086 - RNA, 22 nt, Human
uccucaggaugugggguagaau

SEQ ID NO: 812087 - RNA, 22 nt, Human
agugcuggcccauagcugcugg

SEQ ID NO: 812088 - RNA, 22 nt, Human
uuacagaguucgcaccuggugg

SEQ ID NO: 812089 - RNA, 22 nt, Human
caggaaugggugacagucagcu

SEQ ID NO: 812090 - RNA, 22 nt, Human
gaccacagguaugggcuuggca

SEQ ID NO: 812091 - RNA, 22 nt, Human
ugucugaguggugcaaggcuga

SEQ ID NO: 812092 - RNA, 22 nt, Human
uggcuggagaacuuggggaucu

SEQ ID NO: 812093 - RNA, 22 nt, Human
acagaugagacuccaggaccuu

SEQ ID NO: 812094 - RNA, 23 nt, Human
gccucugcucugcguuggggacu

SEQ ID NO: 812095 - RNA, 22 nt, Human
ugcauuaagugucugcauaugg

SEQ ID NO: 812096 - RNA, 22 nt, Human
cucagagagguugaacaacuug

SEQ ID NO: 812097 - RNA, 22 nt, Human
ccugccucaucaacuugucgug

SEQ ID NO: 812098 - RNA, 22 nt, Human
agcccugagcuggccugggcuu

SEQ ID NO: 812099 - RNA, 22 nt, Human
augcacauguaucuauauacaa

SEQ ID NO: 812100 - RNA, 22 nt, Human
gaaaguauuagccuagaaguca

SEQ ID NO: 812101 - RNA, 20 nt, Human
ucaauuuucuacaacauuug

SEQ ID NO: 812102 - RNA, 22 nt, Human
aaacuacuggauuaguaacuua

SEQ ID NO: 812103 - RNA, 22 nt, Human
cagcuguccuuccuggugggcg

SEQ ID NO: 812104 - RNA, 22 nt, Human
cagagggcacaugguuuccuca

SEQ ID NO: 812105 - RNA, 22 nt, Human
cuacauuucauccagggagagc

SEQ ID NO: 812106 - RNA, 22 nt, Human
uguaaguagaacaacauaaucu

SEQ ID NO: 812107 - RNA, 22 nt, Human
agccucuggcccuagacugcuu

SEQ ID NO: 812108 - RNA, 22 nt, Human
uaaacugcuucucucagucugu

SEQ ID NO: 812109 - RNA, 22 nt, Human
ccaggagcaggagcugcagcug

SEQ ID NO: 812110 - RNA, 22 nt, Human
ucaggcuggggugcuaaggugu

SEQ ID NO: 812111 - RNA, 22 nt, Human
gaaaccucuuagccucucuuug

SEQ ID NO: 812112 - RNA, 22 nt, Human
cagaggcacagugcgggccacu

SEQ ID NO: 812113 - RNA, 22 nt, Human
ccaucaguggcaaauaaacacc

SEQ ID NO: 812114 - RNA, 22 nt, Human
cagauaugcugagacuccugug

SEQ ID NO: 812115 - RNA, 22 nt, Human
agaggcucuggugcagcaugca

SEQ ID NO: 812116 - RNA, 22 nt, Human
ucuggcugcaccauuauaguag

SEQ ID NO: 812117 - RNA, 22 nt, Human
gggccugccauugcugccccag

SEQ ID NO: 812118 - RNA, 22 nt, Human
caaagacacgggaaacaacguu

SEQ ID NO: 812119 - RNA, 22 nt, Human
ucugccuccugcuugucccgac

SEQ ID NO: 812120 - RNA, 22 nt, Human
gacagcuguacacuccugguua

SEQ ID NO: 812121 - RNA, 22 nt, Human
cgcagcagccccgugguaggug

SEQ ID NO: 812122 - RNA, 22 nt, Human
aagccaguggcuucucccugcu

SEQ ID NO: 812123 - RNA, 22 nt, Human
aaagugcauagaguagugccua

SEQ ID NO: 812124 - RNA, 22 nt, Human
ggcuagggacuccuccucaggg

SEQ ID NO: 812125 - RNA, 22 nt, Human
uucuuuaucaguuacucauagg

SEQ ID NO: 812126 - RNA, 22 nt, Human
uggguggagcuccacaaccugu

SEQ ID NO: 812127 - RNA, 22 nt, Human
ugccugggugcccucugcuccu

SEQ ID NO: 812128 - RNA, 22 nt, Human
caaacauuuguuggaaccccug

SEQ ID NO: 812129 - RNA, 22 nt, Human
uucaguguggaaugugaacugc

SEQ ID NO: 812130 - RNA, 22 nt, Human
aguccagaccccggcagcuggu

SEQ ID NO: 812131 - RNA, 19 nt, Human
cuacuuuauaauaugccuc

SEQ ID NO: 812132 - RNA, 22 nt, Human
aacuucauuuauaaugucauua

SEQ ID NO: 812133 - RNA, 19 nt, Human
aggcagcaggccagggaug

SEQ ID NO: 812134 - RNA, 22 nt, Human
ggcaggcugggugucauggagu

SEQ ID NO: 812135 - RNA, 22 nt, Human
uugaaugaauuugagcagagau

SEQ ID NO: 812136 - RNA, 22 nt, Human
aagcuuuggagaggcgggcagg

SEQ ID NO: 812137 - RNA, 22 nt, Human
uauguugagugaaagaagcuag

SEQ ID NO: 812138 - RNA, 22 nt, Human
agccuggcuuaauccuccuuuu

SEQ ID NO: 812139 - RNA, 22 nt, Human
gaaggaaaacagaucugccuga

SEQ ID NO: 812140 - RNA, 21 nt, Human
uccucugcagugagguggccu

SEQ ID NO: 812141 - RNA, 22 nt, Human
cagagccauaaaggugaaagag

SEQ ID NO: 812142 - RNA, 22 nt, Human
agagaaggguguagccugggcc

SEQ ID NO: 812143 - RNA, 22 nt, Human
aagcugaagccggaucaaaaag

SEQ ID NO: 812144 - RNA, 22 nt, Human
acaguguaugauauuucacagu

SEQ ID NO: 812145 - RNA, 22 nt, Human
ggggucacacuguggugacugg

SEQ ID NO: 812146 - RNA, 19 nt, Human
agggccaggauucuggaac

SEQ ID NO: 812147 - RNA, 22 nt, Human
uagccacaugcagacuuucaug

SEQ ID NO: 812148 - RNA, 23 nt, Human
ccagugauugccuggaaggaggu

SEQ ID NO: 812149 - RNA, 22 nt, Human
augcagcugcugacagcuuuca

SEQ ID NO: 812150 - RNA, 19 nt, Human
ugcuggagugacauucuga

SEQ ID NO: 812151 - RNA, 22 nt, Human
ucagccucauuuucugcucugu

SEQ ID NO: 812152 - RNA, 22 nt, Human
aggcagugcugugcccugaacc

SEQ ID NO: 812153 - RNA, 22 nt, Human
uaggaaauacuguaaguuuggg

SEQ ID NO: 812154 - RNA, 22 nt, Human
cuuugcagauuuguuuagugcu

SEQ ID NO: 812155 - RNA, 23 nt, Human
agcuucauuauuuuccaugaucu

SEQ ID NO: 812156 - RNA, 22 nt, Human
cccuccagccauggacccaggu

SEQ ID NO: 812157 - RNA, 22 nt, Human
acuucugagaaauuuaaggaca

SEQ ID NO: 812158 - RNA, 22 nt, Human
aggccugagcagaggaguggac

SEQ ID NO: 812159 - RNA, 19 nt, Human
cucagagaggggcagugcc

SEQ ID NO: 812160 - RNA, 22 nt, Human
acaaugaugcagaugaguaaga

SEQ ID NO: 812161 - RNA, 22 nt, Human
gcagggcgcguuugagcgggcu

SEQ ID NO: 812162 - RNA, 22 nt, Human
ccugcagcuguaggagaaggcg

SEQ ID NO: 812163 - RNA, 22 nt, Human
aagugauuuuccuacuugcuaa

SEQ ID NO: 812164 - RNA, 22 nt, Human
uuaugauuuagaaagauucacu

SEQ ID NO: 812165 - RNA, 22 nt, Human
agcugcugguuuaagggauggg

SEQ ID NO: 812166 - RNA, 22 nt, Human
aguagaaagaaggcacugggcc

SEQ ID NO: 812167 - RNA, 22 nt, Human
ugccucccucucugccacugga

SEQ ID NO: 812168 - RNA, 22 nt, Human
gccuggagccucagcaaggagg

SEQ ID NO: 812169 - RNA, 22 nt, Human
ccccaugaaguagggucucuga

SEQ ID NO: 812170 - RNA, 22 nt, Human
auacagaagccuguauuucugg

SEQ ID NO: 812171 - RNA, 22 nt, Human
uaugcaacaucugguagaaauc

SEQ ID NO: 812172 - RNA, 22 nt, Human
caugguacugccacagaagagu

SEQ ID NO: 812173 - RNA, 22 nt, Human
ucaaacaugaaagcuugauuuu

SEQ ID NO: 812174 - RNA, 22 nt, Human
caggcauggaaaagcccagagg

SEQ ID NO: 812175 - RNA, 22 nt, Human
uccaaggacgcuggaccccugc

SEQ ID NO: 812176 - RNA, 22 nt, Human
uugauucauggacaggccaggu

SEQ ID NO: 812177 - RNA, 22 nt, Human
gcacagggaggcuggccuggcc

SEQ ID NO: 812178 - RNA, 22 nt, Human
acauagcucaguaucacuuacu

SEQ ID NO: 812179 - RNA, 22 nt, Human
gcacugggcuccaggaaggagg

SEQ ID NO: 812180 - RNA, 22 nt, Human
cagcuggcaaguggagcagggu

SEQ ID NO: 812181 - RNA, 17 nt, Human
guccugggaggagagag

SEQ ID NO: 812182 - RNA, 22 nt, Human
uuuccuacccuuccaggcagag

SEQ ID NO: 812183 - RNA, 22 nt, Human
acucucccuuggagccucaggc

SEQ ID NO: 812184 - RNA, 22 nt, Human
uaaggcucccuuugccacuugu

SEQ ID NO: 812185 - RNA, 22 nt, Human
guggcccacuuacgucaugugu

SEQ ID NO: 812186 - RNA, 22 nt, Human
uauuugcaggcuuuugucaugg

SEQ ID NO: 812187 - RNA, 22 nt, Human
gcugccuguugaagggucugug

SEQ ID NO: 812188 - RNA, 22 nt, Human
gccaggaggcugcuguguaggc

SEQ ID NO: 812189 - RNA, 22 nt, Human
gcugauuuugucacauagcaag

SEQ ID NO: 812190 - RNA, 23 nt, Human
ggugguggugagucacgggcuca

SEQ ID NO: 812191 - RNA, 22 nt, Human
gcagauggaucaccugaggucg

SEQ ID NO: 812192 - RNA, 19 nt, Human
uucauucucuuauuguugu

SEQ ID NO: 812193 - RNA, 22 nt, Human
aguugaaauuagaguccuggcu

SEQ ID NO: 812194 - RNA, 17 nt, Human
cagugaucauuacauua

SEQ ID NO: 812195 - RNA, 22 nt, Human
aaaacacugcaaagcugauugg

SEQ ID NO: 812196 - RNA, 22 nt, Human
uccugccuucauacugcuguau

SEQ ID NO: 812197 - RNA, 22 nt, Human
uccugagaugagacagugcugc

SEQ ID NO: 812198 - RNA, 22 nt, Human
gggaggagcugagugugugugc

SEQ ID NO: 812199 - RNA, 21 nt, Human
gccagugcugucugugugauc

SEQ ID NO: 812200 - RNA, 22 nt, Human
agccaagacauuuagaaaagcu

SEQ ID NO: 812201 - RNA, 22 nt, Human
ccuggcugcauuuugcuggaug

SEQ ID NO: 812202 - RNA, 22 nt, Human
acugcaacaccuccuggguuca

SEQ ID NO: 812203 - RNA, 22 nt, Human
auagcaaaggacaauagucagu

SEQ ID NO: 812204 - RNA, 22 nt, Human
uacaaacuguccagcccagagg

SEQ ID NO: 812205 - RNA, 22 nt, Human
aaguugagaugucauaggagac

SEQ ID NO: 812206 - RNA, 20 nt, Human
cuccagccccugcccugguc

SEQ ID NO: 812207 - RNA, 22 nt, Human
aaaugcagguaguauuuauuuu

SEQ ID NO: 812208 - RNA, 23 nt, Human
uucaaagcuuaagcucuuuccac

SEQ ID NO: 812209 - RNA, 22 nt, Human
cagcugauuugagaaagaauga

SEQ ID NO: 812210 - RNA, 22 nt, Human
uguaugcauaaaauuauuuaca

SEQ ID NO: 812211 - RNA, 22 nt, Human
gggaccagaagaaggaugguga

SEQ ID NO: 812212 - RNA, 22 nt, Human
ugaaaugaucaguuugguuacu

SEQ ID NO: 812213 - RNA, 22 nt, Human
uguuucaaguuugcucaaagga

SEQ ID NO: 812214 - RNA, 22 nt, Human
gcugagcugggacaguccuggg

SEQ ID NO: 812215 - RNA, 23 nt, Human
aggcagugucucuuauccugucc

SEQ ID NO: 812216 - RNA, 22 nt, Human
gaagauuuuucuuaaugcuccg

SEQ ID NO: 812217 - RNA, 22 nt, Human
uccucagaagaaccccuagauu

SEQ ID NO: 812218 - RNA, 22 nt, Human
gaggagcuugaggcuaggagcc

SEQ ID NO: 812219 - RNA, 22 nt, Human
acuggcaguggcagcagaaaga

SEQ ID NO: 812220 - RNA, 22 nt, Human
aucugacaucucccucugacau

SEQ ID NO: 812221 - RNA, 22 nt, Human
gaauuugaaaagugaugggaau

SEQ ID NO: 812222 - RNA, 22 nt, Human
ugucugaaggcagguggagaac

SEQ ID NO: 812223 - RNA, 22 nt, Human
aaaccauuagguuuuaucuacu

SEQ ID NO: 812224 - RNA, 22 nt, Human
aagaggaacugggggcugaguc

SEQ ID NO: 812225 - RNA, 22 nt, Human
ggguccagagccucagcccaga

SEQ ID NO: 812226 - RNA, 22 nt, Human
ccaggcugagcaugauuggagc

SEQ ID NO: 812227 - RNA, 22 nt, Human
agcugggaagaguuuucugcag

SEQ ID NO: 812228 - RNA, 22 nt, Human
ggcuguggucucaucuagccuu

SEQ ID NO: 812229 - RNA, 22 nt, Human
uuuagucauuuggauuugaucu

SEQ ID NO: 812230 - RNA, 22 nt, Human
gggcacuucuaagcauggggcu

SEQ ID NO: 812231 - RNA, 22 nt, Human
caccugcccagcaccugggauc

SEQ ID NO: 812232 - RNA, 22 nt, Human
agcagggcuccugaaagccgcg

SEQ ID NO: 812233 - RNA, 22 nt, Human
aacuuaaacccacucauguaga

SEQ ID NO: 812234 - RNA, 22 nt, Human
cuaaacaugcaagagcuucugg

SEQ ID NO: 812235 - RNA, 22 nt, Human
cugcuguccaggagugcccugu

SEQ ID NO: 812236 - RNA, 22 nt, Human
aaccucaaacucuugggcuuaa

SEQ ID NO: 812237 - RNA, 22 nt, Human
guuuuauaggcuguugcuauau

SEQ ID NO: 812238 - RNA, 22 nt, Human
ccugcugggccugagcaaugag

SEQ ID NO: 812239 - RNA, 20 nt, Human
augaguuuaaacauucagag

SEQ ID NO: 812240 - RNA, 22 nt, Human
aaggcugguuuccuugauguuu

SEQ ID NO: 812241 - RNA, 18 nt, Human
gggugcaggcacugacug

SEQ ID NO: 812242 - RNA, 22 nt, Human
cuauuaaauacucuucaaauug

SEQ ID NO: 812243 - RNA, 22 nt, Human
ccugacaggagaagcgcagcau

SEQ ID NO: 812244 - RNA, 20 nt, Human
auggaggaagggcaagagaa

SEQ ID NO: 812245 - RNA, 22 nt, Human
ggcuagggaaauccugauccaa

SEQ ID NO: 812246 - RNA, 22 nt, Human
cuggcucacaggugagaugcau

SEQ ID NO: 812247 - RNA, 22 nt, Human
aggcaguggcugagaccagggg

SEQ ID NO: 812248 - RNA, 22 nt, Human
uugauucaucuucuaauaccca

SEQ ID NO: 812249 - RNA, 22 nt, Human
uccugcuggaauggaaaaugaa

SEQ ID NO: 812250 - RNA, 22 nt, Human
augcuauguaacuggcagauag

SEQ ID NO: 812251 - RNA, 22 nt, Human
aacuucuaaucuguacaguuuu

SEQ ID NO: 812252 - RNA, 22 nt, Human
gcaaacauucaggaguacagga

SEQ ID NO: 812253 - RNA, 22 nt, Human
cuugcuguugugggagacuggg

SEQ ID NO: 812254 - RNA, 22 nt, Human
uuugauaauacacaagagaaag

SEQ ID NO: 812255 - RNA, 22 nt, Human
gcugccucuguagcuuuggacc

SEQ ID NO: 812256 - RNA, 22 nt, Human
cagcacaguuucccccaugagc

SEQ ID NO: 812257 - RNA, 22 nt, Human
cugccucucaggucccugagau

SEQ ID NO: 812258 - RNA, 22 nt, Human
uagggcuggcgugcucagggaa

SEQ ID NO: 812259 - RNA, 22 nt, Human
uugggguguucaggguacuucu

SEQ ID NO: 812260 - RNA, 22 nt, Human
aaggcuccgugacuggggcuga

SEQ ID NO: 812261 - RNA, 22 nt, Human
ugaagcaguuacuggguguuaa

SEQ ID NO: 812262 - RNA, 22 nt, Human
uagagcaguuggcagcuguauu

SEQ ID NO: 812263 - RNA, 22 nt, Human
ccaccaugggaagagagacuaa

SEQ ID NO: 812264 - RNA, 22 nt, Human
acuuguaaacaaaucuaaugua

SEQ ID NO: 812265 - RNA, 22 nt, Human
acagugugguuguuucugguua

SEQ ID NO: 812266 - RNA, 22 nt, Human
gggcccugaucugugagcgcag

SEQ ID NO: 812267 - RNA, 22 nt, Human
uuucaaguggcgagauaaggaa

SEQ ID NO: 812268 - RNA, 22 nt, Human
uaauuuuaugacaguguauuuu

SEQ ID NO: 812269 - RNA, 18 nt, Human
aaaggcagauuacuggga

SEQ ID NO: 812270 - RNA, 22 nt, Human
cuguauuuaguuaaaaugcuaa

SEQ ID NO: 812271 - RNA, 22 nt, Human
uccagcucuaaggcugauagcc

SEQ ID NO: 812272 - RNA, 22 nt, Human
agguagggcuaggcugcgucug

SEQ ID NO: 812273 - RNA, 22 nt, Human
gaaaaagugaccuugguagcua

SEQ ID NO: 812274 - RNA, 22 nt, Human
cacacaaauauucuggaggcaa

SEQ ID NO: 812275 - RNA, 20 nt, Human
gucagaggacccuagagcga

SEQ ID NO: 812276 - RNA, 22 nt, Human
cauggcugcgagaagagugggu

SEQ ID NO: 812277 - RNA, 22 nt, Human
ugaguuuaaugauauuuauaug

SEQ ID NO: 812278 - RNA, 22 nt, Human
aaucagaaaggcuaaggaagca

SEQ ID NO: 812279 - RNA, 22 nt, Human
cuggaagugggguuggcuugaa

SEQ ID NO: 812280 - RNA, 22 nt, Human
agagguggccaugggcgcugga

SEQ ID NO: 812281 - RNA, 22 nt, Human
aggguccaucaaggacugcaca

SEQ ID NO: 812282 - RNA, 22 nt, Human
cagaggaagagauacaagcccu

SEQ ID NO: 812283 - RNA, 22 nt, Human
cuggagagggagcccuggcagu

SEQ ID NO: 812284 - RNA, 22 nt, Human
agcaggcaccagggcucguccu

SEQ ID NO: 812285 - RNA, 22 nt, Human
ugcuggcuguucuagggaggcc

SEQ ID NO: 812286 - RNA, 22 nt, Human
agucaauauucaaguguaaaua

SEQ ID NO: 812287 - RNA, 22 nt, Human
agccagcuguggcuauggcucc

SEQ ID NO: 812288 - RNA, 22 nt, Human
uucaauaugauauuagcugugg

SEQ ID NO: 812289 - RNA, 18 nt, Human
uauauucugugcccuggu

SEQ ID NO: 812290 - RNA, 22 nt, Human
guggcagggugcucaucaugca

SEQ ID NO: 812291 - RNA, 22 nt, Human
gaacacagaagaauuucuaaga

SEQ ID NO: 812292 - RNA, 22 nt, Human
acagucuucaugcuagaauggc

SEQ ID NO: 812293 - RNA, 22 nt, Human
gcugcuggaagcaugcgaugaa

SEQ ID NO: 812294 - RNA, 19 nt, Human
ccucugccagcccgccucu

SEQ ID NO: 812295 - RNA, 22 nt, Human
uuacacaugcuuuguguguaug

SEQ ID NO: 812296 - RNA, 22 nt, Human
acacauuuucuaacagggauca

SEQ ID NO: 812297 - RNA, 22 nt, Human
auugaaaaaugacuauugcuua

SEQ ID NO: 812298 - RNA, 22 nt, Human
ccagagaggccuuggcaagaca

SEQ ID NO: 812299 - RNA, 22 nt, Human
cuuuacaaccuaaguugaagcu

SEQ ID NO: 812300 - RNA, 22 nt, Human
uucccucuuucacugugauuuu

SEQ ID NO: 812301 - RNA, 22 nt, Human
aagggggccacaccugguguga

SEQ ID NO: 812302 - RNA, 22 nt, Human
gccaguaagugguagaguugag

SEQ ID NO: 812303 - RNA, 22 nt, Human
cuguauuuucaugccuacguac

SEQ ID NO: 812304 - RNA, 22 nt, Human
ugcagcuggaacuuagaggaga

SEQ ID NO: 812305 - RNA, 22 nt, Human
uggggcuguccuuagucugaga

SEQ ID NO: 812306 - RNA, 22 nt, Human
ggcaccuggauguagcagugaa

SEQ ID NO: 812307 - RNA, 22 nt, Human
acaggcaggcgggacagcccga

SEQ ID NO: 812308 - RNA, 22 nt, Human
gauaaacuuguggaguuuuggu

SEQ ID NO: 812309 - RNA, 19 nt, Human
uguggggagucagggggcu

SEQ ID NO: 812310 - RNA, 22 nt, Human
acugccuggccuggccucacug

SEQ ID NO: 812311 - RNA, 22 nt, Human
ugccuuugcaauugaggaggau

SEQ ID NO: 812312 - RNA, 22 nt, Human
aauuucacuggaaaagauaauu

SEQ ID NO: 812313 - RNA, 22 nt, Human
uuugauaguugauuaaauucca

SEQ ID NO: 812314 - RNA, 22 nt, Human
ggaccaggcugagcaccugccu

SEQ ID NO: 812315 - RNA, 19 nt, Human
ucugggguguggccuggca

SEQ ID NO: 812316 - RNA, 22 nt, Human
acaggaugggcgcacagagcua

SEQ ID NO: 812317 - RNA, 22 nt, Human
aacauucucauugggauaugug

SEQ ID NO: 812318 - RNA, 22 nt, Human
auaccuuuuacucauuauccau

SEQ ID NO: 812319 - RNA, 22 nt, Human
gagcaggccagcaauggaaggg

SEQ ID NO: 812320 - RNA, 22 nt, Human
caggaaaaaugccaggagucag

SEQ ID NO: 812321 - RNA, 22 nt, Human
aagggcagaauagagaagaugg

SEQ ID NO: 812322 - RNA, 22 nt, Human
ucauuauagaguuguauuuuag

SEQ ID NO: 812323 - RNA, 22 nt, Human
cucagacugguggguaaaaccu

SEQ ID NO: 812324 - RNA, 22 nt, Human
gagggcagugaauuuugaagcu

SEQ ID NO: 812325 - RNA, 22 nt, Human
ugcacagggagggggccagcuc

SEQ ID NO: 812326 - RNA, 22 nt, Human
uuuccuucaucaucugagagcu

SEQ ID NO: 812327 - RNA, 22 nt, Human
ucaaguaugacaucaaguuucu

SEQ ID NO: 812328 - RNA, 22 nt, Human
gagaggagaagccugcgcuuca

SEQ ID NO: 812329 - RNA, 22 nt, Human
ugagccagucugucugggugaa

SEQ ID NO: 812330 - RNA, 22 nt, Human
cccagggauguggcagauguua

SEQ ID NO: 812331 - RNA, 22 nt, Human
auguuacauaguccuuauuugu

SEQ ID NO: 812332 - RNA, 22 nt, Human
ugucucugugcauuugugcuuc

SEQ ID NO: 812333 - RNA, 22 nt, Human
auauauuugagaauauucauga

SEQ ID NO: 812334 - RNA, 22 nt, Human
ccagccuucaccugcucugguc

SEQ ID NO: 812335 - RNA, 22 nt, Human
agaacauuugucgaucaauuug

SEQ ID NO: 812336 - RNA, 22 nt, Human
uacaauuacucagcucugcugu

SEQ ID NO: 812337 - RNA, 22 nt, Human
cugcccucgggcccucccauag

SEQ ID NO: 812338 - RNA, 22 nt, Human
ccagagcagggcagcagggcuc

SEQ ID NO: 812339 - RNA, 22 nt, Human
gaagccaacauuccaaguagaa

SEQ ID NO: 812340 - RNA, 22 nt, Human
ggagcccagguuguuugugcag

SEQ ID NO: 812341 - RNA, 22 nt, Human
uggccacuccucccugcaggcu

SEQ ID NO: 812342 - RNA, 22 nt, Human
agcuggagaauguggaugaucc

SEQ ID NO: 812343 - RNA, 22 nt, Human
uagucagacccaagagagccau

SEQ ID NO: 812344 - RNA, 22 nt, Human
agauauuaaucguacauaaggu

SEQ ID NO: 812345 - RNA, 22 nt, Human
gccagcccagcuccaggggaaa

SEQ ID NO: 812346 - RNA, 22 nt, Human
cucugcaggcacccaggguggg

SEQ ID NO: 812347 - RNA, 22 nt, Human
uagcuugucagugaauagcugu

SEQ ID NO: 812348 - RNA, 22 nt, Human
ccuggcaggcuggggacagugc

SEQ ID NO: 812349 - RNA, 22 nt, Human
acccagcccagaaucuggggcc

SEQ ID NO: 812350 - RNA, 22 nt, Human
ugcaaaaugacuucugaaaaga

SEQ ID NO: 812351 - RNA, 22 nt, Human
ugccagggcugcuacuggcuga

SEQ ID NO: 812352 - RNA, 22 nt, Human
ggcaggugaucuagagucaaua

SEQ ID NO: 812353 - RNA, 22 nt, Human
cauuuucagcacccaucugaaa

SEQ ID NO: 812354 - RNA, 22 nt, Human
aagcugaggcccauggcaaggu

SEQ ID NO: 812355 - RNA, 22 nt, Human
uuucaaguuguuuauauccaga

SEQ ID NO: 812356 - RNA, 22 nt, Human
accuuuccaaguaucagguggu

SEQ ID NO: 812357 - RNA, 22 nt, Human
uggcuggcccugggagugcaga

SEQ ID NO: 812358 - RNA, 22 nt, Human
cugcaauaguuuagaauaauug

SEQ ID NO: 812359 - RNA, 22 nt, Human
uggagggaacccaggcugcucu

SEQ ID NO: 812360 - RNA, 22 nt, Human
uuugucuuggccucaguuuucu

SEQ ID NO: 812361 - RNA, 22 nt, Human
acagaaauugggcaaauggaag

SEQ ID NO: 812362 - RNA, 22 nt, Human
agugcauucucuaauuacaggu

SEQ ID NO: 812363 - RNA, 22 nt, Human
ucuuucccaguagcucucccag

SEQ ID NO: 812364 - RNA, 22 nt, Human
accaguuuuuuauacaucuucu

SEQ ID NO: 812365 - RNA, 23 nt, Human
uaggcaggacucagauaugacag

SEQ ID NO: 812366 - RNA, 22 nt, Human
cggauccucagucgugcgggag

SEQ ID NO: 812367 - RNA, 20 nt, Human
agugugcauuuagagucugc

SEQ ID NO: 812368 - RNA, 22 nt, Human
gaguccugauccuuagcucucc

SEQ ID NO: 812369 - RNA, 22 nt, Human
cugaagagacuggagggggcau

SEQ ID NO: 812370 - RNA, 22 nt, Human
auacacaucuauuuaagagaca

SEQ ID NO: 812371 - RNA, 22 nt, Human
ggccagggaggagaggccccug

SEQ ID NO: 812372 - RNA, 22 nt, Human
guuauaaauaccuaauaggauu

SEQ ID NO: 812373 - RNA, 22 nt, Human
ucaugcaacggcucgcugagcc

SEQ ID NO: 812374 - RNA, 19 nt, Human
aggguccaggcccugugga

SEQ ID NO: 812375 - RNA, 22 nt, Human
uacaguuuuucacugaagaugu

SEQ ID NO: 812376 - RNA, 18 nt, Human
ccuaauaugagggguccu

SEQ ID NO: 812377 - RNA, 20 nt, Human
uauaaauucagagcuuuggu

SEQ ID NO: 812378 - RNA, 22 nt, Human
uuuggcuuuagugccuucugau

SEQ ID NO: 812379 - RNA, 22 nt, Human
aagucagauaggugaguccaaa

SEQ ID NO: 812380 - RNA, 22 nt, Human
agaaggccaauagggugcacug

SEQ ID NO: 812381 - RNA, 22 nt, Human
ugcacacauaugagcaugugug

SEQ ID NO: 812382 - RNA, 22 nt, Human
cuggagugaagucuggcagcuu

SEQ ID NO: 812383 - RNA, 22 nt, Human
ucuaaggccuucaugucaguau

SEQ ID NO: 812384 - RNA, 22 nt, Human
cagguaugaggacacugacagc

SEQ ID NO: 812385 - RNA, 21 nt, Human
ggccugaguauaggacaggcc

SEQ ID NO: 812386 - RNA, 22 nt, Human
ugcuggaauuuuucuaggauuu

SEQ ID NO: 812387 - RNA, 19 nt, Human
uggagaggaaaugcugcuc

SEQ ID NO: 812388 - RNA, 22 nt, Human
ugugggcaggcccgggucugag

SEQ ID NO: 812389 - RNA, 22 nt, Human
gccaggagaaaaggcgaaugau

SEQ ID NO: 812390 - RNA, 22 nt, Human
aaagauguuuuauaaguuaugg

SEQ ID NO: 812391 - RNA, 22 nt, Human
auugcuaaugugcgaaugugua

SEQ ID NO: 812392 - RNA, 22 nt, Human
gcugccugccuaguuccacagu

SEQ ID NO: 812393 - RNA, 22 nt, Human
ccaggccugugcaaggagggag

SEQ ID NO: 812394 - RNA, 22 nt, Human
ugcugggggcuuucuggauacc

SEQ ID NO: 812395 - RNA, 22 nt, Human
cuagggaaugagagacuggauc

SEQ ID NO: 812396 - RNA, 22 nt, Human
cuggcagaguugggucucaaau

SEQ ID NO: 812397 - RNA, 22 nt, Human
cagcaggcaggugggccaaguc

SEQ ID NO: 812398 - RNA, 22 nt, Human
ucuugauuuugugaauaaguug

SEQ ID NO: 812399 - RNA, 21 nt, Human
ugaaaugagaaugcugagcac

SEQ ID NO: 812400 - RNA, 22 nt, Human
gccuccuguuaugccaugugcc

SEQ ID NO: 812401 - RNA, 22 nt, Human
augggguggaguccgggcagcg

SEQ ID NO: 812402 - RNA, 20 nt, Human
accuggcucucaggagcaac

SEQ ID NO: 812403 - RNA, 22 nt, Human
gaggccugggagaacuguuuuu

SEQ ID NO: 812404 - RNA, 22 nt, Human
auugucucuuucaauaacuugu

SEQ ID NO: 812405 - RNA, 22 nt, Human
gaagcagugugaacccauguaa

SEQ ID NO: 812406 - RNA, 22 nt, Human
ucacaugagguuaugacaaagc

SEQ ID NO: 812407 - RNA, 22 nt, Human
guucuggguucuggguuauugg

SEQ ID NO: 812408 - RNA, 22 nt, Human
ugaaugauuaaaacccggacua

SEQ ID NO: 812409 - RNA, 22 nt, Human
cugggagaggaaccucgagggu

SEQ ID NO: 812410 - RNA, 22 nt, Human
auucaacuagugauuguguuau

SEQ ID NO: 812411 - RNA, 22 nt, Human
uuugcaaacggcccugaguccc

SEQ ID NO: 812412 - RNA, 22 nt, Human
auggacagcuggccucaaggga

SEQ ID NO: 812413 - RNA, 22 nt, Human
aucuuuggaaagccaagcacag

SEQ ID NO: 812414 - RNA, 22 nt, Human
aaauauugguaggaugcuuguu

SEQ ID NO: 812415 - RNA, 22 nt, Human
uuugaaauuggcucauugguuu

SEQ ID NO: 812416 - RNA, 19 nt, Human
ucucagagcccuagaggcc

SEQ ID NO: 812417 - RNA, 22 nt, Human
ugggauggcauccugggccuug

SEQ ID NO: 812418 - RNA, 22 nt, Human
acagggagauaucuucaauauc

SEQ ID NO: 812419 - RNA, 22 nt, Human
uagcaaaaacugcaguuacuuu

SEQ ID NO: 812420 - RNA, 22 nt, Human
ccagaggcuggguucaccucag

SEQ ID NO: 812421 - RNA, 22 nt, Human
uaacaaaguaccauagauuggg

SEQ ID NO: 812422 - RNA, 22 nt, Human
gcuggggagcaagaguagugag

SEQ ID NO: 812423 - RNA, 19 nt, Human
cuggccaggccaggggccc

SEQ ID NO: 812424 - RNA, 22 nt, Human
uagcagagcagggaucagagcc

SEQ ID NO: 812425 - RNA, 22 nt, Human
gaggcacagaguaggugcacac

SEQ ID NO: 812426 - RNA, 22 nt, Human
uuuaagaugguauuuuauaaag

SEQ ID NO: 812427 - RNA, 22 nt, Human
ccccugaagacaauggagaggu

SEQ ID NO: 812428 - RNA, 22 nt, Human
ucagaaucugcauuuaacaaaa

SEQ ID NO: 812429 - RNA, 22 nt, Human
accugucuauaaaagugaauac

SEQ ID NO: 812430 - RNA, 22 nt, Human
uuuucugaccuaucuacauuua

SEQ ID NO: 812431 - RNA, 22 nt, Human
cagcuuugccaaguaaggucuu

SEQ ID NO: 812432 - RNA, 22 nt, Human
gcacuuguggauuugauauaca

SEQ ID NO: 812433 - RNA, 22 nt, Human
agccucucauguucucccccag

SEQ ID NO: 812434 - RNA, 22 nt, Human
uuauugcugauaguguuuauaa

SEQ ID NO: 812435 - RNA, 22 nt, Human
uaaaggaagaauucucugugau

SEQ ID NO: 812436 - RNA, 22 nt, Human
caggccucgaggagacagcuac

SEQ ID NO: 812437 - RNA, 22 nt, Human
acaagaguaucuuugacuuuag

SEQ ID NO: 812438 - RNA, 22 nt, Human
uucuuuggggucuccagcauag

SEQ ID NO: 812439 - RNA, 22 nt, Human
ugcuucacaagaauucaggacc

SEQ ID NO: 812440 - RNA, 22 nt, Human
uggcucaguuugggggauugaa

SEQ ID NO: 812441 - RNA, 22 nt, Human
cacaggaauauaaguuugaguu

SEQ ID NO: 812442 - RNA, 22 nt, Human
gaaacucucgcauccugggaac

SEQ ID NO: 812443 - RNA, 22 nt, Human
augcuauaaacucuaggucauu

SEQ ID NO: 812444 - RNA, 22 nt, Human
ucagcaccaguuauccucaggg

SEQ ID NO: 812445 - RNA, 22 nt, Human
uaagagaaggaucuguuccagg

SEQ ID NO: 812446 - RNA, 22 nt, Human
gccaggcaggugucggagcccu

SEQ ID NO: 812447 - RNA, 22 nt, Human
auucacaugugcuucuuaucac

SEQ ID NO: 812448 - RNA, 22 nt, Human
cccaggaguuugaguucagcau

SEQ ID NO: 812449 - RNA, 22 nt, Human
ugagccaugggacuccaaggga

SEQ ID NO: 812450 - RNA, 22 nt, Human
acagaacugcaggaggaaaagc

SEQ ID NO: 812451 - RNA, 22 nt, Human
uuuauucaagaugagguucaug

SEQ ID NO: 812452 - RNA, 22 nt, Human
ggccugagcagacagcaugaug

SEQ ID NO: 812453 - RNA, 22 nt, Human
uuuacuguguccaucugugacu

SEQ ID NO: 812454 - RNA, 22 nt, Human
aggcuccaaauuaccaagcucu

SEQ ID NO: 812455 - RNA, 22 nt, Human
uaguuuuacuugcgaugauaau

SEQ ID NO: 812456 - RNA, 22 nt, Human
guucuauuccccuuaucuguga

SEQ ID NO: 812457 - RNA, 22 nt, Human
uucuaagugauucuagcuggac

SEQ ID NO: 812458 - RNA, 22 nt, Human
uggcagggccuaccccaauauc

SEQ ID NO: 812459 - RNA, 22 nt, Human
caagucauuacugaaaugucac

SEQ ID NO: 812460 - RNA, 17 nt, Human
caggcacaugaagccag

SEQ ID NO: 812461 - RNA, 20 nt, Human
uaaagcagccguggagggua

SEQ ID NO: 812462 - RNA, 22 nt, Human
cacaauuuuaauacacagucaa

SEQ ID NO: 812463 - RNA, 22 nt, Human
acagugauuuuaggauagaugg

SEQ ID NO: 812464 - RNA, 22 nt, Human
uguuuacuuaaauguuuucaua

SEQ ID NO: 812465 - RNA, 22 nt, Human
gagcuuuguaaaaaacuugcac

SEQ ID NO: 812466 - RNA, 22 nt, Human
acuggggugaaauuggaguguc

SEQ ID NO: 812467 - RNA, 22 nt, Human
gcacaacaccaagggagguauc

SEQ ID NO: 812468 - RNA, 22 nt, Human
aucaguguuguugauuggauag

SEQ ID NO: 812469 - RNA, 19 nt, Human
ccaggccugcgggcguugg

SEQ ID NO: 812470 - RNA, 22 nt, Human
ugagccguggucucugagggug

SEQ ID NO: 812471 - RNA, 22 nt, Human
aaucacagaguccagcagauga

SEQ ID NO: 812472 - RNA, 21 nt, Human
auauuuuuguuuggacuguca

SEQ ID NO: 812473 - RNA, 18 nt, Human
uuggaggauguccaugaa

SEQ ID NO: 812474 - RNA, 22 nt, Human
ucuucuuaugugccauuaucuc

SEQ ID NO: 812475 - RNA, 17 nt, Human
ggccuuggggccucagu

SEQ ID NO: 812476 - RNA, 22 nt, Human
acugggcauuuugaacguucuu

SEQ ID NO: 812477 - RNA, 22 nt, Human
guucuauucuccaguuacauau

SEQ ID NO: 812478 - RNA, 17 nt, Human
ugaaagaaucagggaga

SEQ ID NO: 812479 - RNA, 22 nt, Human
cugaggcugggcuugccuucuu

SEQ ID NO: 812480 - RNA, 22 nt, Human
gccagcuuuggcacaggguggu

SEQ ID NO: 812481 - RNA, 22 nt, Human
ggagagaggagcccacugcugu

SEQ ID NO: 812482 - RNA, 22 nt, Human
uucuucauggguucuuuuagga

SEQ ID NO: 812483 - RNA, 22 nt, Human
uccagcaguccaugugagacac

SEQ ID NO: 812484 - RNA, 22 nt, Human
aaaaccugugaauaguuaacuc

SEQ ID NO: 812485 - RNA, 22 nt, Human
cauuucuaccaaaugugacugg

SEQ ID NO: 812486 - RNA, 22 nt, Human
ccagcugguuuauauuccccac

SEQ ID NO: 812487 - RNA, 22 nt, Human
cugaggagagguggccuguguu

SEQ ID NO: 812488 - RNA, 22 nt, Human
uuuuuguucccagagaauuugu

SEQ ID NO: 812489 - RNA, 22 nt, Human
cugggcugccagguaggcacac

SEQ ID NO: 812490 - RNA, 22 nt, Human
ccugcagggugcugccacagau

SEQ ID NO: 812491 - RNA, 22 nt, Human
ugucuuuagccagcagucuucu

SEQ ID NO: 812492 - RNA, 22 nt, Human
ggcuagggacacagcucugcuc

SEQ ID NO: 812493 - RNA, 18 nt, Human
gccugccuagagcuugcc

SEQ ID NO: 812494 - RNA, 22 nt, Human
uggcucagagccuugagagcug

SEQ ID NO: 812495 - RNA, 22 nt, Human
caaagccucugauuucacuugu

SEQ ID NO: 812496 - RNA, 22 nt, Human
cagaggaaaugggaaggagaua

SEQ ID NO: 812497 - RNA, 22 nt, Human
agugcaauuuugcuuucccaau

SEQ ID NO: 812498 - RNA, 22 nt, Human
acacaauuuccuguccauaugu

SEQ ID NO: 812499 - RNA, 22 nt, Human
cagaugaggacagaugacuggg

SEQ ID NO: 812500 - RNA, 22 nt, Human
uguacaaagccagaacucccaa

SEQ ID NO: 812501 - RNA, 22 nt, Human
cgggggcacccacaaaugagga

SEQ ID NO: 812502 - RNA, 23 nt, Human
cugaaauaccagaaaaucagugu

SEQ ID NO: 812503 - RNA, 23 nt, Human
aaauaccugaauuagauauuauc

SEQ ID NO: 812504 - RNA, 22 nt, Human
cuucuaggucuugauugaaugu

SEQ ID NO: 812505 - RNA, 22 nt, Human
gcagcagcugacagugggugcc

SEQ ID NO: 812506 - RNA, 22 nt, Human
ucauugagcuguauggacacaa

SEQ ID NO: 812507 - RNA, 22 nt, Human
ucagugucuagggacaguaauc

SEQ ID NO: 812508 - RNA, 22 nt, Human
aguaaacauuucagauuuauuu

SEQ ID NO: 812509 - RNA, 22 nt, Human
uuuacagaagagaaggaugcuu

SEQ ID NO: 812510 - RNA, 20 nt, Human
uauuuagauucaaguaugga

SEQ ID NO: 812511 - RNA, 22 nt, Human
acauucugaaaaacaguguuuu

SEQ ID NO: 812512 - RNA, 22 nt, Human
uuucagaguuggggaaaagcag

SEQ ID NO: 812513 - RNA, 22 nt, Human
cuugccaaauuaacauacagaa

SEQ ID NO: 812514 - RNA, 22 nt, Human
accaggcaguauggugcugcaa

SEQ ID NO: 812515 - RNA, 22 nt, Human
gcucuucuaaagaauguacagg

SEQ ID NO: 812516 - RNA, 22 nt, Human
cugcagcuccccugagaucaag

SEQ ID NO: 812517 - RNA, 22 nt, Human
cuguuuauuacacuggauagca

SEQ ID NO: 812518 - RNA, 22 nt, Human
guggaagggacugccuagagga

SEQ ID NO: 812519 - RNA, 22 nt, Human
ucacauuucaagugcucaaaag

SEQ ID NO: 812520 - RNA, 22 nt, Human
aggcagccuauggggagcucag

SEQ ID NO: 812521 - RNA, 22 nt, Human
gaagagcugcucagaacaugau

SEQ ID NO: 812522 - RNA, 22 nt, Human
ggccaaggcucuugagggcuga

SEQ ID NO: 812523 - RNA, 22 nt, Human
uucuggagauugagaaggcauu

SEQ ID NO: 812524 - RNA, 22 nt, Human
aauguguaaaagguuuucuuca

SEQ ID NO: 812525 - RNA, 22 nt, Human
uuuuccuuuggaagaugcauau

SEQ ID NO: 812526 - RNA, 22 nt, Human
ugcacauggcaaugcugcuccc

SEQ ID NO: 812527 - RNA, 22 nt, Human
gcagcagaugugggcccagagc

SEQ ID NO: 812528 - RNA, 22 nt, Human
cacuggcauuagucacgaggca

SEQ ID NO: 812529 - RNA, 19 nt, Human
ggcuggagaaaggaaucag

SEQ ID NO: 812530 - RNA, 22 nt, Human
cuccugaguaguagcauuguca

SEQ ID NO: 812531 - RNA, 20 nt, Human
cacaagaggaguucccugag

SEQ ID NO: 812532 - RNA, 22 nt, Human
cucugcugcaggaaggcgugca

SEQ ID NO: 812533 - RNA, 22 nt, Human
uaagucauuaggcugaguucaa

SEQ ID NO: 812534 - RNA, 22 nt, Human
uuacauuuggcuauguccucua

SEQ ID NO: 812535 - RNA, 22 nt, Human
acuggcagggggagccccgaga

SEQ ID NO: 812536 - RNA, 22 nt, Human
ucucuuaauucagaggcaguua

SEQ ID NO: 812537 - RNA, 22 nt, Human
ccuuuccccgcgggaggugcca

SEQ ID NO: 812538 - RNA, 22 nt, Human
uguauuuugugaggaucacucu

SEQ ID NO: 812539 - RNA, 22 nt, Human
ugagccuggcggaagcagcgug

SEQ ID NO: 812540 - RNA, 22 nt, Human
agcugggagcugaaggcugauu

SEQ ID NO: 812541 - RNA, 22 nt, Human
augucuguuuucauaucagaua

SEQ ID NO: 812542 - RNA, 22 nt, Human
uucaguauguguaaacuacuuu

SEQ ID NO: 812543 - RNA, 22 nt, Human
uguaaacauauguauguaugua

SEQ ID NO: 812544 - RNA, 22 nt, Human
gugcugggugcugcagacaggu

SEQ ID NO: 812545 - RNA, 22 nt, Human
uaggacagagauuuguuuuaug

SEQ ID NO: 812546 - RNA, 22 nt, Human
acauuguagacuuuucauaugu

SEQ ID NO: 812547 - RNA, 20 nt, Human
ccucaguguccuggacuggg

SEQ ID NO: 812548 - RNA, 22 nt, Human
ccauggcaauggucagucuauu

SEQ ID NO: 812549 - RNA, 22 nt, Human
uggagcaggaagucuauggcug

SEQ ID NO: 812550 - RNA, 22 nt, Human
ccaccgcugaaggcacuggcau

SEQ ID NO: 812551 - RNA, 22 nt, Human
uccagagaaaucuagucuuaca

SEQ ID NO: 812552 - RNA, 20 nt, Human
aagcagaagcugcucucagc

SEQ ID NO: 812553 - RNA, 20 nt, Human
uuucaaguuguaagguauca

SEQ ID NO: 812554 - RNA, 22 nt, Human
gcagaggggaagcugaggaauu

SEQ ID NO: 812555 - RNA, 22 nt, Human
ggucugagauauuuguucagcu

SEQ ID NO: 812556 - RNA, 22 nt, Human
agaugaaagauuuuuauagaga

SEQ ID NO: 812557 - RNA, 22 nt, Human
uccaggaccucccaggcuagag

SEQ ID NO: 812558 - RNA, 22 nt, Human
ugcaguggaagagguggagauc

SEQ ID NO: 812559 - RNA, 21 nt, Human
cauuucaugauuauagaaaug

SEQ ID NO: 812560 - RNA, 22 nt, Human
ggucagggggaucugugaggua

SEQ ID NO: 812561 - RNA, 22 nt, Human
ucaugcaaugagucaggaggca

SEQ ID NO: 812562 - RNA, 22 nt, Human
agaagccauucccuguaggcuc

SEQ ID NO: 812563 - RNA, 22 nt, Human
guguuuaauagguagcugaauc

SEQ ID NO: 812564 - RNA, 22 nt, Human
acaggcugagcguccaucuuca

SEQ ID NO: 812565 - RNA, 18 nt, Human
uggagcagguaggcauga

SEQ ID NO: 812566 - RNA, 22 nt, Human
ggccaaggaugguggcucuggu

SEQ ID NO: 812567 - RNA, 22 nt, Human
aaagcagguugcaauuacagug

SEQ ID NO: 812568 - RNA, 22 nt, Human
cagagacaggaaucagcugcag

SEQ ID NO: 812569 - RNA, 22 nt, Human
gagauggagucuuuuucuguca

SEQ ID NO: 812570 - RNA, 22 nt, Human
ucaugaaguccaaacuaaagca

SEQ ID NO: 812571 - RNA, 22 nt, Human
acuuggcuuuaguaguaacuga

SEQ ID NO: 812572 - RNA, 20 nt, Human
accagagacuggggacaagu

SEQ ID NO: 812573 - RNA, 22 nt, Human
gagcagcuuaugucaagccaga

SEQ ID NO: 812574 - RNA, 22 nt, Human
auaaaaugucuccacugggcuc

SEQ ID NO: 812575 - RNA, 22 nt, Human
auguaauuuauguuauccauaa

SEQ ID NO: 812576 - RNA, 22 nt, Human
cagcuucuguuucuagccccug

SEQ ID NO: 812577 - RNA, 20 nt, Human
uggcuggcuuguauuuccuu

SEQ ID NO: 812578 - RNA, 22 nt, Human
gcaguguuuuucaaugcuucca

SEQ ID NO: 812579 - RNA, 22 nt, Human
cagacagacagccguggccacc

SEQ ID NO: 812580 - RNA, 22 nt, Human
ugggccagcugaagugccgccc

SEQ ID NO: 812581 - RNA, 21 nt, Human
ugacauuuaguagcauuguca

SEQ ID NO: 812582 - RNA, 22 nt, Human
ugcacaggugagacucaggaag

SEQ ID NO: 812583 - RNA, 22 nt, Human
aacacagaagugccaagagcca

SEQ ID NO: 812584 - RNA, 22 nt, Human
agcaggcugaugggcaugcuug

SEQ ID NO: 812585 - RNA, 22 nt, Human
uaguaaaucucagaaaaagauc

SEQ ID NO: 812586 - RNA, 22 nt, Human
aaagucaucauuucuuuucaaa

SEQ ID NO: 812587 - RNA, 22 nt, Human
ucucaaauaggccuugguccug

SEQ ID NO: 812588 - RNA, 22 nt, Human
uucagcuugcuuagucuccuuc

SEQ ID NO: 812589 - RNA, 19 nt, Human
ucucuggcaguucagagca

SEQ ID NO: 812590 - RNA, 22 nt, Human
ggggacagucgaucuagugauu

SEQ ID NO: 812591 - RNA, 22 nt, Human
uuuucauugagcaccugaguaa

SEQ ID NO: 812592 - RNA, 22 nt, Human
uccucagaauggauggcagggg

SEQ ID NO: 812593 - RNA, 22 nt, Human
cccuaggcccaaagggugacau

SEQ ID NO: 812594 - RNA, 22 nt, Human
aggaagcuaaccagggagugag

SEQ ID NO: 812595 - RNA, 22 nt, Human
uaaauaucaguccagcucuucc

SEQ ID NO: 812596 - RNA, 22 nt, Human
acagcagguuuuaacuuugaag

SEQ ID NO: 812597 - RNA, 22 nt, Human
agucccagcuacucaagaggcu

SEQ ID NO: 812598 - RNA, 23 nt, Human
uugagaacaggugugagaauggc

SEQ ID NO: 812599 - RNA, 22 nt, Human
caggaggccaacugugggacuu

SEQ ID NO: 812600 - RNA, 22 nt, Human
gccaugcuugguaugcugugag

SEQ ID NO: 812601 - RNA, 22 nt, Human
cagucuuuguucccauuacuga

SEQ ID NO: 812602 - RNA, 22 nt, Human
uucuccuugguuuaugggacau

SEQ ID NO: 812603 - RNA, 22 nt, Human
aggguccauucuuugccuuuuc

SEQ ID NO: 812604 - RNA, 22 nt, Human
ccugcagacacuuguccagcaa

SEQ ID NO: 812605 - RNA, 19 nt, Human
gcacacaguagggcuggca

SEQ ID NO: 812606 - RNA, 22 nt, Human
gggcccuggcuuuccuguucuu

SEQ ID NO: 812607 - RNA, 22 nt, Human
caggaaaauggaaucaccugua

SEQ ID NO: 812608 - RNA, 17 nt, Human
uguuuucugcuaccuuu

SEQ ID NO: 812609 - RNA, 22 nt, Human
gccagucucccucaguccucug

SEQ ID NO: 812610 - RNA, 22 nt, Human
ggcagcugcaaaucugcucugu

SEQ ID NO: 812611 - RNA, 22 nt, Human
ugauuuuacuuagcaugauguu

SEQ ID NO: 812612 - RNA, 22 nt, Human
gucuuuaguugaaacauguggu

SEQ ID NO: 812613 - RNA, 22 nt, Human
auacuucuagaaauacuaugca

SEQ ID NO: 812614 - RNA, 22 nt, Human
cccuaggcugggcucuuggcuu

SEQ ID NO: 812615 - RNA, 22 nt, Human
auuuucucacaaugcagaagga

SEQ ID NO: 812616 - RNA, 22 nt, Human
ggcuaggccucaggccugccug

SEQ ID NO: 812617 - RNA, 22 nt, Human
uuacaucacuuuacuuaauaau

SEQ ID NO: 812618 - RNA, 22 nt, Human
ccccacuuugaguagcacuuga

SEQ ID NO: 812619 - RNA, 22 nt, Human
ucauaaaaugcuccugauauug

SEQ ID NO: 812620 - RNA, 22 nt, Human
caugagauuugggaggggccag

SEQ ID NO: 812621 - RNA, 22 nt, Human
ccagcugggucccugcuggggc

SEQ ID NO: 812622 - RNA, 22 nt, Human
agcugugggagaaucucugggu

SEQ ID NO: 812623 - RNA, 22 nt, Human
cagcuucuauuuaucuuugugu

SEQ ID NO: 812624 - RNA, 22 nt, Human
auucaagguauuuaaaacauaa

SEQ ID NO: 812625 - RNA, 22 nt, Human
acagaauuuacacaucucuaaa

SEQ ID NO: 812626 - RNA, 22 nt, Human
cucauuuauuucucccaaaaca

SEQ ID NO: 812627 - RNA, 22 nt, Human
aauguuaauucacagccaaaua

SEQ ID NO: 812628 - RNA, 22 nt, Human
ccacagugaguuagauugacca

SEQ ID NO: 812629 - RNA, 22 nt, Human
ggcuggcaccugcccuccgcug

SEQ ID NO: 812630 - RNA, 22 nt, Human
cuuugcagcaauuucuguuaaa

SEQ ID NO: 812631 - RNA, 22 nt, Human
gcaguaagaaagucaagcaguu

SEQ ID NO: 812632 - RNA, 22 nt, Human
gauauacaauccacaguugauu

SEQ ID NO: 812633 - RNA, 22 nt, Human
ugcagggccaugguggcggcug

SEQ ID NO: 812634 - RNA, 22 nt, Human
gcucccaccaggcagaccuacc

SEQ ID NO: 812635 - RNA, 22 nt, Human
uggggguguccuggugcacaca

SEQ ID NO: 812636 - RNA, 22 nt, Human
caaggcaggcaguucacuugag

SEQ ID NO: 812637 - RNA, 22 nt, Human
aggcucauccccacaaagcaaa

SEQ ID NO: 812638 - RNA, 22 nt, Human
uacauacacaaauauacuguuu

SEQ ID NO: 812639 - RNA, 22 nt, Human
uuccugcagcaaggagaagcug

SEQ ID NO: 812640 - RNA, 22 nt, Human
aaaguacauagcauauuccaac

SEQ ID NO: 812641 - RNA, 22 nt, Human
cucugcccgugccuuucccagu

SEQ ID NO: 812642 - RNA, 22 nt, Human
agaaaugacaagacugaucagg

SEQ ID NO: 812643 - RNA, 22 nt, Human
aaugucuuuaaagugcaauaga

SEQ ID NO: 812644 - RNA, 22 nt, Human
agaggccaagccagacugugca

SEQ ID NO: 812645 - RNA, 22 nt, Human
accccagguccagguuacagag

SEQ ID NO: 812646 - RNA, 22 nt, Human
cuuugauucagagagaauuagc

SEQ ID NO: 812647 - RNA, 23 nt, Human
cagcagcugccugguuuuuuggu

SEQ ID NO: 812648 - RNA, 22 nt, Human
ccaggccuggaccaugccaggg

SEQ ID NO: 812649 - RNA, 22 nt, Human
uuguauacaggucuuguccauu

SEQ ID NO: 812650 - RNA, 22 nt, Human
cuauagaaacaaccucucuuuc

SEQ ID NO: 812651 - RNA, 22 nt, Human
uuuacaugaguagcagauguuc

SEQ ID NO: 812652 - RNA, 22 nt, Human
uaaaguuuggcagacaauaaca

SEQ ID NO: 812653 - RNA, 22 nt, Human
aggaggaauacaauccagcagc

SEQ ID NO: 812654 - RNA, 22 nt, Human
uuuguguggcguuggccggcgg

SEQ ID NO: 812655 - RNA, 23 nt, Human
ucugggccacuugucugcacuuc

SEQ ID NO: 812656 - RNA, 22 nt, Human
gaauauuuguaauuacuguuga

SEQ ID NO: 812657 - RNA, 22 nt, Human
uaggaaauugacaccugcuuga

SEQ ID NO: 812658 - RNA, 22 nt, Human
ucaggcugggagacaaucacug

SEQ ID NO: 812659 - RNA, 22 nt, Human
gggcuaggcuuggccagcacug

SEQ ID NO: 812660 - RNA, 22 nt, Human
ugcagggucccgaagggaagac

SEQ ID NO: 812661 - RNA, 22 nt, Human
gaaaaguauguuuauuuugacu

SEQ ID NO: 812662 - RNA, 21 nt, Human
agagccugagaucuuccagca

SEQ ID NO: 812663 - RNA, 22 nt, Human
aaggcacacaguuagauagagc

SEQ ID NO: 812664 - RNA, 22 nt, Human
uaguuugucaaccacugucaca

SEQ ID NO: 812665 - RNA, 22 nt, Human
aguguuuuggagugggaaggca

SEQ ID NO: 812666 - RNA, 19 nt, Human
ccagggcuuuaaguugagg

SEQ ID NO: 812667 - RNA, 22 nt, Human
aggagcccugcgggaggcagag

SEQ ID NO: 812668 - RNA, 22 nt, Human
ccuuuaaauggauguucaacug

SEQ ID NO: 812669 - RNA, 22 nt, Human
uagggcuguuuaaaagugaggu

SEQ ID NO: 812670 - RNA, 22 nt, Human
aaggaagacucgcaggucuaug

SEQ ID NO: 812671 - RNA, 22 nt, Human
ugcugcugacauuuggggcuug

SEQ ID NO: 812672 - RNA, 22 nt, Human
uuaaggcauucuccuacuaaua

SEQ ID NO: 812673 - RNA, 22 nt, Human
gacagggcugugggaggagcag

SEQ ID NO: 812674 - RNA, 22 nt, Human
gaggcuggaauauuagaaaugu

SEQ ID NO: 812675 - RNA, 22 nt, Human
auuucucagugugaucaggccu

SEQ ID NO: 812676 - RNA, 22 nt, Human
accaggcaacugugaaugggcu

SEQ ID NO: 812677 - RNA, 21 nt, Human
gugcagaggaauguagggggc

SEQ ID NO: 812678 - RNA, 22 nt, Human
agcagccuugcaggggucgcac

SEQ ID NO: 812679 - RNA, 22 nt, Human
cuggcuggguuccaggauucca

SEQ ID NO: 812680 - RNA, 20 nt, Human
caguccugccccuuggggac

SEQ ID NO: 812681 - RNA, 22 nt, Human
uggggauguaaaugaggugaua

SEQ ID NO: 812682 - RNA, 22 nt, Human
ucuggaaagaucauuaaaucca

SEQ ID NO: 812683 - RNA, 22 nt, Human
cacucccuucaggagccuagga

SEQ ID NO: 812684 - RNA, 20 nt, Human
cugagccaacucucuucuug

SEQ ID NO: 812685 - RNA, 22 nt, Human
gaauauauuggugaaaauaguu

SEQ ID NO: 812686 - RNA, 22 nt, Human
agccagcucugaguugaaguac

SEQ ID NO: 812687 - RNA, 20 nt, Human
accaggccccgggcccugca

SEQ ID NO: 812688 - RNA, 22 nt, Human
gccaaggccucugcaggaugag

SEQ ID NO: 812689 - RNA, 22 nt, Human
agucuauuuuagcugcauaugu

SEQ ID NO: 812690 - RNA, 22 nt, Human
acaaauggagaaacugaggccc

SEQ ID NO: 812691 - RNA, 22 nt, Human
acuguucuucauuuagcaaaga

SEQ ID NO: 812692 - RNA, 20 nt, Human
aauuuuaucuccauccuuug

SEQ ID NO: 812693 - RNA, 22 nt, Human
ucugggaguggguccaaggaau

SEQ ID NO: 812694 - RNA, 22 nt, Human
auauucaaauuacauuuacuaa

SEQ ID NO: 812695 - RNA, 19 nt, Human
agagucugugcucuuccua

SEQ ID NO: 812696 - RNA, 22 nt, Human
uggucaaguuaagauaagguga

SEQ ID NO: 812697 - RNA, 21 nt, Human
uagaggcaggagggacugcag

SEQ ID NO: 812698 - RNA, 22 nt, Human
cagcccuggaacagcugacuca

SEQ ID NO: 812699 - RNA, 22 nt, Human
uuuccucacacagaagaucuug

SEQ ID NO: 812700 - RNA, 22 nt, Human
agagugcucagaugcaugucuu

SEQ ID NO: 812701 - RNA, 20 nt, Human
uguuucauaagcuguccuau

SEQ ID NO: 812702 - RNA, 22 nt, Human
gcaucuucacacaaagccagug

SEQ ID NO: 812703 - RNA, 22 nt, Human
agagggagaaaagaaucaguug

SEQ ID NO: 812704 - RNA, 22 nt, Human
aaauccauucuguuuuaaaagu

SEQ ID NO: 812705 - RNA, 22 nt, Human
uggcccuguguccugcugccag

SEQ ID NO: 812706 - RNA, 22 nt, Human
aaggcaccauaggcaaauccag

SEQ ID NO: 812707 - RNA, 22 nt, Human
ccagcagagggucuuggccauu

SEQ ID NO: 812708 - RNA, 22 nt, Human
gugaccauuugacauauccuug

SEQ ID NO: 812709 - RNA, 22 nt, Human
caugaagucaggauuuccauga

SEQ ID NO: 812710 - RNA, 22 nt, Human
auguuuuauguuccacucaagg

SEQ ID NO: 812711 - RNA, 22 nt, Human
auuuggagacaggauuuuucag

SEQ ID NO: 812712 - RNA, 22 nt, Human
caggcuggagugcaguugugca

SEQ ID NO: 812713 - RNA, 23 nt, Human
ugagcagcuaaaggugaugcggg

SEQ ID NO: 812714 - RNA, 22 nt, Human
uugaaugaagucccuuuuuacu

SEQ ID NO: 812715 - RNA, 22 nt, Human
agaggcgcagacucuugagugu

SEQ ID NO: 812716 - RNA, 22 nt, Human
auguuuuuaaauagacuuacag

SEQ ID NO: 812717 - RNA, 22 nt, Human
gagggggcuagcgcagugccca

SEQ ID NO: 812718 - RNA, 23 nt, Human
guuucuaugucuugugccuucau

SEQ ID NO: 812719 - RNA, 22 nt, Human
uucuuuugcaagacuauugauu

SEQ ID NO: 812720 - RNA, 22 nt, Human
ccauuuggcaaacauuuuacag

SEQ ID NO: 812721 - RNA, 22 nt, Human
gcacaggcacagagggccacug

SEQ ID NO: 812722 - RNA, 22 nt, Human
acuuguuugaaucucucuagag

SEQ ID NO: 812723 - RNA, 22 nt, Human
gagguaauuacuauguucagau

SEQ ID NO: 812724 - RNA, 22 nt, Human
cuucugagauguuguuuuacag

SEQ ID NO: 812725 - RNA, 22 nt, Human
gaaacaacuacuauugauuucu

SEQ ID NO: 812726 - RNA, 22 nt, Human
uacaauguugguaaaguaucau

SEQ ID NO: 812727 - RNA, 22 nt, Human
agaaaaagucaaggaauuggac

SEQ ID NO: 812728 - RNA, 22 nt, Human
cagaagcagauucuaaagcaag

SEQ ID NO: 812729 - RNA, 21 nt, Human
cuggcccagggaucugcauuu

SEQ ID NO: 812730 - RNA, 22 nt, Human
aggaagcucggagagggcaaau

SEQ ID NO: 812731 - RNA, 22 nt, Human
cuuuuuuaagguagcuccuccu

SEQ ID NO: 812732 - RNA, 22 nt, Human
cucccgugauccuggaggagag

SEQ ID NO: 812733 - RNA, 21 nt, Human
gcuuauagaaacaucaccaga

SEQ ID NO: 812734 - RNA, 22 nt, Human
ugggaagcauuaaugauagggg

SEQ ID NO: 812735 - RNA, 22 nt, Human
ccuaccaguaggaggccagaga

SEQ ID NO: 812736 - RNA, 22 nt, Human
gcagaggcauuucugacgcugc

SEQ ID NO: 812737 - RNA, 22 nt, Human
cacaauuauuaucucuuucuac

SEQ ID NO: 812738 - RNA, 22 nt, Human
auuuucuauguuguaauuguua

SEQ ID NO: 812739 - RNA, 19 nt, Human
cccaguccuuguccugggc

SEQ ID NO: 812740 - RNA, 22 nt, Human
cugaagcuaggucaaaaaaggg

SEQ ID NO: 812741 - RNA, 17 nt, Human
agcagcuggguugaucu

SEQ ID NO: 812742 - RNA, 22 nt, Human
ccugacaggcggaggcugcagu

SEQ ID NO: 812743 - RNA, 22 nt, Human
aggacagaccuaggacuggagc

SEQ ID NO: 812744 - RNA, 22 nt, Human
guguuuccccuccuggagaagg

SEQ ID NO: 812745 - RNA, 22 nt, Human
cccuucccuucugggagaucca

SEQ ID NO: 812746 - RNA, 22 nt, Human
acuuuguauaagacaauaaaga

SEQ ID NO: 812747 - RNA, 21 nt, Human
ucuuugauuaagcuugacuag

SEQ ID NO: 812748 - RNA, 22 nt, Human
caggagcccagaguccucagcu

SEQ ID NO: 812749 - RNA, 22 nt, Human
ugaugaaaguguuuacucaccu

SEQ ID NO: 812750 - RNA, 19 nt, Human
acugccugaggcucacagg

SEQ ID NO: 812751 - RNA, 22 nt, Human
uucuuaaaacuuauggacaggu

SEQ ID NO: 812752 - RNA, 22 nt, Human
acuacagucccucauauguugg

SEQ ID NO: 812753 - RNA, 22 nt, Human
cagccaggccuggugaccaaag

SEQ ID NO: 812754 - RNA, 19 nt, Human
aauggacaggcaauagucu

SEQ ID NO: 812755 - RNA, 22 nt, Human
uccugccuuagagcaaggaaaa

SEQ ID NO: 812756 - RNA, 19 nt, Human
gcugggagcagacccuccc

SEQ ID NO: 812757 - RNA, 20 nt, Human
gcagugauuugucuauguuu

SEQ ID NO: 812758 - RNA, 22 nt, Human
ccagcccgaaucccuaaagcaa

SEQ ID NO: 812759 - RNA, 22 nt, Human
gagugcuugcauauuuauuguc

SEQ ID NO: 812760 - RNA, 22 nt, Human
ccucugcaugugcaguaccgag

SEQ ID NO: 812761 - RNA, 22 nt, Human
cuggcagguggauggggacucc

SEQ ID NO: 812762 - RNA, 22 nt, Human
gaagccacagagauuguggggg

SEQ ID NO: 812763 - RNA, 22 nt, Human
cuauggcucaauucuagugguu

SEQ ID NO: 812764 - RNA, 20 nt, Human
uccccagggcaucaggagca

SEQ ID NO: 812765 - RNA, 22 nt, Human
ggccugagggugggcucucagu

SEQ ID NO: 812766 - RNA, 22 nt, Human
gacacaggaaucaccuuggaug

SEQ ID NO: 812767 - RNA, 22 nt, Human
auacaaaauauauacuggagac

SEQ ID NO: 812768 - RNA, 22 nt, Human
uagcuuguuacacagcaauguu

SEQ ID NO: 812769 - RNA, 22 nt, Human
uugauuuauagaauguucaagc

SEQ ID NO: 812770 - RNA, 22 nt, Human
cuuuccuucucgugguucucac

SEQ ID NO: 812771 - RNA, 22 nt, Human
aaacagaaggguagguaaacau

SEQ ID NO: 812772 - RNA, 22 nt, Human
agggauggaagcucgucugcaa

SEQ ID NO: 812773 - RNA, 22 nt, Human
agaaggaagccaggagggugca

SEQ ID NO: 812774 - RNA, 22 nt, Human
uugcaacacaaaguuugauucc

SEQ ID NO: 812775 - RNA, 22 nt, Human
uucuggcucauaugcuaagaag

SEQ ID NO: 812776 - RNA, 22 nt, Human
ccagaagucaggaaugagucuu

SEQ ID NO: 812777 - RNA, 22 nt, Human
gggcuggcaggaccugggcuga

SEQ ID NO: 812778 - RNA, 22 nt, Human
agugcaaacuuuauugugaccu

SEQ ID NO: 812779 - RNA, 22 nt, Human
ucuuaauucugugucuucacua

SEQ ID NO: 812780 - RNA, 20 nt, Human
uaugagauuugaccucaaca

SEQ ID NO: 812781 - RNA, 22 nt, Human
ugcuggcucaguuugcagacuc

SEQ ID NO: 812782 - RNA, 22 nt, Human
gcccugagugguaccugugggu

SEQ ID NO: 812783 - RNA, 22 nt, Human
uauauaauuuguaaaagcaccu

SEQ ID NO: 812784 - RNA, 22 nt, Human
ugggggagagugcaagcaugaa

SEQ ID NO: 812785 - RNA, 22 nt, Human
uucauugaaccacuuuauucuu

SEQ ID NO: 812786 - RNA, 22 nt, Human
gcccaggaaguugaggcugccg

SEQ ID NO: 812787 - RNA, 22 nt, Human
ggcagccaugugggcagcgagu

SEQ ID NO: 812788 - RNA, 22 nt, Human
cagagccucccuccucugccau

SEQ ID NO: 812789 - RNA, 22 nt, Human
uuacauucaaggaacucauucu

SEQ ID NO: 812790 - RNA, 22 nt, Human
aauaauauuugaagcuucaaag

SEQ ID NO: 812791 - RNA, 22 nt, Human
caauuucaucuugugcuucaau

SEQ ID NO: 812792 - RNA, 22 nt, Human
gcagccuuuggaauuagagacu

SEQ ID NO: 812793 - RNA, 22 nt, Human
cuggcagcgugagcagcaucca

SEQ ID NO: 812794 - RNA, 22 nt, Human
aagcuggagaguuaggugaaua

SEQ ID NO: 812795 - RNA, 22 nt, Human
ccaggguaccccaagggcaggu

SEQ ID NO: 812796 - RNA, 22 nt, Human
cuggcagggcucuuugggugcu

SEQ ID NO: 812797 - RNA, 22 nt, Human
caguguucccugaacauauguu

SEQ ID NO: 812798 - RNA, 22 nt, Human
cuggcacaugugagccacauca

SEQ ID NO: 812799 - RNA, 22 nt, Human
uucuuucccagaagauauguuu

SEQ ID NO: 812800 - RNA, 22 nt, Human
acaagauagguugagucuagcc

SEQ ID NO: 812801 - RNA, 22 nt, Human
gccagccugugggggcucugug

SEQ ID NO: 812802 - RNA, 22 nt, Human
acgcccggucuccauaguuuuu

SEQ ID NO: 812803 - RNA, 22 nt, Human
cagagguuaccuagagcaagaa

SEQ ID NO: 812804 - RNA, 22 nt, Human
agaaguuugguccuuuucaagg

SEQ ID NO: 812805 - RNA, 22 nt, Human
ugagccaggcacugcuccugga

SEQ ID NO: 812806 - RNA, 20 nt, Human
cacagacuguaugggcacca

SEQ ID NO: 812807 - RNA, 22 nt, Human
gcuggcagaagagcugguucaa

SEQ ID NO: 812808 - RNA, 22 nt, Human
gcaggaagggaaagguugacuc

SEQ ID NO: 812809 - RNA, 22 nt, Human
ugccaggaagugugugggccug

SEQ ID NO: 812810 - RNA, 22 nt, Human
cacugcaaaggggaaagaagca

SEQ ID NO: 812811 - RNA, 20 nt, Human
gggugggagagucugagggu

SEQ ID NO: 812812 - RNA, 22 nt, Human
acacagauauuguacuugaucc

SEQ ID NO: 812813 - RNA, 22 nt, Human
aaagucaguuggccagaucacu

SEQ ID NO: 812814 - RNA, 22 nt, Human
ggcagugugcaucuguguggcc

SEQ ID NO: 812815 - RNA, 22 nt, Human
aucucacaggacugaaacguaa

SEQ ID NO: 812816 - RNA, 22 nt, Human
uuauaaagguuugugcauauuu

SEQ ID NO: 812817 - RNA, 22 nt, Human
augcauauauacauacacaguc

SEQ ID NO: 812818 - RNA, 22 nt, Human
agcccagcccgggcugcgcuuu

SEQ ID NO: 812819 - RNA, 22 nt, Human
cuggcuggaggugagucacuga

SEQ ID NO: 812820 - RNA, 22 nt, Human
ccugcagcagcugaaaucacag

SEQ ID NO: 812821 - RNA, 22 nt, Human
aggcagugagugugacuucaca

SEQ ID NO: 812822 - RNA, 20 nt, Human
acuuuacagagaagacugac

SEQ ID NO: 812823 - RNA, 22 nt, Human
uuugcauuuauaaguuggugga

SEQ ID NO: 812824 - RNA, 19 nt, Human
uaacuuguagauaugaagu

SEQ ID NO: 812825 - RNA, 22 nt, Human
ucuuuggccuuaggagcccuug

SEQ ID NO: 812826 - RNA, 19 nt, Human
uucauuuguaucugcucac

SEQ ID NO: 812827 - RNA, 22 nt, Human
gagcucuuuaccaggucaggac

SEQ ID NO: 812828 - RNA, 22 nt, Human
agucucuuuaaucacagugucu

SEQ ID NO: 812829 - RNA, 22 nt, Human
cagcaacuuggacagcagucuu

SEQ ID NO: 812830 - RNA, 22 nt, Human
acaugcauggagggaaaauguc

SEQ ID NO: 812831 - RNA, 22 nt, Human
agcuggcuauacuugaaaaguc

SEQ ID NO: 812832 - RNA, 22 nt, Human
uuuauucucuaguuggucagau

SEQ ID NO: 812833 - RNA, 22 nt, Human
acuuaaauagaacuccucaaua

SEQ ID NO: 812834 - RNA, 22 nt, Human
aaagggccuccgccugggcagg

SEQ ID NO: 812835 - RNA, 20 nt, Human
agacaggagcccccauucag

SEQ ID NO: 812836 - RNA, 22 nt, Human
uucagagggcuugcuauguaca

SEQ ID NO: 812837 - RNA, 22 nt, Human
aaguuuguucagggcuuacauu

SEQ ID NO: 812838 - RNA, 22 nt, Human
uggucagaaggaagggcuccua

SEQ ID NO: 812839 - RNA, 22 nt, Human
aagcaggaagcucagguccuug

SEQ ID NO: 812840 - RNA, 22 nt, Human
ccuggcucaaggcgaggacucc

SEQ ID NO: 812841 - RNA, 19 nt, Human
uuagaaacuguugacacug

SEQ ID NO: 812842 - RNA, 22 nt, Human
uuucaagagggaacugaacaca

SEQ ID NO: 812843 - RNA, 19 nt, Human
gaguccugugcuccuuguu

SEQ ID NO: 812844 - RNA, 22 nt, Human
cuucagugaauguugaguaagg

SEQ ID NO: 812845 - RNA, 22 nt, Human
ggaggcugaggccccucacagg

SEQ ID NO: 812846 - RNA, 22 nt, Human
ccugcagccucuucugaaaauc

SEQ ID NO: 812847 - RNA, 22 nt, Human
gccaggguucgaauccguaugg

SEQ ID NO: 812848 - RNA, 22 nt, Human
cuucacauaaacaaagggccau

SEQ ID NO: 812849 - RNA, 22 nt, Human
uuugcacacacaauaacaaaug

SEQ ID NO: 812850 - RNA, 22 nt, Human
auauuucuccaaauguuuucaa

SEQ ID NO: 812851 - RNA, 22 nt, Human
gcuggcaggguucucacugaaa

SEQ ID NO: 812852 - RNA, 21 nt, Human
aggaggggucuuucccacuga

SEQ ID NO: 812853 - RNA, 22 nt, Human
ccacaagaugcaaacucuaaca

SEQ ID NO: 812854 - RNA, 22 nt, Human
cucuguuucucagccuauuucc

SEQ ID NO: 812855 - RNA, 22 nt, Human
gcagcugccuucagcuggaugg

SEQ ID NO: 812856 - RNA, 22 nt, Human
gcugccagcucacucuccugag

SEQ ID NO: 812857 - RNA, 22 nt, Human
aggcccagcccguccucgugcu

SEQ ID NO: 812858 - RNA, 22 nt, Human
gcugagcuagcuaucucagucu

SEQ ID NO: 812859 - RNA, 23 nt, Human
cuucucaguaguacacacacuau

SEQ ID NO: 812860 - RNA, 22 nt, Human
gcuuggcauuugcugggagcug

SEQ ID NO: 812861 - RNA, 22 nt, Human
ccagccccuauccucgcuccac

SEQ ID NO: 812862 - RNA, 22 nt, Human
uccugcuggcaaggaagggacu

SEQ ID NO: 812863 - RNA, 22 nt, Human
uguauuuaagcuuuaccuaaaa

SEQ ID NO: 812864 - RNA, 22 nt, Human
gaacucauuagccugcuuucag

SEQ ID NO: 812865 - RNA, 22 nt, Human
gcagcugauggaaguccuauug

SEQ ID NO: 812866 - RNA, 20 nt, Human
agaggcuuccuugggaggag

SEQ ID NO: 812867 - RNA, 22 nt, Human
aaugcuuugucugcuccagacu

SEQ ID NO: 812868 - RNA, 22 nt, Human
uccuggcucucuacaaaccaga

SEQ ID NO: 812869 - RNA, 22 nt, Human
aaagagaaaaugaucuguacau

SEQ ID NO: 812870 - RNA, 22 nt, Human
cucugaggucuaggaccauggc

SEQ ID NO: 812871 - RNA, 22 nt, Human
uucucagaaaagcaagcuuucu

SEQ ID NO: 812872 - RNA, 22 nt, Human
auuugcuuucagguauaaaagg

SEQ ID NO: 812873 - RNA, 22 nt, Human
cuggcugugcugacugagaggg

SEQ ID NO: 812874 - RNA, 22 nt, Human
cugcugagguccuugcucagac

SEQ ID NO: 812875 - RNA, 22 nt, Human
ugcuucauuaaaacaauauuuu

SEQ ID NO: 812876 - RNA, 22 nt, Human
cugaggcugggcugaggguaua

SEQ ID NO: 812877 - RNA, 22 nt, Human
gauccagauauuugggcuggua

SEQ ID NO: 812878 - RNA, 22 nt, Human
cacuuagagccagaugcauagu

SEQ ID NO: 812879 - RNA, 22 nt, Human
uuguuuauuagcaauuauccug

SEQ ID NO: 812880 - RNA, 22 nt, Human
gccuucccaagacgccugaguu

SEQ ID NO: 812881 - RNA, 22 nt, Human
cacaccaaaguauuugguauuu

SEQ ID NO: 812882 - RNA, 22 nt, Human
acccaggacacagagaugaccc

SEQ ID NO: 812883 - RNA, 22 nt, Human
aaguguuuuguaaacagaaaag

SEQ ID NO: 812884 - RNA, 22 nt, Human
uuuauauauggcuggucuggau

SEQ ID NO: 812885 - RNA, 22 nt, Human
aaugagucaaaacagcauauag

SEQ ID NO: 812886 - RNA, 22 nt, Human
uucaauuucauaauaucuagcu

SEQ ID NO: 812887 - RNA, 22 nt, Human
aauucacauauacauuauuccu

SEQ ID NO: 812888 - RNA, 22 nt, Human
gcugagaaaugcagacaugcug

SEQ ID NO: 812889 - RNA, 19 nt, Human
gcuggggaauggauauuga

SEQ ID NO: 812890 - RNA, 22 nt, Human
gucacuguauccagguuccagc

SEQ ID NO: 812891 - RNA, 22 nt, Human
agacagagauacuauguuguca

SEQ ID NO: 812892 - RNA, 22 nt, Human
caggguggggcuggcuaucaaa

SEQ ID NO: 812893 - RNA, 22 nt, Human
aaggcugggaaacaugcaggcc

SEQ ID NO: 812894 - RNA, 22 nt, Human
ucaggaagcuacugccagcagc

SEQ ID NO: 812895 - RNA, 22 nt, Human
cagucuuuuguauauuagcaga

SEQ ID NO: 812896 - RNA, 22 nt, Human
uuacaaagcgcuuuaccucuga

SEQ ID NO: 812897 - RNA, 23 nt, Human
aggcagugggggccacuuugcuu

SEQ ID NO: 812898 - RNA, 22 nt, Human
acagaagcagccgucacagaua

SEQ ID NO: 812899 - RNA, 17 nt, Human
augcacauguaagagga

SEQ ID NO: 812900 - RNA, 22 nt, Human
ggggaugguagaccggugacgu

SEQ ID NO: 812901 - RNA, 22 nt, Human
aaauguguuugauaggaauauu

SEQ ID NO: 812902 - RNA, 22 nt, Human
cauggcggucaggauguaggug

SEQ ID NO: 812903 - RNA, 22 nt, Human
aaauacuagaauucagaguuga

SEQ ID NO: 812904 - RNA, 22 nt, Human
gugcuaggauuacaggcauggg

SEQ ID NO: 812905 - RNA, 22 nt, Human
uagcauuaaagguaagacauua

SEQ ID NO: 812906 - RNA, 22 nt, Human
ucccugcccugccuucaugguu

SEQ ID NO: 812907 - RNA, 22 nt, Human
cacugcaguaacucuaggacug

SEQ ID NO: 812908 - RNA, 22 nt, Human
uaaauguguuguggaugaaguu

SEQ ID NO: 812909 - RNA, 22 nt, Human
acacaggcauagccauacaugu

SEQ ID NO: 812910 - RNA, 21 nt, Human
gcuggcuuccugagggcugag

SEQ ID NO: 812911 - RNA, 22 nt, Human
cuggagggaguuaggacccgga

SEQ ID NO: 812912 - RNA, 22 nt, Human
uucugcacuaaauaucaaauau

SEQ ID NO: 812913 - RNA, 22 nt, Human
uccagcucugcuucacagucuc

SEQ ID NO: 812914 - RNA, 19 nt, Human
ggccuggcuaucccugcug

SEQ ID NO: 812915 - RNA, 22 nt, Human
ugggaagcuacucaugcaggca

SEQ ID NO: 812916 - RNA, 22 nt, Human
caggcugcagaggccuuucaug

SEQ ID NO: 812917 - RNA, 18 nt, Human
cagagcagagguggagcg

SEQ ID NO: 812918 - RNA, 23 nt, Human
uaugccaaaauggaaaguguaua

SEQ ID NO: 812919 - RNA, 22 nt, Human
gaguuaaauagcuuaggauuca

SEQ ID NO: 812920 - RNA, 22 nt, Human
ugagccagccuugcagcugugc

SEQ ID NO: 812921 - RNA, 22 nt, Human
acaggcagauuaaggguaggca

SEQ ID NO: 812922 - RNA, 22 nt, Human
ggacagagggcaggagcccaga

SEQ ID NO: 812923 - RNA, 17 nt, Human
gcccuggagccaggcua

SEQ ID NO: 812924 - RNA, 22 nt, Human
aaucaagaguuguguaauauuu

SEQ ID NO: 812925 - RNA, 22 nt, Human
augacagcauuuucuucuaagg

SEQ ID NO: 812926 - RNA, 22 nt, Human
aaacauuagacaccauaugcuc

SEQ ID NO: 812927 - RNA, 22 nt, Human
ucagcaggugaacaucaugcca

SEQ ID NO: 812928 - RNA, 23 nt, Human
ggcucugugcugggccugcagga

SEQ ID NO: 812929 - RNA, 22 nt, Human
uuccuucuuccaaacccaucau

SEQ ID NO: 812930 - RNA, 22 nt, Human
ucaggcugcuuucaugcuuaga

SEQ ID NO: 812931 - RNA, 22 nt, Human
uccagggacaguauagaggauc

SEQ ID NO: 812932 - RNA, 23 nt, Human
uugcuucugugcaauucaguacu

SEQ ID NO: 812933 - RNA, 20 nt, Human
aggcagagcgcacuuuuaga

SEQ ID NO: 812934 - RNA, 22 nt, Human
acagaaguccccaugaagaagc

SEQ ID NO: 812935 - RNA, 22 nt, Human
aaaguguaaaagcauguuaggg

SEQ ID NO: 812936 - RNA, 22 nt, Human
uguucuuacggaacuuaucuuu

SEQ ID NO: 812937 - RNA, 22 nt, Human
uuucucucuacaguacuuucau

SEQ ID NO: 812938 - RNA, 22 nt, Human
ucccagcacagggcagauguga

SEQ ID NO: 812939 - RNA, 22 nt, Human
uggagguguauaagguagcuuc

SEQ ID NO: 812940 - RNA, 22 nt, Human
ccaggucuaucaaguugggcuc

SEQ ID NO: 812941 - RNA, 22 nt, Human
cuaggcuguucaugcucagacc

SEQ ID NO: 812942 - RNA, 22 nt, Human
aauauaguucugguauuguuaa

SEQ ID NO: 812943 - RNA, 17 nt, Human
uccuggcucugccacug

SEQ ID NO: 812944 - RNA, 22 nt, Human
gagugucagugccuggcuuguu

SEQ ID NO: 812945 - RNA, 22 nt, Human
cacagcaauagcuaacugauac

SEQ ID NO: 812946 - RNA, 22 nt, Human
gccuggagaagauggaacuagc

SEQ ID NO: 812947 - RNA, 22 nt, Human
augaaacaugcuuuguggauga

SEQ ID NO: 812948 - RNA, 21 nt, Human
cuuugguuuccuccugccuuc

SEQ ID NO: 812949 - RNA, 22 nt, Human
uuuacaagucagggacuguucu

SEQ ID NO: 812950 - RNA, 22 nt, Human
uaagucaugauucuguguuacu

SEQ ID NO: 812951 - RNA, 22 nt, Human
aggaggcugggcacaguggccu

SEQ ID NO: 812952 - RNA, 22 nt, Human
guaaaauugcaauuacuuuugc

SEQ ID NO: 812953 - RNA, 22 nt, Human
ccagaauccaaaacguuuugag

SEQ ID NO: 812954 - RNA, 22 nt, Human
uuucauuacuuguuaaggguag

SEQ ID NO: 812955 - RNA, 22 nt, Human
accacaggaauugcucuguggu

SEQ ID NO: 812956 - RNA, 22 nt, Human
acaauuuauccauuguauaguu

SEQ ID NO: 812957 - RNA, 22 nt, Human
gcaggagguugagccaggacug

SEQ ID NO: 812958 - RNA, 23 nt, Human
ucuuuucaaugguucuuuaugug

SEQ ID NO: 812959 - RNA, 22 nt, Human
gaagauguuauggagagcucag

SEQ ID NO: 812960 - RNA, 20 nt, Human
auucuacaagaauaagcaug

SEQ ID NO: 812961 - RNA, 22 nt, Human
aaagucauuguaauauaugcua

SEQ ID NO: 812962 - RNA, 22 nt, Human
uucuucaaccaucuacauaaac

SEQ ID NO: 812963 - RNA, 22 nt, Human
gagccgaggcgcacagcucggg

SEQ ID NO: 812964 - RNA, 22 nt, Human
ugauucaauuaucugaugcuuu

SEQ ID NO: 812965 - RNA, 22 nt, Human
gaaacuuuuaaaccucaugagu

SEQ ID NO: 812966 - RNA, 22 nt, Human
ccugcugugaccggggagcagg

SEQ ID NO: 812967 - RNA, 22 nt, Human
ccuggcucagaccccaguucug

SEQ ID NO: 812968 - RNA, 22 nt, Human
uguuuacuugagguggaaacaa

SEQ ID NO: 812969 - RNA, 22 nt, Human
caggcacacagggaauuuggcu

SEQ ID NO: 812970 - RNA, 22 nt, Human
aggcacuuugaaauuuggagcu

SEQ ID NO: 812971 - RNA, 22 nt, Human
gaguccuguugucccagauggg

SEQ ID NO: 812972 - RNA, 22 nt, Human
ucucugaagagcucagacuagu

SEQ ID NO: 812973 - RNA, 22 nt, Human
uggcccagucagcaggagaggg

SEQ ID NO: 812974 - RNA, 22 nt, Human
ggcaggacucucaggaccaagc

SEQ ID NO: 812975 - RNA, 22 nt, Human
acacauuuuggcuagguggaga

SEQ ID NO: 812976 - RNA, 22 nt, Human
gucaccauggauaagaaucacu

SEQ ID NO: 812977 - RNA, 17 nt, Human
uuacagagguaauuaag

SEQ ID NO: 812978 - RNA, 23 nt, Human
gagaaaccucgguaagcaggagg

SEQ ID NO: 812979 - RNA, 22 nt, Human
cagcuggcugcggugaggggac

SEQ ID NO: 812980 - RNA, 22 nt, Human
acauucacaagccuacaagguu

SEQ ID NO: 812981 - RNA, 22 nt, Human
cccagggugcggcccuggcugg

SEQ ID NO: 812982 - RNA, 22 nt, Human
cuuccuccgaagaaguugcugg

SEQ ID NO: 812983 - RNA, 22 nt, Human
gggccggagcugggucccgcgc

SEQ ID NO: 812984 - RNA, 22 nt, Human
ucaggcuguauaucuugcacuc

SEQ ID NO: 812985 - RNA, 22 nt, Human
cugugccauucuuuguagcaug

SEQ ID NO: 812986 - RNA, 19 nt, Human
accuucagaguggcacaaa

SEQ ID NO: 812987 - RNA, 22 nt, Human
uccagcagagucucugaggggg

SEQ ID NO: 812988 - RNA, 22 nt, Human
uccacugcucauuccacaggca

SEQ ID NO: 812989 - RNA, 22 nt, Human
agcagagugugaaggcagggcu

SEQ ID NO: 812990 - RNA, 22 nt, Human
uacagagaacucauagaaagaa

SEQ ID NO: 812991 - RNA, 22 nt, Human
cuuugauauaaguauacauagu

SEQ ID NO: 812992 - RNA, 22 nt, Human
agucuuuauucacuauugauaa

SEQ ID NO: 812993 - RNA, 22 nt, Human
gcuccaaaguccagcuguuucc

SEQ ID NO: 812994 - RNA, 22 nt, Human
cuaaaugugacucaccaucuca

SEQ ID NO: 812995 - RNA, 22 nt, Human
uggacccaccccagggccugcu

SEQ ID NO: 812996 - RNA, 22 nt, Human
uggaaauacaagaaguauguca

SEQ ID NO: 812997 - RNA, 22 nt, Human
uucauucuucagagcugcgcuu

SEQ ID NO: 812998 - RNA, 22 nt, Human
agcagggacugagccaguggga

SEQ ID NO: 812999 - RNA, 22 nt, Human
agagaauacaggguaacaggaa

SEQ ID NO: 813000 - RNA, 22 nt, Human
uuuccaaaguugccauaagcuu

SEQ ID NO: 813001 - RNA, 22 nt, Human
ccagcagcucccucaggguccg

SEQ ID NO: 813002 - RNA, 22 nt, Human
ucuagaaaaccaauauuacaug

SEQ ID NO: 813003 - RNA, 22 nt, Human
ugcuggggguucagaugaguaa

SEQ ID NO: 813004 - RNA, 22 nt, Human
ugcuggggucauggggcgcccg

SEQ ID NO: 813005 - RNA, 22 nt, Human
ugggcagggagcuggaaccaca

SEQ ID NO: 813006 - RNA, 22 nt, Human
uggcagggaauacagauguuua

SEQ ID NO: 813007 - RNA, 22 nt, Human
acaggacaaggggaagaagaua

SEQ ID NO: 813008 - RNA, 22 nt, Human
ggcaggguggcagaggcucaga

SEQ ID NO: 813009 - RNA, 22 nt, Human
caugaggugauaaagcugggau

SEQ ID NO: 813010 - RNA, 22 nt, Human
gcuccaggcgagcuggaccaga

SEQ ID NO: 813011 - RNA, 22 nt, Human
cccagcaguuguuggugcacau

SEQ ID NO: 813012 - RNA, 22 nt, Human
ccagcagagcauggggaggaag

SEQ ID NO: 813013 - RNA, 22 nt, Human
cacaucauagagacucaaucca

SEQ ID NO: 813014 - RNA, 22 nt, Human
auacauucaucacuuuuggucc

SEQ ID NO: 813015 - RNA, 22 nt, Human
ggagcuaggcaaagcucacgga

SEQ ID NO: 813016 - RNA, 22 nt, Human
gcugcucugugacagccuccgg

SEQ ID NO: 813017 - RNA, 22 nt, Human
gaggcuccgugcugcugcccug

SEQ ID NO: 813018 - RNA, 22 nt, Human
cagagagaggccacugcuauua

SEQ ID NO: 813019 - RNA, 22 nt, Human
cauuuacauuuaagguuaauau

SEQ ID NO: 813020 - RNA, 22 nt, Human
acuuacaagcuagggaagcuug

SEQ ID NO: 813021 - RNA, 20 nt, Human
cucaguguggccugaguguu

SEQ ID NO: 813022 - RNA, 22 nt, Human
cugggccacuccagaugcccac

SEQ ID NO: 813023 - RNA, 22 nt, Human
aggcuaggaacagcccggcccu

SEQ ID NO: 813024 - RNA, 22 nt, Human
gggcagaggcucuggcccaucc

SEQ ID NO: 813025 - RNA, 22 nt, Human
ugcaauaaguuguguuaucacu

SEQ ID NO: 813026 - RNA, 22 nt, Human
ucuccuggaagaauaccacacu

SEQ ID NO: 813027 - RNA, 22 nt, Human
cucuccuugaggcuuggacuuc

SEQ ID NO: 813028 - RNA, 22 nt, Human
ugggaagaagcagagaacugga

SEQ ID NO: 813029 - RNA, 22 nt, Human
caggauaaauaguaaauguaag

SEQ ID NO: 813030 - RNA, 22 nt, Human
ccagccucaucauauuccugcu

SEQ ID NO: 813031 - RNA, 18 nt, Human
aauuuccauaugaauugc

SEQ ID NO: 813032 - RNA, 22 nt, Human
aggucccucagaggccucaccg

SEQ ID NO: 813033 - RNA, 22 nt, Human
ugcggccgggcaucguauggcg

SEQ ID NO: 813034 - RNA, 22 nt, Human
gucaauaauuuuauggagagaa

SEQ ID NO: 813035 - RNA, 22 nt, Human
aggccuggcuuugguuugcuga

SEQ ID NO: 813036 - RNA, 22 nt, Human
cccaagccagacccugacccug

SEQ ID NO: 813037 - RNA, 22 nt, Human
ucuccuggcauuugguugagua

SEQ ID NO: 813038 - RNA, 22 nt, Human
ggcggcccugcacgugcugagg

SEQ ID NO: 813039 - RNA, 22 nt, Human
uccccaggggccugggcacagu

SEQ ID NO: 813040 - RNA, 22 nt, Human
cauuucaagcauugacuucuau

SEQ ID NO: 813041 - RNA, 17 nt, Human
auacaguuuauuuuaca

SEQ ID NO: 813042 - RNA, 22 nt, Human
caauuuccuucauagaugacug

SEQ ID NO: 813043 - RNA, 20 nt, Human
uccagggcuagggagcucau

SEQ ID NO: 813044 - RNA, 22 nt, Human
gcaggacaaaauuuccagggug

SEQ ID NO: 813045 - RNA, 22 nt, Human
aauguuacgaucaacaacacau

SEQ ID NO: 813046 - RNA, 22 nt, Human
gcuggccugggcagccugucgg

SEQ ID NO: 813047 - RNA, 22 nt, Human
cuucucccuggcuucugcacac

SEQ ID NO: 813048 - RNA, 22 nt, Human
gagcagcuccagccgcaugacu

SEQ ID NO: 813049 - RNA, 22 nt, Human
acuggcagaacgugaugcgggu

SEQ ID NO: 813050 - RNA, 17 nt, Human
cccugcacccuacucuc

SEQ ID NO: 813051 - RNA, 18 nt, Human
accuccccauuuucugaa

SEQ ID NO: 813052 - RNA, 22 nt, Human
uuuuaauacugcuauuguagga

SEQ ID NO: 813053 - RNA, 22 nt, Human
cagucagagucacaguaauuug

SEQ ID NO: 813054 - RNA, 22 nt, Human
agccaacagccagcaucaacca

SEQ ID NO: 813055 - RNA, 22 nt, Human
uuuucugugauucugagguugg

SEQ ID NO: 813056 - RNA, 22 nt, Human
ccauuggagaguuuuaagaagg

SEQ ID NO: 813057 - RNA, 22 nt, Human
ugggagcagcuuugcgagggag

SEQ ID NO: 813058 - RNA, 22 nt, Human
cuaaggcagguccauuccagga

SEQ ID NO: 813059 - RNA, 22 nt, Human
ccaggaaggcguuguuccucuc

SEQ ID NO: 813060 - RNA, 22 nt, Human
cuuaaauuggaugaguuaaguu

SEQ ID NO: 813061 - RNA, 22 nt, Human
agggccagggaagcuguauuuu

SEQ ID NO: 813062 - RNA, 23 nt, Human
agcaggcaucuguggcacaaggc

SEQ ID NO: 813063 - RNA, 22 nt, Human
uuacauucauugaagugauuca

SEQ ID NO: 813064 - RNA, 22 nt, Human
ccaggagcuggcauguggagag

SEQ ID NO: 813065 - RNA, 22 nt, Human
uacaagaggauguggacaugga

SEQ ID NO: 813066 - RNA, 22 nt, Human
accuguuuaccugcaccuguuu

SEQ ID NO: 813067 - RNA, 22 nt, Human
uuuccucugggcccugccaccc

SEQ ID NO: 813068 - RNA, 22 nt, Human
cacaccuuaggccugagcgcuu

SEQ ID NO: 813069 - RNA, 22 nt, Human
aggcuagggccauggcugguga

SEQ ID NO: 813070 - RNA, 22 nt, Human
ggggccagcacugugccuuugu

SEQ ID NO: 813071 - RNA, 22 nt, Human
aggccacagccugggaggugac

SEQ ID NO: 813072 - RNA, 22 nt, Human
aucaagaacuuauuuuggaaau

SEQ ID NO: 813073 - RNA, 22 nt, Human
cagcaggugucuagcaaggguc

SEQ ID NO: 813074 - RNA, 22 nt, Human
agcugacauaagcacuuucuaa

SEQ ID NO: 813075 - RNA, 21 nt, Human
ggcuguggagccaugacucac

SEQ ID NO: 813076 - RNA, 21 nt, Human
acauacauuaucuuuuuaaaa

SEQ ID NO: 813077 - RNA, 23 nt, Human
ccagcccuccaccagcucuaggc

SEQ ID NO: 813078 - RNA, 22 nt, Human
uucaaaauuguucuaagcucug

SEQ ID NO: 813079 - RNA, 22 nt, Human
agaggaaggaugcauauccaaa

SEQ ID NO: 813080 - RNA, 22 nt, Human
uggugcugccaggcuccugcca

SEQ ID NO: 813081 - RNA, 22 nt, Human
uaagaugucaaagggucacagu

SEQ ID NO: 813082 - RNA, 22 nt, Human
uggcccaggugcaagagacaga

SEQ ID NO: 813083 - RNA, 22 nt, Human
ccuggcuucuauaccaccaggu

SEQ ID NO: 813084 - RNA, 22 nt, Human
uucaugaauguuccaugugagu

SEQ ID NO: 813085 - RNA, 22 nt, Human
ucagugucaucacuuaauauaa

SEQ ID NO: 813086 - RNA, 22 nt, Human
uacagugaaugaauggcugugc

SEQ ID NO: 813087 - RNA, 22 nt, Human
ggugcugacauucagagucugg

SEQ ID NO: 813088 - RNA, 22 nt, Human
cuacagaaaaucagccacaggc

SEQ ID NO: 813089 - RNA, 22 nt, Human
ggggaggcugaugugggcaaag

SEQ ID NO: 813090 - RNA, 22 nt, Human
uggccacaugcgucugugaggc

SEQ ID NO: 813091 - RNA, 21 nt, Human
uuacaaagcuacagauguugc

SEQ ID NO: 813092 - RNA, 22 nt, Human
uaauagaaagguauuuuuugca

SEQ ID NO: 813093 - RNA, 22 nt, Human
auugauucucauaggaccaucu

SEQ ID NO: 813094 - RNA, 22 nt, Human
agcccagccugauucuacaccc

SEQ ID NO: 813095 - RNA, 23 nt, Human
agccagggcacugguggagauug

SEQ ID NO: 813096 - RNA, 22 nt, Human
caucaggaggagaugaagaaaa

SEQ ID NO: 813097 - RNA, 22 nt, Human
ggcagugagucccggagaggcc

SEQ ID NO: 813098 - RNA, 22 nt, Human
aauauguucaaaauagaucacu

SEQ ID NO: 813099 - RNA, 22 nt, Human
gaaggaagugcucauacuaguu

SEQ ID NO: 813100 - RNA, 22 nt, Human
uccuggggcucaugggauuugu

SEQ ID NO: 813101 - RNA, 22 nt, Human
caggaguguugauugcucagga

SEQ ID NO: 813102 - RNA, 22 nt, Human
ggcaugaguaacgugagugagg

SEQ ID NO: 813103 - RNA, 22 nt, Human
uuuaaugauagucuuacgaaaa

SEQ ID NO: 813104 - RNA, 22 nt, Human
gggagcugaauggcaauggaga

SEQ ID NO: 813105 - RNA, 22 nt, Human
cauauacacuuccaccucugug

SEQ ID NO: 813106 - RNA, 22 nt, Human
uucuauugggcagcauugcuuc

SEQ ID NO: 813107 - RNA, 22 nt, Human
aaaaguauaggguuuggaguca

SEQ ID NO: 813108 - RNA, 22 nt, Human
gccagcagguugucaaggagcu

SEQ ID NO: 813109 - RNA, 22 nt, Human
cuugaaugaaaccaacugauga

SEQ ID NO: 813110 - RNA, 22 nt, Human
gcuggagucccugccuuuccuu

SEQ ID NO: 813111 - RNA, 22 nt, Human
cgcugccucucuggggcccugg

SEQ ID NO: 813112 - RNA, 22 nt, Human
gugcagcuuccuggucucagcc

SEQ ID NO: 813113 - RNA, 22 nt, Human
ugaaaauuguuguacuugauaa

SEQ ID NO: 813114 - RNA, 20 nt, Human
ggccuuggguuucgccuguu

SEQ ID NO: 813115 - RNA, 22 nt, Human
aggccugccuggaucacacaga

SEQ ID NO: 813116 - RNA, 21 nt, Human
gcucuaucaggccaaaauguc

SEQ ID NO: 813117 - RNA, 22 nt, Human
agacaauggcuaaguaaccugu

SEQ ID NO: 813118 - RNA, 22 nt, Human
gacccaggguauccagagcugc

SEQ ID NO: 813119 - RNA, 22 nt, Human
aguuucuaccgguacauucagg

SEQ ID NO: 813120 - RNA, 22 nt, Human
cauacaaucaaguucuuuauua

SEQ ID NO: 813121 - RNA, 22 nt, Human
ccagggcuccauugcucauccu

SEQ ID NO: 813122 - RNA, 22 nt, Human
cuggaaugucugcucaauguuu

SEQ ID NO: 813123 - RNA, 22 nt, Human
ucuuccagccaauagcguccuu

SEQ ID NO: 813124 - RNA, 22 nt, Human
uauuugauagagauaaaugaua

SEQ ID NO: 813125 - RNA, 22 nt, Human
ggagcuggcagcgcaacccaga

SEQ ID NO: 813126 - RNA, 22 nt, Human
uuugacauugaaagcagaaucg

SEQ ID NO: 813127 - RNA, 22 nt, Human
ugucauggucuguaaggagccc

SEQ ID NO: 813128 - RNA, 22 nt, Human
ucuggggaugaggaccuagaug

SEQ ID NO: 813129 - RNA, 22 nt, Human
cacuugaaugagaauuuccugg

SEQ ID NO: 813130 - RNA, 22 nt, Human
agguaggauagauaggaagacc

SEQ ID NO: 813131 - RNA, 22 nt, Human
cccaggcugaguuagagguguc

SEQ ID NO: 813132 - RNA, 22 nt, Human
augaaauguauucagauaugua

SEQ ID NO: 813133 - RNA, 22 nt, Human
gugcugagauuggagugagcag

SEQ ID NO: 813134 - RNA, 22 nt, Human
guccaggagcucagggcuuauu

SEQ ID NO: 813135 - RNA, 22 nt, Human
acauggaauguguacuaaguua

SEQ ID NO: 813136 - RNA, 22 nt, Human
aaagucaucagaaccuuccaga

SEQ ID NO: 813137 - RNA, 22 nt, Human
acaaaguaagggcuaaugagca

SEQ ID NO: 813138 - RNA, 22 nt, Human
gggugggaacaggaugccagga

SEQ ID NO: 813139 - RNA, 22 nt, Human
ggcuguggccagcggggcugag

SEQ ID NO: 813140 - RNA, 22 nt, Human
ugggaggcagaaguugacugga

SEQ ID NO: 813141 - RNA, 20 nt, Human
aaacaagguugcucugagga

SEQ ID NO: 813142 - RNA, 22 nt, Human
uuucugaauuuacucaagguca

SEQ ID NO: 813143 - RNA, 22 nt, Human
aaagccagugguaugagagaaa

SEQ ID NO: 813144 - RNA, 22 nt, Human
ucugggcucugucagcaccucu

SEQ ID NO: 813145 - RNA, 22 nt, Human
aguaauaauagcuguaaagugc

SEQ ID NO: 813146 - RNA, 22 nt, Human
acuuauaggccaaguagacugu

SEQ ID NO: 813147 - RNA, 22 nt, Human
cugggcccacgagggcucuggg

SEQ ID NO: 813148 - RNA, 23 nt, Human
agaugaaagcuucccaucacagu

SEQ ID NO: 813149 - RNA, 22 nt, Human
aaaguucuuugcaucuuugcuc

SEQ ID NO: 813150 - RNA, 22 nt, Human
aggcucugugcagccugcaucu

SEQ ID NO: 813151 - RNA, 22 nt, Human
caacagaaggaagcagggucag

SEQ ID NO: 813152 - RNA, 22 nt, Human
caggaaauugcaacagucugag

SEQ ID NO: 813153 - RNA, 22 nt, Human
ccaggcacugcucgaggugcua

SEQ ID NO: 813154 - RNA, 22 nt, Human
uggcuucugcucccagaaugau

SEQ ID NO: 813155 - RNA, 19 nt, Human
ggaccagguccugggcagc

SEQ ID NO: 813156 - RNA, 22 nt, Human
aguggagugaguggcagaagga

SEQ ID NO: 813157 - RNA, 22 nt, Human
uccagcucaggguuggcucaag

SEQ ID NO: 813158 - RNA, 22 nt, Human
uuuucacacaaggugauaaguu

SEQ ID NO: 813159 - RNA, 22 nt, Human
gaaggaggcuccccaaagucug

SEQ ID NO: 813160 - RNA, 22 nt, Human
aauaaaguagcguuuaaggugc

SEQ ID NO: 813161 - RNA, 22 nt, Human
ggcaaggggucaggcugagaca

SEQ ID NO: 813162 - RNA, 19 nt, Human
uggguuggaagggaaugaa

SEQ ID NO: 813163 - RNA, 22 nt, Human
auuguggugucaguuauaggca

SEQ ID NO: 813164 - RNA, 22 nt, Human
ugcaggaagacuucccaagcca

SEQ ID NO: 813165 - RNA, 22 nt, Human
agagcccugugguucugguaag

SEQ ID NO: 813166 - RNA, 22 nt, Human
uugaaugaggaagagcacuggc

SEQ ID NO: 813167 - RNA, 22 nt, Human
cccucccuauguagaugauguu

SEQ ID NO: 813168 - RNA, 19 nt, Human
caggacagacuucaaagcc

SEQ ID NO: 813169 - RNA, 22 nt, Human
aacucugguucagugauuucag

SEQ ID NO: 813170 - RNA, 19 nt, Human
cuggcagccugucuguguc

SEQ ID NO: 813171 - RNA, 22 nt, Human
aaggcagagucuaucuuggaag

SEQ ID NO: 813172 - RNA, 22 nt, Human
acaguuacucauagaagcacuu

SEQ ID NO: 813173 - RNA, 22 nt, Human
ccaggcuggaaucaauauucug

SEQ ID NO: 813174 - RNA, 18 nt, Human
aggcuugggcccagcagc

SEQ ID NO: 813175 - RNA, 22 nt, Human
aggagcugggcccaaggaugcu

SEQ ID NO: 813176 - RNA, 22 nt, Human
cccuggagugugacgaggcauu

SEQ ID NO: 813177 - RNA, 22 nt, Human
uuuuuuccucugugauggcaaa

SEQ ID NO: 813178 - RNA, 22 nt, Human
aggacacuuggcuauuguucca

SEQ ID NO: 813179 - RNA, 22 nt, Human
ucccaggcagcuucuuucauca

SEQ ID NO: 813180 - RNA, 22 nt, Human
agccuggcuaaauucucccaug

SEQ ID NO: 813181 - RNA, 22 nt, Human
gucuggggcagcaaggcgcgcg

SEQ ID NO: 813182 - RNA, 22 nt, Human
gcucuuggccaaguggaagggu

SEQ ID NO: 813183 - RNA, 22 nt, Human
cuccagagaguccagcucuggg

SEQ ID NO: 813184 - RNA, 20 nt, Human
gaagccagaggggaaaggag

SEQ ID NO: 813185 - RNA, 19 nt, Human
cacaauuaugagacacuua

SEQ ID NO: 813186 - RNA, 22 nt, Human
cagagaagaaagugacuauaau

SEQ ID NO: 813187 - RNA, 22 nt, Human
uguccugugcacuguagcaugu

SEQ ID NO: 813188 - RNA, 22 nt, Human
ucuucacauggagaagcaacuc

SEQ ID NO: 813189 - RNA, 19 nt, Human
aaaagucuauucaauuaca

SEQ ID NO: 813190 - RNA, 22 nt, Human
ucagucacuuuugccugcuaca

SEQ ID NO: 813191 - RNA, 22 nt, Human
guuucuaagcacaugugagugu

SEQ ID NO: 813192 - RNA, 22 nt, Human
ucccugggguaucgcugaggca

SEQ ID NO: 813193 - RNA, 22 nt, Human
uucuacuuuagcaugcucauuc

SEQ ID NO: 813194 - RNA, 20 nt, Human
ucuccuggugacaguaccca

SEQ ID NO: 813195 - RNA, 22 nt, Human
aaagaagggacagacugccucu

SEQ ID NO: 813196 - RNA, 22 nt, Human
aaagaaucuauauaucaccacc

SEQ ID NO: 813197 - RNA, 22 nt, Human
uacaaaggcgguuuuucugggc

SEQ ID NO: 813198 - RNA, 22 nt, Human
ccuggcagacagcacugaagcu

SEQ ID NO: 813199 - RNA, 22 nt, Human
auaaagcuuugaaauggagaua

SEQ ID NO: 813200 - RNA, 22 nt, Human
uagaaacauauguuugagacau

SEQ ID NO: 813201 - RNA, 19 nt, Human
gcuggcuggaggagggaca

SEQ ID NO: 813202 - RNA, 23 nt, Human
auguauuuaaauuucagugauga

SEQ ID NO: 813203 - RNA, 22 nt, Human
cuuucaaagaccuuggcauggg

SEQ ID NO: 813204 - RNA, 22 nt, Human
acuauacaagauuagggauuug

SEQ ID NO: 813205 - RNA, 22 nt, Human
ggcugccugaggcugaggcccg

SEQ ID NO: 813206 - RNA, 22 nt, Human
ggggagcaauaguugaggugug

SEQ ID NO: 813207 - RNA, 22 nt, Human
auuugcaugcuucuauugugaa

SEQ ID NO: 813208 - RNA, 22 nt, Human
auacuaaaguauagaacuuagu

SEQ ID NO: 813209 - RNA, 22 nt, Human
uuuaucuguauaucucaagugu

SEQ ID NO: 813210 - RNA, 22 nt, Human
uacugucuauacacuugauuac

SEQ ID NO: 813211 - RNA, 22 nt, Human
auuuuuccugcuggaucugcuc

SEQ ID NO: 813212 - RNA, 22 nt, Human
aacaggcaauuuaggacucuuu

SEQ ID NO: 813213 - RNA, 22 nt, Human
cagcuggccaaucagggcgccc

SEQ ID NO: 813214 - RNA, 22 nt, Human
cugucccaggauccugacucca

SEQ ID NO: 813215 - RNA, 22 nt, Human
gccaggaggucagccccucaac

SEQ ID NO: 813216 - RNA, 22 nt, Human
gaaauacaaaugccuagauccu

SEQ ID NO: 813217 - RNA, 22 nt, Human
gagcugaggcucaggcuggcgu

SEQ ID NO: 813218 - RNA, 22 nt, Human
aucacaaaggcugcuucaugau

SEQ ID NO: 813219 - RNA, 22 nt, Human
uuuauucauuguuucgucgcag

SEQ ID NO: 813220 - RNA, 22 nt, Human
accaguuucugggggagguugg

SEQ ID NO: 813221 - RNA, 22 nt, Human
uggaagcacuuggguuuuguug

SEQ ID NO: 813222 - RNA, 22 nt, Human
cuucucuuccuuugucaacuga

SEQ ID NO: 813223 - RNA, 22 nt, Human
uuucaaugacacaaaagagaaa

SEQ ID NO: 813224 - RNA, 22 nt, Human
uauaaagugugaacugugagua

SEQ ID NO: 813225 - RNA, 22 nt, Human
uuaugauuugccacagauuggu

SEQ ID NO: 813226 - RNA, 22 nt, Human
aggcuugggacugcuuaggagc

SEQ ID NO: 813227 - RNA, 20 nt, Human
augucugaaguaauccauuu

SEQ ID NO: 813228 - RNA, 22 nt, Human
uuuuucucuucuguaaaguggu

SEQ ID NO: 813229 - RNA, 22 nt, Human
cuuuuuaucucuuaaugauguu

SEQ ID NO: 813230 - RNA, 22 nt, Human
ugacgguauuuagggagcagcg

SEQ ID NO: 813231 - RNA, 22 nt, Human
aaagcccauguggaaguacagg

SEQ ID NO: 813232 - RNA, 22 nt, Human
gccccucccagucaggagcacu

SEQ ID NO: 813233 - RNA, 22 nt, Human
uccagcagcccgaaggcccauc

SEQ ID NO: 813234 - RNA, 22 nt, Human
gcaggucuaucaggcugcaggu

SEQ ID NO: 813235 - RNA, 23 nt, Human
aggagaagagauuuccacaugca

SEQ ID NO: 813236 - RNA, 22 nt, Human
aacuuauuccauaggcucacug

SEQ ID NO: 813237 - RNA, 22 nt, Human
uagucacacaauuguguacauu

SEQ ID NO: 813238 - RNA, 22 nt, Human
aaagcagguuaugaccauggcc

SEQ ID NO: 813239 - RNA, 22 nt, Human
ucaugcaagaauaauaggaagg

SEQ ID NO: 813240 - RNA, 22 nt, Human
agaggccugugugcuccagugg

SEQ ID NO: 813241 - RNA, 22 nt, Human
gaaggcaguaaauggcuguuuu

SEQ ID NO: 813242 - RNA, 22 nt, Human
cacuguucacauuuuagucuau

SEQ ID NO: 813243 - RNA, 22 nt, Human
ggaggaaauccuuaguaaggca

SEQ ID NO: 813244 - RNA, 22 nt, Human
cugccaggugccagggcgcggc

SEQ ID NO: 813245 - RNA, 22 nt, Human
acagcuuuaucucagggaucag

SEQ ID NO: 813246 - RNA, 22 nt, Human
auggcccagacucagacuggug

SEQ ID NO: 813247 - RNA, 22 nt, Human
aaagagaacuuuuacccaagaa

SEQ ID NO: 813248 - RNA, 20 nt, Human
uccuggccucccuggggcuc

SEQ ID NO: 813249 - RNA, 22 nt, Human
uucaccauaaugcaaaguggga

SEQ ID NO: 813250 - RNA, 22 nt, Human
caucaggaauuauccuaauuau

SEQ ID NO: 813251 - RNA, 22 nt, Human
agaaaggaggaagaaugaccuc

SEQ ID NO: 813252 - RNA, 22 nt, Human
uauaaaugcacuuuugaaauau

SEQ ID NO: 813253 - RNA, 22 nt, Human
cuucacugcagucauggcucug

SEQ ID NO: 813254 - RNA, 22 nt, Human
ucacaggcuggucuccgaggac

SEQ ID NO: 813255 - RNA, 22 nt, Human
ugagugagacauccugucuuaa

SEQ ID NO: 813256 - RNA, 22 nt, Human
ucugaggaguugggccagugcu

SEQ ID NO: 813257 - RNA, 22 nt, Human
ucccacagggcuucucuguaca

SEQ ID NO: 813258 - RNA, 22 nt, Human
uggugagagcugaccgugcgag

SEQ ID NO: 813259 - RNA, 22 nt, Human
uuaauaacauuguguaucaccc

SEQ ID NO: 813260 - RNA, 22 nt, Human
ugguaaguaagugaaacaucca

SEQ ID NO: 813261 - RNA, 22 nt, Human
uuuuuguagucauuagaagagg

SEQ ID NO: 813262 - RNA, 22 nt, Human
uucaagaggcuuaauucuggau

SEQ ID NO: 813263 - RNA, 22 nt, Human
gccucagccggcggacgccagg

SEQ ID NO: 813264 - RNA, 23 nt, Human
auugaccagcugucucauuuuca

SEQ ID NO: 813265 - RNA, 22 nt, Human
gcaguccucauccuuuagcagu

SEQ ID NO: 813266 - RNA, 22 nt, Human
ugaguaacacaguaugcuuaca

SEQ ID NO: 813267 - RNA, 22 nt, Human
gcuccuggagagauugagaaag

SEQ ID NO: 813268 - RNA, 22 nt, Human
caggacuguauccuuggagaaa

SEQ ID NO: 813269 - RNA, 22 nt, Human
gccucuuguuuccuuacaugga

SEQ ID NO: 813270 - RNA, 22 nt, Human
uuaaggaacaauucuacacacc

SEQ ID NO: 813271 - RNA, 22 nt, Human
gcaguacacacauauguauucg

SEQ ID NO: 813272 - RNA, 22 nt, Human
cugggcaggagaggugguugga

SEQ ID NO: 813273 - RNA, 19 nt, Human
accaggcuuauggucagug

SEQ ID NO: 813274 - RNA, 22 nt, Human
aaaauagcagggaugugggaaa

SEQ ID NO: 813275 - RNA, 17 nt, Human
ggcagggugcuggguau

SEQ ID NO: 813276 - RNA, 22 nt, Human
ucauaagugguuuauaugcuug

SEQ ID NO: 813277 - RNA, 22 nt, Human
uuaauaaacaggugcagcugaa

SEQ ID NO: 813278 - RNA, 22 nt, Human
ggacaggagugaggcggguucc

SEQ ID NO: 813279 - RNA, 22 nt, Human
ucaggaugacuucaaggaggaa

SEQ ID NO: 813280 - RNA, 22 nt, Human
ccucucuguguggccucuccau

SEQ ID NO: 813281 - RNA, 22 nt, Human
ugaguuaucuaaaauagucaaa

SEQ ID NO: 813282 - RNA, 22 nt, Human
ccccagggacugguuucaugga

SEQ ID NO: 813283 - RNA, 22 nt, Human
cuggggugucucgucugccauu

SEQ ID NO: 813284 - RNA, 22 nt, Human
uuccauuuauucuuguccagau

SEQ ID NO: 813285 - RNA, 22 nt, Human
auggcccagaaguuuggaaagg

SEQ ID NO: 813286 - RNA, 22 nt, Human
uccuuuccagccucaccucagc

SEQ ID NO: 813287 - RNA, 22 nt, Human
uucaagaugucuucacaauagu

SEQ ID NO: 813288 - RNA, 22 nt, Human
uggcagaugugguuugagacag

SEQ ID NO: 813289 - RNA, 22 nt, Human
uccuggaggagauccaaucuga

SEQ ID NO: 813290 - RNA, 22 nt, Human
uaugcucugagaccuuugugca

SEQ ID NO: 813291 - RNA, 22 nt, Human
uuuuaauucaaagugaauagug

SEQ ID NO: 813292 - RNA, 22 nt, Human
ucaguguguaguaaauuguagg

SEQ ID NO: 813293 - RNA, 22 nt, Human
uucuucaaaauccagcaugauu

SEQ ID NO: 813294 - RNA, 22 nt, Human
uaguccagguuuccaucuccac

SEQ ID NO: 813295 - RNA, 18 nt, Human
uggcuggcagugggcagc

SEQ ID NO: 813296 - RNA, 20 nt, Human
uauuuugcaauuaugguuca

SEQ ID NO: 813297 - RNA, 22 nt, Human
gaaaggcaguacagcugagccu

SEQ ID NO: 813298 - RNA, 22 nt, Human
cagcaagggauaaacaaggacg

SEQ ID NO: 813299 - RNA, 22 nt, Human
aaaggaggaauggagagaugcu

SEQ ID NO: 813300 - RNA, 23 nt, Human
guccucuggagagaaaggcagua

SEQ ID NO: 813301 - RNA, 22 nt, Human
auuucucauuaagaucuuccaa

SEQ ID NO: 813302 - RNA, 22 nt, Human
ccacccagccagaugcaggaag

SEQ ID NO: 813303 - RNA, 22 nt, Human
cagcuguuugggcauggccaga

SEQ ID NO: 813304 - RNA, 22 nt, Human
ucucccacagucucccauggcu

SEQ ID NO: 813305 - RNA, 22 nt, Human
gcacuggaaauaccuagaugaa

SEQ ID NO: 813306 - RNA, 19 nt, Human
ccugggacuuaggcugggu

SEQ ID NO: 813307 - RNA, 22 nt, Human
agggagugguuaagaaggugca

SEQ ID NO: 813308 - RNA, 22 nt, Human
acaggcucucagccaguuggca

SEQ ID NO: 813309 - RNA, 22 nt, Human
ccaggcuggagugcaauggugc

SEQ ID NO: 813310 - RNA, 22 nt, Human
aucagagguuauguggagggga

SEQ ID NO: 813311 - RNA, 22 nt, Human
cuucuucaucuguaaaacuugg

SEQ ID NO: 813312 - RNA, 23 nt, Human
agcuggaggcugucuacucccaa

SEQ ID NO: 813313 - RNA, 22 nt, Human
gccuucaguagugucagcugua

SEQ ID NO: 813314 - RNA, 20 nt, Human
uuugcuaugcauaucugacc

SEQ ID NO: 813315 - RNA, 22 nt, Human
ugcagaggugaaagacuagcaa

SEQ ID NO: 813316 - RNA, 22 nt, Human
cugugacaguuucucagaauuu

SEQ ID NO: 813317 - RNA, 22 nt, Human
agcugugguacuugauucacaa

SEQ ID NO: 813318 - RNA, 22 nt, Human
acacauuugggcuccuacauaa

SEQ ID NO: 813319 - RNA, 22 nt, Human
cagucagaggucuucuaaaaca

SEQ ID NO: 813320 - RNA, 22 nt, Human
aggggcaucaguugcacauuuu

SEQ ID NO: 813321 - RNA, 23 nt, Human
gcccaugcuguugggcccgagca

SEQ ID NO: 813322 - RNA, 22 nt, Human
ggcagcugagaucaugcuguug

SEQ ID NO: 813323 - RNA, 22 nt, Human
gcacugggaagaaugagccugu

SEQ ID NO: 813324 - RNA, 22 nt, Human
gaaaaggccuccccauaggaau

SEQ ID NO: 813325 - RNA, 22 nt, Human
aggcaggcucaaugcccagucu

SEQ ID NO: 813326 - RNA, 22 nt, Human
agcuaggaaauugaggcugaga

SEQ ID NO: 813327 - RNA, 22 nt, Human
aaagcagcaaauacuuuugcac

SEQ ID NO: 813328 - RNA, 22 nt, Human
caggacagugcagguccauccu

SEQ ID NO: 813329 - RNA, 22 nt, Human
cagaaacuguggauucauuaaa

SEQ ID NO: 813330 - RNA, 20 nt, Human
auauaauaaauuuugguuac

SEQ ID NO: 813331 - RNA, 22 nt, Human
cuccucccucuuugccacacau

SEQ ID NO: 813332 - RNA, 22 nt, Human
ucagcugcaguuucacaagcac

SEQ ID NO: 813333 - RNA, 22 nt, Human
uuuuaugugugaaaugcugucu

SEQ ID NO: 813334 - RNA, 22 nt, Human
acauuuuucacauuuguagggu

SEQ ID NO: 813335 - RNA, 22 nt, Human
caccugagcacuggggccgccc

SEQ ID NO: 813336 - RNA, 22 nt, Human
acaguguuuaaaauaauaugcu

SEQ ID NO: 813337 - RNA, 22 nt, Human
uuacagagauaaacuguaagug

SEQ ID NO: 813338 - RNA, 20 nt, Human
cauauauaccuagaagugga

SEQ ID NO: 813339 - RNA, 22 nt, Human
guccagagagaucuucugauag

SEQ ID NO: 813340 - RNA, 22 nt, Human
uuacacaaaaauaagauauggc

SEQ ID NO: 813341 - RNA, 22 nt, Human
auucucauuugcuggcuauaug

SEQ ID NO: 813342 - RNA, 22 nt, Human
uauuauugacauuuacuuggug

SEQ ID NO: 813343 - RNA, 22 nt, Human
uggcccagacucugcucuuauc

SEQ ID NO: 813344 - RNA, 22 nt, Human
ucuaaacaguuucacucuuaau

SEQ ID NO: 813345 - RNA, 19 nt, Human
agccagaguggcccagggg

SEQ ID NO: 813346 - RNA, 22 nt, Human
ccacuggcaaccccgccucaua

SEQ ID NO: 813347 - RNA, 22 nt, Human
cagcugaguguuggcauguuca

SEQ ID NO: 813348 - RNA, 22 nt, Human
cacuggcaaauggagagaaugu

SEQ ID NO: 813349 - RNA, 22 nt, Human
uucaacaaguauuuauugagca

SEQ ID NO: 813350 - RNA, 22 nt, Human
acaacacauguguauaugugug

SEQ ID NO: 813351 - RNA, 22 nt, Human
augcauucuagccuggacaaca

SEQ ID NO: 813352 - RNA, 22 nt, Human
uauacacaaggugugcauuugu

SEQ ID NO: 813353 - RNA, 22 nt, Human
aaaucaaggagggauuauauuu

SEQ ID NO: 813354 - RNA, 22 nt, Human
uaacauuacagacaccuugugu

SEQ ID NO: 813355 - RNA, 18 nt, Human
cccggcuaauuuuuggua

SEQ ID NO: 813356 - RNA, 22 nt, Human
caagccuuggaaauccauucug

SEQ ID NO: 813357 - RNA, 22 nt, Human
ugcagggugguuugaagggucu

SEQ ID NO: 813358 - RNA, 22 nt, Human
acaguguacuagguacauguuc

SEQ ID NO: 813359 - RNA, 22 nt, Human
uucaaagugugaccugacaagc

SEQ ID NO: 813360 - RNA, 22 nt, Human
cacagcuugggcucugacaaua

SEQ ID NO: 813361 - RNA, 22 nt, Human
cucucuggcacuucauugcugu

SEQ ID NO: 813362 - RNA, 22 nt, Human
ggguggaagccagagaggucau

SEQ ID NO: 813363 - RNA, 22 nt, Human
uuucacaugcagcagggaagug

SEQ ID NO: 813364 - RNA, 22 nt, Human
uuaacaauagaguuucuucagg

SEQ ID NO: 813365 - RNA, 22 nt, Human
gccaggcugccuuaucucuagc

SEQ ID NO: 813366 - RNA, 21 nt, Human
ugaaugaucugguugccuuuu

SEQ ID NO: 813367 - RNA, 22 nt, Human
uguacuugaacuugacuguaga

SEQ ID NO: 813368 - RNA, 22 nt, Human
ugaggcuugucucagauggggg

SEQ ID NO: 813369 - RNA, 22 nt, Human
uaaagccacgcuggaaaucagg

SEQ ID NO: 813370 - RNA, 22 nt, Human
acacagcaaggucugacuuugg

SEQ ID NO: 813371 - RNA, 22 nt, Human
uuuugguucugggauacagaga

SEQ ID NO: 813372 - RNA, 22 nt, Human
uagcuuuguguccugauuuagc

SEQ ID NO: 813373 - RNA, 22 nt, Human
gcuguauuuaacaacuggcuca

SEQ ID NO: 813374 - RNA, 22 nt, Human
ugcuggggcagaagagccaaga

SEQ ID NO: 813375 - RNA, 17 nt, Human
uguuuucauucauugcu

SEQ ID NO: 813376 - RNA, 22 nt, Human
caguauaagagugaggaagggc

SEQ ID NO: 813377 - RNA, 22 nt, Human
cuggagccacugggucuuguau

SEQ ID NO: 813378 - RNA, 22 nt, Human
acauuuugcccuuauuugcuga

SEQ ID NO: 813379 - RNA, 22 nt, Human
ccucuuccacugggccccaucc

SEQ ID NO: 813380 - RNA, 22 nt, Human
gcaggcuugggacgagcuggag

SEQ ID NO: 813381 - RNA, 22 nt, Human
auggcagcauaguggcaaguua

SEQ ID NO: 813382 - RNA, 22 nt, Human
guuagaaacacauucuuauuga

SEQ ID NO: 813383 - RNA, 22 nt, Human
gccaggguucaagcuauucucc

SEQ ID NO: 813384 - RNA, 22 nt, Human
aaaaucucauuaucaggaaggg

SEQ ID NO: 813385 - RNA, 22 nt, Human
ugcuuucagcugguaaagaaac

SEQ ID NO: 813386 - RNA, 22 nt, Human
guccccucauuuuagagaaaga

SEQ ID NO: 813387 - RNA, 22 nt, Human
uucuuuggcuuacgucuggccu

SEQ ID NO: 813388 - RNA, 22 nt, Human
ggccaggcuggucucagacuuc

SEQ ID NO: 813389 - RNA, 22 nt, Human
aaacuguaagagaauaaacuac

SEQ ID NO: 813390 - RNA, 22 nt, Human
gcuccuggccagcacagggccc

SEQ ID NO: 813391 - RNA, 20 nt, Human
ccucucugcccugcaaggcc

SEQ ID NO: 813392 - RNA, 23 nt, Human
ugucugucauggaauuucaaggu

SEQ ID NO: 813393 - RNA, 22 nt, Human
aucacuaugggcauuauauuua

SEQ ID NO: 813394 - RNA, 22 nt, Human
uucagugugcuucaggacguua

SEQ ID NO: 813395 - RNA, 22 nt, Human
agcccuggcucccagcagcgcu

SEQ ID NO: 813396 - RNA, 22 nt, Human
uagaaacacagaucugguguca

SEQ ID NO: 813397 - RNA, 22 nt, Human
agugcauucuccaucaucuagg

SEQ ID NO: 813398 - RNA, 22 nt, Human
cagcuuugauucuuucugccau

SEQ ID NO: 813399 - RNA, 22 nt, Human
ugcuggcuuuuccuucaggcag

SEQ ID NO: 813400 - RNA, 22 nt, Human
cauucuugaaccaggcacugug

SEQ ID NO: 813401 - RNA, 22 nt, Human
gaggcuggucagcccuaagauc

SEQ ID NO: 813402 - RNA, 22 nt, Human
aaagugcaccugcuucuucuug

SEQ ID NO: 813403 - RNA, 22 nt, Human
cauacauuuauacacaucuaug

SEQ ID NO: 813404 - RNA, 22 nt, Human
cugucuuuucuucucauugaug

SEQ ID NO: 813405 - RNA, 22 nt, Human
gcugccugggcaggaggcgcug

SEQ ID NO: 813406 - RNA, 18 nt, Human
uaagagcagacuguaggc

SEQ ID NO: 813407 - RNA, 22 nt, Human
uggcccuguccucauuucaucu

SEQ ID NO: 813408 - RNA, 22 nt, Human
aagcuuugauaauuggauuacu

SEQ ID NO: 813409 - RNA, 22 nt, Human
uggcuggauaucaggcaagggg

SEQ ID NO: 813410 - RNA, 22 nt, Human
uuacgaauguuagauugcaucu

SEQ ID NO: 813411 - RNA, 22 nt, Human
uucacaauuucccuucaucagg

SEQ ID NO: 813412 - RNA, 22 nt, Human
uggggaaaggagagcauuauuu

SEQ ID NO: 813413 - RNA, 21 nt, Human
auuuucauuuccaggggagga

SEQ ID NO: 813414 - RNA, 22 nt, Human
agguaaugcauauaaagugcuu

SEQ ID NO: 813415 - RNA, 22 nt, Human
cccaggguccggauaacccugg

SEQ ID NO: 813416 - RNA, 22 nt, Human
augcuauacauaugacaucaca

SEQ ID NO: 813417 - RNA, 22 nt, Human
uggaagagggagcuggguggcc

SEQ ID NO: 813418 - RNA, 22 nt, Human
ucaggacagagaucagaacuuc

SEQ ID NO: 813419 - RNA, 22 nt, Human
auaccuaugugacaguauuauu

SEQ ID NO: 813420 - RNA, 22 nt, Human
uuucauguuuauggaaaaugag

SEQ ID NO: 813421 - RNA, 22 nt, Human
gucauuuuugacuuugaaguga

SEQ ID NO: 813422 - RNA, 22 nt, Human
caggugccucaggaugagacaa

SEQ ID NO: 813423 - RNA, 22 nt, Human
uucuggcuuugaccaaguucaa

SEQ ID NO: 813424 - RNA, 22 nt, Human
cccagccucuguuugcuccucu

SEQ ID NO: 813425 - RNA, 22 nt, Human
acacuuuaucaauauucaaaaa

SEQ ID NO: 813426 - RNA, 22 nt, Human
gagaaacugaauauuuaacggg

SEQ ID NO: 813427 - RNA, 22 nt, Human
uaauuagaguuugguaaacaau

SEQ ID NO: 813428 - RNA, 22 nt, Human
gcaggugguccccguggagugg

SEQ ID NO: 813429 - RNA, 22 nt, Human
uauuaugcaaauauuccuaccu

SEQ ID NO: 813430 - RNA, 22 nt, Human
uuucugcaugcauuuaauuaaa

SEQ ID NO: 813431 - RNA, 18 nt, Human
uggacaggguggagaaaa

SEQ ID NO: 813432 - RNA, 22 nt, Human
ucuggcaucacucgcaagagca

SEQ ID NO: 813433 - RNA, 22 nt, Human
gcuggcauuacaggagagaacc

SEQ ID NO: 813434 - RNA, 22 nt, Human
gaggaggcugaacaaugcccug

SEQ ID NO: 813435 - RNA, 22 nt, Human
guggcccucugauagggucagg

SEQ ID NO: 813436 - RNA, 23 nt, Human
cauggggagcagugcuccugacc

SEQ ID NO: 813437 - RNA, 22 nt, Human
aguggcagagugcacucaggca

SEQ ID NO: 813438 - RNA, 22 nt, Human
ccugcuucagggaugauggcac

SEQ ID NO: 813439 - RNA, 19 nt, Human
cuggaaugagaacaugccc

SEQ ID NO: 813440 - RNA, 22 nt, Human
uggaaggaagccaaggaagguu

SEQ ID NO: 813441 - RNA, 22 nt, Human
cauucaaacauuaauuuauuca

SEQ ID NO: 813442 - RNA, 22 nt, Human
guuucucuuaacacauaaagua

SEQ ID NO: 813443 - RNA, 22 nt, Human
aauaucuggagaugcuuuuugu

SEQ ID NO: 813444 - RNA, 23 nt, Human
ccuggcugaccugaagguguagu

SEQ ID NO: 813445 - RNA, 22 nt, Human
gagggccagcagccucagcaug

SEQ ID NO: 813446 - RNA, 22 nt, Human
aaaaagacuagucgagugcagu

SEQ ID NO: 813447 - RNA, 22 nt, Human
cauggggagacaccuagggaaa

SEQ ID NO: 813448 - RNA, 22 nt, Human
uaccaggcagcugcacagaggc

SEQ ID NO: 813449 - RNA, 22 nt, Human
agcugcccuguggggaggguug

SEQ ID NO: 813450 - RNA, 22 nt, Human
cauacagagaaggauaauaaag

SEQ ID NO: 813451 - RNA, 22 nt, Human
ugaggccagggauuccaucauu

SEQ ID NO: 813452 - RNA, 22 nt, Human
uugucugagaaagugaguugcu

SEQ ID NO: 813453 - RNA, 22 nt, Human
aucaguguauucauagggaaua

SEQ ID NO: 813454 - RNA, 21 nt, Human
aggcaugagcccugcauggac

SEQ ID NO: 813455 - RNA, 22 nt, Human
caggccagcuuccugacauccu

SEQ ID NO: 813456 - RNA, 22 nt, Human
uauaagucuggcauauguaugc

SEQ ID NO: 813457 - RNA, 22 nt, Human
gaggcuguuagggccugaggua

SEQ ID NO: 813458 - RNA, 23 nt, Human
ucagaaggugccacugacgcuuu

SEQ ID NO: 813459 - RNA, 22 nt, Human
uugaaauguaguccugccuuca

SEQ ID NO: 813460 - RNA, 22 nt, Human
agccuggccaggccugcccagg

SEQ ID NO: 813461 - RNA, 22 nt, Human
augucuuugccauaguucauau

SEQ ID NO: 813462 - RNA, 22 nt, Human
acaggcucuggggcaggauggc

SEQ ID NO: 813463 - RNA, 22 nt, Human
agaaaucugacugcugugcaca

SEQ ID NO: 813464 - RNA, 22 nt, Human
ugggaggaucgcuugagcccag

SEQ ID NO: 813465 - RNA, 22 nt, Human
uucaguguuacucaaggggcag

SEQ ID NO: 813466 - RNA, 22 nt, Human
guuacauuuauuagaggucucu

SEQ ID NO: 813467 - RNA, 22 nt, Human
auuauauaggacuugcccuucc

SEQ ID NO: 813468 - RNA, 22 nt, Human
uguguuucagaaccuucuuuca

SEQ ID NO: 813469 - RNA, 22 nt, Human
ccagggcugagcugugaccaug

SEQ ID NO: 813470 - RNA, 22 nt, Human
cuggcacagccacugcaggcag

SEQ ID NO: 813471 - RNA, 22 nt, Human
gagggggcucugccaaccuguc

SEQ ID NO: 813472 - RNA, 22 nt, Human
ccaggcuggaguguagucgcau

SEQ ID NO: 813473 - RNA, 22 nt, Human
gauuaaguaacugaacacuuug

SEQ ID NO: 813474 - RNA, 22 nt, Human
acccagagucagacagccaugg

SEQ ID NO: 813475 - RNA, 19 nt, Human
uaugagcugacaaaggccu

SEQ ID NO: 813476 - RNA, 22 nt, Human
ucccugcaguaguggcuaagau

SEQ ID NO: 813477 - RNA, 22 nt, Human
aaauucauauguugaaaugcua

SEQ ID NO: 813478 - RNA, 22 nt, Human
cacugagggcggagcccaggga

SEQ ID NO: 813479 - RNA, 22 nt, Human
ggagcuggcuacagagaacucc

SEQ ID NO: 813480 - RNA, 22 nt, Human
uucuaaagugcaaucugacaga

SEQ ID NO: 813481 - RNA, 22 nt, Human
ggugguguuuggaaggaggugc

SEQ ID NO: 813482 - RNA, 22 nt, Human
ccuccuggaggcucuagggaaa

SEQ ID NO: 813483 - RNA, 22 nt, Human
uggggcauggaugauaagcugg

SEQ ID NO: 813484 - RNA, 22 nt, Human
aggcccauaguagcucugggca

SEQ ID NO: 813485 - RNA, 19 nt, Human
ucaagauggauggcuccca

SEQ ID NO: 813486 - RNA, 22 nt, Human
ggacuggguaggagcccagggc

SEQ ID NO: 813487 - RNA, 22 nt, Human
ucuggaguguguguauucagcu

SEQ ID NO: 813488 - RNA, 22 nt, Human
agcacagauaacauggagugga

SEQ ID NO: 813489 - RNA, 22 nt, Human
guccugggaacuggacagcuaa

SEQ ID NO: 813490 - RNA, 22 nt, Human
cagggcauaagaugaggcugua

SEQ ID NO: 813491 - RNA, 22 nt, Human
ucugcagcuuacuuucacauga

SEQ ID NO: 813492 - RNA, 22 nt, Human
gcaggcugccaccuucugaguu

SEQ ID NO: 813493 - RNA, 20 nt, Human
cuguuugcuaucaugagcug

SEQ ID NO: 813494 - RNA, 22 nt, Human
ggaagaugagaaguggggcucc

SEQ ID NO: 813495 - RNA, 22 nt, Human
uaacaaggcaauuugugauccu

SEQ ID NO: 813496 - RNA, 22 nt, Human
uucugguaugggaaauuucaag

SEQ ID NO: 813497 - RNA, 22 nt, Human
cuguuuuaucucaagaguucaa

SEQ ID NO: 813498 - RNA, 22 nt, Human
uugauaaaaugaugaaaucacu

SEQ ID NO: 813499 - RNA, 22 nt, Human
uaguggagaaguggagucugug

SEQ ID NO: 813500 - RNA, 23 nt, Human
acaggaggggacagguggccgug

SEQ ID NO: 813501 - RNA, 22 nt, Human
caaggaaaagaaguauuucaga

SEQ ID NO: 813502 - RNA, 22 nt, Human
uccuggugguuugaaaacugaa

SEQ ID NO: 813503 - RNA, 22 nt, Human
aacaaauguaaaaugcagaugc

SEQ ID NO: 813504 - RNA, 22 nt, Human
uugaucuugugauaguucaacu

SEQ ID NO: 813505 - RNA, 22 nt, Human
cuggggcugugggagacaaggc

SEQ ID NO: 813506 - RNA, 22 nt, Human
accaggagccacaggaggagcc

SEQ ID NO: 813507 - RNA, 22 nt, Human
cacagguaauagccuaggcuau

SEQ ID NO: 813508 - RNA, 22 nt, Human
gcuccugggcccugggcuaacu

SEQ ID NO: 813509 - RNA, 22 nt, Human
uaagacagggucuauucuuagu

SEQ ID NO: 813510 - RNA, 22 nt, Human
uaggacaguuauggguuuuauu

SEQ ID NO: 813511 - RNA, 16 nt, Human
gggggugagagagagu

SEQ ID NO: 813512 - RNA, 22 nt, Human
caaauuacccucaacaucuaga

SEQ ID NO: 813513 - RNA, 22 nt, Human
guguuuccucuagaagccaugg

SEQ ID NO: 813514 - RNA, 22 nt, Human
cacauuuuuacugccaacuuaa

SEQ ID NO: 813515 - RNA, 17 nt, Human
aaggcacagggcacugg

SEQ ID NO: 813516 - RNA, 18 nt, Human
ggcuucccuacucacuuc

SEQ ID NO: 813517 - RNA, 22 nt, Human
ggcuuccccuccagugcucugu

SEQ ID NO: 813518 - RNA, 22 nt, Human
aaggcuggaguacagugcagug

SEQ ID NO: 813519 - RNA, 19 nt, Human
aaaccuguuaguagagcac

SEQ ID NO: 813520 - RNA, 22 nt, Human
acagucugcagggugaacaugu

SEQ ID NO: 813521 - RNA, 22 nt, Human
ugaaggcacguggguggauacu

SEQ ID NO: 813522 - RNA, 22 nt, Human
cccucgcucuaggcagcccugu

SEQ ID NO: 813523 - RNA, 22 nt, Human
uuuuaucauuacccagcugaaa

SEQ ID NO: 813524 - RNA, 22 nt, Human
aucccuggacggcgccucccca

SEQ ID NO: 813525 - RNA, 22 nt, Human
uuuggagauagggccuagcaau

SEQ ID NO: 813526 - RNA, 22 nt, Human
acauuaaauuucauagugauua

SEQ ID NO: 813527 - RNA, 22 nt, Human
uacaguaaaugugguagaaacu

SEQ ID NO: 813528 - RNA, 22 nt, Human
gcugcaaguuaguauacauucu

SEQ ID NO: 813529 - RNA, 22 nt, Human
ucuggaguggcagucaucugaa

SEQ ID NO: 813530 - RNA, 18 nt, Human
ggacaggagacaugggug

SEQ ID NO: 813531 - RNA, 22 nt, Human
caucaucuugaaugacugugau

SEQ ID NO: 813532 - RNA, 22 nt, Human
gcaaaaguacagccggauuucu

SEQ ID NO: 813533 - RNA, 22 nt, Human
ucauuucagccauuuuuaaaug

SEQ ID NO: 813534 - RNA, 22 nt, Human
auguuauucaauuugaauccaa

SEQ ID NO: 813535 - RNA, 21 nt, Human
ugcacuuugggggacaggcug

SEQ ID NO: 813536 - RNA, 22 nt, Human
uagcaaauguguuaugcuaugc

SEQ ID NO: 813537 - RNA, 23 nt, Human
uccagugugugcagauuaagugc

SEQ ID NO: 813538 - RNA, 22 nt, Human
uugacaaagauauauucaugcu

SEQ ID NO: 813539 - RNA, 21 nt, Human
agccuggcccagggggaggcu

SEQ ID NO: 813540 - RNA, 22 nt, Human
caucuucacauauuuccaauga

SEQ ID NO: 813541 - RNA, 22 nt, Human
uaaagucacagagcaggugcaa

SEQ ID NO: 813542 - RNA, 22 nt, Human
ugcucugcacaucccucacaaa

SEQ ID NO: 813543 - RNA, 22 nt, Human
aggagagaauguuccaggcuug

SEQ ID NO: 813544 - RNA, 22 nt, Human
aaagcugggggcccuggucuag

SEQ ID NO: 813545 - RNA, 22 nt, Human
ggcuguggucugggugcucccc

SEQ ID NO: 813546 - RNA, 22 nt, Human
uuuguaaagucuguucugaguu

SEQ ID NO: 813547 - RNA, 22 nt, Human
gucuacaaagcauauaaaagag

SEQ ID NO: 813548 - RNA, 22 nt, Human
uaaauaaguucuucauuguuug

SEQ ID NO: 813549 - RNA, 22 nt, Human
cagcuggguuuaguggggugug

SEQ ID NO: 813550 - RNA, 22 nt, Human
aaacugcaaugacagguaggag

SEQ ID NO: 813551 - RNA, 22 nt, Human
uagaaaagaauuuuauuugaua

SEQ ID NO: 813552 - RNA, 22 nt, Human
ggagcugggaacuauguaguau

SEQ ID NO: 813553 - RNA, 22 nt, Human
cuuuaugugcugggcauuaagg

SEQ ID NO: 813554 - RNA, 22 nt, Human
ugacaggacagagaaaugaccu

SEQ ID NO: 813555 - RNA, 22 nt, Human
gggggugguucuaaguccuaua

SEQ ID NO: 813556 - RNA, 22 nt, Human
acaguaaaacauuuuuauuagg

SEQ ID NO: 813557 - RNA, 22 nt, Human
gaaaggugccccauaggcagga

SEQ ID NO: 813558 - RNA, 22 nt, Human
gagcucuuccuuucaggaggcc

SEQ ID NO: 813559 - RNA, 22 nt, Human
agaagccagcuucagcugcccg

SEQ ID NO: 813560 - RNA, 22 nt, Human
ggggaggaccuuuccaaggcuu

SEQ ID NO: 813561 - RNA, 23 nt, Human
gcagcugguuagaagggaaggag

SEQ ID NO: 813562 - RNA, 22 nt, Human
gacagaggagaagaugcugugg

SEQ ID NO: 813563 - RNA, 22 nt, Human
uuacaauugagucuauuguaug

SEQ ID NO: 813564 - RNA, 22 nt, Human
uuagaaguucaggucuguaauc

SEQ ID NO: 813565 - RNA, 22 nt, Human
cccuguuuauuuuuggagagaa

SEQ ID NO: 813566 - RNA, 22 nt, Human
cugcagcuuaaaggaguucaau

SEQ ID NO: 813567 - RNA, 22 nt, Human
gccucuggucccucaugcugug

SEQ ID NO: 813568 - RNA, 22 nt, Human
uaucacauaguguuuaguaaau

SEQ ID NO: 813569 - RNA, 22 nt, Human
caugcaguuucucuaugcguag

SEQ ID NO: 813570 - RNA, 22 nt, Human
agccagggcucuccuucgcgug

SEQ ID NO: 813571 - RNA, 22 nt, Human
ccagggcacguugggacaguac

SEQ ID NO: 813572 - RNA, 22 nt, Human
cagcuaguacaaugggagagca

SEQ ID NO: 813573 - RNA, 21 nt, Human
ucugagcugaguccucuaggu

SEQ ID NO: 813574 - RNA, 22 nt, Human
agugaccaaucacugaaugauu

SEQ ID NO: 813575 - RNA, 21 nt, Human
acuggcugguggcuaagaauc

SEQ ID NO: 813576 - RNA, 22 nt, Human
ugcuggagaaaguuuuucugaa

SEQ ID NO: 813577 - RNA, 22 nt, Human
uuuggucaggguaggacaguug

SEQ ID NO: 813578 - RNA, 22 nt, Human
ccccacuugcucagcaugucca

SEQ ID NO: 813579 - RNA, 22 nt, Human
uuacacaaaguuagcucuugca

SEQ ID NO: 813580 - RNA, 22 nt, Human
uggaugaaaaaugagaauuuuc

SEQ ID NO: 813581 - RNA, 21 nt, Human
aggugccaaggagaagcaggc

SEQ ID NO: 813582 - RNA, 20 nt, Human
cuguuaaaagguaugaauuc

SEQ ID NO: 813583 - RNA, 23 nt, Human
ugcuggagacaagugugagaagg

SEQ ID NO: 813584 - RNA, 22 nt, Human
aagacagagggaagcaaugaug

SEQ ID NO: 813585 - RNA, 22 nt, Human
uacaagaaggaaaacuagcaau

SEQ ID NO: 813586 - RNA, 23 nt, Human
cccagggacacgaugacaccucc

SEQ ID NO: 813587 - RNA, 22 nt, Human
ugacuccugguauggaugacag

SEQ ID NO: 813588 - RNA, 23 nt, Human
uuacaaguucugaaauuuccuuc

SEQ ID NO: 813589 - RNA, 22 nt, Human
gcauuuuaauaagauucauagg

SEQ ID NO: 813590 - RNA, 22 nt, Human
uaaaaaucuuaugaauggcaag

SEQ ID NO: 813591 - RNA, 22 nt, Human
uggcagggagccaccggucaug

SEQ ID NO: 813592 - RNA, 22 nt, Human
uuguucauaaagacaguucaga

SEQ ID NO: 813593 - RNA, 20 nt, Human
ugcugagguugacaugccca

SEQ ID NO: 813594 - RNA, 23 nt, Human
ucucagugcacgcaccaugccug

SEQ ID NO: 813595 - RNA, 20 nt, Human
cucucucuccauucccaggg

SEQ ID NO: 813596 - RNA, 22 nt, Human
ggaggccuagccagcuccaguu

SEQ ID NO: 813597 - RNA, 22 nt, Human
uucaaacuuaaggagcagcaga

SEQ ID NO: 813598 - RNA, 22 nt, Human
uuguucaucaggugacacauac

SEQ ID NO: 813599 - RNA, 22 nt, Human
ccaggagacuguacugauauuu

SEQ ID NO: 813600 - RNA, 22 nt, Human
gcuuaaaucccaaugcuagacc

SEQ ID NO: 813601 - RNA, 22 nt, Human
uguaauuuucucaaguuucuac

SEQ ID NO: 813602 - RNA, 22 nt, Human
agucaaggcuauuaugugggaa

SEQ ID NO: 813603 - RNA, 22 nt, Human
uccagcagguguuugccaacuu

SEQ ID NO: 813604 - RNA, 22 nt, Human
ugcugguggagaaaguggaggu

SEQ ID NO: 813605 - RNA, 22 nt, Human
ugggccaguccugccuaaggug

SEQ ID NO: 813606 - RNA, 22 nt, Human
uuuucauuguaaaucaggaaac

SEQ ID NO: 813607 - RNA, 22 nt, Human
ugccucaguuucaucugcagaa

SEQ ID NO: 813608 - RNA, 22 nt, Human
gccauauacccacugucuccau

SEQ ID NO: 813609 - RNA, 22 nt, Human
auuuuuuagccaagacucugca

SEQ ID NO: 813610 - RNA, 22 nt, Human
cagggcucugccuugagggaug

SEQ ID NO: 813611 - RNA, 22 nt, Human
aucaugaaucuuguguucuaug

SEQ ID NO: 813612 - RNA, 22 nt, Human
ucuugggaaauaaacagauuga

SEQ ID NO: 813613 - RNA, 22 nt, Human
uggagagguugaauaacuuguc

SEQ ID NO: 813614 - RNA, 22 nt, Human
ugcaggcugcaccccugcccug

SEQ ID NO: 813615 - RNA, 22 nt, Human
gucugaagccagugguaguccg

SEQ ID NO: 813616 - RNA, 23 nt, Human
uuugcaaauuuuccugacuacuc

SEQ ID NO: 813617 - RNA, 20 nt, Human
cacugaggugcagcucaugc

SEQ ID NO: 813618 - RNA, 22 nt, Human
uccagcucugauucucacuagc

SEQ ID NO: 813619 - RNA, 22 nt, Human
aaugccaauauucauuuguguu

SEQ ID NO: 813620 - RNA, 22 nt, Human
aagaacuuuuggcaaguguuau

SEQ ID NO: 813621 - RNA, 22 nt, Human
cugccugugccaccgccucauu

SEQ ID NO: 813622 - RNA, 22 nt, Human
acauuaccuggcauuugaucuu

SEQ ID NO: 813623 - RNA, 23 nt, Human
gggaccagcuagggcugugaccu

SEQ ID NO: 813624 - RNA, 22 nt, Human
aagaggcgccggguacguggcg
